United States Patent 12,329,181 (MICROBIAL FEED SUPPLEMENT COMPOSITION AND METHOD) - sequence listing, part 4

SEQ ID NO: 337 - DNA, 156943 bp, Lactobacillus casei
ttaccccagaagaatactggaataaggccatctaaaagctaccaaaattttatattatttcatctgtcaacttgacagggccgaccgcagtgaatcgatccacttttatattgtgcaacctcattttttcgaagtgtccggcaaagccgtctttttgttcgtgatatcaataaactgcgcctcgccgacgacagaatcaacggctttttgaagccgccgcattgctgcactggcgattggtaagtcgacaaaatccttggtcgcattgtccagctcgacttcatcagctacggaatctttaagcggccgtgggttgctttcgtctaaagcgcgaatgacgactggcttaagtggccccatttgtaataagtccaaggtcgtggcgtagtcaatgccatacgcatcggcaagatccagcgtttcgcgaatccctgcttctgccgccatgatcgcgacattcgtgatcagtttaagcttggcaccattgccttgttcgccaacatatttaacggtgccgaatgttttcaagaccggaagcaccgcgtcaaccgcttgcttgtctccagccgcgatcagtaccaagccggcttcacgagcatatttcacgccgccaatcattggcacgtcaagaagtttggtgtttgccggcatgaccgactgaatggccgtaatcttacgcggatccaacgtggacgtcacgataagtgtgctgccgggctgcagataatgaacaattccgggctgctcaggggtaccgatatgcaacgctggcacatcatcggacatgaccgacgtgatcacgactttcgacgcggttaccgcgtcttccaacgattttgccgccgtcacgtgctctcccgtcaaagctgccattttggttggcactttatcccagatcaccacgtcataaccggcttttgccagatgcggtaccatgtgactccccatatcgccaacaccaataaatgttattttcatgtttcttcttccttcccattacaaaagcatgccgtactgaaaacggcatataaaaaacacggtcgtttctgactaactcggacgtcaaaaaggcttttgtcgactgatcatgattaaaatcaccatcaatccgcgcgtacgtcttaacctagcatgatcacaaaatgatttcaataacaaagctcgcggtgttcctgacgctcatctccgaacgcgcctgttattgatgcacccaaaagtcattccggcgccgtccctgcaacgcgtgtcaagctgaccgtcaagacattatcggcagtcgtgttgtaatcagccagaatacccttcacaatccctttagaagggccatgagttcgcgtggtctcctcgtaatttcgaatccacgtgctgacagcatcaaagccaaactcaaagccttcaaaaacctgcatgtacgccgaggaacgcggattggtggtcacaatcgtaatcttggtcacgcgtccgttggcgatctgcatcgtcagcttaatcaagccatcatcaaaaaacttaacggttccatctttagccgttgccggcaaccgataatcagccagacgcatattggcattgtaaacacgctgaacatatgcataactacccagatcttcgtgcattttctcacggcctttctgtcatcgcgtcaccccagccttcgcattggagtggccgttttgcgttacctatagtgtacaatttaatgacaaaaagaagaatcaaacagctcggccagccggatactgtcaaaaatgttgtcttaatccactttgaacttccgggcacaaaaggcagatgttgcgttttttcatgataaaaagattcgtcaatcctaacgattaatcgaccttgccatgcgttggatcgtatgccgttccccgcgaatggccttgctgacggcgtacaggttgtcaactggcgactcaaacccccacgcggaatcaccaacatgttgcatgtccacgccgcagattttattgcgaatagccatctcctgaagcacacggctaccgctgccttcctgactcgtcccaatcgcactcatgaccaaaccgccagcgcgatgaaccacttgcacctccgccttcaaagcagcctcatcaaatcccggaatcgatccaacggccggcgccaaaataacatcagcacctgcatcgataaatcttttcgcggtttcttcactcatcagcggttcatcgacgcccgaggcatgcatttttccggcaatgattaagccgctgaagtacgttttggccagggcaatactgtgggcgatctccgcattcgtgacgccggtgcccggattgcccgtcaagaccataaactggaagcccatctcctcggccttcttgataaccgcctcactggccgtacaaccgggcaaaatggaaatttgattctccatcatatttggatggtcaccaatcggctcaacgttgatgccaattggccgcccaaccagcttctgcagccgcgcaatgctcgccttaccatcatgcttaggcgcgctatacaaatcgcgttcaccgggataaagtccgaagattttcggattgtacacatcgagccgattacacagaatcatatccgccccaaacgccgcagcgatctcggcagtggtaatactatccaaattctcctgcgtcacaatattttcgctaacaataatacgcccttcactcgctttaatactttccttaagctcctgtccgttaaattgcatcacttcactggtactggcactcaaaagtcgtttaaccatttttcaataacctcctgtttaatgactccaaattgacgtgaatgttcttcttactaagcattatacttcggcggcagcttcgatttcgtcttcatcaaacatcgattcgtcaatcccccagaaccaattcaggacaaacgaaacagcagttgtcagtaacaaccccacgacagccagcacaaaattattgccgcctgcaggattaatgaattgcggcaggctgagaattgagactgtcacgagtgagaagactttgacttggcacaggctgaagaataacccgcccacacctgaggcaatggtggaagggataatgggttttttcatttttaacatcaacccatatactgcgggttccgtgatacccgacgcggcaattgaaaatgccgccgttgcggagaaagtttttacgctacgttttttgccttttaccaaaatcgccaacgccatgccgagttcagcaaaattccaaaccgcaaaggccacccaaaggaacggatcgtagcccagttgcttgaggttagcaatggcaacgggaaaaaacacccagtgactacccgtaataatgaaaaagccaattaacagactcaacaaggtaatgccgacaaccggcgcttgatcataaatccaaagtgagccattggcgatgacactagcaacaccctgtccaattggcccggtcaccaacaacgttaacggtgccatgatcaaaaataccggaaacatcttcaacaatccgaacttgttcatccaaggacgatcaaccactttttccaacaatgattgaacccacaccgtgactaggatcggaattaaactggttgaataatccaccgcggcaaccggaataccaaacaaatgaatggcactgcccgcgctgaccattttcacaaaatcaggttgcatcataatcccagccagcatgaggcttagaatcgtatttgttttaaagtagcgggaagcaccgtaggcaactaggaaaggcaggaagtaaaacagcgaatttcccatcaaatagagaagccgatacgtctggctaccttgtgccacgatatgactgaccgttaataaattaagcagtgccaaaaataaccctgccatggcgagcccgccaatcacgggagttagtgaattcgaaatagcatcaagaacgccattcaataaacgcttgagtgtgaaaggcttgcggttcttatcgaccacttcgaccgaacgaacagccgatccagcttcagagacacgacttccaccaatgaactcagcattaatatactcaaacactttatctaagtatcccggcatgacaatctgcaccttgccctcagaggcgaacgccttcaccaccccctcgatttcattgagcttatctaactcgactttggcatcatctttgattctgatccgcaaccgcgtgtaacaacgcgcaacactcccaacattggtgagtctgccaacatttgcaataatttcattgccaatccgttcatgtttttccattcttatcctcctaaagactggtataaaaaaacacccaggaaaggtaaaggaatcgggtaaaaccaattccaatacatcttcagggtgttgccaacttaatgtcacaagccactattcgatgatatgaataatgtgaattaaaagaaatagctggttcgaatcattaaaccgataaccaactttgtccgcaataaacgcaacaattttgcccaaacttttaccggcataagggtactgctttttcaattgacgcaaaagtatcgtgtcagaactctcactagagtcgttatacttaccttcctgggttcgcaataagagatagtaaaggtgcgtcgccattcttgataccgctaaactgctctcggaaaattttgctccatagtcttccccgagaatttcgttgacgccagaaagaatcgccatcgcttccgcaaccgtctgaactggaccattcgtttctaccaactcatgctcaatcagatgcatcgcaataaaacctgcttcgtcatctgaaaaagcaacctgactatgcgactggatcatatccacagcttcctgcccgacctgaaactccttttgaaaaaggcgctggacatcgaatagcattggattactcaccaccatgccacttttggcccgctgaactgcaaaatagatatggtctgttaatggaaccagcaaatgaccatcaaacgaaacattcagtcgactctgtgcaagatcgataatgctatccgttagttcaaaatacgactgcggtatctcgttggccaactctttaaacgtatctacccattggacatcccggggcggtacagcgcggaaaatatgatcgtcttcagtcggaaaatatgactcgcctcgcttaagccgaaaccctattcccttcccccaaacaatctgctgcttgtcatgaccatccgctacaagcaaaacgttgttgtttaaaacctgcaagattttcaaattagacacctaacaactggcacaattgtaagtaagcgcttacttattttcccactttaaatgagcaattcttatttgtcaatatattgatagtaagataacagatagcgacgagcttaaaccagcgttaataatgggttacactttaacgatagaagcaattatgtgcgctttatattctttgttaaaacaattaccatcgttcgaaaaatattaattttaatctcatcgccacaatttataaaaataagcgctagttcagtacagtgtgcatttaatcctcgccagcttttttgcaacttatgctaaaattttcaccataagtggcgcgcccttcttttagaattttattgacctaacaagtccaacactaccgatggatcaggtttttttgcgggtcaaccaagctttcgataacaacttatatataacgcatcgtcagcgtaactattccagttccttgcgaccttttcccttttctatatccttttgtttctcgcgatttgtgagcaacaccttcatttgttcccgcaccatttaacaaactaacttcaacacctttaggctgaatcacagctctctttcgtggcatctattcactcctccatttttaaactggtcgaaatcgaccagtttagaacccgaacattgatttttgatcatcttgagactcatgcagattttcttactttataaacttctttctaccccaaaaaaaaaaaaaattgggcttgcttgaatattcgtgccggtaaatgatctaacatttagcaagtatccaagcatttgttcaaggcttacgaaagcccttccaacctcgaatgtaaagaaaaaccgcgacccacaagcgtttatctgtgcttgtgaatcgcggttaaaatcctaaaatgggtggtcaggggatcgaaccctggacccacggattaagagtccgttgctctgccagctgagctaaccacccattgacttatgtctgtcgcgcttcacgacttaaatataatatcacgtacctcttactggcgcaagtgttttgagaattttttttgagagttaattcagcctaatattttgaagcgttacaatgccaaaatgttttcaagaatgcatcactacctgcttcttctatgaataccgccatgaaggagtttgcttagaatcgctgactgttcagtcttaaaactaacagctttttagaatgaactgaggtactaagacccgccttaatctttccacgcaaactcattcgccttcctgaaccttttaaaaaaagcggtgcaatccattccccaaaaatgaattgcaccacttgataaattcgatcttcgcaaatcagcaactacaaaaccaggtcagatcgcatccaaaacgcttcatccaaacttccccaaaaagttgaacggagcctttgcgagacactagtttcaagagatgccattcgcttcttcagtcgctttactaatccagccatccccttatagccaacccaataatctaagcatactgggtaaagggtgttcggagaagcattcttgcatatctgcctattttttatacatcaatcaaattttcacacacaaaaccgtcgactaatgagaaaacttacgcacaaaactatcgaggaagtttgtcggcaattcgtcgtgccacaatacttttaatttatcgatcgcatcagggtgcccgacgcgtaatgactggtcaacgtaatgcatgaccgcttcttcactaacagacgacggcgctgtcacatatcttccaattaaccaagaacccatcgcctgccaacgcatggggctcggattcccaattgtcagcaaccacttgaactcacttagaaacgaacacccaacatcatgcggttgctcagttactacctgcaaaatggctcgattcagaccatcgaagatataattgacccccactgttgtccatggatgtttgccgatcacacgtctggctttttggaacaacatcacaagttgtgccggctgcagccagcgcacaagctcagcggatgcgtgggtttcaagtgacccccactcattcatcgacaacaaatggctaagaataattgacgcttccttctgcatttccacaccggttggcggcgctaagtgagccgcagaacggagaataaactgctgggtatcgaggatgctctttggcaactcaggtaactgtccattaaagcgtgcaatcaccttctccgcttcaatgtcatgcgccgaacccattggaatgttcgcaacttgcttaaatgtcgcccgcaaactgatggacccaggtacacgagaatgcttggcgtccaactgattaggcaatgaaaggacttgtgacggtactaatgccaattcaccacaaagtcgcacccaagtaccaaatgaaagctgtgtttgcccactctcaaaacgccgcaaagccgtgacgctcagaatattcttcaagtcagcacgagtcagaccaagatattcacggcgggtctttaaaatttctcctcccgtcctgctcaagacaattttcttaggacgatccttcaaagccggattatgatgcactgatccagcttgcgtacgtgcaaacattaactcaaaccaacgagcatctgtttcaacgttccgctcacgcaaatctgtgataatctgctgtatcctggcaacattcgcgacggtcggcgcttgtaaccaccgtttaactgccagcccatattgccagttcggataaaactcaattacctgtgctgtgtcatgatactgtttaatgatcggtttcagatcagtctctataactgttgctaaagccatatcccgattcatgagcgctcccagccaaagcatcaacagctgcataaatgatagtgctcgccagtcactttgcacacgcttggctcgctgtcgcaacaacagcaataactcgtgactcgctggtccaacaatagctttatacagctcaaggcccaacaaatcaaatcgctccggcacagccattcgatcagcaatcatctgctcctcttcggcagtcaagcgataatgagcatcaggccaccatttgccagcctcaaataaaatacgagccaaagcagtcatttcattctgatttggatgtgcaagaaaaaatgctttttcgcgctgattgagaatcctgaaatcactcatttgaatcggttcctgcaacgataacggaaaattaattggatccgagtcataaagcgtcaaaagatcatattcatctatcccgaggcgtaccatcagagccagtgccttccccgtgctaatatccaattcaccgcgttcaaatcgcgatatcgtggcctcagacaagttgccactgacatccttcaaggtcaggccacgccccacacggcgattacgaaaatactggcccaatctcttcagcaactgctgatgactgatcgtcttctcgaccatgatttctcccccaataactaactttctcagccagcttatcgaaggaagtaaaacgaagtaaggattcttgcatatatgccccattagcataataaatagcaataatcagcattacatatgcggctgtcttagaaactaagtggttaaaccaaaacaaggcacaggaaatgattttcccgtaccttgtttgcatcaatctatctgtccactggccgttgatattagttcgttaatcagcttttctcatccggcgccgtcaccgacgcttcgttcacatccaaagattgttgtaatttcttcacttctcgcaatccagcatgtatcataacaaaaacggtcacccaagtgatgatggcgaggatgatatagcgaaggatgctaatcgtatcgaatgctgaccaatcccagcacatgtggatcaagatcactaaaccaaaaaagcgcagaaatttataatcccaaaaagtggcgcttcgcaggggttgatttccttttgccaaaactagggctgctgtggcaatcgcacaccattcagtgtggtcagaaattgaagtcgccgttcggaacagtgcagcctccatgctaaccaactggttgctatctgtgatcatgaattgaatattttcaaaagcggcaaacccagttcccactgctgcaccaagcaataatccgttaaacacatgcgaaatgttaagcttacgaacgaagtaggaggcaaccaacactttggaggtttcctcaacaattcctgtaacaagtactccaaataagtcaagcgaagctacgggaaatagcttgtccaagaccaacaccacaatgagcgctaaggcgccacctaagattgcaatcttggtcacctgataaaagctgatatttttaaaaacattagcttcaaaaaacagcaccaatgcagaggcaggaactgcgactgaaagcacaacgtccatcgcaacctggtctcccatcttaccatttaagctattaaccaccgctaaaagtaatccagccgcgagcgtaaataatagtacccgcgaaaatagccacggctgaacttgatcgctcacaacttttgccaaggatggtgtggtttttttcgtgccgacaataaaaatttcttctgcctcctcggtggtgtgtcgttgaaagacctggccaaaaaactgattcaaactaactttgactgcgccttttccgccggtccattcattgagatgcgatgtggcggaatcaatgacaccattagacttatttttcaaactctgcttgacaccatcgccaactgttgcactcccactcacatctgctgtaacagcaagcggttggccacatttaatacagaactttgatgttgcatcattttttgcaccacagtgggtacaaaagataaacgattgcgtttctgtcatattttctcccttacccccatttcttaaatagtctcacggtcggtaaagattgcttttgcagtctactcggtaatgatttcaccgacctatcgagaaagtacccagcctaaaatgccaccgaaaattgccccgccaatggctgagtcagcattcgattgggcttgatcttcatcagcagcctgtttttctttagcatcgtaagcatcttttgctgctcgaaaatcatccgtgtcttgatagcgcattgtctccttggtgcctgtaaactcccataaatcaatcggtgtcttttgatctttcttcattgtcacttctttaatatgccactgaccgatcaccttacctgacagatcatttgcagctttagccatctgcttctcttggttaatcggataagtcgagaagccacctgacataaacgcacctgagatattcgagagttggtcgctacctacctgtatggttaccgttctttttagcgcattaatttgaacggaatagccgcgctctccagtaaatccgttgctcaagacagcttgcttagccatgtttggtgcataaacaaagacatacccgcacaccacaactactaatgcaatcaacacaccaataatgacggaacgatgtgacttctggagtttagctggttttacaattttttctgtctcggccggagcagcagattcttcggctttttggtaaccagccgtctgagctttcaacttagcatttaacggttgaccacagttcgggcagaaatctgcttcttccggcactttcgccccacaattaggacaaaacatgattgctacatctccttctgttttcatgatgcaaccttctgaacgatccagctgccttgggaggtatccaatgctgtatgagattgagtgctgctatcaacatgcgtcaactgccacttattgtcgtcaaccaatgtatattccaaatcaaacgcatcaatttctgtctgtgtttcgccatatgatggcgtcaatccattgactcgtggcatatctggattgacatcggttgttttaactttagcaaaaatggttattcccaaagtcgtcttatcaatatcatttgtgccgtcttttttcactctaaggtacatttgattagacttaccattttgcgtggtatcagcgccttctttgttataatacatttcctcaagttgatacttagttctgatttcgttgttggaattctgtcccctgaacgaatcaagcagttctgaagactggtttggcaacttagatttatcattggtactgatcgcatccaaaagcattggcaaatcggtgaatacctgtttgctaatcgctttatggtcagccttcttcaagtcattaaaatcaagtgagccaatagtatcacccgtattaaaattcgctcctgctggtgctattcctcgcttgaatgatgattcttcatcaagcgtcgcctcccgtgagtttggcccaacttgccattcgttggatttaacgatgccaagccaaggtaatgttccccccagctggaatgatgcgtattcttgcagtttcaccgtgttaaccttattaggatctaagtgcacatcagtatccttaccatttgagtaaacttttaaccaacttggccctttaggcagcccatacgttgctgtatcaccaagcgctttagacgacgccgaagctgctgctttcgatgcctctttcgatgccgactttctttttgctgccttgcttgccgattctgatggcgtcattttagatgacttagaactgcttgtaacggtcgtgttgcctattccatagcaaccggtggcaaatagactaaagctggataaaatgatcgctgtggtaagaagttttttctttttcatttttctctcctgttaagaagcgtggctatttactaagcaccgctttttgccctttaacctgtgattttgtgagaagaaagtcaaatacattactgttaccgctattgtccagaatataaccaatgtattgcgtctgatagatttgctggctgatcgggagctttaacgttaacgcttttgtccaaggaaaatagccaaacattccttttgtcgctgcttcaaagacttgaggcgtgaaaacttttttcacatcttcgggtgttacttgacccttttcaaagtaatcactattaaatctcttagtgacaagactcgccaatgcttgcttatcgggaatggctttatataaccgctcattaaatgaatctgcgttaaagtagtcaatatttttaaaagagaatgtttgtgatataattttattaccggaattatctgtcttttctttatatcgagtaattctttgttcaattggttttcgatacttggttttctcaatgttatttattaaagagtcccctatcattttcttttcagttaaataagtattcccagatttttcgtctgttattaacaagtgcttaacgtcttccgacagaatttctttagaattatctgatttaccctgtccgttttctttctcttttctttgtttttcgaatgaagcttccgagacaatcttgacatcatgaattggagtcttgtcctcttctcctcccaagcaggtgtaatatattgagcctcccccatccacgatctgtcggacataagtaatccaaaaatcgttttgttggccaatttgatcttttttatgcatgtaattccgcacctcatcagcggataccttgaaatattttttatcttgtgcttttgccaaagcgatcgtatcagcatcattcatcttgcttagctttccaagtgtgatgttgttgtcctgaatttgataagcggtcagtttaccatgactcaaaacatagatagcgttaacaatgctgcttttagctggtctataaccaattgctccgtcagcctcagtttttatccaaatataagtaccactacttttagcttcttttacaaatgaaactgttttcgatgtgtttctggtggtactggcgtttgttgaacatcccgtcaaggtcagtgcgaccatgacaatccccactagacaaagagctgctgtttgccaaaaacctacttttctaagatgaaccatttcttatctcctccaaaaaaagattccaactgtcatcgtttggcatgttggaatcctaatctctttcaatgacctaatactgatattgatttattgacgccagatacccttaagttaggcatgtcgaccgcggcgtgctaatccgaagagtcccattattgagacgacggccaatccaaccgcactcaacaaagtttcattgtcgtcacccgtttgtggcatcgtggttgttccgtggcgcaatgccatgcgactgccgactagcggctgcgctggcgtaaagtttgtctgcgattggatcacctttttgctgccagctgctggtgtcgtgatgacgttaccgaacgaatcaaccatcttgccgttgacaaccttccaaccattgaccagatgtcctgcctgatcaacgacggtgtttccgctgatgtgataaccatttgtttgcgcggctttttcagcgtcaagccgatgctgttcgcgagcaactttttcagctaacgtttcggcatcttgagcgctctttaacgttgctttcgctgtggccaactgtgccttggcattgttgaggttcgtgtttgtttgctttagaagcgcctgggcatcagcagtcgcttgcttgtcttcagctaaaacatcttgacactttgccaatgaagcaacggcttgatcatacgcagcctgagttgtcttcaagtttgcctgagcatctgcgagcgcttgctttgctgcggcaagtttggcaggcgcattaaccaagtcagctagtgcatctttagcagctgtaactgcgtccgtcgccttttttaaaccatcctgtgcagttttcagagctgcttcatctttagctaactgcgtctgagtcgtcgtcaacttagccttagcagcggccaaaacgtcattagcggcacttgcggctttgttagcattagtgagcgctgcttgtgcttttgccaatgctgccaacttagctgtccggttctgcaaactggcttcataaactttttgcgcttcagcaagttgcgtttgggcgtctgcgagtgtgctcttggcagccgtcagcgtcttagtcgcagcggccacggttgtagcagcttgagtctgagtcttaagcgcattgttaagttgcgtttgggctgctgtaactgctgctgccgcttgatcgtacgcagcttgtttagcagcttgcgaggtctttgcagatgcaagggctgtttgtgctgtggtgagcgaagcttttgcttgattaagggctgtctcaaggttcttgacgttcgcactggtgttgatggtggcgtcattatctagtgcattccctaatacagcaacatcaatcttgatgcctaacgtatcgtgaacagctggaaaactaacagtgtacgccaatggtctatgagaaataaacttgtagctgaatcccagtaacacctgcatggtccggtcagcctcactacttggagtgacggtaatattgggatcactgctgcctacgcttctttgaagaaagccatgattaattagttcatcttttaacagtgccattgaatactctttttgaggtgctataccacgtgtggtttgagattctatagtaccccacgaaacagtaccatcagcatttttataagccactaatataagaccgaatcccattgatccatcatccaaatcattagacgttacatcgccgatctcctgagtctcacctgatacaacgtcacttttgacaacgctaggcaatccaagttgtgtccgaatagaatttaaaatagcaatgtataagtcaccgaaatgctctctttgtgcatccgacaatgctttaaagacgtcatcatattcttgatttgtaacagcgccgaaccatcgattcgatttattatcaaccaggatttgattccaatcagcgtcagtcggtttatagtcaatggtagttcccaaaataacagcgtctagcatatttgtcaggtctgtcgaattagtatttgttttagctaaatatttctgaacagctgtcttcgcagcatcgtttaccgaaaccgtaatcccttcagccgccagattaacattgctagtgttctgcgcggcatccaaagccctctgcgcagcatcaactttagtttgtgccgcactagcgttattctgcgcggttttgaccgcgtcattggcttgatcaagcactgtcttgttagcggtgagttccttgttggcattgtcgagcgctgtttgtgcagcctcaacagcgctgtctgcttgactcttgtcagtttgtgccttgtcagcattggtttgagctgtctttacactgtcattagctgcgtctgttttggcttgggcctcttcaactgcctttttggccgccgccgtatccaatgctttttgggcatcatctacagttttttgagccttatcgacagctgctttagcggcatcagctttggcctgcgcatcattgaccgtattggtggcgccactcacgtttgactggtcgctggccacggttgtcttagcggtatcaactttggtttgcgctgcagcctgatcggtcgttgctttattaatattgtccttagctttatcaatggcggcaggtgtggcagcatcaacggcagtttgcgctttttggacgtcggttgacgcctgcgagaccgtgttagccgcagaatcatgatttgctttggcactatcaactgctttttgaccgttgccgacgtcttgctgcgcctttttctgggcagcagccgcagcgtcggctttggcctgcgcatcatcctgtgctttctgggctgctgtttcgttcgcagtagcatcgttgacattcgcctgtgcatcttcaaccggtgtcttggttgctgtcgttgtcttgacggttgctactggcccttgcgttttcgtttctggctcggccgttgccgcatgaacctgactcgcaccgacaccggttgtggccaaagcagcggctgctgcggtggttacgattgttattttcgcgttctttttcatggatcgaataccccctcttagattctcctaaatcgtcatcggttgaccccaccaactgatggacaccgttagtgtaaaatggctttttattgggaggaagcgtttttgcatatttgcctcttattttttaaaaatatatttaccagcctgactgagcgctcaagttttgcttctagagcaacgttgtcgttttaagtccaaacttagcggatgacttcacaatcggatataatgaaattgaaatgttttcaaattacctaagctaagatgtttggacaaaaaataacggaggagacttaaaaatgcgggggggggagaaaaacataacgaactaaaaaaattaggtcagtttttccacgatttccgaattgggcgtgagttaaccttagaagaagccgcgggtaattggtcggcacccaccttgtcaagatttgagagtggccgtattgacgtgagcacgcaaaaggctgttgggttaattcatcgaatcggtatggagccccaagactttttgttatttcctgaggcacctggtgacttcccgatgcgcttgcaacctctaatcgaaacaaataacgttgaggccttggctaagcgtaaacaaaacttctttgcagctaataccaaagaaaacagtatgacacgtctggctgctgttctttttgccgcgggaattcactggccagaaagcgactatcgtttttccgtagcagaggaacagatcttggctgaccgtttgacaattcctgagaacttaacgccttttgagtgggaacttcagagtgcattgatcgcgccagccagtcacgaattgctcatgcttctttggcaacgaacagagcgaatgaagcacaacatgcgtaaattttatcgaggaaccatcggcatgaagctttggctcggcgcattaatggatcgggacttcgagtttttgaatgctattcgtgacgatttgaatctggaacttaagcaatacgggcaattgcacgactataccgacacgcaagaggtatggcattttacaaagctattagagcagtgggcacaaaatccaacgcctgaacatgagcaaatgcttcacaaaatgatcgctgcaacagcggatgcgggtgcgtcaagtcaagctaagtacttcgacctggtttttaagcgtactttacagggccacccataccataatgaacgcttggttgatcatgaggtgcctatcgtcgttaaaaagaatcctggcgaagtcattcgtagtcggcgaacttatcttggcttgaaacgatcagatattgcccatgagcgcgacaaatcaacgcttcgccgttttgaaacgggccagacacaactgtcttttggctcgttggttcgattgtgtggacagatggccatcttaccaacaactttactcggcagcatgcatgtcactctgcaaggggcacatcggatcgtcaatctttataacagttgggataatatgacagagattcaagaaaatcatttaccagcaagtgacggtgcgaaaataatcgaaaagctgaagacagcttctcaggatgtcgcgccgcacttgttggcaacccaactttttatccttcaacgcgcaggtatggaggcagggatgtcaggatttgatgagacttctcaacgtgcaacggcacgcgtctgcttccaccgaatgatgaagtccaatcactggggcatgcttgaatacatgacacttcgttatatggtaccgttactttcactggatgaattaacgttaatgtttcgacaggttcagcggatgttacacaagcagccaagattctttggggttagttttgcctttgaagccatgtctatcgcatttgtacgcattacccaacttgcaccaaaagacgaaaacattcaatttttgcacgcatttaactggttactgagccttgattcctcagatgcggcacggtggcaagccatgggcagtctgttaacggccttagatctactacaaccaacaaaggccactcaaactgcgctgaatcaatttttgatgcgatgcaagataacaggacgcgtgaccgtgttagccaagttgaccaaacgctggggtgatttagtgccaaaaaactattttgaacggtgacaaaggtataagaaagcgtttcattaacggactagcagtcagaaaacaatcggcacaaaaaatcggttccagcaagacatatgcgtcttctgaaaccgattttttaacctaacagcaattactgcgcttaaccttttttaaaacaaaacatgaatcgactgattactattaatcaacttaatcgccttgcccagcattggcccgacggaaacttgggcgagtccttcgaattggtgcttggggtcgagctgaatggtgtcggtgatgacgacctttttcaagcctaggtgtttgattcggtcaaccgcgccacgtgagaagacgccgtgggttgcggcggcataaatgtcgagagcgccggcttcgcttaaagccttgtaggagtcaacgatccgatcaccggtatcgatcaggtcatcaatgatgatggcgtgcatgccttcaacgttaccgatgacgccgatatgatcctgatcgcgcttgtccacgatggcgatgggcgtatgtaactcttccgccaacgcccgggcctgtttggtgccgctgtgatctggagcaatgaccacaacattgtcgccgagattcagcttcttgaagtagtctccgatcaaccggtgggccttgagatggtcaaccggaatatcaaagaacccttgaatctggtcggcatgcaattcgactgccacaatgcgatcgacgccatccatttccaacatgttagcgactaatttggcagtgatcggttcccgtgatcgcgcttttcgatcagcacgcgcgtacccataatatgaaatgaccacgttaatatggtgtgcactggcgcggcgcaaagcgtcaaccatgatcatgagctccatgaagttctcattaaccggatcagagactgactggatcacataaacatcagcaccacgaacactttccggcaattcgatctgaatctcaccatcggcaaagtgattaacgctcgcgggcgacagcggtaatccgacttcttccgcaatcttttcagctaatggacgattaccattgagactgaacaactttaattcgtgcatcgatttctcccttgttcatatttaacggtctgcaccgtcattatacgagaaaaaacaagaaattgcgactggttatctaatgagttaaagtgatagcagaacatttgcagattcataagcaaggcttcagccaacgttagctttagcatttgccatgctttgatccaactgcaagacttggaaatggagggctctttatcatgaaacaaagccatttgatcggccttgcaaccccgttgttattgtcagcgggcaccttagcaactgctgagcgtttttatcaatatgcatttcgccgaattaattatattccggacgcacgcagctccatgcaaaaatacgctccgttatattacagtcacgtccattgggttgaaagtcagcgccatatcgaagcctggcacatgaccgccccggacaaccagcgcctcgaagcgctctggttaccacatcccggcagcaaaaaggccgtcattatcggccacgggtacaagggcaccggtatcactatgagtaattttgcccacatgttttacgatctaggcttcaacgttttgttgccggatgatcgcggccatggcgagtcagatggcgaatacatcagttttggctggttggatcgccttgactacctcggctggctgcaacgcattctcgaccgcttaggcaatgacgcgaagttactgctgtttggcaccagcatgggcggcgcaaccgtttcgttagtcgccagcgagcctagcctgcctaagcaagtcaaggccgtgattgaagattgcggctacacggatgtcgaaacagagttagcgtacttgctcaaaaagcagtttcacttgccaccgatgccgttggttccgttggcaagctttatcaattaccggcgactgggatatcccctgcgcgttgtgaatgttcgccaggcattgacgcacaatcatctgccgcttttcgtcattcatggcgctaatgatgtttacgtgccaaccgaaatgggccgtcagaattatgctgcctcagctggccccaaagcgttgtggatcgttcccggcgctgcgcatgcggaaagctactgggtcaatccggcggcgtatcaggcgcacgtcaagcggttcttggatattttcttttagagcccattcaatcaatctgcgcagcaaaaaacgcttggatgccgtaatctcatccaagcgttttttcgtggctattggccagtaattcaccgattcaccgattcgctaaacgttacctaatcaaattcgtcttcctcggcttcatcatgttgcttgctcaggtcatcaaaagcccgcaacattgccaggtttgtttcaatgctttccggccattcccagtgctggacattgaagacgtgcttgaggtgcggcccggcactggcaggccatagcttggtcgtgtaggtgactttattggcgtcgaagacttgcaataaggcctgactttgtaagtaaaagctatcattttggccgccaatgagcatgaatggcggcaaatccaagcccttaaccacctgcgagaaattcaaatggtccgctaatgcctgatcgccgccgctcagcttgtccagataaaacgacgccatctcactcatgtcaccggccgcttccggcagcttacttggctcagccacggggcagaccaaagcaaccatggtaaagttaaaattaacccggctaacaccgaagagttcttgcagctcctcgctttgctgaatgcaggcaactaaggacgctagatggccgcctgccgagtcgccggtcaagaggacatggtcaaggtcaaacccacgctgagggccataatgcgacaaccagcgcagactcgaaaagatgtcttgaatctggccgcgaacatcaacatccggcaatagccgataacccattcccatcacggcgtaaccctgactcgccaagtaacgacaatagttttggttgaggttccgatcgccataaaaccagccgccgccatgcacatcaatcacagttggcaatgtcgcattccgccgtttcgccggataatacagattcagcgtctgctggggatcagccgaattctcatagcgatattccgtctcccagtgaacattttcgggaacccgctcttcggcataccgcgctttgtcccgtgcaccggtttgcgcccagactgcttgaatcttcgccaacattgcatcttcatcagccatacaagattgcctcctatttcttttcgtcaccatcgcattaaaaaggttattcccatattaacgcaaaaaggctgtcagtgacgcacctgacaacctaatcgtttattttcattgtaatttttaacggtccttcgacttaacactggcttcgacttcatcaatcaaagcagcatctttcaagccggtgactgctttaatcacgtcaaccagcggctgatcttttagcattgcctgaagtttaaccgcttcagcatcgtttggttcaacgtaatggaacatcatgccgacagtatccatcaaaatgctgtaatctaaaccgcgttcttttaattcacgaatcggccggatgaagcgttcgttgtaacccaacttgcgaatcggcgtgcgggcaacccgggaaatatcatcggaaatgtagggattctggaaccgttgcagcacccgattttgataagtttcgaggtccttttcgttaaagttcttgaactcggcgagcaacaatgaccgggtctcggccagtgcgccttttgcctgattgaagacttttggatccttgatcgcttcgccaatggtggtgtagcccagatacttgccggtgtaagccgtggtggcgtgaccggtgttgaccgagaagagtttccgttcgatgtaaggttccagatccggaacataatcaacggtcttcagcttcagatccttattcttcatctggctttcgtcaacaacccattctttgaagtcttcgacactgactgccagcggatcgtcatgcttttgctgtggcacaatacggtcaacagccgcattcgggaagccaatatacgtatcggcaaaggttttgccggcgtcatcgagatgttcatacacgctctttttaagcgcctgggacccgccaatcatgttttcacatgcaatcacatctagtggttcgtggttgttggccgcggcacgggcctgcagcccttgcgcaatgagcggcgcaatgattggcagaatcttcgggccaatggcagtggtcaccaaatctgcctgagcaattgccttcacaactgcctcaggatccttggcattgttcaagccgtcaacattgtccacatgaatctttttctcgcctggggccgccagcgtaattgtatattcaccccgctgattcaacgcgttgataatcgtctcgttaacatcgacaaaattgatcttgaagccattcgcggcaagtgtttccccgataaacccgcgaccaatattacctgcaccaaaatgtactgcttccatcataatttattcaacttccttcagtaaattgacgatttcttccggcgtttgcgcgtcggctaatttctggacattctccacatcactgcaatacagcgcaatctgcgacaagagcttgagatgttcaccgttcaatccggcaatgccgaacaccacggtaaccaaattctcatcagccggatcttctgaccaatcaacaccccacggatattgaacaaccgagatcccggtttttttaatatatttcatacctgcttccgtaccatggggaatcgcaataaagttgcccatgtataccgaaacgtcacgattacgatcaatcattgaatcaatataagccggttcaacattgccattgtcgaccaggagttggccggcctgacgaatggcttcgtccctggtctttgcttcctgaccaagcttgatcgtgtttacgtcaagtcctttcatcatgtcaccttcgatcaattttttggatttcgtgcataaagacttctgtcattacttgatataactgactatagttacctttttcaaaaagccgtaagtcagctggtgaggcaactagcttggcgctaaccgcactcaaaagggttaatgtttcctgtgaaacaggattcggggttagcaataacaggatgcgctgtaactggattgtccccatatccatcgctggtagcggcaacgagctggcgagatcaaagacgccgatgtacggggtggtgaccccttggctgctggtgtgaatcatcgccagcccagtgtccggaataccgacaggggccaactccagccgctttaacaaagcttctttaactaccggtgcttcggcaacaacagtcggtaaccggctgagtatcgcgtcaatcgcagccgcaatcgttgtgactggcgccgtcatgtcagttacggcaaagtgttgcaataaaccatctgccgccatcaccattgttttcagactttcaaacgccgtgaccgtctgatccagcgacggttggttcgccggtcgcacctgtttgggcgtagccttttgaactaaccggcgaatttcggccatttcttcgcgccccaggatcggggtaatcaccagatattggtgtttgaagcccggtaacggcatggtcgccaacaccaagtcataatgttcgagttgctgcttaggtaaatcgctgacttgaatgattttgatcttgcgaatctcaggcacctggacccgtaatttcccggcaatcaaactgccggtcccgggaccatcactcgtgatcaacaacaccgcaaccggtgcatcggttcgcgtatggtctaaaaccgaggcgaagtacaaaaccagatagcctaacgcattgccggtaaaggcgccgcgcccgaaaacgtcatcagccgcttgctggaccgcctgataaagttccggatagtcatcacgcaaatgggcaagcaccggattcgtcatcgtgacccctggcagccaatcgccaccggttgtccgctgaacatgggcaagtagtgaggaataaagctgcgtatttccggaaaatttcccgggaaattttcgcgccacttcgcgaattaattcttgaacttccaggttaatggtcaaatcaaacggatcaacctgttctccagccaagccgccacgaatgttactgagttcaaccgccagaaactgatagtcgccgacgcgcactttttctcggatggtgggatccatttcggctagaaactggagtgccagttgttgatcctgaaacagtcgttcctggtcaaaatggggttgggccttcgcatgatgatcttcgcgcaaccgatgcgtgttaacggcaacggtgagtaacactgctttgcgttgattgtcgctcaggtcggctagcgcttcgattcgggataatgcggtattggctgctagtagctcttcttgcggcaaccgtttgatgaagtaatccgtcaccggatcaaaggtttgccgcggatcatttaagaaacgaaagaacacatacggattaatctcggcattcaagacgccgacaagcacccgccgaatatcgccttcctgcccttcaatccaaatgccggcagctttttggcgattcaacttgagatgatattcattgagtgccggttccagaatatcaaggtcttgtttaatggtggtcacgctgacatccacatcggttgctaaggccgtcatggttttgggtgcgcccgcattcagcatcattaagatcaaggcgctctgacgctgactgggatcgaacgtcaggtcttgttgttgctgggccaacgtctccgacaattttgccagatccgttgtcgcgcctgttaaccggtaggaactgccatcacctttgtcgagccgtaagttcaaggcggtaatatcatgctccagttgcgaaagttcacggtaaatggtccggcggctgacacccagctgtcgttgcagctcgtcacggctcacaccggcgggctgactcatcatcagtttgatcattttctgttcacgattcgttagtaacatgtttttcgccccagacgaccgcaactcgacctcgcctatttcattttatcaataagtttatcatagttcgttgcgttcaaaagaccgtcgacggtatagacttgaacattggcaaactgtaatttaacgcggcgtgccgtttcctttgaagcgataattaacacgttgtctttgtcctcaatctcgccgatcgcgacattgcgtaccttgacatccttgttgagtttccgcaactcggagcggaaggttgcctgggccatcgttgcggagccgatgttttgatcatgatgcaggaagtcaacttccgtaatcttgtcaaaatcaatctcgttcaattcgtcttccggtgtttcctgttgcgctttcggcgcttctgcggtagccgtttcatttgtaccgccaaccgcttcagctttcagactggcaatgatttcgtcgtactttggactattcaggaagttttcaaccgcaacgtgagcggcacccggcgtctgtttcttggcacgatccgccagttcatcttgggtaacaaccaacagtcccggcttgtcttgcaaattactgattgctgtgttggtaactgaaagatccaacccagccttcttgactttatcacgcagaatcgaagcacccattgcgcttgaacccatgccggcatcgcaagcaaagatgatttgtttgatgcccttagcctgattcatcacgtctttggcggcctcgacattttgtcccttggcttccgccttcatggatttcatcttagcttcactctcagccagttcatcgccgctcgtgctcttatcccggcgtagaatgactgcagagataaggaaggaaacgactgtggcaccggtgacaccgatgagcaaaccaaggtagttgcccaaactcttaggtgacatcaggaataacgaaataatggaacctggtgatggtgagctcttcaaaccaacattaaagatggagaacaatgtcgtgccagtaacaccgccagccataactgacaggaacaacgctggcttcatcaaaacatacgggaagtaaatttcgtgaataccaccaaagaaatgaatgatgatggcagatggcgcagaaccttttgcggcacctttaccaaataaagcaaaggccagcaaaacgccgagccctgggcctggatcaggctcaagtaaaaacagaatcgatttcccatgctcagctgcagcttgaataccaagtggtgtgagaataccttgattaatcgcattgttcaggaacaaaattttcgctggttcaataaagatattagccaaccaaatcaagccgtgacgaataatccagtcaacaccagcagccataacatttgtcaggcctgaaataatgggacccatcaggaagaaaccaacaatggctaataacatcccgataatgccggcactaaaattattgaccagcatttcaaagccttgcttaatcttttcctggaagcggttatcccacttcttgatgcaccagcctcccaatggacccatgatcatcgcaccaatgaacataggtacgtcggtgccgacgatgacgcccatcgttgcaatagcaccaacgaccccgccacgatgacctgccaccatcgaaccgccagaaaaagcgattaacaatggtagcaaataggtaaccatcggcgtaatcatctttgctaggttcgcatttggataccaaccacctttgaggaagatggcagtaatgaggccccaagcaataaaggcaccgatgtttggcaacaccatgccggaaagcttggtcccgaatgattgcataccggccttcagattgaatttcttcttctccgttaccggcgtgtttgctgatttagcttccaaagcaaacacactcctttcccttgtttacggagattattgtaaccgcttcatgtaatcgctgacaaaagctactttggcacagttggctgtgccaaatattcaccccaagccttttctatcattcatttgccaaaacagcgccaaatagacgataacagtgttcgttaactgtttcacaggttattttaatgggaacgattgctgcatatcagcgacattcagccatgatgccaacttcaaaagactgcttttcatccatatataaaagtcttgacgaatgagcaaaggttttttaagaaaatccaaatttaggtatagaccattgttgacaaggttactttttgatgctatattggactagaccagataagggggatatcaattatggatgttaaagtttttgataacgacacagaagcaggtaaatacgcatttgaactgattaagcaagggatggacaacggcgccaaggtgcttggtttggctaccggcagcacccctgtcaccatgtatcaggcaatggtgaacagtgatgttgatttcagcaacatgacatcgatcaacttggatgaatatgttggcatgtcaccggataacgatcaaagttatcgctacttcatgcagagtcacctttttgacaagaagccgtttaaggaaaccttcgtgccaaacggccttgccaaggatcctgaagaagaaaccaagcgttacaacaaagtcattgccgatcacccaatcgacattcaggttctggggattggccgcaacggtcacattggcttcaacgaaccgggttcaccgtttgatgcagaaacacggaaagttccgttaacccaaaacaccattgacgccaacgctcgcttctttgaaaataaggacgatgtaccgcgttacgcttattctatgggtatcggttccatcatgaagagcaagaagatcttgcttctggcctttggtgaaaacaaagccgacgccgttcaaaagatgatcgaaggcccggttaccaacgacgtgcctgcatctattttgcagaagcatccgaatgttgttgtcatcttggacaaagcagctgcaagtaagttgagcaagaaatagaacattgttaaaacgaactactaaaagcgggctaattggcctgctttttttaatgtgagcgtgagtcagcgcgcttagaagcaggcgaacgcgttatggcataagcccgttcacactctgcaagcgcttctatttttactatggattcatggtaaaatgaagccatcacaaactcggatatcggaggaaattatgtataaagccgttgtatttttcgatttagatcaaaccctgctcaacgatgaaaagcaagtgccgcctgaaaacgtaaaggcgcttaaagcgttggaggccaatgatgtgctgccggtcattgctactggccgcagctactatgaactagccgatattatggccgctactggcattcggagcgcgattacggcaaacggcggggatgttttccttaatggcgagcatatttttcaaagcgtcatcggcgaacctcagctggtgcggtttctcaatgcaaccgcggctcaggatattcaggtggccatgtactccagtgaggcctctgctttaaccggctatgaccaactcaccaccgataattatgcacaagtgcaccaaaccccgccgccgatcaatcctaagtattatcaggaggcctcactgtcgctgttgcttatcttcttgccttggaatcagaccggcgatcagttaggtaagcagttcattcaggacttccccgaattgaccttctatcgcaattcccacttttcctttgatgtcgtcaatcatggcatttcaaaaggcagtggcatgtcggttctgttgaatcagccagccttgcgcggtgtgcctacctatgcgtttggtgacggctacaacgacattccgctcctgcaagccgccaatactggcatcgccatgggaaacgcctatcccaaggttgccgcaattgccgattaccaaaccgatgactaccgcaaaaatggcattcccaacgcacttgcccacttcaacctaatttaactgatccgcataccaaactcgggactcaaaaagcattgcgattattaaaaatttgatagcaacatcgatacccctttgcaaacacgcgttctcatcattttctccaaaattcatggccgaaaattatttaatttttgcgcctaaaacgttgttacatcagcattttcagcgacccctataacgtgttcgccacgcaaagtcaagaccgcagtagcgcgaattttctgctatactcaaggcatgctgcacgttatttgggcgtgatcgtgtcactgatcagtaacgctgcggcatcgcaaaatctgctgatggaggggtctcgttatgttagaacaatcgacaatgcatcctgtagtttggatcaacaaacatacttatatcagtatcgttaaaaatgcggactataatttagaagtctgggagattaccgccgaaaatcggcagcatcggatggcgcggatgaactacaaatatcatcgtgataatttcgccgggttcatctatcgactctttccgcagattgatctcattcaaattcacaatattcaaaagaagatcaacccatatttcgatttagaagtttagaggtgttcacatggatagtctggtcgttcaattactaatcatggtcgttgtcgccttcatcatcacgttggcggtgatcgtagccgaatggcgtaccaaaacattcaagacatggcaaatcagtgtccaatccgttgtcgccatcctgctattagccattggcattagcttgttgacggttcgctagtcctccatttgatgtggctgccatctggaagaagcttttgacgttctgctaaccttttgcccccgtcataacgcccgttgaccgtcaaatgcttcgttttctagatagcgaaccgcaatatgatcaaaaggtcgatagccacaagttggctcagccagtgaacatttaaaaatcagtcccaacaaattcttcttgttggggctgatttttttatggcgaacaagtttactttaaaaaacaaacgatatttgcggtaaaatttaaatttatatgctagaattaagcaaaattcgcaaggaggcgtaagtacatggatgacttcaagttgcctactttaatggcacaacgattggttgacggtttaatgggaggttacaaagaatacctcgccgagcgtaaacagaaacagcaggcattgacaatcagtggtgcttttgcttggacgcgaagtaatttcattgactctaaaatcagcgaactgtttagccaagacgacaccgttgacagtcagatcgacaaagccgggtatgcttgggaatatcttcagtttatccaagaaaacgataatgaccgagcactcatcatcgttaaaaacgcgcggcaagtaaagcgaaacttcaacggtgccactgcgtcgatcgataaaaataattatctttatcgattggcgggtatcaataacacttggagcgcagctggcctgttaagcggtaagccaactgatcgtgttgtccagttggaactcgccttaccagaagcaaccacggattttgaacatcttgcagaacaggtgtcatcaaagttttcaaagttctacattgtcacttacgaggtggataatgtaagcaagatgatttcagacattgagttaacaatgccgaatcaatctaagatgaccttatcgccaattcaaaacttgactcccttgataagccgtagtcaatttcaaatcaattctgaagaactagaaaccattcaaggtgatcaagtgccagatgcagcgtatgaacaaaacacgttgtttggctatgaaattaataccgatgcagagaatgaaagggaggccggcgcagaataagcgcccttcgtcatgtttattggctcaaaactaaaagcactgcgggaattaaacggctatacccgcaaagatcttagcgtccaaatcggggtaaccgaacaagccgtctggcaatacgaaaccgaaaatgttatgcccaaaatcgagatccttaatgcccttcaacagattttcaacgttgacatggcctttttagtgaacggtaatgcaccgaaacatgttgtgcatgaagcaaagatcgcgttccggacgacagatcgttcaagtcggaaaaagacaaagctagaagcccgctatttagattttgcagacggcttaactagctactttgaaaagttcgtcagcgtcaggcccgccggattcgataaacttcaacaaatggtacaaacaaagctgtctggaacgaacaacctgacaaagattcgtgaagttgctaaaatagcccgacagtttctaggccttcaggataatcatgacttaatggcaaaacttgaacaagtcggtatctatatagttgagaaagacctcggtgtccatatcgacgcctattcaaccataaccgataacggacatgcatggattgtactaggctccattaagaagtcagccgttcgccgcaattttgatctcgcccacgaattaggtcatttgcttcttcatggtgccattgactttgatgaactaacagcggctgaatataagcaaatcgaacatgaagctcacacttttgcagcagaattccttttacccattgaggatttcactgcggacttcaaaaaactttatcgacgttcaaatcctgattattatcttgatttaaaacgtaaatatctggtctcgattgtcgccatggcgatgcacgcatacgcactaggacttatgagttatcaagaacaacgctatttctttggtcaacgttcaaaaaagggttacaaaatcatggaaccattagatgatcaactggtgccagtccgtccggggaaaattcgtgctcttataacgctcctatttaatcagcaagtgctgacgcttcgagatctttcgcgtcatcttcatgtcagaccgacgttcattgcccagctcttcgcattggaacccgacttcttcacaaagtatcaaccgcagcacagctacgctaatatgcagaatgtcattccatttcctcgtcgttttacgaaaaactaaattgattaaaacgatattggcgcctgatggagatccccatccattccctttcactgacacaagtattaactaaggagtcgcactatgcctaagcacctacgccaatttttattgacttacaacgctgacctccgtatgcgtcctttaacttactgctttctaaatacatgcttattcgctctttactttattgcgttcatgagcatactcatctcttacgaagcactttggtcaatctctatcgtcatattcatctgtttattgaatttcctcataaacatcatttcagtcgtctctcacgcgaataacgctgctttatccagtctctttaaaaccagacggcgctggctgattcaatttatcggcactgctttagtgtctgttgcgttgttctctttggggcttctgactaaactctgatccttttcgctgtttataccgttaacagtatagtctcaaggacattttgccttgcctttttataatttcttgaaggatatctttatttagtacaactttggtctcgatcttttgaggccattttttatttcgtttcagtttcaactaatccaactgtttcacgtgaaactttttaacaaaattaaaagacccgaaaaataagccgcctgttatctcaagttaacaattcacctaatcccctagcctgtttcgtctgacgcatgccaatacctacacaaaatcccccctccaacttttagctgtcatttattttacaaagttcgtttcttaatcggaaaaccaacaaaattcggcgaaatctatgattggacgttaacccaatcaatccgtatacttgcaccaacggcacggtaaaaatacgtttacatggaggcggaagtttgaaaaagcgacaggcgaagcacaaaggtatttcccaacgaatggtgatcattggcatcggaattttagccatcattgttgtaaccattgttttcttcatgacccaacacaagcaaccccaacagtcaacgacttcgaacgcggtggcgacttttcaggttaagcgccacgaattgcggttgtccggccaagcccaggcaacacgcacgcaaaaaatcgaagttcctgaaggcacggtgcagaatcaatcggtcaaaaacggtgataccgtgacggccggccaacaactgctaacggtctaccaccctgacgttcaggaaaaaatcacgacagccaaccagtcactccaaaaacaacaacgcagcctcaaacaattggatgacaaaatcaaccaactcaagtcgtcactcaatcaattggcagctgacgatccgcaaagatctgatttgcagagccaactggacgaagcacaaagcagtcgccaggattcggccgcggctgttgacgaggccaaccaagatgttgctaaactgcaacaaaatctcaacaccgttgttaaggcgccgtttgccggtcgcctgtttattgactatcaagcaaacggccagcagtcgatcaccgaaacctcatcagaaatggaagcagtcggtcaggtttccgaatttgattatgccgatgttaaagttgatcagtcggtaacagtgcaggcgctgtcaaccaaaacgaaacagacaacttccattaactttatcagcagcgatccggcgaaatccagcaagccgaacctggcgaagtacgatgtcaccgctaagttagatcacggctttttaaacggtcagtcggtcagcatgatcatccctctaagcggcctgcaaattcctaaaaccgcggtacgccaaggcgctgtctacaaggtggtcaacggccgcgcagtgcggaccaagatcacttacaccaaaaaagacgacatgtatgaagtcacggatggcctcagcagcggcgaccgcattttggaaaatcctaccaagtcaaccaaagacggagcgaaggtgaccgttgatgattgatcttcagcatgttaacaaaagttacggtcaaggtgcgactgcttttcacgtcctcaaagacatcaatctgcacattgacgaaggtgaattcgttgcgatcatggggccttcgggttctggcaagtcgaccttgatcaatattatcggctttctcgacacggcatttgaaggtaagtattttttccaagacgaaaatgtcgccgacttcaatgcgactaaagcctcacgcatgcggaatcgtcacgtcgggtttgtctttcaaaatttcagcctcattcacaacctgaatatttttgaaaatgtcctcatccctttaagctatggcggacaccggcgatcggaggtgcgtggcaaaatctccgagttacttgagtcagtcggcctcaccggtatggaaaataaattgccgcgtaatttatccggtgggcagcaacagcgggtggcgattgcccgcgccttagcgaattcgccgcaatttctgattgctgacgaacccactggcgccttggacagtcacacatccgcagacattatgcaacttttcaaagaattacaccgaaaaggcggcacgattatcatggtcacgcatgatgagcatgtcgccgaacaaagcgatcggatgattaaaatcctagacggccagatcatcagtgatacggaggtggcccatgcgactaagtgaactcatcagaatctccttccgcgcactggcggctaacaaacgccgcagtttcttaacgatgattgggattgtcattgggattgcctccgtcgtcacgattctttcgttaggtaacggcatcaaagcggcaaccgtgaaaaacctgcaagccaatacccaaggccagcaaaccgccgaaatcaccttcaatcctacgagtagcagcgagaccgatgccggcttcaaagaaagtgacatcacactggcaaagcaaacggcaccggataaaatcaaaaaagtcgtcattaaacatgacgaagaaaatctccaagtcaacggtcagctggcaaatgccgataccatgatgtctgtcaccttggtcaataaggcaaaacccaacattcagctaaacgctggtcatggttttagccaagaatcgttacagacagacggcgaggatgcgttaatttccaaaaagctcgccaaaaaggttttccacggcaataccgcagcattaaactcctccttggaacttggaaccaaaaactacaacattatcggcgttttcagcccgcccaaaaccccgtattccgcgctggacgttgatgtcttagtgccggaaaaagcctatcgtgcgggccagctttctcaggaaggccgaaaactggcgatcacgtataaaaccggcagcgatgttagtaagttgaccaacaatgttgttcgccagctgaaaaaatccggcagcgaacgacgcagcggcgagtattcgtactttgattacggcgaattgctgaaaggcatcggcaatgtcatcagtgccttaacgctatttgtaagtgccattgccggcatctcccttctgattgcaggtgttggcgtcatgaacatgatgtatatttctgcttcggaacggtcgcaggaaatcggcatccgaatggcagtcggtgccacacctgccgaaatcatgaaacagtttcttttagaatcggtcatgctgacactgacaggcggtgtggtcggattgattgtgggtgcgttaaccgcttggatcatcgcgatgttcctaccgttcaaacccgtcgtcacgttgggctccattatcggcacctttgccatttcaagcattgtcggcatcgtgtttggcttattgccagcgaaaagtgcggctaataagaatctgattgatattttgaagtcataatgtttcgttccacctacaagcgctagtggtcaaatgactagcgcttttttgctgcctcaaaaaagccgcagcatccagtcattgtgaccgaatgctgcggcttcattttttagaacaatcccagcttcccgatacgctgggctgcctcctccaaccgttgtggactggtaagtaagccaattcgcacgtaaccttctccatggtcgccaaagccgttaccggcagctacggccacgtctgcccgctccaaaagtagttcggtgaaggattcgctggtgtaaccggcaggcacgggcatccacgcgtaaaacgtgccgggggattttttcccatgccacccaatggcctctgtcgccgagaaccacgcatcgcggcgttgttgatataaatcaatcagttcgggcactgatgtctgatcgccaagcagtgcttcgatgcctgcttcctgaatcgcagggaaaaccgagacaaacagatgatcctgaatcagattaatggcctcgatcatatcagcattgcctgctgcaaaggccaagcgccagccagccatgttataagtcttcgagagcgtgtaaagttcaatgcccacatcctttgccccagcactctgcaagaaacttaccggccgctgaccatcaaagccgagcgcgccataagcaaaatcactgacaatgccgatgtgatgagccttggcaaaggcaacagtttggtcgtaaaacgccggagttgccaccgcagtcgtgggattattcggatagttcaaataaagcagcttggcagcatcggccaccgctgggtcgatggctgcataatcaggaagccagtcatggtccgcggtcagcgtcatcagggctagtttcacgcgcgccaatgtgacgcctgacagatagtccgggtatcccggatccggcagcaaaattgtctcaccggggttcatcaaggcaagcggcagttccaccaagccaattttggagccgcccaaaaccgcaatttccttttccggatccaactgaacgccatattcgcgttcgtaaaattcggccgcagcctgcttgaagcttggtaagccgcggaaaagtgaatacttatgattacctggcttagccaccgcctgttgggctacctgcacgatgttggccggtgtcggctggtccggattcccctggcctaaattgatcacgtcatggccggccgcaatccgggcattgacatgtttgacgaggctggcaaaaaactgcttaggcagcgcttgaagcaccgctgattctgaaaatatcactggtctgattcccctttttaatgagtttgcatggttagtgtgcctggcgtgcttaatacagttccggccgccgatctgtgaagactggaatttgttgacgcgcggccgcaatctgagccaagtcgatggtgacgatgccgacttgcggctgatcgtccagttgcaacaggcgcttgccgaacggatcaatcacttggctttgcccgccaaaatcattgccaggatcttgaccaacccgattcaccgccaccacaaaggcctgattttcgatggcgcgagcggtcagtaacgccgcaaactgtggtaagcgcggcatcggccattcagccggcaggaaaaacagctgcgtgccgtcactcgccatgcgccggaaccactccgggaaccgcaagtcatagcaaatcgccacactggctggtactgcaagcgtaaagtggttagcctcggatccggcagtaatgaacttttcttcattcatcaggcgaaaaagatgcgccttcgcatacgacgccagcaagtggctctgagcgtccagtgtcaaactgcgattaaaaaaatgctcattttctgccgtggcaaccgagccacccacaatcgtcaggtgatagtggcgggcaagatcgcttaaaaaagtctgcgtccgcaagccatccggatcggcaagcgtctctaaatgttccaggtcgtagccggtattccacatttccggtaacacgacaacatccgccttttttcgggctgcctcggccaccgaatccgccaccttttgataattttgctcaggttgcccaaaagcaatgtcgatttgcgctaaagcaagtgttaactgagtcatctcaatccctcttttttaatcgcgtccacctttgacttagaaggcgggcacgatggatcctttgaattccttggcaatataatccttaatggttttgctctgatagtatttcttgatttgcttgatgactttatcattttgatgcttggtttgtacaacaaagtagtttggataaggattgttcttggttttctcatgataaatcgcgtcttgattgatcgtgagtccggaatcaaaagcaaaattcgtgttgatggcggctgccgtcacgtcttgtaagtgcgttggcaattgcgaagcttccagttcttcaatttttaggcccagcggattctcgacaacatctgctttcgtcgccttttggctaatgccggctttaagcttaatcacgccagcggcttcaaaaagctgcagcgcccgcaactcgtttgacggatcgttcggcacggcgatcgaatcgccctttttgagtgccttcaagtctttaatctttttggagtaaacgcccattggaaacgccacggttttgaaaacctgcgtaatcttgaaattcttggatttaatctgttctttcaaaaacggcaacgtctggtaactattcgcgcccaaatcgccgtcgtttaaggccacgtttggactgttgtagtcggtgaattgctttaatttgatcgttaagccatcttttttagccagctttgcgacttgtttcatgattaattcgtgcggtccggcggtaacaccgaccgtgatcgttttgtctgacagctgattcgccgatgtcttgctgctggcgctactgctgccacaggcggttagaacgaccaaaaggcttaacgcgagaactgctgcccagcttaacttcaaccattttttcatgtaagaatcctcctgttatgggttgtttgactgataaaatgatgatttgcatgaagggagctgactgtcgtaaggcgcttcctggcgcaagagccaagactaacgcgttcgccagcccagaaaaaaggccctgccgaatcaatttaatgattcagcagggccgacaatgtcggggtaccaccctggttcgttactgtgtaaccttaacgatgcctgttgacatcgagaccgtctaacgcaggcctagtgcgtacccgacttatcgccggatccattccgcggtcattttcaccagacgcctgcatcgatttccaccacccatcgactcgcttaagctgcgtttctgactactctccgcttcatgacgtttcatcattttatcagttatttttaaagttgaaagcagtttatctgcatctgggttaaatgtcaactgttttgtttcgccagtcgtgcacgggaacatgccgccgtttacgctaacttttttctgaaaatcgaatattttttattttttggttgacttcgcttatcacagcgcgtatgttaacaattatcacataagatgagatttacatgagaggagttttgtcgatggagctggaatttgatttacgccctggagccaatcggtttgtcagtgaggccggcgcgcttgcctatttggataccattttgaaagatttcaccaaaccggtcgtcattaccggcgaaaagagttttgcggcgtttgaaaaagcctatccgggcacactggacttaccggtttatcactacgacggatcggccagtgacgaaaatggccatgctttggccgaagctatcggtcaggcggatgctgtcgtgggaatcggggctggccgcttgatcgacacggctaaagtcgcagccgaaacgttgggtgccgaactgattagcattccgacgctggcctccaactgtgcgccgttcaccccgttagccgcgatctaccacgcacagggacatacgtttagttacgttgagtattttaaaaagtcggcttatatcacgttggttgactataacttactgctcagcacgccgcatgatttttttgttgccgggattggcgatacgctggcgaagtggtacgaaatggacggcatcacccgcaacaagattgaccagctgaatgcttatggtcagctaagccgtgcgtctgccaaaaccattcaggcaattctcttcaaaaatgccgagcaagccttagccgatttggatgccggtcgggacacacctgccttcgaagccgttgccgacacaatcattggcctagccggagaagttggcgggctcggcggcgttgatggccgagcagcgggcgcccacgccgttcataacggactgtcctacctgccggaaacccacgcgattctccacggctcaaaagtggcttacggcattttggttcaactcgccacaaccggggatgacgatgaaattcgcagcctgatgcctttttatgaaaaaatcggcctaccgttaaacctcgaggatctgcacgtcaccaagaacgtgtcccagaagatgcagcaagtagccgaatttgccgcacaacctgaggagacctttattttaattgacaaggatctaacgccgcagcagattgtatccgctatgaaaaaagtggaacaagttactagcgaagctgctgcttaacgaactggttaggaaaagaatacgccgctacccaactttatcgagttgagtaacggcgtattttgttgaactcatgctgattttccaccgcgtgattttgtctgtgcttcaggcagtttggcgatcaagcgaatcaaaaacgggcggatggctttgaaaataacctcggccaccacgaaccccaccgccagtgccattgcaatcaaaataacattatagatctgctgcgcggcactggcggcttttcccatggtaaaactgcgggcacccagataggcgatcccacctggcaccagcgacacgaggctaggtatgtaaatcgtattcaccggcacccgatggcgaatggcaaaataattccctaacaacccgatgatcaccgttgcggtaaaattcggcagcaccagactgtgatcctgtaaactgatcagccaataggcgcaccaggaaacgccgccggtaatcccagccggcaacaacgcacgcttgggaatattggtgatgacaccaaaaccgatgctcgataagatgctaataataaattcaacgagtaaccgcacgttaacgccctcccaacacttgcgtcaagacaatcgcaatcacgacacccgatccgattgcgccggcgacaaaaatggcatccacggttcggacgataccgctgataatctgccgcgacagaatttcacgaatcgcgttggttatcgccacccctggcaccaacggcatcagcgcactgataataatattgccggcattatcgccccagccaatattcatgagcaactctgccaaaatcgccaccacaaacgccccggtcgcctctttgaaataaggcgttgtggtgcgccgaccgacaaattccgccccgagataaccaaagatcccgacaaaaaatgcccaggccagatcaccgttcgttgctttaaacaatagcatcggcgccaccgagacccagccagcaccaagaatgcgcgcccaccagggaaaattaatgacctgccgatcaatccgggccacatcgcgtttcaaagcgtcaaacgtaattttatgcgcaacgaactcccgcgaaagctgattcagctcatcgaccttctgcaagttgaacccacctaacgacgacttgatcaaccgcgtccggctctcattttccagactgacaaacaccgcggtgatcgtggcataacaggcaacccgtgccccggcagcgtgcccgatatattcaaccgtcgtctcgatgcgcgaagtctccgcaccagcattaagcaaaatctcaccgaccttgccgcaaacttctaaaatttcttctgtatccggttggctcatgcgtcttgctccttatcgcgttgcgttttactaattgtcggcttttttaccgccagtggcaagcaacccgccataaaatagtcatttaaaaacagcatatcgtgtttaacacaaattttcatcagttatcgtgcttaaccaatgaaaaaagtgcccgccgcagcagacactttttcggccgtacgcttattgcatacatcaaaattcacattaaggtgtattaaccccaaagaaaataataaataacgatccataaaccaataaaatcatggcaccgccaatcagtgttgccagcaaacttttgagcaacacggaaaacttgctcttccatagaatcgcaatcagggacaatgccaacatgacaaagataagcgataacaacaagatcagtagcagccgcggccaaagaatatccattcggtatacctcatgctaatgtatcagccattgatcgcggttgatcatcgctgaccgcttttagaatatcaatattttcgcttcaacacaaagtctatgcttcaatcgcatgttggcgggtaccacttatgccggaacaaaaaacagaaaaatcaagaccagcgcaagcaagtagcaaccctgcaccacaagcgctcccatcgtccatccccgcatagctgccaagtcaggtacttttttcatcgttgtccataaatagatggccggtagaatgccaaacaccggtaccacaaatgccaaaaacaacagaaaaataaaccacaacgactggatcaggttttgcttcataagttaaaactcctttattgagggagggacagttttatctaaggtcagtttcaaagcatctacaggttaatggttcttatcataatataaatttatttatttgaacagtttcaatccatcaatttctttactcaataccatcacgcgcattcgccgattcctagccacctcggttcacgctcatatcaaaaaagccagcgaacctttattcaggccctctggcttcgctgcttattgcgctactttactaatacgcccctgttcgatataaaccgacaaaatggccacatcggcaggattaaccccgctaattcggctggcctgtgcgatggttgccggttggattttaaccagtttctgccgcgcttccgttgctaaaccattgatcgcatcgtaatcaatgcgtgtcggaatctttttcccctcaagccgcttcagcttggcaacgctggcttcttccttggcaatgtagccggcatacttgatttgaatttcaacttgttcaatcacccgatgatccagttccggattatcaggtaaaaattgcgccatggtttggtaatcaatttccggacgcttcaggaaatcgctggcgagcacgccatctttcaatggcgcaaagtgatgggcttcaagccacgggttgacatccttgggctttaaccgcgttgtctcaagtcgcttcaattccgttgtgatggcctggcgttttgccaagaaatcggcgtaccgcttatcactaattaagccaagctcgtgacccattggcgtgagccgcaagtcagcattgtcgtggcgcaacaacaggcgatactccgcgcggctggtcagcaatcgataaggttcattcgtgcctttggtgaccagatcgtcaatcatgacgccaatgtaagcgtcggaccgcttcaaggtgaacggtcctttaccttgagcacgccgggccgcattgatcccggccacgattccctgaccggcagcttcttcataaccactggtaccattcatctggccggcggtgtaaaggttctcaacgattttggtctccaacgtcaccttcaactgccacggctcaatcacatcatactcaatcgcataccccggacgcataagctcggccttttccaagcccgccacactatgcagcattttcaactgaatctcttcaggcatggacgtggaaaagtcgccgacataatactcggaagtatcgcggccttcaggttccaagaacaattgatgccgcggcttatccgcaaagcgcacgattttatcttcaatagatgggcagtaacgcgggccaacgcctttgatgacgccggaaaacatcggtgcgcgatccagattttcgcggatgatttgatgggtcgttgcgttggtgtacgtcatccagcaacttaactgatctttgagatagaccgaatcaggcgtggtaaagctaaaatgattcggcgtggtgtcgcccggttgttcttcggttttgctgaaatcgatcgtgttgccattgacccgcggtggtgttccggttttaaagcggcgtaatttaaagccaagatgttccagattctccgacaacttgatgcttggcaaactgttgttagggccggaactgtacatcagctcgccgatgataatcttgccgcgggagctagtgccagctgtgagcacaacacttttagcccgataaattgcgccagttgcggccacgatgccaactgctttgccggcttcgaccagcacttcggttgccaacccttgtcgtaaatccaggttaggcgtgtcttcgatgacgtgcttcatgctgcgatgataggcagctttatccgcctgcgcccgcaatgcccgcacagctggacccttaccggtgttgagcatccgcatctgaatataggtgcggtcgatattcttgcccatttcaccgcccagtgcatcgatttcgcgaaccacgattcccttggccggaccgccgagacttggattacatggcatgaacgccaacatttccaggctaatcgtcagcaacaatgttttttgacccatgcgcgccgcggctaaggcagcttcacaaccggcatggccggcgccgacaaccaccacatcatacttgccggcttcaaacttctttacttctggcatctgttttcctccaagaatctgtttctcatcacattaaggattacttacctaggcaaaattgactgaataactgggtaatcaattcatccggggcactttcaccggtaatctccccaagtttgtcccacgctgcggtcatatcaatttgcaccaaatcgatcggcatcccggcatcgataccggcaatgaccgcgtccagacttttgctagcctggcgcagtaagccgatttgccgagcattcgagaccataacggtaccctgactgttttcaatgccgccaaagaagagtttggcgatccgttcatcaagttcgtccatcccatcactggtaggaatggcggttttgatgacctcattgggctttactaattggtacagcgcatctgtgtcgagttgcttgggtaagtcttgtttattcaggacaatcatgcgttttttgtccgcggtcgccgcaatcaattcgcgatcttcggcagtcagaggttgactttggtctaataccagtaaaatcagatccgcctgcgtgatggcttgccgcgaacgttcgacgccgattttttcgactttatcggtggtgtcatgaatgccggcagtgtcgaccaacttcaacggaacaccgcgcacattaacgtattcctccagcacatcccgcgtggtaccggcaacatcggtcacgatggccttgtcctcatgcaacatatgattcagcaacgaacttttacccacattcgggcgaccgacaatcgctgtcgccaagccttcgcgtagcacttttccttggctggctgttgtcagcagctgttcgatggcttttttgacggtttgtgctttttcaagcagcattttggtcgtcatttcgtctgtatcatattcgggataatcgatattgacctcgacctgggctaacacttcgaggatctcctgccgtagccgtttaattaatgtgtgcagattcccatcaagctgattaacggcgacctgcatggcgcgatccgtttttgcccggatcagatccatgaccgactcggcttcagtgagatcaatccggccatttaaaaaggcccgtttggtaaattcgcctggctcggccatgcgggccccttcgccaagcaataattgcaaaatgcgattggtcgcaacaatgccgccgtgacaattgatttcaaccacgtcttcgcgggtgaacgtctttggcgccaacatcacactcaccatcacttcatcaatcaagtcgccggtttccggatcgacaatgtggccatagtgaatcgtatgacttttgacctgcgtgaggtctttgcctttgaagactttgttggcagttgtgacggcggtttcgccgctgagccggacaatgctgatcgcaccttcgccaggcggtgtcgaaatcgctgcgatggtgtcgtaagcagtgatagatgtggacataacggaagactctcctttttttgatggtttgtgagttgggtaggtttgggatggtttggaggcattggttgaagctatgggtgggtcgttttgtccgcggctctccataacgcgttcgccagcccagaagcctgcgtgtaaggacctcggtcgcaatggccaagatcgggccatcacgcccaaggccacttacactccggcttctaaccgggctggctcacgctcacttcataacgcgctccccggcgcagaagcctgcgtgtaaggaccttggtcgcaatggccaagatcgggccatcacgcccaaggccacttacactccggcttctgaacgcgccggctcgcgctcacaaaaaaagtgccgaatccagtctcttcccttgtttgggagagactggataaagcactttgactacttcatcgttattaaactgtgaccatcatacttaaatcaacgctgcttgtcaaaagttagttacggtcgttttggtgtgaccacgacgtaacggcgggggtcgacgccttcggaatgggtgtcgacgtattgattgtcggctagggtcgtgtgaatggctttgcgttcgaatgatggcattggatctaagtagatcgccttgccggttgccagaacctcacgtgctgtgcgttcggctaaacgtgtaacggtggcttggcggcgttcgcgataatcgccaacatccagcatgatcgtccatttgcttttggcataatggttaaactcggtctgggctaagtattgaatggcattgataattttgccgtgtttgccgattaacagcccttcctcatcggttttgagttggaagttgacggtgttgccctgacgttcgctggtgacttgcgttttgattcccatgccggtggtgatatcttccagatagctttgcaccatcgccagcgctgtttgattgtcgcgctttttagtggtgatatcgttaaacgcactggcaattttcttgccggcagtgtcggttaatgccactgcaagcttgcccggccttgatttgcccgcaggatcatggtcggctttcggatcaggcgcaggatcggctggtggctccaatggttttagattgacaatggccggtttacgcatgaagcctaggaagccgttcttgttttcctgaacaacttgaacgctgaccgcatcacgtggtaagccaagttgcttcagcccggtttcgatggctttttgaatcgtactgccttgaaaggttggcatcttgcttcctcccgttgttatttacgccgtttggtcgctttcttatacgcctttttgagtgcccgttctttttccttttccgcccgcgctttttcttcacgctcgcgccgaatcttgaatgggttttgaatcagtaactgctgaaccattgaaaaggcgttggtaacaacccagtaaatggccagcgcacttggtaaggttactgagaaaacaaaaatcatcagcggcgaaatgatcatcataatccaactgcttgagttgcgggttggctgagccatcatggataaaatgctggtgcctaatgtaaataaggtagccagaatctgcatcacccaccatggatcgggtttggacaggttcatccataggaacgttccggattgcagcgatgttgttcgcagaatcgcttgatacagcgcaatcagaaatggcatctgaatcacgattggcaaacaacccatcactggattgacgcccgcagaagcataaagtttctgggtttcatcacgcagcttggtctgagtttccgtgtccttagaactgtatttttgctgcagctctttcatctgcggagcgagttcctgttgcttggccatactcttgatggacaggtagctcaacgggaaaatcaaaatccggatgatcagggtgaaggcgataatcccgacaccggggttgccgccaaacagatttgccagccagataacaaattggccggccgtgtaaacgacataacgatcccagaatccggtactatgttctgacaccggcgccgtgccacaggcggtcagaatgaataccagactcagcatgctcacaatgacaagcaggcgtttgatttgacgatttttcacaaataatccctctcttaacctaagcatggtcagatgacctcgatatcttcgttcaggatgcccgccaagcgcatgacatgaatcaggttcttcttggtctcagccatatcaagctggttagcggacttacgcgcaatgaccagaaaatcggtctgcggatcaatgtcgggttttaactcaagcaagctttggcgaatatagcgtttaatctgatttcgcatcacggcggtgtggccgacttttttgcctacagagatccccacccgaaaatggggttgatcccgtttcatgtgatagatcacaaaattgcggttggcaaccgaatcgccgtggtcaaacacattttgaaattcagcttcttttttgatccgatacgacttgcgcaatgatgctccctcacaatctggttctaagtatacaagacgagttgatgttttcctatatgtatcagcaggtgactgccgattttatatggtggatgggaaatcaggtgacgaacaaaatgaacggcaacgaccaacaatcgggtcattgccgttcattggatggctggtggggtttggtttcgggggatgtgcaggtgagcggttggccgaatgctctcgtagaaacgcgctcaccggcgcagaagcctgcacataaggacctcagccctaaatggccaaagaccagcctgtttgccgatgctccccgaaacgcgctcacaggcccagaaacctgcgtgtaaggaccttggtcgcaatggcaaagaccgccatcacgcccaaggccacttacactccggtttctaaccgggcctgttcgcgctcttaaaaaaaccactgacgcggtcagtggcttaggcggataatactttacgtcctttagcgcgacggcgtgctaaaactttgcggccgttctttgtgctcattcgcttcatgaaaccatgaacacgttcgcggtgacgtttctttggttggaaagtacgtttggttgtcattgacgacacctcctataaaacccgatttatctttttaagatgacttgcattatcagacatcatccgagtttacacgaggacgcaagctgcgtcaaggttttttcgctgacatggtggatctttttttgggctttttgctgctctgacagttactcactgttgttggttgacctgtggataagttgtgtatcgcaaaaagcgatcttaattgttatgcacaaatagcgcacagctaattcgcagaatcacatgggtgttgatatagttatccacaagctgtcagaagcctgttcatatcttgtgaaacacttactgctacaaggtttcggttccacagacaacatgtgcataactgcatttttctggttagtgtggtgtaggtgtcctcagggttggggataatttgttcgcaccttgtttatttcgcgaatttttgtttgtggaaaactgtggtttctgtggaaaactcggttccgcaatgctaaacttatttttgcagaacatttttcgacctaaccaaaaccagccattatattcactcgttagccgaacttaatcctgtccatcttgatcggcctgtgtttaagtcggcaattttaggttaaaccacatttagcgtttgcggatccacctgttgacaactatagaagttgccgtggtttttttatgcgctgatgcgatgttcgcgtatcaccacatgttggtcatcggcggctttttttggatgctgatgacaaccgctatttagaggaggggcgcttatgcccaatttagaggagctttgggcttacctgaatgataaattccgtgaagagttgaccccagtcggctacagcacatggattcaaacagccaaacccgttaaattaaccaaagataaactcgaaatcgaagttccggcatcgttgcataaggcttactgggagaaaaatctggtcaccaaagtcgtggaaggggtctacgagtttgcccagcttgaagtcgatccggtgatcatgaccaaagacgagttacagccggtcacaacgcatcagcaaccaacaactgccgatgacgatgatcaacaactgacttttaaggcgaaaacgcatctcaatccgaagtacacgtttgatcggttcgtgatcggcaaaggcaaccaaatggcgcatgccgcggcgttagcggttgccgaagctcccggcacgacgtataatccgctgtttatttatggtggcgtcggtttgggcaagacgcacttgatgcaggctatcggtaacctggttttggaaaataatccagccgctaacattaaatatgtcaccagcgagaattttgccaacgacttcattaactcgattcaaaccaagcagcaggagcaatttcgtcaggagtatcgcaatgttgacctgttgttggttgatgatattcagttttttggcgacaaagaagctacgcaggaagaattcttccatacgttcaatacgctgtacgaaaatatgaagcagatcgtgctcacaagcgatcgcctgccaaacgaaattcctaagctgcaggagcggctggtgtcgcggtttaacaaaggcttgtccgttgacgtgacgccgcctgatcttgaaacccgcattgccatcttgcgtaacaaagccgatgccgaagatctcagcattcccgatgacacgctttcctacattgccggccaaatcgaaagtaacgtccgtgatttggaaggggctttggtgcgtgtccaggctttttctactatgaaaaatgaagatatcacgaccagcctggccgccgatgcgttaaaggcgctcaaactcgatgatcgcagcggccaactgaccattgcgcagatactggacgctgtcgccaagtattttcaggtcaccgtgcaggatctaaaaggtaagaaacgggtcaagcaaattgtgattccccgccagatcgcgatgtatctggcgcgagaaatgaccgataatagtttgccgaaaatcggccaggaaattggcggtaaagatcacaccacggtcattcacgcgcatgaaaaaattatgtccacaatgacgacgaatgaagatcttaaagcccaagtcgtcgaactgcgaaatattcttaaaaatcgcggataatccacttgtggacaactgcgaaaacccgccaagtttatcccttgcacttatccacaggtgcataacttttcggctgttgtttctcaaagttttccacagtttgaacacggcctattactattacttaaaaagctttatattatatatataaataaacgtacgggaggctcttatgaaatttacgattacccgatccacattcttgaaaaccttgaatgacgttgcccgggctatttcaaccaaaaccacgattccgatcctgactggtttaaaaatcgtcctcactgatacggggctggtactcaccggtagtgatgccgatatttcaatcgaatcacgtatcaatattgctgatgagaacaacgatcttcaaatcgacagcaccggagaaatcgtgttgcctgcacgtttctttagtgaaatcgtcaagcggttgccggaagacaaaatgaccttggaagtcaaagataatttccaaaccgtcattacctctggtgcttccgaatttacgattaacggcttggacgctaataactatccccggttaccagaaattaccgctgatgaagcgttgaccgtcccagctgaagtgctgcgccagttgatcaatcaaacagttatcgccgtttctaatcaagaaagtcgaccgattttgacgggtgtgcatttcacgattatgggcgatcagttggtggctgttgcgactgattcgcatcggttagcgcaacgaaccctgacattgccgagtgcaagtaccaccaattacgacatcattattcctggtaagagcctcaccgaattgagtcggatgctgagcgaggatgtcgaaaaaatcgaaatccggattgccgaaaatcaggttttgttcgttttcggtcaaaccgccttttattcccggttgcttgaaggtaattacccggataccagtcgtctgattccaacgtcgagcaacacgcaagtcgaattcgacgcgccggtcctgttggcatcgattcagcgtgccagtttgctgagtcacgcaagcagcaataacgtggttcggttgatgctcaacattgcggatcaaaaagccacgatttacggcaattcgcctgatgtcgggaatgtcgaagaagtcctcacctttaacaagttgaccggcgaggatctcgaaatctccttcaatcctgactacatgaaggatgcgctccaaggctttggccaaaccgccatcgaagttgacttcaccgccccgttgcgcccattcaccttggtaccgacggaagacaaggaaaagttcatccaactgattacgccagtgcggacgttctaaagcgcgatggagcaactataagtaccgagcataaagaggctgagtcataattcatagccacaataaaggacgaacatactctgcagtgattagagggtatgttcttttttttattttcctgaggtagtccggtggaattattttagatatgagtgccaaggcggagcaatcgtaggccagagggggctcagctgtgaaattgtactagccgggcgatcttcccggcgtagtacaaggccgagctttgagactcagcgggctttgctgaggctcaaagtcgtgcccacagcgttccagctccctctggccggagattgcggagtttggcacggcaagaaacttattgcctaaaattttttaatcgttcggaatttactaatctgtgaacgttcgtacaaaattatggttcatcctctttttttcagcaaagttcaccgccattacgtcatttataaacaagccctccataactaagcatccttaaaaatggctttaggctagtctaaaaacagtagaattgaaaatttggctgtttttgggctttttaagggtttttagtctaggggggcgtcttggtgttaaattggctcagagccgcttaaatgcccgtttagaattgttttttaatgtacaaaagggtataattgttatgtgttcatctgcggcaaagcgcgatttgatgcgatttgccggtacttttcggattggagggcgacgacgatgacaaccatcaaaatcacgaccgcatttttgacattgggtcagtttctgaaagaagccggtctcattgatagcggtggtgcggctaagtggtatctaggcgagaatccggtaaccgttaacggtgaagccgaagaccgtcgtggccggaaattatatccggatgatcagattgaagttgccggtcagacttatgtgatcgtgagcgcatgaagctggatcatttgacgttaaagaattatcgcaattatgccactgtcgatacggctttttctccggaaatcaatgtcctgataggcgagaatgcacaaggcaagaccaacttgcttgaagctatttacgtcttggcattggcccgcagccaccgaaccaatagtgacaaagatttaattcggttcggtggcgattttgcgcgggtttccggacggatttcccggcagagcggcacccatcagttggagcttgtcatcagtcatcaaggcaaacgggcccgaattgatcggatcgaacaatcgaaactgtcgcaatacttaggacatttcaatgtcattttgtttgcccctgaggacttggcgatcgttaagggaagcccggctggccggcgtcgatttatcgacatggagtttggccagatgagctcgaaatatctctataacctgagccaatacaaaacgttcctcaagcagcgcaacgcctacttaaagcagctaaagtaccatcaggccaaagatcttgtgtatttggatgttttgacggattcgttagctgcctttggggccgagttgatcaccgcgcgtgccaagttattgcaaaccatgtcgggctatgctgcggcgattcagcaggatattaccaaaggacgcgaaacgttgcgcttttcgtatcagacccaggttgatgcggaggcgcaacaaaatagtgaagcggcttatgcggcgttgggtgcgttgtttgcaaaacagcaggcacgcgaaatcgaacagggaaccagcctagtcgggccgcatcgcgatgatgttgccttcattgtgaatgacaagaatgttgccgattttggcagtcagggacagcagcgtaccacggctttggcggtcaagttggcagaaatcgatttaatgaaagatcagactggcgagtatccggttttgttgctggacgacgttttgtctgaacttgatgcgatgcgccagacccacttgcttaaagccattcagagcaaagtccagacgtttctgacgaccaccagtctggatggcattcaaaaagaaatcatcacggcaccagccattttccgggtgcaggatggggttttgtctaaacaagcgtaggtttgctgtatcgggaaacgtgtttttaaggaggataaccagtgacggacaagaaagaatcggccgaagagaagaaagaagagctggcagcagaatatgatgccagtcaaattcaagtgctttcaggtctggaagcggttcggaagcggccagggatgtatattggctccacaagcagccaaggcctgcatcatttggtttgggaaattatcgataacgggattgatgaagcgttggccgggtttgcgactcaaatcgaagtcgaagtcaatccggacaatagcgttaccgtgacagataatggtcgcgggattccggtcgatattcaggcgaagaccggtcggccggcactggagaccgtttatacgattttgcatgccggcggtaaattcggcggtggcgggtataaggtgtctggcgggttgcacggtgtcggcgcttccgttgtcaacgccttgtcgacgaatctggacgtgacggttagccgcggcggcaagcggtattacattgattttgttcgcggtaaggttaataccccgatgaaggtgatcggcactgcgccggaacatgaacacgggaccaaagttcatttcctgccagatccggatattttcaccgagacaaccacatttgacgataaagtgctgaccacccggattcgcgagttagcgttcctgaacaagggcctcaagctgacgtttaccgataagcgcgcagccacccacgagaagctggtctttcactatgaaggcgggctgaaatcctacgtcgactttttgacggagaaaaaggaaaacctgctgcaagagccgatttatgtggaaggtcaggataagggcatcacggtggaagttgcgttgcaatacaccaacgactatcacagcaccttgctgacattcgccaataatattcacacgtatgaaggcgggacgcatgaaaccgggtttaaaacagcgctgacccgcgtcatcaacgattatgcccggcgttctggcgcactgaaggacagcgatgatccacttagcggcgacgatgttcgcgaaggattaacggcagttgtctcggtcaaacaccctgatccgcagtttgaaggccagaccaagactaagttgggcaactcggatgcgcggacggtcgtggaccggacattttccgatcattttaacaagtttctgatggaacacccggctgatggcaagttgattattgataaagccatgcttgccagcaaagcccgtctcgctgccaagcgcgcccgtgaagtcacccgcaagaagagtggcttggaaatctccaacttacctggcaaactggcggacaataccagtaaggatccggaaatctcggaattgttcattgtcgaaggggattctgccggtggttcggctaaatccggtcgtagccgtttgacgcaggcaatcttgccgattcgcgggaagattctgaatgttgaaaaggcgtcgatggaacggattttagccaatgaagaaatccgtacgttgtttaccgcgatgggcaccggattcggtcaggattttgacatcagcaaagcgcggtatcacaagctgattatcatgaccgatgccgatgtcgatggggcgcatatccgcaccttgttgctgacgttgatttatcgctacatgcggccagtgcttgatgccggctacgtttatatcgcgcagccgccgttgtatcgcttgcggcagggcaagatgatgcgctacatcgattccgatgaagagctgcaagacattctggggcaactgccgccaagtccgaagccggatattcagcggtacaaaggactgggcgaaatggatgccagtcagctctgggagacgaccatggatccggatacgcggcgcctgttacgggtatcgccaaaagacgcggaagaagccgatggcatttttgaaatgctgatgggcgaccatgttgaaccgcggcggaaattcattgaagaaaacgcggtcttcgttgacccgaacaatattgatgtgtaattgaccgattgacggatagcaaaccggtcggatatgagaacttttgagaggagacttttcgcttaatggatgatcgccaagaaagccggattacgaatgtgaatctcggcgaaacaatgcgtaaatcattccttgaatacgcgatgagtgtcattgtggcgcgggccttgcctgacgtccgcgatggcctcaagccggttcaacgacggattctgtatggcatgaatgaactcggagtgacgccggataagccgtataagaagagtgcgcggattgtcggggatgtcatggggaaataccatccgcatggtgacagttcgatttatgaaggactcgtgcggatggcgcaggatttcagctaccgatatatgctggttgatggccacggaaattttgggtcggtcgacggtgacggtgccgctgcgatgcggtataccgaagcccgaatgagtaaaatcgccgttgaaatgttgcgcgatatcaataaagacacgattgattttcaggacaactatgatggtaccgaaaaagagccggttgttttgccggcacggttcccgaacttactggtgaacggcgctaccgggattgcggtggggatgaccaccaatattcccccgcataatctgtctgaaaccatttccgctttgcacgtgctgatggacaatccggacgcgactacggcggacttaatgcaggcgctgccgggacctgattttccgacaggcggcgtagtcatgggcaagtcgggcattcgccatgcgtatgaaaccggccgtggaaccatcgtgctgcgcgggaaagttgatgttcagaccgaaaaatccggccgcgaacgaatcgtcatcaccgagattccgtatatggtcaataaggctaaaatggtggaacggattgccgatctggttcacgaaaagaagatcgatggtattgtcacgttgcgggatgaatctgaccgtgacgggatgcggatcgtcattgatgtccggcgggatgccagtgcttcggtgatcctgaacaatctgtacaagctaacaccgttgcagaccggtttttcatttaacatggtcgcaattgtcaacggtgcgccgaagctgttgagcttaaaacagattctgcaatattacctggatcatcaggaaaatgtcattcggcggcggacacaatatgaactgaagaaagccaaggcgcgcgagcatattctcgaaggcttgcggattgcgcttgatcatattgacgaaatcatcacgatcatccgcagttccgaaaccggagacaaggccaaagtcatcttgatggacaagttcaatttgtccgataaacaaagccaagccattttggacatgcggctggttcgcctgaccggtctggaacgcgataaggttgaaaatgaatataaagatgttgaagcagcaattgcggattacaccgatattcttgccaaacctgaacgagttcaccagatcatttatgatgaattgctggatattcaaaagaaattcggcgacaagcggcggacagagctgttggtcggcgaagtgctgagccttgaagacgaagatctgattgaacaggaagatgtcgtgatcacgttgagccataacgggtacgtcaaacgcctggcaaccagcgagtttaaggcgcaaaatcgtggcggccgcgggattcaaggtatgaacgttcatgatgacgactttgttgaacgtctgatctccacctcaactcatgacgtgctgctattcttcaccaacaaagggaaggtctatcgtagtaaaggctacgaaattccggaatacagccggacggcaaaaggcattccgatcatcaacctgcttggtgtcggcgctggcgaaaagattcaaaccgtcatcaacgtccacgaaggtcaaaaagatgaccggtacctgttcttcgtcacgcaaaagggtgtcgttaaacgcacgccagtcaaagaatttgccaatattcgcagcaatggcctgatcgcgttgaatctgaaggatcacgacgaactcaataatgtcattttgacatcaggtcaggataatatcctgatcggcacgcatctgggttacagcgtggccttcaaggaacaggatgtgcgctcgatgggtcgatcagcaacaggggtccgcggcattcgcttgcgtgaccatgattacgttgtcggctccgacattctcaaaccggattccgaagtcttcgtgatttccgaaaagggttatgggaagcgcactgccgcgaaggaatacccgatcaagggccgtggcggtaaaggtatcaagaccgccaacattactgaaaagaacggcccacttgccggtgtgacaacggttaacgggactgaggatattctggtcatgaccgattccggtgtcatgattcgcttcaatatccaaagcgtctcgcagacaggccgcgcaaccctgggtgtccggttaattcgggtagacgatgatgccaaggtcgcaacgatggctaaggttgaaccagaaaccgatgatccggaagatggcaacaagccagaccagccaaccgatccgcaagccggaccgactgatcctgattcaaagcagcagccagctgacggacaatacgcaggtaatgccgatgagcaggtcaacaaactgctggatcgcgctgagactgatcagcctgcatctgatgctaatgacgaagacgaggacgaggactaaaagtgcctgagtcattatgaggaataccgttcaatcctgcccagatgatgggtggattgagcggtatttttttgcgttgccatttttccacaaaatgaggacacgtaccatcaagcgcgaaactttttgcgtaatgtatagccgacagcgaaaatagcgcgatgagatggaggatggcatatgctaaattgtgtgagtttgacgggtcggctgacgaaggaaccagaggtgtttaaaacagcagctgatttggagctggttcgctttacgctggctgtggatcgggtttttaagaacaaaaccggacaacgcgaaacggattttatcgagtgcgtgatttttggcaaacgggcgttgacgtttgccagctcaacaacgaaggggtcgctcatcggcgttgccgggcgcatcagtaacaaccattttgaaaataaacaaggtgaacagcggtggcggacgtcggtggtggttgataattttgcgtggttggagtcgcgggcgatgaccgaaagtcggcggaccggcaccttgcaggcaaccggcactgatgggatgccagcaggtgatccgtcagcctcaccggagctggctacggatgatttaccattttagcagtagtattcggagcgaatctatgctacaattttaccttgtgagtatccggctatttttgtagccttattactccttgctccggcaaacgaccggggcctaaagtccataaggaggtgaatcgtcatggctgaaaccaagtatgaagtaacttacatcattcgtcctgatttagacgatgctgcaaagactgatttggttgaacgttttgacaatattttgaaggaaaatggtgccagcatcattgattccaaggattggcaaaagcgtaagctcgcatatgagatcaacaagtataacgaaggtctctatcatatcgtgaacttgtccgcagaagatgacaaagcgatcaatgaatttgaccgtcttgccaagatcaataatgatattctgcgtcacatgatcgtgaagcgagaagactaattgtaactttttgaaaggggcgctacggcatgcttaacagtgttgcattgacaggtcgtttaaccagagatgttgacttgcgctatacgcaaagcggtacagctgtcggttcattcactttggccgttgatcgccagttccgcagtgcaaacggtgaacgggaaaccgactttatcaattgtgtgatctggcgtaagtcagcggagaatttcgcaaacttcaccaagaaaggctcactggtcgggattgaaggacacattcagacgcgttcttacgataatgcgcaagggcagaaagtctatgtgaccgaagtcgtcgttgagaactttgcattgctggaatcacgggcaacgacacaacaacggccgtccgaatctgcgaatcccgctggccaaggcaaccagaattatggcggtgggcagcagtttggtaataaccagcagccgcaaaacccacctagctttggttcccaaagcgccccgaacaatgcaccatcatcgaatccgggccaaaacccggcagcaggtcaaagccaaggcaacaatggcaatgctgctaatcccgatccttttgccaataatggtaaaccgatcgatatttccgatgatgatctgccattctaatgtgtgactaaggtcatgcttagcgaagacattggttcgtaaggaagcaatgtcgacttggaatctttgatagagaaggaggaattctcatggcacaacaacgccgtggtggccgtcgtcgtcgtaaagtcgacttcatcgccgctaaccacatcgaatacatcgattataaagacacgaacttgttggatcggtttatctcagaacgaggcaagattttgccacgtcgggtaaccggcaccagcgctaagaaccaacgtaagctgacgatcgcaatcaagcgagcgcggattatgggtcttctgccgtttgtttcggaagactaatatcggtatttaaaaaggatgtttctgccaatcgcggcagaaacatcctttttttgtgctcgtcagtcagcaccgttaattactttaattgcgccaacattgccttattgaattccggcaagtcatcaggtgtccggcttgtcactaagttatggtcaacgacgaccggttcatttttaacgatggcccctgcatagtaaagatccgggcgaacggttgtgtaggcggtcatggtgcggcccttggtcaagcctgtctggatgaagaattgcggtccgtggcagatcgcaaagactggcttgtcggccaacaggaaggctttgacgaaattaacaaagcgatcatcagctcgaagttcatctggcgaaaaaccgcctggaagcagtaagccgtcaaaatcatccggtttgacatcggtaatcgtggtgtcgatcgttgccgttgcgccatgtttaccggtaatttgcttcccagcttgcgtttcaatcaaagtgacgtcatggccctgatcctttaacgctttgacgggtgaggttaattccgcatcctcgaagttatcggtaaccagaacagcaatttttgccattttaaaagcccctttcagcatgtattactattctagtttaacggtttaaaagtgttgatgcaaaggattaaaatcctaattttgtgtgaactatccaggattatggatgaacaactctataagtttcaagaaaatgagcggccgtatcagagtcatattaacagcagtccctcgttattttggcaaacaaacagaggcgtgctaacccgctgactagtaacttatgttaacgttagctaatgcgaacaaaatcacaagcttatcgttatatcaaattttgattttgttttacaatgacgatgatcagaagagcaaaatgaacttatatcaggggtttgattatcagaggtgatcaaaatggggctcacattagccgcgatcccgttggctgtcacgaacttatcgcgaatgcagtttgcggtgaccgccattacgcactttctatttgtgacaaccaccatcgggatgttgctgacgaccatgatttttgaatttttatatgcctatggtcgtggcgacactgaaaaatacggccgtttaacgctattctttagccgtatctttttctttagttttgggaccggcgttgtcaccgggttgattatggaatttcaattcggcatgaactggtcggcctttacccgcttgatgggcgatgtttctggtgtaccgttagccattgaaagtatgatttcgttcttcattgaatcaactatcatcggtttgtggcggtttacttggggtaaattgccaaaacgcgcccacgcttggctaggcgttgggatgttgggagcatcactgttttccgtcgtttggattattgcgattaatgcctttatgcaaaatccttatggcttccacttggaaaatggccgtgcccgtttggacagtttgattacgttgttacagaatccacagtaccggccggaatttttacacgttttatttgcaattctgatcaccggcgggtttgtgacagccggcatctcggcctggcagattctgcataagcgtgatactgcggcgttcaaaattgccgttcaaatcggtttactgattgcgttgccagcggccttcctacagcctgcacaaggtgacgatcagggtgccgcaaccgccgcactgcagccgatgaagttcacggcaattgaaggacgctatgatttggaagggagtgccacaaccggtgcgccttgggcaatggctgcgctgatcaatgaaaaggatcacacgaccaaagccatttcgattccgaacatgggcacgtattttggtaaaaacacgtttaccggtgcgatgcctggcatgaatcaagtggccaaaatgtatcatgcaaagtttgataagaccgttgccaaatcctatgacggccagatgaattactatccgccagtaacgctgctgttctggacgatgcatctgatggtttatgcaggctacttcttcactatgtttgcgctgtttgcaaccattatgctgcaccggcgtgagtcgacaattgaggagcatccaaagacgctgcggacgttgggctggacgttatggcttccgtacctgacgtttacttcaggctggattgttgctgaagtcggtcgctatccgtttgttgtctacggcttgctgacacagtatgatgcggtttcgccaagtttaacggcgacggaggcgggaacgagtctcgccttgttcttcattgctgacgtcttcttggtaagcaccatgatttatatctcgcatcgtaccgtcacccgtggcttgccacagattaccggcgattatccggaagaccggaccattccagatccgtttgcaaaggaggcgttcagccatgcctagtctttccaatttgcaagtcattttcctcggcatcatttctaccgagctgatgttgttcttcgtccttgatggcgccgattttggtgctggaatggcaacgttctttgtgggcgatgatttgtcacggcggcaacagattatgaaagtaaccggaccggtgtggggcggcaatgaaacctgggccgttactgcatttgccgtcatgtttgccgcatatcctggctggtattcggcgttgacctccggctattatccattgattttcctgatgctgttcttcttgatttttcgcggcgtcgcgtttgattatcgcaatcaatggcatagccgacactataatcagttctgggactgggcgttgtttatcggcagtctgatgccaccgttcctgctcggcatcgtctttagctccacggtcagcggcgtgccgattcgtaatgggtttgtctatgccagcatgggcgacattctgacaccgttcagcatcttaggcggtattttagcggtcttgctgagtctgaatgtcggcttgacccgagtgatcaaaaaagtcagtgccaatgtcgctgaacaattaaccgtggccctgaaacgcacaacttgggcactttatgcggcggttgtcctatttgccgtcctgttgccgttctatacccggttcttcaccaatcggccagtcatcgtctcgttactgctgatcttgttggtcgcgttccttggggttgagacttggtccattgctaaccaccatccgcgtgtgacgttctggctcagtgtcggcacgatggccagcttcatttacaccattttcctcggcgtctttccaacgctgattgtcggtcgggcgcgaggcacctcagtcaccgccttaaccgcaaccagcggcccggtttcactactttggactgcatggctgtttggcttcacgatcatcttgatggtcggcttacaggcaaccgcctatcacctgatcaataagtattacaacgcaccggcatcgccaatgatttaggctataacgcgttcaccggtgcaggagcctgcatataaggacgcccaaggtcacttatactccggctcctaaacgcgccggttcacgctcggcataacgcgtttgctggcgcaggagcctgtgtataagaaccttggtcgcaatggtcaaagcccgaccatctcatctcgcccaaggccacttatactccggctcctgaacgcgccagctcacgctcagcaaaagggagtgtgtactatgaaaaaaatctggatcaatattttctggggcctgctagtcgttggcttctggctctaccaagtcttctggccggtattctggaacccgatcagtaagttttacggcaatgtcgctttgtacaccattgcgctcatcgctttgggattcgcgattcgggcaaccttaaagggatatggccggcagaaggcttgagaaaagtttcgtacgaaggacacttgaaacttccacagtgattgtgtggggcttcgggtgtcttttttacgtataagttgcgcgacgcatagtgagttatcatcagtcgacgtgagctgcttgttcatatgtactagttaagtttttgaggttgaatgatttcggccaaaagtaaaatctaagatgttgccttaatacaagtgctgatgtcgtaaaaaggttcatttgagtcaaaaatattgagtaaaacgacgttaattggccaaaagtcgacgtttattttttttatgacaaaaaatttgaatctgtagttatactaaaaaagtaaagtcgactttgcaaaaacaagtacagtttttccatgaaagtttttgatgatctttatagtattgtcaattattttcgtgagagccacatgtcattcagttaaaaaggagcatatacatgaataacttagatattttgagtacaaatgagttgcagtcaattgttggtggggatgcagggaaatgccttgccggaaccgttggcggcggtgttgggggtatcctaacaggagcagggttaggtgcaaaaactaaaaatgtgtatgttattggaggattaggcattttagggggtattgggggcgctatcgccggtgcttcgcaaacttgtttttaagcttcttttttggatctgtaccggattagccaatgtccttgttagattgttggtcggtgatacattcgggcgggccatgttgaatgtgttaacaataattccgcttttttggataattgttacgctcgcagaaatgatggtgaagtatttttctgtgaagagttttgcaacggaggatgaacatgaacgaaataagaaagttaagtgaacttgaaatgcaaaaaattgttggaggtcgtgatgtcggtaagtgctttttggggcttgttggcggtggaactattggtggtttgaacggagcatcggctttaagtggatttggtccagcaggcatcactctcggtggtctttacgggacactcggtggtattctaagtggatattccgtaggctgctaattcccaatggctaatacgtatcctgttttgataagcctcaattgtcttagacgttaaaataaattgatgtctaaaactggtcaaaagatactctagtattcttgcaaaagcagccttctcatgcaccgaactgaggagactgttttttgacgtataaggaattataaatttttgccggatttaaaatcgaagtgcaacatcggttgaagtagaccaatccattgggaatagtttaacaaaacaggccataaagacctatccttgaagcgtcaaaacaacaagaaatgtgatatcttcacgactcaatacaagtttaacagcactcgacattacactcaattcaccgctgaagatcgtcggcgtcattgaggggctttatcgtacgaaagccttttctactagaaggattgtcgatcgtcatcaccgatcgccgagtaccatcagtcgggaacttgatcgtggtaagatccgtcaactaaggttgaactacctgtcttacgaggtatacttcgctgatactttgcagattctacataagcagcgttgctaacacgactactagaaggggcgctggcacttcttcgtcactggctcacgaccaaagtcaaaaagaccaagcttcgcctgcaaagaatcgatggttactgtcatctaattaagcgtctctacctctcccgtgcctgtccttcaacgccgaccgtttatcgttacctcgaccgcgggctcttgctcttggacaagacggctaacccgagaagctccaccaccatatcaaacacataagttgtcaccatgaacgcgggaacaaacgccttgcaggaacttccatcgaacagcggccgcaagcggtgaatgaacgtaaaacctttgggattgggaaggcgatctgatgaaaggtaaacggcgtcctcaacgaaccggcgctactcaccctagcagagcgtaagagccgctgtgagttgatctacaaacttcctgattccacgcccaaacctgcctcaatgtcttacaacagatcattgacacgaagagagccagctggttccattcgattaactttttgtccgctgatcatactgtagcccaatggggagattcgaagaagctcaaccgcactacttagtctaggtcaattaatttgcaatcaacacacattaacttagttattgagtcgcttatggctaaacagcgctccggatagttcatgtgaagcttagtgtgttctgtaatcccaaactcatcatttgctaatttttaaacatcaatttttaacataataaactaattgtttttgtcggtatgtaagaagcaatgttttaataataaataaaatgctaattattatacactccaattattaaactgaagtacagcaaaaaaacattgacatgatcacgtgccatttgttaatttgtctttagaaaaacgttttccacttaaaaagctttttgttctcactatcgcaactgatatgaggaggaaaagtatgttcaaagaaacaatcgtacctttgtcagatgctgaaatttctaagatcaccgggggtggaggcggtaaatactatggtaatggtgtttattgcaccaagaaaaagtgctacgtaaactggggagaagctatcaacagcatcggaaacaatatggcagcaaactggtttactggcggtcaagcgggttggaattctggcatcaagtaatattggtacaaagaggccagcgctaatacgctcattctgaaaagctcaaagttctgtgattgcatagatctaaaagcgcaacgttcatggggtgaaattatgggtattttaaaatggtactctggcggtaatgatcgggccaaacaggcaacggatatcattgatcaactgcttcttgacttgaagaacaatccacaaagcgcgtctcttcagcaagtactgaggaattatcgtgaagccctaattcaaaaacaagccgctgtcccacttattttaagtcggatgaatctggaaatttctaatgtcttaataagagacaggattacattgaccaagctgcagtctgacaaaattggacaactttcttcactgtcaaatatcagatatggctattgaatatgacattagaaactacaatggtgactttttgtcctgttcaaaaccgcaatgtattcctagccatctgatgaacggtattagcagatacttgtgacggatactaatcaggaacggcaccgctttcactctattaagcgcattcatttatgcactaacagagaagactcatggaggaaacaactacatgaacacaacgaacgctattcacgccatgaagctagatgcaagcaccctcgaaaagatcaaaggcggcactaacgaagactttctgaatgctgcacaagcatctgaaaagtcaaatttggttcgcgtgccaccaattgaacgtccgaagcatggcaaaagatatccgattcctattgttaaaccgattctgcaggatatctaactctactgatatctaccattactagaaaacggaggtttcatatgtataaagctaagctgaataatcttggaaacgccgaggtccttgctaacaatgaacttcaggtaactatcgggggtggtagccgagttcccgttaccggaggcgggggtgccggctttacgtttaaaatctcggatctccctggcccgaaaggaccaacctatcactcaggtcctagaaaatctcgtcgtgctggacgtcattacgcaataaactaagacctgcttgtcgataagttgtagtttaagagaaaataaagtctacgtgtttcaaaaaggcggatctgaccaaatccgcctttttgccaacttgtgatcaaattgtttgtcactaacattgcaacagtgcctaaaagagagagaggtttaaacatatgcttttgaagttgaagaaggctaatctacttgcaatattttttgcagccaaaggaattctctttatttgctgcatgcttctattcttctattggctatttcttattttgacgaatacattcttaattccatcttctaactttgttggaaatattccctcaattctacgaggagagctgtggtacatcgtaacaggctctatttatcacgcagaattgaaccatctattgataaacattcttccgattattattttgggacctttcatagaatggaagatcggaagcatggctcttgtaaccagcttttttgtctctagttggattgcgaccctcctattttgttttgtgtttgggggatacattcaaacatctttcggaatcggcctctatatttatacgtttaacggtgcgtcactgtcggtatatgccctatttccgttggttgtattagcatttttcataaaaaagccagctttttctttaatttcaaaaattattttatttggattcttttggtatttcattttcggacttattcctaacgtaagtgcttcagacgttgagatcttgacacaaattgcgcatttatgtggtgtccttgccggtctcctttgcacattcataattttgatcttaagaaattggaaaaagataccgttccttagacccaaaacgatcagctaaccaactgacactgctgctttaaaaattaagggaagctctatggttaacattaaatatggatttgccagccgttataaccgctactactcaccacagattgatgaacgtgactgtggtgttgccgcgctcaatatgatactgagatataacaagtcagactattcgctcacccgattaagacaattagcgaaaaccgaccaggaaggaacgacagcattaggcattgttcgagccgcggaaagcttagactttgagaccagtccaataaaaacggacatgagtttgtttaattaatgtatcccggtttttagaaatgggcattatgacgacactttttccagggtgttgtctttttttgccaaaaatatcagttgacaccactaaccaacaaatgataaggtaacagtcgcttcttaatcgtaatggttacgttttagaaagcgaggtaggtagcttcaaaaatagccacacatactgaccgcatgtctataggtagaagcgatcattcacaactgaatagcaaagggtcactaacgctggctcagcctgatgcccaggctgacgaaagtttacaagggggtcatttatgtttgcacttgtctgtttcctgatcatgctgccgatgatctttagcgtaccgctgttatacgtgggtatgttacctcgctcccggcagcagcccgcacttttaaccatgagcgttgcgttgatgatggcgatcggctgctggttggtgtttgggaattacctggcgtttggcaccaatctgttacaggttaaccgttttgcggatttgctgggtggcttggtgcagatggatttttacttatatgcgatcgccatgttgatcgggaccgttgttggctttaagcatagtcgttacttggtgatttttgtgccggtttggacggcgttggtttattgcccgctggcgcactggctatggtcggatggcggttggttgcagcgactgggtgcactggatttttccggcggtattgtcgtgcatctgacggcggggctgaccagtcttgtcttggcaaaatcgttgacccgcagtcgtgaggcggttgtggcgaatgattttcgtacggattacgccgcaacgatcatgatactggtgggctggttaggctttaatttagcgccggtgggtggcctgaatgcccaggctttgcaggtgctgatcaaaacgctcattacggttttggcggcgattgccggctggtgctggttgacgtattggcgaacgcaatcggtgagcttaggtgacttactgaatggcattttatgcggattagtgacgagtacggctttggtcggctatgtcggcgcaggcaccatgtccgtagtcgccgttgtttccggcgggttatgtcaaacagcggtcgtgaaaatgcaacatgctaaaagattctacgatgcggttgattcttttgcgattaatgctgttggcggattgactggcgttatcgggctgatggtggcgcgattggtgacgcgccaggatggtgtccgtttcgctggcgtggagctgttggcggtcttggtgacggttgggttgaccgttgtcggcacctttttggctcaggctgcggcgcatgtgagtgaaaccggactgaatcgattaacggtgcgtgacagtaagcgtctggattgatgtaaggagaaataaatagatgaatcaaattacgattattggtggcggggcagccggaattggcgtcggcgtcattttgaaacaattaggttgtcagcaatttcagattttggagcaaggtgagattggcgaaagttttcgcaactggccaaaagaaacccgttttatcacgccatcatttaccagcaatggtttcggtatgccggacttaaatgccgttaccatggaaacgtcgccggcatatacgctggggacggaacatcttagtggaccctagtttgccgattatttgaagctggtggcagagacttatacgttaccgattgctgaacatacacgtgttggcgccattacggccaatgcagacagctataccattgagaccgatcatggtgtcgttgaaagtaaatatctgattatggcggtcgggcaatttgcttttccgaagttaaccgatcaccctgaaaatgtcattcactatcagcaggtgcattcctggcaggatttgccaggggaaacccaaattgtcatcggtggcaatgaaagcggcgtggatgctgcgatcaatctggccacgcttgggcataaagttttgatgatcacggaatcgaccggcttaaacgctgcttcacctgatcccagcatccgcctggctccatacactcggcgtcggttcttggatttgccgccagcagttgcggatcggatcaccttacaacaaaatgcgactttaaaaacggtgaccagcgattccccatcacagtatcagttgtggttcaccgacggccgcaccatcacgacgccatacaaaccgatcttgtgcacgggattcaacccgggcccgctaaaattatggccggaacttttcgaaagtgctgatggcgaaatcaagttaagtgacgttgatgaatcgacccgcgccaaaaacgtgtttgttgtcggtccggacgttcgccaccaagacgcgatcttctgctacatttacaagtttcgccaacggtttggtgtcatcgtgaatgaaatagccgcacgggaaaaatgggacattggcgattttgtaacggtgagtcgtgccaacagtttctatcttgacgattgcgacacatgcgatgtggcgtgcgattgctaggatttaacgcacctgccgcgtcgttgcattgcctgttgcgctgaagacgcggcaatgcaatgaccacaacaaccataaaaagaagcctccggacctatgcacttgcatagattcgaaggcttcttttggttcccgcggtatttttaggttggtatccgaaaatgggatcccaagacgtgattaagggtgggtaaaattactggtggatataagtgtagctgcttgcaccagagatggtctgggtgttcgggccggttggtgagctgaagcccatgccgccttgggaaatggtgacgctgtcgccggaaacggattgaacgtaagcaacgtgaccatattgaccatcagcagtccattgcccgccaacggattggccagcagcgaagacaatgattgagccggctgccggtgtgtggttaaccgtgaagcctgcagctgcagcggaagcgccccattcagcgccgttgccccagccattgcctgcccatgaagcaacagacttaacataccaggtgcactgaccccaaggataagtgttggctgaactactgtaatcagcatggctgccgctacctgaattggtgttgttgctgatgacggatgatgtggcaccactgttggaagaagtgctggttgtggagagggtgctttggcttgaagcagccttagttgttgaactgctgctgtcggcactcttgcttgatgcagaaccggtcgatgcagcgaccgtcttcaaagcagcttgggttgccgcagcggtcttttcctgttcttgggcgaactggctctgcaatgcaaccaattcgtcacggtgatcattgatttgcttgttcaaggcatcctgcttgtcgctagctgtcttttgcaaggtaaccaactgagacttctgggtttcaagcgatgacttggttgaaaccaacgtctgacgcgctgtttcctgttggttcttcaatgctgccagtttatccttggcaacagtcacagcgtccagcgcttccttgctggcttggctgagtttgccaacggtcatggtgcgggcgatcaggtctgaaagactttgtgagttcaacacgaagtcaatgtagacattaccgctaaccgagctgccagccttcttttgaagggaaatcaactgatccttcaaattgttcttccgtgccgtcacgttcttttgggcagccgtgatttggccgctcaatgatttgatctgggcatctgttgcactgatcttggctgtggcatcactgatttgcgaattcttatcatcaatctgcttgttaagattgatgacttcagtgttggctgcttcgatttgctttaataattcgttggtttcgcttttgttagaagcgatgctggcactcgtgtcagcgaaaaccggtgtaacggcgctggcagtacctgctaaggtaactgcggcaaccaatgtaatcatagctttattgaatttcattttgacctcacccttaattaattaactaaaggctactttactgtgtcaatgttacgtcaccattacagaactgttaggagttgttctcaatcttcatctggcggtcaaatttacgtgattttaggtttttattcggcagttttggtgaattttggatgaaaaaaagcagccgcgcgctgcgactgcatgacaaaattgtaagttattcgttggatttaagcgcttcgaccatgtcaacccgctgaaggcgccggtgggtgagccaagtgacaatggcagtaaagccgatcatcagcagcgtggccgtgaggtagccggtgaaactgatagtcaatgggaaaacgacgtcggcagtttctgcctgttgcaaaatgtacgccgtcaaaagattgcctaacccataaccgaagagaatgccgacaatcgtctgcacgatgctttcacgactgatatacatagtgacttcacgatcgaagaatcccagcaccttaattgtggacaattcccgaatgcgttcggaaacgttgatattgttcaggttgtacaggaccacgaaggataaaacggcacttaagagaatgaagatcaggacaatcggatccagcatgccgctcatgttgctaagcgtctttttcgctgtggtggtaaagctgatgccgataatggcatggtgattcagaagacgcttggctaatcgatcgttttgcttcgtggtctgcgggcgtaagcgaacgagcaaagcgttgggatctgtgtgctgaccggcaagttgccgatagctggtgtttgagagataggcaaaatgaccgacatagtttttggcgatgcctttaatcttaaagctatgtttcttgccatccgttgtggtgatttttaagcgatcgccagtgccgactttaagtgatttggccactttgctggtaataacgatgccggaacgcggcaacgtcaacttttggttggttttggttgagcggaggctgacgtatggttcaagggagctgccgcttgatggagcaaagaggttaacatcgctgatttggtggccattgacgctgagcttggccacagcgctgctgacagtgccggcgctgcgataggcattgcttttcttcaagacggtgcgcgctgctgtaggagttttaccatccgccaagcgagcgatggcttggtaatgaaccacatcattgtattgcaaggtgcccgtggcagtgatggaatccttgatgccgaagccggtaagaattaaggcggttccgccggcgatgccaagaatggtcatgatgagccgtgatttataccggaaaaggttgcggtagctgactttttgattaaaagaaagtcgcgaccataatggcgtgatccgttcaagtaaaatgcgtttagcggatttaggtgcccgcggacgcatcaaggctgccggtttttcggttaattcgttgcggacaacgatgatggcggcgcccaacgtggcaattaaggcgagtacgatcgacaaggcaatgagtggccattgcagcgtcacgacttgtttgagtgggatgtagtttttatacaaactcaagacgatccgcggaatgctgagattgccggcaaaaacgccgatgactccgccgaataaaccggcaagtgccgcataagcaagataattccgggcaatggcccatttgccgtaaccaagtgctttaaacgtgccgatttgcgcgcgggcttcttcgaccatgcggctgacggttgtaaaggtgatgagggcggccacaaggaaaaagaacaccgggaacacattagcgattgcggcaattcgatccgctgatccgccgtagtcaccgaatcctggcaggtcgctccgcgtttgccaagtgaggctggtggtcagttgtttctgcgcccgcgtgctggcttgttttttcagcgtcgcttgttgcttctgaaccgccgcctgcgcggtcgtggcagcggcactggctggcatacctgctgcggtggcctgggcagtggccttcttggtggcggcctgcacaattttggcttcgatcatggtttgcaaatctttttgtgcctggtctttgacgcggcgtttgacttgtttcattttggcggcaaccgcatctttgtaagaagaactgaatgtgtcgcgcttttgcagtcccgggaagcggatgttcaattgcgaggcaaccggcatgttcatttgttgatcaggaatataggcaaaataccgtaccgtgccatccccgatattggcggatccgcggctggtgtcttcaatgtaggccggcgagtccgcgaagccggtgatcgtgtaggttcgccggttgagaccgctgttgcgggcgaatgtgtaatgttgcccgagtttgtagccgctttttttggcgactgaatctagcacgatttcgttatggtgggtcggcaagtggccgctggtcaggtggaggcggttgatcgtggccgttttttggtagccgtacaaggcgacgacatcgctggccttgccaccaattgcgtatttgaacttgacggcttctgcctgagtgccgctaaccgattgtgctgccttgacctgggctttggtgacgccagtggttgccaggagctggctgtcagcgagatgatcggctttaacggtcgtgttcaaggagtccttgagcgctggaccggtcgctttgaccccgacaaataaaagaacgccaagcataatgatgatgacaatcgcgatgaatcggcccaatgaatcacgaatgtttcgccaaagatttttcgttaatggtttcaaactgatcacctaccactcaatatctgcgactggcgttggtgcggcttcgtcatgaatgctgcggacctgcgcatcattgatttcgataacccgatcagccattttggcaatcgcagcgttgtgagtgatgatcaaaacggttttatgatctttgcggctggcatcctgtaatagttgtagcacttgcttaccggtcttgtaatccagcgcgccagttggttcgtcacacagcagcagcttcggattcttcgccaaggcgcgggcaatcgccacccgctgctgctcgccgccggaaagctgcgaaggaaaattgtccagccgcgcgcctaaaccaacttgctgcaacacggtggtcggatccaacgcatctttcacaatggacccagccagctcaacgttttccttagtcgtcaggttcgggattagattgtaaaactgaaaaacaaaaccgacattgtgccgccgaaaagccgtgagttgcttatcggaaaacgtcgcaatgtcagtcccgtcaatccagacctccccttctgtgggcgaatccatcccgcctaaaatattcagcagcgtcgacttgcccgcgccgctggggccgaggataaccgtcagcttaccttgatccgcggtaaaattgatatcctgattggcggtaatggtggtttcccccattttgtaacgtttagattcatgtttgacttcgatatatgccaatattaaaaaacctcctacgatcgcattgagctgagcatgtgccgctggtctgcccataaattcaacacgttgttcattgaatgacattatgttagattaaaagtattcgttcaagcacagaaacggaaaatctgttttgaaatgaacactttgttgaaatcatgttggtttagaggtgaacgttgatgtcagggacacgggacaatcgccgggttcagtatacggtgagtcggtttaagaccgccttactgcagattttggaaaccaaggcgctggatgacgtgaccgtaacggagatttgtcggcaggcggatctgaatcgcggaaccttttacttgcacttccagtcgcccttggctttattcgaacaaattgaaaccgatttactcaatgaaatccaaccgtatctcagtgttaaaatagacgatatgaccaggatgttagtgccgattctcaaggtcattatgcaacatccgcaagccgcaacgattcttttaaccacaccggatagttcggttttacaaaaaatcgtgcggccgattcaggcacaaacgcagtcacgttatcaaacttggtacggcgagaccgataaagatcatctcgattattattatacgtttttcattaatggggccgtgggtgtattaaccatgtggctgaagcatggcatgcaagagccgccggagcaaattgcgaaggtgatcgagaacgtggttaccaaaggggcgccgcactaactaattcgtttatgggagaaaaagatgcgaaatgtaaaattaattgccagtgatatggaccagacgctgttaaccagcaaaggcgtcttaccaccgcactttgatcgttacttacaccggcttcatcaggcaggcatcgaattcgtcgctgccagtggccgaccgttatatacgctgcaggaaacttttccacacttcagccagcacatctcgctggtttgcgataatggcggtttagtggcaacgcatggccatatcatcggaaaaagtttgatttccgcggccaagtatcgcgagattgtgtcattcattcttgaaaaaaccgatggcgttccggtgctatgtgccttggatgccgcgtatatcaatgcggttgatgccaaatatgcaccggcgctgttgccgttttaccacaagctcaaaaaggtgccgaatttgctggatatgtcgctagaagtcgataaggtcacgatttattttcctaatgcggatagtcgcaaaaatgccgatcgttattttcggccagtgtttggtcaggattatacggttcaggtgagtggcgaaacttggttggatattcaaaatctcggcgtgaataaaggccgcgggatgcggattttgagtcggcattttgatattccgactgctcagatgatggcgtttggtgattatgataatgatattccgatgctggagacagttggttacagttatattatggcgaatgcgacgcagggtatggcacagcatgccaaatatcgtacccgtagcaatgatgaatatggcgttttacatgtgatggatcaagtcttgcaggcgcaggaaggctaggcgagcgcatggcggcaatcgggatgcgtgtggtgattggcggttatgggtttgtgatgctgctggttgcctggcaggcgtggcaagccaaacaaggtaacccgcttttcaatcaactaacggcgctggctgcggtcttggtgctgacagcggcggtgattccggataaggtcaacgcggtcatcgttttgttgatcgggttgctgggtttgtccgcagtggcgtggcttaatgggatagcaatgtacggcaagccgcacgtaagccatcacttggtaagattattggtacatttggttttgtttgggttagcggtttggttgttataactgaatcattcagtatggtatgcgtaagaaaagttttcgaaactgagccgtaattttgtaagaacgttcaaaaaagctcaggcaataagttctgggtcgtgccaaactccgcaatctccggccagctggggctggaacgtggtgggcgcgactttgagcctcagcaaacccggctgagtctcaaagctcggccttggtctaaaacgggaaaaccgcccgtttaagaccaatttcaccactgagccccatctggcctacgattgctccgctttggcactactatacttaagcaatttgaacgaattatcctcgtggaaacaaaaatgaacgcacttccgaaatttgggatgcgttcatttttatttcggagtcataaattatgaaccggcttcgagaagcttttgttgataatgtcaaatttcattagaaataggcttgggcgaacagcttggcggccaacaggaaagccaaaacggcaatgataacgcgtagtaactgcactggcagtcgccgggcgatgatggggccaatgtagccaccaatgaaaaggccgatgccgagggggatgaccatgagccattcgattttggtcgtgaaagcgtatatgacggtggcgatgccattagccgcaaagccggttagatttttcattgaattggacacaatgaagggctggtccacggtcagggtcaacgttgccaacatcacgacgccggcagcagcaccgaagtaaccggcataggctccggtcacgaagataacgatggtctgcagcgcttcttggcgaaatgtcagacggcgcgccggttcattcgggtcatgttcctgcgtgggcagtttgccgctgaacaacaataacaggcccgcggcaataataaagaacggcacaattttttcaaaagtcgatgcaggtgcaatcagcaacaaggcgctgccgaaaatgctgccgagtgaaaccaacaggatgagccgccacagaaatttgccgcgtccatgcagttcaggcagggatgaaactgctgagccgacaccggtgaataccaaggcggcggtgttggtcacattggcaatcaccggtggcaccccgatggccaacaacgccgggtaagaaaccaacgaagccagcccagccagcgtggccgtcaggccagcaccgatgccggcaatgagtaggaaagcgaaaatcgcgagagtcatgaagtcaatctcctctaaaagaatgagcgtgagccggcgcggttagaaaccggagtgtaagaggtcttgggcgtgatgggcccgggcttaagccattgcgaccaaggtccttacacgcaggtttctgcaccggggagcgcgttaaagtgaacctgagcaaaaccacatagttttattttatacgcaaactgccaaccgttgagagtcataacccacacaactaccggaacagaaggctacaccatgtttgcatgctaccaactactttggcgtcaaagccttaatcgttgcggtaatgctgtggttcacggtgtcggcgtctagcggctgattgaagtataaaaatccaagaatcaagccgctggtagtcgaccagatagctcttaaaatatcttcaaacggccagtcaaccagcacgccccgttgtttcaggacggttaaatcatgcgtcatcgtctgccaatattgggctgtgaagttgccaatgacctgttcacgaacctgcgtgtcatttaacaattccgatagaacgattttgataatttgcgcattcgcctgcaaaaaagtaatgcgatctttgattaaaacggttagaaaagtttccaatgacacataatcctgattcaaccgggatttaatgaagtcatccagttcggccgggaacatctggtcgagtaccggtgtgataatggcgttcaataggccgcgtttgttggtgaagcggctgtaaatattaccttcggcgaccccggcccgcgcggcgatttccttcgtactggttgcggcgtaccccttctcggcaaacacatcaatggcggcgatgataatcagtttctgtttagccgtgaaatcattaaataattgcgcttgatgcaacatgtcatcagttgaattggccatgtaccaggatcccttcttaaattggattaagtgaaaacttaaagccggcagtgtggttttattatagcacgcgatgagcgccgtcaataggggctttaggcaataagttaagttagcctaacctttttcttgacctcgcttgggaagggtgtatatttatctcggacgatgttgagtgatagctcaatcgagacccaaatttcaaaccaatggaaagagggctttatatcatggaaaaagaaaataaaaactcaaaacgtgagcggatcattcattttgaagacacgccgagtaaaagtctagatgaagttaacggcagtgttgaagtgccgcacaatgccggtttttggcggacactagccgcttataccggaccgggtattctggttgccgtggggtacatggatcccggtaactggatcaccagtattgccggcggggcttcattcaagtactcactgctttcagttattttgatttccagtttgatcgcgatgttgctgcaggcaatggcggcaaggctgggaatcgtgaccggtaaggacctggcgcagatgacgcgtgagcataccggacgtgtcatgggcggttttctttgggttgttaccgaattagcaattatggcaacagatgtagccgagattatcgggtcggccattgcgctaaaactgcttttcaagatgccgctgattgtcggcattatcattactacgacagatgttttaattctgttactactcatgcgcctcggctttcgaaaaatcgaagcggtggttgctactttagtcctcgtcattctgctggttttcgcctatgaagtcattttggcccaacccaacgtgccggaaatgttaaaaggctacgtgccacacgctgatattgttactaataaatccatgttgtacctttcactagggatcgtgggtgcgacggtcatgccgcatgatcttttccttggatcatcgatttcccagacgcgtaaaattgatcgcagcaagccagacgatgtcaaacgggcgattaagttttcaacgattgattccaacttgcaactgacgatggcgtttatcgtcaactcattactgttaattcttggagcggcgcttttcttcggcaccaatagctcattaggccgctttgtagatcttttcaatgccttaagcaattcacagattgtcggcgccattgccagcccgatgctttccatgttgtttgcgatcgcattgctggcatccggtcaaagttcaacgatcaccgggacgctagccggccagattattatggaaggtttcatccatctgaaaatgccgctctgggcacagcgcattctgacgcggctcatgtccgtcacgccggtcttgattttcgccatttattatcacggcaacgaagccaagattgagggactgctgacgttttcgcaggttttcctaagcgtcgcgctaccgttcgctgtcatcccgttggtgcgctacaccagcgacaaaaagatcatgggcgaatttgccaaccacgcctgggtcaagtggctggcgtggctcatcagtgcggtgctcattatcttaaacctttacttgattgctcagacattgggctttgttaaataaataagaacggcatgcaaaaaggccactgggcggagtttcgtccagtggactttttgagtaaactagaaagcgcattatggtgagtaccgagactgtgatacgatttagcgagagaacaagtaaaaaaggaggataatcgcatgacaatccaagaaaaaatgcacaacggcgcactgtatcagccaatggatgcggatttgcaaaaagaacaactggctgacattgacgaagtggccatttataatcgcattccggcgccccatcaggaagaacgcttctcccagcttaaaaagatgtttgcggaaatcggtgaaagaagttacgttgaagcgccgttctattctaactttggtggcgcccatgttcattttggcagtggtatttatgccaacttcaatttaacgttggttgatgatacgcatatttatgtgggcgatcgaaccatgtttggtcctaacgtaaccttggtgaccgccacgcatccgattgatccgagcctgcgtgaacaaggttaccaatacaataaaccgattcatgtcggtcggaattgctggtttggcgcaaatgtcacggtcatgcctggcgtgacggtcggcgataacagtgtcattggcgctggcagtttagttacgcatgatattccggctaatgtcgtggcattcggctcaccgtgtcgggttgttcgtgagattacggatgacgatcgaaagacgtatgatcatgggaagccgattgacattgagtcgctttaaatggcagcacgaacctttagggggctggacatgacttttacatttgacggtttagtgaaggagtcagccgaacacgctgggcttaaaagaaaccaattcgacagacaagatatcgaagactatgtggtttataacatctcaaatatccagtcaagtttagaaaatttgcaggcttttcatacgctctcgtcactgagcgttctctttgaagaattcggcgttccattgagaatctcggtgatgatgaaagacaataagactaaagttgattatgtgacaataaggttgtctaaagctgaatacgatgaggcttcgcagaaagttaagtcaatggttgaacgcgcattgaagcgaaaagcggacggggaaaagtagtgcttctgcaaaagcagtgtttcgctgagtagacgttcatgattctgctttcatcaacatgctctctttaaggttgtttttggtataacgcattagcatgagtctcatcaactaatggtcaaacatggcaggtataggtcatgaaaacattcctccactaactctttttttgagtagtagaaatgagttttcatgatcttttttctagtgtatttccatttcagggaggttgacatgtcattgctctaggagtattttctcattaatatcaaattgttctaatttatttaacataaaacgcagatcgtaacaagcataccctttagacgcgtatttctgattaaggaatgaccgctatgagtcaaagaagcaactggttctacatattctccaaatttgccgctaaatatcgactcaaatttgtcgtgatcttattggggctttgtttagttgagagcgtgtatgttgcggggatatcgttgttgccttcgctcgcagttgttcttatccaagcgaaagacctgaagctagctatggtgattttgaccatcttgctcgccggggtcggtgtgtatgttatcagaatctttgatttatttttgcagcaacgcctgactttgctgacatttgattttcggtttgattacgtgccggttttctctgagcatatttttggttggcggcaaagtttgattgactcggtagatggaaaagcggttattgatcaagcttacgaagcgatttacaacgggcaaaatgttgggattggggcgatcatcgcacagacggtcaccctgattcgaacgggttgccaaattatcgtgctgcttggcatgatgggaattttgagtatttggccagctgccattgtcttggggctgaatcttttacaatatgcctttcagcgcatcggcaatcaatggtatttcaaccataaaggtgaacaaaatcagatcaccagttatcaaagttattttgtgcggacgctgatgaaacgctcaacgggtaaagatattcgcctatttgcgatgtttgatctttttcatcagcattttatagcattgattcaaaagttggtgacctggcaacgccattactcaaatctttcgctgatcattaatctgggacagcgactcgttaacgttatcggcttagcgttgtcgctgttaatcttgattgcacttcagaacgtctcaattgccagtctgctctttgcgatcagcgccatccaaacactcaacctgaactttggtaattttagggatgcctatgtgacagttgggaagaatttggtttttgttgacaattttcgaaaatttatggccttctcttaccgccaagacagcggcgcaaaagagcggaaggttagtgagtcaggtaaaattgaagttcagcatcttgcttatcaggtgaatggaaccgagcttgtgcatgacatcaattttttcgtcgagccaggagagaaagttgcgattgtcggtgagaatggcgcgggcaagtcaacactggtcaaattactttgcggcttatatacgccaagttcaggatcagtggcgattgatggccaagacatcgcgacctgggcgccagcagccatgcgccagcgagtggcggtcgaatttcaggatgacgtgatcctccattttacgattgcagaaaatgtggcttgtacaacgccgcaacagattgatacagcgcgtgttaaggcagtattggctgaagttggattgggagattttgtcgccggtttgcctagtgggattcagacattcattggcaatgagttgagtgaaaatggtattcaactttccggtgggcaaaaggacaaaatactttttgccagagttctttatcgtcaggcggatattaatatcctcgatgagccaacttcggcgcttgatccgattagtgaaaagcagttttatgcattggttgacgcgaagctgtatcagaaaacaacgatcatcgtgacgcatcggctgggggctttggcaactgagaatgtcaagattctggtcatgaaagatggcaccgttatcgcttctggaagtcaccgctggcttttaacaaattgtgactattatcgcaaactttggttggcacagaggtcattgtatgttgggagtgacggccatgaagcatcgtaaaacagaaattcggcacgggatcggaacagttcgctttatttatcgtttcgggaaaagtttattcggcttaacgttgctgataagtatcttgaatgcggtcgcgccactgattgtgatcttgggcaacacgcagatattaaatcaaattttatccaatcagcgacagtcaattatgcagatcgttttgtacttttatagtgcggcagcaatggcttatgtcggggcggccattttacagcgatttttggacattgcctcggttcgcgcaaatgagcggttgaagacggcgatttatgaagcgtgggaaaaggttgattttcagcagcttgagacgcaaggatatttttcaaagatgatgaaaagtgaggcgtcgtttcggtactctggctgcattccggctttctttacccaatttcaaaatctcgttcagagcttggtgacgatagcggctggtttgggactgatcgggtggattgtcatggtcggggccaccaagagcggcaagttggcaattgtcattgtcatgtctttgttactgatcatgttgggtgagtatggactaatcctgatctatcaaaagttgacacactcgaacatcaaactttttaagtatttaatgaacttggaacgtaagatgaactattttctgatgaatatcgtcaattcgtatgagaatatcaaggccattaaaatgtggggcttgcgcggcccgattcaaaatcggtatcgaaccacgtggaaaagtgaaaaaagtgtcaatcataagctgattatcaacgatagcctatcgcaaattgtaacggccatcatggcttcttttgcaacactcgtgttgttcatcctggttgtctttaaaataaaggaaggcttgttaccgattggccagttgaatactttgtttggcagtgttgtgcagatgacgagtgccgttagcgtgatgattgcgacttggcagcaatttcttcgtttccagaatcaagtgcagtatgccagcgacattttaccgccagaaaagcctgccgcctcatctggcagggtcacactcccgctacagacgaagaatgtgattgaatttgttcatgtatcgtttgcttatgctgatggtccggaggtgttgcatgatatttccctaaagcttgatttgcagggcgtgacagcgttagttggtgtgaacgggagcggcaagagcaccttggtcaaattgttgttggggttgtatcggccaacgaaggggaaaattctgttcaatggtcaggatatttctaagtttactcaagcagactacttggcgttgtttaaagttgtgtttcaggattacgctatttttgatttttcgattgcccagaacatttcggcgagtgtcgaccaagatcaggggcgcttgcgtgacgtcatgatgaacaatggtattgccgagtgggtcgaccgcttgccgaatcgcgagaaaacggcgattggcacctatagtcaggaagattttcaacccagtggcggtcagcgacagcaaattgccgttgccagagcgcagtacaaacatggcatttaccagattctggatgaaccttcagctgccatggatccaattaaagaactaagattgttttcaaaaatcaagcaagtgtctcaagatacgccgtcactttttatcacccacagaatcggcgcggtgacattggccaacaaaatcattctgatgcgtgatgggcggattgatggcattggcacgaaaagttcactacttcgccaatcagcctattttcgggaattgtggcatagtcaagctgatatgtatgcatttgatgctaacttggatgcagctggggagtaaagcaactttttgaaaatccgcaccccaaccagtgctatcataaaaataattgaaaggaagcgggtctatgaatcagtttgtgaatcattcgagttgtaccgcgttgctggttggtaagaaggcgtcggttgacgggtcgaccatgattgcccggaatgaggatgcggctggcgggattaatcctaaacgttttattgtcgtgaagccggatgagcagccgcaacggtatgtgtcaacgtttaatgggtttcagttggatttgccgcagtcaccattgcagtatacctgcacgccggtggccgacacgagcgatggcacatggggcgaggctggaatcaatagcgacaatgtggcgatgagtgcgaccgagaccgaatttacgaataccacgatgctgggactggatccgcttgagccggacggtattggcgaagaagccatgctgacggtggtgctgccgtacattcacagcgcacgtgaaggcgtgcagcgtctgggtgacttggtgaccaagtatggcacttgtgagagtaacggcattgccttttccgatgcgaacgagatttggtattttgaaacggttggcggccatcattgggcggctgaacgcattcccgacgacagttacgttctcgcgccgaaccagaccgggattcaggaaattgattttaatgcgccggaacattttcagtacagtgccgatctgaaagactttgctgatcgctatcacttgaataaggccaaggaaggctttaattttcgcgacattttcggtgaagatacccaggcggatcactattacaatacgccgcgcgtctggtatgcccagaaaatgctgaatccggaagttgagcaagaccccgaaagccggacgatgccgtttagtcgggtgcctagtcacctgatttcggttgaagatgtggcgctggtgctgagtagtcactatcaagccaccgagtttgatccgtatgggcagacaggcacgccggaaacccgcaagcgttaccgaccgatcgggatgaatcggaatcaggagatgcatattttgcagattcggccggacatgccaaaagcgcacgcggcgattcattggctggcggaaggggtcaacattttcaacacgccggtaccgttcttcgccaactgcacgactacaccggacaacttccagtacacgccgaccgataaaagttcgacggccagcttttattggctgaacaagctgattgcgatggttgccgatccgttattcgctgaacataattgggatgccgaagtggctgtttcggaaagccgcaagtttggtttcgcagcagggcgcgcggcagtggcgaaaggcgacgaaggattttctgatgtgaagccggaggatctgccagcttggcacgacgaattgaatgccgaaaccgccgcaacgattacgaacgatttgcaatacttactgtatcggttggtttgcattcgggcagagaaaatgacgccgacgtttgaaaaaggtggcgagctataaaaaacggctgacttttgccgtgaatgcgtgtcaaataccgtcacacagcttaacacgctcaccaaaaataccgcccaatcgcaccgatgagttctcatcaatgcggttgggcgtttataatggtcgagaagatgtttcagaaaaggcaacgaagcagaaagaaggtcagctcattaaaaatacaaaaacagaacgctggatcggtttgattgtcggacttgtgctgaatgctgccggaaacggactttgcattgtcggcgcaatgggcagcggactgtggacggcagcggcgattaacctcaacgattggcaaggctggaacatcggtgccgtgctgttcacgtttggcgtgcttaacgccttgaccaacttaatcctcatccaccattgggattggccgcgcttgattagcgaaatcatttacacgctgtttttcagttattttgtcaatgtctttacctgggtgttcacatggctcggccttggaagctggtcggttctggcccgaatttttgtttcctgcttcggggttttctgcttttgcgtggcgatttcactttatcagcgcgccaacattatcatgcatcccaacgatgacaccaccaacattttgcggtttatgtatttcaaaggcaatgccacggcgtcacagattaccaatttcatcccacccatcattgtggccgtcattgcctggatcgcgacgggtaaactgctggggattaacgttgcaacgttgttctcgtttttgggcaatggtatcatcattgcgtgggccgacgagcatgtttggccgcagttgaaacataactttaaggtaacgcctgatgggcagtcgtgaagaaggattttcgttagttaggaaggtatccgaaatgaaaagaaaagaatcagttttaagccaactgccagcgctcatcgcagatccaaccaccactgggccggagttggaaattttgaaacatgcggaggaacggagacaaaaaggcaacaacgaggaaggaattgcctacgaaattagaaccggactgcaacccttagcgattggccaaaagttatcgcccaaggttgtcgactttctgacccaggttgcggcgcaatatcttggcatgggtaatcgaggcaatatcattttttagtaaatggttcttcaggatagttacactttttgccgcttgcggcatatgccgattattttctcataggtaaacctcaacacccgatcatgctggtaaatactttttcagcgtgatcgggtgtttatgttgagcccccgatttttgcgatcgggcgcagcattttccattagatttcggttgcaaccttcttagtaaatagtacactaacattaatatactaatgacggagggaccggaatgaacgatgagctgacgattcgaagtggcatccatgatgtcatgccaacggtgtttggctatattacggtggggatggcttatgggattgtggcaaaaaccggccacttgtcgctgctgatgatcgggctcatgtcgctgatcgtgtatgccggatcggcgcaattcgtattggtaagcatgttggctgccggcagcccgattggcgccatggtgatttcgactgctttgattaacgcgcggatgagtttgatgtccatgaccgtggcaccttatttaaaagatgaatcgatgacccagaatgtgctgatcggcactttgctgacagatgaaagttttgcgctgtcgatgaataaactcaattacaccaaccaccatttgaacgcaccatggttccatacggtcaatgtcggggcttacttagtctggtttgtcgctagtcttttaggtgccgtcatcggcgggatgattcccaatccggacaacttcggcttggactttgccgttgtcgcgatgttcatcgggctgctttacctacagatgattacggatcggtcaaaaccgttcctgcggcatttgagtgtcgccggagtggtcgccgtcgccatggtactgctggtgcgttatttacccggcacaacggcgatcattatcgcaacggtgattggctgtttatttggaatggaggtggaacgtcatgcaaaatcctgacacattgatcgcaatcctgagctgtggactagcaacgtggctcttacgcgtggtgccgatcgttttggtcaaacgcatgacaatccccaagtggctactgcacttcttgagttttgttccggtagccatcctctcagccatttttgtagaaaacctcctcgtcatccacgtcggtcactggcctagcgtcaactggcccaatttattagcgtccctgccagcaattggtgttgcaatcatcactaaaagtttattcgctgtcgttgtcgccggggtggtttctatggctgttttgcggttgctagggtggacttaagcaacaaaggtcggtactgagatgtcttttaaagctgttgaacaaaggcgaatgaatagttcgctttttattttcgaaagaatgattcgttaaaattgttaagatccagtgccaaagcggagcaatcggaggccagatggggctcagtggtgaaattgtactagccgggcgatcttcccggcgtagtacaaggccgagcttagagactctgccggttttgcagaggctctaagtcgtgtccaccacgttccagccccatctggccggagattgcgtagtttggcacggcgtggaatattttagtaaaaacaaatttgtttctcctcttgaaattcacagacaccctcattaactcatatatcagaattttaagacacaaacaaaatagccattgacaagttttactaaaataagtacactacaaggtgaaagcgatttcagaaaacgcactcgtaaaacttgaaatggaggctttttgcatggagacatcgttgttgtacccagtgacaaatgatcagcgcactgatcagaaactggatggactatggcaatttaagtttgatgaaacgaaacaaggcgtgaaagatggctgggagaccggctttcacgatggcgtttcgatgccggtaccggctagtttcaatgacttctttaccgataaagagagtcgcgaatataccggggatttctggtatagccgcaagtttttcgttccgtctgcggctaaaggcaaggcgctgtttctacggtttgatgccgttacccaccgcgcaacgatttttgtgaacggcaaagaaatccggtcgcatgaaggcggcttcttgccatttaccgcggacatcagcagcgccgttcactacggtgccgagaacaccgtggtcgtcaaaggcaacaacgaattgtcccgcgaagccttaccagccggcgacacgatcacgttgcggaatgggaagaaaatggttcggccattcttcgacttttataattactccggcttgaaccggtccgttcatttgctgacgttgccacaggagcgggtgttggattacaccaccacgtttgaattaaatggccaagacgctaccgtgaactatacggtgacaaccaacggggatgcccctgtaacggttagtctggccgatgctgacggccaggttgtggcaacggcccaaggcaaggaaggcgctctgcaggttaagaacgcccatctctggcaggtacgcaacgcttatctctacaccttgaccattcaagttggcgatgacgcgcagacgccggttgatacttataccgatcgcatcgggattcggacgatcaagatttccggtaccaatattctggtcaacgacaagcccatctacctgaaaggcttcggccgtcacgaagattcgccatttgccggccgtgcttttgacctgaacgttgaaaagaaggactttgccttgatgaagtggatcggcgcgaactccttccgtacctcgcattatccatatgacgagcaagtctacaagattgctgatgaagaagggttcttgctaacggatgaagtgccggcggttggtttcaaaatggctgcggcagcctttcttggcggcttgaaccagtccttctttaaagggccatggctcaagaagttgcacgaacgccatattgatcagatccgtgatttgatcaagcgcgataagaaccacccatccgttttggcatggagcctcttcaacgaacccgatacaattgatgaaaatgcggttccttacttcaaacaaattttcgacgagtccaaggatcttgacccacaaagtcggccgcggacctttaccttgagcgaagacgacaccatcgaaacgtccaaagtgctcgacttcccagacttttacatgctcaatcggtatcctggctggtatcattttggcggctaccagatttccgatggggaagccggtctgcgtgatgaaatggacaagtggcaaaaggccggcgtcacgaagccggttgtcttcaccgagttcggtgccgacaccgaagctggcttgcacaagctgccaagcgtgatgtggaccgaagaatatcaagttgaagtcctgaaaatgttcagccgcgtctttgatgactatgactttatcaaaggcgaacaagtctggaaccttgctgacttccagaccgttgagggtaacatgcgggtcaatggtaacaagaaagggatcttcacccgcgaccgccagccaaaagaagctgccttcttctaccacgatcgctggaacaagctgccgctggattataaagccaagtaacttgatctccgcgtcaaactaaaggttcatttagcgatgctgcacccatctggcgctatctgatgggtgttgtttcgcatgaccaatgccaaacgactgtttctgagaaagaagcagttgcttggtatttttttgtcttgaaaagcttatcattcagctgacaaaaattttttggtggttaaaaacgcttcatgacaggcgatgcatcgctttgagacaagcaaatttgaaataaatttataaaaattgttgtcatcaatacttcaacatgtatactaatatatgagttcttttagtaagcgcattcagtaagcgatttaacgcatgaccattcaagggggcttgcctacttttctgacagtgaaccgtagacgacatcgtaacgcgaaaaccggcgcttaatcgcgctaggtcacgttcaaaatgggaggaaaacgagcaaatgaaagcaaagataattggctggcggcccaaaggctttaacaaaaaatggctttgggccagcattgcaacggctgtcgcggcagcatccatggttttgtttttgatgataccgtcggcgacccgcgcggcaacacagaatccggaagatcctgttaccgttaagctggacgggaacgatattgccagcaacaacaccaatgggctcacgtttaaaggcttcggggttctcagcggcaatggtaccagcgccttgctgatggattataagtcagagcatcctgacgtttatgcgaaaatgatgaaaaccctgttcggcggcagtcagccccttatgaccaacgtcaaactggaaatggggaatgatcgcaacaactccaccggttcggagcctgctacccaacgaactgaatcggaaagcgccaatgtgactcgcgatcaaggttttcagctggccgctgacgctaagaaactcaatccgaatctcaaggtaacgattctgcgatggaacgcaccgggttgggccaaaaccaacgaccagatttacacctggtacaaaaattcgattttggcggcttaccgtaaatacggctacatggtcgattacgtcaaccctggattaaacgaacacgcaccggatctgacctgggcgaaggaatacgctaatcgggtcaaaaccgacacgactggcttcaagaacgataccgaacgcaaactttataacaatatcaaagtcgtgatttcagatgaagtcggcgtcggaagcttcggtaaaaagatggtgtcggattcatcgctgcgcaacgctatcacagcggccggctatcactattcaactgaagacgacagtgccaaaagctttacaacgctggctgacaagtacaacaaagaagtctggaatagtgaagcccaggcaacttttggcaattccgattatcggcctaactcaggcaccggcatcggcggtaacgggagttcgctagaaatggccaacaccattgtcaaaggctttaccgattcacggcggacgaacttcatttatcagccggccattgcatccttttatgaaggcgggcaatattcttcgaagagtgtgctgcaggcaaccgatccgtggtcaggttggacgaacaacgatgtcgcgcttgacgtactggcacagttcagcaagtttgccaaactcggctgggaaaatagcgacaatacctccggcgtttggcgggcagtttcccaagccagtgcttcgacggccaccggatctaatcctgtcaacggccgcaatggcttagccaattacttaacccttgcttcaccggacaagaaaaacttttcgacggtcattgtcaacgacagcaagtacacgaagcattaccagatttcagcgaccaatatgggctataaaggcaacccgtcgctggaagaatgggaaacccgtgcggctgattcgagtgccaccgatgcctataacagcaattacctcaagcacgtgggcgatgccagcgccgatagcaaaggggtttacacggtcaccgtgaagccgtggtcaatgatgaccgtcaccacgctggataaagcaaaagataatgatctgaagcaagacgctgctaccccatcggataaagagcgtaccgtgctggataccgatacaaacggcaaaggccatgacacttcagataacaccctttatgccgacaactacgaatatgccgggaaaaaggtggcaaccttgaacgcggatggaaccagcaatacgtcgcaaactgaagatttcatcagttcgcgtggtggcaactccggcttttacccgctctacacgttcaaccgcaacggcacacttgaaggttatcaatcgagcaacgccaagtccggcagctatgttctccgtcagcaactggattcaaccgttgtggcgcctggtggagcgtggaatgacggagatgcgcttgcctggatcggcgacaatcgctggatgaactacaaagccagcaccgatgtttcgtttgaagataaaggtacttatggcagcgccaattacgcttcaatcggtgtccgccagcaagctgattccgggccggcagcttatctgaagttctggcaggacggtggctggtcgctgcacatcggtagtcaaactattagcggaaatgttgcgaccggccaaggcggcaccaagatctccgattttgataccgccaataccgcatggcacaacattgcggttcaagcagccggcgatacgatcacggcttctattgatggtcatgaagtcgcatccggcaaggttacgacgcaactttccggccgtgtcacattaggcagtggctattaccacaccgactttgataatctgaaagttgaaaaggttaagggctacacgccgtattattcacaacaactcgacgacctggaaatgtatgacacgtcagctaaaccgcaaaaagaattggtttataacaatcaatggacccacgaaaacggtcaaggcatgtacgtgcgtgatcggacaatttccaagagcaccggcgctggcgcaacgctaacgtacacgttcaatggtaccggcttggacatctgcggcagcaacgatggctcggctaagttggatgtgaccgtagacggcaaacaggtggccaccaatgcggctactaataaaactggcaaccttgagcaggcgtacacgctgcgcaatctaaaggatggccaacacaccgtaacgtttaccgtcaaaagcggtacgttagctgtggactatgtcggcgtggtgcctggcgaaaacagtgttgattttagcgccttgcagaccgcttatgacaaggataaagacacgaccaacgccagcaacaagtacacgactgccagctggaacgctttccagacagccttatccgctgccaagaacgttttggccaacagcagcgcaacgcagtcagatgttgacaccgctttgaagaatctgaacacggcatacgacgggttggcactcagcctagacaagtccgcgttacagaaggcctatgacaaggcaaaagacgtcaccaattcgaacaacaaatacacggatgccagttggtcggcactccagacagccttgaccgcggcccagaaggtcttgtcaaacaccgatgcaacatcggcagacatcgacaccgcgctgaaaaacctgaatacggcttatgccggcttgaccccaagtccgacaaccaacccagacaaggcaaagttacaagcagcctatgacaaggacaaagcggtcgcgaataccgacaacaagtacaccgctgacagctggaagaccttccagacagctgtggcaggcgcacaaacggttttggccaacaacgatgcaacccagacagacgttgacgccgctttgcaaaaactgaacgacgcctataacagtttggcaccaactaatggcgaaaaaaccgataagtcggcacttcagacagcctacgacaaagacaaaaccgtcaccaacacggacaataagtacactgacgatagctggaaaacgttccagtccgcattggaaaatgcccagaaagtgttagcggacaacaaagcagtccaaaccgatgtcgatgctgctttgcagaagctaaatgatgcctatgatggcttaacggtcaatccagacaccaagccggacaaatcggccttacaagcagccgtcgatgcagccaaagcccttagcgatgcagccgtcactggcgagcatgaaggcaactacccggctgatgccgtcacaaccttgaaggacgcgatcaccgcagcccaaaaggttctcaccgacgcgtctgcttccaaagacgatgtgaccaacgcgttttcaaccctcaaccaagccgttgcgaccttcaaaaaggcagccatcaccgttaaccgtgatccgttaacgcaactggccaaggcaacgcaagcgctcaaagaagccgactacacgagtgatagttggaccacgttccagcaagccttcaccgctgcccagaagttgttggcaggcaaaccaagtcagcaagaattaaacgctgcagtgaccgcacttcaagccgcgaaaaacaacctcgtggcagcaggtggtcaactgccatcaacaggcggcagcgactcatcaagcgccagccaggcaccttcctcatcatcaagcagcgcgacatcaagttccaccgcaactgatcaaaccagtccggtaagtgaatttacttctagctcgaacaagaacaaatatccaaacacaggcgaatcacaactgtcgctggtagtaacagtagcagcacttgctttgcttattggcattggcggtcttgcttggttcctgcatgagaaaggtaaggcgaaacaggagtagaatgaaacattaagaacgtagctggagttgtaacagcaatttcatagtattttaaaatgccccgcagtctggatgctttctgactgtggggcatttttggtatgtcactttcaaggagatttgtaattcgcaatttccattttgatcttcttggcttgatgtgttgctatataccttgtatattcacttaaggaagtatatagcaacaccgcagtgccggacggaaactactatgattcacagccatccagcatagcaaaaattgacaacagcatttcccttaacaaccgtccttccctccaagtcaggccggttatcacttttttaaaatagaaaaaacatgcttgtccaagagcaatcgcttcttggcaagcatgtttcattttcaggacttattcatttgttgcgcaaagcggatgactcacagactacttaccagccttaatttcatccaactttgcccgatatttcttggcggttgcggtgacacctgcgtagtcgccggttttggcggctgcggtgaggttgctgccggcaccgactaaggtaacgccggcgtcgaaccaggtttcgaggttgtcgagcgaaacgccgccggttggcatgatggccagctgcgggaatgggccgtggagtgctttgaccatggctgggccggcaacgctgccagggaaaactttgaccaagtcgacaccggcttcgagtgcggtttggatctcggttggggtgaagcagcccggggtgtaaggaatcgagtagaggttacagattttggcaacgtcagcgttaaagcttgggctgacgatgaacttggctccggcaatgatggccagacgggctgtggccggatcaagaacagttccggcaccgatcagaacatcgtcacggtcggcgtacttttcgctgagttcgtccagtgccttgtctgcgtgtggcaccgtgaaggtcaattcaattccggtcacgccaccagcaattacggcgtcaacggttttaacagcttcatcggcatcgttgccgcgaacaaccgcgacacagccggtgttcactaaccgattcaggtagtcatatttttgcatgtttgtttactccttaaacgtgtttggtaacgaagaaagtcttgtgcgtcttgaagcatggaaaaagtaaaagcgcttttattcgtgccctgtttcattaagacttgttttcataaacttgtcaagttgtgatcgcgtcgggtagccggtgttgtcgccggcggactggatggccaaggcaccaatggcattgccgcggctggctgcttcggcaggggagcggccttctagcagcgcactgatgacgccaagggcaaaaccgtcaccagcgccgaccgtatcgacaatgtgcgccgccggaaaactcggcagcagttggtccggcacgtcgcggcctaacaggtaagcgccttgtttaccgactttaacgataaccagctgcgtctgcgggctttgatcgaggtagaagtgggcgatggtctcaggatcatcgctaccgaccaggattttaccttccgccgcacccggcaacacaatggtggcacttttggctaactcattgatggtgctcgccatggtttgctgatcaggccacaatgccggccgcagattggggtcgaacgtgatcatgatgtggttggtgatgagccgcttcatcaagcgtttcgtcgccgccaacgttgaagccgaagccgccgggaaaataccggtaatgtgcgccagcttgacgcctgccaaatcaacgcggtcaatggcgtccgggtcaaaatgggcggctgccgatccggcccgaagataataagtgttcggatcaccgtgcgtgacgcgcgctttgaactcaatgccggtcggatagcgcgaggtcgtggtgacattgtctgacccaatcccggccgccgtgagttgctggcgaatgaaaataccattcggatcttcgccaagatgcgtgatatattcaactgaatggcccagtcggcttaagccaaccgccacattcaattcggcgccggccagatacttggtaaaatgtttggccgctgccaacggaacatcggcttcttcagcggcgaaaacgacgagcggttcaccgattgtcaggcattcattcacgtgtgatcgtactcctttagacgttcagtctttgttgtcgtagaaaccaaagtagttgcgggcgttaccgtagctgatattcttgacgatgcggccaagggcttccaggtcgtaaggaacgcggccttgttcaaccaactcaccgtagaagttgcacaatacccgccggaagtattcatgccgtgggtacgacaagaagctgcgggaatccgtcagcattccgacaaagtttggcaacagactttgttgggcaaaggtttgcaactgcttgtgcatgccttcagccgtgtcattgaaccaccaagcagcgcccagttgcaggtgctgtttgtcaccttggccaacgaagctttgcagcatggtgatcaatggtaaccagtcatttggattgagtgaatagaatatgacctttggtaacggaccgcgtgcatccattgcctggaaaagatcccgaatttcaccgactagatccggctggctgcccatcgcgtcaaacccggtatccgggccgatctttttgagatttggcagactcagactgcgcgcaacatttgcatggaattgcattgtccagttgaattcgcggttcaagtccatcaacatttcgactaagccggtgatgtattgatcattttcttcatcactgacagggcgattttcgataccctttttgatgatggcatcgagggcttcctgacttgccggacggtagtggaagctgttgaggccgtggtcggaaaggtggccgccgtgttgggcgaagaaggtgaagcgttgtttcatggctttcttcaaggaagcaaagtcagtgatctcaacgccggctgccttgccgagggtctgcaagtattcaccataggagtttgcacagattgccatgagcttatctggacgcatggctggcaggactttgaagccattagtatcttcgtctttagcgatgagttcgtgatagtgcagatcacttgccgggtcgtcggtggtgcagacaacttcgacgtgactgcgccggatcaacgcgcgcggcgtgaattccggggttgccagttttgcattggccagatcccagacttgtttggctgtgtcgcggctcaaaaccaggtcgctgccaaagaagcggcgtaattcaaggtgggtccactcaaacactgggttgccccaggcattttccatggtttcgcaccaagcgacgaacttcttgtaatcatcgccatcgccggtgatcagttcttccggaaccccgttggcccgttcaagccgccacttgtagtgatcgccgtaggtaccttcgtttaaccaaatacgggtaatgttcttgaagttacggttttcgtagatttcttccgggttgaggtgacagtgaaaatcgataatgggcaagtcagcagcatattgatgaaacaactgcttcgccggctcgttggttaacagaaaatcatcgtctaaaaaggccattattttgcactccctttttccagtgcttcccagaggccatgcagatacatgatacctaaggcgcggtcatacaagccgtaacccgggcgaccattttcaccccagatgttgcgaccgtggtctggccggatgtagccatcgtagtctaagtcgtgcaaggccttcatgatttcgtacatatccagtgaaccgtctttggacaggtgatcggattcgtggaagtcaccttccttgttcatgaacttgatgttacgagcatggatgaacggtgcccgatctttcttgacgaattcgcggatgattgccggtacatcgttgtcaggattttcgcctaatgaaccggtgcagatagtgaagccattgtaacgggattcgtgcatgccttcaatgacgcgcatgtcttcggcgttcttgtagacgcgtggcagaccgaacagttcgcgcggcggatcgtcgggatgcatcgccatacgtacatcatacttctcgcaggttgggatgatggcatcgaggaagtacttcatgttttcgcgcaatttagcagcgtcaacatcggcgtaagctttgaacaggcgctcgatttctgccagacgttccggttcccagccaggaaggacatagccttcggagttgttgcgaacggagtcgatgatatcatgcggatcgtctttcagatattgatgctggaaggccatgacattgctgccgtctttcagctgatagtgaaggttggtccgcaaccagtcgaagatcggcatgaagttgtagcaaatgactttgatgccgtattcggataggtttttaatggtttctttgtagttttcgatgtacttgtcgcgcgatggcaggccgatcttgatgtcatcgtgaatgttaacggattcgatgacttccagctttaagccggcatcctcgacctgtttcttcaaagcggcaattttttccttaggccagacatcgccgaccggaacatcgaataaagcgccaacgacttggtcagtgccagggatttggcggatttgttgcaaggtgattgggtcatctttttcgccgaaccagcgaaaacccatttttaaatcagacataaaatcaaagctccttttcgtgatcttgacggaattgttcaagtgtcttggcaacggcgccagggccggcgatcagtttcttgaagtcggcttcgacttggtcagccaaaccgatttgatacaggtcatggccgaagatctgggcgttgctcaaaattggcttgagggcggcgtgaacgtcggcatcgctgccaagcttgatgtcagcaacatatggctgcaattgatccagcagcgggtcgcggcttggcgtgaaggcattgcctttgtcgtccagtgccatcaggtaacggcaccagccggcgaggatcaatggaatggctttaagttgcttgacgctgtcaggacccttgtctaaatagtgttgaatggtgacgccataacggattggcaacttctgtgacgtgtcgctggcaatacgttgcggcgtatccggaatgttcttgttaggcaagcgcttggtgatcagctgatccaggaatttcttcggattgataatctttggatccttaactaccggaagatcttctttgtagccaagatacttgatcaatgtaagtagatcaggattttcgacttcagaagcaatggaggtgtaacccagcagattgccgtagatagccagtgccgtgtgcagtgggttgaggcaggcggtgactttcatctgatcggcatcgttaacggtgtcgcgatccgtgagaatgacaccagcgttttccaatgccgggcgaccattcgggaagctgtcttcgatgaccagatagtgcgtttcttcggtgttaccgaatggcgcaatgttggtgtgcttcggggtatggacgatggtggtatcctcaaagccttctgccttcagcttgtcagcgacattttgggcagggttcggggtgatccggtcaatcatggaccaagggaagctgacgcgttttggatcggtcagatagtcgatgaagccttgggtgaccgtaccgttcttagcccagcctttagcgatggtcaaaataccgtcttcataacgtttgccgttttcggagaagttgtcggtgctgaccatggcaattggcttggcgcctgcttcataacgggctaacagcaagcgagcgatagcgcccatgttggtaacggcatcatctggcttgccggcgatatcggcttcggctgctggggtcagcttgccgttgatatcggtgagttgatagcctttttcggtaatggacatggtaaccagttgcagcgatggttgggtgaaaatgtctttcaaccgttcccagccgtctggattgctcttgttgtagtagatggcctcggcaacactggcaatcagcgtcttatcaagggtgccatctggctgcatgacaacctgcaaaacccgatcgttgtagggcttgtagatgtcagctggaacgtcgccatcataggtttcagcaacaatgaccccggacttaagcttgccggtgttcagtaagtcttgcgcaattttcgcatggaagcagcggaagaggttcccgccaccgaagtgtacccagaccggattggcttgggtcgcttgtttcatttgttcttgatcgaattgcggaacagcgatgccggctgccttgaattcatcagcctttgcttgataatcgtcggttaacttaaccacaataatgaacctcctcatatactaatatatcagaactacaccctcaatatagcacgacttgggtaaaatggaaagcgctatcagtcatcttttgacatttcgtaaaaataaaatctagccagggaatttggatgctttgaaaaatgctctcacctacgcagagggtgggatcgcgctataaaaaaggtcggaatcgaattaagattccgaccttttggcctatttcttgtttgcgttgacgcctttgcccggagcccagtcgtccatgaggttggctgggtatgggttgagtttgaaggcttcgtcttcgcgcggcttgctttcgttgaccggtccgaaggctttgtgcagggttacggtaccccatgccgggacggtgacgtgttgccaagcgtaggcgccgtcacggttaatggtgacttcggcgtctagtggcttgccagacggattgtagatatgtgcggcaatggagccatccggtgccaggaacgcaacggagccgaggccgccggtgtaaccgtcttgggtgtagttggtggaaccgatgacgatggagcctggtgcgacatcctggttaaagttgcgcagcatgtaatattcgaggttgcgctgcactttaccggttttatgatcaatggtgacaacaccgcgacgaccggttgcgccaacctgattgggtaggccacgttcgtccaaagcgatgttccaaaggtcgatcatgttaaggccttggcgcacgagccagttgccgatgaggcccatcataatatgggaagcatcttccggcgtttcttcgatcatgcaacgccgttcggtcatcgccaagtgccagttaggattcaagcggctgcccttgaacagattcgtgtaagggccgtcataggtatggaaggcaaaaccgtcaaatgctgcagcttcatcaggcgtgatgagttcgctaagcggcttgtcgatgacatccaacacattcagactgccatcccagaagtacatcttggtatccgggaatgttttatccaacgctggccgtaagtacttgtaaccgaattgggccaattgcggaatggtccagatcatggctggccaagccggtgcgttggatggttcgttttgaatactcaaagcataaatcggaataccatacttgcgatattcttcgaggtaacgaacgaagtactgcgcgtagacaccttcaaaagtatccttaaccgcataaccgttgttggtgtattcaccaaaccgcaagtgaccacccatgttgagctgaccggtactcttcatccatgccggtgctgaccacggggaagccatgattttaacggccggattgatagcgagaatttcctgaagaaccggaatcagatacttcaagtctttggttgcatcaggggcacctggttcgccttcaccaaccgagaacttggctaaggaagcatcgtgttcaccgaatggcacatcgtcataggtgtaaaaaggctggctggcaggttcgcaggaaccaagtggcacacgaatcgtggaaaagtgaccttcctcaggatcaaacagttcatgtaacaacgcactgcgctgttccttgctttgcttccaaattaaagaggcagcagcatcggtgatcgcagcgccggcaccgatccattcctgatgttgatcagcagggtcgatgacgattttagcaccgttgccaggttgggcagtcggttgcggcgttggtagatggtcacgtttttggcttaagtcacctgcagtagcagtccagaattcggttgggtataagccagaatcttttgtggtcatgttaataaacatcctttcttgcgtctatcgctaacaataacttctattcattaccgaacacgtttgatggcagcaatcagaatcccaccgaggatttccatagcaaccgcgaacatgaagacggcctgataaccgaagccttcaacaattgctgaagcaaccatggcgccaagcatctggcctaaagtattagccaggttgattaagccaaggtccttaccggcagtatcggaagatggcagaacatccatgttcaacgcaccatcgactgagttgtacaagccattaccaaatgcagcgataacagcgtaagcaaacattgcccaagcttctttgacgaacagtgggaacaaagcagcaattgccaacgcgaacgtcgcgataacaactgggcctttaacccgcttcattttatcagcaagtggtccgccgactaaagcaaagaagacaccgatgaacagcatgatggacgagaagattgaaatggaaccgccggcctctttggtgctctgaccaatgtagtcggtaaagatgaatagcaggaaagtcgtcacaatcgttgaaccaacaaccatcaggaatttaccggataatgccaggtagaaatcacgcgcatcatgcgtcgggaagaagaagtacttcttgagcgaatctttgtcaagtttgatctttggttcgtcaaggttgctcttttcgttaatgagcagaacgtgaataaccgccaagataacggtggttgctgccatgacgtaaataccaaatttaacattgccaaggaactgggcagctaatagtgcgaagccttgttgcgcaatggtaaagccgacaccgtagaaggtcgacacggtaccacgccatttaggtgccacacgatccgatatttgcggataaatcgcggccgcaatggcattttcagccgccgccgcaataatccaaatgaagatgatcgcggtaatcgacgttagattagcaataacgactaacgaaatcgcgatgaccaaggtaccaagaacaatgtagggcttccgtttcccgaaacgcgtccgggtgacatcggagaaggccccgaaaagcaagttggcaatcgcaccggtaatggatgcgaccgttgccaaaatgccgaccgcccaaaccttatgtgcggcatcaatctgactgaacagctgtggaattaaaacgcttcgggtcgagccaattggcccataccagcaaagcggtgctaggaacatcgcagtcgcaacaccgaatggtaattttggctgctgcgaatcttgaaccttcgcattggtgacaaccccaaccgtcgtcttaacggctttagggtctttatcaagtttgtctgccatttttttcactcccatgaaattaaataattggcttaaatcgttgaatcctatgaatcaaaaaacataatggcgtcaagcttatgccttctgccgcgcatcccttctttctttgtatgttatgtggtcgttggctgcctcggtgttttgcagaataaggggtttgtgaggaaacttacgatcgtgtggggagatacttgccagaatatcaattcgtcacggaggttagccctaatcgttcatcgcctagtggcctaaaagccggaatgataggcactctagaatgattgatatattagtatatccttacaaacgtcatgttagcgcttactaaaagcgctgtcaaccttttactaaaatattaatatgcaagagctcgaaaagcccggtgtgacaaggaaaaaagactctaaaatcgcaagtcgatgcttggcgtttttagagtctttccgttttttgcgttgcctgaggaacgaatttgtgcaaaaagcgacaagaatttttgagccttttgcaaaagaaccgacgtcagacaactggagaatcttggattaaacttcgcggtcgtgagaaagtctgaaattatagaagctttctttgaccggggcgatcttaatgtcctgaccggcagtccagtttgagaagtatttgggatacttgcgatggatggctgacatatcttcggcaaacttggagatatggaggtaaacattgtgcgccgcagcgtcagcatcgccggactcaatcgaattcagaattttaaaatgttcctccaatgttgagtcaatccgcaattccgataacacctttaagtggcgaatgcggtcttggtcggcggcaatgtatgccagcgcctgctcgatataagtcatcgaagctgcatcgtaaatcagatgatgaaactgattatccagatcaaaagcacggatgtagttcttatgatccagctgttgccgctgattataaatcgtttggtttagcgaaaagacaagttcggagcgatccggcaaactgcaaacttttcgtaccgctgcttgttctaaaagattacgcaaataaaacgactcgtagaccttatcaaagttgatcagtgagacgtacgaaccgcgttggggaaagacattcaccaacccgttttcggcaaggcgggagcaggctctttggatcggcgtacgactgatacccagttcttttgataactcgatggggctgatactcgctcctggcggcaattcgatggcaacgattttactaaaaagggtttgatacgcgtagtcgtttgcaaaaatgcgatgttcatttgagttgtttggtaaatccattttgatcacgtcctgaaggttgaaagttgagggaggttaaaattctgcaaaacgcttttggcaccggagctagcctgagcgcacctatttaaaattgtacaacttagtcagattttgtaaggctgttttgattcgatctcgtcgagaaaattttacgaatgttcggaaaattttgttgaatataaacggactcgtccagctaaaacacaaggaatattttaacagggcgaaagtcgccacaatgccctttctgccatgttacaacaaaataatcagcaaatgggaaaacggagaacacaagtaaaggtatcgttaaaataattccttcacaatgttaactgtatcccttatgcctagtgcattggttcattaatcgacttaagaataccacataaaagttgttgtgtaggcgtttagtttagtaaaaatgaatagtgaacggttatcgaaattgaaagttaattatatttgacagcgcttactcctggtgctatgttttccttgtcacaatactagcatgctagttcattagtattccagaagtcggagatgtgttgaatctgaaaagggggggtgccatgaatagcgggaaatcgaagggttttatcaacaaaaaacgatgaagacatcaaaactattggtgcaaaaaaattttgaaagaatggagtctttaacatgttagcagcacgagtttacggtaaagaagatattcgcgtcgaagaggttcctaagccgtcaatcaagtcttcgaaggatgttttgattaaggtaaaggcagttggtatttgtggcagtgacaatcacatttaccatggggaaaatccatttgcgacattgccgcgggtgatgggacacgaatttgtcggcgaggttgttgaaactggggaggctgtgtccagcgttgcggtaggcgatcacgcggtcatcgaaccgatcaattatcctgaaggcggcaaagattacgctgttcgtcagggaatgcccaatgtttcagcacagttgaaggttttgggtgttcacgttgatggcggcatgcaggaatacattagcgtgccagagcgacaggtatacaaaattgacaagaacattccctggacaactgctgtgctcgtagaaccttacaccatcgccggcaactcaacaacgcgaggacaggttggcttaggaaagacgctggttgttcaaggagcaggtacgatcggccagctaatcttgcgggtggctaaggcaaaaggcgcaacagtgttaattagcgatgtcattgattcgaaacttgaatttgccaagcaaaatggtgccgacagaattgtgaatgccaacaaagaagatttagtggacgccgttcgtgactggacgaacggtgaaatggccaatgtcgtcatcgatgcagttggcgcgcctaagacctttgaaacctgctttgatttagtttcggttgccggagcaattgtgccattgggtatgtccccggaacctgcgcatattgctcaaaagccgatcatgcaaaaacaactgaccatttacggttcaagattacaggcctatcagtttgcgccaattatcaaagccattgagaatgggcaaattggcaatgatggcgttgtgacccaagaattcaacatcaaagacgtccaaaaagcttttgacctcatgaatcaacatccagagaaagcgcgaaaaatcattttgacctttgattgagtagataactttttgaccttatgaaagtaggttttaacaatggaaaaaaagcgtgatttcgaagtcgatacaaaggaattagtcaaagtgacggcaagcggctggatgggaacggccatggagttcatggattttcagctttattcactagctgcggcaattgtctttagcgatatctttttccccgagatgacaccggccatgggtttggtcatggcgatggggacttatggcgcggggtatgttgcgcggttgttaggcgcgtatgtttttggccgaatgggtgacaaaattggtcggcgaacggttcttttcgtgacaattatgctcatggggctggcttctaccgcaattgggtttttaccaacgtatcaacaagtggggattttagcgcctattgggttggttattttacgaatcgtgcaaggctttggcgcgggtgctgagatttccggagccggcgtgatggtcgccgaatttgccaagaaaagcaatcgcggtttagtcggtagttttgtttgcctgggtacatcgactggtaccttgttggccaacctgatctggaccatcatcttaacgaaattagatcagaagagcttaatggcatggggctggcgaattccgttttatgcttcgttcgtcatcatgatcgtggcggttctgatccgaatcttcattaaggaaagtccggttatggcggagaaaaagaagctattaaccgaacaacggcaaaaagaattagagaatcagaaggcaaatggtgatgtcccgacagtccagaagaaacatttcaaacttagtaagagtttgttggttgcgctaggattgcggtttggtcaggctgggaacagtggtattatgcagacatacttggctgggtttatggtcacttttctcagtattcaaaaaacagttacgacaaatgccaatattattgcttccttagtttcctttgtgaccattcccattgtgggctggctgggtgacaaaattggtcgccggcggatgtatttgatcttgtccggcgcgatggccctctatgcaattccgatgcttttaatgattgaaacgaagaatacggtgcttctgacacttgccatggtgattggcttgaatgtcggggttcaggggatttttgctttggaaaatgtcatgttaccagaattgtttgggtccaaaaatcggatgactttgatggctttagcaaaagaaattgccggagtcattgcaactggctttggtcccctcattgctgcaagtttagtttctgcagctattggcagttggtggccggttgccattatgatcgttgtcttttccttgttcacttttgtaagcgcttatctttctgttgatactaacgggcgcgacttgaacgacttagacgatgcgatggacgatatttcgcttaagtctgagaatttgcacaaccgggcaacctcggaacttgtcgatgcccacacaggggttaagaaacattgattcataaataaacatgacaaaccctaaaaaattaggttaaatgaagttaagccattgacattaacgtaactgatatattagtatggcctcatagggcatgacagcgcttacgcattttttaaaagttaaagtacttagtttccgaagcaacatctttttagaatggctggggatgttatacaatcaagtaacaaagtgaaaaagaaggaagggtgacgcccatgcaaatttcgaattatcaagatgaggcgtacaatgccatcaaacagatgattctcagcatgcagctgacccccggggaaaaagtcgacaagaatgacttgagcgcacaactcaaaatcggtgcgaccccgatccgggaggccattatccgcttgcgacgtgaagggctatttgatgtcattccgcagagcggtacttatgtatcaaagattaatctggaagaaatgtaccaaggccgattcgcccgggtcaatttggaaagaacgattgtggcagatgccgtcaatatcatgacgccagaacagatcgccaagttagagcagcaggttgcgcttcaaggcgtttatgaaaactcacgagattatgagcatttctttgatctcgaccacgattttcacgagatcttctatatggcagatcataaacaatatgtctggacgtgggtacagcagatgaatctacaattcaaccgctatcggtatttgcgtttagaagcgagcggcttgcagtggcacaacatcgtgacggaacatcaggcgattgtcgatgccgtcaaagccaaggatgccgaactcgcgagtcatttagttgctgatcatttgttggcgattgatgacgatgtcaaaaccgttctgaacgcttatccggattattttgaaggacaagcgaccccgaatcaccagcctaactaatgctatctcataacgaacattgccttctgtaagcgcaatcgtgccctcacgaaaggaaggcttacagatgacaaaagtattaacattcggcgagatgatgctgcgactaaaaccgtacgatcatcaacgcattcttcaagcgtccggtttcgaggccaattatggcggctccgaggctaatgtggcggtttctttggcattgcttggcgatcaggcacagtatgtcaccaagctgccggataacgcattaggcgacacggcgcgcaacaccattcgcgggctcggtgtcgatacgcacaaaattttacggggcggaccgcgcttgggaatctatttctttgaaaaaggggccagtgtgcgcaatacgaatgtcgtgtacgatcgtgccggcagttcctttgcgaccgctgaagccgacgaatttgattgggccagtctgcttaaagacgtggcctatttttatttctccgggatcacgccggctatcagtccagccatgaaaacggcgattgaatcagctgtgaagtattgcgctgcccacgatattaccgttgtttgtgacatgaattatcggggcaaaatgtggacgccagctgaagctcaagatttctttggcaaggtgatgccatatatcacgattgttttggcgaatgacgaagactttgaagcgacgctgggaatcaaggcatttgatggcaatatggaaaccgggattgatcagattgatagtttcaaagccggcatgttgcaggtcatgaagcaatggccgaatgtcaaaaccgttgccagtgttgtccggaatattcattcggttgaagacagctggtggaccggcttgctggccgaaaatggcaagacttaccaaggcccgactttccatatgcatgtcatggaaggggttgcgtccggcgatgcttttggtgcgggcctgatgcatgccacgctgcatgacttcgatccgcaagccaaaatcaactatgcgatttctgccagtgttctcaaactgaccatcagtggtgatctgaacttgattaccgatgccgatgtccgcgccgtcatggcgaccggcagcggcgttgatcgttaggccagggaacaggaagcgaggaagcgcgaatgcatactttaacaattgatggtgaccagctgcagttggatcaaaatgaagcgaatacgatcaaaggattcggtctcttaagctgcaacaatacctcacgcttgttgatggattataaatgggaacagccaaaagtttatcaacaggttttacaacatttatttggcggcgagcacccactgatgcgcatgttgaaggtggagcttggcagtgattcgaatacctcatgcgggacggaaccggcaccgcaacgcgcagctgacgaaccggccaacgtcgcccgcggcatggggttccagttgattgctgatgccaaaaagatccagcccgatttgaagacctgcatgttgcggtgggcagagcccggatttttgcggccaacctggcaacaagtgaagtccgatgatcctgatcagaaggtgccaagtgcgtcttttgaagggatgtatcaatattacaagcaaaccgtgatcgcggcgtggcaggcttatggttatgtgtttgattacatcgatccggatcgtaacgagaccaaacacccgatgtatcggtatctcaagtggtttgcacaccgcctgcaaaatgaccaggatgattttcctgaaggctttccattggtggactaccatgcaattaagttgatcacttctgaccagaattacggcaccgacatggggacagaattgcttaaagatcccgagttacaggccgtgattccggcggttggctaccattacaataccgatgacgggccagatcatcccttcacccaaattgctgatcagctccacaaggaagtctggtatagcgaaggcgtggctccggtcacattcggaacattgcgggtgcaagacacgaccggcatcggcattggcggttttatcagtgccttggacgttgcaaatcgactagtcaaaagctacgcgcggtcccggcgcagtctgtatattttccaaccagcgattggcggcctgtatccaggcgcgaagtatccaggcaagcagttgctggaaatggatacgccgtggtctgggtacttccagcaggatacggtcggattggtagtcatgcatcattttaccgattttgccttgaccggctggcgtgatcagactgctgataagaactggcggtacgtaccgagtgcgactgtgagtgaggtggctggaaccgagaatctgagtcaagcctttggtgcggccagcgccatgaccctcgtggcacctgaccgcgcggactatacggttattttggtcaacgatacgaatgctcctcagcactatcaggtgagtgtgaaggatctgccggccgctaacaagccagttcatgtttggcagacttgggctgatgaaaatggcaagatccacgaccgcgaacaggtggcaaccctgacgccaaaagacggggttgtaacggtcacgatcgcacctcgggccattgttagtgcaactacggcggactttcagccgcaagcgcagttgacgagtccggctgtgagtcaggatcagccactgcaacaggatcctgaaaaacatgtgttgttccatgatgactatacgtatgcggacatgccggaagattatctcaaacggcgtggtggcacaccgcggtatacaactgacatggacggtgcttttgaagtggtggaacatgccgggaagccagtgctccagcaacagatcacggagcagtcacgggccttggcttgggaaacgcaaactgacccgaactttacggttggcgatattcgttggctgaattatgcggcggcgttgacgttcacatttgataccacgacccagcaaaatacggtaagtgccaattatgtcggcttaggtgtccgcagtgtagatgactttgaaggtagcttattctccgcaccgtatgccgccacgatcactgttggtggtaagttgcggttctacgtgcgcggtgacttgcaaaacacattggacgtaccggtttttgatgccgctgccagtcacgaattggtggtgcaggcaacggatcggcacattaccgtacaagtcgatggcaaaacgtatgtgacttatgatgatccaagcagccagccaggattagccgggcaggtgaaagtcggtaccggttatttcaagaccgtgattcacagtctgacagtgacgagtacgtcagcgaccgcggttttgggacatcgatgcgatgatctggatgccagcttggcatttagtgacgagcattgggcacgcattgcagcccggttcccgcacgcctgggaacggtcgcaatcgactggcgagcaaggcgccacgcttgattttgacactgacgggacgggttttgtcctctttggtacccaagatcaaccaagtcgtctgcggattacggtagatggccgtgctcaggaagtcgtaccgctgacagcattggccaaacagcctaatgcgatggtgacggatttggcagcgggacaacatcacgttaccgtgacggttattgatggcagctatacctttgacggcgtggccccgatcttgtaagcgacaaggtttgcgacgactgacggtacgtttcagaggaaggtgagtcaggtgacccagccagcttatgggtatttaatgagctattttacaggtgaacagtaccaaaatggggagcaaatttactttgcgctgagtcgggatggcctgcattttacggcgttgcatgacaatacgccggtcgtcaccaaccaactcgggacacatggcgcccgcgatccgtttctgtttcggacgcaagccggcgattacgtgttgctggcaacggatttgcggatgtatggacacacagaaccaggtgcctggacccgcgccgaggttgccggcagtgatcaattgctcgtctggcattccaaggatttagtcacttgggatcaaggggagagcgttacgttagggccccattttggctgtgtctgggcgccggaggccatctttgaccctgatcatggggatgatcgactgttctggtcggcgacggataccacggagaatcctaaaagattgcgcatctattcagcccacaccaaagattttcagcattttacaacgccggaaatttatcttagcgatgcgacttatgatgtgattgatctcgatgtggttgcggcggatggtggtttctatcgcttctggaaactgaatcaacgcgggcaagtcgtgatggatcgcgtggcgcatttggacaatgctgctggtcatccgattgcgtcgacttatctggccaatatgcagcgtgtggaaggaccgcaagcctaccagttgccggatggtcagtggtgtttgttgttggatcaagttaacaacgacgtccgggcgtatgtgccagccctgaccgaagatcttgccagcggtcaattcacgcagccatctgcgggaacctatcagttgccagaccggccgcgccatgggtcggtgctgccgattgatcaggcggcttatgcgcggttgattaaacgttggcagtgaaaatgatttagtgagtcagaaaaacgatctagggtcatgtgcgagtcaccatgacaatgaaatagccgtatcccggttttgggtacggctattttttagatggactgttcatttcagagataaattggatttgttgattgacactgtactttgactgttcgtgcttctgttgcctgatttcatcttactggtttaagatgctctaatggtattttctacgactaatcattctcgtgcatccagtcatggaaggcgggggatttttctggatcataatggccacgtttatcgaggttgacgacttcagtgggtgtattcttgaacaaatctgtccactcatcagcagtcggcaatgcgcggataacaattttatcatcaacgattgtagcgacaagctcactattttcgtcaagatgtaactggttacgcatttcaatcggaatgacaatctgaccctcagacgacattttgactttggctgtcattgacacggcctccttgataaaaggtaaatgttttttcttcatacagcttatgtcattattctgacatgcttacttcttaattgctagtatgtgactgactcggaaaagatttttaggccagtatcattgcctgcgtgcacaacagggattaaaatgaggccgtaaaaataacgatataggacatgccgtcagctttcattccaagacacaaaggcagcgaggtgaagatcatgaaagttttatataaaggccagccagccgaagtttgggaaatcagcagaactaacgaataacctgattgggtgaagttagcatttgaagagaattatctttattggatggacaatcacctacgtgttttgatgagcggcctgaacccgtctatgggaaccaacttaaagttcggggcagttggcacggttggcggcggctttgccggttatgacatgtatgtgctgggttatccgggtgactatttggacgtgaccaatcatcgggttgtttctaagaaaaagttcctgaagcaatatcagatgctggaagatgtgtgaaggtaaccgttgaaacttttgggcattgaaaagaacgcaaatagttactaaatttggtaaatctacgtcttttctttttggtatgggacgacgtttttacagcacacgattaaatgacttgttgatatttatcacccgccgcctccgcgaacgactttacgacatttgaacgagatgatgtcgagctgattctgttctgagggtcactataatttagctaattgtatttatttggaatcgtacaagttgcaatctttttttgaggagtaaaaagtgcaacctctaatatttggatacaaaagaccttatatttgcccatgcccgttgtccctctggaatttgaggtgttgaaatataaaaaatatgatacatgccgctgaactcgagaaatttaacatgaactttggcagcccttgcttttttaacgattgttttgctgtcactcaacagcagttcgttactaccagtttgaattaacattggtgggaaatctttaaaattgccaaacacaggggagatgtatgggttttttagattgtgtttgccagcatatgtgatcggtattggatgtcttggggacttcttggatgaggccgagccgaaaagcggatccttggttgtgttggtacggtatgatttgccagatgccgtaagatctgcccacggagaagcgagaacaagtgctgcgggaagtggatctttatgatctcggagatataatgtgagcgcgagtgatagaccggcacctgaagagtcaccggctatgataatgttctttgcctggtagccatgtttcagaagatattgataaccagtaagagcatcgtttaacgctgctggaaatggatgttttggtgcagttcggtagtctagagaaaaaacattggcttgattatctgcgtttgaatagttaactgcagctttgttatacgtgttgctgaattgagctaaataaccgccaccgtgaatttggtaaataactttcgtatgtttgcctttattagctgatagcatataaccacgagccttgcccaaattaatcgttttattggtgtagcctgctggcgactgccaatccttggcacgatatggctttgattcagtttctattttcttaacgaacagcgaaataccgtgctttgcttcgtacatatgattagccatttttaaggaattattgacgaggttaccatatagagagacagttaagtttggccgagtgagagtgatagtgattaaggagacgccaaagaatagcagtgtagctgtcagttgcagccaaaatggtttgagttttttaaatcgtttcaaataaatgattcccgcaaaaagaacgatggtgaccgaataagctagccaattagaatcgagaaaaagagccgataagattgctaggatgaacaagataccggttaataagtaaaagcaaatagatgttaattttctcatcgtgaaaatctcctaactatgaacgtgcggttgacggtttttaggtcaaccggctgtttcttaatacttacggctttagtctaatgaaggagcttcaaagatataagtatcaaaaggtgaacaattgtaactttaattaatagcgtagtaatgcccattttggagatgatacgatgattaaatataaggacacggaaaagagaatctggcaagctttctttcagcttctggaagtggaaaagttcgagaaaataaccattaacgaaatttgcaagcaatctaaaatcagcagaacaactttctatcgtcattatgttgataaatatagattgcttagcacaataaatcattacttttctacgtcgctgggttactttttaaagcatcgagtacatcaagaaaacatcacggcatctttagtcgatattgcaaaatttttgtcagtaaattccgaggtgattttagttttattgacaattcatacaccagaaagcgatttacaagagctatttaaaaaagtcttgcatattgagttcgctgattatgttacgcgacaacataagagttcagtttttccctcaaattacttgattgaaatttatgttgctatttcgatggtcttcttgtcatattcattacggaatgggttagacgttgacgtcattaggtctattgatgacatccagaaacatatttttgcaacactctgaaaagaccagctgttggagaagagttgtgaagaccgaactttgaacccaaaaaatatgtgacgacatatactgcttgagaaaagagatatagttgtggcatgtacgcagaaaagagactcaccgcactttgtaattctcagacaaagtgcaatgagtctctgatttgataggaaatgacatctttatcgcgtgcggttatgcggcttgttgatgcctgtcacctaaccgccactggataacgaaggttaatgccgccaatccagctagtaggaagaagtcaatttggctgccggtcgcctcggcaccagtgggggcgaggcgttgttgcagcgtgataatggcagacagactggctgtgcctagcgagccggcgtattgctgcagggtgttgaacagagagttgatgtcggcttttgctgggccgtctaccatagtgctggcatcggacatggtgttgccgaagccgagattgaagcccacccgaaaaattagatagaacccgacgatcaacgccatgcctaattgatgcgtgaaaagacctagcagcatggcaccaacgaccatggccgcatcactgatcaacaataaccgatgggcaccgaagcgatcatacaaggcgccgccaattggtgaaactgccgcgccgagcagggaaccgggcaataatagtagcccggcgacagaggcattggtatgcagcacattttctgcaaaaatcggaatgacaaaagcaatgccgatgttgccgaattgcagaatgaagaaattgatggcgcgggcgcgaataccggcgtgtttgagtaatgaaaaattgagtaatggcgtagatgtacggcgtaaatgcgcgcccatgccaatgatggctacagctaatgcggcgccgtagatccagaaagcaacggtgatgcctgctgccgtgaattggtcaagcagttcaatgagcgaaaacaagcctaccgccaacagcaagaagcccatgaagtcgaagcgctcgtccgtggcgcgcgctttgacgcgaatagtggcttcacccatggaccagactaataaaatgacaggcaataccagccaaaagatcatccgccatgatgcatagtaggttaacaaaccgccatatgtcggccctaacgctggtgccagtgacgtgacaacgctggccatgccgacgtaaaggccgagatgtgcctgtgggattaaggtcaggatcagatggaacatcaacggcgtcgaaaccccagttgccagtgcctgtaggagtcgcccagcaaaaagggtcggaaaattcggtgcccagatacacagcactgttccggccagtgcgcacaaaacggcgccacgaaacagggaacgcgtgttaaagcggcgtaataaaaaagcggtggtgctcatgactaacgtgaccatcaataggtagccagaagtgagccattgcaccgtggataaggacacatgtaacgttttaatcaatgttggaaacgttacattcatcgacgtttcaaccagaataccgacaaatgtcagcagtccagctgataaaatagcgagctgcgtgcgatgcgaaaccggtgaagtcgtcatgtgcgtgccttcgtttctataatttagtctgaaccagactcaggccactgctgacgatagcagattcctcagcgacacgcaaacgcaagcgctttcatgtggaaaagattacacactgttagcagggtgttagtcgctaaaggccacgaatacaattaaggccggtacacgctataaaaaagccccatcatcattagcagatgtttcgctaataacaatgggactcatgttgattttaaattgcgttgtcgatggtcaaggactgaccaacactatctataccgaagataaacccggcattgctcatcgcggtgacgaagcttatcgatgagtcacgactccggattgttcgtatctgacggcttgctttttgaggaggccgatgctgatacttactttgaccgctgccgtgaagttttagacatcgaggcttgtgagtctgcttttggcatcgccgctaaatggacacgcggtgcagcatgcgacgatggttgcggatgcttaggcgtcgaattcgcggctgcagtggtcacaaccggcgctttaggtgttggcttggttgggccatctggatcgggtgcatctgaatcaggagccggtccggggccttgcgggtggttgtttttgtgcatctgtttgtcggtcagactgataacactggacatgaccagtggcagcaggaagaccaataagatcagtccgatgatgacggccagcgctacctgaatcaaggtggtaatgccggacgggatcatggccgcaaaagtgccgcttaagataaccgcagctgagatgacaacggcgccgataacggtggcggctttggcaatgcgttgggtcatggtgccgccttccaacgcgttgtcacggtaacgaaccatcaggaagatactgtagtcaacgccgagggcaacgagcatgatgaaggagaagaatggggtgttccacgttaacatggcgcgcccaagtacataggttgaaaacaatctagtcaatcccaatgatgtgatataggccatcaacagggtggtaatgatgctgattggctgaatcacggagcgcgtgacgacgatcaacgcgataccgattccgataatcatgatggcagcggttcgttcgaagtcgccgtttgccaagtcctggaggtcagcggtttgcgacgtttggccgccaattgccacagtcgcatcatcaagcggcgtgtgtttcaacttggcggtgagatccgctttgatcgctttaatttgttgggcggccgcatcggtacttggatcgccttttaacaccacggtaaacttcgtgattttgttgttatcagccatgtaagtcgctaatgctggcttaaaggttttacttttcaaggtggcgtttggaatatagaactttttgcctaaatacgatcgctgtagctcagtcagatattgcttcatgctggtgctgccgtccgcaatcgtgccgagggcttgattggcggaagtgaggccgctttgcatggaactgacttgctgggaaatcgctttgattttcgtgttcaaggtctggacaccggtgttaacctgatcggcaccgctcgcaatttgcgaagcaccattattcagcgtgccattttggctggcgagttgggaagaacccgagctaagttggttgacgccggaaaccagtgtcggtacctggctgttcagcgaattgatgccgctgttcagttgattggtaccgctggtgagtgttccgatgccgttgttcatggcagtggtgccggcgtttaaggtcttaatgccatcacctaaggcacttgtgccatcggtcaattgctgcactccactggaaaaggcgttgattttgtccagaattggctgggtgagctgactggcatccggcaattgattgatgagtgtgatgatttgttgggcagttccggttaacgtctgaatctgattattcaacgtgtccatgccgctggtgagttcgcctgacttgctgctgagctgattcatcccgctggcaagcacggtgctgttgctattgagctcgttcatacctttggctagctgggtggaaccggtgctcaaggtgttgacgccagaagttagcgttggtagctggctacttaactggccgaggccattattcagcgaggtgacaccggatgtgtactgactaatgccgctgctgaggctggtggcgccagaggacaaggttgtggtgccgtctgccaaggtttgcacctgctgggtactgcctgcgacattggcgtttttgatttgggtgttggcgtcattaagtccagcctgcacctgcttcaggcccttgacactttgcgttaagccgctgttgatcgttttgagttggtcgttgagatacagtgacttgattttactgccacctggctgggtgaccgacgccacggttttgacacctttttccttctgcaggtaggtggtgacgtcatcgatcgtgcccaaaacggtctggctattcagcgggtgcttactttgaatataaatcgtggtcggcgaggccatgccttttgagtaatgatcctgaatcaggcgataaccgaccttggactgcaacgtttccggcagttcgtcggcgttgttgaagttcagcgtctggttggcattcagtaaaaatggcacggcgatgatgccgataacgccaagcgtgatgagcgggcgggcgatgccaactttggaaagaccatgccacaggcggctggtgctgtggccatccagattcttgctgggccagaagagcttttcgcccatggtcgccatgaagaacatgttcagagttaagagtaccgtcaaaagaatgagcaccccaatagcaaccccaaccgcggaacgatagaacttgaagttggctagaccgagaaccgaaaagccgatcagaaccgacagtccggaataaagaatcgtgcggccgccgaaacgtcgcgcaatgccggctgccttggtccttgggatgccttgggacaacgcggctttaaagtcgtcatatagcaaaatgttgtaatctgtcccgatcccgaataagacaaccacaaggaagacttgcgtgaaattggaaatcggaaaattggccttatcggcaagcgtcatgatgatgttcaacgatgtcagaaaggaaatcgcaacggttagcagcgataccagcggcacaatcggtgaacggaaaacgatgatcagcacaataaagatgaaaatcgcggcaatgatttccgttttctggatgcctttttctgtgaccgtggcaaagtcatcgttgagcacatcgctgccggtgacatatgttttgacgttcgcggttttgatttgctgctcgagatttttggtttggggccgtacctgacccttggctttgacgtcaaccaacgccatctgagtggtgccatctttggcatcaagctgctttttggtttcggcgttgtcagatgactgggtgacgttgacaattttaacggccttagaatctttgaggcccttgagcgttttggtgatcgcttttttctggattgccgtcagctttttgtcgccattgctaaaaacgagggcgaaggagcggactttctggttatggttggcccttttctcaatgttggccgcaacctggctttcttcgtttttgggcagtgataaagcgcctttatcgcggacaattcccgagacgtcaggcatggtcacgagggtcaccaaaataacgacaagccagaaaatcagggcagggatgtgacgattgcgaagatttttcaattaaagacccttctttcactggtgagaccgttccagacctgatttttcaaatcggcggccaatgctttttggttggaaacgtggccttcgatttgctgctgcgcccagacgatatcaatcatactgacgatgctgccgtatagaatggcgagttgggtgcggacatcggctttgacaatcaccccgcggtcctggccatccatgagcatgttgttaatgagtgtaatcacgcgcccgcgggcggcccggctttcggcattgagtgcttcattgaagacgttttgctgaataaaatgcaactctgtcgggtactgctccatggatgcggttgctgcgtcaaacaagcggccgaacatggtctctgggtcatcgggatcacagtcagcggcttcggctagcgagttgtggaagaaattcataatatccgtaaaggcggtgttgagaatatcttctttgcttttaaaatgccgataaattgtgccaaccgcgacttttgccgctttggcgatcgacggcaggttggtttcggcgtaaccgcgttcggcgaataacttcacagcctgctcgataatcggacttggtacaggaatagatgccatgataacctccttgtggaatgaacgttcattcgcatatgttagtgtttatgaatattcttgtcaaggaggtatgaaaataatattccgctgttagttatctggttatctaggaagacaaaaattgtgctataactcatcacgccaaacaaaacagacgaaatgattaacgctaatgcgaaaattatttcgtctgtttcactcagatattttgttaagtttttaaaaaccagtgccaaggcagagcaatcgtaggccagatggggctcagtggtgaaattgtactagctgggcggtcttcccagcgtagtacaaggccgagctttgagactcagccggttttgctgaggctcaaagtcgtgcccaccacgttccagccccagctggccggagattgcggagtttggcacgacaagaaacgcatagtctgaatttatgcagtcttcaacatttcttgatttatggccaaagcttaatgcaaccaaggataatcgaaaaaattgcggtgccgtttttcaataaacggccatcgattttggggccgaggcggctgccgatgatgacgccgaggccgtgggtgacgaggatgatggcgagtagtggcagggtgttcatgagctggatctgactgaggtagccgaccgcggcgggtaagctgatgaagactgagttgagtagggcaatgccgactgccgcgtgtggttcacagccgagtagcacgagtagcggcatgaccagcactgggccgcctgctccggaaagtgcgcagattaagccggtgacgatgcctaaaatgacaagtaaaaccgggtgattcagatgatcgacgccgggttttggcggatagcgttgttgaatcagaatagcgatgccggatagcaaaacgactaggtagagtaacagctgaacccagctggtcggcaatagcaggtttagtcggacaccaagaatagcgccgacaaaactgccgccgctgagcagataggcgatgcgccgatccatcaatccctgccgttgataatggcgtgatccgagccagccggagataatgaacgcaagaaaactaaacgccagaccctccgtagtgctgtagccgagtcctgccgtgtataagattggaagtaaaaaaccagccacgccggtcatgccgacgaggccgccgattatgatgttgccaattgcgatgatgatgaatgccataatgttgggtagcgccgtgcacacacggctttgatcctttctacatctaatgttaacacttttcgttttcgcatcagccacttgccggccaccatggaatcagccacatcattggcgttaacactttctaataacgtgttgttccaattaccggttggccataagtgcggactgtcgatgtccaggccgataatgtctgcttgataccccggagcgatgcgcccaagctgcccaggcatattcaaagcggccgcaccaccgtctaagaccagcgacataatggtggttgccggcatgatgttggcaatgtgctgtggcacgccataatgcagcgtcatgatcgcccggaaaattttcatttcctgccacagactcaagccgccatgcgccgcgccatcggttcccagaccaatggagacgccagccttcaacagttcaggcgttggcggcacccctttgccagagttgctgaatgggctgtgattgagcttaacgtgatacttttcgatcaaggccttttcggcgtcgtctagaaaaaggctatgcgcacctagaaaatgatcgctcaaggcaccgcgtttggcaaggtaaacataaggtcgttcaccgcaacgggtcagaatgccagccacttcttgagggtattcgttcatatgggcttcgagaaaagtgtggcgatcggcggcgcgttgagcggccagatccacgagttcgtcggaacaattattcaacgcccgcagcgaataataaacctgtaaatgatggcggccgtgaaactggtcataaagtgcatcagtgtgggcaatggcggttttggcatccatgttaatcgaagccggcagcctcggatcgtccatggttgaataggcaagggcgccgcgcaatccgctttgcgcataaacagttccggcggcggccatgtgataaccgccagcgtccacaaatccggtcgtgccgctggtgatcatttccagtgccgccagttgtgcgttcagcgtcatggtctcgggagtcgtatcagcttcaaacggcagcataatctttttccagataatgcctttggtgtccagcacgcggccgcggagtaattgctggccggtatgtaaatgactgtcgatcaagccgggcatgaataaacgatgggtaccgtcaatgacgtcatcagcttcggccggaaaactgccatggtcgcctacctgcgcaattttaccgtttttaatgaaaatatcctgatgcggcttgatctcaccgggcgcggtcatggtcaacgtatcttggatcagtgtgctggccaattaaatcacccctgtcagtttcaacgtgagggtgtcccacaaaagcgagccgacaaacgtcccggtcatcacggcaaccccgacgatgatgtacttccagccttgatgaatgaaagtgccgagcttatcggaaattgcaatcccggcaaacgagccgaccacggtgaacggcgcggcgaaggcgatgactttggttgagctgatgaccaccgctgcgatcggtgaaaacggtgcagcgaccaacaatcctaaaactgaacaataagcgataatgggtaatttgaacggcatgattttggctaagacaacggcgacgagggtgatggcgatgagaatgaccacgccggggagacttttggcgatgctgacgccggaaccgatccagttagctagcaaggtaccgacaccgcagacactgaggagaaacaaccattcacgtaatcgcattacttaatccgtcctttcactgcagcaggcgttttggcacggcggccggcgaacattttatccaaaatcgtgtaaagcttatctgtcagcggaatcgccaggaacatggtgatgtaaataccagtgatgccggcgatggtattggcggctgacgccatggcggtgatggtgttggcgtcgtgagggaatagctgggcgaggctggcgctagccgaggccatgaagatgccggccccgacgccagtggacatgcccagcgccttgggatcaaaccagccggtcatgccgagcaccgtggccatgatgccaaaataaatcgtgccgagaatgccaccgacgatataaatcgccatactgccgctggcttcgtcagaatccgaaccataagccgaattgatcaaggcgaggtgatactcgcgattaagcgaactcgtagcgccgatcgactcgcgccgcaacccgagcagcatggccaaagggaggccgaagaaaataccgagcagattgccgaaaccatgtactaacaaggcagggccggcgtgcagaatcatatccatattcgcaccagccgtaatgccaagattgaccacaaacgggcagatcccaacgatgaccagtttcgatgcggctttgacgtgtttgttgtcaaaccagtgcatcacttgcggaccacttaacatgccgagaataatggcgtagaaaaccggaaataaaatgatcatcccaggaccgactttgagtttcacggttccgatatattcagcgatcgcggtgaataaagcagcgacaagataacttttccattcgactttaatacgtgcgcgtaagctagggtaagtcatggggtcctccttgtgaaatgaatagacctagtttagcgcaattatttgggtaaataaaggacgattagattaaaatacggtctaatgttcgtgtttgtcttttgcaaactgatatatctgcggtgaaaataaaataaatgacactattgacgaacttgtaaattgtgataagtgtagttaccttagatgttttttgccgtgccaaactccgcaatctccggccagatgagggctggcgaccgcgaagctagagtggtgggcacgactttgagcctctgcaaaaaccgcagagtctcaaagctcggccttgtactacgccgggaagatcgcccggctagtacaatctcaccactgagccccatctggcctacgattgctccgccttggcactgacatttttaatttaagccgactaactaatttccaatacagaaaaacgcgaccgaattttctactggtgaaaattcggtcgcgcattcttttttaatcatcactcagccactaactaatccaaactcatcactcatacgatgtgcttttatcagcctgtttgatgatctgcaaatacttatagatgctgacggtggacatgttgaggtatgccgcggttttggcgacggcgtctttgagttcgaagaagtgttgctcgtaaaggcggcgcacgatggcgattttttccttgcgggtcaggtcggcgattggcgggttgggggttcccgtttgttcgatgaccacttgccgaatggcgccttctggttgaatgaacaggttttccgttgggggagtcgattcaagcaggtccgcggcaggggctagttccggttggaaggcctgaaggagttcttcgcttaatttttcaagcgtcgccagttgttggaagcggctgacgtccgtgttgatgcagatcatgccgatcagctcgccggcttggttcttgatgaaaaaactggcggagttgacttttttgccattcatcaacgtgctttgatagtgcacgacgtaatcctggtgctgatacagtttatcgtgtaagacttttgcgatgaagtcggtagccggtgaatccatggtgcgtccggagatgctatttgccaagaaaacaatcgaagaatcatagccatcggtcgcgggattaatggcgtgcatcacgatttctgtcgtgggaccgagcacatgcgcaagaaattttaaaaatggacggtaagaatcgggggtgatcgaaatccttcctttcttgataaccgcagcagtcccaggattcgtcggggttagattttggctaatgcctgggtcaggtcagcgattaggtcttcagtatcttcaatgccgcaagataggcgcagcaagctgtcggtcacgccttgagcagcgcgttcctcggcggttaaacaggcgtgcgacatggtggctgggtgggacaaaatggattccaccccgcccagactgacagcaaaaatcggcaattgcagcgcctcgataaacgtgttcaaccgcgctttgtcggcgccggcaatttcaaacgacagcaccgcgccgccgttttctgcttgttgcatgtggacggcatgaccgggatgctccggcaagcccgggaagtaaacttgcttgattttgggatgggcctgtaaaaatgctgcgatactttgggcattttgcgttgattgctgcatgcgcaagcccatggttttcataccgcgcaaaaccagccatgcgtcttcaacgccgagaatgctgccgaattctttttgaaacagtgacagttcttcggcaatggcctgattgtttgtcaaaacggcgccggcgaccacgtcactgtgaccgttgatgaacttggtcagactttcgatgacgatatcgcagcccagtgccagtggcttctggtaaagcggcgtcatgaacgtgttatcggccactgtcaggataccatgtgccttggccagcgtcacgatgggctgaatgtcagtgactttcagcagcgggttcgacggcgtttccacgtagatcattttggttttgggtgtcagtgcctgttcaatattagcaagttgatcgtaggctgtaaacacgacatcaatgccatacttaggcaggattttggtcgcaaacgcgccggtgccgccgtagacttcgaccgggaaaataatctgatcaccggcattgagcaacatgatagtgttggcaatggcggccatacccgagctgaagacaaagctgaattgtgccccggtcattttggctaagccttcctgcaaggcgtcaatggtcgggttgccaaaccgcgtgtacatgtagtcgcgactggttcccaatgccgggctgttgaacgtagacgcttggtacttaggaatcgaagacgcaccggtatggctgtcgatgaccgggtagccatgtaaaagatccgtattgatacccactttttaatcctccgggacttccgccaccatgtcgacttccagtaatgcctgcgctggtaattcgctaaccaaaaccgcggtgcgcgctgggtagccgtcatggaagtaagtccgataaacctgatcaaaactcgccagtaacttgagatcattgatatacacggtggttttggccacatgatcaaaagacgtcccgttatcaaccagtacgtgattcaaattggtcatcacttgtttggtttgggcaatgatgccttccggaacggccttggattccggactgagcggcagttggccagaggtgaaaaggaccgaaccgatctgggtcgcggcggcgtaactgccaaggggagcggggatgtgggtgctggtcaaacgcttaatcatattcatacctctttttcttagtttgatagttgaagagcatcatcccaaacggaatcacgacataaccgaggatcatggcgacaatcgcaaaataattcggggcatgctggttgttggcatcgaggatggtaaattgaccgatccaatcgaatttgatgagcaataaaacagtcaggatcagtgacaccgccgggcaaaccatgtcagtgagcacatttgggcgcgccggattgatgagtcggcgatcaccacggccacggaagaatttcatgacgcacagcggaataatcagaaactgaacgaagcgggagatggagctgagaatgatgatactcgtcatgtcataacggaaagccatcggtagcaacaccgccaaagcgatcgtcaaaagaaacgccggcagcgggaagtttttcgcggtccgcccggctaaccagcttggcagttgcccttgtttggcaatggcttccaacacccgcggactgtggaaagaagccgcaacgttgatgcctaacattgaaatcagcgctccatataacacaatgttttgaatcagcgggttattgaaaaccgccactaaggccacgacttctttggtggccatcatcgcctgcggatttaccatcatggcaatccagacgacaccgatatagacaaccgcaatcaccgaaatagccaggggaatagcaatcggcaggttcttttccggcttgtacatatcatctgccccactggcaacgctttcaaaaccagtgaaagcataaaacgcggcaataacccccatgaccagggtgctcagggttgcgctgctgcctgcgctggtcaaccggtcaatctgggcaaaatgattcacgccggttgtggcaataacgccaacgccgaaaatgatgaaaaccaacaaggcggctaacttaccgatcgttgacagattgttgacaagctcgaagaattttggcccgaaacagttaatcactagcagtgccagcattagcaaaatcaagctaattgtgactagcatcaaatcgttttgatcaaaaccgaaaatacgcaagacggttttgacaaccgcggtggccataacgccccaggcaatgcaggtggcgatgtaacgcgtgatgccgacgtagaagccgacgtgttcgccaaacgctgccttggcataaatataagccgcgccgctatgtgcgacatacttggctgctgcggcaaaggtcactgccaggatcgccgcaaagaaagccgcgatgccatagagaattaacgctttggagccagaagactgcaccacggcacctggtgaaagaaaaataccggagccgataatggaattgatggccaataaaacgattgaccagaaaccgattttctttttcataggctcgtgctacttgccgcggtagcttgcgtttgttgaatgaagtgactgaatagggcgttcatgagcggttggctgtgcgtgagcatttccggatgccactgcacgcccatcatgatgtgatcgccatccgcttcgatcgcttccggcacattgtccgaagcggtcgcgacaacgtgaaaaccttcgccaatcgttgccatgatctgatgatgaaacgagttcacccgtaccgttgcctgctttaaaatcgtaaacaggcggctgtgctggtcgatgcgcacggcatgcgtgacctgcgctgaattcgttgcctgccagtgcctgatcgtcggcgcatcgcgataactgagatcctgataaagcgtgccgccgtgatagacattcagaatctgggtgccgcgacaaatccctaatatcggcagctggcgttgtttcgctgaccgaatcagatttaaatcaaacgcatcccgtcttagtgacgtgtcacctaacttgtccaggggatcatgattgtagctgctcgggtcaacatcatggccgccggataagatcagcccatccaaggccgcgacttgtcggtcaatgtcagcaggatcatcgagtaacggtaaaatgaccggaatgccgccattttcggaaactgcggtgatgtagtcctcgttcacataatcacgtttgtagccggggaacatgcctccttggtcaacaaggacgcctgctgaaatgccgataagtggtttcttcatattattcacctccgattttgagtataacataacttctaataagtacaatattttataaaaataactaaaggtattttatattagtggaggtaatcgctttaattaagcaatcttataataacgctgattttgtattgaaaacgagtgtgggcgcgggatttttataaataacattagcgctgttctgaacattgtgaatttgggcaatgagttctgggccgtgccaaacttcgcaatctccggcggtttggggctggcgacgcgaagctagagcggagggcacgactttgaacccgcaaaaaccgcggtttcaaagctcggccttggcctaaaacgggaaaatcgcccgtttaagaccaatttcacagctgagccccctctggcctacgattgctccgctttggcactagtagattattaatcctaacaaattactcttgagaaacaaaaaggcgagtgaatctccgtatatgaagattcactcgtcccatttagtaactatgaactgttagacctacttttatgaagcagcctttcctttcggctcgagtcggcgttccaagaagccgaggacgaggtcggagatgatggccattagcgctgtcggcaacgcgccggcgaggatgatggctccgccgttggtggcgttggtgccgcggatgatgatgtcgcccaggccgccagctccgacgaaggcgccgattgcggtgatcccgatggcgacgaccaaagcgttacgaatcccggccatgatgaccgacatgcttaaggggatttcgaccatatacagtgactgccagcgggtcatgcccatgcctttagccgcgtccatcaggttcttatcgacattttgcatgccggtgtaagtgttcttgatgattggcagcagcgagtataagaagaccgtgacaatgacggtgtttacgccaagtccgagtcccagcatgatgatcgaaagcatcgctaggctggggatggtctgaatgacgttggcggtgccgatgactgtgttactcaaggtgcgatggcgcgcaattgccagcccaactggaatgccgatcaccgctgcgatgagcaccccatagatcgaaatcagaaaatggcgggcgaactgactcagcacgtaggaaccattgttggcaaggtaataccagaattgctgccaagtatccatgttagccattagtcgtcacttcctttgaaatagttgtgtttggcaagaaacttttgcgcgaccacatttggttcaagtaactggtcgtcgacttgatagttgagttcctgcatggttttcaggttgatcttgccgtctaagcgatgcagtaacggttttagtttagggtatttcttcaaaaggctattattaacgaccaatgagcactgataaggcgggaagaagtttttgtcgtccttcagtactttcagattgtaactgcgaatccgtccatcagtggaatagccaagaactgtctgcattcggtttgcttcaacggcatcgtaaaccagaccaatctgcatcggataaacccgcttaaagtcaaagccatatgctttagtaaaatcgctatagccatcgcctttccggttcatccagctggagtcaacgccggcattatattgcggtgcgactttcttcaaatcagaaacggtgttgagattgtcttctttggcttctttttgcgtcaccataaaggcataggtgtcagaaaagccgtaagatggataccaggtctgatcgtagcgctttttgaactcgcgcttgacgatggcggtggccttagctgagttcttgaccgggttcatgcctaatgtgccggtaatctcggtgccggtgtaacgcgtagcactaatatcggcatcgttgcggaccatggcttgatgcaccacggttccggagccgaggttattgaccaacgtggttttgtaacctagctcgtgattgatcagttcggcaatgatattggccatgatctgcgactcggtactggtttgcgaggcgatccgcaccgtcccgtcattaccggagccgcctaagccaggaaagccgcagccgctcaacaagagaaccggaatcagcaaaagtgacaggaataattttttgaactgtttcatcttgccacctcctaagcgcgttcactgacaggtgtcaggtggtattccaaccgcccaagcaaccagtcaacgaccagtgccaaaatggtaacaggaatcgtgccgccgataatcagatccggctggaagagattcaaaccgttgaagatcagatccccaaggccaccagccccgatgtacgaagccaaggttgcccaggcaatgacataaatagctgacaagcgaatgcccgccatgatcaccggcatcgccaaaggcacttcgacttgccgaatcgattgcatcgccgtcatgcccatacctttagccgcgtctattaacaccggatcgacatcttccataccgatatacgtattccgcagaatcggtaacaacgagtaaatgaacagtgcaacgatagctggcactttcccgatcccgaataaaggaatcatcaaggccaacaacgccaatgatggcaccgtctgcagcatgctggcaataccgatcacgactttagcggtcttaggaaaacgcgtcagcaaaatacccagcggaacggcggcgatcaccccaagacctaacgcaattgccgagatgtaaagctgttcccaggttttggtgatcagttcactgccatgtgcgtttaaaaaagcaaacatggtcacacctccttaggtgcgtctcggtcatctgccgctgccgaatcggttgccggttcatgattggtaggcgttgccgactctttggcgctatcgctggcttgatcgtcttcattttcgccccagatggtgtcgtaaacgacatcaactaatgaagcacgggtgacaataccgaccaatttctgatcgttatcaaccaccggcacatacttgaaaccgcgctttaaaatgcgatcagcggtatcgcgcagcaaagcgttcttattcacatagaagatactcgacttggtaatgtcgccaacgctagtagcactttgataccgggtttccagcgattccaaatcaatgaagcctttcagatgattttcatcatccgtcaccaacagcgtatcaacgcgacgtttacgcatcagggaaatcgcttcagctagtgacttgcctggcgtgatcgctgcaggattcttcagcatgatctgctcaacggtggtcacatcagcccgcgcttgaaccaatcgatcctggccgaccaggttctcaacgaatttgttcgctggatgcgtcaacagttcggttggcgtcgcattttgaatgatatgcccgtggtccatcaccacaattttggttgcgagcttgagcgcttcatccatatcatgcgtgacaaaaaccacggtcttaccaagcttctcctgcagattcttaatcagttcctgcaaagcctcacgggtaatcggatccaaagcgccataaggttcatccattaaaatcagatcctgattcgcagcaagcgcccggataacgccgattcgctgttgctggccaccggaaagctcggatggataacgatccagataatcctccggcaattcaacaagatctaccagctccttagctttctcgcgtcgcttttcttccggccacttcaataacttcgggacaatggtgatgttttcataaatggtcatatgcggcatgaggccaatgttttggataacatagccgatttgacgccgcaatttgacggcatcgattttgtgaatgtccttgccgttaaacaggatttggccgccgctgggttccagcatgcggttaatcatgcgcatcgtggttgtcttcccggaacccgacgtcccgataagacaaacaaactcacccttatgaatctcaaggttgatatgttcgaccgcgacattcccgcctcgataaactttttcaacgtccttgaactggaccattggttgttcttctggcatgacgcgtcctcctttatttgatgattccataataacacatgaagttaattgtattttaatcgaagaccggttgtggggagtgagttttgcgcgggttgggttggtgggtgatttgtaagttaactgggtgtatgaggtattccttaaagaggaaagttgatgaaaggactaaaagcttagttgtttgttaggaaatggaagtttatgattgagagaatacttttatggttatgttaaatcgaatgtcagtttctgacttagtttaaaggcttctgcgtttagagtgtctgagttataaactgggaacaggagtcattgttttggaaaaagctaagtccatactttggggaattatcttattcatacccatactttatctcgctgatggggtttcgcttgttggtacctttacgacgaatatcacactgacctggatctttgtctttggtagtgcagcaatctccataacgttgttgacgctgctagatcgaaaaatacaaaacagaccttcatcgcaaaaacaacaatcatcgtatttgaaatatctgctgttgccgattatttgggcaatcttcattgttgtggtcaatcttgtcttgaataatcttgcctttctaccgcattcaagtgagaatgtcttacagtcagaaacagctcaattgctgaaaggatcattaagatggccgatgatgttggcagtttgtctatttggtcccatatgtgaagagctagcttttagaggtgttatagaacactatctgtcgaagtttttcagctattgggtggcggttgtcgtgacggcgcttatttttgttttacttcacgcggaggctattattccatcgctatctttgttcatcttcgctgtaggactaagtgtactcaacaaaaattcgggaacgttgaggacaagtatcatagcgcatatcacctacaatgtgctggtcacaatactagtgatgattcagttgtagcaaatttttcgtgatacgaactttgacggttgggtggcggaagaagtcctgatttgattagaacggccgctacgataatagtgcaaatcgatacgtttaaaattcggcagtccgatttgttggagaacggtatatagttatctcttgtcaggcgcgcttacagaaactgcatcttaattttttactgacaatagcgttacgaccagagacctaagcgaggtattgtcagaaatggtttggatagcgcaggcgcttctgggcgttaacaatagtattggatgtgataaaaatgtttaagcacaacaagaagcccgatgataaggaaaaagtactaagtgcctattatgattttgtgcttgatccaaatatcactgatcgtgagcgaaagattgggctcttagccaaagatgatatcgagcgaggaagatatttcgttgccgttttgaatcaaacgctaattagttttcaaagggaagcgatgcgaacaggtttgacgaaggatgcttctaaattctatgattttttggagccaattctgaacagaaacgtcccctttggaaccaaccgtggtgcttatgggacgcttagtggctaccttgattgagcttttcatttaatacaagcatttcccctccttcatggatggcgacaatgctttttttgaaccgcatttttacttactgtgatgatggttaagcatcttttttaaaagcttctgttttcgaaaactgacgtccagtttggcatcgttgtccatatataagtaatggttgttggtatccaattgcttaatatgatccgggttgaccaagacgcttttgtggacgcggaataatgttgggtacaaagaggcgatatggttaagattgtcatgaaatgttgcggtctcgttaagtgcatgcacctctaagttaccgggattaccagtagccgtttgaatatagattagttcgtccaatggcacagcgaacatctgtccgttgactgagtaattgaattggttgtgagaccggattttacgatcttcgacccggtcaaggacttgttgaatatcacgtcgaagttggttagaggtttcagctatcggagcatttttatcgattaagtctaagggtgcgattttatgagttaagattgaaagtgctgcctcagtgtggttggttacaaagattatatccgtgaagagtgatgcgttccttatcgctgtcgccacgtcaaccccactaaggtctgagttgtcgatttctatatctaacaggtaaagactgtcttcttcggcagcgggtttgattgtctgaagtagcgtctttggagatgcggtggcaagcttgattgttgctgagagttcctcaatcataataaaattctttagctcatgcgttagagtttttaaataagcaggattatcctctagtatataaatgttgagcaaaatattattcccccacaaagagactaatttctaaatgattttgacgtttcttctttcgtacgttgaggtccgggtatttctgaacaagttcattgataatcgccataccctgcccgtgatttgggcccttagtggtgaaaccagaaccgtctagtacctttaaatcaaagttagttggcacattattgacgacagttagttcaataccagtcgaaggcttatacagtagcaagacttcgaattggtgctcctttagcttgacggtctcatcgagcgcattatcaatcaaaattcctaggatacggacaacagttagtcctaaatcagctctgacgtcggggatccgcttatcagtgcgaattaacatttcaacacctttattggcagcctcgttccactttaaatataggagacttttgagagggatgctttcaacagcagcaagcatgtcattacttatctcggcggtgctaagcgagttctgagcctgtttgatgatggcctgtgtactactggaagaagaggactccttatcagtttcgtttagcgatacctgcaaggttaagagaaggttcttatagtcatggagaattttgtttgtttgctttcgctgttcatcaatggtggctgaatattgccttcgagccatttctgcctgcttaagccaagtgagttccatgttatatttgaatgctttcagcaaagagaatattgagaatgcgttaatacctatggacagaagaaagacgcagagaacgaacatttcaactggggttgggatggtcaggaagttcagaacaacctcaagcacatatagcaaaagacaaatagttcccgttgagatgattatacttttagcaataccatggttttgttgcatgaactctcgtacagttaaaaggacatgcatcttagttaataataaccatgttactaaaaagcagtataacgtcacactaataaatatcccggtccagccaatgacatctaccatctggggagcaaagacttcagctactccgacaaatattgtttgaatattgacgttaacaagattgagatccataaacaaaaaaatccacagcatatctgcaggcttatcggtatatgccatgaaggcaatatatagtatgccaaatagtatttcgccagaggttgaaaaaagcgtagagagcgtcatgcccaaagcagaccagaagaagatgtagcccggttttagccgagcatagaagatcagtgaaagaacggaaatgcccgcaatatagattggtaaaaaagtaaaaaaatattcaaatccgggaacaggtgtcaaaatagtcctcctcaaatggattacatacctaattaaatatacgatgcctagtttacaaagtctaacgaggttttcaaagaggaagagagacgagtgacgttaatagcggatttcgatacgttaatatttttgtcgctcagcttttgttagttctgataagctcatctagacagattgaatgaggcagagttttttgaacaggtaaaaaacatgagaggcgttgtgaatcaagtgcaaaaacaaatttctgaagattataagcacacactttttttaccaataatatttgggcttcttgtaccacctttcatcattgctatggcaaatgaaaacgaaatcggatttatatcctttatcggaatgacgattttgtgggcgtatgttctttttacatatggatatcttcggtgtttgggtgtctttaaagtatcagttgatcgggcggtcaaaggtttattggttgcgatggtcatattgcttttccagatgctgattatgttccttacaaaagctcaaggtggggttggtcagtttagaggcttacatttgaatattttgctacccgttgcttgtttaattggtccagcatgggaggagaccatttttcgatacgcgataaacatcaaattttttaaaggtggctttaagggagtttgtgtttcttccgctttattcgctgttgctcatgggtctacgaggctggttgatctcttagtatactttggcatgggatttttgctttgcttagctaatcgggggcgtgaggatatctttgcttcggttttagctcatagcattattaatgtggttgctgtattggcatttgtagaataaggagtttagacttgacgactcttgctcttggccttcgagatttattactacaaaaataagaaaactgacacttccgcttttggcggttgaacctgagtgcgggcttgtcaaacgttcactttattgagctcgatagacttgcaggtagatattgaaacgagttgtgaataccttaaatcccattactagatgacagtacatatgtggaagacaacaattaccaagtttgattcagtcacgataactcaactaaaagaatgcgagatgtttaaacacttgaaaaaaacttctagaaccagagtggctatcatgctcataattttggtagcagctttatcaacgcatgacagcccagtcctatttaaaatcttcgtgcttatttttttcgtcgttatgaccttcaacattgtttccttgttgagaaggagaaagtcgttgcgtaaatgaactaggctattttcgggtgctgatagatcaatagatgatttgaaacccaaaacagatgctgaccgctttgccaaaaacttaatgatggtgaggcgtttttttcgtgcaccacaaaacattgacacgactatttaacatagttactattaacaatgttaatagtaactatgttaggagacgcttatgaaaaaaaccgtatcagtcgtcattgcaacttgcattggaattttcctgtgcatgctagatacgacaataatgaatatcgctctgccggctattcaaataggactaaatgtcaacttgtcggatctttcctgggcattgaacatttatacaattttgtttgccacactgaccataccgttaagcaagctggctgaaagagttggtattaaccggttctacttaataggactggtaacatttgccctgggttcacttgtatcggcgttcgcaactaatattgttttacttgatgttggcagagccattcaaagtgtcggcgccgctacggtatttccattgtcaatgacaatcggcatttcgacagttgacacgtcaaataggccaaaggtgattgctgctttgggtgtcactcaaggactagcggcagctttgggcccagttatcggcggaatcgtgacacagtttctgtcatggagatggatattcttaatcaacattcccttaatgatccttgtgttgctgctagtgacttttaatctgtcaatgaatcaggaaagaaatgcaaagccgattgatttacagggatgcatattgagcatgatcacgctcttctcccttacgcttttattgataaaaggccgtgaatggggctggacatctttttcggttatttgtttggtaatttcatttttagcgggatgtatcgcatttgttttcactgaacacttttccaagaatccaatggttccgctagatctgtttaaaagtcggcaatttgtcggtgcgtcggtagcgattgtcttaagcaatttgtttttagttggtgtgacagtgatcttgccgacttactttacaaatattcagcaaaaaactgagctgactgcggcactgattattactccgataacagttatgatattcatattctccactgttgctgcgctaatcattgacaaagtgggtgcgagaatcgtcgtccttttggggtttgtattaatggcagtcggatatgccatgttctttactgtcaatttatataactccttagaggtctttgttgcctgcacgatcctaggaacgggctatgggatcattgccggacctattacagttttggcagccgcagatttcactggcgaaaagctaaattcttcgcaaagtgttgccggagttctaagacaagtgggggtggtgctggctgtggccatctttgtaaccaatttatacgctgggctggcttcggcgaaagttagctctgtgcaatttgccagtggccgaattcaacgcttaacaattccgcaaaagcagaaaagcatgatgcttaaaacgactaaagatgccattagcacaggtaaaacacatcagagatttccagtcgatcacttttcaaaaatagaacgaagagcgatgattcatacaaactacgtcgccgcggtttctcgaataatcagcccatcaaattccgaaaaagttcaaataatgagacaggtcaagaaaaaggtagatttagtgcttataaaacaaaatcacaatatcaatgcagccatcggtgatattcaaacaaaatcggaaagctacttcactaatgcatttaagcttctgtacagaaacacactcccgtttctattttttgcaatcctagcatcgtttattttccctgcgtttaaacgggaaaaggttagaaatgtgcgccactgacgatcagtcgttaataagcgtttttggatgttgccgtgtggttgtctattacaaatagcttcggtaacttttaaattggaacttcattatgttactattgtcaataattacataaacaatatcaacataaaggagcgaaccagattgcaaggaaaagacgttgttttagggttattgaatcaacgcgatatgtctgggtacgagataaaggaagtatttgaaacacagctgaagttcttcttcgatggcacttttgggatgatttaccccatcctcagaaaactggaaaaggatggattgattcaaaaaaagcatgtggttcaagatcttaagccgaataaaaatatttacagcatcacagagctagggaagaaagagtttatgacctacctcaactcaaaaacggttgaggaaaccttcaaatcagactttttgatgcgtatgtactttgggcaggatcttgatcgagataaagtcatttcatttgttgagcaagaaatcacgcgaaaaaagacgaatctctcggaactgacggataactatgagcgctggacggataatggcatgaactctttccaagaaatcacctttatgtacgggatagcttattataaaagtgaaatcgaagtgctcgataaggcgttagagcagttgaaaaatcagaattaaacgtcggaagcagcatgagatcagttacttagtatttaacttgaggcggtgtcagcctttcctaaatgattaggaagctggtaccggcttttttcaatcgcataaaaaatcccgccgcctttctccgaaaattgatcacggtcaaggcggctttttgaatgcctcggtacactgaactcgacactaaggttcacgttcaggagggaaagacgatgcattttattcagacacataaacaagaagcgatgattagcggcggggtgctgacggcgctggggctggttttcagtcaggcgtggttgttggtgctggcgagtttggtggctgggctgccgattgcggtgaatgcctgggaagcgttgcgatataagcagattagcattgagctgctggtgacgattgcgttggtgggcgcggtgctgattggcgaaccggtcgaaagtgccgtggtcagttttctgtttctttttggcgactggctggagcagcgcagtctggcgaagacgcgatcggcgattcagggtttggctgcggcggcacccaaaacagcacgccgggttgatggctcaaccgttccggtgggtcagttagcggttggcgatcaggtgcgcgttttggcaggtgagaccgtgccagcagacggaaaagtgatcggcggacacgcgaacattgttgaagcggcgattaccggtgagccggatgcgaaaagaaaacaggctggcgcgaccgtgtattccggaacgcagattagcgatggaaccgttgatattgaagttgaaaaaaccggctacaatacggtttatcaacagattatcgatttgattgaagatgcccaagatgctcagtcaccggtcgcgaccttcatccagaagtttgcacgctggtacacgccgctggtattggtgatcgcattgatagtcggtttggtgagccgggatgtacggctggccatcacgattcttgtacttggttgccctggtgcgctggtgatcggtgcgcctgtcagcaatgttgtcggactaggttttggcgccaagcatggcattttgatcaaaggcggcgatgttgcgaccaagttggatcagattgacacggtgatgtttgataagaccggcacgctgactcaaggcaaaatcagtgtcgtaaccgcgcaatactgggcggctgatagggcgaatgtggcggagatggttgcagcggtcgaagcagcgaccgcgcatccgttggggcaagcgttggtggcctatcttcagccgcagacaaccaagacagttgaagacgtcagggtgactcgcggcgttggtgtgcaagcacaagtagctgggcatactgtcagtgtcggcaatcaaaagattttgaaacagccgcaaacactggaacaacaggaagccatccaggcgattgtgagcggcggcgcttcactggttttagcaacgattgatgacaagctggttgccgcgtatggcttgcgggatcaactgcgttcggataccgcaacgatgctggcggacttaaccgcaagtggcaaaaagacgatcgttctgtcaggcgactcgcaggcagccgttgaacacatgatgacagatttaccgctgagtcagacacacggcgggttacttccggccgataaagtcagcgctatcaaagccgcacaggcccgtggtgaaaaagtgatgtttgtcggtgacgggatcaatgatggtccggcgttggcacaggcggacgtgggcgtcgcgatgggttccgggatggatgtggcgatcgataccgcggatgtcattttgaccagcagtcggctcactaatcttggcgttcttttcaatttagccaagcgaatgaataacaatatcaaacaaaacttggtgattgccatcggaacggtggcgttgctgctgagcggtttgctggtaggcttagtcgatatggcgagtgggatgctgtttcacgagatctcgattctcctcgtcattgcgaatgctttgcggttgcggcacaccccaagaaaatggcaaaacttgacggcgatcaaggcgcatcagccgcaaactgtgaataatgaaggtaaataaacaagaaaggatttttaaaatgacaaaattagtttatcaattagacggattgacctgcccgagttgcttgcagaagattgaaggggcagttggccaacaagctggcgttaagagtgttaaggcactttttaatagtagtaaagttaaggcacagattgatccagcggttacgaacgccgataccctgaagaagacaatcacggatttagggtacaccgttgtcaatgttcgtagtcaggaagcgtaggaggttggatgatgagtgtcacaacagggatgcagacagttagtgccgagcaagtcaaggctcgtcaagcagcagcggcaaagcaagccgatcatgatcaccatgtcccgactgccggggcgatgagcgggcatgttttggcaaatttacaggttttagcacgcaagctggaacaattccgcttgacgctgaatggctcgagcagcgagactgacagacagctgttaaccgaattgctagagcaagcccggcagcattttgcagtgttggcgagcgacttggcagcacagggcgaagattttccgaccacaacagcagagttcaatgaatataccatgttgaaggaagatccggcgttgcggttttggaccaacgacatgaagctggatgcggttgtgaatgatcttgatacttgccagctgttcgtcagtcgcgcgattccacttgccaataaggagaataaactcgtgttggcggcggatatgttacaattgcagcactggcatgaacagagtatccttcgcctgcagacgcgacttggtcgggcagtgacagccggccgggagctgcttgacgaggatgaagacgactgatcggtgattcaggaacggtgcacagattgatttttcctaagcgcaggaggtgacaacacattgcatagttgtacggcagttgtgccgttgtttaaaaaactcgatgacaaggcgcgtgcagccattgacgccttaacccatgagcggcaggttgaaaaaggaacggttttgatcagtccggatacagacgcccgtttattggtggtcgctcagggcaagctcaaaacctaccagttggcgaccaacggcaaagagcaattgttgcgcgttgatggccccggtgattatgaaggcgaggctggcttactcaacatcgctagtccaaacgtttacaccgaggcgctaacgaccgccacagtctgcaccattagcgcgtcggattttcaacaactgctcatgaaacaaccgcagatcagtctgcagctgctcacggaaaacactcgcaaaatgcaggcattggaaaagcaggcgggctatcttggcaatgattccatcaatgtgcgcctcacccattatctgctcgatctgcgcaccgcggctggaaaagacaccgtaaccgtgccaatggcgtggacgcaattagccgattacctcggaacgacgccagaaacggtttcccgtactttgaaacttttggcaaatgaaaagttgattcggcgtacgggtaaacaggtgacgattttgaatgctgaggatatggaagattttgtttggtaaatgcgtcaagttgagcgtgagttcatgcaaaaagccagtgagagattcgctggcttttttgcgtggtgtcaatgttggtaaaactttctgaatagtgttaattttcggaaatggtcaagcctgtacgttgcttttttaaaatgataatagccaacaagataaccagcaacaaatgaacaatagccgatacagtactggcctcgagaccgaaagtcccaccagtcagtggctggaatgttgtcgtaggcaatgattttagaataaaactctcaccagataaaccggagacagaaacgccaaatatagggccttccgcgaagttccagatggcgtgaaaagcgccgcaaagccagatactgccagtcaacaaccgaaactgtgacattgctatggcaaataagaacaagccaatggccgcaggaaggttgaagccgggattggccatatgtaggagcgtaaaaagaatcgcgttgagcaaaacagccattatgaccttattttgcttaagccaatagcccatgacgtagccgcggcaaagcagttcttcaaacatggattggattgcgtaaccaataaagaaaagaaccagccaaagcaggtttgatccttggaagataaccaggacttgatacccaccaaataaagtgatgatgccccaaatgagactgaacatcatgaatccaaaaagtaagccaagtgaatagtttctggcagcgtggtcttttgcaaacggtaagatgtcgcgatcaccacggtaataaatgaccatgccaataataccgatggcctcaccgaacaagaaaagcaaatcaaaggattgcggaatattggcttcgtcctttaaggtgccgaataaccccattaaaaaaggaataatgtcagataagagtgaccaagcaaaggcaatgacgaaaacaagggcaatcgtcgtgagtgacttaggtagttttttgagctgattaatcgtgctcgcctccgaataaaatttggcttgaagatgtcaaggtcgacaaataagcttcttttaggatagccttagttttcttatagggcaaatgggcagcatgcgactcaaaagtagtcaactatctttttgtaccaaaaaacagccagcaaataacatttgctgactgcccttcacatgctaccgcttattgcgggtggtaaatcccgcggcgaacgcatgaaccacatctctaaagaaagattatcggctgacaatacctttgtcaacttaataaaatgagttcgcagatccttttacggttcggacgccgatcactttttcctaaaccactaaagcggccagcgcccttgtttcaacatcgttgccaaattggcgtcttcaagtaaggacttgtccgtgatgacgcgcttgagcattttagcgatgaagccggtgtacttgtgacccttgccaatttgggcgataccatcttggctgccgagtgatgccacagtgcccttaggcttgtaaacgaagtccgtcaacggctgaccgtttaacgctgcggcaacgttcttaccggcttgatcgccttcctgtgtggaaatttgtgcagtggttggataaggccggccggaatcgcctgccattaccgcagacacatcaccgataataaagacctcaggatggtcgtctaagttcaggtgattggaaactaccacgcggttacggcgctgcttgaagccggaatccgcaatcacatcgctgccggaaacgccgaccgtccagataattgtgttcccttcgactttcttttcctggtcgccatcagcataaaccacggcattcggctcgatcttcgtaatcttggagccagtcatcatcgttaccccatgactcttgaggtaatccattgcataattggctaatttttcatcgaacatcggcaaaatgcgcgttgccatttccatggagatgattttaattggcggcgtatcgtactttttagccagcgctggcatactgtgcgtcaattcgcccagtaattcaacgccggtgaaccctgcgccagcaacaataaccgtcaagtctttaggatcttgtgactgcttgtaattggcgacgtgctgctcaatcgtcttggtgatcgtttccgcggaggttacattgtccagcggcaaggcgttttccgcggcacccggcaacccaaagtcctcagaccggaagccaagcgcaatgatgagataatcgtaacgtaacggcgcatggttagccaaaatcaccatcttggtcgacacatcaaccttgctgactttcgcctgaagaaactgaacatcctttggaagaacctgttgaatattaaacgtgattttcgatgcaggcacagtacctgccgccacttcatgaagctgcgtgcgctcttcgtgttcggcgttttggtcaaccactgtgatcgtcgttccctttggtgcgagcttacttaacgttttaacggcccgaatgcccgcatatccggcacctaaaatgacaacatctgccattgattcaccacatcctcatctacaaaattatttcaacgtacggtcaattggccacaaccttattgtaacaatcttattaccattcacaaactttgggctcatatatttgcgaaaagtgggtgagaaatttggttgtatcttgttcgcttccgagtttgcccatgaatattaatgcaaggtgtttcaagaggagacttgcagaaggatatcttaatctcaatgaagaaggaattggttaagaaagcttgactatgtgatcttttcaaaaaggtcaattcatttcagtaacgcaacccaaaaccgagtgttcgatcacctaaaatgtgcgctgaccagatcaacgctgcggccagtaagccataccaagcaccaaggagcgccagtccgccgagaataatcggcccaattaacgtatggccaatatcgtagcagacattgccagtcttttcgttggcgagaaagcctaaagcacttatgtcgggaattaggaagccgacaacaaataatagccagctgaaattgaactggacaaagtaaaaataaatgatgagtgcaaatcctagtgctgattctgttcttggaagccacttcatgaagggtcactccttgaaattattcatgtgagcgccacgatcaagcagagatagagaacgaggcatgactcgtatgtgacacatgtgtgacttaaacgtactttgagtatactggggtcaacgacaagcaacaagcgtttggcgacaagtgctacaaattggtggtatttgtgtcagttaggagattgcaaatatgaacgggaagcaacggatggcgctgcaatcgaagcagtggttggtggatgccttggtcacattaatgcaacgtggtgaggcggtgacagatatttcaatcacggagattgtgcaaactgcagatctttcacgcaaaaccttttatcgagcgtttaaaaccaaggatgatttaatcgattatttatgccgccagttgacagacgattattttgaaagtctgaaacaggccacccgcggacaaacgccgattagttttgaaacgaccatgcagcactttttcacgttttggtggcaacaaaaagaccttgtccgtttattgattcgacaaggtctgttcgatcatttgaatggtgtttggcaacgtgatgccgttgacaagtatcgccagtttccggcgccgtggcatgcggcagggaccgatcgagaggtgaattatatcatggcatttgcactcggtggatttaccaatgtcttacgcttatggttggcacaagatcagcctgaaccgccggaacaagtgcaaagggtggcactggcgggttttggccagttggcgcagagcattggtcattcaaactaatacgctaagttagcgatctttttagataggtacagctctctcaaaaagattataagtaaaagttgatgggtgctgtcaaattgacctgatcaagcgcgagggtgccgttaatgctttttccttgtggaacatcaatcagcaggcgaatcgttttcgtttcgtttggtttgatgacgggtggggtggaaagcattttgaccgcgacttggtgctgatcattggacgccgagaaatgtttttcggaaaagctcaaaggaacagcatagtgggcgttatgaatggtcaaggcgattccggtttggttcttaggaatatctggcaggtacttcgtttggatggtgaataggcgtagacgtttagcgccaacataggtaactttgctgccgactatcaccggttttcgataaatggccgggtgagcaattggatatgattcgggaacgttgatcacctgtttggatgtgtggcgattgcgcgatgttttcaaaataagctttgttgaactcgactgtaatcgtttgaggctgaccaccccactggcagattttttctcggccaatgtctgattgttgaggtcctttaagctgtaatcagtgcgagccggtaagtggaattttaggttcagggactgatggacgttgctaattttgatctgtttagccactggtgctttgttcccggcagtcgtgctttgcgcagatgctgtctgtgcggggatcagtatgtagatcaatgagagcgtcaataatgaaaaccatccgagtcttttcatcgttcatctttcctttttatgagtttggcgaagctattctattggggcttcgtggcagataccatctttagaatagcataggcatggacttgtgaggaataaggaccagtgaaaaagccatgcgatcgttagtgggcaatgcaagatcgtatggctttgacttggctgacactgaaagtaggtgatgctggtagagaaaaatgttgaagtgcgataatccctttatggttgtcagatgaaatatcataattcatctgatgatcatggagggattttctatgcccagatctaagcataca

SEQ ID NO: 338 - DNA, 21048 bp, Lactobacillus casei
tttcttgtttagctagcactaacaagaataggtcttcatggcctttatggtctagtcgtcagggtgttgcacttgaattgtaaactggggctcccaatttattactcattactgttgaaaaaagtcgtattagaaacctaatgagcaaacacttgttagattgcgatctgacattttttgggtggtatcttaccagccaaaaaagccattaatcaaagatatggccgaatctacggtggtgattggactgtagtcaatatgattttgtcttttgatgcatgcggcattatagcagtgaccaccaccgatgatagatactaattcacttgtagaaatcgtctgtatattcaaaaagcgtttcctcctgatttttgttagacaatgaaataaatcttacaggagtgccactaatcctccaataactaagacgccctcggcagcctttcgaattagttctcccgcttgataggcagctttgttgtaaccgccaactactttggtcaatttaaatggatgtaagctgattcctgagacagtacgatcgctgggtgcggaaatctttgaacgatgtgccagtagagaacaccgtcagtcgagctcataaaatgctcgatttccggaaaggttagctggagcgctctatgcagacgattcttgttggttacaatgtctttattaaactgctgatacgtccgctctagatcgtgtaactctgtataaactgggctttcctgataggttggcctgaagcgatttttgatcatcgctctggctaaacccaccgcatccagcgcatcagtttttgtatgcctgaattcttccatcactttctttgcggctaatggattgagttctgtatatttccagccgtctcgctgtagaaaggcacgcaaacgacgagagtacatcgcggtcgcctcgtatatgattaggggtgcgttgaagctattgagttcatcacttaatagcgaaaatcctaaccgatctaacccaattttaaattgcttgataacgacgttatcaacaagtaccgctacattggcgttctctttactgacatcaataccaaatacacattccatacaacaaacaccacctttgaagttgtttcaccgattcactcatcccaattttcaatacacggcgtcttgcgccaacagactgcgaacgagtttcttggtggatcaagcgaagttgccagtttgatttacgacgtcaaagcgccaaaaagacctacggcatgtcaacttcaacaccactttatcaaaaaagaaaagtgacgaaccaagattccgtcgagtcttggttcgtcactcatgttagtctgtttgattgtcttgcattgcttttacaagggtcacaaaggtgttcacaagtgacagtacgaaactgccaaatgctaacatcagcgtgattgcctcagcaacggacaaacaggcacctcccttcacttagattttggacgtctttcataggcgaccacctctttgtgattggatttgccaaccgtcattaacttttctgctaataatattatagcacataaacggctatattcctagagccacaagggatatagccgttcttgcgtccgcgggtctgcgagctttttggctcaacggttttcggccaaggccgaggagcgtggggcgcctgccccgcccacgcgctccaggcaacgtactacgtcgtctcatataaccaatcaagtttttgttaggtaacggacgagataaggacgccaaaaagctcgcagacccggtaatagaaaactatcgctccaacgcttgatcatgatgcttaggtgcaattctaagattggccgtcaccgccctttcttttgctgctgctattttttgatccaaggtcaaacctttactctttgaacgatcatggatttgtagtcgatcattccaatcctttggaacgtctcgtacaacttgaaagtcacctttttggtaacgctgcgcaacctctgtgattcgggtgatcaggttgttgcgatttgctattgtcagatccggtgcctgctgcttgaagtaggcttgccagtcaatgccgttaggttgcagataaggctttaactgtttagcaaattcaggtaagtccgcgaaagaacctttggtaaaggcatcttgataatggtagccatttgccataccgtgaccgggctgtaaattgacagcgactttcagatacgccatcaaagcgacggtaggaattgctgcctgcttagcggcactgacaactggtgctagacactcgtgtggaattgcttggtcagctgggattagactcgtatatggcacactcgctaaagcatgttcagcccgcatctggtcataaaagacatgaccactcgggtcattgtcgaccccaaaagcaatctctgacggcgcatgaccagttttctcgcagaaataaatcagcccttgcttgaccgtgtttggcttcaagccgtccatcgacattaacgtaacgtgattcaagccccgatgcagtgaccaataactcagtgcatcaatcggcgcctcaaacattaaaagtcgttcaggcttgcctagtgacaaattgaagccaaagttttcttgtgagtttttagctatctgcttaaatgtaccgcgcttacccaaatgctcatggtcaattctcgtgccttgtaccgttgccccaacgattttgtctttccttgaccagacaaagatagcattgccatgctcgtcttgttggataaagcctttgcgatgcagtaagtccacaatctgtggatcaagtttccgaaccgtcgttagatacttagtggcctgctcaaagtttgggctatttttaaagttgtattgaaatggctcacgagccttatgcgtaatggtatccgctcgctctaaagccgcgtgattcagataggcaaccgcctcgcgaaaactgctgatgcctaaataatgctgcacaaaatctaatgcaccgccaccaacatcgcgactattccaacggaaaagattcttcttgtcattaatgactagtgaatcatgttcgaccccacgccaatagccattggactgttgcaccagtgcaatgccattcgcttcggcaatcgccacaatggcgacgtgattcgcgtggtcaatcgttgctttactgagtcgtttctgtttgtttgtggtcatctcggttaactcctttctgcattaaaaaagggcgcctaggcgtcctatcgttcaatatcatgatgatgttgctgttcttgctcttcctggggcggttcaccttgtaaatcgtccattaagtcagcaatatcctcccacttgttgaccatgatggtttgctgcttgagactttgttctaatgaccgtagggttttttcttggtctgtgatgacactcgccatttcttcgttagtcagtagtgggttaaagtcttggttttgcaaatgtagcacggcggtttgatacatattaatttcatgttggtacttcctagtgagccggtgttgctcatttggtgaaacgtcctctaatttgtcaataattggttgatattggttgcgggtaaagatgaactttgctaagtcgttgtaggtggtaatcttatcgtgaagcatttcaattttctgctgcacgtcatggagctgcgctttgaccgttgttacctgccggcctaatgactgacggtcagtgatatggttggctctcaattcaccaagcgtggttgacaagcgcttcacgtcagcttgctgagcttgcatatattgacgttgccggtttgctattaaccaacgtcctaacatcggctgcgttgactttaatgcgggtttcaacgcggctcctgtcaaactaactgattttggttctggatcgttcaacgtagcaaagggcgttgcattgtagtgccagcgattgccaatttgcactgtgtactgttgatgcaaccggtcataatttacggcgttattagggataaagacccgttcataaccggcatcaggtagcgtaatcgttagtcccttgtcagagtgaccaaagacagcttgaggaggaacttttaccagttcaggattcaatccttgatcaagatcaatcgcatgtatcaatgcttcaccacggattgaaacagcgcgtggccgttttcctgattgatccgttaatgtgtagtaataattggcttgtagggcaacttgcaaatgatcagaatcgccgcgcaattcgtaacgattcaagtgaactgttagctgtccttcattaggcacttctagttgaaccaaagcccccttttcatcaacacttagcacctgatcatcagacaagtccatcaaggtttcggtgttggtcatcttcgacttggtttgttcctgatactcggctaaaacatcaggagctgccacctttgctttgagagcattggggtcatgccaatgctcattcatatagtttagttggtaagcagggggtagaagttccgcgggcactttagtaccatcatgaaatgtgaattgatagctaccattgcgctgccgtttgagggtaacatcatgttcctgttgcagcataaaagttaaatcatcaaggctgtcacacataccatagacatcatcaattaaggccatcaatcgtagttgattgtcagcattctcagcagtggttgttttaataccttccgacgtgtatgaaccaatatcagatagacttttgtcgcgaatattgcgctgctggtcaggcaaccgataccccctatcttgaccacgcttcgttgtcgtgatttctagctgttcacatagctggtcaaacatttccggtgatgttgcacgagacgcaacaaatcgcagtcggcgacgcaactccgcgcggaatgattggtgaacatccttctcgtgaacaaagccatttttttcgagttgttcatcacgtctcaaggacactgataaaccatgttctgccgtcaaacgattactgatttccttgatgcgattagctgtgatataaggctggctacgaaactttttcaaagtcgtcatggagtaagcattaaagacaatgtgattatggatatgatccttatcaacgtgagttgcaatgacaaattgatagtcattgccaagtagctcgcgcatgagttgaacccctatcgcatgagcctcttctggggtaacatgatcgtctggtgaaaaggactgaatcaggtggtagctctttgctgattgatgccttcggatgccatcgacatcgcgaccaccaacacgttcataattaccattgtagcgatgtgacatatcagccagcatctcaaactcaaacgatgccgtgggcacgtcacaatgaatgccttctacgagttctccgtttcgagtttttagcggatcaataatgtacttgatggcggccttggtcgagcgattaatcgcgtgtattttcgtgattgccatttaagaccacccgctcataatgtttgacgacatcgagacgatgcagcaagtggtcgttgaccgcccagaacaggtcatcaacttcacttttaaccatgttcatttgttcctgcgttagcacttcattttcgttagcaacgtgcgcaagttgattcaggttattcccgattctagccatctgtctaattaactcttttgtgtctgtaaaatccacgtgaatgatcttacttgttaagagcgcgcggcaagcataggcattaaacttggggttccccgcagttgctattctgaaattgacccattcacgttcctctggggtcatacgcacggtgcttctcgaagatcgagtgcgatgctcatctgattgcttcacatgtttccctccattgttatttttagtgaacttaaggctgacgttgcacttgaaccaaactcgttgtcacgaatttcaagattttgcttttttgaagtttttctactgtcgcgagatttgcaagtggacgtccacttgcgataaattgactcattatcagcttcgctgatagtcaattttgttttgggggcacgcccccaatcccccgttattttgaaggagtctgcgacaccttccaaaatcaaagttcaaactcttctaagctctcattttggctcagccatttctgataatcttcgaccgaaaggtcgcttaattttcggatcgtttcgtcgtaacattcgagggtaaattctttctcaattggatctgtgatacctgtcaggtcattagaaatatcatcacgtactgctttaaccttttttagaattgccggcggtgtatcttcgctcacagacttgcggtgaagtaagataatgtcacgatcgaattcgttcatttcgtcaatggttttcatgttggtaattcctttcttgggtgatcaagggctggagaaaagcaagggctggagtgtcctcttgagtgagagtattcaacaaatgggttagcgtgttttctcctgcgttgcttgcaccagcccttgctctttttttgcgatgttttccgttgtcgcaatggttttagcacgttctattttttgatcaagcgtcaacggtttctcacgaatcttttcaaggttttgatcgacggttttattgaatttttcggcggtggattggatacgcgttaagcttttggagagctgggaaagatccttatctttcgaccaaacagcaaggtaagggaacgtataatcactcgtgtcaattcccaaatgttgacaaacaataaacgcggtactttcagcttctaattccatggttgaacgatccaattttaacttcggatcacaatgtaattcactgtgcgcgagttcatgaatcaacgtcttaatggtttgcttctcgctcataccggaacgcaattggatttctttttggcgtgggcgagtaacacccttggtttcgctgctcggcatctcacggctaaagcccacatgaaagtcagttgcttgaacaagtttgctataaatagtggcataatttggtacttcaccagtcagttcatgcgtgaacattttgataggctcaccactggtctgagagtaatcaaagacagccgccggtcggcagaatactttgctctcttttacgcgtttgatggtgccatcaggttgccgaactctcttttcgtacttatgttcaccacccgccaatatcctgatacctttttcgtgttgattaacttgtcgatggtactgatttttccatgtgtgataccctgcaacaaaagtggcatgtgggttctgtaaatagatgagtaactggtttctgacactgtattgatgaaacccgctgatgaactttaaatactctcgatactcgtcagtagagaagacttttttggcgccatcttgcgccaacgccagtaactctttggtactctttggtggttgcttttcttggcttgatgttggcatctttatcacactttcctttacgaatttgaattgttactttcccctaatgtactcagggcatgctcaaatgttttaacggtttgcttagcttgttgtcgcttctctgctgattgctgtgggtcattggcaattttgttaaaggcatcaatgccagcagcatatttttcaccgacctcaattgcttgtttaatcgtcgaatccttaaggctgtcattgatctttttagccttgtcaaagtctttctgacgtacgtaaccaagagcaatcacttccgataaggttttactctcgagttgctcgttaatcagctcggcggcatcgaattgcttagtgtgaacataagcaactgcgagttcgatttggcgctcttgagatagcgtcacacgattactcatcgcgatgacctttgaataatcgtgttgcaggtaagcaagatcaaacagtgtctcagcttttgggtagatacgttgaaacttagcgagttgcttcacgttactttgatctgtgagggttttacgcacatcgtcccgtcgattcggatatagcttaccggcttgaaggtagtcccccttcttaatcagggaggtgtagcttgggggtgcgttgtacgcatcaacgactagttttgttccaaacaaaaagccgcctgctattatcagcaaaacggcaatggttatcaggtgtttgagaaacgatcgactaacttttggtaatgaaattgaaggtaatttgatagcagttcgtttcggttttttggcaacggttctatgtgatcggttacgtgtcctttttggggttgtatcagccgctaacgagtcggtagaaacaggttcagatgcagaatccggttcagtttcattcgctactgaaacgtctgtttctggtggtgaagttacctcttgccgctgagaaattaagtctgtgatcagatcttcaattttcccttcaatcggtagtttaatcttgacggaaaaggcaacttggtcacggtgataggccgtgatttggcagctaccatgttgcgctaaatcaaacaggtgatcactagccgcttgtaactgtgctagcccatcatcaaacggttgcgggtcggtagctaacgcgatcccctcttgattggtaatcttgatggtgtcagtctctttatcttttttccgacccacatcagtccctcccttccatgcctcttgtacgatcattaatgaaactcaggggcttcatcatgtctttctttttgaagcagcgtggcaatatcttcataggtcagatggctctcagataacaacgcgtcaaccttatcggcttttaagactttgagatcacgccttgcggccgtcaattgttgctgcacctttttttgctgttcttctagttctttgatccggttctctttactcttgattcgcttttccagactcgtacttgccattgttgatcgctcctttattagtcatgacttgcctgtgattgattgagacgatatagcgtgcacccaattatcctttgctgcttcatcggcaagcgcagcactaaatcgttttttattctgttgccgtcgctggtgatagtgtatgctacccgtgccattgcaattgtttcggaacctgcttgtgtataagtgacctcgcgatgctggtacgtcaccttataagacagatccggaccaacacccgctttaccaatattagccggtggtacgatttgatctgctattgctttggtcgatagcttctcaatttgatcgtatcgtttttgttgatccgcacgatatccaacaactaaatccgcaaaaacaaggactcttttatctaccttttttgattcaccgcctgttattgcgttcagatgcgtttttgtttcttgtaagacgctttgactgtccgaccaacgataccagcctacgaccatcaaagccgtcattagcacgacatacagcggtaatagccagtggcgccatctgtgtccttccatcgtcttcctccttttaccgtgggtgaatataggtgtaagctcccacgtttcctaacgtttgcaaatttggccctggttgctgcttgaagcccgttcctccctgagagatggtaattgtccctttatccgaatcaactgattctacatacgccacatgcccgtataccgggtctgcttgccaattaccaaccatttggcctgcggcaaaactgaccaatgccccttgttgaggggtatgatcgacgctgaatcctgcggcggctgctgagctaccccagtcagcaccattgccccagttattagcagcccatccggatctggcttttgcccaccacgtacactgacctacaggataagaattaccaccattatgcagcgtgatattaccgattgagtcaccactcttgaatccaaaaatggctaaaagtttgttgacgttgggtacccagttaagattcagattgttagggtcattaatggcgccaataggtgcataggcggcgcctaacttctggacagtattcaaaccacgggtaacaactaagttatgcaacgtgttccgggtggcatcaataccagcttctagcgatggataggcaatgatcgtaccaccactcatttgaccactaggattatttgcaccacgaaccgcagcacttgttccccatgaggattctgtccccataattgcggcaataagcgccggattaacgccagcctttttagctgcgtcgattgagtaactttccttgtcgaccaaaacaccgttagaaaaatacttaacccacgcggcatgaaacttgttggcgtcaaagtcttgacccgttaaattgccaccactggtcaccaagccataagtcgtggcatacgtgtatttcacatttggtaaagcaaaggcaggatttaattcttcctcaataggtggcaaaggtgctgaacttaccacaacggttgaactggaagcggaggaagagttctttgaagataaacctggtgcctgagagacgctttctaaggtgctcgacgatgatggtgttgatgaagactcgtctggagcgctctgctgcgtgattttgataagctgaagagtgatgttcttttcgctagttccgatttgatctcctttcttgatttcctggtttggtttaaccgtcacggttttgagcccaccggtcacggttcgtttaccatcagttgcgatcgtcacacttccatttgaacaggcagtcactgtgccggacatcacggccacaatcttttttccagtctcgcttgaaatccgaatgtgattagacatgttcttttgtccgccacgcattcgccaggcgtaccggtcgttgaccatgatcgttgcattctgatcttcaaagggcgatcctagaatctcttgcgttcgatattgacccacttgacccattgcatctagccgatctttatcatcttgtgagagtgctttaggatggttcttctcccactcatcaaagctagacaaattgacggtcacagtttttgaatcaactgtgaccgacatcatttgatcatgtaatttttttatcttttgtttgaacgcatcgtctactgtaaagtcatcatatttaatcgacaagtaggccaactcacggtcaaagtccgagattagttcaatcccatctgttgttgcttcctgaccattgataatcagtgaacgtccgtttccgtccgtgttagccatactgtcaatgaccttcttagtggcatcagtgtccaactccgtaatgtaactgtaggcgtcagttaagggcttagaatcggctgtcgtcgacatcgtaggcaccaaccagccaaacatggaactcatcaaggcgatcagaccaaacacaagtcccactaataggagaatagccatcgacttgatcacgactggtagcatcagaatggcctttaacagatgcctgattgaactaataggatgacgccacgagaaggtagcaccctttaaagcacgctgcttcatcatttttctgaccgatttacggctgtatgaagtttgaactggcttacctaacttttttgctagtcgcttgcctttacgattcctatggcgcttcaaccgggcttttaagcggctccctccttgcgttgtctttgacaacgtttggtaggttggatcgttttgctcttcacttttctgaccattggtagctgccagtacagtgctcttcttagccgtttcaatcgcgccatgttgaagcgcttctctactacggtgccgaaagcgtttgacccaactagcctgtttctttttatgcttagcgttttgtgctaaaaggccacgcctaaactgccctttttttcggacaaaacgtttgccaccaaagccgccaacgccttgtatgcgatatttgttaccgcgcaaggctttcttaaaccggctcggatcactactgactaaagcgtctttagggtcatgatgctgcttattaagcagcatgtctttccaattattcgccactcacctcgcccccatcctcatgcagtttcttgcgggaaatatattgctccatgtcctctggtttcgtggacataatcttataaagcttggtctttttcggaaagtcattctcaaatggaatgacggcgtcacccgcaatcatcaagccatggccggagtcggcattggtgatatagccttcctcctgttcagacagatgcagcatttctgtgagctgatcacggtcattggcagcttggtcaagcaaaagcacaaattcactgttagacaacatgcggcgggcattatcactcagtagcaaggtttcaacgttttgcgtaatcccagtaggcaacgcgccccatttacgggcacgcgaccacagttcaaagaagtagttagatgcaaattcattgctcaagagcagctgcatttcatcaacgtaaatccacgtccgtttgcctgagttccggttctttgtaatccggttccagatttggtcaagcacaatcaacatacccattgaccgcaggttcttacctaaatccttgacgtcatagacaaccactgaattgtcgttgtctacgttcgtttgatgcgcaaaaacagacaaggacccttcaatatatggctcaagctcaagcgcaatttgctttccctcttcttcgggctgttgtttaagggtatttgatagatcaaccatcgttggcatcgctgtatgctgctcaaaatagcgttgatatgttaaccgacaagcacgatcaatcaaagtccggcgttcggctgacaggccgtttttaccaccgagtaacatgtcgcacatagacaaaatgaagtctgttttgaaaatgacagggtcttcatcgtcaccataatcttcattgatttccattggattgatatgcgctgcggcaccttgagagatcggtatgacttcgccacccagcgcttgtgcaacagctgaatactcacgctctggatcaataatcaacacttcggagtcagcatcacgtaaccgtacagacagcatttcctgcttgctggcaaatgacttaccagcaccgggacgacctaaaatcatgccgttaccagctttcaagttccgacgatccgcagtcactaggttttgagtaacttgattgacgccataaactagaccgctactgtcacttagctcttgagcagtaaatggtataaaaatagcggccgctgaggttgtcagtgtccgcgatactggtacataattttgtccccacatgagcacagaattaagggcttgttcttggagataatcgagatttgcaaattcgcagctatgtctacgaccggccgctttaacttgctcgataatctcatcaagctgttgatcggtctttccctgtgccatgacgaggaatgtcacgtcaaagagttgctggttatcgtcttgcatctgttggagcaagtcctcagcttcatcaaggctgtgcgtcaggttctccggtagaatatcaggatcataccccgctttcatcgccttctgctgctcatcagctttctgcttctgcataaagcctttcttcgtctgcaccatcttcatgccttttactggatcgatagggtgaatttgaatggcaatctccaagtccgccataatatccgttaaatcagtaatcagacgatcgctgatttcgggtggataatctcgcaagtacaacacttgtgcaacttggtcccccattgtaaaacggttctttgcgtgtttaaaattgaagctggttggtgcaattactgagtgtgtcgtcaagccactatatttgagatcgtcatagtcaaaatgcaacacactgccaggcctcaatgtggcattagcaagttggagtcggcgcaaaccattcaacggacgcgctgttgatcccatttgatgaaaactggtaaccacattcgcctgtagttgattcaaactggttttagcacgttgtcgatcatcagcatgttgcgtaaaggttacgtacttctcctttaggagactcgtattgccgctttcaactctttctcgcatgatgtggttcatctcatcacggagcgcgttgagatcatcaggtcgatgcttgaaggacgtctcctgcatgaactggcgaatgtcctttcgcctattgatgatgttaatctgaacagtcgattcactgtcaaagccattaagaaactctgcatatttgctaaagatgtcactttgatggtcgcgatcgctaatttgatagttaatatcggagatcgcaacactcttagaaaaaacacctggtgccacttcacagaggccgtcttcatacatggcacgataagctaaactgtcttgagttgctcttgatggtgcatttttccgctcttgcttgccacgttcctttttgtggcgttgtaacaacttcaaggctttactatggcctgtcttctttgtattctttgatctttcctcggttcttgtgaacatgaaggctaacctcccttcgattttcataaattcttagcccgttcatttgttggtaatgcaagatgatgccgatatacttttctaatggcattccttttggcctgatccagccaaatgccaacactggcatatccaatgggattagcacattaccggcactatccattgaccagtgcaacttccagaccaggaaatagataatgcccgctgaatagatgaatgcgatcgtggcacagattagttgccgcaaatccattgtgcctatgatacgttctttgtaggtcttgatttctttgggtactctcccgcgtaaagccactgttactcactcctttcctacattgctgttgtcagcgacttcgcccaagagtttgtttggaagaccgcaaaaattagtagaattgaaaatcccatcaatgatgctattaatggaaggacgccacttttatcgacattcgcaaatgctgttttcatgaggaatggatagaacagctgcaccatataaatgagggttccttgtatggatactgccatgaagctcttgaagaagtttttagcaatccctgaaaactcatgatggggcatggttgcaattggaataggtgacacagccaaaaacacatacatctgtaaaaaccggccggtgacaacaacattaactaagactgtggcaagcatggtaatgagcatgacaaaaagaagaagcaccatgatcatcagcttcgtccaaaaaccttcttttactaagggactataaatatcatcaacgctaataatggtgcccatatgtccagaattcactaacttaccgatatcctgtgatagcgtgatactcacttgcataatggcattcatgaataaattcatgctatccattgcaatcttacaaaaagccaccttcactaaggcggctgaaatcagcctgacccctgcatctgatccacctcccatagcttctacttgttccgaaattcgatatagttctagcaacgcaaacaacgccagaatcatatatccgaccggcatcatcacattagtctggatcgttgttgcgaatccgtataagtccttgctccaccctgccaacgtttcggtaatgccgttagcctttgcggaaccagaaacggagttcaagataaacttaataaatcccttgatcgtattatccacgcggttccgcctcctcacatcacgttagtgaaatagagttgaacaatgctccagcagcaatgattaaaccgccacctgcaatcgtccagataccgctttgaataccaggcccattgtgatccttcaaagcaccaccaagaccaaccaagccccaagcggcgtaaatagaaccacctgcaatagcaaattttgacattaaagaaatagcttgagataaaacgttcatgtgttgttcctccttttttatcgaaacgtgtctaatagattgacatcagctaggatatccgaatccgcttcgggttccttctccttgaccgcatcattcttggtttcctcttgactgatattagccaggaaatctgactctgctttggattcttctgtttctacctcacctcctttgttgttctcgattttaagttgaggctgatagacatagtctgagtgatccatttgaagttctttataccgtgggtgtttttccaactggtatttttgcgacaaaaatggcggcacacctctgagcatgtaaatactctggtcgccgccgattcgatcgacttcatcaggcgctaacaaatcacgcgcgattttgtcgtagttttggttgaatgaaccattattgcctttggattcaccataacgttgaacgtctatcgtccctttaccaaggatttgggaaatgtactgagcggtttcactgtcgtgtccgccaagatacagcagtgaatccgaagcaccaagaatcgcctggtatgacttcggatagcgttctttgagctggctgagttcctgcacgattgccacgcagaaaataccccgtgaacgcaaggtgttgatacgcttgtcaaattgcggaatctgtccactgtttgcaaactcatcctgccaacaaacgactgtttcattaagtcggccgtttacctgatggtcagcatgttctaccaaagtagtaaacaatgtttggtaaaccaagctgaccaagaaattaaacgtttcactttgatcaggtaggatcaaaaacagaatccgtttctcatctcccaatttttcaagttctaatgtatcgtcactagtaatatcaataatactaggcacatcaaacggtgctaaacgaacaccaagggaaatgacgatactcatggctgttttggctggtgcgagtttgaagataccatattgtttaagcccaaacgcatccgggaagtcctttttgaattcttcaaatattaagtcaagtggcgttgtgttcccgccagcgtcctcctcaattgttgctgctctgactaagtccaaaacattgggtacgtttgcaaccacacggttgtcagggttgccagcttctaaacgtaaataatcaaacaaggcttgcatcaaggccttctcgcctttatcaaagaacggatcgcttttactttgcggtgaggttgtgttttgcatgatcgcattcacaacttcaatgacgtcatcctcattgttgatataagcgaatacattaaaatgatcagtgtgtttgcgagtcaccaaatcaaagaccttaatctgatagccagacttctcaaaaaagttacccacccatctaagcgtctgtccttttgtatcagtaacaacataggagctggagcgctgcaatagattaggtacgacaacggttctggttttaccagaaccagcacccccgatgaccgtcacaaactgatttcgctgcagtctcattggccgtttatgatccaagtcattcaaatacagcttttccgtggccgtcataatcaggttgttatctgggtttttggtatcctcaaatggaagaatatccttatgagtcccccatcttgcgctcccgtgttcctcacctggtcgataatttttcttattggtcaaggcatataaaactaccagcgctacaactgccagtagaataagaccacctaggaatgatttgccattgaaagtcggcggccaccaagaaaccttgccaagattgttagacacgtacagtattttgtcgagtatagacttagcgtctttgtcctggacgttatagacggctcgcgttaaaccactgccaacgatatataccgcagaactaccaatagccacaaggccgaaattccagactaggtttttcgctttttctttgtccatcagcgctcacgttccttgctacgctgtcgcggctttttctctttttgattgcgttcctttgcggtcactttagccttttcaatcttttcttgaagcgtttggccgtgttcgggtgttttgtcaaagtccttaacaaccttctgcaaaacaagttgaactcggtctacatcagcacccttaaaaaagacatggtacatgcccgtttccttgtctcggcggatagaaaagtcaacgtgatactttttaaacttctttccgagcgcgcgcagatcggttttactaatatccacgtgttctagcgcaccctttttttgcaattccgcaatgttttgtttaccagtcgttcgctgatgatggattgcttgtttgctcatatccattgctttacttggcaacttgacggccagtgctttaaggagcgcttgcgcggacaaggtgcttaaccgtagaacatactctgctgcttggttgtccatttgattcacctaccctttttagaccgtttcactgactgttacggtcaaattttgcgttgttgtttggtcgaatttatccgtcacagtataagtcagcacatagctgccaggtttactggtatcaaccgaaccttcgacatcaacagtgacatcgccataagaactggtagccgtaacactagcctttggatcaaagtgatcgccaactttgagttttgtcggtactttagacagatcaagggttggcttgtcagccacaacgttgatagttacttccttgacggtcttctgtccaaacttgtcagtggctgtataagcaagctcatagctaccaggcttgctggtgtcaactgatccatctacagccacaatcacatcgccataaggactaaccgctgtgacattggccttcgggttaaactggtctcccaccttgagttccgttggaaccttcgacacatcaagtgtcggtgccgtggcaaacaccgtaactgaacgtttcagcgttgtcacagcaccattcttatcagtgacggtataaattagttcgtaatcaccaagtttgctggtatcaacgtctcctgcaaccttgatttccgttgtgaggtcaccatcttgataatcatcagccgtaacaccttgtaacggatcaaaggcatgaccaacttcagtttgattgttccccgagacatgaataacgggagcgtcattagtcacgacaacatcacgcgtagcactcgttttgtgccctgcgctgtctgtcacttggtaggtcacttgataagtcccctccgtattaacgtccacagtgctgccatacacaaccttgttggtcaaatcaccatcttctacatcatgagcacttacaccgtccattaaattgaaggatttttgacctaaatgcagatgcaggtcatcagcaaaggatatagtcggggcttggtcaactggtgctggtgttggattcggatctggcattgggtttggctctggtgttggcgttgggtttggctctggtgttggattcggatctggcgttgggtttggctctggtgttggcgttggattcggatctggcgtcgggtttggctctggtattggttccggcgctggatttggtgttggactagggtccaccgatggcgtcgtcttggtatcagtcgtctgtttatctgttaacggtttaggttcaggcgttgttcctgtattgtctgccgcttttggcgtgttctgttccgctgttgcctgatctgccaacgaaataaggctttgactattactcgactcaagctgtttgctcaaatcatttttactgaaaggaaaggcgactactgtttgatcacttttatcgctattcggcagatccggagccagggcatcttttatggtctgatcgggtttgttagaggaaggttttgtgttcttctgtttttgctcgaccttttttgacggcgtccgccattgcttagatggagtgctacttttcttgactgattgcgaagcgggggcagcgtttaactgataagccgtatagccgccgcctcccaagacaatcgcacttatcagcaagattgctgctgttttctttttgttgtttgccatgaatgaatcctcctttttccgcattaatatgcttcaacaaatcgcttaaactcgttctgagggcgaacataagccacgatcacgcgctctttgcttggtaacacccgcacgatctcaccaatacaagttgtatctggcagaataggccaaccagtctcgatgcttagcaccgcatgacgcaacttcaacatcaatgccttctcctttgggggtgggaatctgatttcaagaagaccattgtgccgcttagcttccttgatgtcttttgtttgaagaaccaaattgaacatatgatcacctcttatatcaagttttttgggacggacttaatgcgttctccgctaatcactagactgccgtctttttttaattcagctgacaccacctttagaaccaaaacatttttcagctggttaggcggcttaatattgccaatcaccaccgtcataccaggcttaattggataatcagcatgatccttaacccatgaagctcggactcgataagaaagagcatcatgatctttcgaaatcaacttcaaattgcgatcatgtaaccaaatacctacaggttcagccatgttcagtctcctttctttaacgcaaaaaacacctgcaattagctggcatttggcgttcattattttggcattagccaaggccgcctcgtggaatcgaaccacgattcccagtagcggcatttgttgtcccgtgacacaccattaaattgcgtagcagagcacaactttggtaaaatggaggtacgttaatacctaataaaaacgcgccctagggcgcgctttttgcttgttgacgatgtttttcaagagcttcctgtcgttcctcttcacgagaacacaatccgctaatccgaatagttgtaagctcacacaaaaagataaagcctagtaatatccagaaactgcatttgagaatcagccacaacaccttaatctctcctcacttttcaatttttgaattgtaggacggtaaaaagcctcaatcataaagtcttttctcagtagcaatcaaccgacgcaccaatgttgagggtcgttccttagtaacctgacaaagggcaagaatgtcaatggtccggacaaaaattgtccggttctgccgaatgcgtatggttgtcacttaaattcacgcattatcagatcttttatcagcgtttaatcttgtttaacgtgcaagagacactacaaacaagccctggcatctggtctttccccagggctgtgcgcctattgaaaggttacttatgcagctgctgactttcttttgcaagcaccgcgaccgttggtctcgcgatcatgattgtagaaggtgttgtaacgagcaatggattcagtgacgtctagaattgattcatagttg

SEQ ID NO: 339 - DNA, 377 bp, Lactobacillus casei
aagtctgacggaaacctgcacacacgaaactttgtttagttttgaggggacgacctctctttttacgcctatcgggcctatagctcagttggttagagcgcacgcttgataagcgtgaggtcgatggttcaagtccatctaggcccatcaagcgttcgcttgttaattgaacaacccttatgggggattagctcagctgggagagcgcctgctttgcaagcaggaggtcatcggttcgatcccgttatcctccattggccgtcaggccaattcaccgacgcaagtcggcgactttgttctttgaaaactggatatcattgttgtaaatgttttaaattgccgagaacacagcgtatttgtatgagtttctaatatag

SEQ ID NO: 340 - DNA, 2756 bp, Lactobacillus casei
tcacgctctacttggttaagtcctcgaccgattagtactggtccgctccatgcatcgctgcacttccacttccagcctatctacctgatcatctctcaggggtcttacttccatataggaatgggaaatctcatctcgaggggggcttcacacttagatgctttcagcgtttatcccttccgttcatagctacccagcgatgcgcctggcggcacaactggtacaccagcggaacgtccatcccggtcctctcgtactaaggacagctcctctcaaatttcctgcgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttgggggagataagcctgttatccccagggtagcttttatccgttgagcgatggcccttccatgcggaaccaccggatcactaagcccgactttcgtccctgctcgacttgtcagtctcgcagtcaagctcccttctacctttacactctgcgaatgatttccaaccattctgagggaacctttgggcgcctccgttacattttaggaggcgaccgccccagtcaaactgcctacctgacactgtctcccgccacgattagtggcgcgggttagagtgttcatacagctagggtagtatcccaccaacgcctccatcgaaactagcgttccgatctctacggctcctacctatcctgtacaagcggtaccaacactcaatatcaagctacagtaaagctccatggggtctttccgtcctgtcgcgggtaacccgcatcttcacgggtactataatttcaccgagtctctcgttgagacagtgcccaaatcattacgcctttcgtgcgggtcggaacttacccgacaaggaatttcgctaccttaggaccgttatagttacggccgccgtttactggggcttcaattctgggcttcgcttgcgctaactcatcctcttaaccttccagcaccgggcaggcgtcagcccctatacatcatctttcgatttagcagagacctgtgtttttgataaacagttgtttgggcctattcactgcggctgaccttgcggtcagcaccccttcttccgaagttacggggtcattttgccgagttccttaacgagagttcgctcgctcacctgaggatactctcctcgactacctgtgtcggtttgcggtacgggtagtttatttctcactagaagcttttcttggcagtgtgacatcaggaacttcgctactttaatttcgctccccatcaccgcttgtccttatggtcgcaagcatttcactcgccaccagacttgcggcttggacgcacttttccagccgtgcgctttccttagcctcctgcgtccctccatcgcttaaacaaaataaactagtgcaggaatctcaacctgcttgtcatcgactacgccttgcggcctcgccttagatcccgactaaccctgggaggacgagccttccccaggaaaccttagtcatacggtggatcagattctcactgatctttcgctactcatgccggcattctcacttctaagcgctccagccgtcctcacgatcgaccttcaacgcccttagaacgctctcctaccgcgcaccctgacgggtgcacccacagtttcggtattatgcttagccccggtatattttcggcgcagtgccactcgactagtgagctattacgcactctttaaatggtggctgcttctgagccaacatcctagttgtctgtgcaacgccacatccttttccacttagcataaatttagggaccttaactggtgatctgggctgttcccctttcgacaatggaccttatcgctcactgtctgactcccggagtaagatcgatggtattcggagtttatctgaattcagtaacccttgatgggcccctagttcaaacagtgctctacctccatgatccatcctccgaggctaaccctaaagctatttcggagagaaccagctatctccaagttcgtttggaatttcaccgctacccacaactcatcccagcatttttcaacatacatgggttcggtcctccagtgtgtttcaccacaccttcaacctggtcatgggtaggtcacttggtttcgggtctacatctgcctactcattcgccctgttcagactcgctttcgctccggctccgacttttcatcttaacctcgcaggcaaacgtaactcgccggttcattctacaaaaggcacgccattaccccttaacgggctttgactaattgtaggcacacggtttcaggaactgtttcactccccttccggggtgcttttcacctttccctcacggtactggttcactatcggtcactagggagtatttagccttgggagatggtcctcccggattccgacggaatttcacgtgttccgccgtactcaggatcctggacggagggtccgccgtttcgcttacagggctttcaccttctatggcgcagctttccagctgacttcgactacgtcgaactttggtaactccaatgtccagtcctacaaccccgagaagcaagcttctcggtttgggctcttcccacttcgctcgccgctactatgggaatcgagttttctttctcttcctgcgggtactgagatgtttcagttccccgcgtctgccgcc

SEQ ID NO: 341 - DNA, 1442 bp, Lactobacillus casei
gcgccttggattttttctttagtcataaaagtcacctcaattgttgtagtcattgacgaatgctataataccattatagcaagaaaagaggtgcgatcaaatgaagtcaatggcacaattagaatatcattatggcttgaaggttcgcatctacccaagtgaccgccaaaagaaattgattaagcttaacagcgatgccagtcgcttcgtctataacgagatggttgcgatcggtaaagaactctggcaattaaagcaagttaagctaccaattgatacggttcaagaccgaatcaagcagcttgaattacggcaaaatgccaagcaactgtcaaatcatttccaattcttagaagacaagcgaattgacagtcttgctaaggctaacgctatccggaactaccgcaaggcatggaaagcctttcgaaaggttcatggtactggcgtcccaaaattccaccgtaagagctatgcttggagttatcaaactaattgccaatatatccagcagaaaacgacgcttctaacaaatgggaccgtctgctttgaagatggcaagcacgtcttagtgcctaagttaggtcgccttcgcattaaaggctcccacagacgattactgaatcgaaaagcagaaactcgtattggcacggtcacgattactaaggacgccgcagaccgtttctttttatccatgcagctgggttctgatacacccttcatgccgaaacctgccaagaccaatcggcaaaccggcattgacctcaacacggaaaacttcttgacgaccagtgatggcaaagtcgtcgccaacccgcgctactatcgaacaattaagggacgattggcaaaggaacaacgtgttttgtcacgccgtgctcgaagggcaaagaaggagcatcggccgttacgtaacagtaaaaattaccaaaaacagcgcttgttagtcgccaagattcatgccaaggttctagatcgtcgtaagaacttcctgcacaacgtctcaaccacactcatcaagaaccacgatttggtggttgcagaggaattgcgcagtaagaacttactaaagaatcgtgccttggccatgagtatcgcagacgtaggctggcgtacattcttaggcatgctaacttacaaagctgacctttatgatcgccagtttgtaacgatcaatcctaagaataccacgcaaacctgccatcattgcggcttcgtcatggggacagaaggcactaataagctgacgctggctgatcgagagtggacgtgtcctaaatgccagacccatcacgttcgcgatcacaatgccgctcagaacatactgatcaaaggtattgctaaattagcctgattaggctcgtccctatggcaacctggggacgctaaaggcactggtaattgccgtgtaagacaagcagttcgtagaactgcctgcagtggtg

SEQ ID NO: 342 - DNA, 385 bp, Lactobacillus casei
gcgactttgttctttgaaaactggatatcattgttgtaaatgttttaaattgccgagaacacagcgtatttgtatgagtttctaatatagaaattcgcatcgcataaccgctgacgcaagtcagtacaggttaagttacaaagggcgcacggtggatgccttggcactaggagccgatgaaggacggaactaataccgatatgcttcggggagctataagtaagctttgatccggagatttccgaatgggggaacccagtacacatcagtgtattgcctgcaagtgaattcatagcttgttggcggcagacgcggggaactgaaacatctcagtacccgcaggaagagaaagaaaactcgattcccatagtagcggcgagcgaag

SEQ ID NO: 343 - DNA, 1769 bp, Lactobacillus casei
tagtgctaactggaacgactcacaatctattgcatttcaaaagtgaggttgcaagattatttggccaattgcaataaccgttggcgcaaagcaggatcagctgcgtaaagataaagcccatgcttcgccctcttcagcagaatattaatggcattcatgataatcgcggctttagcgtcggtggtgtcggccaaatccgggcgctttttgaaggcttccttgtcttggtactgcgccaggtcaaccgtaagccggtcttttgagggatcatagcctagactcggccctagaatcacacctgcgtaattcaagtcaaagccttgaatcgtataaatggaaccaacttcatgcaatgtctcaggacgttgtgcccacggacgatcggtgaagttgatcttgtcccaaggtaaccgcaaagaaccagcttggacataccaggttttaccatcgagcactgtgaatggatagtcagctgtcgcgatcatgcgcgaaaggccggtttcggcattgcgccgctgaatgaggtcatacatcggctgaccatcagaaaagacttgaaaatcaaaatgttgcggatgtggcaaaggcaacatttttccacgaacaaaatgatcaatccaatcattcaccgccgcatcgcctacccgcatctgttcggtcagatgataatgtgtcactgcgtaatcgcgcgtcactcttttcaataaagcaggtgtccaaaaactctttagcttgactagctggtggaaatcgaacacgagcaccaccactcgagccaactgaagaatatcagcaagctgattatgcccacggaatttattatacggatcaggcatcgtcagtagtaaatggccttcatcgatcagcacgacatctgcccgcttaccggctttgcggtacgcgttaataaatggtgttggtttcatggtagattgtaaaataaataaaattcctcgatttaaaattgaagtgcaacacctgctctactagaccagttctttattcagattagtcaaaaaggccatgaagacctattcttaattcaccacaaacaagaaagaggtatcttcatgacccgaattaagaatatcatatctaatcagtatcaccaactcaatttagctgaacgtggtcgaattgaatccctaagggacttagattggtctatccgccggattgcccaggcccttcatcgtaatcccagcacgatttcacgtgaattaaaacgtgggacaacgacacagattaacgctagtactcatatctttgaacagtcatatctggcagaaactggtgaagcaatttatcgtaagcaccgactaaatagctgttatcgtggactctttgatcattgtcaaaccttctgtaatgctttggtgacagctttaaaagcgcgtcccaggatgcatagtgtggatacttttgtccaccaattcaagactgatcacccaaggcttgtctgcccggcaagaatgtcaatggtccggacaaaaattgtccggttctgccgaatgcgtatggttgtcacttaaattcacgcattatcagatcttttatcagcgtttaatcttgtttaacgtgcaagagggactacaaacaagccctggcatctggtgctttccccagggctgtgcgcctattgaaaggttacttatgcagctgctgactttcttttgcaggcaccgcgaccgttggtctcgcgatcatgattgtagaaggtgttgtaacgagcaatggattcagtgacgtctagaattgattcatagttg

SEQ ID NO: 344 - DNA, 1715 bp, Lactobacillus casei
ggatatactccttcttgggtagacaagcaaataattaaagcttgtcttcctagggaggagtttttgtatgggccgaaagggttccagatacacgctggaggagaaattattctatattggtctggttcgtgagggtggctgggcaccttgggctgtccagcgagaatatggtgttaggcataatcaggttcgacaatggcttgaacgctttgaagcaaccggtgtagacggcctcaaacccagaagcgttcatcagaagtatgctgaggagttcaaattagagattgttcagaaatatcttgcggggcatacatcgtacccagtactagcccgagaatatggtatccccgacaatagcgttattgttcggtgggtttccctgtatactagtggtcaaccattacaaaccactgggagggccagaccaatgaaggacggacgcaaaaccacacagattgaacgtatcgagattgcacaatggaccattgccaatgactacaactacggcgcagcgatgcagcaattcaagatctcctacgggcaggtatacgcctgggtcaagaagttcaagcaaggcggcgaatctgccttggaagatcggcgtggcaaggccaagaaagacaatgggcaactgactgagatcgagcgtctgaagctcgaaaataagcgactacaagcgcgactggtccatgtgtcaacggaggcggcagtactaaaaaaactccaggaattggaaagaaggaatgccggtcagacgaacaatatcagaccattcaacaacttgcacaagaagtgaacccagacgcaggcaagctctacggtattagcaaggcttgccggatgatgggcgtctcaagagcagcctactacaagtggacacatcgtaaagtgaccgtccatgagcaggagaatcaggccatccgggactacatcattgagctcgaagagaagaatcactacgtcttcggcgttaaacggctcatgacgtacatcaacgcggagacgcaataccacgtgagtcacggccgagttcgccgaatcatgcggttggcaggtatccgcgcctccattcgtgtggcaaagcgtgaccgtcaagtggagaagaaggcgtttctcctcgtcaataagctctacaccgtcaacatggggcacgccttccacccagtcgctcctaacgtagtctgggtgaccgactgctcagagatcacctacggcaaggacaacaaacagaggctacggctaagcgccgtaaaggatcttcatgaccacagcgtgattgcttggtgcgtagcaccgacagagacggctgatttggctactaaaacaatgaaactggccatcgagaataacgatggtatcaagcctgataccgtacacagtgatcagggcacggcttatacaagtagcacctataacacgttcctggcgggcgaaggtatcacgcacagcatgtcacgacccgggacaccaggtgataacagcccgatggagagcttgtggagtcacctcaagatcgagagattttcctttgagcactgcttatcggaactagaaatgatgaagcgtattgaggcggcaatcaactggtataacaacgaacgccgccaagaaacactaaacggcatgaccccgatgacataccggaatcatgccgtaaagaaaactgcataggcactttaattattttacctgtctacttgacgcggaccagcgcc

SEQ ID NO: 345 - DNA, 341 bp, Lactobacillus casei
ccaacgctttgccagcaacaccgccgctcgttttaaaatatcgagttcttccctcaaacggcgattttctttttgaagttgcttgaactgttcgttggtcacagcagtaccttgatgatcaatggcaatgacagtggccgcctgaacccatttgcgaatagtgtctaaggaaggaccgtattcttcatgtagttctttgaatgagtgtcctttttcatgaatatcaatcaaggtttgcttaaattcgggggtgtagcgaatagctgtattggtcataaaatattcctcatctgtcaattatcgcacaaactatttttgtccgtaattacagcataggagcc

SEQ ID NO: 346 - DNA, 2430 bp, Lactobacillus casei
ctatttcccaaggaggaggaaacttacttcaacggttcccatttccattcttcgacttccggcagatcggtcccggcttcacgaatgaagtcgtggtgcttctgcaggagatcatccatttcctgcatcagatgagcgcctttttccgtgaagtccggcacatccaggacagcttccttgactaagtggaagcgatctaggtcgttccgtacccgcatatcaaatggggtcgtgatgtcgccttcttcacgatagccgtgaacatgcaggttgtggttatgacgatcgaagaagatgtctttgatcaggtcgtcatagccgtgataagcgaagatgaccggtttgtctttggtgaagtacatatcgaattcatcatcggacaagccacgcggatcgtctttcttcagcttaagcagatcaacgacattgatgaagcgaatcttgaggtctggcaaggccttgtgcaggatggagatggcggccaagctttccagcgttggttccgaaccggcagccgcaataaccagatccggctcagcgccttggtcggtgctggcccaatcgatgatgccgaggcctttttcaaccagatccttggcttcagtatccgtaaaccactgcggacgcggatgcttgctggaaacgatcaggttaatcagttgtttggaatcaacggccttgtcgaagacccgcaccaatgtgttggcatcggctggcagataagcgcggatgtacttggtcttcttttctgccaagtggctgatgacgccaggatcctgatgggaataaccgttgtgatcctgctggaacgccgtggaagaagcgatgacgttcaaagatggcacatcagcacgccagtcggcttcttcatgggcattgcgtaaccacttgaagtgctgggtgagcatggaatcaaccacgcgcaggaaggattcgtagctggcaaagaagccataacggccggtcagggtataagcctctaacataccttcgtccatgtgttcggaaagcattgaatcaatgattcggccatgtgacgccaacagggcatcatatggcgggtcggtcggttccatccattgccgtttcgtggcttcaaagactttattcaaccgattggacaaggtttcatccggtccaaagccgcggaaattcttgttcttatcattgagcttgatcaggtcacgaatgtaggcaccgagcaccatcatgtcttgaccttcgatggcgccatgatccttgttatccaaggcgtaatcagatgggtttggcttctccagatgcttggccagctgaccaccattcgtcaccggattcatcgccatacgtttgtcacccttaggaatgatcgccttaatgtcagctttaagggtgccatcgtcattaaacaattcttctggatggtaggacttcaaccagtcaacgagttgatcggcatgttgcatatcgccttggtccaccggaattggaatctgatgggcacggaaggagccttcaatgggttcgccgtcccattctttcggaccggtccagcctttaggagcgcggaagactaacattggccatgccggacgactttcatcatcgttgtccttagcgttcttccgaatcgcctggatctcttcgatgatcttgtccatttcggctgccataagcacatgcatcttggccggatctttgccttcgacaaaatgcggatcccaacccaagcctttgaagtaatcttccaactcttcatgggattcacgcgacaaaacggttgggttggcaatcttgaaaccattcaggttcaagatcggcagcaccgttccatcggttactggattgagaaacttattgacttgccaagaagttgccaacggaccggtttccgactcgccatcacccacgacaaccgccgcaatcaaaccagggttgtccagcaccgcaccggctccatgaagaatggagtaacccagctcgccgccttcgtgaatggagcccggtgtcttgggatcggcatgtgacgcaacgccgccagggaatgaaaactgtttgaacagccgttgtaagccctgcgcgttctgttcaatctttggatacagttccgaataactgccatccaaataggagttagagaccatcacctggccgccatgacccgggccttcaatgtaaaacatgttcagattgtacttgttaatgacccgattcaaatgggcgtaaataaagttttgacccgaaatcgttccccagtgaccaatcggatgcactttaacatctgacgccttcaatggccgcttcaacagcgggttgtctttcaagtaaagctgaccgaccgacaggtagttagccgcccgccaatacttatcgacttcagccagatagtctttcgacgaatagtcggtggttttttcaattgtttggtccataattggcaatctcctttgc

SEQ ID NO: 347 - DNA, 13254 bp, Lactobacillus casei
caatacttatcgacttcagccagatagtctttcgacgaatagtcggtggttttttcaattgtttggtccataattggcaatctcctttgctaaactttgcgtttgtttgcatagcaataataccacacaagcaaaattttgaaacccctttcaaaattatttttaagaatgacgataaggacaccgccattaacattcttaaacaatgacctttacaccgtgtttttccattgccgagatagtctcagtgttgagacctttgtcagacaaaatgacgtcgtaatcacttatcgaagctgttctaaagggattcatcttagtgaacttcgaatgatctgccagcaacacctttttatggcaatgctgcatcatctttttgtccacctcaatttcagaaaaataatgatttgtcacgccacgactgatgcttacaccaccagaaccaaaaaagccaatgtcgcagaagacactgtcgatattggcaagcgtcaaggggccagacagtgaaccttcaatacgacgaagccctccgccgagcaagaccagctgaaccgactctgcatatcgtagttccagcagaacattaattgatgtcgtgataacaacgacattcttaaactcatgttccttgatttcctgagccaccagtgcagcagttgtgccattgcctaagaatacagaatcaccctcagaaatgagtttgacagcattccgggcgattgagagcttttcttggaagttctctttgcgcctctggtcataaatcgtttcatttacgggtttattcagaacagccccaccacggatcacttgtagtttcccttggttccctagctcggcgatgtctttcctaagcgtttcgcgcgaaacagataagtctttcgctaactcagagatacgcacgcttccgttactgttcaattgttttaaaatactttgctgccgttcaatataattcaccaagatcgcctccaaatgttgatttaacttgtctaagcacgccccaaagtataaggcaatattaacattcctaaacctcgttcgatacttgataaatcaaggcatcgcgccattaatttgcaaattatggcaaatattcaagtagcaaaatattgcaaagttaaaaacctcgtgctatagtccttcttgaaaacggttgcaaaaagatggaggcttatatcatgttaaacaatgcagttagaagcaaggaaattacgtcgaagtcctacaggttattgaagcctggagatattgaagaggttatgttaaaacacgaactaaagcctggatttgtcaatattcagccactaatggcaagcgtttgccatgcggatgatcgctactttgctggtaaaagacgcccagaggcattggctaaaaagctacctatggctttgttgcacgagggcattgggacaattaaagaaacaatgagcgacaaattccaaaaagggcagcgagttgtaattgtcccaaatgttcctggttatatgttacgaggggaaaaaaagaaagatacaatccctgacaattacagtgtcgactcagtctttttaagtagtggttatgacggaattgcgcaaagtgacttagtgcagccggatcgtgcggttgtccctctcccagacaacattccagatgaaattgcaattttaactgaggtcagcaccgtggggtatcacgcaactagtcatgttgcggatgcattagcaaagccagactgccgtgtcgcgttatttggtgatggacctgttggctacatggcagcggccgttttgcattacattcgcggcattgataaagaacacctgactgtgttcggtgcagttcctgaccgactaaatgaatttgactttgctaacaaagaattggttacagagtatgatttcgaccatgctggtgaacaatttgatgtgatcttcgaagcaacgggcggaaactttagctcaagtgccattaatgaaggcattaaagtcatcaaacgaacaggtaaatttgtcttaatgggcgttagcgaagatctggttccaattgatacccgagatattttggaaaagggtttgacgttctatggaactagccgttcgacaacacctgactttgaagaagtcgttaaagccatgagtcaaagtcaagcatatcaagacacgcttcgtaaactcttgcctaaaaaagaaacgattatcagaagcgcgtccgatttaaataaagcatttgaggcaattgttgcaagtaaggcttggtacaaagccgttctgaaatttgaatggtaactgctatatctcaactatgaacggtgatgattctatgaaagaaggaagttgaaaatatggtaggttttgtcattgcaactcacggaaaattagcgtcagggtttctggacgcagtgaagttaattattggggaacaagagaacattggcgaaattggtttgttcgaaggcaatgatgtttccgaatttggattgaagctggaaaaattgatccgacaagaagatgaaggtgacggtgtcattgtgttcactgatctttttgccgctagtccgtacaatcaagcagcactttgcgcaagtagaatcaagaatgtcaaaatccagctgatcacaggggtcaatttgccgatgattattgaagcaatcaatgcacgaatgatggggcaaaatattgaacagatcacgaatgctgcatttgaaaccgctaaagttggtatcaaaaacttttgggatgaactaaatgcacacaattcgcacacaaaacattaaggggggaattatcatgtcacagatcgtattagcacgtgttgatgatcgcttaattcacggccaggtcatgactgcttggttgcagtatacggagggtaatcacattgtcattatcgatgatgccacagcaaaggatgattttctaaaaagcattatgtccatgtcagtacctcaaggaatcaaattagatgtcttaagcgttgccgaaggaccagatttcctaaaggaggaacacggtaacgataagctacttttactagcaaaaactcccaaagctttcctcgatttggtaaatgcaggcgtcaaaattgacaaagttgttattggcggtatgggtgcaaatcctcaaagaaaaaagttttataaaaatatttccgcttcagacgacgaaaaagctattatgcaaaagctaattgatgcaggcgttgacgtcaaaattcaaattgtacccagcgatggagcaactgatgttaaaaacttgttgaagtaaaaatggaggaatagagatatgacaattcatctctggcaagcattcctgattggggttgtttactaccttggtcagatggggacgccttgggtttccctagcaggcactcacactatcatgcgtcccttggtaaacggagctttagttggcttgattctgggcgatccggttaaaggaacaatctacggtgccgctattcagctgccttttctagcttggattggtgccggtggtgctgtccctatggatacggcattagctggtacgttgggtaccgcccttggcatggcatccaacgtttccccatcagtcgcaattacactagccgtacccatcagccttgttgggaccatgatatgggttcttcatatgacggtggatattacttttgttcacatggcagacaaggcagcagaagaaggaaatttgaaacgaattgacttcttgcatgtatggccgcctcagataactatgtttcttttttccgtcattcccgctatgctggcagcatatttcggtgcaggaccggtcaaacaggttattggtggattagctggtacaccactgcatgtattaacagttatcggtggtattttacctgctctagggatcgcgatgaacttacatgcaatgagcagcaaaggaactattgtgttctttcttttgggattcatggttgccgtttactcaaaactcgcaattttgccaatcgctatctttgcagcaatcatcgcctatatttacacccagttattcctgaaacgaggtgaacaagcatgagtgaagaagacaaaaaagaacaactcgaagaaaaagaactcccctcggaaaaaaagcctaatgcaaaaagattaagcaagcgtgacgtggttaaggctttttggcggtggacattcttctcacacgccaattacaactacgaacgtttacaagctactggggtgattcatgccctttcacctatctttaagaaattatacggcgatgatgaagcagaaatgaaagctgctttgttacgacacatgcaattcttcaacaccgaaccacactttggcggctccattcttggcgttaccattgcgatggaagagcaaaaagcaaatggtgcaccgattactgatgaaaccatcaacggactgaaaactggtttgatgggccctttggctgggataggtgatactctatggcaaggtactttaattccaattttgctttcatttactattagttttgcggcaaaaggaaatattttaatgggacctgttctttttgctgttttgcacttagcgattatctggtccatcgggtatcttgcttggatgcaaggctataacttaggtaaagaaggaatagcgaagatcttacagggatcattattaccgacagtgatgacctatgcgcaaacattaggacccattgtcattggtgcactgtcagcaaccttcgttaagatctccactccggcgaaattgcacttgggtaaaaccgttatgaaggttcaaaccgggatacttgataaactggttctcggtttactccctatggctgtcaccctactcacctactatcttttgcgaaaaaagttcaaacccactacggtattattaatacttgtcggaatcggtgtcgttggcggtttattctggattatttaggattaaccagaattattcgggggaaaagaaaatgtcaattgaaattgcgccttcaatattaagtgctaacttttcaaatttaatgcaggatatcgataaagttaaagattctggcattcatatgcttcatgttgacgtaatggacggtcactttgttcccaacattactttcggttcaaagatgattgcagatctccacaaatcaacatcattaaagcttgattgccatttgatgattgacaatcccgataagtttgcaccagaatttgcaagagctggtggcgacgtcatcatggtgcatttagaagcatcagtgcatatctatcgtgttcttcaggaaattaagaattttggagcaaaagctggactggttttgaatccaggaacaccggttgacgctgcaagggaagtgttgccacttgtggaccaagtactaattatgactgttaaccccggattcggcgggcaaaagtttattcctcaaatggtcaataaggttcaagaattggctgagttacgagataatttaggcttgaaattcaacattgaagtagatgggggtattaacgatataaccattaaggattgtgcggcagccggtgctaatattttcgttgctggttcctacgtctttgacgctagtgatccaatatcacaagtcaataaattgttaacagccgtcggtcagtaaacagtggcttgggataacaaaaacttatcaagggactttgccgtatgacgtacatggaggtgattttgttatttttgacacatcaatggtcattccatcgttgataaatggtcgtgatctcaactatgcattgcgcgtgccctcaaaggttattttgctatctggggtttcgattggaaatttgagagaatttgtctatgctatccatgaacatcaaaaacaggcagtggcgcatatcgatatcttaggcggctttaaatcggatgatatcggcatgcatttgctgaaaaacttgtataaattagatggtattttaagtgctaatgttcgagcacttagtcaaggaaaacattggggaatgacaacgatctatcggcttcccttaattgattcactttctttggcaaaggcaaacgattttttaaaaaattctgacagttatgatgctgttcaagttttgccagccgttggtgcgattgctgaagttaaacgcattaaacaaatggttacacacaagccgttaatcgcaagtggcttgttagaaactcgtaaccaagttaaattagcgttttcgtcaggctatcaacttattgcaactagccagaaagatttgtggtaaccacgagcatcatcagcggcagaaaaagctgactaacaaagacctgttgatgcgattgatgaaaccatgtaccatcgatagttaaaactaaagatctgcatagagcaacgtaaggagacgctcaagaattcctgtttcaggagtttttgggcgtttttgtaatgaaaggacaaggaaaacgattatgagcaaatttaggagaatgaatcaaatattcgcagcagatggcagagcagttgttgctgcgttagatggctttgctttttcaatgaccacatcaggtattgacgacacgagtttacaaattgaccaattagttgatgccggtttagatactgccttagtcacgtacggtcaagctaagacttatgaacatgaactgtctaaggtaacaactgtacttcgtgtggatgcaaatactgaaatttacgattcatcagtgcctaacacacaactctttttcgatattaaagatgcgcttaaactcggcgcatcaggagtcgtctgtatgacatttcctggtgcctcaaaaagagaagctgattctcatcacatgctgaccaaactggcgcatcagtcagcaaagtggaaagtgccagtcattgcagaagctttgccgtttggctatccagttacttccccaaagtcaaatgatccatattatattgcaactgccgttcgactgagcgcagaacttggtgctgacattattaagacacgatttacaggtactgaagaagatgccctgatcacaggaagtaccagtcagcctgttctagctttaggcggtccaaagactgacacactaacttacttcaagtttgtccaacattgtattgagatcggtgcccgaggtgtagctgtcggtcgaaatatcactcagagtcagagcccagttggaatagtagctggcttgaatgcaatagttcataacaatgctgatgcaaacacggctttcgagatatttaaaaactacgaaaaaaagaacaaaaaggaaggctaaaattatggcaactatgaatgcagcaattttcaacgatattgaacagttagatgttgaaagaatcaataaacctaatatcaaagaagacgaggtcctcgtagagattaaggcgtgtgccctttgtacgtgggaacaacgagtttatacaggtgtcaacaaagttcactttccatttattggcggtcatgaagaagcaggaattatcattgatgttgggaaaaaagttgacaccgatttatggcaaatcggaaaccgggttgttgttggcctgctgacttcttgcggctactgcgataattgccggacaggccacgaaggaagttgcacccagttctcttacgaaaatcatgttggcggtttaaacattcgcggtatgggcgggctcgcagagtacttagccgttccggtgactaaactctttaaaattggtgatcaattaacctacgaagaagcggcacttaccgagccgttgtcttgtgtcgttcatagcgtagatacggcaaaggttgaattgggtaatgatgtagtggttattggtgcaggcattatgggcatattccatgcgatgcttgcacgagagcgcggtgcgcgtgttattgtcagcgaacctgatggaaatcggcaaaaatttttgaaacagcttgggtttcacgaaataatcaatcctaaacatctggacccagttaacgcaattaatacattaacaaacggaaaaggtgcagacgttgtattcgacaccctgcctatttcgccagttgccgaacaggccgtatcaatggctgctattgatgggcgagttattctatacagctcttttcatccagacatgccaatttctattagtcctcacacccttcatcggcgaatgacaaagttaatgggcagcgcaaactcagattctggcgattttcttaaagctatgaagttgctaaataacggaagtgttgatgtaaagccattgatcgcgggtaccgtgcctttgtccgaaatcgataaaggtatgcaatgggcgcttaagccagaaacttatcgtgtcattgttgagttaaaccgaaatgatgacaaatagatacatttcgaagagacaaccaaaaaccatagtgatatgaaataccccgcaatcgtagtcaatgctcaactgcgatcgcggagtatttttcggctttaatacaagtttttcaccgattcaatcgcatatctcaaatgcttcggatcgttgaataagaatctaacttccagcctttttccaaaaattttttaagcggacaacgaacgcagagcttaaagttttacggcatggctctttgacttagcattattctgcccgtaatatgcgtttttcccgtgcttacgataatagtgcttatccagcagatactgaggaacatgaacatccgcatgtgttaacgtcagggcatgataatcgatatcggcaactacctcgagaacttttgcgttgtaaactgctttttctggtgttgcgccccaactaaacgggccgtgctgactaacaatgactgcaggaacggcgttatgatcaattcccctgtccttgaaagtcttaacaattaccttgcctgtgttttcttcgtaagcttcctcaatctcttgtttagttaatgcttcagagactggaacatcaccatagaaagtgtcggcagccgtcgtatttagattcggcacatccatatgagctgaggcaaatgcaactgcccaaggtgaatgggtatgaacaatgccgccaatgtctggaaattcgttatacaataccgtgtgggttggcgtatcactagaagggtttaaatcaccttccactacttccccttgaaggttaaccaccaccatatcgtctggcgtaagatcttcataggcaacacctgatggtttaataacgaataggcctttttctcggtcaattccagatacatttccccaggtaaaagtaaccaatcctaatttaggtagctgcatattggcatcgtaaacctgtttctttaaagattctaacattttaaaatctcttccttcctatagtggcgcttccagcatcagtgattttgttaatcgatatcttgattgatctttacgactaccttgttaaattcaatttctttgttgtacattttcttcaaggtatctccgagctgatctagactaatctcatgtgaaatcattgatttaaagtccagccggcctttgctcatggcatcaatgacgatatcccatgcccgaccaggatatggcatggtgtatgacatccatgatccgtgaatattcaagccgccgcgcaaaacatattgttcaaagacatctttaggaatcggcaaatcatctcctgagataccgatatagacaacattgccgtctcgccgcgtaatttccagggcttcaatttcggtgaaccgactgcctgcacagtccacggcaacgtctaccccatgtttggtaatctttttaacttctgcaatgacgtcctgcgtctttccgttgatggtataatccgcaccaagctttttcgccaattcaagtttgtcgtcaaatacatcaacagcaatgacgttgcttgcgccataaagttttgcattctgaatcgcaaattggccgattgatccggcaccaagaattgcaacagtatctccagcctgaatgtgcccgcgagctaatccatatccactaaccgtagccggttcaatgccagctgctgtcttcaaatcgactgaatcaggcagatgcaaaacatgacctttgggtactttaacgtattccgcgaatccgccattgctacctgtccctatcaggttgtagtgttcgctgaacccatacaatcccattttggtgtaaatcgaatccggattaggcagcaacggcgcaatggcaacatgatcgccttccttaaatccttcgatgttggcgcccattttttccactgtaccgctaaattcatgccccataatcaacggatacagtctagctccattttctttttggcttctgggtagatctgaaccgcaaacgcctgaataagcaactttaatcagaaaatcgtcatcagaaatttccggaaccgggacatctttgtactcgacgttaccagcactaatcaacacagcagctttcattgtattaaccatgagaatattgcccaccttttttaaatctttcgtccgcgttaacaacttgttctaatctttccaaacatcaatcatcggttgccgcagtggcatttttagcagcagcccgttccaaataagcgcggaatttctctttgttcttttggaacgctgcccataaaacgaagtaaagaacgatagtcaaccctatccaaaaaatattttggcttaaaaaggcatagaagattaagccaaagaacggcttgccaagaatgttaaagcttgtgaccatcaatgcggctgttggaatagcaacgccaattccagaacttgcaatgtgtgtgaataaaggagcagttgcggtacacatataaagccctaagctgaaccagatgacggcattgatcattgttttgaccatgttaccgttcgacaacgcgatcagaccttcaatccaatatgggatcgcaagcaaatcaataaccggtaagactttattacctggtaacaagatagccagaacaaccatgataggaatcagtaaaattcctgtaatcagagtagctgtttcaccaaaaccaaccgcatcattgacacccaagaaccatagacgaggctttttaccttcaggttgatttgccgctttgcctttattgcttttacgaatcgagcgactggcagcttgagaaagaggtgcaaaagcttgagcaaaaataccagcaattttagggaagatagccataattgcacttgtagcaatcgccacttgcgtaatttgtccccaagatgctaattcgccgagatgtttaaagttaccaaggatacctagcagaaagcctaagaaaaatcccaaggaaatcggttcccctaagaagcccaacttttcttgaaggtactcaggacttaatttaattttgttaatgtgcaatttgttccaaatgggatccattaaaatgccaaaaattgccggctccaaattatgcagagcaatgattgtcgttctgggataaccatagtaagttgaccagcgttgagcgattgagtctgaaagaagaagactatacatatttaagaggcacatcaagagtagcgaaagccacatgtttttcgtgacgtagtaacacatcgatccccaaaccatgtaggagtagttattccataaatctgaaggctggaagacgtctgtccaacgaactaagaacaaaactgtttgcagaataaacgccacaaccagaaagatcatacctgcttgggtggagtaagccactagcgatgccccttgccaaccaatatcgaaaacaggcaagttaactcctgtgtcactaaccatctttttgatgactttactaatgatcggtgtatatgagttcaataatagagtgaatccagttaacccaacaccggcatataaagccgagagaaaagctttttgggtcttaacttttagtattaaggcgatgaagaataagataatcggaacaaagacgtttgctccaaaagtgtcaaagacgagctttactgtcgttagcatttcggcatctcctcgtatattgatgattttgtataagaactaacaaagagctctaagctttcgcactaattccagcaacggtcttttttagttcttcccaaaattcgtcctcgccaatgccagtcaacaagcctgtcccatttataaccggaactccatagtcagctttagggagtgggcttgtatacactactaaatcaaatttgccactatcaattaactgtttggcttctgttggccgagcttctgttgccttgactgtgtaaccgtcatcgcttagttcatcttggatttcaccagcgaccatagatgacgttacagttcccgaaccgcaaactgccaataaattaatacgtttggtcataaattccatcctcctaagatttgctgctttgctccttaacggtatttgacttcaataacttataaatccctgatgctgtatcttctgacataattttttccatcaaatcttgatcttggaaaaggcgcattaattcgcgtaagattgtgacttgtcctttagggtcgctaacggcgatcataaacatcatgctgaccggtaattcttgttccggatcaatcatgctgtggactttaactggttctcttaaagtggcaaccgctacagctgttttcttgacatattcagcttccgtgtgcggaataccaatattcatgtttgccaataccaatcctgtcggaaaattcttttcccgagcaagcacttgatcgggatattcagaagtgacataaccttcctttaagagattttgtgacattttacgaaccgcatcttcataacttttggcgtctagctttggatagataaacgcctcttcaaattttaaggccatctggctttctcctttcacacaccctgaaaatcgcttatagctttgtttgttacctgaaatctgtccccgtcagaaacaagaaggaaacgctttcaacgtcatcaatgtatcacctttgctttttgtttgcaacaacattgcattaaattttttagcaaagaattttaaggcatatcgtgtttattgatattgcaaatttcttaacaaggttcataaaaactaatgcatcgttaacttccctttatttataggcattccttcttaagtatagatgcacttcaagttcttaatcctaaacttcgctcattatttatcttggcaaaaagtctgcttcgatttttttacggattttttgtgctcatcttgcccttttagcgaattaacaattgcaatcggttacatttagatatactatacggtttgtagacaacaatatgcgaacattttgcaaaggagattgccaattatggaccaaacaattgaaaaaaccaccgactattcgtcgaaagactatctggctgaagtcgataagtattg

SEQ ID NO: 348 - DNA, 605 bp, Lactobacillus casei
gcgattaataacttatttgaaccctggaaagcattaaatcaggcggccatttggctcgtaagtgttgcaatttcaacttgtaagggggtctggtagcccagtgaactatgaattctcttcctattgtagaaagcatgcacatattcaaaaaggacggcagcggcagtttcataatcttcaaagaccggcactggataaacacattcctttttgagggaagcgtgaaaggattccattggcgcattatcatacggacaacccttacggctgtatgagtggcggatatgtagctcagttaaacgttgattgtaatcatcgctggtatactgtgatcctaaatccgtatggataatcaggtccccagtaatggttcgatttttaaccgcgctttcaagggtctttaagactaaatcagtatccatcttttttgagaacgaatagccgataatccgtcgtgagtgcaggtccatgatggttgataagtaacaccagccattacgcttcgtttgaatatacgtcatatcagcggtccatttttgatttaaaccagtggtcgagaaatcctgcttaagcaagttgggacgctgttcaaccttggttttgga

SEQ ID NO: 349 - DNA, 744 bp, Lactobacillus casei
gaatcactttaagggacgccactttcaaaaggacatcatcttagtagccgttggctactatttcagattcagtctcagctatcgtgacatcgttgaattgcttcgggatcggggtatcactgttcatcacaccacggtcatgcgttgggttcatcactatggccccatctttaaggctctatggcgtcggcatcaaacagctcacgctaaaagttggcgaatcgatgagacctatattcgagttaaaggccgttgggcctatttgtatcgcgctattgacagtaacggtttgaccatggattttgagctacgaaaacaccgcgattataccgcatcctatcactttttgaagcgtctcttgacgaccaatggtcggcctgatcgattagtcactgatcaatatcgggcaacactgaaagcagtgaagcacctgataaagcaagactatttgagcaaatcagcccaccaatgttccaaatatcgaaataatttgattgaacaggaccaccgattcattaaacgtcatcgtgtccgctcagcaagctttcaaagcattcgaaccgctagtgcaacgttgagcggtgtggaaattgttcacgcaatacgcaaaagaacccgacgagagttaagtctcatcgggttctcagtcgtggacgagttagaagcattgttagctgcataaccttcaacataggatcaatagctggttagatggtcatctctcagactgtttgcaccagatcc

SEQ ID NO: 350 - DNA, 2751 bp, Lactobacillus casei
tagtgctaactggaacgactcacaatctattgcatttcaaaagtgaggttgcaagattatttggccaattgcaataaccgttggcgcaaaaaggtaataatatcacaccgcaccggtgttagttagcaaatcaaaaactattatttagaatataattcggacttattttcttgcttctattgctcgttcaatccgcccctcatcataaagccgcaatacaaaatacatccccacataaataaccaacggaatccaaacataattcaaattaatcatggtgagagttgcggcattctgggttcgattggcaacgtaacccgaaaagtgaaacaaaccagctgtaatcaagccgccaacaccaaggccgacgttaacgccaaagtcatccgttgaagccagaattccctcggcttggatccccatgctggcaccataacggattgtgtcagcaatcatgattgagacgaggccgataatgatcccattgccaatcgagttaatcaagacaccgccaaacaagaaccacagtattttggtataaaccccaaccgcaatcacggcttgaccaaccagcgccattaaaataccgcgaagcatcgtttgcttcttactgcgaacctcggtaattcgaatgatcagcaataccccgattaacgctgccagggtaaaactgttagctagtggtaccaggttttcgtttcccaccgtatatttaaaatagtaaatggttgtctgattcttaattgccgtcaccagccagtacatgagaatcacgattgacataacgatccatggctgattatgtttcaacatttttaggacagttgttaacggttgatgggcaatttcaggattcgcgaaccgttcgcgaacatggacaaacgtgttgataatcaaaagaaatgaaatcaggctaaacacgaagattgtgcccaagaaccctttttgctgattaccgtggccgaagaacgcaaccaagggtaatgtgaataccgccaccacaatttgaaccgaactgccaaagaattgacgaatgacacccaacaacgtcaactcacgagtattctgcgacatcgttggtaagattgacgtgattggcagattaacagccgtatacagaaatccaaggcctaaatacgtcacatatgcccagattaatttaccattatacgaaaagttaggcgtcacaaaggtgagaaccgcaaaaataacgtaaggtaacgaataccagaggaagaacggtcggctcttgccaaaccgtgaatgtgtgtgatcaatcatgatcccgatgacaaaactttcaacaacgtcagctacccgcgccacgacaaataaaatggccaccgcgcttggtgtcagtccataaacatccgtgtaaaagaatagcaaataggtcgtcatcatttgaaagactaaattatcggcggcgtcacttaagccgtaactaattcgttcgggccaccgtgttacccatttcgtcgtgcttttcatcccatcatcgcctttagcgaaattgttaatcctagattgcaataataaagttaccacctagaaagaggcttgctcactgcttgaactggggtttgccaacggagacattttctaggtttgttattgataagcgctgtggcttgttgaatatcggtctctgaaacctgatcaaactgtgttcccttcgggaaatagtagcgaagttctcgattgaaccgttcatttgtgccccgttcattcgggtgataggcgtggcaaaagtaaaccggtatccgatagcgctttgtaagcgcctgatcgcaggaaaactctttaccgtgatcaaccgtcactgatcgaaccggacccggaaagtccaccatcagtcttgcaaatcccttgagaacagcattttgtgataagttttcaagcttagttgtcgccattaaacgtgtcacccgatcgacaatggtcaaaacagcagcctttgacccgcgaccaccgcgaactgtatccatctctaaatgtcctttttcggttcgccgattagctgactcactgcgaatctcaattgaggtgcctactgcttggttatagcgcgaccgaaggtcttgtcttcttttatgacgtttaccgtgatcaaagagttggcttggctgaaaatcgacttgtctttgataaatccagtggtaaatcgtgtgtggcgcacagtgaacggcataaccgaccatttcaggggaccaacctaggtttagcttctcagttaccatccgcttcaacttaggcgttaaaatcgagtgccgaccacaacgatgccgacaagtatcggcatgatcctgagctataatggcgcagtaatcaccttcagggcaacggtgaagctcatgcctaatagaaatacgagagcggcctaaggtcgcggcgatgtattgaatcgtgtggtgttgcatcagttctatctgagatcgttcaattaaggttataatggccatgggacctgtccttctctctagatggtatgttatgcaaacaccattttagcaagaacggacaggtcttttttcacattttctgggtggtaactttaattatgcaatctaggaatcaactttatcgtactctaaaattagttctcatgatatagattgtacacaatttggatgtaagctgattcctgagacaacttttaagggatctggtgcaaacagtctgagagatgaccatctaaccagctattgatcctatgttgaaggttatgcagctaacaatgcttctaactcg

SEQ ID NO: 351 - DNA, 27230 bp, Lactobacillus casei
cttcattcgtgaagccgggaccgatctgccggaagtcgaagaatggaaatgggaaccgttgaagtaagtttcctcctccttgggaaataggtaaatattctaaaacgcgtcctcttgtgtgagaaaacgcgttttttagaaaaaacttttgtgcggattcttcaaccccgaattgtcaacatttacccgttgcgacattctacttgacaaacccaaatttgcgcgtaagctgacaattaaattaatatttcatgacaagatgagtaatcgtctaaccgaaacgcagagaattgtcagttggtggaagacaatgtgaagttggcgatgaatatggtcttggtattgtgggtgtgattgcggtcgaacgttggtaagacggcaacggaaactttcgttaacaagtaaggatattgattttgatgtatccggagtgagacattttgtctaatcaaggtggtaacgcggcttatggtcgtccttgtcgagtgatcggcaaggataacataggccgcgtttttgtttggttgatgatggtgttgtcgcaatacgctataggaggagattttcatgaaacggacgcagcgggtggttcatcttttcattattttggcgggcttgtttttggttttggtcggctgccagaagaccagcagtcagcaagcttccagtagcacgagtaacgttaagcaggagcttttggatcataagacgttaacggtggggcttgaagggacttatgcgccgttttcgtatcgaaagaatggcgagcttgcgggttttgaagtcgatcttagccgcgatattgccaagaaacttggggttaaagtgaagtttgtgccgactaaatgggattcgctgattgctggtttgggggcgaacaagtttgatgttgtgttgaacaacatcaccaagacaccggaacgggagaaggtttatgatttttcaacgccgtatatttattcgcgttatgcgttgattacgcccacggcaaaagccggcacgattacaaagttggcggatattaagggaaagacggttgtggaaggaaccggcacgagtaatgaagtcttggccaagaagttgggtgccgctaagatccttccgtcaggtgactttgcgacaacactgggccttttgcgtcagaatcgggcggacgcgacgatcaactccactgccgcatggtattcgtttgttaagagcaatagcactaaagggttgaagtttagagcagtccccgattctcaacagaagccagatgaagtgtcggctttgttgacgaagaaaacgcctaagcttcgtaaagcggttaatcaggcgattcacgatttacgcgcggatggcacgcttaagaaactttccgagaaatattttggcggggacgttacgactaagtagtcgccgttcttgaaattgatatcgttttttgtagtcaggaggatctcgatgacagattttaataccaagcttgtccatggcatacccgttggcgataaccaaaccggagcagttgtgccgccgatttatcaaagtaccacctttgcttatccgcaggcagacgctaaggtgcgctgggattatacccgaagcggcaatccgacccgtgaatatctggaaaaggaaattgcttatttagaagatggcgatgccgggtttgcgttttcaagtgggttagcggcgatctcaaccgtgttttcgatttttgaccgcgatgatcatattatcattggcgattcggtttacggcgggacttatcgtctgttgaacgattattttaccaagcatggcttgtcgtttacgacggtggatacgcgtgatctggatgcgattaaaggggccattcagccgaatacccgcgcgatttattttgaaacgctgtcgaatccgctgctaaaggtgacgagcgttaaaaaagtcagcgcgttggctaaggagcatggccttttgacgattgtggataatacctttttaacgccttatctgcagcagccgctgaacctgggtgcggacatcgtgattcacagtgccactaaatatttaggtgggcatagcgacgttttggcaggcttggtggtgaccagaacaccggcgttgagccaacaagtcggctatttgcagaacgcattgggaccaacattggcgcctgaagcggctaacttggtccggcgcgggatcgaaacccttagtttgcgcatggatcgggaacagcaaaatgcgctggcaattgccgaacacctggaggcatcgccgctggtttcaagcgttcattatcctggcttgaaacaggatccgaattatcagatagcacaggaagaactcaacggagcagggggcgttttgtcgtttgaattggccgataacgttgatgccgatcgctttgtgaatcagctgaaattatttacactggcagtttcgctaggatcggttgccagtttggcagaattgccttggacaatgactcacgccgagttgccggtttctgcacgcaaggcaagtgggctttcgccgcaacttattcgactggcgattggcgtggagagcgtgcgggatcttattgaggatcttgatcaggcgctggcacagatggggtgaggcgtgttagctgatggcaggtgtaacgttagtgaaaaatcttgatacagtataattgcaaagtaatcatcttcatgtaaaaatgagtaagtcaaagttcgatgttccgtcaccaggccgtgattgactgcaagcatcacggcctttttaaatgcgtttgaacttctgcgagggtatagagcttgcgccaaaagcgttggctatggtaaggttaatttgatcaaaaaaatcaacatgatagcacagtagccgcttcccgggctaggggtagcggctatttttttcgcctagtcatcgagacctacctggctaggcgtgtgggttgatggcaaccatgagattaccgctgatcagttaaacggtacagtggggcggagcaacaactaaaaatgctgaactgaagcatcgaaaaacaggtatcgtaccggcagtgaaatgccggtaacaatacctgcttctttatatacatagtcgttatacccaggattgtcagactgagaatctgccatcaactaggttcatacctagtgcttcccatgcaaaacctcaagccgatacccatgctgcttaagagcctccgcatagttgtcaggcagtttctgatcaaaccgaaagcggatgagcggcttgaattcaccttggtctgtgcggatgccgaagatatggtcggcacctggttcgctaggcacgcgttcaaccacggtttgttgcacttcgccgcgttgacgtgcttgaatcaaggcggttaagagccgatcaagattcgtaatggtcactggctgcatgtgctcatctcccttgatcatcaactattgttccaagttgactttagtctagacgcgtttcttccgggatgcaaagcccatgaaactaaagatgctgacgatggcgagtccgaatacagctaacgggctctgggcttcaccggcttgtggcatggttttgccggttgcagcttgtttggtggcgttggctgtcgtgccattcttggcagcaggcgtcttggtttggtccttaagcttgttgtcaagcgtcactaactttggaccctgctgaccgttgttgccgttaccgccgttggagcctgtgccggttgttggcgtcgtcggtgtgccgttgccggtagccgggttttggccgctgccgttaccgccttgagtgccaccgttgttgccttgattgccagcattgccaccctgattgccaccgatgccttgctggttcgagttgccgttacccgagttattaccgttgttgtcattatcaccaggcgttggtgttggcgttttaaccttaacgacatggaagaccttggtgactttattgccaaccatatcgacggctgtcactgtgaagtagttatcgccgtctttgagggtgtaagtctggttgaagtcagcggcaccatacgggttagaggttgtcgatagcggatcaagatggttgttgaagccagccagattcttttggtggacaacgttatcgccattggtgtaaagccggtagccgttgatgttgtcgttgaccgtgccggaaaccgtgaacgtgtcactggttgtggtgatgtcgtaattgccttgatcatcgactttcaacgtgtcggcttgtggtaggtcgagtgtcgggaagatggtgtcgaggtagatctgcagctcgccgtaagcagttttggttgatttcgagccatccgtggctggttcggtcagccggtagccaactgattgctgttcggcggctttgaatggcacggtgaagctgaacttgccatctgcgccgattgtgacggttttggccggttcggtggcatccgtgacggtcaacgttttaccagccgggttgtcaacgtggccggtaatggttagctggccggtttgcgcgttgtagatatcggcgacttggtcagcgccaaccagtgtgaaggagttgtcgttgaatttatcaaacttcagaccggcagttggctgggcatgcgtcgtgatttgggaaaaggcgcggccccctagtactggcgcaccactggtcttggtcgcgttggccgcagccttggcattgtcttgcaacggaacgacgacgtgcacgttcttctggctgaagtgaccgtagccggcagtgccgttagcatccaaaaagacaatcatttcatcaccgtctgcacgaccggcttcttcataggttccgaagtctgcggtcggtgaaaggacggtgccgataaagtctccatatggcgcggattcggtcaagttgaaggtgacagtcccggttttggtgtcgaccgtgcctgggaagactttgccggtttgtgcatccgtggcatagacgatccagtctacgcccgccggtacctgagcgtaagcggtaaagctggtttggtcggaaaccgcttgaacgaagccttcagaacgccagaagttgtgcgggccatcgccgactttccatgtgaactgtggtgcgacgtcacttgttggcgttgtggtatcggtttgatgcgtgccggcggttgcttgcagggtggcgctggttttattaccggcgacatcggttaacgtcagggtcaggctgccgtcactattttccagtgcggctttttgggcggcggttagttcaaagtttaaggtgccgtcgttattttggccgttgttgtttaagttgacgccgtatgctttgttgccgattttcagtgccagatcgctgaacttggtgaaaccggcgccttgatcatcgtaatggacggtgacgcggccgtcttgatagcttaggccggttaacgtcggcgcaacggtgtcgacagtgaccggtaagtcataatcctgattctgttgggcgcctgtgttgtattgctcggtcaccagccggtacgtgtacttgccatcgggtgcggtgacgtatttgccggttgcctgatcgtaaaccttgccatcccaagtgaaggcgtttggatcgaggcgcatgtcggtacttaagccgagatcggagttgaagctgttgccattttgcaagtaggacttggaggtgttgttttccttgtccaggacccgaacaacatggccttgagcgtcgaggatctggatggtgactgactttaggttttgtttagagaagacgtatgggaaaaccgtgtcgctggcgccgtcgccgttgggtgagaatgaaactttcttgttgtcgacgtacgtgggtaccagcgtccatgtgtacttgccagtcgtgtcggtgttgaccagattgctgagcgatgcggcatcggtaaccccaagtggattgttgttgttatccaccagatagccgccattgaaaatggattcgccgctgtttgccggggcgtcgatgacctgctcatcggtgagatcaccatagtagccgagatatggaacgctgatcgtttgcgcggcatcggttgctttaaaggtgagatagccttctaccagttgattggccgcaaccgaatcatcgagggagagcttgaaggtgacttgcttggtttcgccagccgctaaagtgaagttggcggtatcggtgttgacggttgctccgacaaggatttcgtcatggacggtgttgccgttacttgcatcgcgaacctgggtgagcgggccaccattggtatcaaccgtgtagttttgtgcggttttgccgtggttcgtcagggtcacagtgaatgtcgtagttttgccgactttaccgagtgaaaccgaaccggcgtcgttggtgccttcagcgctgaccgtcaaatcgccggctttggcgacatcgatttggccagctccttggcgccgcggggaaatgtaggtgtccggataattgacatctttcatcggttccgccgcgttcatgagggctaacttgacggccttgacgagatcggccccggttaagtcaggttgggttgctttgattttttgcataacgagcaacgccgcaccagcattgaacgggccggccatggacgtgccggattcgacggcatatgtttgcgtgttagtggtggggtcgatcgcggtagacgtgacgttatcgccaggcgcggaaatgtctggctttaaggtgtaatcggccatcggaccccaagatgaaaagccgtccatctgggaatccgcgccagttgcgctggtttctgctgcgaccgtcatggctgacgcagcggcaccgggatcgccaatcgtcgagtcgtttttaggcgcataggcggtggagatatcgttcggcgttttggaaccgatgatactgccggcgatggcgttgttaccagcggaaatcgagacgaaaacgccgtgctccgtggcatactgaaccgctgcctgctcttcatcggttaaatcctgctcggtaacaccgatgcccaaggacatttgaatggcgttcgctccgagtgccaccgcatcacgaatcgcccgggaaatatcgttggcattttcatcagggaattcgtcgatgacctgcatagcgagaatttgggcttctggcgcgacgcctttgacgtaagtagacgccttttccttgccggttgcgccgtctgcggtggtgccgttggcggcgatgatcccggcaacgtgttcgccgtgggtcgagccggcaaccgtggtcccagtgttcacactgtcgttgttaacataatcgtaggcaaatggaattttgctgttgacgtaggtgccatagcctagtttggcgatggctgcttcggctttttctttggtcagcgtagcggtgctgtcgtcactgagacgcaaatcggcatgcggttgcaccccggagtcaatgacggccacgaccatgccctggccttggtagccttcatcccatagccctttgacgttgcctttggtcagggtatcttggttagctggcccgggatcggttgtggcggcagaactggcttgattctgattgtcagctgtagtcgtgctggttgcggttgccgcggcgcttgcttggctagtggtcgttgttgctgtacttgttgccgtttggctggccgtgctgctggtgtttgtttgcgtggttgcgccagacgccggtgcggttgttttcgctgtcgcagatgaggcttgctgggacgtagtttgcggctgactagcgctgctctgcgtgttttgggcaggtgttgcctgtgtctgagctgcgctacttttggcattgtttgccgttgtagtttgagtcgcgttgctagaagcagcgctggctgttgcctggctggtcgtcgtttgcgcggcaggttgggcctgcgtactagttgactgagccgtttgactcgtcttttctgtcggcgttgtcgttgtatcggcggcaacggactgggtggcggtgccgcccaagacaatcaaactcgtaccaaaagtaatgatcgcagcagtcatccatttggagcctgctttatacatcttgtaatgtcgcttcatttcggtcgtcgaatttttattcatgtacgcccgtcccccttagattttgtattaagaaaaatgagacttaaaagaaatgtccaaaatacccaattttttcacattttaaaaacaatttcttctcatttattcttaatagcaaaaagcttattccctgaggtggcttctgtcaagacatggacggggtttcagcggtgaaatctggctcgataattttgatttcattttatagtagattatttagcttatattgataacgattaataggaaaattgtcttgcttatacgaagacaaaaagttcgagtttgccgtgtcgcaattgcatttctcgggctttttggcgtgcaaaaaaagatgtcgcggcattttgttaagcattcctaaatcatgaataagaaacaagacaggtattgcaatctgacagttaacgtgcaactttaaatgtaattgtagatttttgccttaatcggttttatattcccttaacgtgttttcgtctgattgtgataaataatacagacagactgatacgacttcctaagcaagaaaccagcaggccattgatattgatttggttatgccgcaataacctttatgcactgaattgccgaaaattatgattccattcataaagtttcactgcttaaattcgaaaaagtgcatataaagttcataaagcgtcatataatcctagaaacgttcatatagcggtattgtaagcgcaaccacaagactttaccatgagaaacagggtcagggaaagaagctaaggaggaacatcatggtaaagaagacaatcaataacgtcacccgcgaaaaatggattctgagcacgtttccggaatgggggacttggttaaatgaggaaattgcggcgaaacatgtgaaatcgggcacattttcgatgtggtggctgggttgcacgggaatttggttgaaaactgctgaagacacgaatattttggttgacctgtggtgcggcacaggtaagcagacgcatggcagcggcatgatgcgcaaaggccatcagatgatgcgaatgagtggtgtgcagcagatgcagccaaatctgcgtaatcagccgtttgtgattgatccttttgcgatgaaggatgtggatgccctgtttgtgagccatattcatagtgaccatttggacatcaatactgccgcggcagtgaatgccaattgcccgaatgctaagttttatggtccggagaaggtctgcgaaatctggcagggatggggtgtcccaaccgaaaaaaccgtcgttgtccggcctggcgatgttgtgacgattggcaagacgaaggtcaaagtgttggagggttttgaccggacagcattaatcactgaggatgatccgaatgtgaagttggcaggcaaaatgccgcaagatatgaatcaaattgccgttaactatttgtttgaaacaaccggcggcaatctctatcatgcggcagactcgcattactcaaacctatttgccaaacatggcaatgaaaatcacgttgatgttgccttgggtgcttatggggagaacccgcgcggcattaccgataaagtgacctcgattgatattttacggatggcagaatcgttgaaaaccaaggtcgtgattccggttcactatgacatctggacgaatttcatggccgatccaaaggaaattgaggccctgtggcagatgcggaaggaccgtctgcagtatcaattcaagccatttatctggcaggttggcggcgaatttacgttcccggacgacaaggatcggatggaattcatgtatgaccggggcttccatgatacgttctcggtgccaaacgatacgccgtttccagcatttttataaatcgtgtgaggtggggttttagcatgttactgaaagacttttgggaaaaggatttagttgatattcgcccggaaccggcaaccgattggcgagatgcattgcgtcaggcagcaaacaagttgattgaacatcagtatattttgccgggatatgtaaatgagatcatcggaaatgttgagaagaatggaccttacattgtgattgtacctggtgtggcgatgccgcatgccatggcggaaagtaccaatgtgttggggacggcgattgggtttgccaagttcccggaacctgtcatctttgacccggacgatccggagaagcaagcacagctgttctttacattagcggcaaaagaaccgaaccaacatttacaaaacatcggtgatctttctgacatgttgatgacagaaggactgattgatcgactattggccgtcgaaagcgttgatgacttcaaggtgatcgttgacgcagaaagttgaaggggaaaggtatcaattcatgcagccatttttagattttctagtcagtgtatgggactactttgcggcaaatattctaacgcagccggcctacatgattgggttcattgtcttacttgggtacattttggaacgcaagccgttgtatgaatcaatcgccggttttctcaaagcggtgatcggttacatgatcctgatggtcggatcaggcggcttggtcaatagttttcgcccgatcctgacaggcttaaaagatcgatttaacttaactgcgactgtcattgatccgtattttgggcaaaatgcggtgacggaaggcttggaaaaaacgtttgggcgaacctttggcgatgtcatgctgctgttgctgtttgcctttgtcttcaatattttactggtccgcttccaaaaatggacaaaattgcgggcggttttcactaccggtaacgttcaggtacaacaagctgccacagccttttggattctgctcttctgttttccgcagatgggacggattgaagtgttagtggtcatgggcgttgtgctgggactttactgggctgtcgggtctaatatgacagtgcggtatacccaggatttgaccgatggcggcggctttgcggttgcccatcaacaaatgttcggtattgcattcgtatcttggttggccgataagttcaaagcacatgaagtcaaggcgcagaaaaaagctcggcgcttagaagacattgaattgccaggctttctcaagatttttaatgaaaatatggtagcgaccggaattctgatgctgttcttctttgggatcatcatgttgattctcggacgcccatacttcaatggcgtctttgccgcgacaaaaggtgcttcgggattggcaccgaatggcagttttctgttttacattatgacgacatcgctaggctttgccgtcaacctgacaattttgcagctcggggtgaggacattcgttggtgaactgacggaaagtttcaccggtatttccgaccggttattgcctggttcggttccggggatcgacgttgcggctacgtttgcgtttggtgagcccaatgcggtgaccatcggctttctgtttggtgcactggggcagtttttggcaatcggggcattgctgctgttccattcacccacgattatcattgccggctttatcccgcttttctttgataatgccgcattcggggtttttgccaaccggcgttccggcgccaaggcggctatgattctgccattcttgagcggtttgattcaggtctttggcgcagcactgattgccacgtggatcggattgtcgaagtttggcggttatctggggatgttcgactgggacacggtatggccattcttcaccgtcttaatgaagttccttggcattgtcggtatcgttgccgttgtgatcattctaattttgatcccgcaacttgaataccggcatgatccgaagaattactttttgatggtaactgactatgaacagtacaaagagaatatgacgaagaaaaaagcatcgtgaggcgttcacagaacataggaggagatttgatgaatattttagtatcgtgtgccaatgggtcaggaactagtttgatgatgatgcgcagcgttcaaaaagccttcaaacggctgaatattcctatttctaaaatcgaacatactaacttggcagaaggtaaaagtactgccaaacaatatgacatggtgtttaccaccaccaattttgtcgacatgtttaaagatgccaaggacaaaggcgtgcaggtgatcggcgttaaaaacgtgatgagtgataaagaagtcgagcaacgggtacgggaagagactgaccttgtggagtaatggttgtgaattttgagtgtatggtggcgggtttgccaccaagaattttcggttgggcgtacaggaggaaaacattttgacgaaaccaaacttacaggtggcgctagacaataatacgttagccagtgccttggcggatgttcgggaagtcggcccgctggttgatattgtggaagcaggcacgattctgatcttgcaggaagggacgattgcagtgaaggcattgcgcgccttgtttccggaaaaagtcgtgattgccgacaccaagtgtgccgacgcaggatccacggttgccaagaatatggcggatgccggtgcggactggatgacatgcatctgctccgcgaccattccgaccattcaagcggcgcaacaagaagtggctgacattcaaatcgaactctatggtcagtggaccaaggaagatgcccaattatggctggacattggcgtcacccaggcgatctatcaccagagccgggatgccttgctttccggtgggtcatggggtgccgcggatcttgccaaagtgcaaatgctggtcgatatgggctttcgggtttcggtgaccggcggcttgagtgttgacacgttaaaactgttttccggcgtgaatgtttatacgtttattgccgggcgggcgattacccaggcaccggatcccgccaaggccgcagctgattttcaagcggagattgtccgaatctggggtaaataagcaacgtaaggtttggttatggggtgacaatggtgaaaaattcaatggcgaatgtgcaagcgcgccgggagaaagttctggttgttgtggatcaagccgaatcggtggcggttgaagaattggcccgccagtttgatgtgtcgatcacaacgctgcgccgggacctaaaagcgctgtcggatatgggtcaggtcaagtggcatcatgggctcgttgaaaaagccaaactgcccacaaccgccaatcacacctcgcgttcgggcatcgaattgctaaaggacacgattgcagagacggtaccaggctatattgtcaaaaatagcaccttgtttgttaactcaagttcgctatgctggcgagcgattaatcagttggcgacaatgccgctgacgattatcacaaacaatatccgggcgacagaatgtgtccgtcaccctgaaacatcaattatcctgactggtggcgaaatccgctatcccaaggaatcactggtcggcaccgtggctattcaaattcttgaaaccatgcaatcggattttactttaatcggttgtgatggcattagtgaaggcggcggggtcacgacgcaaaatatttttgaagcgcaggtgaacaccaccatgattgcccgtaccaagcaaaaggtgatttgcgtggcggattaccgcaaagtaggcgttaccagcaactatcatgtggccgacttaacggcagtggatgtgctcattaccgataattttgccaacgagaaaacggttcgtgaactgcggcgtcacgggattgatgtggttcaagtggtcaattaacgcgattgatgtggaaatacgcgctggcgaaggcctgtcgcctggccgatccagcctgaaaaactggttgaatgggcaacggactcaggaggtctcgccagttttttgttgccaaaaatcgcgtcaaggagggaaatttttgaactcattgggaatttatgaaaaggcactgcctaagaccgattcttggttgacacgattgcaactggtgcgggacttggggtttaactttttagaattgtcgattgatgaaagcgatgagcggttggcgcgtctagattggaccaaggacgagcgggcggctgttcgcgatgcgtgttggcagaccggcgtgcggattcatacgctgatgttaagcggtcatcgccggtatccgttgggctcggccgatccggcagtgcaacagaaaagttgtgacatgttgggtaaagcgattgatttggccagcgatctgggcatccgcaacgtgcagctggccggctatgatgtttactacgaacccaaaacgatcatgtcccgcgaatgttttattgaaaatctgcaacgcggcgtggcgtacgcagcgactagggaagtcacccttgcgattgagacgatggacgatccgtttttgaattcgttaacgaagatccgggcacttaaggatcaaattcgtagtccgtggttacaggcctatcccgatgtcggcaatctgtcagcatggccggaaaacgatgttggccgcgaactggagctgggcattgccaacattgcttccgttcatctgaaagatactcaggccgtcacggcagatcatcccggccaatttcgcgatgtgctgtttggggatggggttgtcgacttcgctggctgcctgcgcaccctcaagcgccttcattatggcggcgcgttcacgatcgaaatgtggactgaaaaagctgccgatccgattaaagaagtgaaacaagccaaagcgttttttgataagctattcgctcaagttggcttgacgcaggaacctgtgagcgaggcaaatgtgcggtcttaaaaaggggcttacttcgctttccataacgcgctcaccggcgcaggagcctgcgtgtaaggaccttggtcgcaatggcaaagggcgccatcacgcccaaggccacttacactccggctcctaagcgcgccggttcacgctcacataaaaagcagccgacccaagctgccggctgccaactcaatctattcttataaccgaatcgcggttggactgatctggaagtaatcgactaagtaactggcgaccccatcgtcatcgttggacggtacggtaatgtccgcaatctttttgatggacggaatggcgttgcccatagcgacaccgatgccggcgtattcgatcatgtccttgtcgttttcttcatcgccaaaagcggcaagttgctcacgtggaatgcggtagaagttgagcgctgcctttaagccattcatcttgttgacgttttccggcatgatttccaacaatgtccgacgtgaacgggcgacgttgaggtttttgagcgattttgcagcagttgcggcggcatcgaccatgtcaggctcaccggcgatcacaaccttgaaaatcggcaacttagccggaaccttatcaaaggtcgtgtctgtaaacggcatcagcttaggaatcagcgtctgataactcaatttaccaaactcggtcagtgaataaactttatcttcaccgacaatgtccagcttgaagccattttccttaaccagatcatacaccggtttgacttgttccttggtcaaagccgtttctttaatcacggtatgttcgcgaaccagccgaaccaagccgccattgaagcagacgcagacatcgtcatttttggtgacatgcagttcctccaagaatggcttcagcgtggcaaacggccggcctgaacaaagaataatgcggatacctttgcgattcaggtaacgaagcacgtcgcgattcgtgacgctgagttccttcttactattaagtaatgtgttatccatatcaagtgcgatggctttaagcataattaactccctttccaactttacgtggttaatgcttattatatcagagtttcccaatgtaaaaacgttttcagaacgaaccgagccaaaatgaattcatgacaaaggaggcaatcatcatgctcgaacaattaaaacaagacgtttatgaagccaatatgcagctgccaaaattgaatctcgtcaccttcacgtggggcaatgtttctggcattgatcgggaacgcggcttattcgtgatcaaaccgtctggcgttgcttatgaagacttgaagccggcagacatggtcgtcgttaacttagatggcgaggtagtagaaggcgcgctgaatccatcaagtgacacgcccacccacacggttttatacaatgcttttccggatattggcggcatcgtgcacacccattcgccgtgggcagtggcttttgcctcggcgcatatggacgtgcctaatctcaatacgacggcggcggatactttttatggaaatatcccggtttccgaagccttgagccaacaagaaatcgaggacgcctacgaagagaatactggcaaagtgattgtgaagacattccacgatcgcggactcgattacaaggcagtaccggcagtgttggtaagccagcacggcccattcagttggggtgcgacgccggccaaagcagtttataacgcaaaagtcttggaagtagtcgcggaaattgattaccacgcgctgacactgacgcaccacgacgcccacttgccgcaatacttattggacaagcactattatcgcaagcacggcgccaatgcttactatggacaggatggcgcgaaatcgcaggagcatgcggcgaaagcataggtgggttagttagttttataaaagttaaaaggagaaccggtcaagatggggaatcacccactttggccggttcttttggctgactcggtaaatcatgcgggcaaaaggccggggccttaccgccaatgatgaacctagtatcggcaactgttcgattgattctaaatgttattttataggacttatttcgggattttgcacgaatggaacagctgacttgtgaaacccatagacacacctatttttaaagccccaaaacaaagacaattccaccaacctgttatatgccggttaaatgccgttttataagcatcttaataattcgctaccgaaacagaatcagaccgcaattttcataaatggaacagaccaatcaatttcttgttgacgcgatcacatattattgcacgattaatcgtgcaaacatttcctgttgtttcgtttgagaaagcgctttacagtgatgatagacattaacagcaaagggggtgaacagatgacattgagtagccggcagcgacaacttgttttgcagttgttgaatgccgaaggggcggtgaccgctaagcaattagctgaatcggcaggggttagcgtccggactgtgaagtatgatttggccgacattcgcgattggttggcggcgaagggctccgcgttaaagagtgcgccacgcaaagggatttggattgaggcgggtgatgctgccagagcggccttgcgtgagaaaatcgatgaacaaattgccgatcattatttagcgccgaatgagcgcatcatccgcatgattttgattcttgcgcaaaccggtgattacacgactcagcaacagtttcaagcgcgggtgaatgtcagccagacaaccgtcaacaatgatcttaagaagctggcggtttatctacagcagttcaacgtgaagctgaccagtaaaaactactatggctataagctcaatggcactgaattggacattcgccgcttgttagaacagttgatcacccagcaattgaatcggaagacgctcatggcggaattggtcgatagcctaagcaccaaaagcgagccgaagcgggcagtgattttgaccggtgaggcaacatttgatcacgcgtttaacacgattttgaaagaagccattcgcttgggcaaaacggaagcacacatgccggatccgagcgaactgattgcgacgatcattcggttgacgatcggtgtgattcgccaaggttttaatcaactggtgaatagttatcaccgcgttgcccagtcccatgccaagcaacactttactgacaagctgatcatgaacacgctagccttttataatctgccggcgctgacagatgatatcgcgtattaccttggccagcgtgatcacgaccagccggctgctcaggatcacaatctggtggcgatgacgcatcgcatcattttggcggttggcgcgttggttgatcatgatttcagtcatgacagtcagttgcaggagaatttgtacctgcacctgagccagtctttaggcaagcacagtcagcttctggaatatagtccattcacgcaagacattaagcaagaatatccgggcttgtttgcggctattgaaaaaaccgtcaataaggaattggccaatgatcaagccgtgttgagcgaggcgtttgtttctttcattgcgttgcatttcatggtctcgcttaatcgcgacagtcaaatgcgaacggtgcgggttgcttatgtctgtgcgacgggtatcgggattaccaatttgattcagcagcggattgcttcggctatcccgaatatcgaactggtgggttttgcttccattgacgatgcgcgggccttgatcgcacgtgaacaaccggaattggtcatcagcgtttttccactcaaaaatgtggatgttcaggtgatcgaagtgcagccattgcctaatgccaccgacattgcggcgattcgccaggcagtcgccaaaaaattacaggtaccgctggcgcaaatcaaatcgcagcattccgtcgtaccgatcaaaccaaagccaaacttggaacagcagacgcaacagacgattttgaccatgttcagcatctattcggaactcaagctgcagttgccgaccaaaattgatccgtattacggcgatgcgttcatgatgcacgtttttctggcggtgcaacgcattatgtttaacaaacagtatcaaggcaagccgaatcatgatgatccgaaattagtcgggaccgtcgagcatgtcttttcggatcatggactggcgattaatcgggctgaggtgcacgcgattctggaatatttgagcctaagtcatgcaacatcttagaaaggggatgacaccactggaagccaacgatgaattaccggaagaagttcaaacaatgatccaacaaagtagtgatgcgcaggcggcggaagcgctggttcgttatgtcattggattagccgcagccgcggagattcgatttaccgatgttcagctacaggtgctcacgaatcacttaatcgaaatgctgaaccgttctcagtctggtgaacaactcccagcggtcgatccgcaaatgtttgccgatgtttcccaaaagtcgcttgacttggcggatcaggttgttcggcacatcgggcatttggccgtcgccgagaagtatattttatcgattcattttgaagcagcacagaacaaaatttaggaggatttaaccatggttaaagttgttattgcagatcgaatgggtaaaggtcaaaacgttgcaaaaggtgtcgaggccgctggcggtaccgctgttgtcgtaccgggcatgggcgccgatatgcgtttgggtcaggtcatggacaaagaaaaagcggatatgggcattagtttctgcggttctggcggtgccggtgcgatcactgcgcatacgcaatttggttggccggaacgtcacggtatgcgttcgattcaagaaggcgtgaccgcgattgaagaaggcaccaaggttctcggcttcgggtttatggatcaggaagcattggggaaagccttggtcgaggcgtggaacaagaagtatccagaagcttaaggagtgagcaagatgacggtcgtgaatgaaaccaaacgtcaggtggtcaccgtttccggcaaaggcgaaaccaaacaacaggcgtttgccgccgcttttagcagcatccaaaagcaactggtcggcaacggcgatgaagccattttacggattattccggaaaaagttgagccgcttaagttagttaaatccagttataccgagaagttcctgttcttctttttcaagcggacgcgaacgacgtatgcggttacgttggccgtgacggttgcggtgagtgcgatcgatcttgacgctttgacgtttgaagatgtcacgacgccgtcaccggatgcactttcattgccaaatttgaaaaatatgttgaagggtgtgaaatgaattgccaatattaacaatcttattccagtcgatcattattggtggactggtaggttttgcggcaggcgttggggcagcgcggatgtttacggcaccgaaaacccaagccttgggcgcattccgtaccttgggggaaatgaatgcggcagaaggcgatccggcttcgcattttagcttcggtcttggattcttcttcaatgcttgggcatcaacggttggtgctggcgcgtttacccaggatattacccaccgtgtgattccgaactgggcagcggcaggcttgttgatgaagaatcgcaatgtcgaacagaccatgcataacccgaagaaaatgggaattgccggggcgattgtcggtgcagtggttgtggtgttcctaaatgtcacttccagctcgattccggaatcgttgcaggtaacggcggttaaggtgctggtcccagctgccaatcaactgatcaatctgatcatgccgattcttttctggctggctgcaattgatgccggccgccgctccggattattcggcaccgtttttggcggattgtccgcaatgatcatgggcaatgcggtgcccggcgtagtgctgggcattttaatcggaaaaggagtcgacgaactcggctggacgcggattacgaagtccattttggccgcagcgattctgctgtttgtcctatccggcttcttccgtggctttgatcttaacttgttgaagtcctttaacctaaatgcgccaggttggttgtcgaatgtccatcaaatgataggcggaaagtaggggtgttgacgtatggcggataaacaaaccaccgcaactgcggacgaagaattgaaggcagttgcaaacgaacatgacttttggcacgcagactggggcttcgttgtgattgtcgcgttgatgtcggcaggggtctttgccgggacgtccatgtatttcaattatggtgtcggtgccttcaacgaagtcgcgatcgtggcgatgttgaaggcggggatgacaggcggttcttacggtgccgccgcggcgtttggcgccagcttcctgttcgctcggatcttggaaggctcgctggttgggattctggatctcggcggctcgattttgaccggtgtcggcatcgggattccggccatcctgctttctgttggggctaaacctttggtcgccaacttcggactggcgcttttaaccggtgctgtgttgggcattatcattggggtcatcattttcctggttcgaaaatttactattaatcaaagtaatgccacatttggcgcggatgtcatgatgggcgccgggaaccaaaccggccgtttcctcggtccgctgatcatcctgagtgccgtcaccgccagcattccgatcgggatcggcagcacaatcggcgcagcactcttctacgcatggaaaaaaccaatcccgggcggtgcgattattggggctatgattatgggatttttctttccagtcaaactttagaagaagttttagaaaggcaggtcatcacttgtgtttgatgttttaatcaagaacggcaaaacagaacgcgaacagccgattgaagtcggcattaatggcaaccgaatcgcggcgatcgcaccgaagctcgaaggggccagcggtcaaaaagaaatcgacttgcatggccagtcgtatgtcagtgcaggctggattgacgatcatgtgcattgttatgaaaaactggccttatattatgacgatcccgatgctgatggttacaagtccggcgtgacaaccgttatcgacgccggttcaaccggtgcggacaatattcgcgatttttacaacatcacccgggacaaaaagaccaacgttttcgctttgattaatatcgggcgtaccggcattttagcgcaagacgaattaggcgatatggagaaggtcagcaaagaagccttatttgacgcagtggtcgatttgcctgattttatcgtcgggatcaaggcgcgggaaagtcattcagtggtgattgacaacgacatcaaaccgttactggcagcgcggtcatacgcggcactactcgggcatttgccgattatggtgcatgtcggtgcaaatccgccagagcttcaggacattttgcaggcgatgggcgcaggcgatgtcttaacccatgcgtacaatggcaagccgaatgggatgattgacgaaaacggcgagatcaaggatttcgtttatgatgcctacgatcgcggcgtggtcttcgatgttggtcacggaaccgattcgtttaattttaaaaccatgaaaatcgcccgcgaccatgggctggatccgaagtcgctgagtaccgatatttatcaccgtaatcgggaaaatggaccggtttatgacatggcaaccactatggagaaaatgcttcaagttggctacaccttgccggaagtgattcggatggtcacgtttgcgccggctgatactttccacctgctgaacaaagggcgcctgcgtccgggcaaagatgctgacattaccatttacaatgtcacgacgggtgataaagtattaacggattctaatggcaatacggaaaccggccatcaattgatcaccccaatctgcaccattgttggcgggacggtatatgacttggaggcacagcgagcatgacagactattacagcacttatgatttaaaacacgtgattaacgccagtggcaaaatgaccattttgggcgtttccaaagttccggaggccgcgattcaggcgcagcaatttggcgacacccacttttttgaaatgaaggatttgaccgacaaaactggcgccttcatcgctaaaaagttagggacagaaggcgcactggtggtgaactcggcgtctgcggggattgcggaagcagtggccggcatcatcggtcgcggcagcaagtatcatgcttaccatccgttctcaccgcgctacaccaagcgcgagatcattctgccaaaaggtcaaaatgtggactatggcacgccggaagaagtcatgatcgaactcggtggtggccaggtggttgaagccggctatgccaacatgtgcacgccggaacacgttgagatgatgatcaatgagaacaccgcagctattttctacgtgaagagccatcatgccgtgcaaaagagcatgttgacgattcaagaagcgctggaagtggcgcataagcatgagctgcccttaattcttgacgctgcggcggaagaggatctgaagaagtacgtcgacatgggcgttgatgtggttctgttctccggtgccaaagcgattgaaggccccgcttccggtctcgtcttcggcaaggaaccgtacatcagctggaccaagttgcagggtctgggcatcggtcgcgcgatgaaaatcggcaaggaaaatattctcggcttcaccaccgcgctcgttcagtatcttgatcatggtccggaatccggcgaagcgatgaaagctcggctgcatccattcgtggcggcgctcaatgatgtgccacatctgaatgttaaggaagtccaagacggtgccgggcggccaattttccgcgccgccgtgactgtcgaagcttccagcccgaaagacgccaagcaggtaactgccgaactcaaagccggcaatccagcgatttacacccgcgaatatcgcgccaatgaaggtatcatcgagttcgacatccgtgccgtcgatcaagccgaaatggatctgattgttcatcgcctcaaggaaattctcgcctagaaaggatcgctcccatgaatttaatcccaaactattacaaaaatcgcgtcgccctgaacgttttggctggctccgttgaaaatgccaaagagatctacgaagctgcagaaggtcatgtcgtcgtgggcgttttgaccaaaaactacgacaccgacgaagccgcgattgaagatatgaaaaaataccaggaagtcaccgacaacggcctgtcagtcggcctcggcgccggcgacccgaaccaaagcacgatggtcagccgcgtttccaaggtcttgcagccacagcacgttaaccaagtcttcaccggcgtcggcaccagccgggcacttttgggacaagccgacaccgtgattaacgggttggtttcgccaaccggcaaagtcggcgtggtcaacatcgccactggtccaaaaagcagccaaaaagcagccgcggaagtgccagtcgaaactgccatcgctttgttacaagacatgggcggcaccagcttcaagttcttccccatgggtggtttgaaacacgaagccgaattccgtgccgttgcccaagcctgcgcggcagaagggtttaacctcgagccgaccggtggcattgatttggataactttgaagctattcttcaaattgcgctggatgccggtgtcaagcagatcattccgcatgtttatagttcgattatcgataaggcgactggtttgacgcgcccggaagatgttgctgcgttgtggcggattaccaagcgattggttgatgcgagtgagttggtagcggagtaggaagtttttgcaacgaagtgtatttggaaggtatagaagttaaaagcctacagacagcacaatgcggtcggtaggctttttattacgttgattcttagacattttcagctcagcggaactggagattgtggtatcgataccacatcggttgggtagttttaagtgatgcaacattttgcgactcatcagctaatttatgaagtgatggaaattttcaacttaaggccaagcccagcggcatagcgattaagcgtcgtaaacgaaggcaatgtatcaagcaattcgatcttggctaatcgcgattgcgtcatgccgatctttttcgcgagctctcattgagaaataccgcggcggatacgttcgctatgcaattcagcgagtgtgtcgatgatgagtggttcttgtggaggtagttgcgttcattttcttttcgaagtcggtccaggttggcatggtttgcgctcctttcagggtaactgattgatacaaagacagttttagtcatggggtgcatgcttatcttaccaatatccgacgccaaagcacattgattttctgcataaaaaagaagccaccccaaatggctagcttccttggtgatgacttgtccaccttcgacaagcaaattttaacctgtcagcgacctctttgacaaatggtttgctggagcggaagaacagaacaggcagctacaaatcctcgtttagagaaattgaatcaataaaaaacgatcgtttccataaggactatcccatgtatagcatgttatctggtagactaaaaaacgatagcggctcagctattgcgtccgctggacccataatggtacgcgacacaatttcatcttggattgccgaggtcatcaccaaggcaatcattaccgttgctgccgcagcaattgtcgcgatagttaaatatgcttataagagcgctgcaaggcgtttgcgcaagcgtaaaaagcggtaagctgtgcagagttctagtgctgaccacattagaactctgtttttatgcaataaaaaaacggctccctttcagggaagccgccaccgttcgaacgatcttttaacatgcggttgactagtccgcgatgaccgttaaatggtacgctccaatttcatcctacaaaaaacttatcacgtccaagcactcttgtcaattacaacgcaattgacgtatgtgtcaaaaagagcggctccctttcaaggaagccgccaaccgttcgaacgatcttacttaatgcaggtggttaatctgcggtgaccgtcaaatggcacgtctcattctcatcctatataaaacgtatcacttgcagcactttttggcaaccacagcgttaaagtaggatgtggtgggtaagcagaagaaaaaaagaagccgccccgcatggctgacttctttgggtgattataatggatgagttcgaacacaaaaatcagagcctatttgccgtctttttgcaatacggcgagctcgatattaagaataccagtcatcaaaagaaggagcgtcccccaatcgagtgatggccacaagtcaattcttttctgtataagacattttcgtatagcggatttacgtagttactgcataggaagttcttactcggtaagaaaaaactgccccgcaagcggctagattctctttgactatcacgtaggttttcgttgttcatagtgtgaccacgctgaccaaattttaataaggtgagcttttttgtcaaccgtataaacgactcgatgtttgctgttaatccgcatagagtaaattttttctgcttttggctgaagcatctcgtgatggtacttgcggctaaaaggattctcttttagtgttttaatgatgtccatgtacttctcaaaaagattagccttttgaagtaacagttcatcttttcttttaacatcgcgatgcggtatgacgtgccactcgttggtcatcaataggcgtttttctcattgaagtcacccggtttttcgttttccattcgctgcataacgacatccagagtccctgttcgttgtaagaaatccagttcttctaacttttcatagcggtctttgctgattaagataacgcctttattgggaccttttggttgcttaagagtgacctccatttcttcgttcttatccactattttgtttaataagtcaaacaaattcttgcgtagatttgtgggggtatatacttccatgataccagcctccttaatttacttacatgtacattatagcgtacgcttttacgttcatcaagcttgttgttgattgtgtttttgctgaactttatttgacatacatagattacgcgcaaaatagcatttaagaaggttcttatggtcatcgcgatttatttcttcagaaattcctcttgactggcgttttaattatggttggccggaaatcccgtgactttagtcatgggatggataggcccgctctcaacgcctgttagggcgtttttttagttcgttgtatttttggttgttgatgtaatgctcaacgacgcccttgctcatgttgccaagcgtactcatgtagtagctgggtgcccataaatgcccaccccaatattgagaacgacaaatttccggatgccgtttgagaaagataaaggcacttctacccttgagcgccttgatggcactggttggtgccttgctaggcggaaaactgatcaag

SEQ ID NO: 352 - DNA, 4459 bp, Lactobacillus casei
atgtcacgatagctgagactgaatctgaaatagtagccaacggctactaagatgatgtccttttgaaagtggcgtcccttaaagtgattcatgcgcgcaatccctcgtttcttggcacccagtatactaaaatcaagtcagcgaggaaaatttgcacctgaaccacccgaagaagtggcaatctcttcgggttttcagtaatcactgaattgcaacaactaatagctgcctgaagccaacagtgtcagttaaacgggtagaacttagtcatttattgaactttgcaccagaaccagtttgagtgcaacaatatcaaatcaaaagacatggtcagaataatgatcatcttgagtgaggtgcgtaaatggataatgcaatcataaataaggatattctccttaatttaagcgttgaggatgggggctttgatttttctacatcgattgctgatgcaatggcgaaagctgaaacagagcttgtcgttttgaatgaaacggtagattcgattaaaggtctgaaaccagactgtgataagttggattatattttggctacaagttctggtgccttgtgtggtatcatcgacatttttttagtgggtaagcctggtgagtcacctttaggtaatattacggataaatggtttgtagccagaatgatagattttgcaaaactgtgcaatccggaaaagaaaaattttgatagccttgattccgcattgagattcttggagaagaaatttaaggttccatatgaccagaccggactgggtgacgctggaaagactattttcgatttgactgccaaaaatcatcatttcaaatctcttgcacacaatccgagtttgttgggactgttcttttcgatactcgaccagttcagcaatacatctcattttgttacagacggtcaacttgtttctttgcaacaggcagatgaaaaatgggaactacgaggcggaaatattccaagtaagctgttctgtggatttgctaactggataggtcatcttatttcggatgtatccggttcatcgtcaagtgcggccaaaggtaatcgcggcacgggccttccatctccattgtggacatggaccaatgacattattgccataaaagctaaattgggacttagtgtaactgaaacggacaaagctatgaatgagctggctctaaacatttttgaaaaaggctatgatattcggttccagacagctcaggctataccagtatttttgaacgagcttcttgttagactcatttatgctattcgccgtctattcagatatttttcagaaattccaaagacagaacgctcctttgcgctcatgtggaagaaatgtgaaccattctcaaatgctacagttaagcgaatgttgacggttgcacatggtacattctgtttggttgatgtcggtgatgcagtgggcagatcgcttatagctggtggaggtacttttaatgcggtagagtttgtcttacgacttaacgttgtcggagtcggacgatttgcaatatctctctatggtgaaacgaggagagcgatttcctataatcacgcaaagaaagaattcgattttgcgtcaaaggaaaccgttattgttagcaattacatagagggtctgaaaattctggcacatcagtacgacgaccaccacctgttaatgtttatcagtgacttcgaaaaaagcgatgcttatatagaagcttttggaaaatcagtaacattagcagaagtgcgtaatgttcccgtaaatagaattctgaaaagtaagccggacatcgacaagtactttggaggaaaataatatggcaaagaagtcatcaaaacttaaaaaagcgcaacagaaagcaaaagctgctgcacagaaaacgaatcaaaaaataaatgagctgggaaaatataccagttcattgtacacctcattgaccacgatacagtcgttatttgaccgcattcgcaatgtgccggaaaaaaacatgctgaaatatgagaagttaaaaacaatcagagttaactggaaacagcaggctgagaaaatagaactggaatataagaaagcggaggtaaaagctactggtcaaggcgttgctggtgttggtgccggtgttgctgttgctgcgcttggccctacagctgctatgggtattgcgaccacatttggagcggcttctaccggaacagcaatatctgctttgagtggtgcagcatttacaaatgcagcgctggcatggttaggtggaggtgctttagctactggtggcggtggaatggctgcgggcagcgcctttttagcacttgcgggacctgttggctggacgattgccggcgtttctattgtagcaagcggtctgatgttttttaagacaaacagcgataaggaaagacttgagaatacatacacgcttattagtaaccgtgacatcaaatcatacgaacttgctattgtcgaactaagtaagcgcattacaagaatcatagatgaatctgagaaattaagagaagccattgtgaagatagaaaccttcggaactgactacaccaagatgacggaggctcaacagtatgagttgggtgcatatgtcaatctaatggaagcatccaccgcgctacttgttaatccaattttggggcttcaacccaaatattcagagcaggattttgataagttgtgtgcatctgaaagcgaattgtacagacgctattttaagactcacaaaactatgattatttcgatggcaaacttgctttataaaatcaagctcgatgataaggataaaaagttgctggctaaatctttgaaaaaaaacaaagacttcttatcatcggtacagatggcaaaaaagaaatttgatgcagctgatatttcaatgattgagagagcattgaattatagatacaaatacagcacatactaaaaaacgcctcatcgccggaatcaaatccagtggtgaggcgtttttgcgtccatgaagttatgcctatacttctttcgattctggtgcaaatattctgaaagatagtcaagtaaccagcaatttctgattacacttctttggttagtcctaattttagcaatcaattttggagtggctgaattgttgggcaacgctaatcgttcttttcaaaggcataattgattggaaccggtgaattaaaagtctaattcttagaaattgattggccttctctttcgttaagctcaattataagtctagatttttggaggtaatcaatttggtatttggcagttaattgaactaagaaaggaccgagactatcattatcaggttgtagctcatctaaaagcttcagatattgatgtaactcttcatcggtacatttcttcttgaaatatccccagatatgttgataagtcgttactaacgtttttcttgttggtgaaactgacccgagtgaatcaagaattttatctaactcttgtgacttttgtggcgtccattgattattttttgccaataaacgaatgtggtcatattgttgctgtgatttcgacattacccaatatttatttaccgcccaaattttttgccaattcatatttcgtctccatttcaagttactacacgtaagatcccactaagctaccttattgaaatccatttaaaaatggccaccgggtcacttatttgttgctagcgtttgttgagtttacaagtggatacgatagggtacaccctagtgcaacaaatagattgatttaaattagtttatacgcaaaccaatgtccgtcaatattaatttaagctgcctctctttttgctcatttacgacttcgcttgagtcgttttcatgtattttagttgttgcatagaagtaacggtcggtgtctgtacctgccaattcttctatcttactatctattttattttgggtttctttttgtgggttgtgtgatgtgtagaacaaatatcttatgtctgcaggagagacactttcttcttcccgcaaaatctctcctaggatttcaaggttctttagtatagcccaagcactatcgccctcagaaataattgcaatccaatagtcaccgtctttagcactacagtgatatattcccacgaaatctgattcatgattggttggcttctcctttgaatcattacaacttagtttaactttttttctcaaggtttgtaaaagtgttgttttacctgtatcttggttgccactaatgttaataactttcatcacaagaattgcctccttcaaaacgataactgtagtattcgaattcagataagaaaatccatttcagaatatgtattccagatggttctggtgcaaattttcctcgctgacttgattttagtatactgggtgccaagaaacgagggattgcgcgcacgaatcactttaagggacgccactttcaaaaggacatcatcttagtagccgttggctactatttcagattcagtctcagctatcgtgacat

SEQ ID NO: 353 - DNA, 8141 bp, Lactobacillus casei
cttcattcgtgaagccgggaccgatctgccggaagtcgaagaatggaaatgggaaccgttgaagtaagtttcctcctccttgggaaatagtttaaaaagctcctctgcaagcatcttccaatgttcaaaattggaatgctgctacagaggagcttttttgtcgaagcaaattttcaaagctcaatgttcaaactacaaggtttttcacgcctatatgctgaactagatccttattgataccagagtcggagatgatgaaatcaacgtcatctaacttaaacatgctgactaatgagctagcgccaaatttactatgatccgccaaaacaatgcttgttcggcaatgctgtttcattgctttggccgtttgggattcttccaagtagcggttcgtaatacctgaaacttcatcgatccctccacagccaaagaagccaacgtccgcataaatcgactcaattgcttgcaaggcaattggccctgataccgatccttcatctccacggacgacgccgccaagcaaaacaatttggatacctttcataacaagcaaagtctgcgctacaaaggtggaactagtaatgattgataaatcatggcgaggttcctgcttaagggcttcagctaattcatatgaactggttccggagtccaagaaaatcgtggcgccatcttttatatacgacagagctcgttgtgccatttcacgttttgcatcttgattgaccgctttccgctgatcaaatcgtgatgtcggatcatcatcgactgcctctgctccgcctctgatcgcgctaacgagccccttctccgccaagttataaatatctttgcgaatggtttcccgtgagaccgccatcttcttgctcaacgctgaaattctcacatttttattttgattaacggcgtctaggatataacgcctgcgttcatcgattttcatacgattacctccgaagtccctctttaaaataattaacgaccagtttgcaaaccaattatatcttttttgcaaacaatttgccaatgatagaaaagctaaatccttgcaatttcaaaaaatgaatgccataattgtttcgatgtaagggctttctacactatgataaaaggggtaagcactatgagcaagcgaattaatctgttatctgtctgcggttctggtacagtgacatcatcgatgatagccggtgagatcacggataacttaaaaagtgatggctatcatgtcaacgccaccgaagcaagaccgacagaggcaaagcaattagtcgatagtggtcattatgacttgatcgtttttactagcccattgccaaaagcggactatgggattcctgtgattaacggaactggattactaactggtattggcgaagatgaattctgggacgaactcaaatcaacacttgccaaacttgaaacggataaaacaaacaaagtctgatttcttttaaattcaaaaaagtactgtcctcaccgtaataaatgaggtcagtactttttcattggccaaacttctaaatcaaaccttctgtcccaaccacccaacctcctgcccttgcccccgccaaaagaaaccgctttaatttaaccaaggaagtgatttcattgacgacggagaagcagaagttccttgctgggcagccttatcggatttttgatgaggagttggcggcggatgaggagcgggcgcgggcgttgtgtcgggagattaatcgttgtacgacggatgatgcgcataagattggcttgattcggcagttgtttggcagtgttggtaagaatgtttatgttcagcctgattttcattgcgattttgggtacaacattcatgtaggtgataactttatttgcaattacaacaatgtgatgctggatattgcgccgattacgattggcgatgattgtatgtttgggccgttggtgcagctttattcggcgtcgcatccccttgatccggagaggcggcgggaacgcatcggtgaaggttccccgattacgattggtaacaatgtctggattggcggtggcgctgtggtgttgcctggcgtttcgattggcgataatacggtgattggcgccaatgccacggtcacgcacagttttggtgcgaatttggtggtggctggtaatcctgcgcgggtgattaagcagattccacagaaggatggctcgtcgtcggcctcgtgattcattcattgtttgacagcgggttaactattgggtgctagcagctttgctggcacttttttgactgcctttttccaactgccttcatacttgagcttccgtgtcgtggacattggccattccggtgtttcttggatagtgcatgcagaggattacctctatgatcatgatttaagccaactttttaacggctatccctcgtgatgcttgtttaattgggtccgctgacggaagaattgcccggttgttttgacttgctgattgacttcacgataaacccgctgatgatgatcgcctgcataaagcgctggtgtgatggtggcaacattgaggcgcccattttgaagcgcgtcttcttgtaccaatcggcgggtaatgtggccgatgaagttgatgtagccgtgataaggaacgcttttttcgatatcaatgaagagtgtgcttaaggcatccgttagaatcggcagatcagtttggggatcaatttggtggggcagttgaccactgtttaacttttcgcggcgatgtaggtagccggcatattcaatttgatctaagtgagcgcttgtcatgtaattgatcgtgcagtgccgggttctttgcaattgtctggcaacattttcgtcgttggccacgctgaaggtgaacatgtcgcctaaggaatatgatgaactgcaggtggttacattgtagcggcaacggtcatcttgataaccaatgatgaagattggataagcgtagtagagtttcttagtcgtgtagggtaccagcattgccaacattccttccttgaccagttagtggtataaccataacaaaagtaataatcgaggtggatcgaaatatggcatgttctgaagatcgaattgtcgcggctccgaacgtgacggatttggcggcgatgcttgctgataacacccgttcggctatcattgatgttttaatggacggcaaagcctataccttatctgagatcacgcagcggctgacggtgacgccgcaaaccgtgagctatcatttacatagaatgtgggcgattggcgttgtcaatcagattaaaagtggtcggcatcattactatcgcttggcttccaatgaattagcggccacttttgaatccttaagcacagtggctcctaggcaaatcgaacatcgcttgagtcagcggcaaagtgccaccgcaatgacttattgtcgctcctgttatgaccatttagccggcaaagtcgcggtcagcttactgcatgcgttggaagagcggcattttgtgatggcgcattcgaaccatcgtcttgaagtattgtcagctggtaaggattttctgaaagcggaactggccattgatcccgatagcatcgatcgtaccagacgccaaaacaccgttgcctgcctcgactggagcgaacgtgactttcatttgggcggcgcgtggggacatgcacttttcaaagggctgttagccaacgactatgtgcagcaaacgccaaattcgcgcattgtcaccgtaacagcagacggccgccagtggtttgccagtaagctggcacttcagctgcatgcctgattccttgaaggataaaaaccaaaacagcagcgcaacttcctgtcatttggaagttgcgctgccgtttgttgatcatttgattctttggcgatgctaagacttagagtggatgcccgtgcgttgcagcaatggcaccaccgcgccaatcaagtttgcctcgttgtggtatttagctgcttcaatcactggcatctggatggttcgcgcagcaagcggcgtcacgtcgcggtatgccgccacgcctgactgaatagcggcgataacgcgtggttgggcgctgataccgccgccgatgacgactttttccagatccaatacggtttgcatgttgtagatcatggctgccacgccacgggtgaagatttcgaggatggctgcggcaggtgtgttgggtttgagcgcttggaagacgcgcggacccagtggtgttcggtggatgttgagggcagcggccatggcgttgacggttttgaccgcggaaagtccggctgcagtctggtcgcgggtgatcgggcgcaagccgttggtgaccatgaagctaggctcgccgccgacttgatggcttccggtatagagttggccgttgataaatagcgaagcgccgacaccggtgcctaagacgaccatggcgctgttggtggtgccggcgagttgcccgcgccagaattcggctagtgctgctgcgttgccatcattttcgaggaccacgggcaccgttactacggcagcatcagcgagccgtgtggttaacgcgacattttccaaaaatggtaagacagcgcaggctttgacgatgcctcgttgcggatccacaacgccgggtaatgccaggccgatgccggcaatctgggtttgatagcgtttgatgagctgattgatggcctgtgcgaagtcggtcaagttgctgtggacggttgcttgtttgccttgttcggacaaatcgccttggtcagagactaacgcatatttggtcgtggtgccgccaacgtcaatggctaaatattgcttcatatggctgtttcctctttttccaagataatctcattcaatcggcgccttgatgcgcttttcataagcatcgagccatgcctgcgtgatcggttcgatgttcgtcgtttggttcgggcccggatgcgcgatcagaatagccggttcttggctggcggtgcccacactgaaggtgaattccacgttagtcgccacgccccaattgccttgacgatccaatgcaatcaaggagaattcgccggctttgccgtagcggcttttcaacttttcgataaatgggtagacggcttcatcgcaggcttgttgcggggttcggccttcgcccatgcggcggacgatgtcataggagagacaccctttcatgatgtcttcgcctaggccggttgctgcggcgccgccaacgtcactgtccacgtagaagccggagccggacagcggtgaatcgcccacgcgacccggacgcttcatgaacaagccggatgttgacgtagccgcggccatcgatccgcccggtgccagcgtgatcgcgccgactgtgtcatgaccgtcatagggtttgactttggcgtcggcaatttcctgacgccgcttttcccaacgttgcttggcgcgatcggtcaacatattacgcatttcaaagccgtttagctgcgcgtattgcgtggccccttcgccaaccagaaaactgttgtaatgctcgtggctgagtgcccgcgccaccgatacggcgtggaaaacattgtgaatgccggcaacggcgccttgagccagggtatcgccgtccataaatgcggcgtccatttccacgaccccattttcattaggtaagccgccgtagccaaccgatttgtaataggggtaggcttcaacggttttgatcagcgcttcgacggcatccccggcgctgctattggcttgcagcatctggctggcctgcttaacgccatcatgcgccatccgccaagtggcaattgcgccccacgtagttttattcaatcggtcattcctcctagtttcatcatcgcagtcatatcaatcagcatattcagtttaagatcctgttcgtccatccattcatccgcgttatgggcaatgcctttttgcccgggaaaagacgggccaaatgccacgatattcggcattgcccgggcgtaggtcgcgccggtggtggtgacgagttgccccggttggccggtgatttgttcataggcttggcttaaatcctgcaggcgcggatcctggcgatcgtgcaaaacgccaggcaggctgcgaatgacctcaatggctgttcgcggtaacaccgccgcagccaacgcctgcatgacatcggcctcgtggtaagtgaccggatagcgtatcgcgaggcgcaaagtcagcgtttggcctgccttttgccattggtatggggtaacgatgagattgccactggccgcatcggcaaacgccatgcccaagcccacgccattgtgctggtcggctagtttggtgactagccaccggcaatagtcggcgaattgcccgtggactgcaggttggttgagcaatgtgtcggctaggcgagtgatcgcattatcgccaagttcgggcgcattgctaggtgcccgtttgccggtgacccggatcagctggccgttaaccattacttccagctgatcgggaacgtggtcgctggcctgatcgccgcggatttcgccgatgttagcgagcgacccatccgtgatcggcgtggttaactggtaattcacgatcccacgttcgccatacacgaccgggaatttgcaatccggcgtgaagccaaagtcaggcggtgcttggctggcgaggtagcgcggtacatcagccgaaccactttcctcgtctgaacccaagatgaggcggatcgttttggtcggtcgataaccagcctctttcaacagcttcatcccaaacaagcatgccatgctcggccccttattgtcgagaatgccgcgtccatacaagcggccgttttgctcagtgaggtcgtatgggggaaaatgccacgctacttcaccggccggaacaacatctaagtggccgacaatcccgatatagtgttgatcgtcgtcaccccactggatggccgtcatggcgccattgatcactttggtttgaaagccgtacgctgtgccaagttcggccgctgcatccagtgctgcgcgtgggccggaaccgaatggcgcgtcggggcgacttgggccgcgcacgcttttgatttgcatgattgagcgcagtgcatccatgaattctggcctctgcgcatcgtataaggcagccaacgtttcttttttcaccgggttctgctcctttggcttcagacgtgatcgcgggtcagcgttgacttaaaggaatacttgtcggcgcggtaataggaaatatcgtacagaatcggtttggcatctgccgtgtaagtcacagaatggaccagtaggatcggatcgccttttttcccatccagtaacgcagctaaatccggatccatcagcaccgcttcgacttcctgatgtgagtaggcgatcgccacccgcttttcgagtagcgcaaaaagcgagccttcaaagtcctgcggctgcaggccttcgatgtattcgtggcagatggcgatatgttcgaccgtcatcggctcttcgtcccagaaccggcgccgcaccaacaagtcgacggttttatgaacttgttggtcacagcccaacacgcggccgatttcttccgggatcggctccagcggcccaaagctgatgacttcggtgcggctttttttgccgtatgctttggcggcttcggtgaacccttgcagccccatccgcccgctttcgactttatccgaatatgacatgacatacgtgcccttgcctggcgatttgaccaacagttgcttgcgaatcaacaggtcgatggctttgcgaaccgtcaaccgactgaccgcgaactctttggctaaatcatattcggatggcaggcgctgacttgtggtgtaaatgccatcacggacacggcgactcaattcatctgcgacttcttcaagttttgccattttgtagcctccggtttcttggtgggcggactgtcgctaggtttcatggtgttcaagttcatgcggcccgctgcgcatctatactttttagtatatactatttgatctacttttaaactgcaaccgtttgcgtgaatttaaaaatggcacccacgagcggctcttgcatttaaggtttccgccggcgcaaaagaacatcctgaatcggcagcgtgaacctggtaccacacgaaaataacttcacaccgccaatgtatgccctttcatttttgcttgtcattcaagaagcggccggttataatcagtatgtactaactagtatat

SEQ ID NO: 354 - DNA, 281 bp, Lactobacillus casei
accgcaagcgatattgtcttaagtaagcagttagccaaagtgtcacaaaaactgtaacctcttagaagatacatctaggaggaatcacatgaagaaggttgtcttaacaatgaaagaagaagaacgttaccgagtcatcaaagcagtggtcaatggtaagacctccgtgcaacgcgcagccgttaagctcaagcgctccgaacgaaccatctaccgattgatcaagctttacaagcaacaaggcaaagacggctttatccatggcaatgccggtcgtgagc

SEQ ID NO: 355 - DNA, 3890 bp, Lactobacillus casei
aatggccgcctgatttaatgctttccagggttcaaataagttattaatcgcgattaatgatttatttgagctgtggaaggtaaacgcggttctgaatgtctcttaaaatctgtctcaaatattgacttcaatccaaaatattttacacaaactgatactacaagatgaggaaaaaggagagcgcctaatgggtaccgtttttcgccgtaccatcagcgacaaaatttttattactgctttagtttgcgcaggactgagttttttgattgggacgccacaatttaccgatattaactggaacacgattggaacgctcttatcacttatgattggagttcagttattacgaaccatgcatattttagatgcattaagtgactggcttttagtcaaatcacaacatactcgacagatgacgcaattttttattttactggcattcggtggatcaatgattttgaccaatgacattgctattctaactttagttcccacttttatgacattaaatcgtcatcagaagggagcaattgcttacccattgactctaatcgtgatggcggcaaatcttggaagttcatttacacctattgggaatcctcaaaatttgttccttgtgacatcttatcacattgatatattaacctttttcaaattatcggctcctctgatgattgccagtctgattcttctggtagcgttaagcttgtgggtaccacgaaagtccttaacgatggttcccgcaaaatcaactaccattcatgttagtcaaattggtattgcaacttccctgattgggtttattatgctcgtaatttttaacttgataccaatttcattagttattattgttactattattgttggtttgagaattgattggcacgtctttcaacatgttgattacgctttgctcttaacattcgtctgctttttcctttttgttagtgctattagtcacaactcctatattactctctggttaaatcagctaatgcaaacaccgcagagcgtttatattgctagcctaatgactagccaagcgattagtaacgttccagccgctatcttactggccaattttacaaagtacttaccagccttattcctaggtgttaacataggtggattgggatcaattgtggcctcccttgcaaatttgcttgcagtaaaacaattattgctgtttagcgaagaacagtcattgtggcatttccttaaagtgttcactgtgttaaatctgattggtttattaattttgggtgtttttggatggctttacttgttaatgtgagcacggtagccaccataaacaattaaagtttcttgaaaggtgctctttcaatctgaagttgaagtctcttaaccaagcaaactagacacaaaactcatgaaggtccattcacgagtttagcgtaagcttttcaatctacttcagtagaacgctctgatgctttacgtataatgacataaaatggagataaaatatgaattggcaaaaagtttgggcagtcaacaaatattgggtaatgtctaaatcacagcaacaatatgattacattcgtttactggcgaagaataatcaatggacgccacaaaagacacaagaactagggaacatcattgactcacttgaatcggtttcgccaacaaaacaaacattaacaacaacgtatcaacatatttggggatatttcaaaaaaaatgtaccgatgaagagttacatcagtatttaagattattagataatttgcaaccgaacaatgataaactaggaccttttttggcccaattaactaacaagtaccaaattgattacctttaaaagtctagaattataattgagcttaacgaaagaaaagactagtctgtttttacaaagtaaattttaaattctcccaaaattacagactcattatataatacaggacaacagatgaaatttaaggcttagcgtaaagtttaagtgggtaaattatcagaaacaaaaagggagcgatccctactcatgctagaatgttaatgacaaatcaaccagctagcaattaggaggaatcactcttgaactctatcttacaacaaatcatcacagaaatgatgacatcatttggaaactctgcctttgatttactgacaggaaagttagactttgccaatctagtcatcgaaactcaaaaaagttttggaaagactctttgtcaattacttggtgtcatgctggaacaacaagatcaggttttggcggattcttcctaccggaagcagttttttaaaatcaaagatatgcgtgaacgccatgtcgataccagcattggcactgtatcttttcgccgtcggtactatgaagatgttcgtaccaatgaacgcatctttttgcttgatgagcagatcggccttgaaaaaagtagtcggctcggtctcgacctcaaggccaagttattagaacctgtctagtatctgctgaatctggtagaattgtggaaaaccgactgaggagtttgtcatgccagattatccaagcaatatttctcgagcgcaatttgcgttaatacaacctgatttagaaaacttccgcaagcatacaagaccgcgtcgttatgatctttatgacgtattcaatgccatcctttactcgcttactacagggtgtcaatggcgtgaattaccgcacgatttcccggaatggcataccgtctaccgctattacgatatgtggcgagataaaccagacccgacagctgattcgctattagaaaggcttttaaaaaaactgtcgcttcctatcgttttgcacagggccgatcggcccgaacgtcgtttgtgattgttgatgctcaaagtgttaaaaccactgatttaacgaaaaatagtggctacgatggcggcaaaaagatttcagggattaagcgtcatatggcggttgatattaatcgtttaccacaagccattctcgtgacacgagctaatgtatcagatcgttcaggtgcattggctatgtttagtttggctagccaaaatttagagctggttcagcctgtcatggttgatggtggctacactggcaatgactttacggatcaagtgatgctcattttgaatgctaagacgacggtagctaaacgcaacgagttgcatacgttcacggtgttaccgcaacgatggatcattgaacgttcatggagttggctagacaaatgtcggcgactttggaaaaactgtgaacgcgcccttaacagcagtcttcaaatgattgtattggccttcccgaagatagttcttaaaagatactagacaggttctcagaactgctcattgctgcacttatctgtttcttgtcagactcaattgtgtcttggctaattgccgcttgtccgctcgcatcgttctggtgtgaggatggatcggattttggcgccgcacggtcatgttcggtgatgtttgtctcaccgttgtcggctacagggacaacggcgctgccgacctgggtcagcatcaacatcgccaacatgacgatatggatcaacttcttaggcatctgtgcgcctccttccattgtttccggcgtctctcttcttccaacaccagcttaacaagttgaccccgcgcaaaggaatggtaatgttcgttatttaacaatattttttaacggtgcatacttattgacattataggtattaatctttacatataatgtaaaaagctctacttataggtaaataaggtcttcaaacccaaaagtagccttgaaacagccggcgtattgccagtaagtttcaagactacttataggttatttatttaactaattagtttaagctttgatgattttcccaactgcaattggtaaagtaacgtgggcatcgtagttcatgacagttccttgaacagta

SEQ ID NO: 356 - DNA, 1604 bp, Lactobacillus casei
tgcggtcggccctgtcaagttgacagatgaaataatataaaattttggtagcttttagatggccttattccagtattcttctggggtaaggccgtctctttgtcctgaacggttgtcgtgattgaaatagtggatcccatcttcaacgagctggacgaactccttataagtttttgccattgggtgacgatccatccaccgcagtttaaactcattccaccagcgctccatcggtgcgttgtcatagggcgttcccggtcgcgacatacttcgtgtcacttcaaactggctaaggtagcggttgaatgccttagatgtataggcggagccacgatcagtatgaatgagcggatggacgttgctggcgcgagtgaaagcgcgctggaagacctgaatctcagcggcggttgtttcggttgcgcttagattgtaagccaacagattgcgaccatagaggtcaagaacgccactgaggcgcatcttgtactcgccgttgataccgtatttcaactcggttgagtcggctagccagacttgattagggcgttccacgtagaaacattgattgagcacattgtcttgcaggtactgttcagattgcttgacgcgactatgccgtttttggcgaatctgacatcgaatgccaagctcgcgcatgacgcgacgaacttgtttgatcgtgaccgggaagtcaattagctcatcctgttgtaagttgatcaggagattcccggcgccaatgccttggtgatgaaagtcaaaccaatattgggtccgctccttgagctgccgatcgtggacctcccacaatgttttctcccgccttaagcctttgtaataagcttgacggctgacgccaataacgtccaataactttgtgacagcgccgtggtggccttgactaacttcttcgatggcacggtaagcttgtcggcgttgtttgatcactccttgtgctggatttccagtaatttttttacaaaggcctccactagctctttgtccttgagttcagcttctagttgacgaatgcgcagtttggccttgtctaattcggttagatcacgcttgtctttgtggtgaccacggttatctaccagcgcctcataaccgccttcgcgagccttgatcacccaagaccgtgcctgttgataagacacatcaaaatgggctgccgcttcagtataggagtgcttacccttagtgacatattcaacgactttaatgcgttcttcgaaggtggttgtacgactcatggtggggacctgctttctagacggtgaagccgtcaaagattgatgatccctattatacatggctatccaacgttgcagttgtgttgatgaacgcagaccaaattgcatcgtaacttcggctaatgacccttcaccactaagataagcaagcactgcttcaagctttagctctttggtataatgttgattctttcgagcttcctctaatcccttaatcccatcacgttcatagagtgtctgccaacgttgtaatgtacgatcaccaagaccgtgttgacgagagaaactactgatacttgtcttcgaatgtctgaactcctccaatatgtgtaacttttcttgagctgt

SEQ ID NO: 357 - DNA, 225 bp, Lactobacillus casei
gggcgtagcatctgataagctatgactaagcagaaagttaaataagcggtggcgcttcgcaatcgaaagaaggtgatgccgatggttttaggactatcgaaccacattccaacgaaaggaggtgccagtttgtcgtctgtgattgacgcctttgcggcaatcacggctggcctcggctcggccattgtcatggtcaacgtgttcacacgtttgatcaaggctttg

SEQ ID NO: 358 - DNA, 201 bp, Lactobacillus casei
ggcctgagttcgttggccgggttttggccaatggactcagggtccttatgtggaggtttctgcgactgcgaacgcgtttcgatgaaatacactggttcccgacaacacaaaaacaacaatgatagccagttttgagagcgcaaagttctcataagtgtggtggcgatagcaagaaggatacacctgttcccatgccgaaca

SEQ ID NO: 359 - DNA, 697 bp, Lactobacillus casei
aactaattagtttaagctttgatgattttcccaactgcaattggtaaagtaacgtgggcatcgtagttcatgacagttccttgaacagtagccggtagcttcaaggtatccggcacaccatgaatataaatgacccttttatcaagctgcaaatcgtcactgccaaaagcggctttaaacgctgtctgcaattccttcagatcaacgagtttgtcataagcatagtgaccttctgcatcagccactgggtaactgtcatttggcacatgcatcttggccggttcagcgtcaaatggcaccatcgttgtaccggaaaccggttctgtttctggcagatccacgaaaccgtcaccattagcatcttgtgccgctgtggcgatttctgctggcttaccatccgggaatccgtggaaatgttcccaatgctgcacattagcaggtgtatcaaacatatcgatatgaatcttcatttgcgcaccatcaatcgtgaacgtcgcggcaccgtgcggcgcggtgccaatcttctcagcgttcaatggcacaatttctgctgtatacttttcagccatgcaaagcactccttttagatttagactcagtttcagtatagtgctaactggaacgactcacaatctattgcatttcaaaagtgaggttgcaagattatttggccaattgcaataaccgttggcgcaaa

SEQ ID NO: 360 - DNA, 3544 bp, Lactobacillus casei
gattcgccttgcttatataggttgataatgttttgtttgaattctttgtcgtaacgagttggcatgtaaaaattccttccttttgagagacgatttattcattataccctctcttaaaagttgtctcaggaatcagcttacatccattttgagtctagctattagggtgttacacttgaattgtaaactgggtaggaaaataactaaactctttgatcacgggaattccataaaaaaacaccttcggtcgtactacaaccagaagagggaaatcatgagaaaagtgattcaaaatacagtatttatagaaatgatgatacaatgctaacttggcgagtgaagcgattacgagctttaggaacaaatatagttttgtcggtatttggcgagcaagataattctgcattagttgctgccgaattgctaatcaggcaacaagaatctaggttgacagtaaatcaacctcattcagaaataatgaccataaatcaactagcaggatatgacaatactgagatttcgtgtggtacgtatgcacttataaaaaatgctgtcctagcaagccaaaagcactttggattcaatgccttgattggaccacttgtcaaactttggaagataggtttcaacggtgccaatgttccatccgatcacgacattaagtctcggctacttttaagcaatcccgataacattattatggatgatgcgttgcacaccgtaaaactagtcaaaactggtatggagctcgatcttggaggaattgcaaagggattcattgctgatcaaattcggtctatttggtttgcctatgggattagggctggaataattaatctcggtggtaatttactatttgttggagaatctccacgacgatctgatggccgatggatagttggtattcaggatcccaataaaggaagaaatattggcattggaacggtcattaaacctgcatgtgcagctgttacaagtggtatctacgaacgatttttaataaaagggggtaaaagatatcatcatttgttggatcctcaaactggatatcctttacaaacccaattggctgctgttacggtatttgctcgtgattctctgcagggtgaattagaagccaagcgattattttttgctggtaagcctattccaggatgggagaaagatcctaataatttaggcgctgtttttatctatcaaaatggcaatacacaaacggtcaaggcctcaattcattaaatctccttaactataagttatcaggttcactgccgttctctaagagtgacgagattgctactctgcaagctaaaaaggaatataattatcctgggtaaggtaaagttaccctttcgagtgattttcctagaaaggaaggtgttcaaatgttgcactatgttggtattgctggaacaaatatacagcggtcaactaatctcaagttacttcaatatatgaagaaacattattctgaggaggcagttattgagattgttgacattagtaatttaccagttttctataaggcttcccaggatcatataccggaagccgtcaacgttatatctggaaagattcggaaggctgatggtgtcattattgccacacctgagtatgatcatgccatacctgctgtgctgagttctgcacttgcttggttctcttatcgtatacacccatttgctggcaaacctgtgatgattgttggtgcatcttatggttcattaggcacttcacgcgctcaggctcaattacggcagattctagattctcctgaattgaaggctagtattatgccaagctctgaattcttagtagggcactcactagaggcatttgatgactccggtaatttaaagaacttacgattaggtgtccagcttaacggtttattctcagacttttccgtctttgttaagttgaccaaacaaatgattcattcacaaaaacaagctaaagaacaaactaaaaacgtcaattggcaggataactaggaggacaattatgaaaattgttgcaattgcaggaagtattgcagatatatcatacaatcggcaattattaacttttatcgctagccactatgcttcacagattgacattgaactactggaaattaagaatataccgatgtttaatgaagataaggatcaaactcaaagtgcagctgtccaatatctagtacataagatcgaatcagctgatggtgttattctagcaactcccgagcacaatcatacaacaagtcctgctatgaaaaacgtcattgaatggttgtcttacaaagtacatccgttaaatcagaaaccagtcttaatagttggtgcttcttggcatacacagggttcctcaagagctcaacttgcacttcgtcaaattatggaatcacccggcgttggggctttggttatgcctagcgatgagtttttattagctgatgccaagaaagccttcgatgagttagggaacttgaaggactcaaagacaattgcttttctcgacactgtaattaacaagtttatacgttggattaatgtactagacgcactacaggaaaagaaaaagcaagaaccttggcgtcaagaggatcttgcaggaaaacatcctgtcgaaacttctattgatattgatatatccgatgattgggtggaaaaggcagctaaactagttaaggcaacgagtgggaatcattatgtccaactgaatcgtggcgtattaacagttgatcaattaaattggttccttaacacgatgcctgtagagttaacttttatggatgataatgatcaatttatttattacaatcattttctcgatcatgacgctatgctcgcaccaagggatccaaaacaggttggcaacactgccgatttagttcaccccaaacgagccgttgagcacgttcaacaagttatttgggctttacgtcaggggcaaaaagagcttatcgcgatgccagtacctggaaataaaataaaccaaaagtacattatgcatttttacaaagctatgcacgatgcagacggacgttatcgtggtgttaacgaatgggtcctggacatttggccaattgtctctgattatctaaggcgtactggacaaaagcttatcaaggatcccgatagtaaacctgatgcaactacaagtgcctcacaaagtgaacctcaaagggtcttatcttctcgagtagaagggaaagacgtacaaacaattaatgacatgaaaacttcaacagctgatgcgatcacaggtgcttccgagacgactaaataagcagtactgacttaactgataagaacatcaatcgaataaagtttggcgctacgtcaactggtattgaagaataaatggctctgcgtcaactgatgttgaagaatatatttatcatttgaggcggttctccatttggggagccgtctttgtcatgttatgccgtgatttggtagattcgtttcctcaattttcaagtcaagtgcaacgatgataacgaattcttgatagtggtctaggctgttacgccatgcatcggtagtaatcgcatggg

SEQ ID NO: 361 - DNA, 254 bp, Lactobacillus casei
ttgcggaatttaagcagcgatacggtgttatgaagatccaccatgaattgaatctggaacttcaaccactgcagcttcggtgcagtccacgacggatttcccggctcatgaaggaactggatatccactccgttaccgtcaataagtggaaagcggcttcggcttccaaaaccaaggttgaacagcgtcccaacttgcttaagcaggatttctcgaccactggtttaaatcaaaaatggaccgctgatatgacg

SEQ ID NO: 362 - DNA, 366 bp, Lactobacillus casei
tcttaggcatctgtgcgcctccttccattgtttccggcgtctctcttcttccaacaccagcttaacaagttgaccccgcgcaaaggaatgataatgtttgttatttaacaagatattttcaacagtgcatacttattgacattataggtattaatctgtacatataatgtaaaaagctctatttataggtaaataaggtcttcaaacccaaaagtagccttgaaacagccggcgtattgccagtaagtcccaagactacttataggttatttattaaactaattagtttaagctttgatgattttcccaactgcaattggtaaagtaacgtgggcatcgtagttcatgacagttccttgaacagta

SEQ ID NO: 363 - DNA, 1601 bp, Lactobacillus casei
ttttttgttagagtgagcgtgaagccaacgccgtagattacaacttggcatttaatgccgtgggtgaaattggcgggcttcattgatcctgagagtctggtcgcagtctaatgggcgctttgacgccgtgtattgaaaagtagatgaccaggatccaaaaatttgaagggtggtaattacatgcgtattgcaattggtctggatgtgagttctaaacagacttctgtttcggttgtggcggaaccacaacgagaagtcgattcttgcaccattactaatgatttactgggttttgacaagttgcttaagttaatccatcaatactcagatcaggatactgaacagatccctgaagtggtctttgaagcgaccggtgtctactcgcggcgactcaagcattttctggagatacatgcagttccctacatgcagcttaatccgcttcaagccaagcatgatttatcaatgatcaagggacttcacgggagaaagactgatcgcatggatgcactcggcctctcacaaagtcagttgatcttgaatcgtagtaaatcgtttgtcgaggatccagtgtacatggccttgaaagacttagatcgcacttatcaagaggcagttcaggatttagtgacgaacaaaaatcgcctacatcgatacctgcagttaacttttcccgagttggaacacgttacaggaacgactgatggtattttctattggcggcttgtccaaacattcccacatccacagatattgttaaagtctcgtcagaacttcgatgcttttgtggaaacactgcggcatctaacgccgtacccgacatccgaacaacgggcgaaatcaattgcggacaagcttggcaaagtagcactgacggccgctccagccgtctcggcagtaccagttgagttagaacaggttcaatacattgcgggtgagctaatcaggctctcagcacggcgtaaacatttgattaaggaaatgtgctctctagctattccgctacccgagctaaaaatctttgaatccttacctggcattggggtaacctccgccgtaactttgttagcagaacttggcgatttaacccgtttcaagaaaagcaatcaggttaatgcttacgtaggcattgatcttcgtcattatgaatcaggtgactatacggcaagcgatcatatctcaaagcgcggtaatccatacgctcgtaagattctctatcgcgtgatcaattgcatggtttcctctgcggccagatccaacaaacccaaccatatcgttgattattacaaaaagaaaaagcaatcttcttcggcggtcggaaccaagaagattgccattgcatctgtttcacgtctcatcaggacactctacagtttagttattaacaatcagacctatgtctatcgcatcgcaactaaaggccgataggcaacatctgattcaacacttattctaacaacctccgtcaaaaaatgaaataccgaaggcttagtttagtgtactcaaatttttagatcatggcgttatcgatacgccacaagaaaaccgcaagaacactgaaaaacctaatgaatgagacttgacttctggtagaaaattgt

SEQ ID NO: 364 - DNA, 839 bp, Lactobacillus casei
ccgttgattcatagcggccgaaaggccgctctttttatgattcaagatcaattgagccgggggcaccgcatcacagttattctccgagcgttacggatcccttcgagtacctactatgactggttaaagtggcatcctaagtcacgaaatcgccgccgaattaagcttaaagagctggttcaggttctttggcaacgtcgaaaattttacggatacgtgcggattgctaaacgcattcgtaaattacttaaatgccgcttaagtgaccgcacgatttggaaagtcatgcgtgaattggggattcaatcgacaatgtatcgtaaacgctctaaaaagcctaccacaaccactgacatgtcacaaaaacctaatttaatgcgacacctagctgacttgtctgaggtcgtgaccaccgatatcacctatattcaactgatcaaccaaaaatgggtttaccttgcaacagcgtatgatccaaaagcgagaaaagtcttagcttggcaagtgggtcaacagatgacacaagacctcgcggtcgcaccgattcaagcgttaattcaccaaggttatacttttaagatggtgcatagcgatatgggtagtcaatataccagtcgtttatttgagacaacattgacagatgcgcacctgcgtcactcatattcgcgcaaaggcaaaccggctgataacgggcggatcgaagcctaccattcgctattgaaacgagaatgggtccggctggagcagatcaactatgaatcaattctagacgtcactgaatccattgctcgttacaacaccttctacaatcatgatcgcgagaccaacggtcgcggtgc

SEQ ID NO: 365 - DNA, 1283 bp, Lactobacillus casei
atgatacgtagccgaactgagaggttgatcggccacattgggactgagacacggcccaaactcctacgggaggcagcagtagggaatcttccacaatggacgcaagtctgatggagcaacgccgcgtgagtgaagaaggctttcgggtcgtaaaactctgttgttggagaagaatggtcggcagagtaactgttgtcggcgtgacggtatccaaccagaaagccacggctaactacgtgccagcagccgcggtaatacgtaggtggcaagcgttatccggatttattgggcgtaaagcgagcgcaggcggttttttaagtctgatgtgaaagccctcggcttaaccgaggaagcgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgaatgctaggtgttggagggtttccgcccttcagtgccgcagctaacgcattaagcattccgcctggggagtacgaccgcaaggttgaaactcaaaggaattgacgggggcccgcacaagcggtggagcatgtggtttaattcgaagcaacgcgaagaaccttaccaggtcttgacatcttttgatcacctgagagatcaggtttccccttcgggggcaaaatgacaggtggtgcatggttgtcgtcagctcgtgtcgtgagatgttgggttaagtcccgcaacgagcgcaacccttatgactagttgccagcattcagttgggcactctagtaagactgccggtgacaaaccggaggaaggtggggatgacgtcaaatcatcatgccccttatgacctgggctacacacgtgctacaatggatggtacaacgagttgcgagaccgcgaggtcaagctaatctcttaaagccattctcagttcggactgtaggctgcaactcgcctacacgaagtcggaatcgctagtaatcgcggatcagcacgccgcggtgaatacgttcccgggccttgtacacaccgcccgtcacaccatgagagtttgtaacacccgaagccggtggcgtaacccttttagggagcgagccgtctaaggtgggacaaatgattagggtgaagtcgtaacaaggtagccgtaggagaacctgcggctggatcacctcctttctaaggaaacagacgt

SEQ ID NO: 366 - DNA, 266 bp, Lactobacillus casei
tgagaaagataaaggcacttctacccttgagcgccttgatggcactggttggtgccttgctaggcggaaaactgatcaagacatggacataatcgggcatgactgccattttttcgatcacaatctcattatcatcggcgaccttttgcaaaatgcttttcatttcgtctgccagttccttagttgcaaaagtttgattgcgatatttcgtgacccagatcaaatggtaatgaaaattatagatatagcgtctggtataaaccgcg

SEQ ID NO: 367 - DNA, 1529 bp, Lactobacillus casei
tccttagttgcaaaagtttgattgcgatatttcgtgacccagatcaaatggtaatgaaaattatagatatagcgtctggtataaaccgcggcttggattttttctttagtcataaaagttacctcaattgttagagtcattgacgaatgctataataccattatagcaagaaaagaggtgatattaaatgaagtcaatggcacaattagaatatcattatggattgaaggttcgcgtctacccaagtgatcaccaaaagaaattgattaagctaaacagcgatgccagtcgcttcgtctataacgagatggttgcgatcggtaaagaactctggcaattaaaacaagttaagctaccaattgatacggttcaagatcgaatcaagcaacttgaactacggcaaaatgccaagcagatgtcaaatcatttccaattcttagaagacaagcgaattgacagtcttgctaaggctaacgctatccgaaactatcgcaaggcatggaaagcctttcggaaggttcatagtactggcgtcccaaaattccaccgcaaaagctatgcgtggggctaccaaactaattgccaatatatccagcagaaaacgatgcagctaaccaacgggaccatctgctttgaagatgataagcacgtcttagtgcctaaattagggcgtctacgcatcaaaggttcacacaaacgattattgaatcgaaaagcagaaactcgtattggcactgtcacgattactaaggacactgcagaccgtttctttttatccatgcagctgggttctgatacacccttcacgacgaagcctgccaagaccaatcggcaaactggcattgacctcaacacggaaaacttcttgactaccagtgatggcaaagtcatagccaacccgcactactatcgaacaattaagggacgattggctaaggaacaacgcattttgtcactccgcgcccgaagggcaaagaaagagcatcggccgctacgcaacagtaagaattaccaaaaacagcgcttgctagttgccaagattcatgcacaggttctggatcgtcgtaagaacttcttgcacaacgtctcaaccacactcatcaagaaccacgatttggtggttgcagaggaattgcgtagtaagaacttactaaaaaatcatgccttggccatgagcatcgcagacgtaggctggcgcacattcttaggaatgctaacttacaaggctgacctttatggtcgccagtttgtaacggtcagtcctaagaataccactcaaacctgccatcattgcggcttcgtcatgggaacagaaggcactgataagcttacgctggctgatcgagaatggaactgtcctaaatgccagacccatcacgttcgcgatcacaatgccgctcagaacatactgatcaaaggtattgctaaattagcctgaataggctcgtccctatggcaacctggggacgctaaaggcactggtaattgccgtgtaagacaagcagttcgtagaactgcctgcagtggtg

SEQ ID NO: 368 - DNA, 320 bp, Lactobacillus casei
acatcgacgccgggctgcttgagctagacaacatgacacttcccaagaagctccgacgccgcatcaaaggctataagaacgcccacaagcacaagaataagaagatatacggcgactcaatcgagttgcgtcctgcggccgtgaatgaccgcacaggcgtgggacattgggaaggcgacttggtcaaaggtattcgcttagctgatgagccagcattaatgacgctcacagaacggtacagccggactgagatcatcgtcaagattcctgactatcatgcgggcacctgccttaaagccttgcaggacacgatcgacgac

SEQ ID NO: 369 - DNA, 437 bp, Lactobacillus casei
gaacggtacagccggactgagatcatcgtcaagattcctgactatcatgcgggcacctgccttaaagccttgcaggacacgatcgacgactacggggccaaggaatttgagagtatcacttttgacaatggttccgagtttgccaagttatcagagattgttggaacccagatttacttcgcacatccgtactcgccttgggagcgtggcacaaacgagaacgccaatggactgcttagggaattcttcccgaaagggaagtctctcagagcagttaccctggttgaaattcaagcagtccaatccgcactgaaccatcgtcccagacgtattctgaactatcttcgcccatgcgattactaccgatgcatggcgtaacagcctagaccactatcaagaattcgttatcatcgttgcacttgacttgaaaattgagg

SEQ ID NO: 370 - DNA, 601 bp, Lactobacillus casei
ccccagtttacaattcaagtgcaacaccctgacgactagaccataaaggccatgaagacctattcttgttagtgctagctaaacaagaaagcaggaatcttcatgacccactctcagactaacacccacaagcattaccaacaactcagttttagcgaccgtgctacaattcaggcccttcaggctgctggtgacaccgcgaccgtgattgcacagaagcttcatcgcagtaaagcgacaatctcacgagaaatcacgcgtggatctgtaactcagctcgactcgaagcgtcactcgcatcaagtctatcttgcggaaactgcccaagccatgcacgaccgtaaacgcgatagaaccggtcactacgcctttcttaagaccggccgtgcgttcttcaaggctctcgccagggagcttactcgtaagccgcgcgtacacagcgttgatagcttcgtacacttctatcgcgaccagggcaaggcttgcccttcaacgacaactgtgtatcgctacatcgacgccgggctgcttgagctagacaacatgacacttcccaagaagctccgacgccgcatcaaaggctataagaacgcccacaagc

SEQ ID NO: 371 - DNA, 250 bp, Lactobacillus casei
tctctcaaaaggaaggaatttttacatgccaactcgttacgacaaagaattcaaacaaaacattatcaacctatataagcaaggcgaatcagctgcccaactggccagagaatatggcattggctattcaacagttcataagtggatccagggccaggccaaaactcaatccggtaaatcgccagacgaaatcaaagcgatggaaaagcgactggcttcgctgtctgaggagaacgaaatcctaaaaaaa

SEQ ID NO: 372 - DNA, 218 bp, Lactobacillus casei
gtggttgaagttccagattcaattcatggtggatcttcataacaccgtatcgctgcttaaattccgcaaagatccgcagaatccgttgttacaagtccgcatcttcggcccggcgttttgaaggtttgggggatcgataacgataatactgagctctggaaacaccgaggattcggcacatcttggttacctggtggtgatggctttcttggtgaatg

SEQ ID NO: 373 - DNA, 316 bp, Lactobacillus casei
gtcgtcgatcgtgtcctgcaaggctttaaggcaggtgcccgcatgatagtcaggaatcttgacgatgatctcagtccggctgtaccgttccgtgagcgtcattaatgctggctcatcagctaagcgaatacccttgaccaagtcgcctaatgtcccacgcctgtgcggtcattcacggccgcaggatgcaactcgattgagtcgccgtatatcttcttattcttgcgcttgtgggcgttcttatagcctttgatgcggcgtcggagcttcttgggaagtgtcatgttgtctagctcaagcagcccggcgtcgatgt

SEQ ID NO: 374 - DNA, 217 bp, Lactobacillus casei
gtggttgaagttccagattcaattcatggtggatcttcataacaccgtatcgctgcttaaattccgcaaagatccgcagaatccgttgtttcaagcccgcatcttcggcccggcgttttgaaggtttggggatcgataacgataatactgagctctggaaacaccgaggattcggcacatcttggttacctggtggtgatggctttcttggtgaatg

SEQ ID NO: 375 - DNA, 1726 bp, Lactobacillus casei
agacttgtggtctgaagtcaagggagtgattcaaattatctagacttgtttcatttttcagagggtatacttcccccagcccagggatttagtaatttctctaggtgaatctaaagccctaacttgacgcttggcgcgctagaccgctttggctggtttatacaactcgtggtttttaagtaatgcatagatcacgcgtaccagctttcttgcagtcatgacacaagcacgtcggtgttgatattttggcacctcccggtatttcttgtcgtaaaatctggcaaatgtgggatcatgcgctcttaccgagttggcagcttcaattaggtaatagcgtaagtactgatcgccgttatgcgtgcgcggcgttagttgccgctcaccgtttccggattgacttctgcgccaaaccagtccggcatagcttgccaaactagcttcactcggaaaccgttcaatctgaccaatttcagccagtagtccagccgagtagactgggccaacgcctggaatactttgcgttgactgtgagccatcaatgacggcacacaggtcggtgatgctcttgtctagggcttttagttgcttttgtaacatccggatctggttgatgtaaatcgccatgacctggtcaacagaatcggcaaccgtcttgctcaagcgataagagctacggatggctttttgtaaggccttagcgatcgcctctgggtcaccaaagcgaccgtgggacaattggttaagatcttgagtaagcgtctgtaagggcatctgagcgatttcgtccagtgtgtacttttcaccgctaagcaccgtcatcatcgtgtttccgaacacagaagtcggtagctcagcttccagtgtgttcaatcggaagtacagattgttgaggaagtggtttttgccatctgtaatttgtttgacgacgtgataccgttcgcgggtgagccgctgtaaggcaatgtgtttctcgtcgcgggtcactggcacttgataccggccaatgcgcagaaagtctgcgatgtggaaggcatcaatggtatcagtcttgtcgtcatcgaacaattggctgtaacgatgagtcatcttggggttcaacgtgacgacagtggcatccaacgcactgagcgctgagctttgttcaaagtaaagtgtggggtggatgttgtacaccgaggtggcttccatgccaatcacgatctttagtgaatcatcttggcgtttagcccattccaggattaatttctcaatttggccggccccgtcaggggtattcgtggtcttgtcctggaaaataaccttcttggcagaatccaagccacagtaatcaagctttgcttttgaaacatcaataccaacattcaagttcatcgaattggacctcctttctgttctgatttatggataggcttgggcgctgcgcgatattccctaattatgaacctacagtacttcctcgcagtatgagcagtctgtctgaggatcagtagctgctcggtgaaacgcgagtcaccgaactgatctccagcccccgcagcttgtggtttgtgcttgttcgattcatctgggcggcagtctcggggtgaagtctagcaatagctagcaacaggagggaaaagcctataccagttggacccaaatccaatgaacaactagagaatatcacgcaacatccaagtacggagctatccaagaacttggttgtaatttaaatatacgaggaggg

SEQ ID NO: 376 - DNA, 254 bp, Lactobacillus casei
ggtcatatcagcggtccatttttgatttaaaccagtggtcgagaaatcctgcttaagcaagttgggacgctgttcaaccttggttttggaggccgaagccgctttccacttattgacggtaacggagtggatatccagttccttcatgagccgggaaatccgttgtggactgcaccgaagctgcagtggttgaagttccagattcaattcatggtggatcttcataacaccgtatcgctgcttaaattccgcaa

SEQ ID NO: 377 - DNA, 210 bp, Lactobacillus casei
atcaggtagataggctggaagtggaagtgcagcgatgcatggagcggaccagtactaatcggtcgaggacttaaccaagtagagcgtgagcaggagcgcttagaaaccggagcataagcgggcctgagttcgttggccgggttttggccaatggactcagggtccttatgtggaggtttctgcgactgcgaacgcgtttcgatgaaatac

SEQ ID NO: 378 - DNA, 221 bp, Lactobacillus casei
aaaggttacgcggataatgcacacagttcagcgaatgatgcttccgactcagcaactcaggctaatgattatgcaagcaagtatcctgacgattctgctgtttcaaatgctgccaagaaagcatctgacgctgcagctgatgcggccaaggctgctcaagccgctgacacagctgccaagagtggcaatgtggcggaagcatccgatgcagcaagtcgtgc

SEQ ID NO: 379 - DNA, 221 bp, Lactobacillus casei
gggggataacatttggaaacagatgctaataccgcataaatccaagaaccgcatggttcttggctgaaagatggcgcaagctatcgcttttggatggacccgcggcgtattagctagttggtgaggtaacggctcaccaaggcgatgatacgtagccgaactgagaggttgatcggccacattgggactgagacacggcccaaactcctacgggaggcagc

SEQ ID NO: 380 - DNA, 545 bp, Lactobacillus casei
tcaaacaccgacatgctacttttgatggtagatgcgaagcggtcattgtaacgcttgataaagccgaccaaaaaccgattggcatctgcgattgtggtgatgttatgcaaccgcagttcacttgtgagccgatcttgaaaagtctccagaagacgttctatacggcctttggcttgcggaatactggtgaccgaaagttctgttccaagtgtctggcaggcataaccgaaacgtgtgagagggttctcggtcgaaggtgagccctcttttttgttgctgttaaacacggtgcgccgatccgttaggaattctgctggagcgccataatcacgaaggacttgggcaaacacatgataatagccgctgagtgtttcttgtttggcaaagtagccgccgacaacgttcccggactgatcatcaatggctgcgtgtaaggtggttttttgagtgccaaaccaatactcccaggaagcatccatttgtacctgttcaccagaataatgtttccgaggacgttctggatgggctttgatgttttcaacgac

SEQ ID NO: 381 - DNA, 353 bp, Lactobacillus casei
ctcttttcttgctataatggtattatagcattcgtcaatgactacaacaattgaggtgacttttatgactaaagaaaaaatccaaggcgcaatttataccagacgctatatctataattttcattaccatttgatctgggtcacgaaatatcgcaatcaaacttttgcgactaaggaactggcagatgaaatgaagaacattttacaaaaggttgccgatgataatgagattgtgatcgaaaaaatggcagtcatgcccgatcatgtccatgtcttgatcagttttccgcctagcaaggcaccaaccagtgccatcaaggcgctcaagggtagaagtgcctttatctttctca

SEQ ID NO: 382 - DNA, 245 bp, Lactobacillus casei
ctgttcccatgccgaacacagaagttaagcttcttcacgccgagagtagttggtgggaaactgcctgcgagggtaggaagctgccacgcttacatatggaggattagctcagttgggagagcgtctgccttacaagcagagggtcacaggttcgagccctgtatcctccattgagccgttagctcagttggtagagcaactgacttttaatcagtgggtcgacagttcgagcctgtcacggctca

SEQ ID NO: 383 - DNA, 203 bp, Lactobacillus casei
tgttcggcatgggaacaggtgtatccttcttgctatcgccaccacacttatgagaactttgcgctctcaaaactggctatcattgttggtcgtttgctttgctgagaatcggcgtatttcatcgaaacgcgttcgcagtcgcagaaacctccacataaggaccctgagtccattggccaaaacccggccaacgaactcaggcc

SEQ ID NO: 384 - protein, 448 aa, Lactobacillus paracasei
MKVVKFGGSSVADAGQFQKVKAIIDQDANRQIIVISAAGKYGNATRKLTDTLYLIADGMEAGRDVEPLFNQVLARLEAINIALQLNVPLIKLLHTIRHHLAIRYSRDYLVSRGEFLTAHLMAAYLGYTFVDAANLLFFNKAGAIDEAKTQTAYQQLASHHGIVVPGFYGRDADGHVKLMPRGGSDISGAWLARLAHADLYENWTDVSGIKMADPRIIKDADSIDVMSYDELRELTYMGFSVFQEEAVQPVRECGIPTRILNTNAPEDPGTLIIHDDDPANDLKTITGIAGRKHYLVITVRKYQLALHLEVIQHALGVVAAHHLVVDYLPTGIDSFSLLIREPRHQVSVQELTAEIAAACQPDKMEVTENVALIAMVSRKLRQRPAIAGKVLAYLDDNLLNVQLVSQTNDDINLLIGVHDLDYDKAVRVIYSSIHQNFQRPAPYIEGIA

SEQ ID NO: 385 - protein, 399 aa, Lactobacillus paracasei
MKIAILGFGTVGSGVYDIIANGDTRMRVTAIFIRPTHPATMPEMTTDLDAILNDPTIDVIVETMGGLHPAHDYILQALQHGKHVVTANKAVVAKYLPEFTAVAAQHHVQFYFEATTGGGIPWIRNLERAARIDQIDTIEGIFNGTSNYILDQMQRAHLDFDPVLLAAKDMGYAEADPSADIDGEDVVNKLKISAALAYNMAPPRDVPTFGIRNVSKADIDFFASQHQVLRLIGKSKRDGDHYSMVVEPRLYSETALAANTFENFNLIRLHGQTIGDLQFYGQGAGKYPTANAIVQDLYDILENAPHLDRSFDQPLHFDANLNVTDYVLRADPMTFAMFNDRETEIVNDRLVIKQIPTGDMHKLMRGVLAIDADAFMAAIGDSELAAKDVLHQQDQEVIG

SEQ ID NO: 386 - protein, 504 aa, Lactobacillus paracasei
MRYTSTRDHQVSKTSKEAIKQGISEEGGLFVLPHLADQTLNIHELLDLDYETIAQRVLMILLPDFNTDSLKKAIHFAYHQHFSDDRITPVRSVGDFHVLELFHGPTSAFKDVGLQLLPRLMQLALDPDDRVMILAATSGDTGTAALQGFKDVAQTGITVFYPNHGVSPIQERQMLTVGSDNTRVFPIAGNFDQAQSAVKTLFTDTSFAARLQAEQVTLSAANSINIGRLIPQVVYYFAAYSQLVKTQAISMGDEVNFTVPTGNFGDVLAGYYAKSLGLPVHKLIAAANANSELADFLATGVYDRNRPFLKTVAPSMDIQISSNLERLLYYKSGEDSAYVAHLMQELETTGRYQVRPDVLTAIQADFAGGFAVDEEVADAIREVWHRDGYLLDPHTAVGYAVQQQYRAASGDNTPNVLLATASPYKFPRVVAKALQSHVPDDDFAAMQMLQQVSGVPIPPNLARLQQLRPQEKIVVAPTDMGQAIIGAAKEVFNDDQRVRSGNER

SEQ ID NO: 387 - protein, 293 aa, Lactobacillus paracasei
MISVSVPATSANLAVGFDVLGLALDLKAHFTFEMSTQKLEIIGDDPAFANSENLIYQAFSKFAEAIDQPVPNLRIVVDSAVPSARGLGSSAICVVGGIAAANAWYQAGWDDTALLRFATEMEGHPDNAAPAIYGQLCATIMAQNEPVVRQYTVSSKLHFVTLIPDYAVSTADARRILPRTMTYADATYQMGRCTLMTRALADGDMSLLRQVATDRMQEPYRAELIPDYSAAHQVVQTAGGVLLISGSGSTMLAITASSAAAAQIQAQAQESWKKWQVQVVAPSQQGVQVEQFE

SEQ ID NO: 388 - protein, 419 aa, Lactobacillus paracasei
MKNAPSFTPILLGSDMNVYGMARSFHEMIGGAIDVYAREQLAPTRFSRIVNVHLIEHFDSDPTFIENMRQVAKVHADAPGKLLLIACGDTYAQLVSKHKDELSQWFICPYVDYELLKRLNSKESFYQVCEEYHLPYPATKIVTKSMYESNATITAPFEFPVALKPTDSVEWLNIRFEGRKKAFTIHSQVELTNTIAKIYDNGYTSDLILQDFVPGDDSNMRTLNCYVDQYHHVKMMCLGHPLLEDPTPSSIGNYVAIMPAFDQDLYDQIKTFLEAIKFTGFANFDMKYDHRDKTFKLFEINIRQGRSSFFVTLNGYNLASWPVRDYIVGDLKDAPTVYGNDDHSKYKLWLGVPERVFKQYSADNEAKKEALQLLKEKRYGTTVFYKPDMTFKRWLLMKYMFHNYVGRFKQYFAENKGDM

SEQ ID NO: 389 - protein, 153 aa, Lactobacillus paracasei
LVTEDDLTIESMHYNRLLLAVDDDDDDSSRKALNYACTVAKIYDIPLGIVSVLETGDLNIFQSLTPDDVDAARETLAKDLNTYVEKATAFGVQNAQPIVAEGRPAAAILDEVIPAFKPDLVIMGSHVRRGRLRLGHVASEVARDASVSVIIVR

SEQ ID NO: 390 - protein, 243 aa, Lactobacillus paracasei
MYYQNVSVGQLIKRVSRFTVEIDLNGTVEPVHMNNTGRNKEILIPGSLASVRYVDNPNRKTHYDLLAVQRQGRWINIDSLAPNHVAKECLEAGTLKLPGLALPYAVHPESTWRDSRLDFAGKAADGQSWFVETKGVTLANGTLAAFPDAPTTRAVKHVHTLTMAQAEGYQAFLLFIVQLPDIRQMTIYRDRFPELVTAITTAKQNGVRVLAYDTMTGPDQITLGNEIPFDEHLPFSEINLNSL

SEQ ID NO: 391 - protein, 407 aa, Lactobacillus paracasei
MQHKVESNAETKIEVRGLTKIFGKRVNRAKEMLKAGKTKPEILKATGATVGVDRADFSIKTGEIFVIMGLSGSGKSTTLRMLNRLIEPTDGQVLIDGDDIAKLDKQALREVRRQKLSMVFQGFALLPNRTVLQNAAFGLEIQGMEKDEREMKANKALDLVGLNGFADQYPDQLSGGMQQRVGLARALASDAEILLMDEAFSALDPLNRRDMQDELLDLQEDMQKTIVFISHDLNEALRIGDHIMIMKDGEIVQIGTPEEILSQPADDYVEKFIEGVDRSQVYTAANVMIRANTVNIDRDGPRLAARRMRDNEISSLYVVDTKRKLVGILDADDVRSAIDAGQKDLRSIVKSDVPTTKMDTPLADLLDAVSTTPVPFAVVDDHDRLRGIIIRGAVLGALSGQEVNVNV

SEQ ID NO: 392 - protein, 283 aa, Lactobacillus paracasei
MSNILSSIPTLPLAHWVDSFVTWLTQFSGFFGVLTNFIGGIVNAFQAVFDFIPIWLFIILVLALTWYLKRDQKYRSLLIFELLGLLLIWNLGFWRDMTQTLTLVLTASLLAIVIGVPLGIWAAESKSVSAVVKPLMDFMQTMPAFVYLIPAVAFFGIGMVPGVVASVIFAMPPTVRMTQLGITQVPADLNEAAVAFGATGWQQLLKVQLPFARGTIMAGINQSMMLALSMVVIASMIGAMGLGTKVYFAVGRNDAGGGFVAGLAIVILAIILDRITQSLNRSR

SEQ ID NO: 393 - protein, 300 aa, Lactobacillus paracasei
LTFLKKIAAALAVLITVGALAACSSTQPKYDAKEPLGPQINYTITGIDAGAGVMTSTDKALKAYGLVDKKWQLQPSSTAAMTSTLQKAIADKRPIVVTGWTPHWMFTKFPLKFLKDPKNVYGKTEQIHTIVRKGLKQDAPQAYQVLDQFHWTPEEMSSVMLAVNGGKDPAEAAKAFVKKHPEQIAQWTKGVTHVSGKPKLTMTYIAWDSEIASTNVVATVLRQIGYNVTIRAMEPQPVWASVATKAADAQVSAWLPNTSAKLYSDYKNQVVDLGVNLDGAKVGLAVPKYMKNINSIEDLK

SEQ ID NO: 394 - protein, 586 aa, Lactobacillus paracasei
MVKTIKAGVAALKTLESWGVTHVYGIPGGTFNNMMYALDEEKDNLKYIHVRHEEVGALAAVADGKLTGHIGVAFGSAGPGATHLFQGAYDAKMDKVPTLFLVGQVEQRFMNYDFFQELDEDPMFQDAALYARTVTTAASLPHIIDEAIRRAYAGRGAAIVVIPNDLAAEEIPADGYYSAAATHATPVLPAGSDEQVDAALRLIGAAQRPVMYVGQGVRGAADTVMTLARKLQMPVITTALGKPIIPYEFESLLGSAARVASKPANEALRVADLIMFVGSNYPFAEVMFSPNAKFIQIEADSKTLGKRHHTDVAILADAPATLKKMIDRSDDAPRSGWYQANVDNVKNWHQYNDDMMTRTTGKMRFEPVFGQINRIATDDAIFAIDVGDVTQNAVRLLKVNGRQAWTTSGLFATMGAGLPAALAGQLSFPKRQVFNLAGDGAAAMVMQDLDTEVRYHLPIINVVFSNNALGYIEDEQEDDGHEWFGIDMPAIDFATVAKGMGMTGITVTQVDELPAAFETAEANRAAGKPTLIDAKITNERPIPVEHLQLDPNQFDADTIAAFKKRYYAEKLVPLSEFLKTHKVPVA

SEQ ID NO: 395 - protein, 310 aa, Lactobacillus paracasei
MPFAEVIMNPSAGNARWKKQLPELVAIIESHFAPLHISQTRKAGDARLVTERLIKAYQHKMDDLQLIVIGGDGTLHDVVNGLQRQGHPEVAIGYVPTGTGDDFARANHIPLDPKKAAAALTTAMPHALKIGVADSAKYGTQYFINNFGIGMDAQIVYQTNHSDHKAALNALKLGHLSYAASILKALRQQKRFPATWQADGQGMAIDNAYLNVFTNHPFLGGGLRLFPNKADNRSTLSFVQVHREKLGILLQVLFAILSGRSVHRAMHHAQGQTFEFATSATVPIQIDGEEYSTPIQVTLHQTKKLFLLPT

SEQ ID NO: 396 - protein, 136 aa, Lactobacillus paracasei
LKKLFQLYKRYEMIINYLFIGGLTTLINFVTFFAMRYFGIGLVLTNTTANIVSVIFAFFANKSVVFHSDYSSKKKFWFELISFLVLRGVSLLLDNLIMIIGVDWLHGNEILVKILDQVIIVIANYLFSKLIFLRKK

SEQ ID NO: 397 - protein, 47 aa, Lactobacillus paracasei
MGSVVKSLLAVYRLQGDRASRLRAGFARGLEVVPTTLASRSPPRIAA

SEQ ID NO: 398 - protein, 233 aa, Lactobacillus paracasei
MTQSNKKQPPRKHRWLWRTIFTLGILLGLALIFNEPIKLFVVDHLSQWTMAQVDRDNVNKNEKRKATFDFKGVKALDINTVGNAALNRDLHPIGKVAIRSVGLKLPIFKGLSNENLSAGAGTMKADQKMGEGNYALAGHYMTNQGILFSPLKNVKQDDIIYITDMKKVYSYKVTSKQVVNETQVQWIDDVAGKKLITMVTCASPTEGEVDRIIIQGQLQSVKKATKQHLKVFL

SEQ ID NO: 399 - protein, 357 aa, Lactobacillus paracasei
MSGYEKFINNLPVRRTVVLFSVFLLLWFARSIMSDILLTFIFAFLVSRLVHAVQRHVHIRPFVIVVPVYILVILGLVYAAVHYVPAIIHQTIGLFNSVQNFYNSEAFANNQVMQWVLQSTKSLNLTEQLKTGVTTVLQYAGNIGAMGLTLFVSFILSFFFTIELDSLPAFGQLFLDSPFGWYFKDLQYFAMKFINTFGVVMEAQIFIAVVNTVITTITLLFLKMPNTPSLAIMVFLLSLIPVAGAIISLIPLTIIGYTVGGWQDVLTILIMIAAIHVLEAYVLNPKFMSSRTQLPVFFTFVVLLVAERLFGTWGLIVGIPIFTFFLDVLGVKKIAGTAHKQSTYASVPQPKEHDDDA

SEQ ID NO: 400 - protein, 364 aa, Lactobacillus paracasei
MHKHRWLIVIVLAVALVAATGLTMAWVYHQRQANKIVARPVPQAQVGKHAQALIKKTAFTGSVALIKNGQIVYTGGVGDADHGQHEANNGETMFPLASVEKYLTALVIGHLIAEHKLSFNTKLAKFFPKIDHSKDISIRQLLDHRSGIQMDELTPDQTLTSEQAILDWTFEQMGSTGDHSFIYANANYAVLAGIVRQVTGKSFANVLQQTIITPLQLTHTHNFTALTAQMPVAQGYLTAGDNDYQPDELSNALLSTLLGSGSVYMSATDLAKVIIAAETGKIMPLKVYHQLINANYGDGNPYASGVMWLDDQRLLQGMYNDNPESFSTLAYFRADAKSGVVLFGNHTMSTDTVSLAQNLEALVN

SEQ ID NO: 401 - protein, 47 aa, Lactobacillus paracasei
LHQNLQELLEASVNEPDEIKRNFYDSLYTYVLQKSQEDIISRPGFVI

SEQ ID NO: 402 - protein, 167 aa, Lactobacillus paracasei
MPKLANTLADKFAKKDPADKATFKANAKKYIASLDDLNTLINKLKSKVNGQLVDVSEPVFGYALDYLGYKVNDDHFSKSTEDGTDYSAKDIHGIETDIKEKKIAFFVNNIQASSKTVNQLVKIAEQNNVPVLKVTETLPKGKNYRTWMTSQYQQLEKIQDQATNSAK

SEQ ID NO: 403 - protein, 213 aa, Lactobacillus paracasei
MANIMILGAHGQIATLARHQLLKETDHHLSLFLRNAGRLQDVNPQRETVIDGDVTDTAKLTKALAGIDVVYANLGNKGIEDQAKSVVKAMDAAGVSRLIWISTLGIYDEVPGAFGKWNHQMLDGGYLETYAAAAKVIENSDLKYTIIRPAWLSNKNIVSYELTEKGEPFKGTEVSRRSIADFVVKLINDPSKHIGASLGVDQPNTQGDKPSFY

SEQ ID NO: 404 - protein, 251 aa, Lactobacillus paracasei
MNLAVNNTSLFLAAMLVLVALGISLWQKLGLDRDIVIGVVRAVVQLFIVGYLLKYIFRVNNLWLTLAMMGFIIFNAAWNAKKRGPGIDHALAISLLAIFVSTGVTLGVLVLSGAIKFVPSQMIPISGMIASNSMVAIGLAYRSLNSQFHDQRQGVLERLALGAGLLDASIAIVREAIRTGMSPTIDSAKTVGLVSLPGMMSGLIFAGVDPVRAIKYQIMVTFMLLSATSLGSIIACYLAYRNFYNEQKQLK

SEQ ID NO: 405 - protein, 216 aa, Lactobacillus paracasei
MNSLISLEKVNYQIADQHILHDVDWQIPAGAHITLTGPSGGGKSTLLRIIAAMISKTSGTLIFDGQPIESYDPIMYRRQVSYCFQQPTLFGETVADNLAFPYQIRKQVMDTQRVVTALNNVGLSERTLHQPITELSGGERQRVALIRNILFLPKVLLLDEVTAGLDENNKQIVHACLRQLNEQDHVTTIMITHDATEIDAADQLAKVVAGRLEVHA

SEQ ID NO: 406 - protein, 81 aa, Lactobacillus paracasei
LRYPKRAYTFSVDYFSTPESVDPLKSLAEEFGPSKDSIAIWVKQATPIMIKGQSKTLKDVKQLEKRLAILEEENEILSRIA

SEQ ID NO: 407 - protein, 345 aa, Lactobacillus paracasei
MKKHQDIVKRVLFTMMILFVYALGQQIMLPGFDITLARKIMSHNSLLQMFGLTTGGQMNLPTLLSLGLGPYMTAMIVWQAIQSLDIRAINNMSVRQSGVLQRFVTLVLATLQGIVMVYYLQDAIKPLYLISDNINLGPSVAVLILVTGAMFALYIGNENAIFGFGGTIALIIPGILMNLPHAFLYGYGTDRMKMTPVSISIAVVVTVVVFLMGIMVFRAERRIPIQRPSLESSFSDSYLPLPFLAAGAMPFMFLNMLFILPAQVVSALGYQYTDVGQFIINQINYNHWPGIIAYAFIILFLGFAFGLINISPSKVARQLKERGDYVYHTAPGDATEALIMPRLHN

SEQ ID NO: 408 - protein, 782 aa, Lactobacillus paracasei
MNFFGSSYRYHKKTKQILKLEATYKKMGDEELRHQTVLFRERLQNGASLRSLLVEAYAVVREATSRVLKMRPFPVQVLGAVAMEYNNIVEMKTGEGKTLTAAMPMYLHGLTGPGNFLITTNGYLANRDAEQMGKVYRWLGLTVKAGVPEPGHEGEDRDREKIYQADIVYTTNSSLGFDYLFDNLAADPSDQYLRKLNFALIDEADAVLLDSAQTPLIIAGIPRVQSNFYGSAERMITMLREKDDYELSDDRKSVWFTPEGIERMQHYFGVDDLLGKKWYELYRHLVLALKAHFIYKRDRDYVVDHDEVLLVDRDNGRELVGMKMQGGQHQAIEAKEHVTVTDEMRTMASVTYQNLFRMFGQLAGMTGTAATDAPEFMEVYRLAVFQVATNKKMIRRDLPDELYITQAAKLIASLKTVHTAYQNKRPLLIETGSLSLSNLYSRLLLREKIPHSLLNARSASKEAKIVAEAGQLGAVTVATSMAGRGTDIKLGKGVKEKGGLLVLGTERMTNRRVDNQLRGRAGRQGDPGSSIFYTSLEDRIVVQNSPKWVRKYAYQHADDQKQKLSRHGRFRKVIDRAQDQMSNNGRSARFSTLQYGEVFRAQRDNVYATRDKIMVAKSLDRVIEGVFKQVGEQYINEHRDGDISDFLDFVYTNIDRDFLPQAITEHPEKVRDSAYLVKMMKEQFAKKRAFLTDDKQWHFFQRVTVLKTIDSAWIDQVDNLQSLQAVTMNRSSNGRDPLYEYQKETRRTFKKMKQAMNIGITRNLLCSDLVLKPDGSVEIQFP

SEQ ID NO: 409 - protein, 62 aa, Lactobacillus paracasei
MTSKKRKLLDKDIAQRIKKENEEITKPEKDHVQATKIVQVGVSLLLAVMVLFGLVYSLIQIL

SEQ ID NO: 410 - protein, 338 aa, Lactobacillus paracasei
MNYIISPLQPQTDQATIKPKLDIAYFFGKIGFRELFLSRYVSWNDENWRSEILGMIATVGEGDVVIYQIPTYAAPEVEEAIVELVHKQKAKIVAFVHDVEYLRFPDQYDKAEVLRFLSSFDGLIVGTERVKSQLTADGITIPMVPSGPWGYRQPIEYRRPTFSQNIHYAGNLVTRKGGFLQNVPEGLHLKVYGSADGDVNLPYSLADSVEYLGSYRQEELALALNNGYGLLWDADTDNHFDDYARINMTHKFSLYLSMGLPVIAFNQSAIGKYVNEQGWGLGIDSLDNLPNLLEGITEDDYNHLVDKVADVSSLIRNGVHNQMAALQIVLAVKGTMPF

SEQ ID NO: 411 - protein, 364 aa, Lactobacillus paracasei
MLWVSRGNYTTVKAYDQSNRTAMYKAREDYTADLMAMGAQPLDLFFYYWRDEPDANLSSRLDGMLAGFKPGDTLILQVPFFIRPLNLKRLITQIQDVYQGKVIGLVHDYYPLWAVEAAKEDTDSDPWLDQYSYRTYPVLFSLFDGLIVHGEAYKEAIKKELDFKGPIITQGPFSYRFIEDEETSAPKFQKKLVFAGNINSSNYLNQVPDTWRLDVFGGKPKEELLKKENVDYKGSYTPTELPNHLDGGFGLVWASDNFDQVTGETAQYNRLCYEHKLSLYLSKRIPVFIWKHAAPAKWVTENHLGFAVENLSDIWSIIENFTEEQYQAMQPDLTRVSHLIRNGVFAKHAAMNALLAVNETYTEF

SEQ ID NO: 412 - protein, 277 aa, Lactobacillus paracasei
MRKRWRIFLSILTIMTSITMFNNANQVDAKVKFINDLDMFKNEPENARPSNLSFITTINKHGTMIYDDDAIKQKDVITAAAAHWNRAVGVNLIMSYQKAKVAKAAADVVIKSADLPNGVVAETGYNGIVYEGWQNIIKINDTILSGASFQGGFVQAVAAISHEMGHALGINHDSGALMGNSGNAQLAMGILPDIPEYNINAVGDILKNLNQLYAGAKPVIIPNMTDGIFYRGVDTTMDVLNTGPVSQLLSGKSRPLTRDFMVVQSKLQIAKMSSKSS

SEQ ID NO: 413 - protein, 432 aa, Lactobacillus paracasei
MKKFWKTLLSALIIAISFGAFSTANQVDARVKFTRNADYYKNEPENAKPSVLSTITTINKNGTMIYDADTVKQKDVITAAATHWNKAVGINLIMSYQEAHVAKADADVVIEPADLPAGIGGVTGYDGYVYETWQNIIKIANTTLDAASSQKGFVQAVSTTSHEMGHALGLNHDPGALMGTSGAAELANGILPAIPDYNVNAIGAILKDLDQLYPGSKPITIPNMTDGSAYRDAGTTEEILPTDRVAQLVLGVDHLATRNFNGGTVEILSNENVYQVGRGQVGTTNSFNLTKTKQPIVTGYMSAGSQRYYQIKVGSQYYIIGGGSRVIITGDAYRDNGTTTDVLDTDLISKLFKDDSRLVSRDLTHRTIEITGNEDVYQVGVGRISTTNALLLTGTQQEVLTTYVKVNGFHVYQIHVGDRYLIISSDFTKVVD

SEQ ID NO: 414 - protein, 304 aa, Lactobacillus paracasei
VKVRKAVIPAAGLGTRFLPATKALAKEMLPIVDKPTIQFIVEEAKASGIEDILIVEGKQKRSIEDHFDSAPELEQNLKEKHKDALLELVHSTTDIGVNLFFVRQPYPRGLGDAVRLAKSFVGDEPFVVMLGDDLMHDKVPLTKQLINEYDKTHASILAVKKVPHDEVSAYGVIDPEKEVSKGLFNVKKFVEKPAVADAPSDLAIIGRYLLTPEIFDILENQKPGKGNEIQLTDAIDTLNQTQRVFAHEFTGDRYDVGNKFGYVKTNIEYGLTHPEVKDELRAYILDLASKLQANKPVGKPANKK

SEQ ID NO: 415 - protein, 357 aa, Lactobacillus paracasei
VITAQAPGKLYVAGEYAVVETGFPAIIVALDQFVTVTVEATKHFGSIVSEQYQENSLYWQRQGDEMVFDNRDNPFHYILSAIKLTEQYARELDKPLALYKLYIDSQLDAKDGKKYGLGSSAAVTVATIKALAKFYDLKMSKDQIYKLAAIAHLDVQGNGSLGDIAASVYGGWIAYRSFDKAWLAAARNQMSLADLINTDWPDLSIELLTAPADMQLLVGWTGSPASTSQLVDKITLAKAKKPQLYRDFLTASRETLEKLIDGFRNRSLSSIQAGIRRNRELLDELAHFSGVAIQTPALRQLVELAEQAGGAAKSSGAGGGDCGIVLIDSHQAIKPLLAAWRDHHIEPLKFNVHEIND

SEQ ID NO: 416 - protein, 69 aa, Lactobacillus paracasei
MPRTIKAQAIVYTMIDPEKEDYKQVRRMNNVALEADDGQLLAIGSAFASLYPGTQLHSTVLQQQTELNA

SEQ ID NO: 417 - protein, 85 aa, Lactobacillus paracasei
MKTLSFSFKSSLGKTTSIRLNKYEADVTADQAKQFAQIVADAKAFVKDGVNLYATPTGAKMTETQVTEIYHVDEKKEPQPAEPQA

SEQ ID NO: 418 - protein, 353 aa, Lactobacillus paracasei
MADPEALISVIMPVYNAEKYLAEALDSLLAQDYPNYEIICVDDGSMDTSKVILAAYMRENPRIHVVRVQNGGQARARQIGIDHASGDLITFMDSDDLVHPQWLSTMADGMKAPRVDMVVVNYYNYIGSTKMKARAFRESTFKIEGDDKYRYWLEDRDLRGYLWNKLFRAELFEQPVPVANFNLLEDAYFIGHLLPRIDQIGFIDEPRYYYRFNATSSVHAKFQKRDLEAIHQLGAVFLTLAHDKPELTSLAVRRYAALSLFVLSKMSPRQLVKNWGYVRQLGMVLGQYTREFQDVISAGDVNDLATENPDKPNKTSLTGRLRAWSQLLGLPTFDDLNKLAKADDDPEDVKRES

SEQ ID NO: 419 - protein, 274 aa, Lactobacillus paracasei
LITIKSAREIKGMAKSGAILAGMHLGLRDIIKPGISSWEIEKFAKEFFESHGAKAEQVGFEGYKYVTCVSINDEVAHAVPRKGLKLKDGDVVSVDTVVSWNGYFSDSCWTYGVGKVSEADQKLMDVTKKSLYLGIDEAVVGNRIGDIGAAIQTYTEDDNGYGDVRELIGHGIQPTMHESPNVPHYGVPGHGLRLKAGMTITIEPMITEGTWKIKGKQVPGDTWEYYVTADGSKCAQYEHTLVITDNGPKILTSQGDAIDEKYKLTEADLKTLPE

SEQ ID NO: 420 - protein, 153 aa, Lactobacillus paracasei
MASARIVYASLTGNNEDIAGIIEEAFEDLGVDVTTTEVSQALASDFEDVDICVTATYTYSDVGDGELPDEAVDFYEELQELDLKGKVYGCCGSGDRFYDDFATSVDDFDKAFAKTGATKGAEDVKIDLAPEEDDIKHLEAFTKQLVEKYQALQ

SEQ ID NO: 421 - protein, 335 aa, Lactobacillus paracasei
MARKQHQKKPPLLSAEQEVAIQSGRAALADLALPRRTKMRVFVKLAINRITESNIGQSAAALAYYTLLSLFPLILFVANALPYFGLTYKGLAAYLTQAIPSNVMNWLDPVIANLLDSSSGGLLGIGAVATLWAASLGVNGLKMGFNQIYGVESSQNFIIQRLLSMLMTFTLIIVMGAILIVFAFGRQFLEWLIPLLRLNDDWLRTFNTLRWPVTITALFVIIMFLNYFLPNVKIRMWTVLPGTAFTVAGWLLIAQAFSLYMKYFGTRYLSYGTIGTFIAIMLWLNFSALVLLWGAVINALTAEYFIGRLHGSKGKVHDFVKRRVRTPHEEKEAKS

SEQ ID NO: 422 - protein, 457 aa, Lactobacillus paracasei
MGSSSDLKDLLRERIAAKYTIDDLKDTGKKIRKTAPIESLAAVSKIDRDPVQFINSVEQNLTKSLLPMRHSRMGASQAAFFRGTAELMAYDLQQGEKSGINLLIDGDAHLQNFGFYASPERNLLFDLNDFDEAQINSFEFDIKRLLTSVYLLGDQQGFDADKLDELVQTDASIYRKTLRDLFKVGALDRFYQSTEVNHLVQAIPGAEDSALLSKFVKKATKRNNDSVIKKYTTTIDGNMRFKDDPPSSVRLDKATYQAIFDGFTQYRKSTRPDILVLLSEYRITDIIHHSVGIGSFGTNCYLVLLSGLGGSHLVLQVKEALPPRPELIPNTERITLQQEVSQGQRIIASQMILQKASDPFLGWFNVGDKSYYVRQFRDMKGSVDLEELTFPEFQYYTQITTYLLAMAHAQTPQAAVVTGYLDKSFDSAVQRWSKWYLNQVKADYSAFMRAVQTHMLA

SEQ ID NO: 423 - protein, 42 aa, Lactobacillus paracasei
MAKTQPFSLEATYVPVSTRASSRSKKTAPHRNGYPQFAINDR

SEQ ID NO: 424 - protein, 202 aa, Lactobacillus paracasei
MARKKTITHDQILNAAYDLVVEQGFKSFTARNIAKKMNCSTQPIYLEFKNMAELKQAVMDRIKELLSLKMAKHFTNDPVVDLGLAYINFALENRPLYRAVFVEDHFGVDEMREYAMSTAMRVFDSYEPAQHLNEAQLRNTICGVWIVATGIANLMAPGFIDITRDQMVDILTAVTQDFIVNGRFSDDPRISWFQDAKIAQGY

SEQ ID NO: 425 - protein, 411 aa, Lactobacillus paracasei
MTLPNFDKSLKQYAELAVDIGVAVKPGDTVYLQIAVDQAKLAQLIVAAAYDRGAAEVQVQWHDDLIKRLDMAHMATSRLYNIPDFIKGQFDYWVDHNAKRITVISADPDNLAGLDPQRIANYQNAFNQAYARLMDAISSMKISWTIIGAASPKWAEKVFPDGKTPEEATDKLWAAIFKTTRIDQPDPEAAWKAHDQQLRTKADWLNTEQFDRLHYVAPGTDLVVGLPKHHIWEGAGAYNPRGEEFMANMPTEEVFTAPDFRRIDGTVASTKPLSYSGNILEGMHFTFKNGQVVDAHADRGDTVLQNLLKIPGARSLGEVSLVPDPSPISQSGLIFFNTLYDENASDHMALGQAYPFSVKDGVAMTTDQRTAAGLNQSNTHVDFMMGSADMNIDGIKADGTVVPIFRNGDWA

SEQ ID NO: 426 - protein, 592 aa, Lactobacillus paracasei
MIAPQAETILKEKFGYDHFRAGQNQAISRVLAGESTLVVMPTGGGKSLCYQIPAMLLSGLTLVVSPLIALMKDQVDALNDNGIPAAFINSTLDYQEIADRLDQARSGRIKLLYVAPERFDTDWFVQRLGSTDISLFAIDEAHCISQWGHDFRPSYLNLANVAAQLPSQPPVIALTATATPRVAQDICQRLAIPADGMINTGFERSNLSFKVVRDQDEDRYLLDYLKLNVDQAGIIYASTRKEVDRLYTFLAHKKLPVAKYHAGMSEAQRAANQEDFLFDRKPIMIATNAFGMGIDKSNVRFVIHAQIPKDVESYYQEAGRAGRDGLPSEAILLFKPQDLQVQRFFIDQSEGDDEHKQRQYEKLKMMERYANTDQCLQQFILNYFGQSGTKPCGRCSNCLDDRESVDVTVDAQKVLSCVVRLHERFGKGVVAQVLAGAHNQRVLSFHLDQLSTYGLMSSRRQRDITTFIDFLAAGGYLETHGGQYPTLGLTAKGAEVLRGQAQVFQKTAQKAEQHLEVDDTVFQELRSTRRQLAEQQHLPPYMIFSDKTLKAIGSAMPQSLDELMAVKGVGQAKLDKYGQIFLDVLQAIKAKA

SEQ ID NO: 427 - protein, 240 aa, Lactobacillus paracasei
MQAFTAVYLPGWLIFIGGMLIISSVNAATVQAMVNRAGRSNTQLWYMKPGIFVHELLHAVVARLFGLQVTNFSMRADVVSGSAAHVSLRYNRRSPWAQLGLFLSSSAPVWGISTVLLIMGRWAFFPTDGRLWPVLTAATSLNEKWLAMRGLIQINWVWFAAFIVTALVLTPGIALSAQDLRNMWRSAPIVFLLTIVIFYVFLTFWPAGFAWWSLLNLNVLLLDAIMLLFSILIWLLASIL

SEQ ID NO: 428 - protein, 140 aa, Lactobacillus paracasei
MKIEKTLQTPAAFLYSKIIAPVQADIAAANNQQVAAAELGGYAYRKQFPDGEWAKVKVTKNVIDREFAMLTVTRFSRFKVRYLITPLNANASQVRVSETVQPVNWAAQLKQMVTELLVGNKRRRNYGRMLDSIERSYMTA

SEQ ID NO: 429 - protein, 122 aa, Lactobacillus paracasei
MQHRMYDEDKGAVMVSMKAEQMAAMMTLMSAAGDAENATMTAIDEAKAGHAERSRKLLKQADAKLKQAHQAQTQMLTYEARGEKVDVTLLMVHSQDHLMSAMTIRRLADEIIDLYQQVQARK

SEQ ID NO: 430 - protein, 461 aa, Lactobacillus paracasei
  misc_feature (6)..(6): Xaa can be any naturally occurring amino acid
DEADBXATPDEPENDENTRNAHELICASECSHAVTIATPFQKRWQAAGYTEQTPIQTAVYQPLKADEDVVGLAPTGSGKTLAFGLPLLEKMVPGDGLQLLILAPSQELAIQTRDVLTPYAKDIGITVQGVIGSANVKRQLDRLKEKPEVIVATAGRLLELIQSRKLKLDGLQTLVVDEADEMLRDPGFDQVREIAAAAPAEAQLAFFSATPSPYFKELHKWFGKTPDIIDVRAIDRTRGEVRHLFLQTDRAHQVDWLRTLAHTDGFKALVFFNQNSSLERVAGILRHQAVRFAVLSREGRQTVRQKALTDFRRGRITLLLVTDMAGRGLDILKLPAVVNFEPPKRAEVYIHRAGRTGRMGEAGLVVTLGDDHDRRDLSKLVPQYHIHRGYMSDGKLVDTPPAKKVSEASAPTTVEKHASPVAKQQPVKPEVAQEPAVRPRRKHKKHRLRDQRNKGKHKDNA

SEQ ID NO: 431 - protein, 317 aa, Lactobacillus paracasei
MLKLGVIGTGWITKQFVAAAMATKAYHLTAVYSRHQESAQSFIDSTAPATAYTTMDAFLGSDINVVYIASPNSLHASQALAALDADKHVIVEKPLVATTMEFEKLDEALRKKPSLYLFEAARHVYEHNFEVVNDFTHSQPVDGATLTYMKYSSKYDAFLAGKLPNVFNPEFAGGALMDLGIYLVYDAIAWFGVPENAVYLPHFLKSGIDGDGVARLDYGKFAVTLITGKTTNSELPSEIYSGKQTLMMDNAAELETVKLGDQVLSTEKLANPMEAEAAYFAKAIVGKDRNAFDKAWQLAKEVHQVMSILRTSANLDF

SEQ ID NO: 432 - protein, 118 aa, Lactobacillus paracasei
MASFLRGLKHALAHRGHHQESQTKAANPALALAKNFTGNFAFLDEQTNKTHSLAISPQLQIAIDNKVLPGQVVGITIHELTFLDHYGYKLVITADDNGPQTIYDEAEDATYAIIVPSV

SEQ ID NO: 433 - protein, 118 aa, Lactobacillus paracasei
MKKVLIGLVVLIVLVFGGLKIFEITNYGGTTYYTKITNAGQQATDHDQDGNKYTIYAYDLPGYDEKGSLQQLKFNANQDRPLKMNAYLKVIYNDKKGVTDWQRVPRAEVPKAALAKLD

SEQ ID NO: 434 - protein, 245 aa, Lactobacillus paracasei
VRSRVIYADTYRKRHQRRLFLLAVLIIALGALFVWWHQRNPRPDPQTYPVLGVRLDQTDGVQDFDSLRSSKVSFVYLKATEGSSYFDDNFNTNFNQAAGSRLSIGIYHVFSFETTPQAQADQFTRQVGQNIGDLPIGIYLSYYTEKKPSTQWLTTHLQTFVTLVQQHYHRQVLLMGSPSILKAAQKVDPQAPRWVVSDKKPTTSSGFWQYTSGARLPNGPHADYRAAVFMGDRAAFLKLSQQIVN

SEQ ID NO: 435 - protein, 64 aa, Lactobacillus paracasei
MLDERLLGTIFTLPTSAASGEITLYGIHYHYRVQDDAAAGDKVVVNAISPLYLSVVKPEHALHY

SEQ ID NO: 436 - protein, 308 aa, Lactobacillus paracasei
MNSIILISLIVVVLVIVVAILFSSVAIIHTGEVGIVERLGKYVATLEPGFHMVPPLIYRITEIVNMKQIPLKVDEQEVITKDNVVVRISETLKYHITNVNAYVYQNKDSVLSMVQDTRANLRGIIGNMDLNDVLNGTETINQTLFQQIAETTAGYGLNVDRVNIDSIQVDATIQDSMNKLLRASREKEANIMEAEGHKQAAIAKAEGEKQSAILEAEANKQTQILQAQGHAESQRLIADAVKDQINSINAGLIDNGNLYLQYKNVEALEALAKGTANTVVLPSTAIDSLGSIPAVGTLFNQKKTTDNN

SEQ ID NO: 437 - protein, 290 aa, Lactobacillus paracasei
MYQLLTDSCCDLPYQTLHDHHVDFVSMHFTIDGQEYEDDLGEDKYDINAFYQQLKQNVMPTTTQVNVGQFVDFFTPYVEAKTPILYIGFSSGLSGTFDSATQAKAMLLEKHPDAQIYLIDTLAACAGEGQFVLDAIDKRDAGMPIAELAQWLTDHRLHYRMWFTVDKLDFLYHGGRVSRTSAALGTMLNIKPVMDVDTAGKLRVVRKVRARKRSLIDLTDETLKAVKANPTHRVIISTSGDYDAANFVKDRLHAASPETPLQVGNIGPTIASHTGFGCVAVFSMATDDRQ

SEQ ID NO: 438 - protein, 150 aa, Lactobacillus paracasei
MSIRPAITNDVSPLLSLVQGYYHDSPVPLTIDESAMAAHLNQLRTDATLGALLVAELDQQLVGFAILYRSFDTRTLKPLLIINDVYVAPKFRRHGLARQLMQAAFQLADECGYAGCSWQTRISNHGAQHLYDQLGVRETGWIHYDRAGKD

SEQ ID NO: 439 - protein, 471 aa, Lactobacillus paracasei
MCASRRWLILIATSIVSFMATLDASIVNIALPYIARELKVPMSTVELVTSVYMIAICVLLIFWEKLSDSVGRIWLFQLGTILFALGSLFCGLSMTLPWLLTARLIQATGAAMTMATNFGIITAIFPMNQHGRALGVNGALLQLGNIAGPGIGGGVLAVLSWHWIFLINVPVALVAFLIGVLVFPRQRPSLAGAHMDWPGYGSYSVIILGFFITVFWAQTAGLSWVTLLPGMLAFVALVAFVQIERYASDPLIPFAIFKNPGFTIGILTAMIVYMLGYFNSVIMPFYLEETLGLSALTAGFCMMAIPAANVISAPIGGNLGDHFGAERVSFFALFLWCVPMGLFAAATPNWPLGWIVFGLAWSGLANGAFQNNPMMMDNVAPKFQGLAGSMAALGRNLGMTIGVALVTSLLYLNMSTQAGRYIHDYPHGHPQWFIYGMHRSYDFALLLLLLAVLLLGWLNLHRLHERKQSLS

SEQ ID NO: 440 - protein, 634 aa, Lactobacillus paracasei
MSLPRIQDDLYMAVNGTWQQNTVIPPDKSVVSADSDLTDSIRIKLVADLKKINAAPQAADSPLQNAARLFAKANDKVRRNQLGMTPVRARLDKIAGLKTLAQFRAALPKLLAEQYVLPVSPYVDADMHDAAHNILNLGGPATILPDAAMYQTDDAENAADLAAWSKMVATLLGEAGFDQTAQAHYVAAAKNFDRRLAAFIPANVDFAVDSTFDNPLTWTEFVEDAGFLGIPEALAAKMPQTPTKVNAVVPAYLPHLSTLITEANYPEWQAWMLISELLACADYLSDDSRQLAGQYDRFLAGQPEPEAWEKHAFGVANDYFDDAIGQYYGQTYFGADAKADITAMVKEILQQYQVQLEHNTWLSPATKQKAVRKLATMKIKMGYPDQLFPLYAILHVEPEADLLPTILQLSQQTQDFWLQQVGQPVDRNVWGMPGHLVNACYDPMKNDITFPAGILQPPYYSLNWTRAQNLGGTGATIGHEISHSFDNNGALYDEYGTLNNWWTVEDKQAFDKLVTAIADQFDGLLYEGVKVNGRLTVSENIADNAGMAVALDLLGDSADPKVLQDFFIAYARSWATKMRPERAKTVLRQDVHAPATLRVNVPVQNFEAWYQAFDVQPTDGMYRLPAKRVTIWRR

SEQ ID NO: 441 - protein, 291 aa, Lactobacillus paracasei
MALEQYRFDGKGKFDMKGFTTTPPDSFKNKKDQIKADIENNIKTLSKVQQHLAAQKQYSVLIIFQGMDAAGKDSMIEHVMSGVNPQGTSVVSFKVPTELELDHDFLWRIHKAFPAGGELTVFNRSQYEEVLVDRVHPELLLKENLPGIDSVQDVSDSLWAERFNDIKALEAYARRNGILILKFFLHLSKAEQKNRFLKRIEVPEKNWKFSLADIKERRYWDDYQKAYQEAIQNTATKANPWFIIPSDDKWYSRLIVSQIINQEVTALPLKYPEISDAQKQQLEHAVEALKD

SEQ ID NO: 442 - protein, 278 aa, Lactobacillus paracasei
MKKRGAFDLRYRLILSDIDGTLLNSNHQLTDEVKTAIKEYAAAGGTFVLASARPPLAMTALAHQMGLDVPLASLNGAVICQPQHGDLKILSATPWPAGIGSQAYEALAKLALSLNIFSGAHWYVNVVDAWVQQEAAITGFGAETAPMEQMLAEGLPVHKMLCMGEPAVVDRAEAIILAHPEWQLVASRSKRTYLEIVRQGVSKEAALRQLSDLFAIPMTETMALGDGENDLPMLKTAALGVTLANGLPVVLDAIKTVVPDNDHDGAAVAIRKYAMAKA

SEQ ID NO: 443 - protein, 414 aa, Lactobacillus paracasei
MISSSDKKWGSMVQQKTLAMKWLFLGSLITNTGISLIWPLTTIYMHEYLGEPLTVAGIVLFANSMFMVIGNSFGGWLFDHWQPYGTVLAGIGLNLFATGMLIFFHGWPAYPLLLVVSGLGSGITTTAINSYATRIQNKRPSVVFNILYFTSNLGLVIGTLIVGFVLPYGIGVVFALATGLFALFLVVALLHYRIDKVAIATATTQTVSSERNPAKPRLVMLMVTLFVTWLMYEQWQSNISAFMLGEGLTIKDYSFLWTINALLIVLFQPILTAFDRWLLQHIRLRLIGGFVLFAGSFLLLLNGSGQYITFIVAMIVLTMGEVLALPAVSTYVTLFTPLAQQGRYQGLIQGFASAGRALGPLLGAMVIEGTGSYQLLFVGATGLILLAALGFAFSVRQSIPALNDPLHPATHQQS

SEQ ID NO: 444 - protein, 454 aa, Lactobacillus paracasei
LAQPAVTKNQDLEVTIQDLTYEGMGVAKVDGFPLFIEDALPGEKMQVHVLKTQKQYGFAKVVKRLSDSPDRVPGADSTYIRTGIAPLSILAYPAQLQFKQKQIQELYKKAHLDIAVLPTIGMTNPLGYRNKAQVPVRTVNGELQTGFYKKHSHDLVPIEDFLIQDPKIDQAIVVVRDLLRKYHVPAYDERANKGVIRNIMVRRGHYTKQMMIVLVSQTWQVPHLKDIVEEITLALPEVTSVVVNLNDKRTNVILGRKSRTIYGEDYLLDKLLGSEFQISPVSFYQVNPVQTEVLYKKAIEAAGLTGKENVIDAYSGIGTISLTMARHAKHVYGVEVVEPAVRDARANAVRTHIDNVTFEVGKAEEVIQRWKDNELPVDVLMVDPPRKGLDKSFIDAVGYMKPPKIVYVSCNPATLARDLQLLAAFGYTAKETQPVDMFPQTQHIESITALTLAK

SEQ ID NO: 445 - protein, 344 aa, Lactobacillus paracasei
MRKRARLIYNPTSGNEGLKRFVPDILDIMEQAGYESSTFQTTPKPFSAREEAKRATEAGFDLIVAAGGDGTINEVVNGIAPAKKRPKMAIIPAGTTNDYARALRISRDDPVEAAQVILKGQTLAMDIGQANHHYFMNIAAGGLLSELTYSVPSEVKSIFGYFAYVIKGAEMLPAVRTVPMKLEYDGGVYDGPASMFFLGLTNSVGGFEQIVPDAALGDGKFSLIIVKTANMANLLKLMALVFNGGRHVDDPNIIYTKTKKLRVKAGGDDPLKINLDGEYGGDAPMTFINLKQHIAMYANLDEIPTKNLGTDAQKQKDYMAEVESISHQDIDGDGQIGSQDEKDD

SEQ ID NO: 446 - protein, 235 aa, Lactobacillus paracasei
VRQETRRWDPDAKETLLMRVKEGADDYRYFPEPDLPPVAVSQKWIDDIQASLPQPPAERRQRYIEDWGIPAYDAGVLTQTKEMSDFFEATVAQGADAKQASNWLMGEVSGFLNAQHVELGQVALTPAHLAGMIKLIGDGTISSKMAKKVFKEIIQHDTDPDKWVHEKGLIQLSDPAKLTPIIDEILDNNQQSIDDFKAGKDRAIGFLVGQIMKQTHGQANPKVVNQILMAEIKQR

SEQ ID NO: 447 - protein, 131 aa, Lactobacillus paracasei
MTLNNQDFIGELRLSRLPYYDELLGQERFKSRPIVIIGAENDYGPTDFSVLPVSKVSHEKNIDDFFDVKVTQRAYPFLGLNEPVSYIRTHKFYTVNSIDVSADPICLIQSQYPNLYREIRDKFHTYVNGLF

SEQ ID NO: 448 - protein, 170 aa, Lactobacillus paracasei
MKNLDEVVRFVLLRYKKISGEDLDSELKLQKLLYFSQVESFALTNKPLFDEDFEDWRHGPVLKEIRHIFNDGYKPMTSNEATHVDATTKVVIEFTLQKYAQYTPWKLRELSHHTAAWSRARGDISDDSRDNKIIDKSVIKAEAQSQRLYDPVYDMYVDEFPDFTGETMNL

SEQ ID NO: 449 - protein, 394 aa, Lactobacillus paracasei
MKLKTKLITLVVAFLAAISFALPSQVNAAKGDQGPDWAKYQGASGRYGTDQDKFVIAQIGGTYGGTYIDQWTYDSQIASAKAAGKRVHSYIWYGVGASSQLGLEALDRYMPRIKAQTPKGSIVALDYEDGASGNMAANTDAILAGMRRIHSEGYTPMYYSYKPYTLAHVDYQRILKEFPNSLWIAAYRDYLPTTKPDYGYFPSMDGVAIWQYTSAFGLSQGLDGNIDLLGVTDNGYSKQPATPSVPVTPAPSQPAKSNAASDTDYAQAGVFKPSTTINIRTGAGTGYASVGSYAPGESVIYDHVYIRGTYVWARYLSYSGRYHYVALGVNGGESYGSRSSGYTSPVSHTYYTVRSGDSFWSIASKYGISMYTLAANNGKSIYSLIYPRERILIF

SEQ ID NO: 450 - protein, 148 aa, Lactobacillus paracasei
MNNLTELLVSLAVAAVPIIGAWISKQLLANKQALTLVKVLGPLANAAVTAAEQLGVTQAIDGAVKKSTAIQAVKDGLNSLGFTSTDEQTIANAVEKSYADLKDSLAETYPQKTVDQEASNQDRVAAAAQAAADAVKAQLAPTSVAPQQ

SEQ ID NO: 451 - protein, 128 aa, Lactobacillus paracasei
VDLFIKLGGAGLVSGLLMWWIKILYGKWQDNKKERLNEVAANELDRKKEAESLQDSVELLKTAMVGLQHHDLYKTCQTYLDRGYVSTADLNDLDYLFKPYKALGGNGTGELLYNRVHDLEIRKEDTNE

SEQ ID NO: 452 - protein, 43 aa, Lactobacillus paracasei
MTNYDQCALLYSWGIDLTPYVPIMITPDQYKQITGNDYVASKS

SEQ ID NO: 453 - protein, 94 aa, Lactobacillus paracasei
MKIKIWLDEQNRLTNWAYQAEDAKVGPTGDGQQIIEADDVSQFFEGHASLVDCKIVADEGYDPANDHPLPGPSPEQQMIAALTLEVAKLKAAKS

SEQ ID NO: 454 - protein, 975 aa, Lactobacillus paracasei
MEYYFADRKSNILGVGSTDGKGEWRIDNDIETQSVDNRPAVELSLDIHFTTDQEQAVNEMAKATNFIMYQDEEGNAHQMVIESVDHDSLGHIHSIVASDAGNDLINETVGAFKADKPYTIADYITRFTNDSGWEIGINEFPDNVRTLEWTSEESSLARIIAVAKDFDAVLSFGFEFVGTNLVKRVINIRHETAGDSLISFEMNKDINNIVTHLDTYDMETSIKAYGAVPESTNGSTNQDPINLIGYKWTDPTGQFVLDQYGFLHDTIAVQKYSRLLSNSNPNPTQSDWNRVKTFDSKSQAELLQAALADLKKYNHPNETYDIDLVNSPYVPLNQTVHIADENQQLFLSAKVLSIQRSRANHSVKLTLGEFAHETVSFDERLSDLANQMANMPKTIQYYPWLRYADDDQGTNMSAFPTGKKYMAIVWSNKTSVPSDNPDDYAGKWALIKGADGADGVPGAKGADGRTSYFHTAWANDVSGQSGFTVSSGDGKKYIGTYSDFTLADSTNPDDYNWALFKGEDGDVGPKGDEGLPGKPGADGRTAYAHFAYANSQDGQTDFSTTAPNRKYIGFYSDFTSGDSTNPSDYNWSLIKGADGADGKDGVPGRAGADGKTPYFHIAYADSSDGKTNFSLDTPGSRKYIGSYTDFTQADSTNPAVYSWQLVQGPKGDTGPQGPQGPQGVQGTPGSKDVPFPYVQLDAPANPKKGDTWWHGTSLKDTTAVQRYDGSKWVDDAIAQAVLYIKELNSIILNSAEINSPNINVPFQHVSIAGSGILSSGSLTLNGASYVISGNIEDTNGNPNGQNYHTEVNPDGLLSYITQTDGTTQMHTSRISMGVLELTDLVSGLGNSAKYITSTFNAHDAVDYYHKDSGLETNDVSGLNISYSRKGPNVTIGIAFQMKTSNGWVKIANIRPGYSPFNSDDAARLLGSMSYTGAACELYVSAGGIYIIPWRGQGGYAGSLNFITHDAYPTNDAVVN

SEQ ID NO: 455 - protein, 662 aa, Lactobacillus paracasei
LKKVITVTFGDVDLSPYFIVSNVTMPFLYKDNKYDQVGLSDGEQLTYSRNAKTPITIEGTILSENSDLTVAETRDHLISLLSGNVTKQLKLSNYPDRYFDAIFEGTQEYDGTFDYIAKVDLVFMVPDGIAHSVATKTFDNMPYKNLSENLYSNSSFETNAISAGTVNTGKWSQSNDVAYSGAYSLKTTSTNSGDSGVGIPVPNPLPSTSYTFSGYLYSDSDKVVQLSGYSGGWSSLGRQNVSLKAKTWTSFTYKLTTTTSIDNVRLCFLMNTDTTAFYIDQVKIELGETATPWSPNPADPEYYTNTITVHNGGTYPVEPVITATMHADNGMVGLVNDRPGILQFGTQEIDGYTTDVSEKGLNGDFSAPISGTIYNQSATNNPNWGGDSSKPNKQTGSINYASDSYNGPHMEPAYASTGTYWNGPAAKIPIAATSQNTRNNNFTVSMMLHFETTVSELGRMELTLEAGGKVQYQMVITDNNAVKDEIQVNCYVKDQQVGTMSLDRSKFTNDKLMQARLSKFGSSINFEVSPWNGKSGREMTVSLPPLTRPDMISENVEAFSVWFERNNTWGQAGMKLIAVQFDWQHVNWWTDIKNRFSNGDVLTIDVANAKTYLNGSENRTLHTIGNQWEQFELPPGDTEIAITPSSWAQPFACEVEIREAWL

SEQ ID NO: 456 - protein, 1381 aa, Lactobacillus paracasei
LAEPLGQMMIELGLDDTKFGNGLKNAKSQLKYFGSEMKAQASFYDAFGSKVDGLSAKEQGLTKMIAAQSKVVAESKKAYDGSLTSKGEMTKSSARLAANFEAEQAKLASLAKQYINTAKAEAEMSVKTTGVTGAINKLGTAQIAIGNRMKSLGDSMTTGITVPIVAAFVAATAKAIKFQNQLLVIKNLLTSSGESAKEAISGVNKMQSDAIQYSNHYGVSVEKISAGYEELVRRGYTSKQAIAAMKTELQGALASGDDFNDVVSVASSTLEAFGMKSNNTATMTRNTKTAVNELAYAADLSAANFQSLGVGMSYVGSTAHQAHFTLSETAAGLAVLSNNGVEADKAGTGLRKVIISLNTAIKNIGTKKDVLGALGIKKDEIVGSNGQLKSLSTIMDVLNQHTKDMSATKKAAVFNSLFGTTGQNAGIILAQNSKKLAELNDQVDKAEKKNYVGSLSEKNLKSAQNQLKVLQQNVENLGMTLAQKVLPSVQPIIKDLTDAVNWLGKLNPQVQQNIVKWGLLAAAMGPVLSIGGRLTTGLGKLGTSSVGLIAKIAGLGAKSQAAKTVMGQLTDATGNVVGTLTKAGGAATNTGGLIGNLAGRMTVAAGETGVLGSALTPLGLGMIAVAGAATIGVVAWEGFGKQMVESSNRASRWGSDIGKTADTAATEMSQYQSKVDVAMSGASGSVSSNAKTINSAFSGMITSAQKASKAQKKAADDVAKAIGGEAAAALEEEAGKEETARNKEIAKMKSYAKEAHDILKNSADNNVALNAEQRVKIGNIQNEMAEAQIKTLGLTAKQQRQVLAAELVETSKMSVKQLSSMAKSIGDASYQEMSSYEQRLKAINGNAQLSEAEKNVAIEALEREHIATMDKLGGDYIRVAKAQGKSHSEIISELTQEYGFTATQAAEAWDTYNSRTKAAADETKKAVSVSLDGLSGSVKKAAESWNNLKLTDKNGKVKTNAVEEVQKAVKSGKTWNAIQLLLQEGKMTTNAQDMVAEALAANKQWDDLQWIQSDLHLSSNAKEQVASAMIANNQWNVSDWKEAQIWATNKTNSATVEAIANMSEWDSFTPKQQQLIAQAKTGAALKQTLQDLGQWDSLTPKQQQLIAQAKTGTALKQTLQDLSKWDSLTPKQQQLIAQAKTGAALQQTLKDLGVWNDVSSKVRQAILKAIDESTVPAAQAKRAVDSFVERTKTSVLKTVYVEEHVVSGAYGRSANVATRAKGDSNFAGGLAMVNDQKGPTFREAIIHPNGGIEIPFGRNVIKPIEKHAQIVPAGMTARMFPKLPQYANGKDIPANATALSLANQVTQSLGQASSVTVTNNSDNRNIETLLGSIKALLATLLTRETDFTINGQSVAKIMYPYLDQIQKISDKRQARGRGITI

SEQ ID NO: 457 - protein, 105 aa, Lactobacillus paracasei
MLKLDLRNKDGKVEHFQETFVPALKLIEGLKLTPENFPDLDESDWMEKNAEFMASCFEDKSVTKQRILDGVAAWDFNKVFNTFNQQLFGIDPKKVAASESAEKKH

SEQ ID NO: 458 - protein, 196 aa, Lactobacillus paracasei
MTLVHFPRMTIQPFDKLGVPDGDPIVIQGDQNKGGTITAEISGLASNPLKTAASDIEYWISQEGVGEVSVDFTLIDLPFDSEAKILGQKTTEAGITYVGNDTNPPYCGVLLEAESLAGDSAYLGFFRGKFAKDKETLNTQDPADKKAPEGDSYTFTAAGSPDDGDQKGEYVAKYVGSDATAISTVKAQVLKATPNP

SEQ ID NO: 459 - protein, 125 aa, Lactobacillus paracasei
MKDMLNTIYTEIRGDPLVSQYPIKYYDYPEAASKETFVLIKPLSPPTAAFGASDKELAQQLTYQIDVQSGDRMLCKQIQQAIKKHMYSLGFSQLSEGLDEFFSDTKRYVDARRYRTVTQLYDTNY

SEQ ID NO: 460 - protein, 137 aa, Lactobacillus paracasei
MTVTLDVKGLEDLENKLSQKFSDRKVAKYVNNALTIAGRYAVVELKQAAASYRDTGATVNEITAGKPRLRGGVRNIKIGWSGDGSKQRWRLVHLNEFGYTRNGRTYAPRGIGKIRSSYDEMQPKLKELEAAELRKLL

SEQ ID NO: 461 - protein, 126 aa, Lactobacillus paracasei
MVSRPSFQYQAPKVDSGKLRIPIHFYAQDVGDSPEPTDIEPKEVFFCLCDAYSPSNKDKVVLDSHEVDLGVTVIIRDTKGEFIPNNKMTAFIDDSRYREVNEWQIEEVRHDFEANRFITMVLGAKQ

SEQ ID NO: 462 - protein, 96 aa, Lactobacillus paracasei
MNDDQIESLLTEFKSRMSIYHSSEDAELKNMLQASYDAVNRMTGVSDITNNQFKELVIERTRYVYNDQAEFFEDNFLSTIIGLNLQAYGEEDDDNG

SEQ ID NO: 463 - protein, 390 aa, Lactobacillus paracasei
MTMSFKNLDTFAEKQKAFADIVKSGGDAEAQGKAFGEMMDALSTDLNSFQEKLKNKTQEEIDNIIAANTGDVKMTQDEVKFFNDISTDTGFKNDQLIPQTTVDKIFEDLTSNHPLLQAIGLQNNGVRLKIWKSDATGAAVWGKIFGDIQGQLDATFTSVDAEMSKLTAFVVLPNDLDSFGPAWVRTYVTTQITEAFAAASESAFVDGDGNSKPIGLDRDPSKGATAAGVTTYPVKADAGTVTLKDADTAKFELMTIIKALSKKENGKPVVARGNTVLVVQPGASLDFERAMTMQNVNGQWVYALPYGIQIIESQYVPDGKAIAFVKGRYDAYMAGGLNISDFNQTLAIQDAILFTAKQFFYGAPADSNAALVYALNIAAPSASTTGGTGN

SEQ ID NO: 464 - protein, 242 aa, Lactobacillus paracasei
MTTVIPINTQLVDDETASVMKSWGLDLVAPNAIREMLPTDNSDVVVEIDSPGGLVTAGSSIATLLKDYPGTVTAKIIGQAASAATVVALSADKIMMAPTATFMIHRVSVSGISGNSGDLDKYSDVLSMQDKQFANLYASKTGKTADEMLKLMADETYMSAQQAKDIGFVDEIMFEEQPTLVAGPKTMLTKEIVDALKEYREIKDKPTEPAMKIDTDELAEKLANKLKPHEEPKQSKFAGFLF

SEQ ID NO: 465 - protein, 388 aa, Lactobacillus paracasei
VNFNLFDLFTQRKDASFAYDLDLIGGQQTQVYLKQYALNTCASFLARTVSQSEFKTKNSALYYKLNVRPNYNQTATSFWQELIFKLITDNEVLVVQDDTGDLLIADSYVHNVKAVYPDTFSGVVVNDYQFQRVFGMDDVWFIKYNNDNLTTYTNQLLSDYANLFSRMISFAMRNKQLRATVDFSGVTSFDSQTPKDDANGNKKENPAQKFIDKLFSAFRDNDIAIVPLQKGIKYDEVSSQYSGADQAFSDITAARKEAVDSVAEILGIPPALIHGAQAEVDQNQQELLNFCIAPLNQKIEDELNAKAVSQSSYDQDKVTVWGLNKPNALNLSDAIDKLVSSGVYNRDTVRSWFGDDPIPDGSGQKYYITKNYEEATKGGDNDDDSNSN

SEQ ID NO: 466 - protein, 563 aa, Lactobacillus paracasei
LIHNKYVDDYIKDYEEGHLLFNKERIQLVDYLKKSVLSDDTLHFDNEQIENCIKFSEKWFFKLQPFQKFLIAFVFLYHEDGTNYYEDFLWMMGRGSGKNGLISALGTFLISEFNGIPSYNGSIVANSEDQAKISVEEIHDVMESNRPKLRPAFYWTNGLIKAKKTNSTLRYRTSNGNTKDGLRDGFVIFDEIHEYQDDSNVKVHLSGLGKKQNPRVFYIGTDGYVRDGFIDTKKKQAANVLSGKAAPDFIFPWICKIDDVSEIDDPEKWEKAVPMIVKPLSSYGKTLYRQIKKDYDALVEAPSGREEFLTKRMDYPSTSMNSSVAPWEEIAATNQPIPHDLDGREAIGAVDFASVRDFIAAAVTIRYRDKLVTIEKQWARKGFCDQYYAYSRKERIATPNQRINIPLHDWERMGLIEVVDEPLMDPRHALEWIQAMAHRFDIKKVVMDNYRAQIMRKMFEDANFEVDIIRNPTSIDGLLASIIDDGFPRGRFIWGDNPLLRWNTQNVLVKVNKANGNKSYEKKEETRRKTDGFKAFEYTLYRVNELSDVDVSESLAFLNDLDF

SEQ ID NO: 467 - protein, 103 aa, Lactobacillus paracasei
MDKLDKLKNRLLSQIDKTNPIETEKVDRYVSMVDMFYKLQKEAIKQPIIEIENGSQHFTKSNPALADMNKINASLISLGKDMGLSAPPGIDGKGTGYDPDDLL

SEQ ID NO: 468 - protein, 113 aa, Lactobacillus paracasei
MGITNTSYTGDVHSHAGRAHFYRSPEWKALREQVLERDHYECQWCKAEGRVTTGNDMTLEIDHIKTLEERPDLALDPDNLRTLCRDCHNKRHGRFNYKRLGRPKNQYASDERW

SEQ ID NO: 469 - protein, 54 aa, Lactobacillus paracasei
MCKFLLLLTLIFVLAKLFGLIAWSWLLVFMPLIVMIAVLVLFIGLGIVIGLHEE

SEQ ID NO: 470 - protein, 107 aa, Lactobacillus paracasei
MLFDNAKGQSRQLSHRQLPPPAPVLPKMEGYVPTRATATKKYKDNLIADVNDAINQGINTTSPISIGVSKYNPAVVNEVISLLNKSGWDVTGLNIDGNGSYSTIILS

SEQ ID NO: 471 - protein, 109 aa, Lactobacillus paracasei
MNSTNAMKRVGYGYVSRTEQSIIERLSREEKHMNAIIYTKPHCQKCRRTVFKLSRVMPVSTITADADDYERFRRLGYRSMPVVTVYKANGTHETWCDLQVDKIKQYTEG

SEQ ID NO: 472 - protein, 322 aa, Lactobacillus paracasei
MRLKHEPNKDPRTLMELCGYDPDKFEMVLGDYKVYEQHSTEDGTVPQYSIHIRVKPKQGLSISEMAEAFNDKIIPVNYGMKKSGDRNLVIPLPDLHFGWTTFADLKDMVSQLREIIMDGYNEIVIEQLGDLFHSDQIHATQTVRGTQLDHANMRQAFHDAVKLFDQIVPLAIEYSNRVSIKSVFGNHSGDLEYAFLYALIDRYPQVHVDLNDSNPATDWRCAYLLGHVGIMLAHGDVAKDKLTSLFPFEYKRIFSVAKTYELHSGHYHSERFKDDRGIMWRQLGTAKPNDPYEIKNGFTTGKHLLYAFVYDDTRLRCTYELN

SEQ ID NO: 473 - protein, 103 aa, Lactobacillus paracasei
MLDNIGKLVHQQRRSLNLTIEKLAERSGVSISLISRMERGDVNNISIKKLTDIARALNMQVGDFFIAPEMSDISTLAVVKYLTHLPEKERARVSEVLMQVINL

SEQ ID NO: 474 - protein, 74 aa, Lactobacillus paracasei
MTFEAILPSLKAGKKAVRTGWEGTELYVQLVPEGKFEGDTLNPYFLIKTADEAFSLWSPTDCDILAEDWQLVNA

SEQ ID NO: 475 - protein, 237 aa, Lactobacillus paracasei
MTHFDFTDKTVIITGAASGIGAAQAAAFQAAGATVVGIDLQPISNLIDAIQADVSDPATAAAIAAQYQPDIVCNTAGVLDGYQTVTDTALSAWQHILDVDLTSQFLMIKALLPGMLARGHGVFINMSSIAGLVGGGGGVAYTAAKHAVIGLTKQLDLDYAAQGIRANALAPGAINTPMNVADFAGDGKMAAWVARETPAKRWAKPEEVAQLSLFLASDAADYIHGTVIPIDGGWLEK

SEQ ID NO: 476 - protein, 166 aa, Lactobacillus paracasei
MQTTSTTHRSIVSLAKTAMITAIYVVMTLMLSPLSFGVVQVRFSEMLNYTALFNRRYVWAVTLGVFLANLTSPTALLDVPIGTLGTLVFIIISRWLAKLVQPKWAKFTIMGILFALSMFTIAGELTILTKVPFWPTYATIALGEAISMAVGGVVMMILTRFVDLDK

SEQ ID NO: 477 - protein, 239 aa, Lactobacillus paracasei
MKKNKLRLRDWLLSIALGLAIAGVAGFFYVKHYQSEQAIAVNQSTRQRIQKDSKAKVKKEKVLNQYRLYGLTDSEINAAKTLPVSAIGDSIMLGSSAYLKVLFPEMSIDAEVGRQVQAAPAIISQLKSSGKLANTVVISLGTNGPMTEADINGILDQLGTERQVFWVTAYAPGKAWIDPVNKLIHAAAKTHANLHVVDWYYLAGGNDDWFADDGVHPNDAGRPHYYTLIAKDVMQTLKK

SEQ ID NO: 478 - protein, 307 aa, Lactobacillus paracasei
MNEQIDLSQLWNVIKRSFIAMILLGILGMGIAYFGSKTFIAPKYAASTSMLVNRKQDTNPNMQLNAQQADIQIINTYKDIITRPVILRAVADDLTSPHRVVAKKGTKAVYGTRYNATTGIQERYVVKAAEPAQYKLKPAKYSNITEADLGKMVSVSNAQNSQVFSVNVRDTNPVRARDVANEIAQVFKDKIATIMSVSNVSVVSKATANPSPVSPRLKLMSIIGLILGVLVALLWGLIRELTDRTIKDMDYITNDLRLVNLGIVNYVQKMSDLDEAIEKSRDHSDSKSNNTENVDRLGYPQRSRRRI

SEQ ID NO: 479 - protein, 245 aa, Lactobacillus paracasei
MRWSFDRILPGHKEDKESQKNGVMLVTFAEPKHVVSEQFRTVRTNIEFAGAALDKCQVVMFTSSAMSEGKSTVSANVAVTWAQAGKKVLLIDADLRRPTVHATFRTLNIDGVTTVLTGKSKASEVTESTFVNNLSIITSGPVPPNPSELLNSKRMGLLLDWARENYDIIVLDAPPVLAVSDVQVLVPKTDGVVVVVNMGKTLKGDLQRTVEVLKLAKAKILGSVERVNAKHGDRGYGYGYGYGES

SEQ ID NO: 480 - protein, 99 aa, Lactobacillus paracasei
MVDVFIVGSKGIPAQYGGYETFVDKLTENRCNMDIKYHVACKVRRDDHSVKRFSYNHADCFNVTVPKIGAAEAIYYDLAAINESIAYLDCIIKVTTQKM

SEQ ID NO: 481 - protein, 279 aa, Lactobacillus paracasei
LRYPKRAYTFSVDYFSTPESVDPNLFFTIASRIRDKQTNEIHFPFAQLKDLSNYTQHGEQFVRDLNQTYHKLLSLNAMQDDGHTITAFVLFTEYEIDRDKEEVRISVNPKFKGLFNELKNWTRFNLEQFASLKSTYSKSVFRLLKQWRTQGNCEFAMADFRRLLDIPKSYKTGDIDRYVLKPAKAELTPIFKGLTVRKQRGGRGGRIVGYRFSWQAERKDANDFKHGHLSAGQQNRNKKKRVERVPEWPIEKHEVTDADRKKLSEQLELLRALGNHQAT

SEQ ID NO: 482 - protein, 259 aa, Lactobacillus paracasei
MSEYITVKDGTRISYDVHGEGSPILLIHGVTDCKETYDTDLPFLTKNHRVYRYDLRGHGASDHPKHPFTLENHIEDALAVISKLNLHNFVLYGGSLGSYIAEAVATKIPQDLSGLILNVSAAHNPASALADTAKNDNIPLDKVERRDYWIRHLTIDKDNIKQLTDSGFQKNSLSPEDEDRALRSITAFDFRNELPKITCPTLITSGLYDPVNGPSKGIEIQKYIPNACFVVFKSGHLQRLEMPTAYHHVVDDFIETVAR

SEQ ID NO: 483 - protein, 331 aa, Lactobacillus paracasei
MRVLTKKDVQAVYSMKDAIADDKIALAAYSKGDATVPLRTNIDVKPDNGQSLYMPGYAAGKEPALGVKIVSVYPNNIDKGLPSVPATMVSLNPKTGIVSAIIDGTYLTQLRTGALQGAATDLMANPDAKVATLIGTGGQAPTQLEAMLNVRQLTRVYVSDIDKDRAAKFAQDMTRRFGKQFKVEILPAVDLQKAIRASDIITSVTTSKQATFDAADVKPGAHINGIGAYTPQMHEIPAELVKQADIVIFDTMDGVLAEAGDMISPLKNGLVSKDQYSGELGQLINGDIKGRDSHDQITLFKAVGTAVLDVVVAEKILQAAAKADKGTTIDL

SEQ ID NO: 484 - protein, 289 aa, Lactobacillus paracasei
MIKILLGLIVLINLGFVFYFIRDLLRHRSEVMSEPATTWALPFSSFIIFLLSTFGISDFAISTALYPKAKWVSIKKLPGTLNTQCVVPVAAMALSYITAITVDIKTLAVCIIAAVIGAYIGPRFVVKLPANTIKKFVTAGLIIAALMILAGKFNWIPANGTATSLSGWKLMLTAILLFIYGALNNIGIGSYALTMATVYAMGLNPSAAFPIMMGAATFSVSTSSIQFVKLADYSRKITLFTSTFGVLGVLVAVFFVKSLDTSMLQWLVIIVLLYSAISMALSLRQKGEA

SEQ ID NO: 485 - protein, 276 aa, Lactobacillus paracasei
VDPELTDLFKQFHFSKYESQCYVTMLQLPASTGYEIAKRSGIPRSKIYEVLNRMTERGIVLASKSDPTYYNVISADELVTTLGHQASAQLARIKTRLANVETKQDGELIYSIPNRKQTQDKLSDLLAHCEKSLYLQIWKEDISSDILGELTRLSKILDHFVVILFSNRHDYHMPFTRVYPHWFERDKLLDFGGRWVNAVIDGAEVLYGTFGDEGDDVIYTRNHSFVFIAQEYVIHDAYDLRTLETLDAAAKKAFGPDLEGVRDIYMMDRKGKNAHD

SEQ ID NO: 486 - protein, 213 aa, Lactobacillus paracasei
MMSDQKQILVLLAGAPGTGKTYTANKIMQAISGFVSLPLDLFKEHLYDELGFDNLEEKQLLDAEARARYYRGIGMLMQEHKMILGDYPFSRLQKPALEKLAAKHHYAVITIRLEADIKVLYDRQRKRDLSDPRHLGHLMNHYHRGDTLENISETPDGMPTFEVFSNRVQDRGYQTFHLGQLIRVDVNDYGAVDYRRLVEALREAIRGVEFLTR

SEQ ID NO: 487 - protein, 286 aa, Lactobacillus paracasei
MYKNLKQLMDEAQALDYTVGAFNAHNLEMVPSMITAAKDAGSPIIIQTSVATAEYVGMKNFVAVCKSMAQDLLVDVDLHLDHAKSFDAIKEAIDAGYSSVMFDGSALPNKENMERARRVADYAHEHGVSVECEIGTIGGTEEGVTVKEGRYTDPQQAIAFLNNVDVEALAVGVGTHHGQFKSKTELNWPLIEELHKEISKPMVIHGGTGVNEADYHRLTENGFRKFNVGTELLVGWTRKAKEMFGQTEVNNSLRNNIEPCNQVVYDIVKHKSGLFLNKDAEVPINA

SEQ ID NO: 488 - protein, 140 aa, Lactobacillus paracasei
MFGSLFKKKDTQKQPSAVPKEVNQSLSTTEAAALTKKVAALTTQIEQITDDKDKRHLLYNQLGDTQVKLGNDLEAIAAYEASVKDKEEFGDAYNALLNLYETQRKQAAKAKNDDDIQKWVTKTDALLDMSKRVMRSGFGY

SEQ ID NO: 489 - protein, 428 aa, Lactobacillus paracasei
MVVVNFIIQNILTQAAITIALIAMLGLLLQRKSFGAVLTGTFKTLLGFQVLSAGSAIIVTALTYFGKIFQHGFHLKGVVPSIEAINGQAMNTLGLGNEIALTFLGIFIVNIIIARFSPWKYIFLTGQALLWMSTMTVVGGKIAGFNSVVTIAVGSVIGGIFEVAMPAIAQPFVRKITKGDAIALGHFCTIGYMVEAGAAWIFGERGEKKHSIEDIKLPKYMEFLQDTYLSVAVVMVPLFMITAAFAGPKYAGNGTSLNYIMNAFMMGIQFVVGVYVLLAGVRLLLGEIVPAFRGIAMKLVPNAKPALDCPVLFPFSPNAVILGFITTTIGTVIGMFLMPVFGLAVILPGMLTNFFAGGTAGIFGNVVGGRRGAIIGGIIHGLFITLLPALLVTALTSFGFVNASATDSDTIVAMLMYAWILTPILKAV

SEQ ID NO: 490 - protein, 103 aa, Lactobacillus paracasei
MTRKLTIYFICGAGLGSSLACQMTAEDVLNRLGLDENLEHEAISSTPGLRTDIIVSAENFASQFKQYDLDPAIKFVFLHNIVDPDEIEAKLVPVIKELSEKSA

SEQ ID NO: 491 - protein, 698 aa, Lactobacillus paracasei
MRERLTNLLRTLLDSSASSLSDLGKQFNVTTKTIRNEIQVLNEVLAEKNLPLFDIKRGVAYNHISTQQRHSLSDVLDFDSISQGALTPEQRAVYLLLDLLQATQPVYLVDEQEKMQISKSSMDSDLRNLRADLAKYNLTLTTSPKLGAQIEGNERSIRTMFGDVLTRQHALVTLIAQQLIASGMYVDKMKEVFTKQDVTYIRDLLRRCFPKGALAANDMYSQQVTVLLIIWLHRVRSGHYVKDDETAVDLNKENAKFLNELIQHYALQIDVASELGYVGFLINSFNRRGAIDLDDWVKAQIFSVALIDHMETEIGFPFSKNEKLFEELYNHMTALFKRLSQHVKVVNPLRKTIQQGYGPIYDAIDRFFKTGRYQLTMSDDEKAFLAMYFSATQAEDRQRQDYQYQAAVVCNFGTATGRVLAAKLEERFNIDVLAVLSTSEVGILRKLPVSLVFKTVDMPIDKIPSLKVNPIPSEVDLTRVAAFLKKHTTLTKYEGRTLDPTRLFRTVLDVLKTHQVTVDKRLLADLQAAFKENHVEINEREVQPMLKDLINDHQIQLQQKADDWEDAIRISAKPLLDEDYITKNYIQAMIDSVKKFGPYIVIGPAIALAHARPEDGTKKLGVTITTLTKPINFGNPDNDPVKIIFCLAAIDNYSHLNVMKAIVQLINDQQKVDQLAQQTDIQTFKNILFNEKTSKETI

SEQ ID NO: 492 - protein, 508 aa, Lactobacillus paracasei
LKKWVKIAGLLALMSVVLVGCSSGASSKSSSSSSKANKAASSKVTSGASQQAYTDPKTMKGKYDIVIVGAGGAGMTAAIEAKQQGMNPVILEKMPVAGGNTLKASSGMNASQTKVEAAQGIKDSNDQFYEETLKGGGGTNDKALLRYFVDNSASAIDWLDSIGIKLDKLTISGGMSVKRTHRPHDGSAVGGYLVDGLVKEVKKEKIPLFVNSDITKLNETDGKISGVTVKINQDKTKKIAAKAVIVTTGGFGASKQMIKKYRPDLAHYVTTNQAGATGDGIKMIEKVGGYAIDMNKIQIHPTVNQSKHILIGEATRGEGGILVNQSGKRFYNEMNTRDKVSAAINKQKGKDAWVVIDTGVRQRSSAIDFYIKDKLGVEGKTLDELAKKMKVPAATLSKTVSTWNEAVTNKKDAEFGRTTGMDHGLTTGPYYAFKIAPGIHYTMGGVKINTKTEVLTKKQQPIPALYAAGEVTGGLHGDNRIGGNSVADIVIFGRQAGTQAAAYVKAQQ

SEQ ID NO: 493 - protein, 262 aa, Lactobacillus paracasei
MLSFLSLRLPKKRLWFAVSIALVISCLQMAQILNPIPVGESPYTRWLSIDPFNFTPIIFFILLPLIASIPAGSLLKNDADSGLLAKVKLHSPFQKVIRSYVGIAFLSGFTIIAIALLINFLFYFTIFPNIRPDNLLNRNILLINLNTMLVGLYYAHPLLHAAISILFASLWGGLFSVFVMVTSVWIKNSFVALSTGLVVQVAILMLNHLVRLPDLVSFSPADFLHELSPDTNVNLTVTGIVTMFMLIYCAVLAQIGEKRLVS

SEQ ID NO: 494 - protein, 226 aa, Lactobacillus paracasei
LSHSVISQQNLLTKSFFKVYLICGLTTLFIGLAGFNTICQADFSPENLISTIFPRHLIFSGLIPTYLLGLLPAIQIRPQDILLYQSRKIVSLQVLYRVCFTMLPMAIIWGFANIFVLSVNGYLNFLGDLWLPILIRAVYLWITVFLLGLITVMLAIATKSKLIAFFISFGINSLSFTFVISKRPSLFFDFSTLDSNGALISKGIIMLGIALLMIPLMTFIVNRRDI

SEQ ID NO: 495 - protein, 242 aa, Lactobacillus paracasei
MMWRLFNNQFLFFWHIIRTRFLFWLIFISLIILSTRIAGNPHLTVFSLFFDGVSYATVETHRVTLPILWFAYFFVPLLILLNSFQQLWRTRTLHLRGLQISPGRFSKVNLLLIALVTTVYDVLSITVMLITSMTAHSAELHVGNWNGALAVGGLFCITWLGVFLLLLLQAIGNRFNPPLALIIPASMLIMSAYTAFRRNPVSYLMLTPITETNAWYPILILLSITILTGLSYLLIERSLNLN

SEQ ID NO: 496 - protein, 211 aa, Lactobacillus paracasei
MAFIELHQVSKIIKHRELLHQVNAEVQRGSITTLEGINGSGKTLILKALLGLMTVTGDVSVAGKSVNVQEAYPIKAGILIENPSLIDDFNAYKNLELLAKLDTTLQPKQIHNLLDYFELTRFPEQKVRKFSLGMKQKLGIAEAFLGGYPLIILDEPTNALDHNSIIKLIQLIQAYNVNGSTFIIASHDHDFVEQVATHKLFVREGTISHEI

SEQ ID NO: 497 - protein, 174 aa, Lactobacillus paracasei
MKSKTKIWVIIVGLIALIGIGGAFRYHQVNANIKQKGVLHEVFIKEGQLVHAKNVDFTVTKARVLKNKDQVTVPVTISINQTGSANYGQKKNNFNYLENVWLNIPYGISNQTDTIFDKNNKRIAHAENLLAAEQPVTMHFSTNRANYDQRDQKMRFSFLVPSSDHYVKYSLLLE

SEQ ID NO: 498 - protein, 126 aa, Lactobacillus paracasei
VKKLTIKTVENLYKVGFISALLIVVGLTLWWTSYRDGGITYYIKVNRPLSKFSVTVPVNLQQKCYRYRATAKDTAGREKVLAFKTDEYDPGPFPKGQMLRLTYNVHYGVTHYERVSIEQVPRKARH

SEQ ID NO: 499 - protein, 71 aa, Lactobacillus paracasei
MAKADFDTLVTQLGDLRERARRLADEDYISAKYKGYSSEGLTLEEVMGALEETEGEIEKLERQLARFDDES

SEQ ID NO: 500 - protein, 183 aa, Lactobacillus paracasei
MMALLPIPEDYHVVQTDVRKRNKVQVTVDRYQNVDEVTPNNKHLTLVTDRNGNLISFNASTFKNGGKLPSADKALRQAVTLFNQLDPNYADGLSYMRTEQQERHYEDNGMQVSAPVYWIKFAHRNGSYNWVTIGPDNQIIEIERESFWDYFRNRRATEMWNYDNWVLARQGKIPQLAAPDALA

SEQ ID NO: 501 - protein, 144 aa, Lactobacillus paracasei
MPKEPDELLSRVNILARHIQHDLDVALAPTTLSASNYYFILKLGKVDEMRQETLFKTIHLNPSNVTRRLAQLIALGLVAKRRSDEDKRAWIISLTPKGRRLIPMVTQIVADYEATLTAKLSEANKIEFARMLDVLNETEKGSEF

SEQ ID NO: 502 - protein, 460 aa, Lactobacillus paracasei
LFKRWLILITLGLFFFMVIIDGTIVVVAVPTITSALAVSPSQVNLLLTVYLTTISVCLLFFGQLADQYGRTRLFIWGTYLFLIGSGLAGFGVNFQLILAARVVQAVGASMTMATSYAIVADVFPPAILGRALGIESIFISAGALAGPGIGGLILSQLPWGYIFWVNLPIGIVCLLVEWAVFPRTHAPSGKRGVDGRGFLQLIVIGGLLLLIQINKQPLFTGILVILIGSCAYWFWRHERQTDQAMLDTRLFSNQRFSRNLAASFLNYVAAYFFTLLAPIYLQLMLRLPVALSGYLLMLTPLVSLAANPVAGVLSDRFDRQRLMRIGLLMLVLTNVAFALLPHQTTTWPFVIVSVAFAVGTALFTNPNSVVLMQSVDATMRGQVGAATSLARQLGMSIGSAVAGLVFYQTLGIVSPHTTAVHAAPQALFVAQGISFMLAAALFFIAVMLLRKKVENAKRTG

SEQ ID NO: 503 - protein, 663 aa, Lactobacillus paracasei
MKKSTLTIIGGVAAAIVIIAGGFGLYQWYQGKSEADAVQATAQTYTQAFAKRQYDKAVKQVDTSHLTGPGWHYTAKTLAARNQAVFDRVGASDIKITNVKTKKYDSKTYELTFTANMNTKIGKLSAQHYEAPIVKVGDNWRIQWSPRLLFPSMDGKDTVQIDLIAATRGQIYDRNNQLLAKNGDVTQAGLVPGKLGTGADRTANLEKIAAAWDVKVTSLETLLKQSWVTDDTFVPVKIVTDSPVMTGAAYQTIGSRTYPLGEAAAQLIGYVGTATADDIRKDPTLTANSKIGKTGLEQIYDKQLRGTDGGQISIQNGDNIHPLLTKKAVNGKSLKLTIDANQQKTAYTQLAGKAGSVVTMNPTNGELLTLASSPSYDPNAFVNGISQTDYDKYANNTSLPFLSRFAQRYAPGSTFKMLTAAIALQNKTITPDTTKSISGLKWQKDSSWGDYKVTRTVDAASENMTQALVNSDNIWFAQVALKMGASAYLKGLAPLFKTQADLPLTMKKAQISNSGKLASETLLADTAYGQGQLLLSPIEQAAMYSTIANGGTMQQPTLIQGTKGKRTSSVLQANAANTVKTALTHVVSDQAGTAHNLAIDGHTIAAKTGTAELKQKQDTDGKENGFLVAMDADKNTYLTVALIEGTGSDDVVTAMKPYVASLY

SEQ ID NO: 504 - protein, 85 aa, Lactobacillus paracasei
MDAMSYHHFKQHLKGHLKQVNEDAIPLVVTFKNPDDNVVVMSKRDFDATEETMYLFSNPELMARIHRGDAQITAGKAKRHDLPNV

SEQ ID NO: 505 - protein, 309 aa, Lactobacillus paracasei
MPNHVVVIGSINVDSILHIQRLPQPGETIKMDTFSQAAGGKGANQAVAAARSGAKTSFIGRVGDDANAAFMRGELVKNQIDTQYVATTVGTQTGQAYILLQASGQNSIIIQHGANFEVTPADVQRAADLIQSADFVVAEFETPVDATAEAFKIAKAAGKMTILNPAPAQKDLPAALLKNVDLIAPNETESELITGIPVVDEDSMRASAAYYHELGIRGVIITLGSKGSFISLDGEATIVPAFKVKAVDTTAAGDTFIGALASVLQTDLKNIVTAATYASMASSFTVQKLGAFPSIPMGDEVRAALAKIK

SEQ ID NO: 506 - protein, 319 aa, Lactobacillus paracasei
MKQSLKRFLMVAVVATAALFTLTACGGTGLSSKSDSNTKVTKKAPKDLKVGVSLSTLSNPFFVSVRNGIQDLAKKNKTNVQVSDAQNDTAKQNSNIEDLIQKKVDVLIINPVDSSAITPAVKDANDAGIPVITVDRSSDGGKVLTLVASNSTKGGQMAAKYMIEKLGKDAKIAELQGIPGASATRERGKGFDGAAKGKLDIVSKQTAGFDRAKGLTVTENILQGNGDIVGIFSQNDEMALGAVQAVKAAGKKITIVGFDGEADGIKAVKAGDMAATVAQKPEEMGRLALQAAYDHFDGKTVKKNVESPLSLVTTEDANK

SEQ ID NO: 507 - protein, 326 aa, Lactobacillus paracasei
MQEQSKAKTSSKIDVKKIFSRLGPLLALVVLVILVTIMSPTFVSPANLLNLLRQVSINAVIAFGMTFVILTGGIDLSVGSILALSGAVTASMLASGFAAPLALLAGLVLGAIFGLLNGILIAYGKAAPFIATLATMTIFRGATYVFTNGNPITGAKMNSSFLFQFMGRGYLFGIPFPIIIMLVAYGVLFVLLHKTSFGRKTYALGGNETAARIAGVRTKMVTMLIYTISGLMAAIAGIILTSRLSSAQPDAGTSYEMDAIAAVVLGGTSLAGGKGRIFGTLIGALIIGTLNNGMNLLGISSFYQQIVKGIVILIAVLLDRRSSNNG

SEQ ID NO: 508 - protein, 524 aa, Lactobacillus paracasei
MSRFLRKANAFRKSKHQHVLGGITMKIEMKKITKSFGANRVLEGVDFTVESGEVHALMGENGAGKSTLMNILTGLYQANSGEILVDGQPTTYSGPMEAEQHGISFIHQEMNNFLEMSVVDNMFLNKELRTKFGLMDNKAMREQVAHYLSLLGAKLDVEQPIGNLSVGRQQMVEIAKSLMTDAKIIIMDEPTAALTETEIDQLFGVVRRLKEKGVGFIYISHRMEEIFEIADKVTVMRDGLSITEYATKDVTMKQLVKDMVGREIDDFYPDRTPDHGPVAMEVKGLTENGVFKDVSFTVHQGEILGFSGLMGAGRTEIMRAIFGIDKYQSGEILLDGKPVKIRDPQDAIRHNIGFLTENRKDEGLILEDSLHDNIVLPSIDGFVKHGLVDDKATDEFVRMLMKRLTVKAMGPDVSAGSLSGGNQQKVVLAKWIGSGSKVLILDEPTRGVDVGAKREIYDLMNELTDRHVAIIMISSDLPEVLGMSDRIAVVYEGKITGILDGKTATQESIMTLATGGVEEHAGAI

SEQ ID NO: 509 - protein, 130 aa, Lactobacillus paracasei
LKKGTVINTQLSQVIADMGHFDLLGIGDAGMPVPEDTWKIDLAVSKNLPSFIDVLKNVLSELQVQKVYLAEEIKTENPEQLKQIQQLIDVPIAFIPHDQMKQDLSKTKAFVRTGEMTPYSNILLESGVVF

SEQ ID NO: 510 - protein, 335 aa, Lactobacillus paracasei
MKKKISITDVAKETGLSVTTVSQILNGKGERFSEKSRKRVLAAKKALGYEPDFFARGLVGKRGNSIGVVIPDIMNPFFASFVVSVEKAAIPQGLFPQIFSINGFHENVDYFIRQFLGGTQRGLILAAPEASQEIVQKVEDQLHLPMVFMDQATTLTSGDSIRIDDFHAGSLVADHLIKRGHRRIALVLPEPLTFNLRDRLAGYQHAFDSHNVALDPQLIFRATFDPEGGRQAVDQIVKTDATAIIAINDDVASGVYRGLYEHHKRIPEDYAVVGFDDVSQARFMTPGLTTIAQPIDELGQRAIDMLLAQMAGDHQDRNVIELPVKLIERGSTNRI

SEQ ID NO: 511 - protein, 82 aa, Lactobacillus paracasei
MMSNELRSDWKDFAATAIAFLVSGAFMVFLIMPIPGFQEDLVLSGILAAIIYIIVLIVTLLALKKDEMKRFISFFKRQKSDM

SEQ ID NO: 512 - protein, 482 aa, Lactobacillus paracasei
VQEEELTPRRYMSWPVLSLLVFITVIGFENIFYPFQNQGLSVVVNWVILLVIYIVPYALISAQLGTTFTRADEGGGLATWIRRTLGDTWGYWTSWIYWAQTLPYLVDVSNAVIVALSWMILGDNSLGKRMSNLTFGLLTFAIILLFIVFENLFSRSLEVMSLIGGAAMFLMAVLFVVLTAAGLAKGMHSATNFSWAAFKPHFSLHYFATTGLLIFATSGAELGATYVAQLRNPKKEFPKAMWALALMTGFLVIFGSLALGVWFNANHLPDDLKMNGAYYAFSMLGQAWGWGKVLMYLFAITQLLFMLAQLAVLIDASSRVLSADTAMRFMPKWLLQKNKQGRPIHSYIFTASLCLFLLLLSGTLPNINAIFNWLLNLNGIVSPYKTALVFVAFLALRAQADKFTSGYTFIKSKAGAYLVGGWCFVFTFICATLGFLPQEVVFGTNGWTHQLVMNIISVMVLFGFGFIMPLLARRDVKKERLM

SEQ ID NO: 513 - protein, 275 aa, Lactobacillus paracasei
MTVNRTPQVVTIAGSDSGGGAGLQADLKTFQARHVFGMSIVVALTAQNTYGVQASLPIPAGFIDAQFQSLAADFDICAAKTGMLADREHVEAVVRNLQQVDFGPLIVDPVMVAKGGATLLASEAVVTIKEQLLPLADVVTPNLPEAEILVGKKIVTNADMVRAARMIQTLGVKHVIIKGGHRQNHKAEDLILLADGTCYWLSAPRIATANTHGTGDTFSACIAAELAKGQPLKAAIMTAKAFLQGAISQGISVGHGHGPTNHWAKLSEKVSLRQG

SEQ ID NO: 514 - protein, 213 aa, Lactobacillus paracasei
MNATDLKLYLVTHRYDDNEATFLAKIAAACENGVTMVQLREKMLSTRAYFELAQRVKLITDRYQIPLIIDDRVDICLAVDAAGVHIGDDELPVAMTRQLIGPDKVLGVSTKTVETAVAAVAAGADYLGVGAIFPTQTKANAAVTPIATLKAITAQVAVPVVAIGGVKEANLATFKDTGIAGVAIVSEIMQAPDIAHKVQALRTKLKAVLPNDR

SEQ ID NO: 515 - protein, 280 aa, Lactobacillus paracasei
MSKAITDVFYTAFKTALPLTSSPLVQCITNEITVESMANALLYIDAKPVMADDQREFPEFFAQSDALLLNLGHISEVRQQNLLAAGKFAQATNQPTVIDLVGVSATQLRYDLGHQSLANHPNVVKGNISEMRRFADLKSTGRGVDGSQLDQSATALGELAASLQQLTQAFPTTTFLATGKIDLVVSAKGTWYLKNGVPQLDRFTGTGDIVGALIAALLGTGLDNDAAVVVAVSYFNCCGEVAAAQNRTGGLAAFREGTLNQLSLLAATADWLQMVKGEAL

SEQ ID NO: 516 - protein, 166 aa, Lactobacillus paracasei
MTQSSVKKLAILAMMIALDVVLSPLFRIEGMAPMSSVVNVVAAAMMGPLYATIMAFGCALIRMALLGIPPLALTGAIFGALLAGLGYRFGKHNWWAAAGEILGTGLIGSLLSYPVMVWFTGSAQSLYWFVYTPRFFGGSISGSLIGLFVLYELDHIGITKRIQKIF

SEQ ID NO: 517 - protein, 230 aa, Lactobacillus paracasei
MKFSEKARQQVVPYWEGSFTHPFITELQAGTLDPAIFRFYLIQDAYYLQHFTHLYTLIAAQTQEPELKAYALQSAEGLAQGEIAIRHDFFAELNISTTELAATTIAPTTYHYVSHMYRQLVEGTSHVAIAGMLPCPWLYQEVAQQLQQRKSPVPIYQRWIDTYSGADNADDQRAAIALIDRLYDQSMPTEQQQMLNAFRISSQMEYSFWEMAYHIEAWPKGAKVDDPKQR

SEQ ID NO: 518 - protein, 215 aa, Lactobacillus paracasei
MAQKKTDALNLSLLILALTLEISFSHAVKLNVALIVLALGFLGWRRAFRSLIVLLLLPLIPAASSYWAITLHATDTSYALLLFVRTYAFTALGLVFLTGVDLEALLLWLEQHKLSPNFVYGLLVVIHALPQIMREVADLREASQLRGQKLRPWSPLIYVKVIFVAMAWQDQYVTAMYAHGYTEGGSRTIQRQLTSSRRGLLMAGAVFVMVNLIGH

SEQ ID NO: 519 - protein, 447 aa, Lactobacillus paracasei
MSIVLKAIRFHRETDLFTDLNFEFPTGALTVLTGDSGSGKSTLLSLIAGFAAMPYEGTILLDGHDDRNAAMQVKAQHVGMMFQNPDQQFTMRTLSGELSFALENLNLPVAEIQRRFAQAVALGETQALLNRDLSTLSGGEKQRAALTVLLAMDAPILLLDEPFASIDPTSRHLLIGKLGTLRDHGKTIVIAEHDLTDYADVADQLVALKNGALSRLPLATLTTLPTHFNLTQPRQATNKIFHLENVVCQQNHHILLQAPSWDFNDGITTLTGANGSGKSTLLRSMVQRHPYQGRMFLGQQRLRPRKRLYQTMTLAVQAAAKQFVTLTLADELAFGPALPAAVREKQQAALAYLGLAEKQTTSLYQLSEGQKKMVQLMTMLSLDLSFLLLDEPFSGLDDRACQYFAAWIKAKSATQAFLIVTHRLVPLAGISQQQVLLANQRLQVVQG

SEQ ID NO: 520 - protein, 188 aa, Lactobacillus paracasei
MDKWSLRDVVLLAFLAFLFGGVFMGADAIYAVVAAALTPLGYAPFVNELLFGMWVMAAPMTTMLLRKKGSSILGECFAALAEMLYGSYFGPAVLLSGFVQGLGSEAGFMVTRYRRYDVVSLLYAAIGTTVFSFTYEYFKLGYGAYSLRMILALVVVRLLSVIFFGVVLVQLVLKLYEQAAGAKHLASR

SEQ ID NO: 521 - protein, 82 aa, Lactobacillus paracasei
MGKPISHTLKKKVHKLVCGRCINDDHGLCGFVRDTGGCLNKASQSQYQTATSSGRIPQGARATPRKIGKLKAAHPSGESRGF

SEQ ID NO: 522 - protein, 229 aa, Lactobacillus paracasei
GNATFAMILYPRTEINMKTTIRPEQPSDYRQVETIHRNAFWNLYVPGADEHFLAHIIRDHTDFVPELDLVLEHNAQVIGNIMYTKAKLVDENGNEKTILTFGPVAIDPAFQRQGFGKQLMEVSMKRAAELGYDTIVILGDPDNYVERGFKSCQKFNVWAADNTQPTAMIVKVLKPNALDGRKWTYHESPAMSYDKEDATRFDTTFPAKAKGYQASQEAFYILSHSVLKS

SEQ ID NO: 523 - protein, 546 aa, Lactobacillus paracasei
MFKLKKWTLMLPLAALALVAAGCSSNSSSSTSQSKKAQTLNWSEISSIVTNDPSMSTDTVSFQMMTNTQEGIYRLTDKGQKTQLALAKKVTTSKDGMTYNVTLRNAKWSNGDPITAQDFVYSWQRTVDPKTKATDAFYFAPVKNASAIIKGTKPASDLGIKATDSKHLTITLENPTAYFKKMLAFPLYYPQNQKTVEKYGKSYGTTSSAQVYSGPFKLTKWNGASDSWTLVKNPEYWDKKNVKLSKVNETVIKDVQTGMNLYQTNKLDSIVLTGEQAAAHLNDKDAIKRLSSNMTRVDLNQKQVPAFKNLKIRQAFSMVVDRNAVTKNVLKDGSKPALGFVPIGLQTNQKTGADFAQTTQVKSAVAYNKAKAKKLFAEGMKESGQSELNLTLLADDADVSKQVAEYLQGAFESLPHVKVTIKSIPKAQRLQAMMSGNYDMVVTGWQSIFADAYNFLDVWISNSGYNTSGYKNTKLDQLLSETETKYGNEPQKRWTMLQDAEKILMNDQGTLPLYQANNLQLLRPTVKGVSFNPNGTPYDFKTAYIK

SEQ ID NO: 524 - protein, 415 aa, Lactobacillus paracasei
LTIHIDLPQLQADFIRYAKVNTRSYPGRDTTPSTPGQTELAKLLVAQLKDLGLQDVGLNPANGFVTATLPANTDKPTKSFGIIAHLDTADYNAENVQPQVHPNYDGKPIHFDNGLSLTVEQFPALKRYFGQTLITGDGTTLLGVDDKAGIAGAVATARYLLAHPEVKHGLIKFGFGPDEEIGTGADKFDAKGFATDFAYTLDNGDPGQIEYETFNAAQATVTIEGTSVHPGEAKDLMINANTLGRQLDAALPLFDRPEFSDGHEGYFLLLKFHGEISDAQLVYIIRDFDRQKFDARKAYFMKTIDELNAPFDHPRFKVEMHDQYYNMADIINKDPYPLRLAEAGIQAAGMTPKTIPFRGGTDGSKITYQGIPTPNLFNGGINFHGPYEVVSTEAMGKIAETLVHMAELNAAGTVD

SEQ ID NO: 525 - protein, 612 aa, Lactobacillus paracasei
ABCHPERNREGLATRLREQTIINALQTNGPMSAAALAATLGVSRRTLQSDLRQLNEDNTGFIITVTRNVGYQLTITDSAQFAAYQASLQDQAQPAMPAKRLPALMHVLLTTTEYLTVAQLAEHELISSKQLQRDLRELEKLLIGTPLQLERKAHYGIRLQGEWQSRIHALQQRGLPPHHQTLCQRLMPLGLDPAITAQFAGEVGWSLAVRGQTTVPAPTTAAFAGLLADSRLSEEAWQFLTVSFAAKHKQLTTRLDHDLLKTKLQAYFTALDTRHKTDFATHPEFLSLMYFHVLALIGRLQKHQSLAGLSLEPLARDYPIAFNWAVQFAQWLTREYQIAVPKTEIGYLTTHLLVPLEQAHEAWSRRLYKIAVLCGTGGGIATLLCLRLRRIFPEAVIQTFGLNELTAIHELEPDLLFTVTELTETFDCPVVRIDELASDLDFANLRHELSMAARSNNTDTLVDLLTPALFFQTSQAADYHALLLALTATMTSYCGQSDYAESVMQRENFLATIYDNGIAIPHPLSFNAEKNAVAVVVLPNGAGGSSRPVKLVWLIALKRDQLPLHRTLTTQLAALMQQPDVIEQLVHQTGFTRFINILRTALEGAEQTWIYN

SEQ ID NO: 526 - protein, 346 aa, Lactobacillus paracasei
MDLQLMAALSNADAIASNEGEVRTILRDYLKPVDLKVQTDGLGSLIFTKRTVKPAFSVMIYGHMDEVGYMVRTITPEGLLRLMVVGGVKPLASHWQSVRVTTVSGQKLPGMVIRDESLAAFDQILCDVGANSAAEVAALGITIGDMVTFSTDFTEYAADGVFGGKALDDRLGCYVGARLLQELAEDELPFTLRFAATSSEEVGIRGAKTATQLIQPDLAFIVDVATFQNPRERSEVNQRQVGSGPILTHFDRTLAPNRTLQQFVKETAATASLPLQLDMFNGGGTDGGEAHKVGVGIPTVVTILPCRYGHCAQSLAQAQDVDQMVALYAAMCRRLTVATAEKARSF

SEQ ID NO: 527 - protein, 110 aa, Lactobacillus paracasei
MATTQELEIMQLIANAGESKTKAFAALQAVQTQDFAKARSLLAEAKAIDVAAHNAQTAMICREFDPNHTPEPVSLLMVHAQDHYMTSQLARDLIETLITIFEAQTTKTNV

SEQ ID NO: 528 - protein, 112 aa, Lactobacillus paracasei
MRILLCCAGGFSTNMLMQNMAKVVKDSHKLNEDDFKFDAIPVDGLEEEIDNYDIVLVGPQIGHKTGYIGEICDPRHIPFAVIDKDVYGQMDGATVMKLALLTHAKYQKKHAG

SEQ ID NO: 529 - protein, 441 aa, Lactobacillus paracasei
MFSQFESFMNRFFMPIAHKVDNQRHLSAIKAGMVAMTPFTILGSIFTIIPALPNMLGPKNAVSLFITSNADLFDLPVKLSIGMIGLYACLSIAYNLGNHYKLYIPGCVTLSGFAFLMMVATFTKTGQLDVTNLGARGLFTGMIVALLTVELYHWCKTHHLTLKMPDGVPDFVSRSFELIPVTLITGGAFIAGRFAFLNFAGELPPSILTRFLAPLVGSMDNPWAVLLLNFAICTVFFFGIHSSVFSPITSPIMVTFIAENIAAMNAGEAIPHFYTAGAVSSFFGFTGCGISIGCVVACMLSKSKRYRKIGKISLFPALFGINEPILFGAPIILNPIMFIPHVFGGAIIGTLPMFFMHWGWIAKPIFNPPYVGVFLEGFLTNGDYRTIFANALQLVLAVALYWPFFKVMERAELKLEAKKAAKKSIFSKEDEDTLAGLDLDF

SEQ ID NO: 530 - protein, 359 aa, Lactobacillus paracasei
MTHLKKIQQALTMQAIDALLLHDRQSKRYVGALPGSGVYVVVTPTQALQFHDGRYRNEAADTSGFTNIEVPQGEYLPELVSFLSAQLCRRVALVSTGFSIPEFQTLTAQNWTLSLADSLLAESRAVKDAMEIQAITAACRVTDQVFAHLLPHIRAGVSEYELNAWLHFYALQAGTSAMAFDPIVASGPRGALPHGRATDRQLKSGELITIDFGVVLNDYQSDMTRTLTIGEPQPELSAVHDAVLTAQLTAIDALKPGVQAREIDAIARGVLTAAGYGDCFTHGLGHGLGLGGDQPILNPQSQTVLQPGMVVTIEPGAYLPGIGGVRIEDDVLITDTGAQVLNQTSKDLMLLEEQEYESV

SEQ ID NO: 531 - protein, 400 aa, Lactobacillus paracasei
MSQFDTLFDRKAGNARKWADSVLAKKFGLTPNAIPMDLADLDFPVAPPIHDAVMARAAVSDYSYTYIPDAFNETVIAWNARRFGLELEADWLKLSYGTVPTLHYIVQAFTAVGESVLINTPAYDPFAEAVEHNQRQLITSPLKLENDRYVFDFEDLADKMARPDVKVFILCSPQNPSGRVWTAEELEQVGDLCLQHHVLLVSDEIHRDIVYPGVHFTSIWQACPAIRDHSILCLSPNKAFNLGGLKTSYVVIPDAGIRDRLAQQFAANSITSPNSFAIPALIATYTKCDAWLDEMVAYVADNFVYLRDRFAEIPEMQVMPAESGFLAWIDVRRLFADEAELKRFFTACDLSCVVGSYFVADGEGFVRLNIGMPRPLLKEALDRILAIYATWHQQEAPVPK

SEQ ID NO: 532 - protein, 319 aa, Lactobacillus paracasei
VPAASTEATSEKEVSFFSEHWLDQRHAYIGRFHLDLNGGHVGPIKVSESKLHKMANAPTNGDWVKAEEIKDDELMRYKITTLKRDPLPTEIVRLQFLPAVYRQDVKRWYIEFQSPEHETTQQLLLGDYDVLSFKLKPGDYIDYAYRRGQEIDGKIVWKYTASAVVATRMKRQFAKSALEASAETKPSQPAPAKKKVSVAPVRQLRQVFADKSLLLVCIENSAMPRKVKRHVEDRGGKLILSPRSDSNAMLKKKVQKADMVIVTTDFVDHGQMYAAKDEAKRIGKPIWMAKNTNERNMLQWYKRHFGTQTADQDIEQAAE

SEQ ID NO: 533 - protein, 31 aa, Lactobacillus paracasei
MDDKSAIIELIKNQITAKTTQLTTDNIQKNN

SEQ ID NO: 534 - protein, 138 aa, Lactobacillus paracasei
EIIABCMPNENTMSKLVLISHGQLCEELKKSAEMIMGPQDDIATVALLPNEGPEDFQAKFKAAVEGQDDVVVLADLKGGTPNNVAARVLAEGGKFDLYSGMNLPMVISFLNAQMLDMKPDLIGDGKAGIAYINDIVKH

SEQ ID NO: 535 - protein, 273 aa, Lactobacillus paracasei
MMNSNKPTYKLTDKDFRQINRRSLFGFQLGWNYERMQGSGYLYTILPQLRKIYGDGTPELKKVMKTHTQFFNTSNFFNTIITGIDLAVEEKEGIAGEETVAGIKTGLMGSFAAIGDSIFAALIPAIFGAIAAQMATQGNPVGVFIWIAAQIAVMVFRWKQLRIAYNEGVSLVTTMAHRLAALTDAATLMGVFMVGALVATMINVKIGFAPKIGSVPLDFQKYFDLIIPKLLPALIVGAVYWLLGRKHMTSTRAIFIVLIVSVLLSALGVIAKG

SEQ ID NO: 536 - protein, 248 aa, Lactobacillus paracasei
MVLGVGTFGGASKIDANSGTILATAFSVSAGMKPEAAVAAIAVPVASIMIQTDILARFSNTFFAHRIDKMVDQNNYKGIERYFLAGALPWALSRMIPVGLALAFGGGFVTDLAHVLNTSWKWLGDGLATAGAVLPAVGFAILLHYLPLKKHFPYLIMGFVFTVLFTTLFGSVQTLGTAVAGVAKGFTASFNGLSMLAMALIAFAFAAISYQQTTKLHDIAVGNGNTDAASGTAANKTNEQGEITDDEL

SEQ ID NO: 537 - protein, 55 aa, Lactobacillus paracasei
MIAWWQIALLTLYAGYQILDELQIYSAMSSPVFAGLISGLVMGDMKAGLLIGAST

SEQ ID NO: 538 - protein, 160 aa, Lactobacillus paracasei
MAIIAARIDGRLVHGQVANLWTTKLGATRIMVVDEAASKSDIDKSGLRMATPDGIRLSVLDVATAANHILNHKYDSQKVFIVAKRPETFLALVNAGVPITDLNVGNMSQTDETRSITKSINVVDADVDTFKELDAKGVHLTAQMVPGDTAADFMSLLKKG

SEQ ID NO: 539 - protein, 598 aa, Lactobacillus paracasei
MTTFSIDHEFMLDGQPFKILSGAIHYFRVHPSDWYHSLYNLKALGFNTVETYVPWNLHEYNEGDFDFSGILDIERFLNTAKDLGLYAIVRPSPYICAEWEFGGFPAWLLTKKMRLRTDDPAYLQAIDRYYTALMPHLVGHQVTHGGNVIMMQVENEYGSYGEDKDYLAAVAELMKKHGVDVPLFTSDGPWPATLNAGSMADAGILTTGNFGSRADMNFDRLAAFNQAHGHDWPLMCMEFWDGWFNRWGEPIIRRDPEETAEDLRAVIQRGSVNLYMFHGGTNFGFMNGTSARKDHDLPQVTSYDYDAPLNEQGNPTPKYFAIQKMIHEVLPSQAQTTPLVKPAMRQADNPLTAKVSLFSVLDQLAQPVAASYPQTQEFLGQYTGYTLYRTNPLISGTDKGTPAKLRVIDARDRVQAFFDGKSLATQYQEAIGDDILLPEVEGRHQLDLLVENMSRVNYGSKIEAITQFKGIRTGVMVDLHFIKDYLQYPLDLNKAPQLDFTGDWQAGTPAFYQYGFDVVKPQDTYLDCRGFDKGVMLVNGVNIGRFWEKGPTLSLYVPAGLLHTGHNEVIVFETEGQYAEAINLVDHPIFKELNTEEE

SEQ ID NO: 540 - protein, 386 aa, Lactobacillus paracasei
MSYYIHAAKFFLKNVTEIGGYLEVTDDGKFGEYLPETAKPDGDIVEQSGKLIAPGLVDTHIHGLLGHDVMDNDWDGIETMSKNLLKAGVTSWLPTTLTGSFDQLNEVCKTIAAHAGDESGAKIQGIYFEGPYFTTKHKGAQNPKYFKNPSEQEYDAWQTSADGLLKKIAIAPEREGAADFTRYATADGTVVALGHSDATFEQAKACIEAGATVFTHTFNGMSPLSHREPGMVGAAMYLQGVDDELICDGHHVRPEVATTLIRLKGAEHIALITDCMRAGMMPDGDYVLGEFPVYVKDGMARMKDGDSLAGSVLELKDALTNLLAWNAATPEAIIRMASQTPAASCNIDDQCGSILPGRAADYLVLDADLKLEATYLDGKLGYQAEA

SEQ ID NO: 541 - protein, 393 aa, Lactobacillus paracasei
LFEKTTEELTKLGAQITTAEIKQQPELWQEAFDNYTNAKEKITAFLDQVTAAANGKTVRVIFTGAGSSQYVGDTVTPYLRAHGDRSKFEFESIGSTDIVSAPYDFLEADTPTILVSFARSGNSPESLKTVELAEQVVHNLHQISITCAPEGQLAKKSETEDKTLLLLQPAGSNDKGFAMTGSFSCMTLSALLVFDTASDTDKSKWVKAIAAMGQEVVAREAEVQKVLDLDFDRIVYLGSGSLGGLTRETRLKVLELTAGKYATMFDTSMGFRHGPKSFLDDKTLLFDLVSNNAYTRQYDIDVLEEVKGDGIAKSVMAVGTKQDQNFSGDAFYFENGLKDLPEAYQALPDVMFAQTVALLASIKVGNLPDTPSPTGTVNRVVKGVTLHDYAGKE

SEQ ID NO: 542 - protein, 238 aa, Lactobacillus paracasei
MEKVPLTKQLVDQLETFIKEKLQPNDKLPSERDLSELYQVSRNTVRAALNELFLRGFIYRSTGKGTFVAERFDERTDVSGSYSFTKQMLAMNRKPVTRIQRLEKIAAPAKIAKRMRIEPGTPVYVLDRLRIADTLPMMIERSYLPANTVPGLNQEALSKTPLYDWLEGHYGIHIVSVDEAFFAGLVTPEDAEQLRVAPASACLNIRRTTFADTGEIVEYTLSVARADQFVYHVHHVNH

SEQ ID NO: 543 - protein, 339 aa, Lactobacillus paracasei
MRISDLKRLFKKGVGILTEPLFLKPYFNPKIWGGRKLETEYGFDIPDGKIGEAWIISGHPHGPATIENGPLKGKTLREAWHEDPAYFGPQHSQEFPLLVKILDAEASLSVQVHPDDAYAAAHEAKGELGKTECWYILKADPGAYLIYGHHAKTHEQLKEMIEAGDWEHLLRKYPVKTGDFVYVPSGTIHALNKGIVALETQQSSDTTYRLYDYDRKDDQGHKRELHIKQSLDVTTVPFHDPKLDITKEQVTGGQITTFVKPPLSPHFAVCRLDVDGTMTFTQQASYTNVTVLDGDGTFSADGKDYPIKTGDSFLIPNQIKTWAFTGKLAIVTSTPGVDA

SEQ ID NO: 544 - protein, 569 aa, Lactobacillus paracasei
LKKHGFRFWLLAIVGLLGMVLSLSQPPKQVVAADNTLKSVFSIDAGRKYFSADQLKTIIDRAHTDGYTDVQVLLGNDALRLLLDDMSVTINGKTYGSDVVKQAIQAGNKAYYDDPNGNALTQTDMDAVLKYAAARDINIIPVINSPGHMDAILTAMAQLGIKNPAFNGSKRTVDLNNDTAIAFTKALLQKYVMYFKGHATTFNFGSDEYANDVDTGGWAKLQQSGTYKKFVAYVNDLAAMAKNAGLKPMVFNDGIYYDNNTSFGTFDKDLIVSYWTAGWGGYDVAKPEFLTDKGLKIMNTNDGWYWVLGRVDGDLYSYKTALASLASKKFTDVPGASSAVPIIGSMQAVWADDPSAQLDMPALLKLMDQFSTAYAPYLVRPADYSKVDAAIAAVPRQLNQYTEASVAKLDAALNAVVRGKKATDQALVDGYAQTITVAIKALQLRPADYTKVDAAIAAAKKLDRSHYQDLSAVDAALAAVNRNLNITQQAQVDTMAAKITAAIAALVLKPGPQPDPRQQQVPTKTIVNPDRYLPKTAEASGWGLMLAGLATILGVISIVFFWRQHRMAV

SEQ ID NO: 545 - protein, 231 aa, Lactobacillus paracasei
MEINVHKFQEAILDGSFEHTENHLTAAAFKKDGIEVGLTKVFADVRKAIDKQQLIQADLVIDFPEPTIITVETGIINLPFANVNKVTNFLEADEIVPVRVYLVVASPFVNVSGLRIDEIATAADYLTGFETLNKQMTASVHEKLDHIQEEMAKPKETAKPVPANKQKTPAKKTTRRTATKRTTTRKTTKKTTTAAKTSATKPAAAKKPAAKITKRTTKKAAPKTTRRTTKK

SEQ ID NO: 546 - protein, 429 aa, Lactobacillus paracasei
MKKTSFWRLLGLMGAVLLLLTACGKQGTATKSSSSAPVKITYWHRMTGTYDKSLNKLITKFNQSQKKYKIVATSQGSYNALQQKIMAAGKSKTLPTMAQSPYTNIGDYVKNKLLLPFDPEMLNGADKLSNADLKDIYPSFLSAGKYEGKYYGLPFSVSTSVLFYNKKLMSQYNISIPKTWADFAADQEKLKGTDVNAIELDQSYDVALEGMAYGAGSQLITPKLKANLNAPKTLAAVNQILDLRKSGALKTAGEDQYFSVPFANGKAVFGIGSSATVPVLIQQAPKDLDWGTAVIPTYEGKRSNPLNGNYNVLFKGASKAQQAGAWAFQKFLLKSENASQWAMDSGYVPVTKTASNSTTFKNYLQKNDKYKAAVSAVSQSFASTVFTGYTDYRNDLMSTVDSTLTKNVSGETAFNNLQKQTETILKENK

SEQ ID NO: 547 - protein, 794 aa, Lactobacillus paracasei
MANNRIGIREFVELTVRTGDLNPITSNSNNTAIIGSQIHRKLQAAHRESDYEKEVYLKTAVTVNDEDYQLEGRADGVWTDDTGLTVEEIKTSARPWEEATQNTKDRYWAQARIYGHLLCEQRHLDQATITLVYVQTSTDTVSRFSEIKSAAELADDFTDLLEEFRDWLKLRSDIIKRRNTSIDQLNFPFPQFRAGQHELAAAVYKAIYSQARLFVQAPTGTGKTISALFPTLKAMGTGLIQRAFYLTAKQSTRRVAEQAMALMAQAGLTAKSITLTAKDTITFADEPDDPSKNPYMLGYYDRLKPALHDLLEHEDQLTRPVIETYARKHRLDPFEFSLDASLFCDVIICDYNYLFDPLVFLQRFFSEKDDSNFFLIDEAHNLVSRARDMYSAAITDQDFVQLKKALTPYKGAPLTKVRRAMTRILNTLDATTSTLLTSQPTIFQDDPLDDLTAVLFRFTEVVHDWLSEPPTPALQPAVDLVLPVFFLANQYLRIGDFYDATFKTEVTKENGQIMVKELCLDPSQFVDEALKKGRGAVLFSATLSPMAYFQKLLGGIDNSLAYTLPSPFDPAKQAVIVDASVNTTYRRRTQDLPQLIASLTTLVRTKSGNYLFFFPSYAYLKTAYEAFTAANPDLRVCAQENAMTEADRQTFLDYFQTGSEPIIGFAVLGGIFAEGIDLKGSRLIGVAIISVGLPGINAETDQLRAYFDRANGQGFAYAYQLPGFNNVLQAGGRVIRGTKDVGVILLIDERFITPRYARLFPDHWTHAQVSYNPTQLAQLLTHFWEAHHENTAHA

SEQ ID NO: 548 - protein, 226 aa, Lactobacillus paracasei
MKTQLTLDLEKTLYAYWQEQGATVVEEVTMPDDRGIVDTLVRQKQQDATIWRCFELKVTKADFHSSAKLSFIGHYNYFVLPQRLYTAVASEIPHGIGVFTYHPFSKAAIAASAVPVVTPGTLTIAKPARRQELQVPEATLTDHFIASLNREVVKAKQVAKGLGQFSAADLFTELKKRSADYDIYHPDKNLYDQFVSELDNTTINALQEEIDALNAELATVKMDISK

SEQ ID NO: 549 - protein, 282 aa, Lactobacillus paracasei
MNYFPIIRGKLYDLAAVTQLVADHQLPNTVTPIIEPVKDIAGVTKATSAMAHAAHPGYVIQNPQVGNYQLLAAPRHLAVLSHTVQPARIFDAQPAALVIATTAAQAKLLPKRQLALVPDEARVRQLALPHAVYLNDHFTVYPHTDDYGILQDEFYQYAPPSLPGIGFADYPLATSAYFEHGYPQRAVAIHLVYPAEDGTLRLHHFVSVNNDDFANPQAKFFEVLAQLAAWLPFHLDAQTTGTAAFMDAANRHHFPGLGVVRKYQLMHHLELIGRWLQTSTQR

SEQ ID NO: 550 - protein, 464 aa, Lactobacillus paracasei
  misc_feature (5)..(5): Xaa can be any naturally occurring amino acid
NADHXIDASEMKILVIGATHAGTFATQQILTEHPDYDVTVYERNHNLSFLSCGIALWVGDHVSDPEKMFYSSPEALAALGANMQMEHDVLAIDPVAKTVEVKDLKTGNVTTDTYDKLVYTTGSTPIVPNIPGIHDTDVHLCKNWHDAKALKALAPTIKSAIVIGAGYIGAELAEQYALTDKQVTLIDGLPRVLAKNFDATITDRVEKLYTDHGVNLALGEMVTGFTQGTDGEMTVTTDKGSYTADVAVLCTGFRPNTELLKDHLETLPNGAVITDAYMQTSDPAIFAAGDTATVHYNPTGKNDYIPLATNAVRQGILVGKNIEKPTEKYLGTQSSSAVELFEHAIAASGMTTEGAKARGIEVASVTIEQDYRPDFMLTTTPVLCSLTWDPKTHEVKGGAFFSKHDISQSANVISLAIQTHMTIETLAMVDMLFQPNFDQPINWVNAVAMAAVAKAQEMEKTPVA

SEQ ID NO: 551 - protein, 62 aa, Lactobacillus paracasei
MLENNLVLKNFSCIDDSELAESQGGIGVVATGVIIGSLTVFLSGVFSGFTDGMTQEKKPATV

SEQ ID NO: 552 - protein, 54 aa, Lactobacillus paracasei
MNQKALNQFPELTYTEQVSVVGDDLSVEVIMKGIFTGIFDAGYQVGQSIAKWVK

SEQ ID NO: 553 - protein, 493 aa, Lactobacillus paracasei
MVDAKKVLSVTAGFVGAAGLATLATGANTVSASTGTVNYKSGATTVWNSPSWHQVKRYVTFGDKVQVLGQKVDRNGATWYKVGDNQWIPGIYLNFDGKTVTVQAPEQTASQAPVSQAPASQAPASQAPASQAAAQPDTQTANIQLYVKNIGSAVTVWATPAYSQATGQYLEGNQTLTAVAQLQANGETWYRLANGGYVPERFASTTPAPAPQSSAATSVAAPTVPVSDATASNAAASDAAASSAAASSAAASLAVASEAAASVANASSAAASSAAVASAAAESSTAAESSAAAESSAAASKAAADSSAAAVQTTTPESSAAPATTQVDATQEQQQQAEPSITVNAEETTNNATPAPTPTPAPTPAPAPVTPSRQAKIQAVISIAEQQIGKPYVWGGKGPNSFDCSGLMYYAFLNGAGVNIGGWTVPQESSGQQVSLSALQPGDLLFWGGHGSSYHVALYIGGGTMIQAPQPGENVKYTALAYFMPDFAVRPSL

SEQ ID NO: 554 - protein, 238 aa, Lactobacillus paracasei
MSTHIDAPKGAIADVVLLPGDPLRAQYIAENFLDNAQRYNTVRNAFGFTGTFEGRRVSVQATGMGIPSISIYVNELIQDYGVKTLIRVGTAGGMGENVKVRDVVLAQGSSTDSSIILNTFGAGLYFAPLADFNLLREAANLADTSAIRYHVGNVLGEDRFYNDEMDRQKLIDYEVLATEMETPALYLLAAKYHVHALSILTVSNHLVTGEETSAQERQTSFNDMIGLALGVAKTVPDR

SEQ ID NO: 555 - protein, 396 aa, Lactobacillus paracasei
MAFDRIITIVLDSIGIGEAPDAAKYDDTGADTLGHIGAYFDGKLALPNLQAIGLGNIARPTPIAGVTALGSPSGYFGKMAEISAGKDSMDGHWEMMGLPVTEPLGYFPKGFPAELIKQIEEFSGRKVVLNKPYSGTEAIKDYGEQQLKTGDLIVYTSGDSVLQIAAQTDVIPLEELYRICRYVRSITIDAPYRIGRVIARPYVGTDPTTFTRTSDRHDYTLKPDKPTDLDRLQGAGIATYGIGKINDIFSGQGLDDGVHTTSNVDGMEKTIEAVKSDRRGFVFTNLVDFDAMYGHRRNAQGDGDALMTFDRQLGDLMTVLRHQDLLMITADHGNDPTFRGTDHTREYVPLLAYSKQLPGNGDLGIRSPFSDLGATILDNFGVTGNQVGQSFLKLLK

SEQ ID NO: 556 - protein, 221 aa, Lactobacillus paracasei
MAKPLAKYIDHTLLKPDATQDQIDEVLAQAKQYGFASVCINPYWVVRAAASLRDTDVNVCTVIGFPLGANTTQTKVFETGQAIDEGAQEIDMVLNIGELKAGHDDHVRADIQAVADMTHAKGGLLKVIIEAVLLTDDEKVTACKLAAAAGADYVKTSTGFAAGGATVHDVALMRKTVGDKLGVKAAGGIHTYAEAKALIDAGADRLGASAGIQILKEAGEA

SEQ ID NO: 557 - protein, 227 aa, Lactobacillus paracasei
MTNLPPNLTSKLRTDIVQAPSAIKAASGITLFGKKIRSIIYTMDVAVIANCDADAILAVYPWTPNTRILQAVATVANVPILAGIGGGLTKGLRAATIGAFAEESGAQAVVLNAPTPIETLINVNRVVDVPTIYTIVRHMDDLNARIDAGVAAFNIAGGKETANLVAEVREAIDSKHPNFPIIASGGKTDQQITATIEAGANAVTFAAYGVTEATFHAKMEAYRKQKS

SEQ ID NO: 558 - protein, 438 aa, Lactobacillus paracasei
MSNLMQRLLPVLVNNSVRLRHTRIYRALQQTLAVIFPFILVGAWAQMLTQSVFSRNGFFAVIYHLDTVIPYYNQIRTILMSIQTVTLDLMAVMAAFFVAKFIARSYGKDDSLAALTSVGAFMILNLDSRRNGQSPFQMNNFGYRGLFIAIFFGLLIGWLFRFTRADLEEPTHRYTIAALVDRGLRGTWLTVVILVISVAINYSLSRISTEGFIGLFYIPFQIPASSLSHVSIRLALVTTINALMWWAGIEGPINPLTVQAGSTTSTANLNYALEHNNLFNVPNPITIGTIYHPFASFGGVGMTLALIIATLWVAKTRPLRRIAGMSLLPSLVNISSPIMIGWPVMLNPILLVPFLIAPLVNMTIAWAAIRLRLMPPSVYTIPTTTPGPLAAFLGTNGNWVSLIVAILCLAISVLIYIPFVRLAETINLESAKVGGHHD

SEQ ID NO: 559 - protein, 300 aa, Lactobacillus paracasei
MIKHWRKWLLLLVSVLAVTAIMLPATSWMEQNVKSARVVHNSRMQPIILIPGSSATEDRFNTLITQLNAQTTGHSLLKITVKTNGTLTYSGKIAARDTEPYIVVAFENNKDGYNNIKKQAAWFNIAFKQLAKTYNFNRFRGIGHSNGGLIFTLFLEKYYSDSDVRMTRLMTIGTPYNLEESNPDNRTQMLNDLITSRNKLPSSLTVYSIAGTENLDGDGTVPIESVEAGKYIFQNQVAHYTQITVSGDEAGHSSLPQNRQIVNLISQYMVATPNQQGIRPGQGGSGRGVGQAPGDTGQNP

SEQ ID NO: 560 - protein, 237 aa, Lactobacillus paracasei
MLEVKHLVVNYGGIQAVKDVSFSVQTGEIVALIGANGAGKSTILKTISGLLRPRSGIIDYEGQKINGMAAAKIVKQGISQVPEGRHIFAGLTVAENLQMGAFGLKDKQAAGEQITMVYDRFPVLKERQHQDAATLSGGEQQMLAMGRALMAKPKLLLLDEPSMGLAPIFIQEIFDIITKINAQGTTVLLIEQNARQALAIADRGYVLASGTVKLTGTGEELLADPAVQATYLGMQVP

SEQ ID NO: 561 - protein, 261 aa, Lactobacillus paracasei
MTQQLVIDHVSKVFGGLKAVADVTMTIEQGTLIALIGPNGAGKTTLFNMLTGESGPSSGTITLYTADGPVDITKKKAYQVAKLGVARTFQNIRLFGAMTVKENVLVARTHLYRESFIGTMLRLPQFYQQEAAVATAADELLDFFELADVADEPTASLPYGTQRRVEIVRAVATKPQLLFLDEPAAGMNPEETADLGRLITRIREHFGITVVLIEHDMSLVMKLAESIYVLDHGAMIASGTPNEIQTNAQVISAYLGGENHA

SEQ ID NO: 562 - protein, 316 aa, Lactobacillus paracasei
MFKNMRSKLIWLATMIAGFVLIDIGELTGVINGFIENALVTIGINIILAVGLNLIIGFSGQFSLGHAGFMAIGAYATAIITQNISTPLGFYLAMLVGMIVAIIAALIVGIPTLRLRGDYLAIATMGAAEIIRVIINNLKITNGPAGMFNIPPLASWPTIYILMCVTTVIVVNFIHSRAGRAVMAIRDDDIAAESIGINPTKWKLAAFVLGAATAAIGGSLHASYLQTIAPGDFGIMNSIALLIIVVLGGVGSITGTFVAAVVLGIIDTVLQNFGTLRMVIYALALILLMVFKPAGLLGHYELSFKRKRQIRKGAAS

SEQ ID NO: 563 - protein, 292 aa, Lactobacillus paracasei
LQTLMQQIINGLSLGSIYALLALGYTMVYGIIKLINFAHGDIYMLGAFWGDYAINYLHFSFVPALLSAMVMAALSGVLIEYLAYRPLRNSPRIAALITAIGVSFFLENGMSFLFGANARNFPQVITTKTYQILGVDVSNVQLLILFTSLVLMVMLQFIIKQTTMGKAMRAVAVDPEAAQLVGINPDHVISFTFALGSALAGAAGVMIGLYYNSIDPLMGMVPGIKAFVAAVVGGIGSVPGAAVGGFLIGLLETGVQAVGLSAYKDAAVYLVLIIMLVVLPAGLFGKRQREKV

SEQ ID NO: 564 - protein, 397 aa, Lactobacillus paracasei
MKKQIVKAIMSAGVIAASMLALAGCATKSATSKGNTAGNTIKIGVNMELSGAVAGYGEQQKQGIELAVKQINAAGGIKVGNTKKKITAIYRDNKSSTSGAASVAAQLANTDKVVAIVGPATTNDGTASIPNVTKAAVPMVSPSATDPNFTLQKNGSVQPYVFRACFNNDFQGDHAAIFANDTLKAKNVAIIADNSTDYGTGLAKAFKKKFKGNIVTTQYYQSGDKDFNAMLTAIKSKKIDAIYAPGYYSELGLVIKQARQSGIKVPFIGADGMADPKLAQIAGAANATDIYYTTPFSTLSANSSKLVKNFMTSFKKQYQTEAPTFSALAYDSVYMIKQAIEDQKAADSASIAKGLAKIKQMPAVTGTTTIDSHHNPEKPLAVEQLTQGKIAKVYTVK

SEQ ID NO: 565 - protein, 85 aa, Lactobacillus paracasei
MITKESQLIFSEIFIGNLLNVYFDDNLTPGNNFLRGNACLSQPSILIKLLEQKEFVFVVSLVKSQIKKDVLTLKGKNVLFLQYPS

SEQ ID NO: 566 - protein, 152 aa, Lactobacillus paracasei
LQWWFALLVQLLFSYLATVAFAIIINVPRKALNLAGWAGMMGWLAYWLLMEVGSGRMMANLVGAFVIGLCGIFFARYKKMPVIIFNIPGFVPLVPGAVAYQAVRATVLGDLDGALQYVSRVVMIAGAIAVGFMLAQLLSEVLYKRAVLKPKK

SEQ ID NO: 567 - protein, 258 aa, Lactobacillus paracasei
MTHSVERQDTAIQNQVLATCLLAGRIMIEGGSEMYRVEDTMRRIAVNAGEPQTLVFTTPTGIFASIENQPYIQERPISKRSIDMEKVTRVNQLSRSFAADQIDLDELHAALIKLDQNTPFFPIWLQVVSAAVVSMTLMVLFAQQYDWLDMPLAAAVGALGFLVDIKVNAVTNIRFISELLGALVVGLTAWLGVRLGLGHNLDFIIIGAIMPLVPGVAITNSIRDMLAGHLLSGMARGMEAILSACAIGVGIAMIFRFF

SEQ ID NO: 568 - protein, 110 aa, Lactobacillus paracasei
MEGDHIMAIEATKDNLKALTAEGTVVVDFWAPWCGPCKVLDPMLTALEQELPALKVVRYNVEKDHTLPSTMGIMSVPTLVIYQQGEAREKVTGVYPKDKLKRYFEQKLEA

SEQ ID NO: 569 - protein, 338 aa, Lactobacillus paracasei
MAKKIILTGDRPTGRLHIGHYIGSLKNRVELQNSGEYEPFVMIADTQALTDNANDPEKIRHSLLEVALDYLAVGIDPDKTTILVQSQIPALFELTAYYLDLVTVNRLERNPTVKAEIKQKAFGDSVPAGFFIYPVSQAADITAFKATTVPVGDDQEPMLEQTREIVRTFNRTYHKDVLVEPEGYFPPKGLGRLPGIDGNAKMSKSLNNGIYLADDADTVKQKIMSMYTDPGHIHVEDPGKVEGNVVFTYLDIFDPDKQQVAELKAQYQHGGLGDVKIKRYLIDVMEAVLEPIRTRREHYAKDMGAVADMLKQGSAKANVVANQTLQEVRDAIGFNYFK

SEQ ID NO: 570 - protein, 202 aa, Lactobacillus paracasei
MKTKRLSPVAVTSIVLGVIVAICLIFGIGTYNSLAKQNQAVEAQWGQVENVMQRRADLVPNLVNAVKGNMGQEQKVFGDIAEARKSYANASSTTDKAKADDQLNKSVGTLINVIKENYPTLQSSNQVNTLMTQLEGSENRISVERKRYIDQVRDYNQSVVTFPKNIFASMMGLGKKDTFKATPAAQTVPSVNFSTNSSSSGK

SEQ ID NO: 571 - protein, 286 aa, Lactobacillus paracasei
MRRHLAWFVAALTGLLLFTGAAQPVAAAEDLPARPTEHYYLDQDSVLDESTKQLIDSKNQYYQGTKQQPQIAVAALKSTHGDPLSDYAPDLFQKWGIGKKGTDNGVLLLYANNGGKQNMRIEVGYGLEGDLPDALAGRILNDNLKDIKSHDPKELNQAIRKVFNAVATVIDKKYKFPKDQNTVSDETMNQYRNSSQDSGGNFLTKIVFIFIAVVVVAIIFGSRGGGGRGGRRGRGDSSFWLWVILDALLSSGRRGGGGGFGGGFGGGSGGGSSWGGGSSGGGGADV

SEQ ID NO: 572 - protein, 451 aa, Lactobacillus paracasei
MRNLTIGKPLKLIVLFTIPLLIGNLFQQLYSFMDALIVGRTIGKDALAAVGATSSIVFLIIGFAQGTTAGLSILTAQAYGAHDYRRVRRSFGTSIWITVGISLILTVAAVTMTRPLLTVMQTPPDIMDGSIAFVRVIYFGIIASMSFNLLSNMLRALGDSRTPLLFLIIATIINIVLDFWFILGFHSGVAGAGYATVSAQVIAALLCWIYIRMRIPLLMIRRRDLRFDWHDIVQHLKVGLPMGFQMSIIAIGAVILQVMLNTLGTNAVAAYTAAGRIDQLATLPSASFGVAMATFAAQNLGAKEYGRIRRGVYQTLMVNVGLSAVLGVVIILFSKPLVNLFLGPNQPAVTALAQTYFHFNASMYWLLAILFTIRNLLQGLGQTLVPTVAGFFELGMRAFAAIFLVVPFGFAGASAANPLAWFGSVLVLVSSYVRTMRRIRQQEDELAGHQD

SEQ ID NO: 573 - protein, 166 aa, Lactobacillus paracasei
LIEFTPATASDLPKIVAIYNETIPTHQATADLQPQTVAEKQTWFAAHNNHFPAWMIQVDHKIVGWLTLSAYSDRSAYDQTAEISLYLDVAARGHHVGSAALAFVDREAPKHDLTTVLARIFGHNQASRNLFTKFGYDHWGHLPAIAILPEGEADLEVYGKHFKSRA

SEQ ID NO: 574 - protein, 274 aa, Lactobacillus paracasei
MEKRLDYITDLMALGPTANARTIQRRQTAHRLAIAEAWQVKPGEKILEIGCGQGDLSAVLADQVGSAGHVTGIDIASPDYGAPLTLGQAWNHLLAGPLGDRLTVHFNTNLSDDLGPIADQHFDRVVLAHSLWYFASANALALLFKNMAAVCDHVDVAEWSMQPTALDQIGHLQAAMIQGLLYAIAPSDVANIRTLITPDTLAQIAHDNTWTYTAGTIVEDPTLDDAHWEIATTNALLTELKLSTDLRDRVKPLLEAMSHNGTASLATFTGRITF

SEQ ID NO: 575 - protein, 310 aa, Lactobacillus paracasei
MKMIDLGRSGLHASAIALGVMRLPNLDRPRATELLDAAYDVGINFFDNADVYSNGKAEQLFDDALKKASFTRDQVLIQTKVGIVNDRKATHRYDFSKEHIVDAVNGSLKRLGTDHVDSLLLHRPDPLMEPEDVAEAFLQLQNEGKVRQFGVSNFNPAQIELLQQAVPQRLIINQLQFSLMHTGMIDAGMHTNMADARSIDHDGGLLPYSQQHHMAIQAWSPFQYGFFEGVFIDNDKFPELNALLQKLADQYTTNPNAIAAAWLLRVPADVQVIAGTTKPARIRAIAEAGDIALTRQKWYDLYFAAGNDLP

SEQ ID NO: 576 - protein, 509 aa, Lactobacillus paracasei
MANNIQGFVMIGAQAIVFSITNLRTLKTIERGRYPVAIGDDFYAEHEILPDTVDAIVQAFDAINQIFKDYGVPTVNVFASTSWAEADNAEFVRDQLYTRTGWLIKTTSLSEEAFFRTQAIMVKFPQFKSITQKGTVLIDISSGSVELTTFSNGVFGFSRNLSLGPLRVYEIMSDVQRSVTNYVEVMRDYIDSRLLDFMRLLPQGVEYTNMILMGSNLSIFQNIIPEGKHQVETDRPGFDLLYDEVTKASDQYLADTYDLTSDQTSLVLPTVLLVYRLVETLNSQSIWISDLKAIDGIEVNAAHEGGFKKLGFDPNEEIVISANNLAERYQVDEAHMQATRTVALQLFDRLKKLHGMGKRERLLLEVAATVSDIGSYIETHKHYAHSNYIIKASEIMGLNDLEVTMVATITRFHSSITPQSDLKNFPTMSTENRLVVAKLSALLRVADSLDASRQQKIQQLRVSVKPNEVLLTARADDDIELERWTLARKGKFFSEVFGLGLELKGRNIL

SEQ ID NO: 577 - protein, 720 aa, Lactobacillus paracasei
MKKLDFSKPRYFNNRELSWLAFNDRVLEEARDKNNPLLERVRFLGITQSNLDEFFNIRVASLKKMVTVNYDQPDAAGLKPQEQLDAISETAHAMVEKQYTTLVRSLLPKMSAVDIQLLHASELTEKQHDFVSDYFHYELYPVLTPMGVDPTRPFPFLGNNSLNLAIRLVRPDDKGDKSRSFAMVQVPDVFPRVLRLPGGDNVFILLEEVVRMFVSELFVGADIKETATFRVTRDMDMDVAEEDASDLMKEIQSQLKKRQRGKVMRLEIEAGMSKHLRKRLIKAMNVKDEDVYEIHGPIDLNFLSKLVKQVHDHKDLLFKPFTPYMDPDFKKESIFDVIKDRDVFMQHPYDSFQPVVDFIREAALDPQVLAVKMTLYRVSSKSPIIRYLKKAAENGKQVTVLVELKARFDEENNVHWAQELEHAGCHVIYGLVGLKTHCKLALVVRREEEGIKRYMHMATGNYNDVTARLYTDMGLFTCNNEIGEDASNIFNMLSGFSEPPYFHKLVIAPLGIRDYLMDRIDEEITAAKAGRKALIQMKMNSLSDTAMIEKLYEASNAGVEIHLLIRGICNLKVGIPGVSDNITVHSIVGQLLEHSRIYYFYADGQENVYLSSADLMNRNLSRRVELLFPILQDDIRERIIKIFSIMWADNVKTRILQPDSTWVRAQLRGVTKLNAQAYFIEHAEAMGEALRREEVDDAPEDLHATHTFIPITAPKEDDDA

SEQ ID NO: 578 - protein, 313 aa, Lactobacillus paracasei
MTHHFAVIDLGSNSARMTIWEIEQEVVKPIKRLKEMVRLSEDMGPDRVLQPAAMDRTLKALQGFKTELNKYADIDLKAVATAAVRQAKNQKEFLKRVKNEAGLIINVIPGTREAEYDFLGVINTLPIQNALIMDTGGASTELILVQNRKLQHLVSIPFGSVNLSERFLNPDVISAPEYFALSTFIHETFNSIWWLRRAQNLPIIALGGSNRTLAKIERRKEKMADFEAIHGYRMPTKQANAIFKEILGADLATRESIPGLSKFRADIIVGGLMPVISMIRYLDSDRLTFSQFGLREGALYDHLNTRAVTQREH

SEQ ID NO: 579 - protein, 344 aa, Lactobacillus paracasei
MRRFLGWRTHLKGWILLMKKFMKWLGLAVAGLALLTAAPHVVRADTWSQPVATIGSSLTADQKSGTLSTLQNAAGVNNASQLTVNGATLVKYLNPSGSTFTESSGVWSSALVQKTDNGGINVKIVPYNGTNNITTITADQYRNAALTAGVSNANLYITSAVRIDGSGALAGVYAAFAQNGENLNNQQINAAQQEVNTLSSITQANKDKDGYSDKQLNNAVAGAKQQMASQSNNGQQTLSQNQIGNIVDSQLKQNNLTTIINNNQRQLIINLLVNVQKAGSLKNNDFKAQAGKLADSIQNSAKGLFDKLNKSLNTEENRNFLQKIWDGIVSFFNGIAQWIQSLIK

SEQ ID NO: 580 - protein, 92 aa, Lactobacillus paracasei
MIPAILTTTEGSGNGHTLTGAILIGAVVAVIIILFLVIKLLGAILRHPFISLILFALGGFAIFKFALVGIIGVGVLAAAGAGALWLNTGDGS

SEQ ID NO: 581 - protein, 169 aa, Lactobacillus paracasei
MKLSVPLINGQLADRYGKHASGSDVKNGYPITSFPFTIEDAPAETVSFALWFLDYDAVPVGGLPWIHWNAANIPADSTTFPAGASHTNKVPMVEGKNATAGRLVGNTDPFTQAGYVGPQPPDKDHDYTLIVFALDTKLPLQAGFWLNEARHAMKGHILAQAEIDLPSRV

SEQ ID NO: 582 - protein, 40 aa, Lactobacillus paracasei
MTQTQPFTPEAAYAPVSNRGRSRSVLNTVADPETGPAHAL

SEQ ID NO: 583 - protein, 308 aa, Lactobacillus paracasei
MQEDVETLLNEIKEHYDHPLEVDISGEASGVLTHDQSHQQLKKDGTLVVAVTDTTNVDYTLSHELLHLLFQMKGYPQLQFHLLSGDPQVDDQLYATSTSLYNAAVHMLVVAWQRDHNLLTDAAVAQVLAGFKQNVPAEADDQLVIYRVLSLLDLLGFLNGELPAELANAYPQALPLARELYDLLDAQKLDSPFGLRRAIVHLLARFDTVIERLGYQPTNDAEFATVTPVLSHRQLRLTLDQVYMIKHSGYRDRETKEPAYVAMGRSDEQNAFVLPLPEKETTPEAFQQLYQQSLNDILTQYRLDYTIR

SEQ ID NO: 584 - protein, 48 aa, Lactobacillus paracasei
MKSFRWSHVISYLIMVIVLVFFAFVLYQVIMLGVHSVSNSFFINFGRH

SEQ ID NO: 585 - protein, 230 aa, Lactobacillus paracasei
MFDLQTAIQQAKHVTFMTGAGVSTASGIPDYRSKGGLYADQVDPEYALSIDNLQAHHEDFHKFVVNNMYFPAAKPNVIHEKMATITNQKGTIVTQNVDGLDRKAGAEHVVEFHGNLYRIYCQTCHKHFDYETYLKSDVHAADGGILRPDIVLYGEPINPDTVSAAIEAISTADLLIVVGTSFVVYPFAGLIGYAQPEATIVAVNREKIALPEGAHMVQGDAVNVFAKLVV

SEQ ID NO: 586 - protein, 202 aa, Lactobacillus paracasei
MNKGRLEAFTDAVIAIILTILVLELQPPHSGSLASLWQLRGVFAIYLVSFLTLIVYWNNHHHLFQLVERIDWRVMWANSFFMLVVSMFPFATSWVGEGHVGTFGPELAYGFVILMANISYVLLVQTLIRVNGPTSALADLYRQRHNWKAAASVAIALVAMLLALLWPPLTIILDLLMLLLWAIPDQRIERHLMADSKKKSRQ

SEQ ID NO: 587 - protein, 301 aa, Lactobacillus paracasei
MARTIGIIGIGHVGVTTAFNLVSKGVADKLVLIDKKAELAEGESFDLKDALGGLPTYTDIVVNDYDALKDADVVISAVGNIGAISNGDRIGETKTSKVALDDVAPKLKASGFHGVLLDITNPCDAVTSYWQYLLDLPKSQIIGTGTSLDTYRMRRAVADTLHVNVADVRGYNMGEHGESQFTAWSTVRVNNEPIAEYAKVDYDQLADDARAGGWKIYQAKHYTSYGIATIATEMTQAIISDAHRIFPCANYDPEFGIAIGHPAMIGKQGVIKTPTLKLTDEERAKYVHSAGIIKDTFEKMK

SEQ ID NO: 588 - protein, 174 aa, Lactobacillus paracasei
  misc_feature (4)..(4): Xaa can be any naturally occurring amino acid
NDIXDMAINPRTEINMVKKYTLVTVETPSGWLLINRTNPPYRGMWNTLGGKFLPNETPATCASRELQEESHIIIPPHDLINGGRVFWHVDGELRAELFAFFGHTEDELVMPRATREGILATFSKDWLLADNPGLVPDLQPLLHYALNGERHDYASYFTGDRLEDFRIADGEIDD

SEQ ID NO: 589 - protein, 270 aa, Lactobacillus paracasei
MINVGLTSVADHPELATRGNRSTFSDYAQHFPVLELDTTFYGLKPVEQVRHWQAQVPSGFQFIIKATRTMTKHEESADTVADFSKFNDMVAPLVASHQLQAVLCQFPPYFGVTAENVRYLQQLNRLLPDLPVAIEFRHPSWYLPAYRANTMALLQAAGDIHVIVDEAQTTSGSVPLVPIATNADLTMMRLHGRNPAWGRTGAKTTERTNYRYSQEELQQFGIIAQHLKSKNVTVIFNNNGGHDAAANAQSLIDLLGLDFPGLAPRQLDLF

SEQ ID NO: 590 - protein, 292 aa, Lactobacillus paracasei
MKIQEGYMPFHEYKTYYRIVGEPSADKAPLLLIHGGPGSSHNYFELMDDYAETGRQLIMYDQVGCGKSSLPEDPAVYVKETWAEELIALRKYLHLDELHMLGQSWGGMLEMYYLTSFDPQGIKSVMIDGSPSSIKLWIQEQHRLIKYLSYEDREAIAEAERTGDFTNVKYLAANDRYMEKYCWDDPDENSPEPLRRPTNGKRASLIAEGPNEFTENGTISDFDVTDQLKNIHVPVLVTNGTDDLCTPLIAKTVVDHIPNAKWHLFANSRHLALLDQHDEFISVLDHWLAAND

SEQ ID NO: 591 - protein, 660 aa, Lactobacillus paracasei
MASKPTFYVTTPIYYPSGKLHIGNAYTTIAADVLARYKRLMGYDVFFLTGTDEHGLKIEQKADKLGVTPQAYVDGMATQIKQLWKMLEITNDKFIRTTDKEHVEAVQTIVERLIKQGDVYLGEYTGWYSVEDEEYFTESQLSEVYRDQDGNVTGGKAPSGHEVQLVHEPSYFFKMSKYTDRLLKYYDEHPDFVQPASRKTEMINNFIKPGLEDLAMSRTSFNWGVQIPSDPKHVVYVWVDALLNYITALGYGSNDHALFDKYWPANVQLIGKEIVRFHIIYWPIILMALGLPLPKKIYAHGWLVMKDGKMSKSKGNAIYPDMVVERYGLDALRYYLMRAIPFGNDGIFTPEDFIDRINYDLANDLGNLLNRTIAMINKYEDGILPAFKPDVTPFDQDLGDVAQAALAQYHKLMDELRFSDALDQVWKIVSRANKYIDETEPWNLAKDPAKKDQLDAVMAHLAESLRLIALLIQPVMTHAPLQIFGQLGLDHENDDHKLVQWGALPAGVKVVEQGTPIFPRLDTEEEVAYIKSKMTPGTAKATVDEKTRKSEIEFKQFDKSEIRVAEILNVEPVKGADKLLKFTLDAGDEGTRQILSGIREFYPEYEKLKGKKVMAVVNLKPRKLKGEMSEGMLLSAESLDGKKITLLEVSENLENGSLVG

SEQ ID NO: 592 - protein, 638 aa, Lactobacillus paracasei
MTTFKDAEKKKPASNTVVRTLRVVRVIYELDSAALPVEFMRALTTVGIPYLNIAFLGLVLNQLQQRASLQQVMLLIGLFLAVRFLLQLCGGWFSKRAEDHETAVKRRLDRAVTEKLLTVSYSTLQDPDMRKAYAGAQAGQSFSGGLSSLMKQGLLDFFSLVIAIAFGTATLVNLMKPMAASYTWLNDVRYPLMILVLLILPIIVGSWSIKHSNLIQQEIIQKILPSNRRFTYFFNFTENMDNHQVVRLYRASDLIMHRETNSTMASLQQIWDGDWQMAKYGHWPNLAIAVAVIGLYILVGAKALLGSLAIGSVMIAVGYFQQLMTAAYQFLQQVGMYVNMVDYLQFYVDFLALPDHEKSGSLPVEKRNDNEFAIQFHDVSFKYPGSDEWALRHVNLTLNIGERLALVGRNGSGKTTLIKLLVRLFKPTEGMITLNDIDIQKYDEDEYRSLLGVVFQDFRLFAYSIAENVAATTQPDRDRVWQALTVADVADRVKRMPETIDTPITTALSDDGVDVSGGEAQKIAIARAWYKNAPIMILDEPTAALDPISEYEIYQRFDELIEGKTAIYVSHRMSSTRFSQRIVVLDHGQLVQDGTHASLMAKSGIYRDLFNAQAQYYTEDRIKAARKKVATSVAPVAN

SEQ ID NO: 593 - protein, 607 aa, Lactobacillus paracasei
MKKYGLFNNLRWYLTYLRKDEPSLAWTATGLAIDKAAAALLGVFTPALLVGAIVQHATLGEFAWLAGLTGLGLAITSEVEYLLMTFDIKGTSLRTQIEMDFHQQQWDLDYDQISSGKIQDLAHTAFSKGLSWTYAGAEAIYIYGRGTLIDIATLLVFLATLSTVIPWVFALVLLSAAISYAGLSWYRKWYQTNNVNWNKLSRQQAYISRNAYALENGKDIRMFGMASWYHTHLDRLLSLQDAWQRRNSLRHFLGAQVGELAGLCRDALVYGSLVIAVIQGSLSIAQFTLMFGMTNGFITLLDQLLKDFSGLQTASLDLQELREFMTLKPQTPARPLTTFEQTQLAQRPVTIHFDHVTFRYPEAKTASLKDVSFTLGAGQKLAIVGVNGAGKSTLARLMMGLLHPTSGTILINGLNADLLPLATRFSFFAPVFQETIVLALSLADNVALTNPPQPQRVESALKDAGLADFVATLPQKAHTPMTRYTRDDGIELSGGQSQKLMLARALYKDAPVLVLDEPTAALDAIAENEVYQEYAQLASGKTSLFISHRLASTRFCDTILFMDHGQVLESGTHDQLIANNGCYAQMYHIQSKYYQPEAKEVPANDNL

SEQ ID NO: 594 - protein, 303 aa, Lactobacillus paracasei
MTVNEWWWLAAFGLLTVGCCLLLWWTFRRQQNWPVRGLNLAVTLLALGGWWLWPLPSVRFVLFCSTVLTGTLEFVLMRQFLNDQDAVFARSLDKMMAQYSQEVQELYANMRGWRHDYHDHLQALKAYLDNQDTQAARAYLDELEDKLDEVDPLVHSGNAMLDAIVNAKLTLAERLHIPVNEKVIVGSTPLIKDVDLVVILGNLLDNAIEAISEQPAGEPRQLRLYIGIVKQQFYLSVTNTRPAEQEIDYQYASTKSDKRGLGIRRVNKLVAKYNGMINRQYEASVFVTEIAIPIHAVKSTTHA

SEQ ID NO: 595 - protein, 234 aa, Lactobacillus paracasei
MHIAIIDDQAATRQATTQLLSQLTTPTQPLQVTAYPTAEAFLFADEPADLLLLDIKLGSGMDGMTLAKQIREHDAATAIAFVSNYDEFVFDGYDVNAIDYVIKPLTSDKLQHLITKVAAQTQPKLLAFTTANGIQRVAMYDISAIEVTDHRLQVHTQKMTYTVAGQLKDFLPQLDENFIQIYRSIVINLNFLSQLEKNTVVMADGTSYPVSRQQAPLVKQAFFKHFRGLAHDSE

SEQ ID NO: 596 - protein, 293 aa, Lactobacillus paracasei
LITIENSKFKAGIAERGAELQSLVNKADNYEYVWTGDKTFWNRHAPILFPSIGKSNQDQYRLGAKTYPMSQHGFARDYDFDVSDKSDSAVTFTQHQNAETLKKFPFEYTLAVTYMLTDGGLSVHYTVTNDDTKSMPFALGFHPAFNVGLKADRSFDDYDLTVEPLNSPLQRFGIGPVPFRNGDVEDIPGAEGNRLPLTHDLLDGGLVILANSEIAKATLASPHHDHSITLDISDFPYLTIWSPEHKKAPFIAVEPFDGLPDQAGEPTDWYTKLGNTTLSAGANKQLALKVELH

SEQ ID NO: 597 - protein, 332 aa, Lactobacillus paracasei
MSVKLTAGQLKHLKQLSNDDNVISALAIDQRGSLKKMLAAAANKPADETTIVDFKKAVSEELTKYASAILLDPEYGLPAAKVRDPKSGLLLSYEKTGYDATEPGRFPDLIDNQSALRIKNEGGDAVKFLLYIDPDEPDAINDRKYAFVERVGAEAKANDLPLFLELVSYDGKTNETGTAAWAKAKPEKVIKITKEFSKPQYNVSVLKLEVPVDQKFVEGYTDDGVTPVYSKEEAAKYYKEQSDATDLPFIFLSAGVTNELFLEELKFAKQAGSAFNGVLCGRATWKPGVKPYAAEGEAAGKKWLQTEGKANIDRLNKVLAETATPWTDKVEG

SEQ ID NO: 598 - protein, 160 aa, Lactobacillus paracasei
MTDLITPELVYFLNTPTQAAFFKTISTTLVDQQIMAPAGKEALITREQTFPSGMQLNEVADGLPNIAIPHLEGELVKQTRLVVVHFAIPVAFKDLADASRILPVNWVFMLMNAEPQKQPERMAQLIRALTQSPAAQLKRLFAAKKAAQVARLLTPLMTEA

SEQ ID NO: 599 - protein, 259 aa, Lactobacillus paracasei
MDIFDSHTHLNDTPYQGKEAEYIENARQLGVKKMAIVGSDTALNAGALALAHQYDNLYAIVGWHPESSKDYDAAKEALLIKQLADSKVVALGEIGLDYHWDTSPREIQRRVFRRQLEIARSLKIPVSIHSRDAFDDTYDILKKAHVEDFGAIMHSFTGDATWGQRFLDLGLYISYSGIVSFKNAPEEHASAKIVPNDRLLVETDAPYLTPTPYRGRQNQPGYTRYVVEALAKLRETTPEVIAKQTWDNAHRIFGLKEKA

SEQ ID NO: 600 - protein, 189 aa, Lactobacillus paracasei
MTTIKQVVVVEGRDDTKRLKETFGAINTIETRGSAIDEATLERIRQAQAKRGVIVLTDPDFPGEKIRKTISRAVPGVTHAFLPRREGVPDHKGSLGIEHAKPAALRAALQHLFTEMPDAPQVISQQDLLAADLVGGVGARQRREQLGELLHIGYTNGKQLLRRLAEFQISRAAFLAAMAQVDGGQHDKT

SEQ ID NO: 601 - protein, 298 aa, Lactobacillus paracasei
MTKPEKVAQPAVTNAILKRHGFHMRKGLGQNFLTDSKILQKIVTAADLTPEDDVIEIGPGIGALTQFLADSAHQVVALEIDDRLLPILDETLADYPNAMVVNEDVLKTDLGALVAEHFDGKHTLKVVANLPYYITTPILLHLLRAQLPLHSMTVMMQKEVAERLSATSGSKEYGSLSIAVQLVASVATAFTVSRHAFVPAPNVDSAIVTLTQRTEPLAALTDPASFDRLVRGAFASRRKTLWNNLVVLFGKTNKAAIRSALTTAAIDPGTRAERLSIADFARLDRALRAADLISQAHA

SEQ ID NO: 602 - protein, 83 aa, Lactobacillus paracasei
MPITLASIKRKLDGKIGENLTVVAQAGRKKVTRRRGTLKETYPAIFVVDLDQDENAFERVSYSYADLLTKSIQITFEGEEKAS

SEQ ID NO: 603 - protein, 316 aa, Lactobacillus paracasei
MHTTGLAVIVIDRQAYGSPETGGWMELIEKAPAKINLSLDALYRHDDGEHEWQMVMTSVDLADYVMISPHRSIQVSTDSGFLPEDPRNLAYKAALALQRHANIRQGARIHIEKHIPVAAGLGGGSSDAAAVLRGLNSLWQLGYSRSQLARIGLSVDSDVPYCVYSETALVTGRGDVVTPLGSLPNFWVVLAKPRVSVSTPTILNAIDYDAGLRHPDTQTVVAGIQNHDFAQMTSGMANSLEAITASRYPEMTALKQRLQKYGAEFAQMSGSGPTVFGLCQKHSRAMRVYNSMKGFCREVYLLRPFCLSATGPRFRG

SEQ ID NO: 604 - protein, 292 aa, Lactobacillus paracasei
MEQVQPNKAFFWGILLNTIYIIAEVAFGIGIGSVALVADAVHNLGDVLGLGLAWFADWLSGRHPTVERTYGYKSSSILAALANAAFLLVAMGAIIVEAVTRLSQNAPVEGGWMMLVAGVGIIVNGATALLFHGGSQHDLNIRGAFMHMAADAGVSLGVVLAGGLILLTGWEWLDPVMSILVAIVVLVGTWNLLRDAVNLAMAAVPKDIDPVAVKKLVNAYPTVASCHDLHIWALSTTDVALTVHVVRTTTVGNDDFLDALSLSLRESFDIAHTTIQVEYGPYEPQNKMENPY

SEQ ID NO: 605 - protein, 253 aa, Lactobacillus paracasei
MSNQLIVSPITLLLALILVLIALAINLKEDLGMTKDLIIGVVRAVIQLTVVGFVLTYIIKADTVWLTLAMIAVIIFNAAWNAKKRAGTIPNALVTSLLAITTATGLTLVMLVAVKAIRFVPSQIVPICGMIASNVMVAIGLAYRSLNTEFNDLRQQVLERLALGADLKQASQSLIVNAIKTGMAPTIDSAKTVGLVSLPGMMSGLIFAGIDPTKAIMYQIMVTFMLLGATSIGSFIAVYRSYPRFYNARKQLR

SEQ ID NO: 606 - protein, 216 aa, Lactobacillus paracasei
MNCFELSHVTFAPEKNAILHDINLMIPWGADLTIAGHSGSGKSTLLRLLATLLTPTSGTIRYNGKPQDDYDPTSYRREVSYCAQQPALFHGTVADDLQFPFTIRHQKMPREEAERALESVDLAKTMLDDPVKNLSGGERQRVALLQHLFFPPKVLLLDEVTAGLDPDTKTVIHALLQKQNDQGITLIRVTHDEGEIQAAKQLLRLVAGQFEEAAHE

SEQ ID NO: 607 - protein, 282 aa, Lactobacillus paracasei
MKVRRSDRLIDMTRYLLERPHTLIPLTFFSKRYESAKSSISEDLAIVRRTFAQRQTGILETVPGAAGGVRYIPIMGEDEAENFIAAMSKRLSETDRLLPGGYVYLSDLLGTPSVLRQIGRLIATQYREAHVDAVMTVATKGIPIAQSVSQYLNVPFVIVRRDSKITEGSTVSVNYVSGSSARIEKMELSKRSLPANSRVLIVDDFMKGGGTVNGMKALIDEFNAKMVGITVFAEGKFDGDRMVSEYTSLIRVDKVDTKANTLHATAGNFLDQNRQLLEVAGQ

SEQ ID NO: 608 - protein, 397 aa, Lactobacillus paracasei
MSAYLGPVRTAIITFPFLALVLALPFLVVVYRRYGAFSWWRAVVIYSFVFYLLSAYFLIILPLPSRAAVAQFTGPKYNLEPFMALRYFVHTTVFVPTNPHTWLAALKQSAFIQPFFNVVLTIPFGFYLRYYFKRSVPQIILMSFGLSLFFELTQLSGLYGYYPRPYRLFDVDDLILNTTGGFLGGVFAPILMRALPSRDIIDAKSQARGARVTLARRFAAFIIDFFLFSGIIGVLIQILLHLLGLDQLPGFLGNYVLPLFFVFVLWPAFNQGQTLGKSLVRIKIVRTNGQPIGFWRLFLRESLLYELALPSFMGLNYFFGEYFGAFHQTEINLAALGFFGLLSLLFLINFAWEIISRHHRFFYDAWTDTTQISTFQSQPKDPVARQDSGNDDDIQKS

SEQ ID NO: 609 - protein, 462 aa, Lactobacillus paracasei
MSKKFTIILAAGKGTRMKSKYYKVLQPVCGKSMVEHVVSQVEAIHPDAIVTIVGHGAEAVEETLGKRTKFVLQSEQLGTGHAVLQAEPLLGQKEGATLIISGDTPLFTAKTLNDLFAYHEAKGAKATILTASAPDPTGYGRIIRDSDGNVVKNVEQKDATPEEALISEINTGVYVFDNQALFKALHQVNNNNAQGEYYLPDVLGILRDAGEKVAAYQMPDYTESLGVNDRVALARATRLMQQRINEQHMRNGVTLIDPATTYIDTEVKIGADTVIEPGVYLKGKTVIGEDCHIGTHSELVDATLENDVTVTSSTIEHAVMHAHSDIGPNSHLRPDADIGEYVHLGNFVEIKKAKIGARTKVGHLTYVGNATLGTDINVGCGVVFVNYDGVQKWESKVGDHAFIGSNSNIVAPVDVADHSFIAAGSTITKDVPFHAMAIARARQTNKDDFWKRLPLAKDPDWN

SEQ ID NO: 610 - protein, 324 aa, Lactobacillus paracasei
MSEQYGDPRLKIFALNSNKPLAEKIAAEVGVKLGKSSVKRFSDGEIQINIEESIRGDDVYLIQSTSSPVNDNLMELLIMIDALRRASAHTINVVMPYYGYARQDRKARSREPITAKLVANMLERAGATRVLALDLHAAQIQGFFDIPVDHLVGAPLLADYFLRNHYDGADTVVVSPDHGGVTRARKLAEFLKAPIAIIDKRRPRPNVAEVMNIVGNVTGKQCIIIDDMIDTAGTITLAAQALKDAGATEVLVAATHAIFSGPAVERLTHSAIEKVVVTDSINLPADKHMDKLDVVSVGPLMGRAIMRIQENRSVTPLFENRFTK

SEQ ID NO: 611 - protein, 127 aa, Lactobacillus paracasei
ASCHDMAINPRTEINMRMGLAHDQFLLVKQGSKTIEIRLNDEKRQQLKVGDTIVFEDTTTAQTQRRTVSALEKFTSFAELYHKYSGPQVGSAPTDSETKMVADTYQLYTVWQEASFGVLAIHLQPAF

SEQ ID NO: 612 - protein, 169 aa, Lactobacillus paracasei
MGFGTLTNNVINSNVVCLIFGVIAHQIGFLEDNALNKAGVFNWLMYGLLAYVFGQLSATTPAVLGGIVLQIIVLIALGVLGMFLASRLLAKPFGMSWQMAFSCSLTALFGFPADYIHYILTSEVARAMATTEDEEEYLTQQMMPKMLVGGFATVSVASVIIATIFLKLL

SEQ ID NO: 613 - protein, 123 aa, Lactobacillus paracasei
MLKEFQKFIMRGNVLDLAVGVIIGSAFTGLVTSLTKNLINPILSMFAGKADLSGLYFTILGAKFTYGNFINDVLNFLIIAFVVFLLVKGINRILPSKPAKPAGPTQEELLTEIRDLLKQDQQV

SEQ ID NO: 614 - protein, 352 aa, Lactobacillus paracasei
MSAQELFIIFAIPIVLGVIFAFSFTVEPRRLINGVLFNFFAVTFLVALAIAILRSGNLLLISVTGVLFLIIILIVALLFALHLFWLLWNAILVWRREGHSLSNMLTLYIAIGLLLIEIAASFGRRFIPDPLYFSLAIFFGLGGFYVLLTLYNFLTVLILYNFRPQPHNRTFLIVLGAGLLHGDQVSPLLASRIDAAIKFYRKQIKKGRPAPRIIFSGGKGSDEAISEAMAMQRYALGKGIPEGDTLLEDQSTTTLENMQFSKRLITQEIGESPYKASFFTNNYHLFRAGIFARMAGIVANGVGGATSFYFLPNAVIREYLALVVLYKRRHAVAFGLIVLIAIAEFLRVWHLG

SEQ ID NO: 615 - protein, 150 aa, Lactobacillus paracasei
MIDPVFGRKDPKLDYHTRIGAYGVIPDHSGARLLILQAPNHALFLPGGGVEEGETPEVTLARELLEEFGATVHVTQKLGKSSEYFYSHHRQTAYYHPATFFACDQLAFVQDPLETFNTLMLMPIDLALAELKRPTHRWAVAKWLANQPKR

SEQ ID NO: 616 - protein, 450 aa, Lactobacillus paracasei
MLFEKLPREKVFRDPVHNYVHVQHRVILDLINTPEFQRLRRIKQLGVSDYVFQGAEHTRFAHSLGVYEIAREMCDNFVNNYPTQTPGDGLWDDAERPVVLCAALLHDIGHGAYSHTFEHIFDTDHEAITRAILTDSHTNVNKILRGVGPEFPEMVASVINHTYPNPQVVQMISSQIDADRMDYLLHDAYYTGTKYGLFDLSRILRVMRPYSDGIAYEANGMHAVEDYVVSRFQMYQQVYFHPVSRGMEVILFHLLKRAKFLYESGQFESGFSPRLLVPFFEQTFNLTDYLKLDDGVLNTYFTYWLDYPDSILSDFADRFLNRRPLKSVTFTDQTAYLLPRLRDLVASAGFDPHYYTAENDSFDLPYDQYDPASANPKTQIEIMQKDGTLEELSTLSPLVAALSGRATGDKRFYFPKEMLATQDSNLFSPIYEKFQHYLLNGGLIDPHFND

SEQ ID NO: 617 - protein, 282 aa, Lactobacillus paracasei
MDLTTLAGQQAAIFQQNFTKDEAPLSFAHTNALLAHPELHPPLMLHFWTADQTVILGMQDLKLPQLGRGLRVLASDGYGFFVRNSGGLAVIADRGVLNVSLFLPNEDELSINGAYELMTQLFRTAFPSLPIATTEIVHSYCPGKYDLSVRGQKFAGMAQRRNRAGIVVMLYCSIFGNQDARCALLRRFYHEGKAAASSHFTFPVIRSETMTTLSDLLGRPLTLEQATVALLNALADTGIAADMNSMPTLLRDPAYHKALTEATADLHTRNRSLKKMGEHDAI

SEQ ID NO: 618 - protein, 148 aa, Lactobacillus paracasei
MDLSQGVPIQIHLETFVTQGEDNETHVFDEPGTLVQMGNALYIRYQEVDEDAGTSMPVTMKLREDGDVQLSRGSSNGDTQLKLFFANEKRVLTRYRTPYGIIPVETVTPRIDVRMTTEPVAGEVYIEYQLFANNQHLGDYRLRLQFNA

SEQ ID NO: 619 - protein, 226 aa, Lactobacillus paracasei
VYRLKLKAFANADKSELSMIEVAHEILKEKGDTMAFVDLANEIQNYLGKRDEEIRERLPQFYTDLNVDGSFISLGDNVWGLRAWYPYDSVDEEVNHPEDEEEAPRRKKRKKVNAFLADVADDDDVIDYNDDDPEDEDLDADSDDDDDFDDDDSGFHDKVGKTTDTDDDSDDDPDDGLPDGIEGQLAEFGDDDSDDDDDNDDITADFSDDDDDDSDSDDDDDSDTKK

SEQ ID NO: 620 - protein, 291 aa, Lactobacillus paracasei
MISKELKTRLDTFIDAILAIIITIMVLELPAQSWEHHANITNFFLAVGVYAVSFCFVANIWYQQATLFSTVDQIPRRIVLWEFILVFLLSLVPALTRLMSGDVESISVIIYGAIYFLVIVVFRLISRTIVHQQANDKDEMRKIYTSIYGEHNLENVIMIAAIMILAIFVPKAAYILYIAIPIRSFFTIDNDELTGIQQMETTGQQDYLRMSHDQQVKFRRLVGEFIRESRNARGNTEISRTAWENFAKAAEAELNINPTTLGHWFAAFQQAKNTHQNGAPYRQGRPRKVHD

SEQ ID NO: 621 - protein, 534 aa, Lactobacillus paracasei
MTKYIFVTGGVVSSLGKGIVAASLGRLLKNRGLKITIQKFDPYINVDPGTMNPYQHGEVFVTDDGAETDLDLGHYERFIDINLNKYSNVTTGKIYSEVLQRERRGEYLGATVQVIPHITNMIKEKIMRAAKHSDSDVIITEIGGTVGDIESLPFLEAIRQMKRDVGSENVFYIHASLVPYLRAADEMKTKPTQHSVKELRSIGIQPNMLVVRTEKPITEDMKKKIALFTDVPENAVIESRDAKTLYSIPLALQAQGMDQIVVDHFGFDVPDADMRAWTQLEHKVQHLTHTTKIALVGKYVALKDAYISVAEALKHAGYYWDSDIDLQMFQAEDVNDDNVESLLQGFDGILVPGGFGDRGLEGKIAAIRYARENDIPFLGICLGMQMASVEFARDVLGLKDAGTTETQPDIKDPIIDLMRDQVGVKNLGGTLRLGLYPCVLKPGSVAAKAYDNAHEIQKRHRHRYEFNTKYRQAMEDHGLVFSGVSPDNRLMEIIEYPKNKFFVAPQYHPEFQSRPNKPEGLFKAFIQAAGDFKA

SEQ ID NO: 622 - protein, 419 aa, Lactobacillus paracasei
MEKMLIHGGKKLSGEVVIGGAKNSTVALIPAAILSRTPVTLDSVPHIQDVYNLMAILDDMNVKSDFTENVLTIDPTEINDVPLPNGKIKSLRASYYFMGALLGRFGKAIVGLPGGDDIGPRPIDQHIKGFEALGASVSNEHGAMAIKAPAEGLHGARIFLDMVSVGATINVILAAVTARGRTVIENAAKEPEIIDLATYLNNMGAKVRGAGTDVIRIDGVPTLEAHNSHTIIPDRIEAGTYLAMAAAIGEGVKVKNIISEHLDAFLAKLEEMGVVMDVGEDSIFVYPSGDLKMVQIKTMPYPGFATDLQQPITPLMLKAHGEGLIIDTIYPKRVRHIPELLRMGADITIENDVIILHHCDHLQGTEVAAEEIRAGACLMIAGLMAEGTTTITKVDNILRGYDRVVMKLRGLGADVELID

SEQ ID NO: 623 - protein, 83 aa, Lactobacillus paracasei
MKQGIHPDYHPVVFMDSATGFKFISGSTKTSKETVKWEDGKEYPLVRVEISSDSHPFYTGKQKFTQADGRVDRFNKKYGLDKK

SEQ ID NO: 624 - protein, 142 aa, Lactobacillus paracasei
MPIKTLPEDQLVTMSQFVVKDVAKAFDFPYYVNDLTHDANFDTEHTATKLEFELTLLNDPDPERTISFYSDASADPIMGGAASAQVIVESGITFVYLNDGYKDSYLIIIRDGKVVQNLKLEQQILSGPEVEDLIDNVMPKAK

SEQ ID NO: 625 - protein, 225 aa, Lactobacillus paracasei
MTKRSNFLYWLNVGGDLLYLLIVGGLYISGRSLFHGQMMLLAQVASGILIVSLPRLMERWWHFRFPPVLIYLFEIFILLSVLLGTGLQCYSVPYWDKFEHLFSAAMLAGLGFAIFAALTPQKRLTSTSPLLMALFALAFGTTIGVLWEFYEFTFDGLLGLNMQRYMATGGELLRGRAALMDTMGDLFMDFFGSLGLALFGYFGIKRDLRWLDTFAFQPDHKSVNH

SEQ ID NO: 626 - protein, 214 aa, Lactobacillus paracasei
MLQPWPNLIPRPDLPTIPKTAAIPPAYFKLIQTGILPMNWWLPTKEPTSDAIDGVGIHAFATVGPAMTSSDLPAHFLPFAKTGHQYFGFDLQQEPRQIRYIDTEVDQWLTVAMDLPAFMKQLQPHEAKLPEISVDPQIFGHMAVIATAAEWPALFDYAREFMAGQAIGPWLRWLAQSKEEAKRQVGMEEFHFLTRYQPNFLTPNDTLTLQHVFG

SEQ ID NO: 627 - protein, 65 aa, Lactobacillus paracasei
MAKARPSRPRPLALRFLTAPTHALIETRSPTQKPAHKDLERNGQGPAITFKAAYAPVSKRVGSRS

SEQ ID NO: 628 - protein, 254 aa, Lactobacillus paracasei
VRNAMIYVRHEPLAHLFLTYGISASDLLSDHLKVPKHLLLLPPVDEQEQIDPHTWFNIIDGADQVQDFLRSKAGQTRCWLDYSSPRFLQELTPNEIAELLYLGHAKTHLSSPFYYKLKNELVYLPLRNGMVNMYLRNESLFATFLANAINKYMRRIANEEPFWLRLRQQHFSRVSHAVYTQFLPLLEDGVVFDFRNVRFSREKISVPLLAPKARFVPDGILTDTDVRRLGMLVLMRQKNQWMMIDDAASADHRQ

SEQ ID NO: 629 - protein, 462 aa, Lactobacillus paracasei
MKMTLAEIARVVKAQLLSEADGSHVVTGLVFDSRKLKPGMLFVPLRGERDGHEFIPAAATAGAVATFVAADHLPVTTKLITLVVPDPLKAMQQLAQYYLLMKVNPKVVAITGSNGKTTTKDMTAAILATQYHVVKTPDNYNNEIGVPMTILSMEPNTEVLVLEMGMDRPGQLHALSTLAEPDVAVITMIGEAHIEFFKTRDKIADAKMEITDGLKDDGTFIFNGDEPLLQERAKKITQERETFGLHPENTIFAHSISGHRNHTEFTVEAWPDLTFSIPIMGEYNVVNALAALLVGRKFHVKPEIMQKALAHFQVTANRTQWLIGDVGEQILSDVYNANPTAMKAVIHDFSEFTATGRHIAVLGDMLELGEQSPALHAGLAEALDPKEVQVVYLYGSDMKALADALAAKYPADQLHYYPLDDKEQMTRDLQNDVNHDDMVLLKASHGLHLETVLSALVAGGRA

SEQ ID NO: 630 - protein, 47 aa, Lactobacillus paracasei
MKMKRLLACFDGFYSFKNVSLGLNKYVLTEAFGDYARLGRISALVFL

SEQ ID NO: 631 - protein, 535 aa, Lactobacillus paracasei
  misc_feature (6)..(6): Xaa can be any naturally occurring amino acid
DEADBXATPDEPENDENTRNAHELICASECSHALKFKELGLDHDLLKAIAQSGFEEATPIQAETIPLVLAGKDVIGQAQTGTGKTAAFGLPILQNIDKADRSIQALVISPTRELAIQTQEELYRLGQDKKIKVQAVYGGADIRRQIRQLSEHPQIVVGTPGRILDHIGRHTLKLQNLKVLVLDEADEMLDMGFIDDIEKIVEQMPTARQTLLFSATIPASIMRLTNKFMHEPVTVKIKAKELTADTVEQYYVRAKDYEKFDVMTRLFDVQDPDLALIFGRTKRRVDELTRGLKARGYRAEGIHGDLTQQKRMSVLRQFKSGQLDFLVATDVAARGLDISGVTHVYNYDIPQDPDSYVHRIGRTGRAGHKGVSVTFVTPNEIEYLHTIEDLTKKRMLPMKPPTAEEALMGQISSGLETIKAQVEANDTEKYEAMAESLLENYTPLQLVSAYLKAVSPDDASAVPVKITPERPLPHRGRSNHGHGNNRGGYKGGYKGKRREGGYQGNRDNKRSYDKKRNFSDKRKNVKRSFKIRNGE

SEQ ID NO: 632 - protein, 124 aa, Lactobacillus paracasei
MIYGIGVDVTDLARIQAAQEKNSGFAVKILTPTELANYQQLDGRRAVEYLSGRFSAKESYSKAFGTGLGKVALQDVEILNNELGKPILTKHPFSGQAFVSISHSETLVFTEVILEKEGPERDDR

SEQ ID NO: 633 - protein, 378 aa, Lactobacillus paracasei
VTIGNFRPAKVLIDETAILHNIQHEVARLKKQTQLFAVVKADAYGHGMLRVARVAKAAGATGFCVAILDEALGLRKADYSEPVLVLGIVPSQYAAIAAAQTISLPVSSTEWLEQALPVLEAQPELPPLRIHLALDTGMGRIGFTEDQALKTAVAFVEAHSKQFVIEGIFTHFATADAPDDTYFKQQVDKFNHLVDLLPSRPRYVHVSNSATSLWHAACNGNMIRYGVAIYGLNPSGDAIPTTPFPLEPALSLESELTYCKQVHAGDGISYGVTYRAKGDEFIGTVPIGYADGWLRRLQGFHVLVDGQYCEIVGRICMDQFMIRLPKAYPAGTKVVLVGQSGDQEITLLDVAKYSKTIHYEIACNLTPRLKRQSVNPVD

SEQ ID NO: 634 - protein, 82 aa, Lactobacillus paracasei
MKKQTSVAVTFDDAIKARLDAYCELNDIDAQAVITEAVATFLKSQAPEINQLISGYVAMGQINTEISHAFSACESEAYAHIR

SEQ ID NO: 635 - protein, 127 aa, Lactobacillus paracasei
MDVSVKRGDVFFADLSPVVGSEQGGNRPVLIIQNNVGNHYSPTVIVAAITSKIQKPKMPTHVGLRAKQDGVERNSVILLEQIRTIDKQRLQARVTALSSTKMAAVDRALAISVGLVSLPKPKTYNKN

SEQ ID NO: 636 - protein, 173 aa, Lactobacillus paracasei
MTNLKTRGWVLNALVAAIYIVLSIGPASLNLASGAIQFRLSESLNHLVVFDRKYIVGVVTGVVIFNAIFSPLGWLDVVFGGGQSLLGLLLVGWVAPKLRQLWARFALNIAVMTITMALIAVEIVWTGHLSFATMFLPTYVSLMLSEFIIMTISAPIMYGLDKIVHFHAAIVRK

SEQ ID NO: 637 - protein, 188 aa, Lactobacillus paracasei
MDGVAIWQYTSAFGLSQGLDGNIDLLGVTDNGYSKQPVTPITPAPSKPAQSTAATDTDYAQTGVFKPSATVNIRTGAGTGYASVGSYAPGESVIYDHVYIRGTYVWARYLSYSGRYHYVALGVNGGESYGSRSSGYTSPVSHTYYTVRSGDSFWSIASKYGISMYTLAANNGKSIYSVIHPGESLYIR

SEQ ID NO: 638 - protein, 237 aa, Lactobacillus paracasei
MYHKNHFIEIRTPFPDMFHDNISLVLYKDADGNLMLSDDGYTMDELGTLGFDTNTSVKRKKYFNDTLLSFGVQYAPTGELTIKIPSLSKYAQAELQLIQCITQVGDMLATSRDRTKDLFLEDVVNFLINSDISVNTNVKYTGQSGNNINFEILIGRTKTTSAKALKLVNNPTGNAYKEPIFSITDVRSFNDEIKFYLLANDLERNISPSFQSAAEGYNITLLPWSQKASWIGQLRLA

SEQ ID NO: 639 - protein, 95 aa, Lactobacillus paracasei
MKIINVKLVVKPDRDAAYRQFIAALVQGSRAEQGNLSYDHYQSLTAPNEYEIIEHWRDAEAVESHNGTAHFQKFLAGINEFLTEPLEILRMNDHA

SEQ ID NO: 640 - protein, 176 aa, Lactobacillus paracasei
MTNQIFFDGILLLLTIGAITEITGVVKVIKARRPTKGANSYQVVMLSAKMLKTFPEEMKRAQKVALLLRLNLFSLSACIGFLIAGIYQLNIYADPTVCRVSAWLTVIVTITLIYLSCQSYTISRHMMEKYFEISPSSKEDILPFSLEQGHRSFIGRITALFGLLIMEAAFVLMVIF

SEQ ID NO: 641 - protein, 283 aa, Lactobacillus paracasei
MRKNKLLQLFMPLAVVGLLLGGCSTTNSRSVKSAGDPVASQTKANKKTQSAISSLDSELTEKRKEITDLKAKLAKTQPAASESSTSAATTTASDLANLDYTGQQEIIVNKNNPAFSDADLSTAKGAWATYSDLDGQNRVTDANALLNKSLMPTAKREPLTWNPTGWHNKKTAHGWLYNRSHLIGYQLTGENNNPKNLMTGTQTLNTPLMLAHEMDIAYYLKQSTSHYVRYEVKPIFRGNELVARGVQMRAQSIGDNQVYFNVYIFNIEPGYTINYADGTSTKN

SEQ ID NO: 642 - protein, 249 aa, Lactobacillus paracasei
MSTLGNIFVLLGLVGSVWGIIRLLRQRKHPLTKRLNLIMLIGGIILVIVGSPMANTKAASGSPHQSSSVSKTKALTAKQQSRLDAEKAHGKILLAVKAKKVAELKALQKEEASLESEASSQAAASSVAAASSSRAASEAASKEASASQVAASEQAAAASSQAAAATQAAKQAEEAQKSAANQQATQPQQQAPAKSGDLYTGNQGTIIGNSRSKIYHVPGQAGYHMNSANAVYFNSEADAQAAGYRKALR

SEQ ID NO: 643 - protein, 387 aa, Lactobacillus paracasei
VKPAKTKFSDAPDGSIHQYDQILKYFNDQPADQTKPRGNRITFVTTGIIGFDGGQTTMLHLGTLLANAGYDVYYLSYVPQSQDEMIQNAEFNYPGYKGTCLPMGELESHRSDIWVATLWESVYVIKNKPGYKMYFVQDYEPYFYPYGDRYQMARRTYSLGLHMVSLGPWCAHMITMHCKVHSPIDVINFPVDVARYPFKERDMGPYQQKKQIKLAVYTKWSSPRRAPINIQIVLENCRQLLRAKGIDLKIQYFGTGRSKRFINGENLGKLTPPELNRLYQSADFGIAPSMTNFSLVPYEMMSTGLPLIDFKEGTGSYFLKDGTYFASHLDERDLAKTLANACANPDTISNQVQNGQAFLKTIGWDRTEKDMLAIIANLYANVDVVKS

SEQ ID NO: 644 - protein, 305 aa, Lactobacillus paracasei
MLTIGVMGLGTIAQKAYLPVYTQMQNQVHWVLSTRNDDKLQQLATQDGLAIAGTTLEDLDAQPLDAVMIHTPTETHYQYVKHFLEKGVNVFVDKPLATDMGQINELYDLADTQHVLLTVGFNRRFAPMIQDLAEVDDKTGVRVDKNRIDAPDDPEHALWDLFIHPVDTALMLAGYPEKPNTRYSLHTGDDGKLQQASVIFTAPGIRGEAGIDLQAGTNLEEAQVAAPSGVQRVQNLDQLVVYGRGGATQTFAPDWQPMLTTRGFQPMVQAFVQAVADPEGKNPVSPATSQLTHAVVADLVNQIKA

SEQ ID NO: 645 - protein, 155 aa, Lactobacillus paracasei
MYRKEFMAMANEEAKANVNGSDGGPFGCVIIKDGKVVSRAHNQVLVDHDPTAHGEITAIRKAGQALGTHDLTGCELYTSAMPCPMCLSAIIWANIKQVYYGNTADDAAAIGFRDAAIYDFINAGLKGDMLALTQHDRELTIGAFKDYQSAQKKLY

SEQ ID NO: 646 - protein, 350 aa, Lactobacillus paracasei
LQHPAQAASRVSFSNFAKNYIDLYRSKGSPRTYALYQNTVKKIKDQFNDRLLTSITRDELQKWLNDFGKSHAITTGEKLYRQLHVIIGAALDEGIISRDISKGLIYSGSKPQAADYKFLEYDEYITLLNYLRDNATFNQMTEEMMLFALMTGSRYGEVAGMTWDDINFKTATININKQWNPRLHKFMLTKNHGKSDRIVSIPDQYLPQLKEMKRVQQLYLKNTEHQRRHDWEWKTTTYHEEDMMFLSFTFKVPQNDSVNRRLDELHYQLGIKRIGMHGMRHTHATRLIYAGYSDWYIAKRLGHNSLKELHRTYGHVFEQMQAEADTKLRASIGQDYLGKASHKIVKIDPK

SEQ ID NO: 647 - protein, 253 aa, Lactobacillus paracasei
MKKKQRRVKRPRGEIKQRFDEQLSYLSFAADGYDTQDHSLIKMATAPLRTLFLKQNMGEPLIEQLKIDPEKTKFMSSVALGEGVVLYGGPVIAGWGKEKPTELPQAEYLPLCYNPSANILHSIPFEKWWNGRLLVFEDHIITRKDIVRYVANQDGGAHVDRTLVKEYDDLLRGMYSANIFRNNMPKDIKNIHLALLRQLVDETIRSFEKLGLLPQNLKYDSGSNKYQQTYILSEPMLAHILLVEGDHISTQYY

SEQ ID NO: 648 - protein, 79 aa, Lactobacillus paracasei
MIVTRTGSLVSTKLSTMYHKQKRFKDEVSILTDGLKYSVNYNAYLPHDEDAFASHITKATTFLTNHVDEDQSVGYELNK

SEQ ID NO: 649 - protein, 187 aa, Lactobacillus paracasei
MYRREHNHVPPWILVNDISFGIASRWYAISNKGIKRQVLNDLNPSTNVSEQERLNLLRLSLKIAQDYRNTIAHGTSILKTRLSYPTSRTELPRSIVRLINNPTIISVNDYALGFGKNDIFSLLLILASHTIGHPSLLSALADLQNLIDPSKDMAITYVNKLVYNDTLGFPPNTHERIKALRNWYENK

SEQ ID NO: 650 - protein, 153 aa, Lactobacillus paracasei
LRPDKPFKTYLEQVARLADHDIKLVSESEEEVISDLKQYGYYNLVNAYQDRLPHTKAEKFDPPIPFNLLVHIKRIDEILSGILLPLVIHFENTFETSLSYHIAENFGVYHVSHNGVPGYLDSIRYPRINMDPAPTLRKLREYATGMHVKQNKN

SEQ ID NO: 651 - protein, 145 aa, Lactobacillus paracasei
LTEEIDGQVIRIISPSDLIINLGYVDRIKKGDSAEVVIFGDEIFDTDGKSLGLYTFVKDDLEVTHVNRHFSVISKIRKRHAGNSPYSNLLEQMSKSISTIYGTSHEVEEPAKLKISSEEIEPLKVKAPADLAIHKGDEVRVIHVE

SEQ ID NO: 652 - protein, 160 aa, Lactobacillus paracasei
MQTKRNINWFHLILSIVVVELIGSLSGLLAGNIKGIYTSLKLPPLSPPAAVFGPVWIILYLLIGVAGYLVIKDTTSRTPKTINLSLFGSQLLLNFIWSIVFFGGNSYWLGLIIIIVLDLVVLACILAFRNVNKLAAYLFVPYFVWILFATYLTLGVAVLN

SEQ ID NO: 653 - protein, 48 aa, Lactobacillus paracasei
MMQYRLQLDTKNQLFVAIDAHDQNHFGTGRTVEEAIKNLKDSTDNKAA

SEQ ID NO: 654 - protein, 397 aa, Lactobacillus paracasei
LVREIQLRWLLTGALLSSIGMSFIWPLTSIYLHNRLDISLTVIGVVLLLNSLGSVVGSIIGGRLYDQGDPYRLALFGVGLTGLVLIGLTLWHGWPAYSIWLTLLGIGSGWNITMVNSLGTSIRSKDGRYVFTMLYFAQNVGVVVGTALVGFVYDISITLLFLIAVVLYGIFFGIVLIKFRPAAKTAQPTRKETTTETPKPSLPGANKLMLTTFFFALLIFWLMYQQWSSNLSVYMTGLGIPLRNYSFLWTLNAALIVVIQLFLNWFNEHVNGIQIIYQILFGLVMVAISFLILITAHTYALFMIAMIALTTGEATASPAIPALVNDLTPREIKGRYQGFVNSWGSVGRALGPLFGGLVIDWLSYRSLFIIAAVGVFALVAVLIVVWIRTRRRLVRYQ

SEQ ID NO: 655 - protein, 200 aa, Lactobacillus paracasei
MSKSRIEAFSDGVFAILITILVLEFHPVAGRPGTLLHQVTGQMPLLITYLTSYFYVGTLWLFHHDYFTHVKRTTTALNILNLILLFTATLINYSMSLVAMALRTLNHADMQVAFIVYDIVALLISLSYWLIYHYLSTHPQLTDHGITSPTQHIDPLISGLIYGSSILVSWLNVWIAGVLLLLGIVFHFIAYLRMRLPAMH

SEQ ID NO: 656 - protein, 476 aa, Lactobacillus paracasei
MKIESACTSILVGKKASIDGSTMIARNDDTFSPLTPQRFYMHAGWKGEKSLHVKSPLNGFEADLPENGYRYNAVPNVENDKLGDYEESGINERNVAMSATESTYGNERALGFDPLVKDGLDEDLIVNMVLPFIESARHGVEYLGQLIKQYGSPAGNSVLFSDKDNVWYMEIVTGHHWVAQRIPDDAYAIAANQVAIQQVDFDDTDNFVWSEGIQEFVDAHHLNTDKEGWNFRHIFGTMNEKDRHYNTPRVWYGHKILNPEIEADPESAELPFIMHTDHLINREDIAQILGSHYNETPFDPYGHGSDADRFRYRPIGLNRTQNSHILQLRRDVNEGLAAIMWLAIGMPTFSPYVPFYCNANDTDPSYSKTPKTFDIDADSAYWLHRLLDVLVEAHYTQFIQADRDYLTALNRDYREMIQATDDGAKDLGDKELTQYLTEANYKLVDHTKQATKALINNYVMESLKLSKLTFNMDKNL

SEQ ID NO: 657 - protein, 111 aa, Lactobacillus paracasei
VINAAIMILAYAHAHPQSYQVRTVPYQNVASILLDDRVLFPEQSLFFPPNRLRVIRLPEHFAFNNPELGAWLLSLLPELSEDAEQASTNNMWLTTSHLTKARRLLIEVSFE

SEQ ID NO: 658 - protein, 240 aa, Lactobacillus paracasei
MTIRLYLVRHGETPMNAARQLQGITDAALTAKGRAAADRLGELLRPVPFAKVFTSDRGRTIETAHRIIAGHQPQPPLIQLSALREYYFGGLEGDSGNAVITRTIRQFGVAAAFRAWRGSERFAGLVRSIREADPTHQAEDLPDLIARAHQAFTQVIAQSPDSSDILVVSHGMLLSALIYQLAPEDLPFMLLKNTSVTRVDITEKQWHVRGVNLTRERDILALRGSATSTAHDAASDQSQK

SEQ ID NO: 659 - protein, 216 aa, Lactobacillus paracasei
MPKPTFFRLPEAKQKRLMDAANKEFARAPFNDASISHIIKDAGIPRGSYYQYFDDKADLYFYLLEQVRHRAVAALQQVMAKHHGDLFAAMSEFFGLTIDALVQGPHAALYRNVFLHMDFHSASKMAGSPLAERPRGHHEIHQYLLANIDRRQLRIKSDDDVSLLIRQIVGMFMQTIGYFYSRQTKGKEVTVAELKQRTNQILDWLQYGVASKGERH

SEQ ID NO: 660 - protein, 576 aa, Lactobacillus paracasei
MLKLAKKRMSGWAVIGAVLFMIVQVMSNLYLPNLTADIVNNGVAKGDIDYIWATGMKMILFALLSILASVGNVFLASQTSQKLGQKLRSDVYRKVINYSHDEMDKVGTSSLITRTTNDVTQIQNVWMMILRMMIMAPIMLIGASFLAYQKSHTLTMVFLISLPLLAFFLLIIMYFAVPLFKAMQKKTDNINLVFREGLTGVRVIRAFRQDDFEQNRFETVNQDYTHNAVKVFSIIAAVFPVMTLIMSGTNIGITWWGGHLIAQQALETGNLIAFMTYAMQILMSFMMLSMIFVFIPRAQASAVRLNEVLDQHSRITTPTSPKSLDTTHPALQFDHVQFRYHHAEEPALSDIDVQVTGGETLAIIGGTGSGKTTMVNLIPRFYDAEKGHVRVDGEDVKAVDLKKLHEAVAFVPQKANLFTGTVRDNMKYGNDEATDDQIWHALEIAQAKDFIAANPEGLDYQVEQGGGNFSGGQRQRLAIARALVKDASVYVFDDSFSALDFKTDANLRAALKADAKIQTKVVVIVGQRVSTVADADTIVVLDEGKMVGKGTHAELKATNTTYQEIIKSQIREGDEQ

SEQ ID NO: 661 - protein, 628 aa, Lactobacillus paracasei
MADQKKSETTKQPSGPRMGPGGRAGLVEKPKNFWGTTARLFGYMRNRLIGIIAVLVLAIASTVFQIRTPKILGEATTEIFKGVMKGQAEQKAGMSVGTYPVDFDKIKQIILIVLVLYLGSALFSFLQQFIMTRISQNTVYQLRKDLKYKMKTVPIKYYDTHSNGDIMSRAINDMDNIASTLQQSLTQMVTSAVMFVGTIWMMLTISWKLTLIALVTIPLGLIVVGIVAPKSQRFFAAQQKALGLLNNQVEETYGGQVIIKSFNREDDEVRDFEGQNQAFYNAAWKAQFVSGIIMPLMIFLNNIGYVFVAIMGGIEVANGAITLGNVQAFLQYMQQFSQPISQLANLANTIQSTIASAERIFAVLDEQDMQDEPSGVPAVANDPNKLVMDHVQFGYTPDMLLLKDYNLQVKPGQMVAIVGPTGAGKTTIINLLERFYDISGGSIRLNGTDTRDMKREAVRSHFAMVLQDTWLFTGTIWDNLKYGREDATDDEVLAAAKAAHVDNFVRQLPDGYNTILNEEASNISQGQRQLLTIARAFVADPEILILDEATSSVDTRTEIHIQHAMNRLLTNRTSFVVAHRLSTIRDADNIIVMDHGSIVETGNHDELMAKNGFYADLYNSQFSGNVAI

SEQ ID NO: 662 - protein, 277 aa, Lactobacillus paracasei
NADPHDEPENDENTFMNREDCTASEMKILGIYGGQDANGLTASLVKEVLAGVAAPATTEFVDLNQYQIHPDKPETTNPTLDKLEAKLKAADVWVLGTPTYFGTVAGQFKQLLDCMRHRMTRMTHKGDTLPGQFKDKHYVSVTSCFATGLDNTFTHQTDATLVAIDKAMTAAGVHKITELVLPHTWGMTSLPLAKVNQAHQLGEKLGTFKKKDDETVKRYFLLFGMIAVMALATMGIQLLLPGIATNFWWRYVSFVVIFFVLLACLLHYATFMRHKRR

SEQ ID NO: 663 - protein, 288 aa, Lactobacillus paracasei
MTGIILPEETRVDFVALKVANLTLVSQWYQQVARLDLLRQNGSTIYLGTRLNQQVLVVLHQITGLQAQQPVTGLDHFAILLPNPGALGAAYRIVAKDQTVTTAFQTGYREGFIAHDPEGNGVAFTIDRAIEQYQEERQYNWEDETLQSIDPATIGKHAAREYDRLPSGTTIGYVQFRVSDLPATSHYLEQGLGFREKTGHDPNEVFLAAGDYRHHIGINLRLDAKLALPTPDMYGLDYVSFILPDQHAMENILMNLDAAGLTDYDYNKDNQFLMIAGPNRLTLWFRVA

SEQ ID NO: 664 - protein, 335 aa, Lactobacillus paracasei
MDFQAVTDELKTWTKARVMPGFSVALLTGKTVQTAVSGEAQWFPQPAPLQPHMLYDVASLTKVVGTTTVFLQAWDQGLVSPDMPLHRFLPDFPHTTTFRQALTHTSGLEGYIPHRNALSAPALKQALMTQLTVTEEVDRQVVYRDVNLLLVGWALEQVYHQPIQTLITRQVIQPLALPQATFQPDSQQCVPTTYSPAVGLRQGVVHDPKSAILGKHSGAAGLFASLADPVTFTEYFFGNRQSASWPAHAADLTQDWTKHHLGRSLGWDLRRDGQGRLWLYHTGYTGTFWLIQPDDQLALVVLTNRVHPQPNPAFLAKRDALIARFLSDFKTMPAV

SEQ ID NO: 665 - protein, 450 aa, Lactobacillus paracasei
VAFSAKASLATAIGRSSYWFLHTFLKGGSSLPGQIANRIDPQVLRTLGQNYDVIVVTGTNGKTLTTSLIVKVLKKKYKEVLTNPTGSNMLQGITTAFLAQPKRGHGRGIAVLEVDEANVAPVAAQLKPKAFVLTNIFRDQMDRYGEFYTTYQKILDGVTRDPEAMVIANGDAPIFSSRKLPNPVTYYGFELTANGDHKAPPNTDGVLCPVCQHILHYHAQTYANLGNYFCPHCGFKRPALTHQITEVTQMTPQSSDFMIDDQPCHIDIGGMYNIYNALAAFAVGRAFGVTPTEISQAFAYDEKVFGRQEVIQLGKKKLTLILVKNPVGLNQVLSMIETAKQPFGFAMLLNANYADGIDTSWIWDGNFEELVASQKAASYLVGGERYKDIGLRLTVAGVPEKALVSKPALDDVISTLKRSPQDQLYVLATYTAMLQLRKKLSDGGYIKAGF

SEQ ID NO: 666 - protein, 196 aa, Lactobacillus paracasei
MAQLFFRYGAMNSGKSIEILKVAHNYEEQNKRVILMTSAVDDRAGVGMIASRIGLERTAIPITHETNLYDIIKANDPKAACVLIDEAQFLQKHHIFEAARVVDELHIPVMAFGLKNDFRNELFEGSKYLLLYADKIEEMKTICWFCAKKAIMNIRIHDGQPVYEGKQVLIGGNESYYPVCRHHYFHPPLKQIDPAD

SEQ ID NO: 667 - protein, 359 aa, Lactobacillus paracasei
MDKIFEQLDGLLDRYEELQELMSDPEVISDTKRYLALSKEEGGMRDVVAAYKKYKQVLSDIKESEEVLRESKDDDMEALAKEDLEDLQKQKADLEDQIKVLMLPKDPNDDKNIIMEIRGAAGGDEASLFAGDLLNMYMHYAERQGWKTEIIDATPTEVGGYKEVVVMITGDNVYSKLKYENGAHRVQRVPVTESAGRVHTSTATVGVMPEYDEVDLKIDPKDIRTDVYRSSGAGGQHVNKTSSAVRMTHIPSGIVVSMQDERSQQENRARAMQILRSRVYDYYETQNQEKYDQNRKNAIGTGDRSERIRTYNYPQNRVTDHRIGLTLNKLDRIMNGELDEIIDALIVHDQAQKMESLNV

SEQ ID NO: 668 - protein, 276 aa, Lactobacillus paracasei
MSKTYAEALKWASLLLTKDGIDPDGARYVLMTRADFTPSQLILHRQDLMPETRWQQFQQDVERLRQFEPAQYIVGVAPFFGELFKVTPAVLIPRFETEELVAWVAEEQRTAQTGLDLGTGSGAIGLTLARKLPQTTMTLSDVSPEALAVAKQNAKKQQVAVQFTVSDLFAALPARYDFVVTNLPYIAPEETPVMDQSTLRYEPKLALFAGHHGLAVFEQFVAALPQHLTAGGVAYLEFGYRQEPALRELFAKQLPQAQVTFRRDMADHPRMAKLQF

SEQ ID NO: 669 - protein, 333 aa, Lactobacillus paracasei
LSKRYHESDIPEAAAALKRGELVAFPTETVYGLGADATNVTAVGKVYAAKGRPSDNPLIVTVADADMVGQYATITPLAAKLMQAFWPGPLTIILNILPGRLSMKVTGGLQTAAFRNPDNALTRKLIATAGVPIVGPSANTSGKPSPTTADHVLHDLDGKIAGVLDDGPTQVGVESAIIDLTVTPPAILRPGAIGPDELEPLIGHVDTAAHHVGQNEAPKAPGMKYKHYAPAAQVVVVDDPAQFSAAVAWAKQTGQVFGLLATDAILAQYPTIPSYSLGKDVQSAAHALFAGLRWFDLHPDVTLVLAQAFSKTELSAAYMNRLLKSAGDMHFQG

SEQ ID NO: 670 - protein, 410 aa, Lactobacillus paracasei
MDFMAQDPEVFGAIHNEEERQEHNIELIASENIVSPAVRAAQGSVLTNKYSEGYPGHRYYGGNQYIDVVENLAIDRAKKLFGAEFANVQPHSGSQANMATYRAFLEDGDKVLAMDLTDGGHLTHGSPVSFSGQEYHFYHYGLDPKTERLNYAKIREQAEQVQPRMIVAGASAYSREIDFKKFREIADHVGAFLMVDMAHIAGLVAAGLHMNPVPYADVVTTTTHKTLRGPRGGLILAKAQYGKAINSALFPGIQGGPLDHVVAAKAVALGEALQPSFKTYAQHILDNMQAMVSGFEEDPHLRLISGGSDNHMVLIDVTGYGVNGRQVQDLLDEVGITTNKNQIPGEQNGPFKTSGIRVGTAAITTRGFTADESKRVGELISAAIAQRDDQPALDQIHQEVLALTARHPLS

SEQ ID NO: 671 - protein, 209 aa, Lactobacillus paracasei
MGKFTVLNHPLIQHKLTLIRDKHAGTKEFREIANEIAELMVYEITRDLPLESIEIETPMGKTIQKQLAGKKLAVVPILRAGLGMVDGVLRLIPAAKVGHIGMYRDEKTLKPHEYFVKMPPDIEQRDLIIVDPMLATGGSANMAIEALKKRGATSMRLVVLVAAPEGVKAVQAANPDVDIYAAALDDHLNENGYIVPGLGDAGDRLFGTK

SEQ ID NO: 672 - protein, 236 aa, Lactobacillus paracasei
VNEQYPSIKLFGLSFNLTNDIGVLVSAVLVFLLVFWLSRNLKMRPGGKQNVLEWIMDFTNGIVKGTMPGSERYTFNLFAFTLFLFIFISNQIGLFIEVDIGKDTWFRSATASPVITMTLAMMVLVLSHYFGVVFKGFKGYLKGYASPVAILLPINLLEEFTNFITLSMRLYGNIFAGEVLVLLIRQFAFSGGAVSFVSGFLLEVLWQGFSVFIGSIQAYVFVTLGMVYTSHKIVSE

SEQ ID NO: 673 - protein, 70 aa, Lactobacillus paracasei
MQFIAASIAAGIAAFGASIGNGMVISKTLEGMARQPEMAGTLRGTMFIGVGLIEAVPILSVVVAFMLMSR

SEQ ID NO: 674 - protein, 162 aa, Lactobacillus paracasei
MTLGDTLFTLVTFLVLMLAVGKVAWKPVSKMMADRQQKISGDLDYAEKSRKDADALAAKRQEELQHSQADAVKIVNQAKENGEKQRQSLVDAANAEVTTMKKNAQTDIDQARKDALASAKNDVADLSLTIAQKLIGKELNADDQKGLIDDYIKRLGDANGSH

SEQ ID NO: 675 - protein, 181 aa, Lactobacillus paracasei
MAVTNQMVAPRYAKALLEAAQDQNQVETVHEELQALQSVFNDNPTILTIFDNARITAADKDALMTTLTKDASPLVANLLKLTQQYGRFGALPAIISAFNQAYDEEAGIIAATVTTAVALSADQADALRSTIAARFGMKSTQLDQVVDPSVIGGVRIQARGSVIDGTVKHRFDKMKAALLAD

SEQ ID NO: 676 - protein, 509 aa, Lactobacillus paracasei
MSIKTEEISSLIKKQLEGYQDDLAAEEVGTVTYIGDGIARATGLENAMANELLQFSNGSYGMALNLETNDVGIIILGDFDEIREGDQVKRTGRIMEVPVGDAMIGRVVNSLGQPVDGLGAIKTDKTRPIEFKAPGVMQRKSVSEPLQTGLKAIDALVPIGRGQRELIIGDRKTGKTSIAIDTILNQKDQNMICVYVAIGQKDSTVRAQVETLKKYGAMDYTIVLTAGPSEPAPMLYIAPYAGAAMGEEFMYNGKHVLIVYDDLSKQATSYRELSLLLRRPPGREAYPGDIFYTHSRLLERAAKLSDKLGGGSMTALPVIETQAGDISAYIPTNVISITDGQIFLQSDLFYAGTRPAIDAGASVSRVGGDAQVKAMKKVAGTLRLDLASFRELEAFTQFGSDLDAATQAKLNRGRRTVEVLKQPVHKPLPVEKQVIILYALTHGFLDPIPIEDITRFQDELFDFFDSNAADLLKQIRDTGNLPDTDKLDAQIKAFAGGFQTSKQLAAAKD

SEQ ID NO: 677 - protein, 308 aa, Lactobacillus paracasei
MAESLMDIKRKIASTKKTGQITQAMQMVSGAKLSQIEKRAKKYQIYSDKVRQIVTHLAAGQLLELANAAESDTDSGDKSQVISVASLLQKRPVKKTGYLVITSDRGLVGSYNSTVLKAMMQMIKDDHESPDDYVMMAIGGVGADFFKARGLNLAYEYRGVSDIPTFNEVREIVKTAVTMFDNGVFDELYVCYNHHVNTLTSAFRAEKMLPISDLDVSEVADTNVEYLIEPDLDSVLESVLPQYAESLIFGAIMDAKTAEHAASTTAMRSATDNANDLISHLSTQYNRARQAAITTEITEIVGGAAALE

SEQ ID NO: 678 - protein, 488 aa, Lactobacillus paracasei
MPNSTGKIAQVIGPVVDVAFPINGDLPEINNALTVAKKDGSQLVLEVALELGDGVMRTIAMDSTDGLQRNMAVQDTGGPISVPVGKDTLGRVFNVLGDPIDGGEAFGPDHRRDSIHRDAPKFEDLNTSSEILETGIKVIDLLEPYLRGGKVGLFGGAGVGKTVLIQELIHNIAEEHGGISVFTGVGERTREGNDLYFEMKESGVLENTAMVFGQMNEPPGARMRVALTGLTIAEYFRDVEGQDVLLFIDNIFRFTQAGSEVSALLGRIPSAVGYQPTLATEMGQLQERITSTKKGSVTSIQAIYVPADDYTDPAPATTFAHLDATTNLERRLTEQGIYPAVDPLESSSSALTPEIVGDEHYKVATEVQQVLQRYRELQDIISILGMDELSDEEKVVVARARRIQFFLSQNFNVAERFTGQPGSYVPVEETVKGFKAILDGKYDDYPEDAFRSVGRIEEVVEKAKKMGFAPDDQNTDADEKPAAQAAAN

SEQ ID NO: 679 - protein, 143 aa, Lactobacillus paracasei
LAETSNVLRVNIVTPDGLVYDHHARMLVVHSVAGELGIMANHEPIVTPLEIGEVDVQRVDASDHNDSIAVNGGFMEVSENVASIVADSAERERDIDLSRAQAARDRAQKRIAQAKNDHNQDDLRRAQVALRRAINRINVKTSH

SEQ ID NO: 680 - protein, 78 aa, Lactobacillus paracasei
MFQTIGLNGAITIVSHFVFIMLAFRALNALRFEQFIKANHVREAQVLLLFIAVALGFLVSSFFLSLLQAALNLPKLFL

SEQ ID NO: 681 - protein, 329 aa, Lactobacillus paracasei
MAKDIGIDLGTANVLINVKGKGIVLNEPSVVAIDTHTGKVLAVGTEAYKMVGRTPGNIRSIRPLKDGVIADFDITEAMLEYFINKLNVKGVFSKPNILICAPTNITDIEQKAIIQAAEKSGGRHVYLEFEPKVAAVGAGLDIFQPQGNMVIDIGGGTSDIAVLSLGEIVTSRSLRLAGDKMDASIAAYVKNKHKLIIGEHTAEQIKIKIGAVYEADEKETIEVRGRDIATGLPREVSVTSVEVAEALHETMMAIIEGAKGVLEKTPPELSADIIDRGIMLTGGGALLKGISQLFAAELKVPVLLADDPLDAVALGTGVLLDNIEHHRQY

SEQ ID NO: 682 - protein, 56 aa, Lactobacillus paracasei
MDSQYPKRIFHIIKIWLMIALIALILGLLIGFALGEGNPLKLFLPSTWVHFFKFLR

SEQ ID NO: 683 - protein, 101 aa, Lactobacillus paracasei
MKQVLTWLVRGYQRFISPLLPPSCRYYPTCSTYMIQALQKHGAIKGSLMGIARILRCNPFVKGGLDPVPAFFTLRRNPHPENDLDLSDIQNLNHKLGGRHG

SEQ ID NO: 684 - protein, 73 aa, Lactobacillus paracasei
MAKERNIKVTQADETRNGHTVSVLKIGDREIGFIEPDGTRFSAFVAGSTKPNRFKTLDAAVNALIAEYHLHQG

SEQ ID NO: 685 - protein, 401 aa, Lactobacillus paracasei
VESHEIKSNSEGDRIDYGIILSVMLLALIGLVSIYLATAHDTSTLQNPVRATVMQAAWYVIGGIGIFFVMRFDAEQLWRIAPYLYGIGIFLMIAVLIFYDRNTEASTGAKSWFALGPISFQPSEVMKPAYILMLSRVVTQHNAAFSHTIQHDWQLIGRMVLWTLPIAVLMKFQNDFGTTLVFLAIFAGVTLVAGINWRILVPIALVAGIIGTVGILLVTQTWGRSILGSIGFKTYQFARIDSWLNPSGSTTGDSYQLWQSMKAIGSGQLTGKGPMHIAVPVPVRESDMIFSVIGEAFGFVGAAVLILLYFMLIYQMIRVTFDTKNEFYAYISTGVIMMILFHVFENIGMNIGLLPLTGIPLPFISQGGSFLLANMLSVGMVLSMRYHHTSYMFSRDTEDFE

SEQ ID NO: 686 - protein, 99 aa, Lactobacillus paracasei
MATTYFWQDELAAGQIRLGLTQEAQETLGKIKYVDLPTIGASLTTGKPFLSVEAEKAVLDLEAPLAGTIVDVHQELSDKPALLDETDHNQNWVVTVSTK

SEQ ID NO: 687 - protein, 396 aa, Lactobacillus paracasei
VLNKTRAQSLQQLTVATKDGAIMTEPIALLQKLIQINSVNGNELAVAKLLQAELEAADIPTKLIPYTEDRVNLIAELNHGDRVLGFTGHEDVVSPGDESAWTYPPFSGKVVDNVMYGRGTDDMKSGLAAMVLALIALKQSGFTHPIRLIATVGEEYGAMGARLLTEQGYADDLAGLVVGEPTTKILKYAHAGTVNYEIDSEGVSVHSSRPEKGVNAIDGLTTFAALEHHAFDNAPADPDLGPFRHSITVINGGDQVNTIPAHAFLRGNLRPTPSANIELVVKMLEDLVAHVNATTDAKLTLKVLHRFLPVHSDKTGHLVTSANTAIAAVTGKPAELAVAFGGTDASEFIKSTNHFDVIVYGPGDNHFSHQVNEHIDLNSYTTAIKIYQEIAKRFFE

SEQ ID NO: 688 - protein, 276 aa, Lactobacillus paracasei
MKRFWKILTTIFVLGLVLVGCGKSSSSSSSSQKQTTVKIGVVGADNRVLQAVAKKVKKEGITIKIVQFSDYNQPNTALRDHDIDLNLFQHQYFLNNWNKTHKADLVSIGQTIIAPLAIYSKKITKISQIKKGDTIALPNDPTNEGRALQLLETAGLIKLNKKVALPTTRDVTENKLDLQLKAVDAAQTASSLPDVAASVVNSGVAHDAKLDPKKAVYTEKVDKQSQPWINVFVANKKDKNNATYKKIVKAYRTKDIADLIEKLYHGSEVPAWTQKF

SEQ ID NO: 689 - protein, 275 aa, Lactobacillus paracasei
MKFWKKAILTFALILPVFVLAACGKSASSTKNTTVKVGIMSTDKEIWTDIQSRLKKQGVTIKLVQFTDYNQPNQALEDGDIQLNAFQHHNFLDNWNKKHNTKIVDIGATYIGPMRAYSNKIKSLKDVKNGDQISVPNDPSNEGRALQLLAQNGLLTLKKGVASPTIRDITENKLNLKFTELDAAQTARSLNDVAVAVVNNDIAAAANLKPANAIAVEKITKASKPWVNFIAAKSAKDKDNATYKKIVKAYQTQRTADLLKKVYKGSTLPAWNYKF

SEQ ID NO: 690 - protein, 350 aa, Lactobacillus paracasei
MSDQAVVTLKDVDVEFHGKTRSVHAVDHVDLTVNRGDIYGIVGYSGAGKSTLVRTINLLQRPTGGSVNVLGQDMLALSPAQLRKERKRIGMIFQHFNLMNSRTIADNVAFPLKGIKSKQAIQKKVAELLDLVGLTDRANSYPAQLSGGQKQRVGIARALASDPEILISDEATSALDPKTTSSILELLQSLNQRLGLTIVLITHQMEAVKQICNRVAVMDDGAIIERGDLLQVFSNPQQQLTKDFIDTTLQLDQAIDAVMQQPTVKNLGPDDRLLRLTYVGDSADQPLVAKLFSSYHVTANILFGDIQILQDTPFGNLIVVLSGDHDEVEAGIAYLKQQDVKIEDILKKEA

SEQ ID NO: 691 - protein, 229 aa, Lactobacillus paracasei
MGQFFTKYFPNVVPIWSGDGGVTQAINETLYMTVLTAVVAGILGIVIGILLVLTDEGGLLANQPFYFILDKLVNIFRAVPFIILLAIMTPVTRAIVGTGIGPTAALVPLIAGTTPFYARQVQNALLTVDPGVIEAAEAMGVSPLGIVLRVYLREGLSELIRVSVLTIISVIGLTAMAGAVGGGGLGNLAIAVGYQRYQYDVIIVSLIFILAIVFLVQFIGDFFARKTHH

SEQ ID NO: 692 - protein, 255 aa, Lactobacillus paracasei
VHTLEIKDLHVKIKAEPEHPEILTGVNLKLATGEIHAIMGPNGTGKSTLAETIMGNPAYEVTQGDVLIDGQSILDMAVDERARAGLFLGMQYPQEIAGVTNAEFIRAAINSRRPEDDQIRITDFLKQLDDTMATLEMPESMADRYLNQGFSGGEKKRNEILQLMMIHPHFGLLDEIDSGLDIDALRIVAKGVNLLRGPDFGSMIITHYQRLLDYIIPDVVHVMKGGRIIESGGPELAKELEKTGYEHLKVGDQNG

SEQ ID NO: 693 - protein, 343 aa, Lactobacillus paracasei
MAEAVTLPAPNLPKFPLARYLKLQPDAVLDRVILHAPQSVAYAAGSSEVQRFTPVTSLDAWLLAHPQGATTIDIPAHFVSGDEPIVLTGPKQAGGLLYVHVGKGAKVTIQEKWASGGNVLGVWLVLVIDADAEVSWLSYDSFTAETVIANRTATLGANAKLNWTLAGFSRNSGLNRVDVRLLGQNAEATVNVGVLAAGSQHVSYTTSVTNEAQHTVGHINQRGVITGSAHLLFNGIGHIIKGARGSDAQQENRVLMLSPHAEGDANPILLIDENDVTAGHAASVTRVNAEQLYYLMSRGLSATLAKRLVIRGFLEGGLAEIDDVRLKKELFATIDRTLVAEDA

SEQ ID NO: 694 - protein, 398 aa, Lactobacillus paracasei
MREQFPFFRAHPELVYLDTAATSQKPQALLDAIQNYYVNDNANVHRGLYKLAYDTTEAYENVRQQVAGFLGAASADEIIFTRGTTDSLNLVASAYGPQVVTAGSQIVVTGAEHHSNFIPWQQLAKRQQATFTVTPVKPDGTVDIAALLAAITPQTKVVAVAQVTNVAGDTLPIAKIAAKAHAVGAVVVVDGAQAVAHLAVDVQAMGADFYAFSGHKIYGPTGIGVLYGRADLLQHMPPIQFGGEMISEVRDDVSTWADGPIKYEAGTPHIAGVIGLGAALTWFDQSVNAAAFDNEHQLADQLRAGLAAIPDVTVYGNQASLATVSFNLTGIHPHDLATFLDEQQIAVRAGHHCAQPLMARLGVPATVRASFGIYNNADDVERLIQAVQAARRYFHGID

SEQ ID NO: 695 - protein, 148 aa, Lactobacillus paracasei
MALTKLDQMYRAVILDEAQHPRHHGVLPAFDHEITVRNPSCGDVLHLQIKEDAGRVTDVAFSGSGCTISQASASLMTEQIIGKTPADIEQMVETFSDLIINGDVPNADILGDAAVLKGVHQFPARIKCATLAWKAAAQVLTQKGEDHD

SEQ ID NO: 696 - protein, 478 aa, Lactobacillus paracasei
MTETKNTKNNETVAADIDFLPEDNPADFKDDIKPVYSTGRGLTEETVRAISAEKHEPDWMLDYRLRAYATYKRLAMPNFGPDLSDLDLDNMLYFQKATDRTYRDWDDVPDAIKNTFDRLGVPQAERKYLAGASAQYESEVVYHNMRDEFEKLGIIFMDMDSALKEYPELVHDYFGKLVKPSDNKFAALNGAVWSGGSFIYVPKGVQTDVPIQSYFRINAENTGQFERTLIIVEPGAHVNYVEGCTAPNYSSDSLHAAVVEVFVKNDAYCRYTTIQNWSKNVFSLETKRAQALDNATMEWVDGNLGSKTTMKYPSVYLDGKGAHGTMLSIAVAGEGVDQDNGARMIHNAPNTSSSIVSKSIAKDGGAVDYRGTVRFTKKADNAFCHVECDTILMDEKSSSDTIPYNEIHNATVSMEHEAKVSKVSEEQLYYLMSRGISEAKATEMIIMGFVEPFTKELPMEYAVELNRLIGMEMDGSVG

SEQ ID NO: 697 - protein, 60 aa, Lactobacillus paracasei
MDNYDKARKVLQSTALSKIAQQTGISIGQIWHYRDRHEGIEKAPEAYVKKIASLYRNKRY

SEQ ID NO: 698 - protein, 126 aa, Lactobacillus paracasei
MAEDLEHFIKTMALGIPTIKPDEKRAFLGNFRERVAMAITIKQLRDARITTMLDAVLTRYPGYRIFLNGRMGESLVNQYMMQALAHNYPFTIMNQPGMRVTKRVLQTDFGWVLAHPTQKIARPILL

SEQ ID NO: 699 - protein, 322 aa, Lactobacillus paracasei
LTQLDTIQRTVQQLRDLLNKGEIFTALPNMLGKVIESVAVEPATPIKIPRDDKTAIVKIRAIQKRIKQTSDPSVTDDEIDFLVAHLASTNPAVRDKGVFFLFNDLFQAEAFTNEQIKTLFKRLQAPDILFNHIFEPQNNGIFLRSFSLMILSGMIYADQNRYHVLTKADYLATVQNIAVYILLEKDGRGYVEKKGWAHAYTHIGNMLEELSQVGVLPRAEKVLLMAAVVEAWRRVETPLVFGEDHRMALYLSSLTNVNKFYSETLLMCLKNWQHALVNVRPQESYSFWVRWYNRNRLLQALALRADLPQPIADYIQQIVDLF

SEQ ID NO: 700 - protein, 217 aa, Lactobacillus paracasei
LIKAIIFDMDGVIVDSEPCALENRLAYLRQVGIEADDRKLAGLLGRNMADVWRIIAPSKDALQLQAGYVAYKQAHPIPYVKIVMPGARPTLQWLKQHDIKTAIASASDLTFIEKMCTETGLRQYFDQLLSGADFTRTKPAPDVYLAALQVLDVAAEEAIAVEDSTLGIAAAKAAGLYTLAVPLRDPRFTQNQQAADQRIKKLTDIMGIVDDKNAYNQ

SEQ ID NO: 701 - protein, 295 aa, Lactobacillus paracasei
MRKEQQTLRILGDKVRYYRKLKGLSQAELAANICTQATISLIEKRNKVPSMNILMRLIGRLGIQLDDIVVEHHDRVQQLLTGIDFQIQHHQYALAAENLSKIRLDKIKNDDDQKRYYYYQGIIELFKNNAPDEAIYFFGRVLSPLVNSERDLFGILATLGLGLAYAAKHTFDRSRVYIDQALRMLKHVPLSDSKYLDVELTIYWHIARIYYELSDFKAVLKYTDLGVREAVKHDKLFLLDELFALQARALKLLGDPDASKSYQIAIAFARVTGSTPLETSLVAEMVSQKPNIETA

SEQ ID NO: 702 - protein, 165 aa, Lactobacillus paracasei
MLQQYQHILVAIDGSYEAELAFKKAVAVAKRNDAELILIHIVDTRAFQNVSSFDSAMVEQVTENAKSTMEGYVDQAKKAGLDKVSFSIEYGAPKTIIARDIPKAKNIDLIMIGATGLNAVERLLIGSVTEYVTRNALCDVLVVRTDLANKPALASTKKPTDNSDK

SEQ ID NO: 703 - protein, 92 aa, Lactobacillus paracasei
VTLLLMGIYAVVTFALAAYTWLHREQNFLIIKKPTPGLTRFLKLFACLFVLVGIAAIIGGLFFPLWANLVILVVGAFLAMIFVLISLTQMKL

SEQ ID NO: 704 - protein, 40 aa, Lactobacillus paracasei
MLRFLTGLAHASTKKAGTGPAKNRFGFCERLIGAVFFPDR

SEQ ID NO: 705 - protein, 431 aa, Lactobacillus paracasei
LQQPLAYRMRPQNLDEVVGQQDLVGPDRIIRRMVSAHRLSSMILYGPPGTGKTSIASAIAGSTKYAFRILNAATDTKKDLQIVAEEAKMSGTVILLLDEIHRLDKTKQDFLLPLLESGRIVLIGATTENPYMNIQPAIRSRTQIFQVKPLTPDDIASAIKRALADHKRGLGDYQVDLQPDALDYLTHATNGDLRSALNGLELAVLSTPASDDGTITIDLTTIQQSLQKPALAGDTNGDAHYDIISAFQKSIRGSDADAALHYLARLIAIGDLNSITRRLLVIAYEDIGLANPATASRTLTAIQSAERLGLPEGRIPLADAVIDLCLAPKSNSGIKAIDEALADVENGNAGQIPDDLRDAHYRGAKQLGHGIDYKLPHNYPNGWVAQQYLPDNLKNKHYYQPKATGRYEAALAQRLQQLKDWQRDAQKSKKR

SEQ ID NO: 706 - protein, 654 aa, Lactobacillus paracasei
MLNHYWQLIQKNNLFGLRDDTRIGVIRTVKPVLAEGEQLPVWANASRHALVQQVSATMLQLTTPLLDDPSEVVAYLRAGLSRVWAALPENGKLPVFTAGLENNQRIRIVLPEVLFERLYTAENFQGNGPDYVTYRNQIYDLVADGLITQLPLLTYLFAASPAKNGRAFWPAPDQERQLVQKVSDPDHLARTLALDVAVELDPYAASGVTEQMLNFLIDSCWFALSQPAIPLPAAAEVRRHSLAEAQKIAAGDPTAPVASLTAPIDAMAVWLNQVGLTPQRKQAFELMQSRVLKPETTIAGQVAAAYHDISAAQTPLATQAHADLSMEEDLPGFSNLSGNSQALLQAVIDGGYQWTLLDREQNILQIASDTQRHVLIDGALTSRTPASAMVVAEHRHAAKKVLAAAGLPVARGAKFTRWPEAKAAFEQSFARKSIVVKPEQRSHGLAVEQFAVPPTAKQFAQAFHAANQDHGVLVEMMGRGTTYHFTVIGRRVVSVLENAAANVVGDGRKSIKELIALKNGKRPNARQLKLDETANRQLKLQSVTMNTVLRRGQQIFLASAAHPQTGGDIYDVTTEIDPSYNQLAVAAADALELPIAAVDIVIDNLYDAYAAEHEGQAIIISVDPIPDLTLPQQPDMGAAHSIAPALLTYLFSEK

SEQ ID NO: 707 - protein, 146 aa, Lactobacillus paracasei
MSDDNMQEHLNSAIYGPPQTKPDERRAYMGSLRERVALQVTNQALADPKRQAQVQPLLKDFHAHGYKALLNGKLDNAITGPYMKMLTDANVPFTLVANETAQTADKAAGLLIVADTAINQSNVDLPPLEQDSEKPKKRGFDFFKKL

SEQ ID NO: 708 - protein, 200 aa, Lactobacillus paracasei
VVLFTLEDFAVFKATTLATRMHLIREQLDPKFAEAATVIVPLLQTDQQAIYSHIAKHQRRYRNPPPNTWVAFSTSSRGYKMVPHLALGFWDDRLFLWLSVLRESKPASRVLTGITAMATTLPGKWQVAGEHTDKAMLPLTSANLATVRARFQTIKKAEFLLGKVYLADDPIWADPVRLWQDIQRRVVALKPMFDQLVQNI

SEQ ID NO: 709 - protein, 221 aa, Lactobacillus paracasei
MPDVRFHSVFDIIGPVMVGPSSSHTAGAARIGKVVRDIFGEAPETITIYLYESFAKTYRGHGTDVALVAGLLGMAPDDPHLPESMKLAYDQGIKVSFVPKSDKVDHPNTAHIVLQKGDHRLAVTGVSIGGGNIQITEINGFKISLSMGQPTYITIHEDVPGMIAQVTKIFSDAGINIGTMTVTRESKGEQAIMIIETDDYQDDILAKLKQLPHMVNVTYFE

SEQ ID NO: 710 - protein, 288 aa, Lactobacillus paracasei
MFYTVKELIEQSHAFPSVAALMVHTEVENSTRTEAQVRHLMSRNLEVMERSVKEGIAGVKSVTGLTGGEAKKLDAYVTSGQFMSGKPIMEAVRNAVAVNEVNAKMGLICATPTAGSAGVLAGVLLAMRDRLHLSHDQQLDFLFTAGAFGLVIANNAGIAGAEGGCQEEVGSASAMAAAALVTANGGTVEQAATAVAITLQNMLGLVCDPVAGLVEVPCVKRNALGASQAMISADMALAGCISVIPADEVIEAVNRVGMQLPATLRETGEGGLATTPTGLRLKEEIFGK

SEQ ID NO: 711 - protein, 227 aa, Lactobacillus paracasei
VIHFYIVRHGETAGNVSQLIQGITNSQLNARGRKQALALGRGLRASGLMIDRVVASDLLRAQETAQQILLGMQVKLAIETDKGLREENDGVFEGRSLKDVSQEVFGVPDYHILVRSGKMPLEAIPDGIHAADATNQAENTQQVVSRYDFAMRRIVTGAEAANETNVLVVSHGTASLLWLRAHGGDLPNRTELTNASVSKVTYDNGRFKVDWMDNTEFRDQGLKEELS

SEQ ID NO: 712 - protein, 276 aa, Lactobacillus paracasei
MEQDVFLAKVTNLMLAPGTRAFEREQLRQAKHLVEAGRPVAEGWAQLESSLRPLAMRDNLTPDVADFYRAETGDPAGAVQTDLSAHFDRDMPFQERAIFAGGCFWCMVEPFVDLPGITAVTSGYTGGHSAHPTYEQVIGGYTGHVEAVEIIFDTRKMSYAALVALYFQLTDPTDALGQFQDRGSQYRPVIFVKDDTQRQIAEAAKAELAASGRYLRPIITAIEPVATFWPAENYHQDFYKKNPKRYQMVERTRRQFLQFQRAQGNLRVMLKRRKKA

SEQ ID NO: 713 - protein, 311 aa, Lactobacillus paracasei
MREPIRHWTQKNMPDLHGSYAVVTGGTSGVGFAMSAALLRHGATVIIVGKQASKGVTAEAKLRAQTGQQNVTFMGADLADQAATKHLANRLLRMLPKLDILINNAGVMMPAKHTLTRDGLELMWAVNYFAGFILTIELMPLLLRSDHARVVNVASIAMGRPHLTFNQFDGHDYRPWTIYTTTKLAQAMMVVKLNQLLTEAGQSVIVTGSSPGLAATSLKTISSRKTAWLMRMGALSFRLLPFLRQSPDQAALPALYAATDPNAQGGVIYAPHAWRGLRGYPALWAWNQRPELHDQKLLDRLYRASRNVTGV

SEQ ID NO: 714 - protein, 243 aa, Lactobacillus paracasei
VQTSGNYFSWLMHQLKGCPQQNYYLFWFAFGCQLMTLVDAKITPVTIITFIGTTLGVLCVLAINATKAVNGWLGLLSAACFIYVGFIARNYLSMFEQLAYVVTLDLPVLISVRTWNDDTKNNLKTFNAQKWMLSIGFTLIVWAVSAYLIGQFTNDPRPIFDGMAFAISLTGGIVCFLRYNNQYFWWLFSGVAQLVLWAITFAQGDASLAMAINASIYVINDILAFTVSPWFNRGRKQLGLKTI

SEQ ID NO: 715 - protein, 242 aa, Lactobacillus paracasei
VIYILGSIGAGKTSLTKVLSEDMQAPAYYEDVEGNGMIANMLQKFYGAGVESRKRTGAMLQIAFLTFRYQQLKKAVTQENAIMDSSLESDFVMASQLHKHGEIDDVDFNVYVTLSQEMQSNVNGSPWNGFPDLAVYLKIDPDHEIDEIQSRGRDMEDIREKPELVDYYRRVNTAYRDWAKGYTRSSMITIDRDRYDFMHSAADRASVLDQIETKLVDLGKLSPQAFDALQAQHADGPISKFA

SEQ ID NO: 716 - protein, 270 aa, Lactobacillus paracasei
VTIYDQHMHTLYSFDSEAQLRDYLTQTKAPVVTTEHLEFDNPDDGGRDNLPDYARMKATQAALAEKFPNEFLLGIEAGYFAPADARFRQYLDNHDFDLTLLSFHHDGHYDYLDEQLITMPAKQQLEDYFERMLAGLKRFHDADVLAHFDYALRRFDITPDQLEAWGKPLLDQIFTIAVENDLALELNTKSMYRWGNAPLYDQAIAWYQAAGGHLFTIGSDAHEGPQYEANFADALAMLKRHGVKEIATYRQHQRTMVPIEPPVIDADNAY

SEQ ID NO: 717 - protein, 546 aa, Lactobacillus paracasei
LKTQQKWLVVAAAALTFVLTACGTQSSKDSSSSSKQQVWHRMEADVLQTLDPSKASEGVSGQAIIDTMNGLYKYYGHDLQPAMATKIVKPTNNGLTYTFTLRNAKWSDGTPVTAQDFVFAWQRTVDPATKSTQANMYSGIKNADDIRAGKKPATDLGIKAINDKTLEVTLEHPIPYFNSLLNNVAFFPQPAKKVKAWGAKYGTKSQYTLSNGAFKSKGWTGTGDKWTEVKNTTYWNKKNVHLTQIDVQVVKDTNTALDLYRTGKLDDANLTGQLAAQQKGKTGYVATKRARTYFLELNENKVPAFKNTKIRQAISMAINRDSFVKNVLADGSIVARGITPADLSQLPDSSTDYATAVAKNTKAITTYNKKKAQALWAEGLKEVGTKTVDVELLGDDVDAVKATQEYLQGALQENLPGLKISIASVPAKNRQQRAATHDFDMVLSTWGADYPDPNTYLDLFTSSSEYNHGQWQNADYDKLMAKSNGADANNPTARFKDMTEAEQLLVNQAGAIPLYQLVAARMVNPKIHDLKTSPGNSFNFVYAYLK

SEQ ID NO: 718 - protein, 298 aa, Lactobacillus paracasei
MLGIIIGLSVICLVLAITLLLIIIDIRRINRELIYINHVETNAGVTTNTNFPLVRKLAAGINDNLNATRQLRLEQIAQEKKIHQMLLNLTHDIKTPLTVATGYVQLLNRDPHADAKQSLARVAHNLRSVNYYLHYLMDFNLIQEKSTALKLKPINLSKLLETELFDYFDQLTASGMKVTPKIAPNLVLTTDETMMRRVFQNLIGNWLKYAKNQASVTLVRQDEQRLTITFTNNTDKPLANADQLVDRFYTTDSARTTQSVGLGLSIVQSLTTTLGGKMTLQSDKQQFAVTLTFRDHNV

SEQ ID NO: 719 - protein, 225 aa, Lactobacillus paracasei
MGKILIVEDHQDIQALLRDVLSPYYAVIQAYDGISALAQFHQEAPDLIILDLMLPNVTGESVLTTIRKTSSVPVLVLTAIQDKQKTVALLQQGANDYLTKPFDIDELLARVQVQLRQTLPAPSAKAQDHLQVGEITLNLKRHAVTVNNQPLTLPKKEYAMLALMMRDPHQVFDKQQLYEQVWGEPFMNADNTLNVHISNLRTKINDLAKDPKYIVSIWGIGVRLI

SEQ ID NO: 720 - protein, 309 aa, Lactobacillus paracasei
MTQSVLTIEHVSKQFGRFQALDQVSFTVEKGDIYGLIGENGAGKTTLMRLITGLSPMQHGTVTLLGEQAGHYQHALSRIGAVIESPAAFEKLTVYQNLRLCAIQHGIQDKQAITEAIDFVGLKAKQTTKVKHLSLGQKQRLGLALAILPRPDFLILDEPINGLDPSGIMEFRQLLKRLNEEQQTTILISSHILSELYQVSTRFGIIHHGRMIKQLTKAELDKANQSGLAVTVDDTALAAQVLDQNGYQTFDVIDDHHLLLRQPEVNAAAVNQLLVTSGVGVQDISHQAGSLEQFYMQLLGQTEKQEGQA

SEQ ID NO: 721 - protein, 256 aa, Lactobacillus paracasei
MINQIRADFYRQIHTTGMYIMLVLTIIYAATTTLGQSVGGVTVRGDSGQFAQVGGKSWSVLTGIKVANMGETMLLYVFIGVFVIVFGYEFSQKVYKNTLISGISRLAFVLAKYLVMLLDLLLLFAVNFLTVLMAGLVAGRPLGGSLGTLFGTFSLSFVAATFFVSVIFSIGVFLLVLTGSIMIPAIVVVVFPLIVSVLHVLGEWDWIKYIDFFGVAQNIGVGGMKVSALPPYIAVSLALLVVMIGSSALMLRNKEL

SEQ ID NO: 722 - protein, 292 aa, Lactobacillus paracasei
MELRTLRYLVAIADAGTITAAANAIHISQPALSRQMQELETELGTKLFNRKSRAISLTANGTYLVNRARQILTLTDAAVADIVDDHAVSGTLAIGLGESRLNQIVLKAAQQLIDAFPDVTLRLYSGNADDIKERLDHGLLDFGVVIDPADTYKYAYRRISGENRWGLLIPISDPLAAQTAISPETIRGQALIVSEREPVVKMLTDWAGHAFNPNQVVARYNLIYNAGLLAQLGSGYIVGLSHLIGHDEMQLKFVPFSPTLTTKMALIWTKNVPMSGAAQKFLEIFNQLIETV

SEQ ID NO: 723 - protein, 288 aa, Lactobacillus paracasei
MKKTLLLIPAVLLLFTAGCGQNSQSSSKSGSVRTTQSSKKTAKASTSQKQKKTASKSSSSTSSSTTESADAASSSTTNTSGTANVDQRYAALKQATFRQLGNPKWPSAYQVDQTQYLNIFTTGDSQNYSIFFSPGSHALAYNDATLQNVNAELAIQKKTYGNNAQAQAQIGAAQSTQGLPQVAIGDGIYAASQGAAGSSYLTWNEGRWTVTVKASAVNGEDPLPLAKEAVTWFANNALPAPETHGTVDLAVTAANTRQNQITWTEGNAVYQISGLDPMKTIQEGTATR

SEQ ID NO: 724 - protein, 380 aa, Lactobacillus paracasei
LAKIKVMTVFGTRPEAIKMAPVVLSLKNRSDEFEEVTVVTGQHREMLDQVLSIFHIEPSYDLNIMKSRQTLADITSNVILKLGQIIAKEKPDIVLVHGDTTTTFAASISAFYQQTKLGHVEAGLRTWNKYSPYPEEMNRQLTDVLSDLYFAPTNQSQANLLKENHPESQIFVTGNTAIDALDQTVRDDYHHEVLDMIDPNKKMILVTMHRRENQGDPMRRVFKVMREVVESHPDIEIIYPVHLNPVVQEAADAILGHHKRIHLIDPLDVVDFHNLAARSYFIMTDSGGVQEEAPSLGKPVLVLRDTTERPEGVEAGTLKLVGTDPTMVKTAMLQLLDDPTEYRRMAEAKNPYGDGHASRRILDAILYDFGKIQNRPAPFK

SEQ ID NO: 725 - protein, 330 aa, Lactobacillus paracasei
MALPTLWIVIPCYNEEKVLPITAPKFLAKLNDFIRDKKIKENSRVLFVDDGSKDHTWELIQQFAQKDAHYLGIQQSRNRGHQNAVLAGLMTAKDHCDITISIDSDGQDDINAMDAMIAAYTDGCEIVYGVRSDRQTDSWFKRVTAQGFYKFLRLMGVDVVYNHADYRLASSKVLQHLADFKEVNLFLRGMFPLVGFKSTSVYYERHERLAGKSHYPLSNMVSLAINGVTSLSIKPIVFIAELGAVVSILGFIGTIWAAVMAFKGATVAGWASIVCIVSFLGGIQLLSLGVIGEYVGKTYMETKHRPRFIISDQTWEETQEKEQEKKNHSQ

SEQ ID NO: 726 - protein, 346 aa, Lactobacillus paracasei
MDIILLPFIGLILASMQQSQNLKKGHLGKNTTNNLKGISIIFIILHHINQELGPVAGTFFASRLSLAGRLGVAIFFFVSGYGIMRQYQIKGPSYLKNFLPHRLLPIVTLYILAMVLIFPIKHFLMGLTLKQAAISMTNGAPFVNDSWFILAIIFFYLAFWLAMKLSKGHALPLFAILLLLTAIYTGYIWKKGMGEWLINAAFVFPTGVLFAYYEDHFIPFIQRYYSPIMLSTSTLFAICFTLDEVHSLMRYRMLSEIFFALALMIISYKVECDNKLFLISSAWSLNLYLYHPFIASLLHGNAAIAAHSVIYGLLVIILSYLVAGVIAFIQRKVKTIRPKETIPVKS

SEQ ID NO: 727 - protein, 215 aa, Lactobacillus paracasei
LKNINQGAGAVAFIGQILAYPFLIALSLQITWHFQIIALLLMGICLAAAMVVKRYPLVLIIAAITGIIGAINQWILLPLVAVQLLLTFLLRTQKVTKQWAGTIAFGQAILFQILLIYAGLHFLSQDMLLDLALLYVPALIGLWASHFAKWTDMVLLAITVVIGYWLQRLNLIAIGGIIILVTLINSRRPFKVPSYLYQFSPVIATLLLYLARMHG

SEQ ID NO: 728 - protein, 394 aa, Lactobacillus paracasei
MQERHLFTSESVSEGHPDKIADQISDAILDAMLEQDPDSRVACETTVTTGLVLVVGEISTKAYVDIQSVVRGTIKKIGYTKESGFDPDSVGVLVALDEQSPDIAQGVDESLEARESDTDPLDKIGAGDQGMMFGFAIDETENYMPLPISLAHALMRKTDSLRHKGEISYLRPDAKAQVTVEYDDDDNPIRVDSVVVSVQHDPDVTLEEIRRDVEAKIIRTVIPEALMDDDTKIYVNPTGRFVLGGPQADSGLTGRKIIVDTYGGFARHGGGAFSGKDATKVDRSASYAARYIAKNVVAAGLAKRVEVQLAYAIGVAKPVSVSVNTFGTSAVSEDVIEQAIRENFDLRPAGIIKMLDLKRPIYEQTAAYGHFGRTDVDLPWEHLDKVQALLKYRD

SEQ ID NO: 729 - protein, 497 aa, Lactobacillus paracasei
MKQRKTNVALVTAAIFIGTFMTAIEGTIVSTAMPTIIGSLHGVHLMNWVFSIFLLTNAMATPIYGKLSDKIGRKPVFLIGLTIFVIGSLLSGLSQSMEMLIIFRAIQGIGAGAIMPVTFTIIADIYPFEKRAKMLGFNGSMWGIASVIAPLLGGFIVDQLSWHWIFFINVPLGIFTFGLVWFFLQEDRRSVRQPLDMRGTVWLLVALLAMMYGFQTLAEPNGIWQLVAMAIVATLGFWRFWQAERRAVDPIIDLKLFENRTFVIHNLIAALISGFVIGFEVYMPMWIQGIRGMDASLGGFAVTPSSLMWVVGSFVAGKLLGRFQPKPILTGAMIWLLGGSLVLALVPQSTPYFVFLLVAGALGFGFGLVITITTVTAQAVVAPDQVGVATSFNTLSRTLGQTLMVSVYGIVLNLRLTQGIAADSRLNSNMLNELINPHTAKNLPAAVLPTLRQILYEGLHNIYFFSIIIVALAILANHFEAKRVLTKETIQESNEES

SEQ ID NO: 730 - protein, 140 aa, Lactobacillus paracasei
MGPFNARLRSLDISLGIGETSRVTGATPTQIRYWEKKQLIHSRRHDANGNKRYSLANITLIVMIKTMLDEGYTLAKASEEIERSHQKADMLHVLISTRLQDIKREATQTVFNFGPLENDPDYDVIAQVTDKTAKLYKQPV

SEQ ID NO: 731 - protein, 492 aa, Lactobacillus paracasei
MDVKDINGKHVNVPMMVTTLIVGTFITILNQTILSTAFPTLMKAFNISTATVQWLSTGFMLVNGIMIPVSAYLSAKVPSKWLYMSAMSTFFVGTLVAFIANSFGVLLIGRLIQALGVGITMPLLQNIMMSIFPPNRRGAAMGMAGIAIGVAPAIGPTLSGYVIDNFGWRFLFGMILPIAGLVILATLFFFKNVLPLSDPKLDIPSLIESSIGFGSLLYGFSEVGNDGWGDPIVLGTIALGVVFIFIFGYRQLHLKEPFVELRVFKSKIFALSTVLGTIANMAMVGVEMILPMYLQIIHGKSALESGLTLLPGAILIALMSPVTGQVFDRIGAKRLAQLGLFLLTIATLPYFFLTESTPSIFITVIYAVRMFGISMVMMPLTTNGMNALSPDMIRHGTAVNNTVRQVATSMTTAVMISVLSNVTNLAKPAASLLKTNPLQYKQDFFGATLSGYHAAFLLAAGFSLIGWILAFFLNTHAMSQEVTIKNEKKVKA

SEQ ID NO: 732 - protein, 241 aa, Lactobacillus paracasei
MILWFLGLTVIGLYLSFIMMKRSSLRSTLIAVFGIGVVGSLLLITLNDNAHFGMVKRTTTDEQTIYTASPNAQLPMLLKQNIGTDGKHVVYIYKTDPKKKAVHTKADIVVTNRVTTTANATASLTSKTTRWQYQNGFYGALFNHEGAGQLVAQHNQLVIPTSWSVLTTAQAKQLGKKLAALQQPTAEQKASLAAAVKAKAAALAKAEPKLAADPTALAKQAKAAVEQAMIQQAVREVQAQK

SEQ ID NO: 733 - protein, 227 aa, Lactobacillus paracasei
VLKRRPEPLYLAAIALFIFITLLTGILNNAGWIHTIDQQVIAAVIQFHPVTFKPLLILITSLGNPVSLVFLTMAFAVVLLLKRYRYAALFAASMGALMSLVNVGIKYWVRRPRPFIADPQIRALVHAGGFSFPSGHSSGTMIFYGTMILLAWALLKRQSAKWLITCLASGMILLTGYSRIFVRVHYPTDVFAGFSLGFALLMVSWWYFSPYLTNRFAKQSKKQTVKK

SEQ ID NO: 734 - protein, 803 aa, Lactobacillus paracasei
MAYDHHEIDKKWQRYWAEHNEFNTTTDPKKPNYYALDMFPYPSGQGLHVGHPEGYTATDIVARMKRMQGFNVLHPMGWDAFGLPAEQYALNTGHNPKTFTKQNIETFKRQINSLGFSYDWNREINTTDPNYYKWTQWIFEQLYKHGLAYEAEVPVNWSPDLGTVVANEEVIDGKTERGGFPVVRKPMRQWMLKITAYAEKLLTDLDDLDWPESIKQMQRNWIGKSTGAQITFRVTDSHEPFDVFTTRPDTLFGATYVVMAPEHELVQKITTPAQQAVVDAYIDEAAHKSDLDRTALDKEKTGVWTGAYATNPVNGEKLPIWISDYVLASYGTGAIMSVPAHDDRDYAFAKKFGIEIKPVIEGGNVDEAAYTGDGVHINSGFLDGLNEHDAIDRMIKWLEDKGIGSAKINYKLRDWVFSRQRYWGEPIPVIHWEDGETTLVPEDELPLTLPEEADIKPSGTGESPLANLTDWVNVVDKNGRKGKRETNTMPQWAGSSWYFLRFVDPHNKEALADYDKLKAWMPVDLYIGGAEHAVLHLLYARFWNLFLYDIGAIPNKEPFQRLFNQGMILGDNHEKMSKSKGNVVNPDDVVDEYGADTLRLYEMFMGPLDAGIAWSTKGLAGARKFLDRVWSAFIDDEGKLRDRITTINDGRLDKVYNETVKKVTEDYDALHFNTAISQMMVFINSARKDDDLPLEYVEGFVKMLAPIAPHLMEEIWSRLGHDHSLTYAPWPSYDESKIKTDTYDMMIQVNGKLRGSITADVNESDDEIKQAALANDNVQKFTAGKDIKKIIVVPRKIVNIVAK

SEQ ID NO: 735 - protein, 547 aa, Lactobacillus paracasei
MENSLGSGNQPQRSDKEKMIRGSAWMTAGSVFSRILGAIYVIPWRIWLGAAFLTANALFTKGYQIYSLFLIISTAGVPGAVSKQVARYNAMGEYKTGMRLFYHGTFAMVLMGIVSCGAMWLLSPLLAAGDARMIPVFRSLAWPLLLIPSLSLIRGFFQGYNEMAPSAISQFIEQVARILYMLVMTYAIMVAGNHSYLSAVIHSTFAAFIGAVFGLGLLVVYFLRQKPRLDALVAQSANSLQISVNEILLDVARQAIPFIIMDSTINIYYIVDQYTFNPMMKAFYLVSEDQLDRFYALFAGNANKLIMIVVSLAVAMAITVVPLLAGAKTRGDVEGLARQITNTLQLFFIVMIPSALGMVAVARPLYVLFYRDMDWLGIRLLQISSLLAIMLGLFTVLAAILQGLFNNRLAIQEMLIGLAVKVIVQWPMIFFFNVYGPVLSTMLGMTVSSLLMLYSTNRMYNIHVRQTIRRGVGILAFSLIMCAVCYLIVNASILVINPRSQFGAAFVLLIAVGVGVLIYVYLILKTRLADLIIGERISRLRDILHIR

SEQ ID NO: 736 - protein, 236 aa, Lactobacillus paracasei
MRLDKYLSHLQFGSRKEVKALIRDKRVRVAGDLITDPGYNVLPGIAVEVNDAQADGPLEVDYLMNKPAGVITATEDPTQSTVLDLIRPHDYRPGLYPVGRLDKDTTGLLLLTTDGNLGHALLSPNRHIAKTYAATLAKTLTADMKQRLETGIDLKDFTTAPAQVVVLPDTDGKRIQITITEGKFHQVKRMLLAVDNEVTALTRIAMGPLSLPADLAAGEYRALTDDERTDLDNITR

SEQ ID NO: 737 - protein, 71 aa, Lactobacillus paracasei
MDQQQYVCPKCQNTAYVADQFQATGGNFSKIFDVQNKKFVTISCTRCGYTELYRSETSSGMNILDFLLNGG

SEQ ID NO: 738 - protein, 273 aa, Lactobacillus paracasei
MKQLTEQFAQSVVRPRARDTYKGSFGKILIVGGNAHFGGAAIMSASAAVYAGAGLVSVATDPVNRHALHARLPEAMILDATAPELETAVRQATVIVVGPGLGTDGTALTILKTVFAAVNAKQVMIIDGSAITLVASHHLDYPQAQLIWTPHQIEWQRLSGLPLAAQTIEASQKAAAKIPGIIVAKSSHTHVFVDEDVYENTAGGPAMATGGSGDTLTGIIAAFAGQFQPLDKAALAAVFVHSRVADIVAMNSYVALPTMVIRELPTYLKQLSE

SEQ ID NO: 739 - protein, 167 aa, Lactobacillus paracasei
MTHKTHRAFGCYGIATIDDKLVVIKKNGGPYRHRFDLPGGSLDGPEPLEHDVLREFTEETGLTATIDQQLGATSFIYPWKYQHWTINQHICVFYALSINGGKLETSVAQFVGQDSLGACALPLDTLTWANASPLVMFAKAFLTTGQPELTTKTFSNWEVLKEAANPS

SEQ ID NO: 740 - protein, 503 aa, Lactobacillus paracasei
MIYFLDEYLLAKNSSVEHAALKRLALFKQFKQPVKILTRDYDRLSVQTLRELGVAQTDVRNMFDYFQHVPADRPEKAVHNDEINLPTMDEVSVDANQSQVTNGDRLRRQVGYIPGTVGHVYYQNFLDDQGNLVECDLWDARGFKSATQYFGQDGLLAFERYYDLRGVPVLDIYYAGDHAGQIQISRIVLKGQTLKEDHEFDTLGELFSYFLDQLATEDSETTIFISDRPGIGVQPLLAMHAAAKKFVYIPINHVLTPDKPRQGELDGFIQPVLQHPQKVDGLIVQTPQQQHDLHDRFPKVRVAAIPAVTFDPALTARSAAAAASKKILFVGRLSPDKQLDQLLRAVALASRQVSGVTLDLFGYGDEQYQTAMRQLADRLEIGSQVTFKGYQSSLADQYPQYALLVNTNLTDGGPLALVEAQTHGLPVVSYRFSYGPSACVIDQETGYLIKQGRVNDLAEAIVRLLKWPEQSQQFGDHARALAQKQLAPEKVYARWQAFLGLDS

SEQ ID NO: 741 - protein, 519 aa, Lactobacillus paracasei
MYYFLNDQMAYAKSGIEGAEIQRLQLFKANQTPAKIVTRQFALDLHDVLKDAGIDDTDFINLFDYFCDLLSTPWQQVTVADVCQPTAGVTRRREGRQVIFSRGSRVIRIVYLREKAGREQEVSNVQYFDVTGRTIKMSWWDTRGNHCLDQYFDQGGKIFQEHYLDRHGRTRLEKLHYLNHSQQEKFSWKLVDFHGVDYLFDGLHDLTRFFYDQLNQVDGGYNVFVCDRTTETGWGLLHMTTPALKVLHLHNNHVAGNEDVLHAKLNNFYASALTHLNRWDAVIVPTPQQAQDMAARFGTATPIFTIRVAFVKAADVAANRLPFSQREQHLVVHVARLAPEKQQASSIRAFAQVVKAIPDAKLELWGYANGDMAPKLHALVEKLHLANHVFFKGYTRDIAAVYNRAQLGLLPSSAEGFPLTLIEAQAHGLPMIANDIHYGPADILANGKSGLLTQNGDIDGLANAIIGLLNDSTKLAQFSAAAYDNALRFTDTSTFVQWQKLMAFAAKKKTRLAAFEHVD

SEQ ID NO: 742 - protein, 157 aa, Lactobacillus paracasei
MSIYDYEVTLEDGSQYALSKYKGRPMLIVNTATKCGFAPQFDGLEKLYDKFKDQGLVVLGFPSDQFKQELADGHAAAEACRLKYGVSFPMHDLIKVNGKEAAPLFQYLKAQAPGELGKSIKWNFTKFLVDRDGQVVARFAPKTKPEAIEPAVEKLLG

SEQ ID NO: 743 - protein, 152 aa, Lactobacillus paracasei
MAGFWPFMSEVLMCRFLGLRTRLEQSVNQPGRDRSVSGLGCDGRALVIAPKVLTRRSLGWQTRLKQSVNQPGRDRSVSGLGCDGRTLVIAPKVLTRRSLGWQTRLKQSVNQPHVQLTKVSQEASPLLVQSLLVLFLVQSGRQLDHHDQPKTS

SEQ ID NO: 744 - protein, 37 aa, Lactobacillus paracasei
MLRFLTGPAHALDTHACDAYNDIKSKKAGMIDGRIAS

SEQ ID NO: 745 - protein, 401 aa, Lactobacillus paracasei
MEELPADVAAFVETHLVVRRNSNAVKWDGLAGEFGRTDLLPMWIADTEFKAPQAVIDALTARIQEGTFGYSIRPQSYYDAFIDWEKTRHGVTVQPEWMRFGVGVVKSLYAMVNWLTEPGDPVLIMQPVYYPFMNAIKDLGRKVVSVDLQLTADGWRIDFDQLDKTLATQNIKAMIFCSPHNPVGRVWTREELERLFAITSHHDVTVVSDEIHGDLEVSGPKFTSALQVAEGPARSRLVVLNAPSKTFNLAALLNSHIIIPDEKLRTAYDDFIKQLHPVDTSLLGQVAGEAAYRHGGAWLDKVLQVVRYNYQQLLTGLKQSAPKATVADLQGTYLAYVDIGAYVAPAKIKSFVEDVCGLAVDYGAWFSPKTATYIRLNLATDPKLVAEAIQRLTEHLAQPQL

SEQ ID NO: 746 - protein, 442 aa, Lactobacillus paracasei
MKAVKYVAALFLMLIFAIVLGQIHPDRDRPLTNSSQATIWVLSDTHFIAPSLHDEKTAYTQIKRSAAGKDMDYQPVAINALVQNALKARPTALVITGDVTFNGEKASAESIMRRLQPLVANGTKVLIIPGNHDIYDGWARAYKGKRQLLTEQISPSDWRNIFHTSYEQAVAQDPNSLSYRVNLNRNYQLLMLDSNIYTIEPSNRPPNTGGKLTPQTMKWVRQQLAAGQKAHRKSIVFMHHNLYAHNEAVNQGFVLDNSDQLKTLLKAYHVPLLFSGHIHAQDISRDPDGQCPTIEVVSGAFSISPASYGVVTFTPNRITYQKHATDPTPYLTAKQRKNPDLLHYQRYLKQLFLQDGEGLAYGDLMDNGVTNQHDLDAAAKLMGVLNWRFFTGDDHPDKAELKRLKADPGWAVLERSPMLRRYLKEIVQDHNMNDNHLIINHP

SEQ ID NO: 747 - protein, 88 aa, Lactobacillus paracasei
MQVIVTVIGTDKVGIIAQVTTALADLDVNILDVSQTIMQGAFTMMLLAKIPDNGNFNTVKSQLATLGDQIGVEIKVARQEIFDAMHRL

SEQ ID NO: 748 - protein, 447 aa, Lactobacillus paracasei
METQQIKETIEMISEENLDIRTITMGISLLDCVTGDLQTTADKVYAKIMAKAANLVPVADAISDEYGIPIVNKRISVTPVSLLAGADQNLDFRPIAQAMDRAAKDLGVDLIGGYTALVQNGSTPAETALMKSLPEVLDTTERVCASVNIGSTRSGLNMDAVKLMGTVVKEVAMRKPQNAMKLVVFCNAVEDNPFMAGAFWGISEGDVAINTGVSGPGVVERAIAAKPAASFEEICETIKQTAFKVSRMGQFVGKVAADRLDVPFNIVDLSLAPTPAKGDSVAQILETMGLSHVGTPGTTAALALLNDAVKKGGIMAAERVGGLSGAFIPVSEDANMITAAAKGQISLEKLEAMTAVCSVGLDMVAVPGDTPDATISGMIADEAAIGMINNKTTAVRVIPVPGKQVGDTVEFGGIFGTAPIMAINDGDAQQFINRGGRIPAPIHSFKN

SEQ ID NO: 749 - protein, 351 aa, Lactobacillus paracasei
MFVALDKNNQRVTLTSHAQAANLTHQTFHCPICKQVVRIKNGTVMPAHFAHRSQPMGEGEPESIEHLTGKWWLASWLKQHGEQATLEYYDATIRQRADLLVASKPPRVLEFQASPLSVPDLQKRTMMYHARGWQVTWVLGHRYWHPEGKIQARKFLSIEDHRLTLWHLQTTVGELVRIQFGNEGRWLTRFQHDDPPTQTWQAESTYPQRQIRQIAISLQKRVQPWMTLQAAAYQQGRNLNGSPWFVHSRPHVLRHFGIPELQLRLKWLLIFEGQPFTATANRQFWQAALPNIWTPLLPAGTLGKMMGAHWLQVLLAEGFVVQEDGCRYQWQRLPVWFADLERKLAMKKDFA

SEQ ID NO: 750 - protein, 211 aa, Lactobacillus paracasei
VIEIFLFFNPIGSVCLGTEQKLLRQLDKFQQEVRVHFVPVLNLDIMEQFMKREQLSVGNLAKRNQLLRAAYNLALDYKAAQYQGNKKARMLLLRLQQHAPLVQYQYDAAFVAKMLDKCKLDQEMFYEDRQRSEVKMGFDSDQRTANQMGITQTPSLVIVDTDRKVDDGHAVLIEQIGDPALIPHLCDLIRTDPAGFFTERPENMGSNFRIF

SEQ ID NO: 751 - protein, 212 aa, Lactobacillus paracasei
CYTHDMAINPRTEINMSISREQEFKTTLTKTDFLAILNQFDFEPGFSQMNTYYDTPTGAVKKAGLGLRIRQFKDRAEQTLKVPNKNQHRDLEEITDPLTSVEARSLIDQGQLKTGQVTTALAAREIDPAAVHPQTQAKTTRRVAHLKAGLLTLDQTFYMDNTSDFELEMEYHDLPQAQVFYDTLLHQFNIEKRPVINKVQRAFMHVHDSQAD

SEQ ID NO: 752 - protein, 223 aa, Lactobacillus paracasei
MQRDWDSFLMPYEQAVGELKIKFRGMRKQFQQANEHTPIEFVTGRVKPVSSIIEKQSRRFISDELLEQDMQDIAGLRIMCQFVEDIYQVVALLRQRTDMNIVEERDYVTNVKPSGYRSYHVVIEYPVQLIHGEKKILAEVQIRTMSMNFWATIEHSLNYKYNGEFPDTLKARLKRAAEASFMLDKEMSDIREEIQEAQHLFVYGKGQQPHSKTKDHHDDKKDE

SEQ ID NO: 753 - protein, 265 aa, Lactobacillus paracasei
MRVTVFHNSIPASITAAQKLTKLLKSGHFELDERHPEVVVTIGGDGTLLSAFHRYADQLNSIRFIGVHTGHLGFYTDWRDFEIEDLVIALKEDSGQSVSYPLLDVQAIYADATSAHYLALNESTLKRLNGTMRTEVYIKGDFFESFRGDGLCVSTPTGSTAYSKSNGGAVIHPRLDALQMTEIASINNRVFRTLSSPIITAPDEWVTLEPTGRDDYVMTVDQFVINPPTIKQIRYKIAKERIHFARYRHMHFWDRVEDAFIGAKH

SEQ ID NO: 754 - protein, 300 aa, Lactobacillus paracasei
MRFEWQYEGPPLKLAAFLKQQGFSRAQLKKLRYQGGFVFVNKRQRHTAYPVRSGDRILVQTAPEHAADSVVPYSHDLAISYEDDDYLIVNKPAGVASIPAVGRQNNSMANMVKAYLIKTKAESQAVHVVTRLDRDTSGLMVFAKHGLAHSLLDQQLHSQDFVKQYVAIVTAQTPLATHGWIVLPIGVSDGFYMRRVVTDTGKASVTEYRTLDQNTAGAMMLVTLHTGRTHQIRVHFAAIGHALYGDGLYSPDTHGFNRQALHCAHLRFWQPLKHKLIDLHAPLPADMATLAAKLKLSQQD

SEQ ID NO: 755 - protein, 352 aa, Lactobacillus paracasei
MRKFVIGLLAFIGFLTLSGCQKTASPTYLKTPYTQNEFVMGTTCTLTIYDKGKKSALKDGFAMIHHVDAEATLTRGGSVLDKINDNAGIKPVKVPKDFMPLLEKAYYFSKNSNGSFDMAIGAVTNLWQIGLPGARVPAQSEIDKALPLVNWRDVKLDTKNNTAYLTKKGMRLDFGGIAKGWVADKVKAVLAKDGVTAAIIDLGGNVVVMGHSPLGTNRDWHVGIQDPTAPRGTAVGTIPESNESIVTAGTYEQYLISNGHKYIYLFDPQTGYPYDNNLASVTIVSKNSVDGDALSNAAFDKGLKGGLQYMNAKNSDHIQAIFITNDKKIYLTNGLKKQFKFDADSGYHKGNF

SEQ ID NO: 756 - protein, 211 aa, Lactobacillus paracasei
MLKEIAVENYTSIPKAIAAGADRIELNDNLAVGGTTVSKGVMAESTKYVHEHGRSLITMIRPRGGNFVYNDVELKIMEADLFEAQALGVDGVVFGALTPAGAIDEDAMTSLIAASAGMTVVFHMAFDAIPETKQFAAIDWLADHDVERILTHGGPLTTPITDTLPRLQAIINYAGDKISILPGGGITNQNAASIGETLGAKALHGTKLIAF

SEQ ID NO: 757 - protein, 272 aa, Lactobacillus paracasei
MFDIIKAVIIGIVEGLTEFLPISSTGHIDLVNHVIKLSQSQDFINMFEYVIQFGAILAVILLYFNKLNPFSKPTAKARNATWQLWAKVIIAVLPSVVVGLPLNNWMDEHLHTPLVVATTLIIYGVLFIILENYLKNKNAHITTLADITYQTALLIGLFQVLSIVPGTSRSGATILGALLIGTSRYVATEFSFFLAIPTMVGVSILKIGKYLWQGNGFSGEQWAVLMTGSIVSFLVAIVAIKWLLKFVQTHDFKPFGWYRIALGAIVLLVMFI

SEQ ID NO: 758 - protein, 346 aa, Lactobacillus paracasei
MKQRLLLGGYTRHGGAGVYAGTFDNDEAHLPTPAPFITDLGSPTYLAVSDDNILYAVDAEGDQGGVAAYDLNADPPRLINKVLQAGSSPAHISIDANRQLVYASNYHEGRINVYRIKNDHGLALTDEVKHTGNGPRPEQDSAHVHFAAVTPDFQRLAVVDLGNDTLTTYAVSDAGKLSDPVIFHTEPGFGPRHLAFNHNNPIAYLLGELSSQVSILNYDAATGQFKLIATLPTIPEDYTDHNGAAAIRLSSDQRFLYVSNRGHNSITVFAVSPDGRNLSELQQISTAGDFPRDFNFDLTEHFILVVNQNSSNGTLYSRDAKTGLLTEIQRDIPTPEAVNVLFLSAK

SEQ ID NO: 759 - protein, 125 aa, Lactobacillus paracasei
MQLTATVTAIGKDALSSKDPMIILFGPQATDALRDVAVIQQFADKSALEKLVIKAGDQLTIDDETFEMTYVGQLANSNLKAIGHVTLLFQAVPADKPMQNAIYLKPTHRPTFKVGTTLTYITQAN

SEQ ID NO: 760 - protein, 89 aa, Lactobacillus paracasei
MAKKSKIAKEKKIEATIAKYAPLRAKYKAEHNYAALQALPRNASPVRAHSRDELDGRPHAYMRKFKMSRLNFRDLAHKGQIPGVRKASW

SEQ ID NO: 761 - protein, 329 aa, Lactobacillus paracasei
MNNGMQIFDYEDIQMIPNKCVVQSRKEVDTSVKFGPHTFKIPVVPANMQTIIDEPLAIWLAEHDYFYIMHRFQPERRMDFVRDMKKRGLIASISVGVKDDEFDFIEALAANELTPDYITIDIAHGYAQVVIDMIQHIKHYLPNAFVIAGNVGTPEAVRELENAGADATKVGIGPGKVCITKLKTGFGTGGWQLAAVRWCAKAARKPIIADGGIRNNGDIAKSIRFGATMCMIGSLFAGHEETPGKHVNIDGKEYQEYYGSASEYQKGTHHNVEGKKILLPVKGKIGDTLKEMQEDLQSAVSYAGGRDLESLTKVDYVIVKNSIFNGDQY

SEQ ID NO: 762 - protein, 315 aa, Lactobacillus paracasei
MLAIYRFDDKTGQLNQQSRISPGVWINVVDPTPAERQQLQDKAKLSEAFLLYGLDPDEGARYEYDEDNDSHLFIFDMPIVTRDARKKVVYETAPLAIIITNTAVITINGEPIPLLSLFAEGKVSNFDPRRQNRSVLQFLYQISISYLTYLRDLNKAREANENKLQRSLRNEELYGLMGIQRSLVYFMMSLRTDRNVLEQLKRSNPLGLDEDDQDFLEDTIIENQQAIEMAQISNSIINETADTYSSIINNNMNGVMKFLTSYSILLTIPTLVFSFYGMNVHLPLADMKVSWIITIAISVAIAVVLAFQFWRNKFF

SEQ ID NO: 763 - protein, 280 aa, Lactobacillus paracasei
MRKRETKIHLAAAQAPLFACPVCGQPLQVTAGSLVCVNGHVRDFSHKGTLNFLNQQVATEYTTPMLAARRRMLNAGLFTPFLAAMAAKLPKHQRLLDVGCGEGTPTAYLAEAGQQTAVGFDISSPAINLAGGLAAPVLFAVADLAHLPFVNDAFDTVTDIFSPGNYRKFRRVLRPDGQLLKIIPRAGYLREIREGLYSGTAKAVYNNEPVLKRFLAAFPDASQETITYDFPLAPTQFGDLMAMTPLTWQAPADQRDQMLAAPPISIHIDVDLLTLSHLVK

SEQ ID NO: 764 - protein, 169 aa, Lactobacillus paracasei
MANHIVLFEPLIPANTGNIARTCAATNSYLHLIKPLGFETDDKHLRRAGLDYWQRVRIIYHDSLDDFMATVKEPQYLYLITKFADQTYSDRDYADINQDHYFLFGKETTGLPEGFMRDHADQCLRIPMTDNVRALNLSNCAALVIYEALRQQHFAGLETSHTYEHDKLK

SEQ ID NO: 765 - protein, 136 aa, Lactobacillus paracasei
METKRYPIAVESFHYDLVKQGTPVKNDLQVAMRQIEWSDPAKQDELKKGNLFQMMIPFDVVPDDAGFEISGKITQIVQVLDYFGEANELPQAELGKLSRPLVETIETLTYQVTAVALDQGINLQFGASDEQPGQTK

SEQ ID NO: 766 - protein, 777 aa, Lactobacillus paracasei
IIIEMAQKRSGRKSPRRKRPTKQQQHTLSWVGALFVVFASLAFFRLGIVGTVFANVFRLVVGDSFLVVSAGMILMGIWFLFADRLPKLARHVWVGLAIILICALVLLSAGTMTTLNVHSHYLLATWRLLQNDFGLMTTASSVGGGLIGAGLYALLAPLLSSIGATILAWLGIVVGTLAFLGVGANQVFNWLQRCGQACKHGVMQVQAAVAAMKKERAQKAAAQQKKTVSAKPQTTTPVTENEAPSETPDHQDDFTINGPAPVHELTQPAPLPRTEPKPQSATTAPQPEPSEAASGLDADDPSTNYQLPDLDMLTTIPPVDQSAEYKAIKTNRVKLKETFESFGVHVAVKSATLGPSITQYEIQPAVGVKVSKIVNLSDDLALALAAKDIRIEAPIPGKSLIGIEVPNQHIATVGFKQVMAETPKSPDRPLVLPLGRDVNGKVVTFDLTKMPHLLIAGATGSGKSVMINVILTSILMRTKPSDVRLMLIDPKRVELSVYNGVPHLLTPVVTEAKRAPSALNKILTAMDERYQRFAAAGVRNMTEFNQKVAADPTSGQQKMPYIVVIIDELSDLMMVAGNEIETAIVRLAQMARAAGIHVIIATQRPSVDVITGLMKANIPSRIAFATSSGIDSRTILDSNGAEKLLGRGDMLFSPIGASKPMRIQGAFIPSVDVERVVKAITDQVSPAYVESMTPTENTEAEKPGDSEDELYDDAKAFVISQQSASTSMLQRRFRIGYNRAARLIDDLEANQIVGPSEGSKPRKVFVTPEQVTNGTPS

SEQ ID NO: 767 - protein, 420 aa, Lactobacillus paracasei
MRKEMKPGVWLIVLPTTQFKTTRINVQFLAPLQRATVTKRTLLTSLLETNSAVYPTQAALSAHLESLYGANFSIGVAREGKLHRIGVTMSTVDDRFTDAPLLPQAAAFLRTILFEPNMQAGSFDEATFAREKENLDHYLASLDDDRQTQAALGVQQLYFGADQDQAIPSFGTREDLASLTASSLAAYYQEMMQHDQVIITVLGDVDPKQVAALFADWPLDARSQTVPAVAFDLPTHPDVLTQTTKVNAQQAKFDLAYHVETDLMGPKYAATLVAEELFGGSSLSLLFTNVREKASLAYYASSMFDAFRGLMLVQTGIEGKDRQQVADLIRDQLAAVVNGDFSDALLKAVKDGILDHQRAAYDSPRFLTNQALYQLLVPDAPQNFDEFAQRIKAVDRQAVQQAAADMKLQATYFLTGEDSE

SEQ ID NO: 768 - protein, 430 aa, Lactobacillus paracasei
MKTQYFSDVDETVITTTLSNGLRLQVVPRPAYHKSYAIMTTDYGSIDTQFAPDGKQMVTYPAGIAHFLEHKLFEKEDHDAFDLFGETGASANAFTSATKTSFLFSTTTQLTKNLQILLDFVQTPFFSKASVAKEQGIIGSEIQMYQDDPGWRGYAGLLENLFPNHPAHVDVAGTVASIAQITPEMLYTIHRVFYQPSNMTLIVVGNIDADAIMAFVAANQAAKQFPAPQAIVRGVHADLQTDDIVPYRQLEMPISRPKTLVGIKGQVAIPMTAEGWRYQLTIRLLLEVLFGDSSQLYQDWYDRGLIDDSFDFDFTNQRSFSYGLVGGDTDDPHALSDAIKHVLLSAATQPDLTRDRVALIKRASLGKYYAGLNGLNGVANQLSALSFGQASLFDFPEILSSITLADLQAMIDQVFQAKALTVLDMIPEAD

SEQ ID NO: 769 - protein, 242 aa, Lactobacillus paracasei
MRAALIVGASGDIGRAVAKKLAHDGWSLYLHYFEHEQVVTSQIATFQAAYPNQDFIPLQYDLTDDRHLDDLTAQLFSLDAVIFAAGMTYYHLFKDTTVSELTTLMRVHLLTPMALLTKIEHKLAQSGHGRVVFIGSVYGGAGSAMEVAYSTVKGAQSAFAKAYAQEVASLGITVNVVAPGAVTTKMNTKMFDQATLTKVREEIPAARFATPQDISYYVTMLVAKDAAYLTGQTLYVTGGWRI

SEQ ID NO: 770 - protein, 309 aa, Lactobacillus paracasei
MDEIGQKLRDARIQKGYTIDDLQQITKIQKRYLIAIEEGNFDALPGDFYVRAFIKQYADTVGLDGDALLTQFQQDIPEPQPQEYAAQSVENKTRATRAEEASPVNRLRRYLPQIAIAAIVVVAVIVIYVIMLVYQSGPKQTIPTDSESVAVSSKRSTSKTSKSSTSSKTSKTSAASSSSKTAEKSSKKSTKKSSKLDISVADANGATQAVTLKNLPKTGNKLTLGATGATAWISVIVNGSTTWQGSLTSGNSQEVTLPDNVTTFQVRSGNATATTIKLNGQSVDISKGTSIVRTITFTADATESEGSQE

SEQ ID NO: 771 - protein, 197 aa, Lactobacillus paracasei
MNLPNKLTLIRIFLIPVFTILLALDWPAGYLTLAGTKVALSWFIALIIFIVASLTDFADGQIARRKHLVTNFGKFADPLADKLLVMTAFIFLTANGQIPAWGTAIILWRELAVTGLRLLLSNEGEVLAAAWPGKIKTNAQMFAIIFLMLNNAWFNNINVPFALILFYIAVFFTIYSGVEYFYKNRGVFKDSFGSSHQ

SEQ ID NO: 772 - protein, 413 aa, Lactobacillus paracasei
MQAEIIAVGTEILMGQITNTNGAYMAKQLTALGIDSYHQQVVGDNGPRLEEAIKLAESRSNLVILIGGLGPTPDDLTKQTLAAHLNRKLVEDPDAMAKLQARVKQQQRPMTPNNQLQAMYPEGADILVNRVGLAVGAWIVNGQHTYVLLPGPPKEFVPMVDHELLPRLAKWSGHAEVMVSRVLRFFGIGESQLVTDLDDLIANQTDPTIATYIKDHEVTVRVTASGATEKDADAKLEPMVGAIMDRDGQYFYGYGDDNSLAKELVKTLAANDMQITAAESLTAGAFQAALGDVPGVSTYFKGGFVTYSLATKAAFLAIDARELAAHGVVSAFTAKAMAEHARRKAAADISVSFTGVAGPDTLEGQPAGTVWIGLARRGQLPEAHVYHFPGGRNDVRQRAVMTGMMLALRALQA

SEQ ID NO: 773 - protein, 353 aa, Lactobacillus paracasei
MAGDERQKALDVALKKIEKNFGKGAIMRMGAKADTRVSVVSSGSLAVDDALGVGGFPRGRIVEIYGPESSGKTTVALHAVAEVQKQGGTAAYIDAENAMDPKYATALGVNIDELLLSQPDTGEQGLEIADELVASGAIDIVVIDSVAALVPRAEIEGDMGDAHVGLQARLMSQALRKLSGSINKTKTIALFINQIREKVGIIFGSPETTPGGRALKFYATVRLEIRRSEQIKTGADVVGNRTKIKVVKNKVAPPFRTAIVDIMYGQGISQTGELVDMAVERDIVEKAGSWYAYQGERIGQGRENAKTYLDNHADLQQTIKQQVRVAYGMAAAPGRETASVSEDQPEIHQQAEV

SEQ ID NO: 774 - protein, 523 aa, Lactobacillus paracasei
MSSVTLVSITLAAVIALAVGLLIGFALQKKLHQNNLDRATQTAEGIIEAAKKEAATLKKEKLLEAKDENHRYRTQLEDELKDRRTEVQKSEHRLNQREDTLDRRDDTLDRKEQSLADREANLNKRQQQLDEREQDISSEISKQHTELERIAELTHEQARQQILDQTQSELTHERAVMIKESEDEAKEAADKKAKVLIADAIQRSASDIVAETTVTVVNLPNDDMKGRIIGREGRNIRTLETLTGIDLIIDDTPQAVVLSGFDPIRREIARIALEKLIQDGRIHPARIEEMVDKARKEMDDRIREIGEQAIFDVGIHNMHPDLIKILGRLHFRTSYGQNVLDHSIQVAKLTGVMAAELGEDVTLAKRAGLLHDIGKALDHEVDGSHVEIGVELATKYKEPKTVINAIASHHGDVEPTSVISVLVAAADAISAARPGARSESLENYLHRLEKLEAIANSHAGVDHSFAIQAGREVRVIVQPEKLSDDQSVILARDIRNEIEKELEYPGHIKVTVIRETRTVEYAK

SEQ ID NO: 775 - protein, 238 aa, Lactobacillus paracasei
IMPACTFAMILYMEMBERYIGZMSEQYLTIQQTGNYTNTIKKSRFITHLARIKDEDDAKAVIAQVSKENAKATHNVFAYVLGDTNQIQRASDNGEPSGTAGAPTLEALLQHDLRDVVAVTTRYFGGIKLGAGGLIRAYAGNANTAIETIGIVARIKQKAVTFTIPYADFDPIQHFLTTNHLSIANTDYGTAVTITLYLDDEHLQATLAALNDFLNGQFSPTIGASQYREVPLPRKPKL

SEQ ID NO: 776 - protein, 115 aa, Lactobacillus paracasei
MMNLAGAQLTENELMRLTVSNIAQATSLPALIQEHGRWCCQRCGDRKPVQLPDGRFYCSACVSLGRLTNRDLLYRFEQPHRPVGDGLLTWHGTLTPAQQKASTALQTSVTAGLII

SEQ ID NO: 777 - protein, 306 aa, Lactobacillus paracasei
LIWAVTGAGKTEMLFPTISQMVQQGKRVAIVSPRIDVIRELAPRLRTAFATTPIAVRYGGHFDQTDSDLVLATVHQLLRFHRAFDLIVVDEVDAFPMAGTPMLHRAVQGARRGPVVYLTATPDRPLKAAMRKGLMVSRLFRRFHGHPLPVPAIRLMNFKKLPSQLPPAIVKWVRDVVATGRSCLLFVPKISWAPQIAAFVQRNGLRVAGVASTDRLRAEKITAFRQRQIQVLVTTTILERGVTVPKCAVGVVAAADRAFTASALVQIAGRSGRAADSADDPVVFFTDRYTLALLAAKRQIVMMNGR

SEQ ID NO: 778 - protein, 224 aa, Lactobacillus paracasei
MVMRCCGCDRHVDRSPTLKALLAGSKLIAPRLCSSCLARFKMITGATCSGCGRSGDARICADCRQWEQQGRLLHNRALFVYDAAMKQWIYQYKGLGDYRLHDAFQDLIAAQLQNARTLIAIPSESKHYDVRGFDPIQGLFGGLQLQPWLRKSPTAKPQAQKNRRERLQTPQSFTVLVPAAKLNQTKQITLVDDLYTTGRTLYHARDALVAAGFQGTVTAFTLIR

SEQ ID NO: 779 - protein, 185 aa, Lactobacillus paracasei
MLTYNVRGENIEVTEAIRSYVEKRISKLNKFFGGSVTATAHVNLKVYSDKTAKVEVTIPLSFLTLRAEETSPDLYASIDLVTDKLERQVRKFKTKINRKSREKGFGQIDIDATAPAEPKPAEDDDNLTVVRTKRVSLKPMDSQEAILQMDMLGHNFFIFEDADTNGTSIVYKRRDGRYGLIETDE

SEQ ID NO: 780 - protein, 787 aa, Lactobacillus paracasei
MANILRKWVESDKREIARLGKIADKVQQYEDEYAALSDEQLKANTPKLKDRLAAGATLDDILPEAFATAREGAKRVLGLFPFRVQIIGGIVLHEGNIAEMKTGEGKTLTATMPVYLNALTGKGVHVVTVNEYLSTRDATEMGELYNWLGLSVGLNLNSKNSDEKREAYNCDITYSTNSELGFDYLRDNMVVYKEQMVQRPLNFAIVDEVDSILIDEARTPLIISGGAEKTTGLYIRADRFVKTLKAETDYKIDWPTKTISLTESGIRKAEKNFGLDNLYDTENTALTHHIDQALRANYIMLKDIDYMVSDGEVLIVDQFTGRAMEGRRYSDGLHQAIEAKEGVQIQDENKTMANITYQNFFRMYTKLAGMTGTAKTEQEEFREIYNMEVISVPTNKPVIRVDSPDVLYPTLDAKFNAVVEDIKARHEKGQPMLIGTVAIESSERLSKQLDEAKIPHTVLNAKNHFKEAEIIMNAGQRGAVTIATNMAGRGTDIKLGPGVTELGGLAVIGTERHESRRIDNQLRGRSGRQGDPGSTQFYLSLEDDLMKRFGSDRIKAMLDRFKVADDDQVIQSRMISRQVESAQKRVEGNNYDTRKNTLQYDDVMREQREVIYKQRQQVINEQETLKPVLMAMINRTITRIVQTHTQGDQKDWNLDALYAWVTANMIDPEKFKRSQLDGKSQDELIGLLAEMAETNFQQKNKQLGDDAQMLEFEKVVILRVVDSAWTDHIDAMDQLRQSIGLRGYGQMNPLVEYQEEGYRMFEEMIASIDDDVTRLFMKAEIRQNIRR

SEQ ID NO: 781 - protein, 368 aa, Lactobacillus paracasei
VLCATPWPPCGPKLINLGGHFDLDALNERITENEGRMAEPGFWDDSEAAQKVIDNNNALKEKHDRFYALENELEDLEAGFELLQDEPDKDLQQEEEAKIKDLQEKLDKYEMQLLLNGPYDHNNAILEIHPGAGGTESQDWGSMLMRMYQRWADQNGFKVEVADYQPGDEAGIKSVTLLINGENAYGLLKSEKGVHRLVRISPFDSAGRRHTSFASVDVMPELDNSIEVDLRPEDIKMEVFRSSGAGGQHINKTSSAVRLIHLPTGIVTSSQAQRSQFQNKATAMAMLKAKLYQREEEAKRAKAKAIQGEQKDVAFGSQIRSYVFHPYTMVKDHRTNYETGNGNAVMDGDLNPFINAYLQWELAQKNPD

SEQ ID NO: 782 - protein, 228 aa, Lactobacillus paracasei
MIQMENVTKQYANGVTAIKNLNLEIHDGEFVYVIGPSGAGKSTFVKMLYHELMPTSGTIKIDDFDFATMKPSRVPFLRRHIGIVFQDFKLLPRLTVYENIAYAMQVIEAPDEKIKDRVLEVLGLVGLEQKLRRFPDELSGGEQQRVSVARAIVNKPKVLIADEPTGNLDPQTSDEIVDILERINASGTTVIMATHNKDIVNERQHRLLEIAGGRLVRDEEGGTYGNED

SEQ ID NO: 783 - protein, 367 aa, Lactobacillus paracasei
MAVVVALLINPVGLVFWLALGLTIWFAVNRTDRERRRYLRAIHPKHPEIGRFFWIGLVVGALVSLVMVIGRLQISLAALLALSGLTLVALLFSKWRFSPWWLGLASLAAVGQSGLLAEQHAANLAILVGLLWLTQAGLARFNRGDEIESPVIQQDRRQRQSAAFELRQLFWVPLFLPVAVENVSNLPLLAVTVQSLTFVGLPLLLGATFMTPRDRAQTAWRRSWPWYGGAGGVLIVYGIVARTMTLPLLVSLVFPAVVSLVLVGGFIWQGRQVHLTVTLADQGVVLIGVVPHTPAAEMGLQPGDRVLACNHHSVNNSRELYDAIQKEPTYCRLRLRQADGELRLTETAIFAGAPHELGMILFPEETA

SEQ ID NO: 784 - protein, 235 aa, Lactobacillus paracasei
MKKILIVDDEPAILTLLQYNLEAEHYQVETATDGQEALDKVRNEPFDFIILDLMLPSLSGLDVTRKIREDKIQTPIMILTAKDNETDKIVGLELGADDYVTKPFSPREIIARIKAIERRSQSQPQTSQKPGNSDQITVGQIAIDPENYKASKGGKRLQLTPKEFELLVYFAQRVGKTLSRDALLNGVWGFDYPAETRMVDIQVSHLRDKIETDPKHPDYLKTVRGFGYQMEAPHE

SEQ ID NO: 785 - protein, 555 aa, Lactobacillus paracasei
MNKRIIRRALIISLLSLAGFFVLVTTVNQQIVHQQARDLRRVGRTYAASSHDGVNRQALAESEAAFITVIPNNPRTTRQKVMADALRGNRDAAFVTTVNVNGRTEQAYLFQNKGQWVAVSRFKSSVWTTAPEQFWLLTLAFAALLAAILIWLFRSEHRYQEAIEVMSHNLDRIRRKKDPDPVILPPDSPFVPVARRINALAAEQAHLREKVAVRQSSFDRLIDNLPLGVMLIDTDKDVILHNHAMSQLLGHQIPQPRHSYLDDVKTYALARMIEHTFRHEKTHHQELTILTTQKSVDASVIPLNQGISRLQVLVILYDVTYLRQVEKMQLDFVGNVSHELKTPVTAISGFAETLLGGAKNDPATLDRFLGIIYDESKRLTQLINDILTLSRPDSNQNVAASVALKKLVDDALHNLAKVIQDKQIRVEVAITPDLLVVTDERKLTQIVRNLLNNAVFYNRLAGHVTISAQVVDHQLSLAVADTGIGISETEQARIFERFYRVDKARSRHNGGTGLGLAIVAELVKSMDGHVAVHSQVGVGSTFTVTLPVGEGPHRG

SEQ ID NO: 786 - protein, 286 aa, Lactobacillus paracasei
VKKIVTLLSLLFLPLLISACNSSSQQSGESITAVGSSALQPLVEAAGEQYQTEHLGVFINVQGGGSGTGLSQIQQGAVDIGNSDLFAEEKAGIKAKALVDHKVAVVGIAPIVNPKVGVKNVSMAQLQKIFLGEITNWQQLGGKNVPIVLVNRAQGSGTRATFEKWVMQGKQPMAAQEQDSTGMVRQIVGSTPGAISYVAFSYIDKTVQGLSVDGVAPTDANVTTNQWRIWSYEHMYTKGQPKGLTKKFLAYVMSPAIQKKLVLKMGYVPMTQMKVVRDANGKVSKQ

SEQ ID NO: 787 - protein, 307 aa, Lactobacillus paracasei
MDPIREAMLKKSRSAKLEQRGKLISLLCISLIVIVVVAIFFFVASKGLATFFQNKINLWSFLSKSVWNPSIKDAHGNPEVGALPMIVGSFGVTFLSAIIATPFAVGAGIFMTEISRKWGQKILQPVIELLVGIPSVVYGFIGLSVIVPFIRHIFGGTGFGILAGTFVLFVMILPTVTSMTVDALKAVPRHYREASLALGATRWQTTYRVVLRAAIPGILTGIVFGMARAFGEALAVQMVIGNAALLPKNLVSPASTLTSVLTSGIGNTVMGSLDNNALWSLALLLLLMSLAFNLLIRWIGKKGELNK

SEQ ID NO: 788 - protein, 294 aa, Lactobacillus paracasei
MNPKVADKIATTVLYIVSGIIIIILASLLGYILFQGLPHISWHFLTSPAQSFEAGGGIGIQLFNSFYLLLLAMLISTPISLGAGIYLSEYAKKNWLTDVIRTSIEILSSLPSVVVGLFGFLIFVLQFKFGFSILSGALALTVFNLPLLTRNVEDSLRGVEYEQREAGLALGLSRWETVLHVVIPEALPGIITGMILGAGRVFGEAAALIYTAGQSAPALDFTDWNPANIASPLNPFRPAETLAVHIWKINSEGIQPDAVAVSAGASAVLVLAVLLFNLGARYFGNRLFKKMTAS

SEQ ID NO: 789 - protein, 272 aa, Lactobacillus paracasei
MQELEKYSLDDTYIRPFDRDKQEIAIETENLRVFYGENEAIHNVSLPFERYKITALIGASGSGKSTYLRSLNRMNDNIEGARVTGKIMYRNLDINSDAVDVYEMRKHIGMVFQRPNPFAKSIYDNIAFALRRFGLKDKQKLDEIVETSLKQAALWDQVKDDLNQSGMSLSGGQAQRLCIARAIAMKPDILLLDEPASALDPISTSAVEDTLMSLKDKYTIIIVTHNMQQAARISDYTAFFYSGTAIEYDETRKIFTRPKIKATNDYVSGHFG

SEQ ID NO: 790 - protein, 254 aa, Lactobacillus paracasei
MAEAKKIITSSNVHLFYGKFEALKGIDLDFNQNEITALIGPSGCGKSTYLRTLNRMNDLIPGVTITGNVSLRGNNIYSPNEDVVQLRKQVGMVFQQPNPFPFSIYENVIYGLRLAGVKDKAVLDEAVETSLKQAAIWDEVKDHLHESALSLSGGQQQRVCIARVLAVKPDVILLDEPTSALDPISSTQIENMLLELRDQYTIILVTHSMHQASRISDKTAFFLTGNLIEFADTKQMFLNPKEKETEDYITGRFG

SEQ ID NO: 791 - protein, 225 aa, Lactobacillus paracasei
MRRLFVDELNDLHVRFSEMGMMVNEAIYKSVKAFINHDKALAREVIHEDKHINEREVDLEKRSFELIALQQPVTTDLRVIVTVMKASSDLERMGDHAVSIAKSTIRVKGETRVPQIEEDIAGMAEAVKEMVEQVLDAYVKEDSARARKIALEDHGINDFSSRIYKECIRQMQDNPETVIGSMDYMLVSSYLERIGDYVTNICEWIVYLKTGKITELNSNAIEDKF

SEQ ID NO: 792 - protein, 493 aa, Lactobacillus paracasei
MNERERILDLVKKGVISSEEALVLLENLAKRQGSQQAASPADNTAPEGTSETPNTDDEHATSDTDRNEALTELNTEIAEAAGALDAATAQVTTIGKQIDANNEQIIVLDTMEDLEALSPEKYQKRGDLKQENQKLTDQLAELKGQIESLKANLAGLRHQKHDLERKKLGDKILNDDWQKDARDAFSEFGKNLGDATTQLGGFVKDTVNNVLDNVDWKNVTITVPGLATEKFDHVFDFPDSQATILDVKVANGDVKFKTWDQPGIQVAAAIKLYGKMDAASPLDAFKDRSRIDVTDDHFSFQVPNKRVQADLVISLPKRSYDHVAVRLLNGSADLTGITGKDFYVKSTNGQMNFTHVDGVMIESEGVNGSIKVQGGHTHDLLLTTVNGDVSVDADPATAALKTVNGTVRATYHTDFTTLEGTSMNGNVKVAVPSSIALNGEVRTHFGSIKSRLSEVAEPAKGIKRLELTRPGTGSSEMKLNTTSGNIQLKDSND

SEQ ID NO: 793 - protein, 89 aa, Lactobacillus paracasei
MPFLLIPLMFFIIGLIIVAVFAIGIFLLKLLIVPALLIILAVWLFSRHDRSDRYDRRRPRHPYRDRDSSRPRKNATHVTESHDDDWSDF

SEQ ID NO: 794 - protein, 111 aa, Lactobacillus paracasei
MNFVKRTIITTAVFLIYAQLFPAQLYVAGFGVAVVGALVLGVLNGLLRPILVILSIPITILTLGLFLIVLNGLMLSMMTWFVPGIVFSGFGATMLLAVIISVLNMMFVGKN

SEQ ID NO: 795 - protein, 319 aa, Lactobacillus paracasei
MADSVTVRQLVKATKLEVYSGEEYLDQRQVVLSDISRPGLELTGYFNYYPHERIQLFGRTEISFARNMSSEERLLILKRMATEDTPAFLVSRGLEAPAEMITAATAAHIPVLGSRLPTTRLSSLITEYLDSQLAERRSMHGVLVDIYGLGVLITGDSGVGKSETALELVQRGHRLIADDRVDVYQQDEQTIVGAAPPILSHLLEIRGLGIIDVMNLFGAGAVREDTTISLIVHLENWTPDKTFDRLGSGEQTQLIFDVPVPKITVPVKVGRNLAIIIEVAAMNFRAKSMGYDATKTFEKNLNHLIEHNEETDQNSSGDK

SEQ ID NO: 796 - protein, 275 aa, Lactobacillus paracasei
LLLALNPIAFQLGGLEVHWYGIIIASAVLIAVYLAMREAPKRGIKEDHILNLILWALPFALIGARLYYVAFEWPYYAAHPGEIIAIWHGGIAIYGALIASVIVFAIYCRVQWLPVWLVLDIAAPTVMLAQAIGRWGNFMNQEAHGAVTTLAYLRGLHLPEFIIQQMNIGGAYRQPTFLYESMWNLVGFALLMTVRHHEHWFKQGEVVLSYVMWYSFGRFFVEGMRTDSLYVMPGLRVSQLLSIILFVAAAGLVWYRRRQGNVAWYLDGNPLKAVE

SEQ ID NO: 797 - protein, 79 aa, Lactobacillus paracasei
MCRFLGLRTRLGEREQARMCQAFLGSTLIKLDPIVRVDSAAIRGGDRAARVVGTTSSQRASPARCLEARSWSKRRKPLC

SEQ ID NO: 798 - protein, 762 aa, Lactobacillus paracasei
MENATKAEEQARVTAVIEKLKARLAAIHDQIEAAHKETSRIERSYGENTKVNVTEVDDQMETNAAVQQQKVMVARAVENETILKHEGNRLTLLADNPYFGRIDIDEDGDPDTLYIGTATFIDQDGEFLVYDWRAPVSSIYYNGTLGDVSYDTPAGEQHATLKNKRQFQIEHGHIKTMFDTNETVGDEILQSVLGDQSDEYMKNIVATIQREQNDIIRDTTSDLLVVQGVAGSGKTSAVLQRIAYLLYHSRSDLDADQMVLFSPNRLFANYISQVLPSLGEKNMRQATLFEFLANRFTGLHVETLFERYEHDAAGLPPAAEHIRRFKEAPRYLEAIYDYAKQPKRTPHFIDVEFNGETFFSAATIAKIYQAQPALMQPVDKFTATKNALIKRLNTRIHMEAKRDWAQLRVSDLSQTELETLTADHEFETGEDEQRFVSEAIVSKAFSPIYDALYNDHFYDVFQDYQQFMAQVKPPVAPAIWHTMVNAFSDGIEAHQLRLEDAAPLLYLRDLSTGSGQNSLIQYVFVDEMQDFSMAQLLYLKHAFPKAKLTLLGDAKQDVFTSNYQPSDFIHEIEDVFSGYKIRLITLNKSYRSTQPITNFAKALLPEHDHIQAFNRAGDKPEVLTVARTEAPDALSKLVTQLLATDTTVAILTKDAQTADQLYATLKLDAPVTLLSANDHSLKNGCVILPVYLAKGLEFDAVIGWDISATTYQNEADRDILYTLCSRALHHLTLVALDAPSPLITALPADLYTHAGDASEARV

SEQ ID NO: 799 - protein, 277 aa, Lactobacillus paracasei
LFNLLRTFMAVYETRSFSLAATHLFTSQPTVSHHIHQLENQLKTTLFERNKRSATIPTAAADILYTFSGNLLAEWEKTQEAIQNSQKDAIVDLHIGVSQSVAAVLFSRIAAALKKAFPYLQYDVAVLNSLQVVKQLEGQHLDLGFIEQPLTLKGAVRTTLCTDQLIAAGWSTGTWITREEGSGMRYYTTAYLQTAGISPQHMMTVNNNAMLLALVQQGVGQALLSDQVALGNAPAQAIGPQFQRHFYLLQNPTANWPHKQAMLDKIVEAARASEVTR

SEQ ID NO: 800 - protein, 323 aa, Lactobacillus paracasei
MRSFLKRVPLPMAGLTLGLASLGNLYKLAGWQLVGNLTGGLAALLFGLILLKICLTPLHAAKSLQDPIIASVSPTFSMTLMILCTYLTAWGMPVGIATVIWVLAVIIHFGLMIFFVSRHLLPQQKEWQMIYPSWFVTFVGIGVIPVTSGKFVPALGQPLFWLAFVIYVAVFPFVLHRVRTIPLPEATQPLLTIIAAPASLCLTGYLASFTHPNLAFAAGMLIFAQCLYFLTLFSIRQYTRLSFYPSFAAFTFPLVISATALTRFIAIFASKGLVHNLLSVLQWGEWLVASLMLIFVTGHYLNFLRLTAKTVKQTATATQELSD

SEQ ID NO: 801 - protein, 248 aa, Lactobacillus paracasei
  misc_feature (4)..(4): Xaa can be any naturally occurring amino acid
CAAXAMINTERMINALPRTEASESELFIMMNITYMKILRSFVQLVGVAAGFIAYSSAELALIRSEATWGAYGAIGALVFVFGALIAALMVCYRHFYRQQPALAVAHPSSVIWQGIGLLFLIQLINVTLTQVMHAPQAANQSNLLDLVKNYPWSIKLLAVVGGPIVEEYLFRGFLMNSFGSLKQRSWQWVSVLISAAVFGFAHVAGKVDYNFFIYAALGGVLAWTYLRTRDMRYSIGLHMLNNATILLV

SEQ ID NO: 802 - protein, 224 aa, Lactobacillus paracasei
MVDNEKEQRFMIEWQELTAFAKKVSEQDHSGHGFDHIQRVVATAKQLAAQTPEADTAVVLAAATMHDTYDDKLVTDVPIAKAAAQQAMVDAGMRADQVQMVLTIIDHMSFKANLQHHQSLPVEGQLVQDADRLDAIGAIGIGRAFMYGGAHGGRMYDPDLPPRADLTAAQYRTTEGTVINHFYEKLLKLKDQLNTDAAKKMAMHRQQVMEDFLTEFKAEWHGRR

SEQ ID NO: 803 - protein, 138 aa, Lactobacillus paracasei
MKKQYLAASQSVNQFNRLFSPVSTSEIPLNQQNLLFWMATDATPRTPTSLAKEMHVTKAAITKASSPLIDRGLLEKQPDPEDCRSFKLVLSEEGEQAIEDLGPEYLGNLERLYHELGEKKYLKLIKLLSQATGTLVTE

SEQ ID NO: 804 - protein, 842 aa, Lactobacillus paracasei
MAIPDHISVRGAYVNNLKHLNVDIPLNKLVAITGRSGSGKSSLAMGVLYAEGMRRYMSALSTYTRRRLGQTSPAAADSVRHIPSAIALRQRPTVPGIRSTVGTATEALNVIRLMFSRLGSPVCPNGHRVSPTLDIAKAMDLPNDGESGMGMITCPTCGVRFMAFAAEDFAFNSTGACPTCGGTGQARTLAANRLIPDQTLTIRQGAVASWRLPGRNFMPFVAQAIGIDIDTPFQDLPKDQQEQVWHGERKKYAINIPSKTGKIFHMDHAQYENAFNAVEDSLATTKNERAIQRLNRFYEFGICPTCHGSRFAPKLLSQHLVDQNIAQVSDMTLTQLAAFIPEIYHWLPADMQSLAHDIIQELTQLLKPIMDLGLSYLTLSRAAASLSTGELQRIQLSRTLRTETTGVLYVLDEPSIGLHAANVSGLLEVMHGLVNQGNSLVVVDHNTAIIEAADQVIEIGPGAGVAGGRLIDQGSPEAISHDTHSLIAPFLTGAASLIVRPQAGEQEIKQTKQLQLTVTDRFNLHDLHVHFPVNCFSVVSGFSGAGKSTLIFDALVPALSATADQPAPAFVRDLDRGGLRHVVAIDATPVGKNVRSTVATYTDILDHLRHLFASLPDAKAQHYTSSHFSYNVKAGACPTCGGTGVINLDIQYLPDMQQTCPTCHGRRYNPEVLKIKWQQHSIADLLDLDVDSALTVLKDEPAITHTLQTLHDMGLGYLHLGESTPTLSGGEAQRLKLVAHMGRSQKDTLFVFDEPSVGLHPLDVQTLIAVFQRLLKTGATVIAIEHDLDVIANADYVLDLGPKGGAEGGRIMAAGTPQAIAKQGKGETAPYLAGHLAAFHVK

SEQ ID NO: 805 - protein, 334 aa, Lactobacillus paracasei
MYYAATDRYDKMPVRHAGKTGLMLPAISLGLWQHYGNLDPFGPRRSVILDAFDHGVFHFDVANHYGNGDHEPGFGSSESLLGQILATDLKAYRDELVISTKVGYEIHPGPYGVGTSRKAVIQGLNDSLKRLQLDYVDIYYAHRFDDTVDLEETVNALDQTVRDGKALYIGISNFDTQQTKDAIAMFKDLHTPFVLNQFSYNMFNREAETSGLTKALQADGAGLIAYGPLSEGLLSDRYLNGIPDTFKIHPTNQATFAHGKDAVVKKLNELNEVAHDRGQTLTQMALAWLLRDPVVTSVIIGTTSVDHLEDNLKATENLTFSAEEISHIDSILNV

SEQ ID NO: 806 - protein, 270 aa, Lactobacillus paracasei
MPRYLIISDIDGTLTANHHDVTPKTAAAIAAAVASGASFYVATGRMHALAQVVAKQFEPEASIIASNGAVYDFSGERVHHVLGQAALTAVETVTDQLGLNALYFSDDTVYYTGKVPPAIEAAARKFAPSSVSIDVVALPSVDDLLAHAPAITNGIIFGPHDSEELAKGKAALEAQDVLHVSASEHTNLELIPKHIDKATAVKELQTLTGIGPEQTIAFGDGLNDLGMLKAAGISVAMENAVPQVKQTARYMTDANVDDGVANFLNDFFEK

SEQ ID NO: 807 - protein, 114 aa, Lactobacillus paracasei
MAASNTTIDQLNETAQHTALETFAKFYLDRFFGAGLDAFSQIDTQGNLADINHYLLDNQPLTREELTAGLLTNRSGNLLDLLKQVKVTFNAQGAPETPWNDWYADQIDGLPQGL

SEQ ID NO: 808 - protein, 87 aa, Lactobacillus paracasei
MEKEKLHLGDAVVCHVKEDMEAPFTGKIEKVYENSALLSITDYADKDRQNAAELNFKIVANFHAMTQNLGGGTVLAFPPEPAEEPKK

SEQ ID NO: 809 - protein, 225 aa, Lactobacillus paracasei
MNEKPYPVHESLLIGTLLTAAAGSFDAFTYLLHGEVFAGLQTGNVILLGIHLGQAQWTTAVRYIVPIFAFMFGTMAARALQLQAGKKSRPLTEQRWLIQYEITLILIVTLFGHWLPDLAASALVSLIAAAQLQEFRRLKGGPFTSLMMTGNLRTAAQSLYDGFIRGQQKGRKDAATIGTIILSFAIGAAVTGILTTLFGTYALVGAALCLVWIDIIFWRDQVELH

SEQ ID NO: 810 - protein, 228 aa, Lactobacillus paracasei
MTTLYLVRHGQTEFNVQKRVQGMADSALTPKGIADAKALGQGFKTKNIHFDAAFASDLTRAVDTAHFVLSGLDEPIPVTTLMGLREENYGKFEGQLANDFSLATMGIANFHDALANQEITLAQTADAAFTANMDQHPNKAETNRMVQERLNRTLRAIAVEAVAKDWERVLVVSHGTAALMWLNYVHYNIDGREMLDNASVTKLMWENDRFTVTDFNDLSFLHAGQAAN

SEQ ID NO: 811 - protein, 270 aa, Lactobacillus paracasei
MERYLIALDLDGTTLNADGQLSAGTIAVLREAQAAGHLVVITTGRPDSISEHFYDDLQLHGPMINFNGALIHIPHQHWRYEQEVTIPIPVALSLRQLKRDFSFKVMVAEGKQLLVADRPYANIPFLPDRPHPKALLDEQGLRQPPISVTMFMTAKTFDPVSKQVNALYPHLAAKTWGAWSGEYTALEVTSKNTSKSRALAYVAGQYGIDQKHIIAFGDDMNDLDMLQFAGHGVAMKNARPAILAIADAQTPNDNQHDGVANYLADYLKLA

SEQ ID NO: 812 - protein, 160 aa, Lactobacillus paracasei
MAESIVLYTDGGNRNTGNQAGGSVRPTDKSAWAALLIYGDHEKMLSDGDYGRTNNYMEIMAVIQGLKALKRTDIPVDVYSDSAYVINTMQQRWWVKWQQNNWRNHGKPVKNAELWQALLHQVNRFETITFHKVKGHATNRNNNRVDAALNQTMDQLDDHV

SEQ ID NO: 813 - protein, 300 aa, Lactobacillus paracasei
MANFSYEVFSKVVERGTLAKAAAELNVTPSAVSHSVSQLETELGFPLLIRNRTGVALTEDGAQVLPIIQSIQNLEEQLTQVADNINGVNTGRIRIGAFSSVSTNWLPTIIRRFKKRYPHIEISVVQGTFNRIVEAVRLGTADIGFSSLPVGPGVVVEPLLKDPIYCITPKQFKPKNGRTVTQADVDKQNFILQQIDYDRDTKNALDRYHVSSNAINYSIDDQSILSMVESGLGMGILPKLAVQKLVGDVNMYPFSEPFERTLCLVINPTIKKSPSVQRMQQVIHSFLAETYGEAFLGHQG

SEQ ID NO: 814 - protein, 400 aa, Lactobacillus paracasei
MKFATRTQKTGHSGLEDLFAASGPNVISFAGGYPDRDLFPTKQLNQAFSQNFTSGDRELLQYASTEGYEPLRAKIAARLQTTGMQVDADDIMMTQGAQQGIDLVARLMLDPGDGLVVEAPTYLGALAAFNAYQPTYYEVPMQADGMDINALQRILMSRKVKFIYTVPDFQNPTGVVMSLAKRQAIIRLANQYDVMILEDNPYRDLRYTGKALPTIKSLDTEGRVIYLGSFSKILSPSLRMGWLVAAPNLLKELLALKGGSDLESSNLVMHGINTYMENNDLDAHIREIQDCYREKKNAMVAAMKRYLPEEAHFTNPDGGFFIWLTMPAGFDMGAFMKEHLLPEANISYVPSTNLYATAALSNGARLNFTGPSLAQIDTGMKALGAALKVALQHNLVAEQA

SEQ ID NO: 815 - protein, 397 aa, Lactobacillus paracasei
MAKKTTAKNDNTKSDATDRDTELEKALQKIKKAFGEGAVMKMGDRPELKVDVVSTGILSLDLALGVGGLPRGRIVEVYGPESTGKTTIALQTIAELQKSGGKAAYIDAENAMDPKYAAELGVNIDDLLLSQPNSGEQGLEIAEMLIESAAVDIVVIDSVAALVPKAEIEGAIGDSHVGLQARLMSQALRKMAGSINNTNTLVIFINQLREKVGVMFGNPEVTPGGRALKFYASVRIEVKRGQQVKDGKDVVGFASKLKVTKNKVAPPFKSVETTMSFGHGIEHNTDMINLATDKDNDIDVITKSGSWYNYGKERLGQGLVNASHYLDEHPEISKEIEEKIREQVAPKKPEETDEKQDDKKDDQASADKKTEKTTTTDTEKKADKKDDPASFGVDRLV

SEQ ID NO: 816 - protein, 232 aa, Lactobacillus paracasei
MMFMGSIVNGLTIIGGGLLGLILHSISDHAKDTVTKSLGLGTFALGIQMALQTKSFIVMVISLCLGGLIGEWLHIEDGMNHLGLMLEQRFARGNQHFAEGFVTATLIAVIGAMGILGAIQAGVSGDNTTLYTKSVMDGFMAIMLTASLGVGVIFSALPVIIYQGTITLFASFLVQFVPKALMTNALREIGAVGGLMILGIGLNLMGITKIRISNLLPGLLVLVAILTGQYFL

SEQ ID NO: 817 - protein, 157 aa, Lactobacillus paracasei
MKKRHIVARVRRPNGLVLDFRLPKDVTRAINVSQQTDWFERLRGGLIVVPMAPYVGKGETALFVGRIERVYYSDRFLKRFTRSQFLLPDVWREQDMLESYTFLRHDHAWLNQQYLKDDLRYWYYDANSHLLGVVRDWHCKLVYYRFHRQKQRLIPNF

SEQ ID NO: 818 - protein, 673 aa, Lactobacillus paracasei
EIIABCCMPNENTMAKYDLIAATGCATGIAHTYMAQEALEQAAKKMGLTIKVETHGQTGVDDPLTQEEISGAKGVVIASDIDVDADRFAGKPLVNVPVAAGIREPAKLIQEALSSDTAVFMPKGGKATAEAGEKTETSSASIGNKIYTSLMNGVSHMLPLVVAGGVLIAISFFWGIYSADPKNAQYNQFAAMLNAVGGAAMGLMVPVLAAYIGEAVAKRSGLIVGMAVGMIAYNGGNGSGFLGAIVGGYMAGLVILLLQKAFAFMPDREFRGLKAIFLYPVLGVFIAGSIMFLINTPMKAMNLGLMAWLKGLESSSPIILGIVVGVMCAADFGGPINKAAYLTGTALLAQGNYFFMAGVSAACIAPPLATTISVLLNPKAYNRDERSAGYVNALLGSTHITEGAIPFAAKNPLMNIPAFMVGSAIAAVLTYMSRIQVPAPHGGFIVLPLVNKPFLWVAWILVGAAASGVLLAMIAGRSARKRGVKTGVVEAALATEAADDDVAAAPIAVDDARNQPAPTTDDDQSFDPGEILNKEFIEVNVPAKTRDDVLHYLADMAVKDGLATDADAIFKKYVAREEEGSTGMEKGIAIPHAQDETIKRSAMLILHLAQPVEWKTFDGKPVNAVISFLIPEHDSGSHLKYLSNTAKLLTHEDFVKSFQAAQTPDALYDLFNR

SEQ ID NO: 819 - protein, 309 aa, Lactobacillus paracasei
LIYTLTLNPAIDLFIKTQQMAPNTVNRTDSYDVQANGKGVNVSCILKRRGVDNTALGVGAGFTLDYIADFLTQQGVPNHFYKDAGFTRINVFARVVTTDTEYKLVNPGPQISADTLTQLYQQLTTLGSDDWLCVSGSFAQGIAPAFLLKLGALSQKNGFQLIIDSAYPEAVEALAYKPLLVKPNDVELMNWFHQTGEADLTTMITLGHRALEAGAQNILVSLGAAGALFMNQDVTLVGNAPKIAVLNTAGAGDTMLGTFLAGLYQHHDLAETLKLAIAAGSDTARQAWITDFSNTDELLGQIKIRKMEG

SEQ ID NO: 820 - protein, 250 aa, Lactobacillus paracasei
MATLSPTEAYLWDYIENHQQAVVNASITQLSTAANVSPATVVRTMKKKGFNGYTDFRHDLLKRTGDAAPFSILDQVDDQIKKVIMQNQVEVYNTLENLKVSVIEDSVQLLAKAEIVLILARGLSESIASEVTLKLQLLGKYAEFFSDPNIIQTIAGQVSPKAVAITITLNGETPELVAAAKTLAARDIPQIILTTNAEAPIVQYADELFVGYKSKAAYFDKYEVASRLPLQVMSRILLDSYVVRKRGQKS

SEQ ID NO: 821 - protein, 504 aa, Lactobacillus paracasei
MADKYMMAIDEGTTSTRAVIVDHAGNMVGEAQKEFTQYFPEPGWVEHDANEIWEAVLSTIADTFISTGIQPSQIAGLGITNQRETTVVWDKKTGLPIYHAIVWQSRQTNGIAEQLRKAGHGDAIHEKTGLLIDAYFSATKIRWILDHVPGAQQRAENGELLFGTIDTWISWKLSGGAIHVTDYTNASRTMLFNIHTLDWDDDILQLLNIPRAILPEVHSNSEIYGEGAAYHFFGSAVPIAGMAGDQQSALFGQLALAPGMVKNTYGTGSFIVMNTGEKPTMSANNLLTTIAYGIDGKINYALEGSVFVAGSAIQWLRDQMGLVAKSPDTEMAANASTSNDEVYVVPAFTGLGAPYWDAEARGAVFGLTRGTTKTDFIKATLQALAYQTRDVVDTMYKDTQIAVPALRVDGGAAKNDYLMQFQADILGKPLERAANLETTAMGAAFLAGLAVGFWQDTDELKKIFKIGKRFEPQMSEARRENLYAGWQQAVAATQLFKHRPLPKA

SEQ ID NO: 822 - protein, 245 aa, Lactobacillus paracasei
MTKPKYQEIADVLISELDQGRLNQGDRFYSEAELKSRFDVSSTTAVKVLNLLQTENRVTRIKGRGTFVAKESHRRVVYLTDLNMAKTEPEWTKVLSVAFGEDPVVRQNLRLADKEAYVVIKRLRMIGDQAVQYTVNNINAAYINTDQISHPEAFLSVYQRIRDDSRLDPYKLPYTQRNLAGTIDAALVTAYFPERPEQQTFIQQFRQTYLPFDAASHLEYAISYKLPEFWGLQTDSTYGFIEPEL

SEQ ID NO: 823 - protein, 414 aa, Lactobacillus paracasei
MTEPLPRIQHYEDLGLGLFIHWGLYSQMAVGEWTEFIHHRNQHDYEQLIKTFTAEQFDAKKIAHAAKAMGAKYIVLTTKHHEGFFLYDTKGLSDFDIMHAPARRDLIAEFVAACREEDLLPFFYMATYDWHTPLYDDDFPAYLTYLQKSVEVLCRNYGPVGGFWFDGNWNKKDADWHLPELYGMIRHYQPNAIIVNNTGLKNRGQVSDPEIDVVTYERRTPDEIYHGAPNEKYVAGEISITLNQHWGIAANDLNYKSPAEVIETVAHARHIGANILVNIGLTGTGAIPAAAQTYMHLLGRWTAMAAPVLYKGRPVPVTSAHGTRDFVLHTSKHDFLCILDLQVVGNDNVVLGGEGVNPRSFVGIGQPIQRIHWLDNDEVLSFAHDLDKKVLTVDATGYPYGSDWVVRIAQIDYE

SEQ ID NO: 824 - protein, 324 aa, Lactobacillus paracasei
EIIABCMPNENTVYVFASHGDYAAATLASCELIAGKLSNFATVTFHDPMGLADLIAAYEALFAKETDPANFQIITDIPNGSPANAALQFKHKHPGVRVFSGLSLGLALALATGTPIAEALKESQAIAKELFLKGESQAEAPADTAVTSTEKAFVPAPENTNTGDPLINVRVDARLIHGQVATMWTRMLNATRIMVVDDQIVQSEVQKMTLKTAVPGGVHLSILTPSGAAKRILAGNYQGQRVFVIVRNPKALQEMVEAGVTLKAVNVGNISMAAGAKQIAKSVAVTPDNIAVFDYLTKHGVELYHQMVPNDQKVAFNTLLKNKA

SEQ ID NO: 825 - protein, 268 aa, Lactobacillus paracasei
MAIAWWQILLLTMLAFWMIIDQITVGILTNYPLLYGFVSGIIMGDVKTGLVVGATLQLMVLGVGTYGGASMPDFMTGAIIGTAYAVISGKGINFAIGLAVPVGLLMVQLDVLARFTNTFFLHRVDRYIEKGDTKRVARNIVYGVFPWGLSRAIPVFAMLVVGNTVVQKVVNAMPQWLSKGLTAAGGILPVVGIAILLRFLPTKRFISYLVIGFLAAAYLKVPMLGVALLGLALAIIYYKQGSHQSSDHHDDPDTNKGGYENAIGEYED

SEQ ID NO: 826 - protein, 274 aa, Lactobacillus paracasei
MPSANTKTDLPVKLTKHDLFQANWRWLWGSQICWNYERMMSTGYLFTMLPTLKKLYKNDQDLIEMMKMHNQFFNTNAYVGGFIVGMDMAIEEKQGRKAEDTVAGLKAGLMGPFAGVGDTIVGVILPTIFGSIGAYMGLKGNPTGAILWLLVNFAVLILRFFLLPLGYSQGEKLIYATGDKLNRITDAAILLGVTVVGALIPTVISANVPLVFKTGKVVLKAQTVLDQIMPSLVPVALVALCYWLLGKKRMNSTRLIVLVLILGIALGAFGIIGK

SEQ ID NO: 827 - protein, 105 aa, Lactobacillus paracasei
MDEQQQLVVMQLIMAGGNAKGAAVEAIRAAKAGDFTQAETKLKEADQFLAEAHQAQTGMLTAEASGQHQPVSLLMVHGQDHVMTAITFRDLAGEIVALHEQIASR

SEQ ID NO: 828 - protein, 104 aa, Lactobacillus paracasei
MAENKKTIMLVCAAGMSTSMLVRKMLDAAEQKDVHVKIFAASASDAQDQLAAEHPDVLLLGPQVRYLESDFKKTLTIPVAVINMQDYGLMKGDHVLQTALDLMV

SEQ ID NO: 829 - protein, 476 aa, Lactobacillus paracasei
MTIQFDADFVWGAATSGPQAEGTFHKKHENIFDYHYHTRPQDFYHNVGPDVASNFYNDYENDLALLKQAGVQALRISIQWTRLIDDLEAGTVDPVGADYYRRVFKTMHQLGITPYVNLHHFDLPVTLQHQYGGWQSKHVVDLYVKFATRCFELYSDQVTHWFTFNEPKVIVDGQYLYQFHYPNSVDGRMAVQVAYNLNLASAQAVAAFRQINRQPQGTIGTIVNLTPVYPASQAPEDLAAARFAEQWANDLYLEPAIHGRFPEELVARLKRDGVLWEATSDELAVIAANRIDVLGVNYYHPFRVQAPAVSPDSLQVWLPDIYFDNYDMPGRKMNLDKGWEIYPDALYDIAMTIKRRYDNLPWFVAENGIGVANEERFLKDGMVQDDYRIQFMTDHLRFLSQAIAEGANCHGYFVWTGIDCWSWLNSYKNRYGLIRNDLRNQTKSLKKSGHWFSQVAATGLVAPTLRPFESEEKDHG

SEQ ID NO: 830 - protein, 291 aa, Lactobacillus paracasei
VSLAVIDIGGTTLKFGCYDEVPGISHQTSVKTPQTLGLFYQTLQTQVRELQRKATITGVAISSPGSVDQTAGIIRGASAVPYIHHFPIVAELTKRFQLPVTIENDANCAALAEVQAGSATDVRDVIFLVLGTGVGGAVVLDGRIHRGRHLLGGEFGYMLYGNGDTVSHLGTIVNAADRYNRANGTDLDGKALYELAKTGQPLAQKAVRDMLQVLATTIFNLQYSLDPDCFVIGGGISQNSDLLADLNQALDVVMAKVEIAPIRPIVRIAKFQAEANLYGAAVNFQQHQRSR

SEQ ID NO: 831 - protein, 431 aa, Lactobacillus paracasei
MTEDSRPLAAALTAFADEHPLPDAPAQQMFRTLLPDALVKATSRQADGTYFVATGDIPAMWLRDATFQVLPYVQLIKDVPDLKPILEGVLRRELAFVQLDPYANAFNQTASAAHWRDDDETNISVSPQVWERKFEIDTLCAPLLLALRLHTETGDAALFDATFWETFAVILDIFEQEQHHEQSPYFFRRRDTAANDTLPNNGYGTPVAYTGLIWDGFRPSDNRCEYGYHIPANLFAKTVLKGLLPLIPANHQSLAARAQTLVTAIERGIAKYAIQTLPSGDQGLAYEVDGLGRTRFMDDANVPSLLSLPFLGAIAADDPIYLATKTFILSRQNPYYYQGEALAGIGSEHTPLEYVWPIAVAMAGLVAESKTEKAATLATIAATTAGTGQCHEGVHKDDPTQFTRTWFSWANMTYCQLALDYVRDQEKEVAL

SEQ ID NO: 832 - protein, 879 aa, Lactobacillus paracasei
MQKVHVIAHTHWDFEWYFTRQQARVQFAYHMAEVLQALADNQLDSYLLDGQLAIVDDYLQTNPDKRAAMMRFVKARRLFIGPWYTQIDEMVTSGEAIVRNLQLGHKLAADLGGIMKVGYLPDSFGQGQDMPKIYQGFDITATVFWRGMPHEKNARYFYWTASDGSKVLAANIKNGYYAGVDLIENDDAAALLHRIATDTQAHDLALPVGGDQRAVDFNLKDRLQYANQQTSDFELVEDNYPDFFKALSTSSDLPTYQGEFIDPSASKIHRGIYSSRADLKHLYDRLEHLMVDVVEPMMVIAAHQGIEAQDGMVAHIWRAIARGQAHDSSGGCNSDATNQDIYQRSVEALQLAESVRDYLLRKLASGAPASLNVFFWNPTVRPVHQNGEITLATRGKHFSLKDENGEVVTYEILKQVKVDNAVLRRDPAQEKPDVYYRTTIVVPLTMKAMDWVGFTLEEASQCVANRQPSTTISNAYYTLTFDKGQLVLVDRRTKQSFVNPIHFDDGGDEGDTYDYSPAFQDWLLDLTLAEAEVTGQQGKLVSELVFRGQWQLPSDLAQRAAKKASVEMPYVLVLKLAADDPVIHFEFTVENTVCDHRLRLILKTPVQAQTSFADTPFGIAARPVIDPHLKDWRAIGYHEEPTALRPLIHFANTHDDKTSWTFLGLGEKEFQLIGDQFDQLAVTMFRGVGYLGRPDLKRRPGDASGLQTKYVSTLDSQLLGTRQMQGGICLDADFVPAELQRRVQSLAIGSLGYQTQTLDRFTTPLQYFPINTNQTNLVHQSPVQLVSRDLVVSSVSETPDHAGYLVRVYNPTDATVATAGDFILEVAASIRQLNLNHETKQTLATDVTTFKLPAFKPGEIRTYGIYPRHISLASKKESL

SEQ ID NO: 833 - protein, 441 aa, Lactobacillus paracasei
MKFNVDKLQEPLLKASMWVQNNTILQAVKNAFVRTIPFTVIGSFSNLIKMQLDALIKSQNLYWGWLTSISNLFGYLGVATLGIVGLIVVISSAYSYAVELKQRDENKSMNIIIATLLAFSAYFVMVPNNVNFADPKAKVIEGFASSLFSYEGMFTGLIVGMLAVALFAAFSHSKFTIKMPGSVPQNVFDSFFALIPMAEVLLLFGLARIGLQAMGYASLIQLIATVVIKPLLTVGTGLPAIIVVILLEQILWFLGLHGFNIVWGIVSAFWLPLFLQNVAKFAETKSFADISIAPNTMTNVYAMIGGSGATFGLIIAMLIFAKKGEKEREVAKLALVPGCFGINEPVIFGLPIVLNPIMFIPWIVVPLFNAIVAYVVTSIGWVVPLVVLNSGNEPIFFSTWILGGLHMSPVILALVLVIFDVFLYAPFVIMNQRNERQMAAA

SEQ ID NO: 834 - protein, 241 aa, Lactobacillus paracasei
LYLYWEIYSDIKKDILTNHYRAGKPLPTQEVLARTYHTSRLTIKKALRMLQDEGLIYTKQGSGSFVRAQAPDDDKELLPLDAPIGVTYSHRDQKITSKLLYFDARLPSATEQKNLGIKSNEPVYDIKRVRLVNGHFYSLEHTTMPTNIAPLDKKILKGSIYDYLGSKGVQLTDARRILYATEADEETAEALQIKQGSPVLVIEQTAYDQEGHAFEYSVSSFIRDHSRFVLNIHRRLPDLPH

SEQ ID NO: 835 - protein, 242 aa, Lactobacillus paracasei
MTEQYVFENERKDLAEVAREMFMRKNTNVAGGNISVRITPDKDFDYGDIHIKAGKDYLIMTPTMMSEAWYAKLQPTQILVVDLETGKLIDGVGRLTREINMHEEAYRANDKIRCVYHSHAEESMFWATAGLDMPNVTEVTEEVGPIRVLPYAPACSKELADTVYNGLKEVGDAAKEHIFLLNSHGVLITSEDLHHATEILETVEWNAKIAYQQTVFMKLGLLESYQSCGKTTDGMLKEPLKA

SEQ ID NO: 836 - protein, 86 aa, Lactobacillus paracasei
MIRNAVIKVSKTLASFLVFLDTIGISIALLGGNTWLCLLMGIATVILYVKVNPILFGDYDRKRKEKIEKKREELLARRTNKEGISK

SEQ ID NO: 837 - protein, 530 aa, Lactobacillus paracasei
VTILKDVVNYILNLGGPVFVPLIMLILGLVAGLKFKKSIVAALTLGVAFSGMTLVVNYMMEAISPAAKSMSKLFHLSLNAIDAGWTGVAAITWSYKSAFLFFPLLLAINFVMLTFNWTKTLNVDMWNVWNKIFTYVVVLYFTHNAFFGFLVAGIQIVFELKAGDMWQRHIEDLTGMPGVTVPHFITLFAVILQPLNKLLDFIPIMNKPFDADALQKRIGVWGDNTVMGALIGVLLGFGAGYSVSGSLNLAIKAATAMTLFPMISKLFMTALSPIADAMSGFMQKHFKGREVYIGLDWPILAGRNELWVTVIILVPIMLVFAMILPHNTVLPFAGIINLSFVNAALLLTGANLLRMITLGIITTPIFLYGATYFAPVITNLAKSTGTVKVQAGQQLSWSTFEGPDFRLLFAQAFNGQWWAIALAVLWTLGFIWLYRDQIKIKLPSQRYGALVPVTAAAAPTAPASTSNDATDVDLSDLSGLDFSDAKASNESKKATKDKQNDTADDVDLNDISGLDFSQTSHDKKRGDKGE

SEQ ID NO: 838 - protein, 106 aa, Lactobacillus paracasei
MAKIVVACGSGVASSEATASRIKDFFETNNVKGISVDATDFKQLPEILHNYDVYVWIAKPNQQLEELAKENNIAVVNGMLIFMNMNPEKSYKEIVQALKNMQAAGK

SEQ ID NO: 839 - protein, 159 aa, Lactobacillus paracasei
MDYSTMIHKDLIFLNENAADRKTLFRDVAKKIRAAGYAKDTYEAALNKREDEFPTGVVFPEISVMLPHADPENVSEPFMAIVKNAQPVRVLQMGYNEPEDATAMFFLGITDASQQVGLLQVFMDLLQDKAFVAKFKATTDPEAMYQFFVDTFKTQAANK

SEQ ID NO: 840 - protein, 265 aa, Lactobacillus paracasei
VSQKPAKFERLNDIIRILRETPQISVAELSRQIFTSKSTLRRDLIELENTNIIQRQYGMIQLLQGNNIEFTYEKRRNENARLKRIISHQIADKIPSNAAFFIDGSSTFFSLPELLHNQVGLHVITNNVNMGLQFNSLNNIETIIIGGKMAPRSASTLGSTTIEEIQSFHPDFALLSTGSIDAGGIYVADPEQAAVKEAMIANAKCVIFGIDSTKFDQSDYIRITNMNQIDEIITDKKPNAAYQNLFEKNHILLTYPHEYRQTPKN

SEQ ID NO: 841 - protein, 282 aa, Lactobacillus paracasei
MPTNHDIQDNLSNWDDRANIHAGGGYGDIAGFINNPNGVTGTVKRDLEVLLPHLPANSVKGQRLLHLQSHIGTDTLSWWRLGAVHVHGIDFSPNSLHYARDIAKQAGADIAYVQSDARYAAKALANEAQGFDVIVTSAGTITWLPDLQDWANSIAALLAPGGIFMIRDNHPLLFALDNDGLTITQNYFSGAEISYDSDGSYTAGSKGLIQHTRNHNWAHDFQEITSVLLKAGLTIEALGEQRITDWQALPMLTFNQEEDGWQMPADLPQIPLTFSLVARKQI

SEQ ID NO: 842 - protein, 560 aa, Lactobacillus paracasei
MHKSWWQEAVVYQVYPRSFQDSNNDGIGDLTGVVEHLDYIKQLGVDVIWLNPIYKSPNADNGYDIADYGKIMAEFGTMADFKHLLNEAHARGLKVMMDLVVNHTSDEHPWFQAAKQSRTDPHHDWYIWRDPVDGHEPTNWRADFGGSAWTYVPEVGQYYLHLFATKQPDLNWTNPAVRKAVFDMMTWWCKQGIDGFRMDVINLISKPEQFTDDPYIVEHPNGSSLGFIANGPHVHEYLREMNQTVLSKYDLITVGEAPGVTPVLAEKYTGFDRHELEMVFQFKHMGLDDDPQFGKWSLHRPKLTDLKRVLSEWQTDLHGKAWNSLYWDNHDQPRAVSRFGDDRPAFRVRSAKMLAATLHMMEGTPYIYQGEELGMTNIDFSSIHDYRDLDTLNAWHELVDQQHALTSEDMLKRIHRRSRDNARTPMQWDATQHAGFTKSTPWIKVNPNYQTINAAAALADPDSVFFFYQKLNQLRKQYPALIVYGDYELLDPDDSDIFMYRRFTDDQELLVINNFTDQEQSRPISTRLPKNARLMISNYADDRGDVLRPYETRSYLGERR

SEQ ID NO: 843 - protein, 250 aa, Lactobacillus paracasei
LKKRTWVITITGVAILLVNTFSVILIQKNDAERRLSLGRSRVSSISTSKVKASKWQVSVSEAQSTANSKFYADKTSKDAVASSAIVASEAKSKAEAVNHVDFDKLSKIDQAKAAIYYGLGNMQYFNDKSVSNYPGDAVYSSSGVDVVFVKDMSAGIGSTPYLVAPHLSQVSAAAPVFSYVELGMQADGHRPEGLTYGKVDDDANGYVPDPGLHNTVGVSFKTVNDWINSHGGMAAVQKININRFIDFDQE

SEQ ID NO: 844 - protein, 52 aa, Lactobacillus paracasei
MSHAQNPVKGGVWLSVADAITIMLAFGSFVLLLVGTVVILVRAILDNQKDRH

SEQ ID NO: 845 - protein, 762 aa, Lactobacillus paracasei
MKTSKTIRVGLLVLLALSVGLFVAASGKVNRLSAAENRIFYIANNGNDNNDGMSVDHPWRSLAKVMATKFQPGDQILFDANGIWNGQLILDGTKNGEGSASEPIVIGSYHQGDVRKKAIINGMGTTANQSPYHHRNLSNINLMTGAVELWNANHWTISNIEVTNFSNDGNRQAMRIGILVASDINVPYPSGTDAASIQQKLAIFKASHRTGINIRNNNVHHVDGAYQSDPVPDQTGKMVPSGKNSGGIIIVGNTDVTAENNVITDVSNEGLRNDANASVLPGGWDQYSFRASAHTAFRNNYIRNSAGDGIVISSSENGTAEYNTVEAANSMPGSKNESGASKNFAGLWFMGGEYNLAQYNEVFGIPNHYLDGAAFDFDGFASKGVYQYNYSHDNSGGFTLFMGDHQTDNVFRYNLSVNDVSDLPSPALNHLIFVVSGKNDGIAGFPLFHNNTFIVGKAVKNLMVSNNGQTGIRFVNNLVYAPAGNTPKFVVNQAGNKRPLFAEGNLDHNLFYPQALLDQSHTDAVDVSDNLFVDPQLGDVTAKPSGLINHNTGSMSVESLGSFIPIAGSPVANAGRSVAELTPAAIQAKFPITQDFSGKPINFERPTIGAFEATKPTIPVQKGELKTVIDQALAVKEKAKYLKASSDNKAAFDQILAKAQSLLTNQIADQLTVNNMVSALRRALEALDGKDDVPGTLNKPDPEKMMKSETLVKKKQHSETDQSKAFPKTGEMMMNSLPIIGLVALIVCGFGVIGWRKYVANK

SEQ ID NO: 846 - protein, 336 aa, Lactobacillus paracasei
MRFVQLVEVMTTKKVNKLLIGLLTLVFMLAGCQAKETPPFLEVAGVPVSQRVYQYFLQNEKASTVSHYMTKYHTTYNEHFWLTKYGSETPQQFAQDKALRTLKQYIVEDKALVTAGLIKKPLVAFTDLKKADQTGASLSGMAAAQKTHSALMMRLRSQYAKKYRQTITSKQLENFYSQNKDKYWGKPNLVNYQALTFEREKINDLGRFTALVQQVSGKSSDLSTIQNDFASKGFSGTFVMADSSHDKDKYYGNYLRASNSGDVQQGIIFIAWTSNETMSLVRPITFTNGGYYDFSTVKEDVAVKLLERRLNATLAKKAARAVLQVNKAALSKQKLS

SEQ ID NO: 847 - protein, 641 aa, Lactobacillus paracasei
MTKQSWARYIQQLAQQQHLTKDAKTNADRLLDNTFLFDSPYAMEPTQISYTMDPIKWQETPNGDPEWLYMLKRQEYLLDLLEAFYTTGQVKYQTKMKALLFSWIDQNLALPETWRTIDTGIRLLNWTSVVANLVESEQLNASESVSVHDAVKVQADYLRQNYTEKFDISNWGILITSGILTYAARFPDVVDRDTVTWAQQRFEVELDLQVDTQGMQWEQSPLYLLEVWRSSLAVIAAQQRAKQTVAPNILQKTRAMQRMMAQYVKPDLTLLQQGDTDAIRIDSLFNSSAAILSQPAQLQDRLEPVFDFVLLELAHQAWQPAAKKAELTKQYAAPISGNYFWRSDWGENADYWHLFNGNLGSGHGHAALGHLDLVMDGHDVLVDGGRYTYVDGTERRYLKSVEAHNTVMLDHKPFSLPKDSWKYQYAATPVTNQVIDFSAGQLIKAVYIDRAQQTPVMVVRYLINLAEERLRLILDVVSDPGYHTLKRFWQIAPDLTVTKQAEGYQLGNVASLAVTERNIWKSRQLFSPRYNALDHLTRLESETLFKDFTAQAAVFSPANPDITVTPVQIRHSGNDDEIVDDQLATGFRVDLGRDVNYLVTLQSENTIVGRKLYWFDGTETYGSFNLFKRKGQRVEKHFQLL

SEQ ID NO: 848 - protein, 115 aa, Lactobacillus paracasei
MTFWQIILAIMVVLVCLLYLVAIPLAKRHAMQKQADAVDQMHANLQIGDQIVLIDGILGNIQSLNQEDVQVEIAEKTVITVKRMGIAGVVKEVSGHDKAKLGKVHSATSAATTSH

SEQ ID NO: 849 - protein, 156 aa, Lactobacillus paracasei
MNYEIVIVGHGRYPDGVLSALQLLIGTTEGIKAFNLDEQTTHEKFEKQLTELLSEHERVLVFADMTGGAPHQIVSRLVLEGNQPHQYVISSAPLNLMLDLYAKSLTGFEDDTIEGELQHTLTLSKQLIEILPDRMNTNSATAPVPDMTHQDEGDGI

SEQ ID NO: 850 - protein, 271 aa, Lactobacillus paracasei
MASSRKPVLTKKDYLNSILRSYVLQNGQNYGTMQGTGMANSIMPQLRKIYKNDEAEFKRVTTSNLEFYNTNPQPYPFVSSIMLAMYDSGQDEDDVRAIKFALMGPLAGIGDALSQFGLAPLFSSIFASLALQGMTWAPIPFILCLFGITFGVRMLMGYLGWKVGTSIIDTLSDRMAAIADVASMLGLTVIAGLSVSFVKVNLAWQYSQVIKGKTQVVAVQTILDKIMPFMLPIALTYFVYWLITKKKWTIYKIVILLFVAGVLLSVLGILK

SEQ ID NO: 851 - protein, 270 aa, Lactobacillus paracasei
MTYSIVQALLVGLWAAFCFAGQQWGIYTNRALFISFGIGLILGDLQTAVVFGATAELAFMGFGVGPGGSTPPNPLGPGVVGTIMAISISGLKPAAALSLSYPFAILIPFVITFIFSVNANNLAWSRKAIEEGKYRKFHFLANTTLLGFILFAFCFGFAATLSTSALKVFVQAIPQWLISGLTVAGGLLPAVGFALIMSTMAKKEYIPALILGYVCVAYLKMPVIGLAFAGAVLAFNNYYNGRRADKNKGGSTSTNDLGSDGDEGGIEDGI

SEQ ID NO: 852 - protein, 166 aa, Lactobacillus paracasei
MAEPNIKAVRLDERLIHGQGRLWISNLGVNLVIVANDEVAKSHIQQQLMASLMPESVGIRFFSLAETIDKIFKAAPRQTIFIIVKTPQDALKLAEGGVPIKALNVGNIHMKDGKTRLTNFISVDADDLNALRTLHEKYHANLNTRTTPLGNDVGSDFDLNDYVATH

SEQ ID NO: 853 - protein, 392 aa, Lactobacillus paracasei
LKIEPLTNAQRFFNAGAVDIHAVTNALDNVVRHLDLNIKVLGESFPEPSTVQERYAAMPNTEWTNGFWTGMLWLAYEYTGKDQYRALAEKNVQSFANRIDQRIAVDHHDLGFLYSPSVVSAYQLTGSQLAKEAGIKAADQLLTRFNDKGGFIQAWGQKGAKDENRLIVDALLNIPLLYWATRVTGNHQYQQIADRHYETALQTVFRPDGSTFHTYFFNDLGEPVRGATRQGYSDDSAWARGQAWAIYGTALHYYDTHDAGAFQTFKAVTHFFLNRLPPDHVPYWDLIFQAGSGQSRDTSSAAIAVCGMHEMLKYLPEADPDKSVYQVAMHAQLKSLIQKYAMPMDGQAVEPLLRHGVYSWHSNHGVDEGNLWGDYFYMEALIRFYKDWQLYW

SEQ ID NO: 854 - protein, 276 aa, Lactobacillus paracasei
LEIALLSASDQVIDTSRNGESDGYLHLDHVYAEGDYVQVEFERQLLPGFFWVQVDAALVPSLLYFTQSTWHYVIPTDELAVTHPEHESIYPETAFAGKTHLIRIWKPDASEVSEERNVAFNSHDQAVHFGAYPHASANIETRHDPTFAARNAIDGYRLNDHHGKFPYQSWGINQDPTARFTLTFGRPIKLTRLAITLRADFPHDSYWTQGTLRLSDGSQMLLHFTKTDQRQMFDINKEEISELQLADLIKADDDSPFPALIEIEAYGCELVEEIAN

SEQ ID NO: 855 - protein, 255 aa, Lactobacillus paracasei
MGTTTNESKPYGTVLIKAKDILDFLLATTDPPTLSDISRGLHASKPTILKILGTLESLGFVWRDTTTKQYFLGTQFVPYAQKAIATFNIVRVARPYLEDLRDKTQETINLGIVRDNKMILVEKLESPTSIKLQSTIGGSMNMYSSAMGKAVLATYDAKELQAYFKSHKLTPMTPHTITTPTKLQQDLKTIQELGVAIDNEENEEEVYCLGAALQKNGELYGAFSISTPKYRLPKERRAAFVRLLLDTRHAIENTL

SEQ ID NO: 856 - protein, 281 aa, Lactobacillus paracasei
LTFHMATRYAHSPEDIKHFDTTKLRQEFLMEKIFNAGDILLTYTYNDRMIFGGVVPTESSLEIKLSKELGVDFFLQRRELGVINIGGPGSIIVDGDKAAMVKQDGYYIGMGTKQVVFASDNPANPAKFYVVSTPAHKTYPNKKLPFANALAKPMGDQQHLNKRTIYKYIDASQMATCQLQMGYTVLEPGSSWNTMPAHTHARRMETYMYFDFAEPDTRVLHLLGEPTETRHIALFNEQAVVNPSWSIHCGVGTTNYAFIWAMCGENQTYDDMDQVPMNELR

SEQ ID NO: 857 - protein, 274 aa, Lactobacillus paracasei
MAEIHQTEEEIRKHEQELDHFKMSQFNLAGKVAIVTGGNTGLGQGYAVAMAEAGADIFIPTFGKAEWDNTRRLIEKRGRKVAFMDVNLTAPGSAEAVVAEAIKQMGHIDILVNNAGMIRRNPLLESKDKDWDQVIAINLSSVYHLSLAVSKEYAKQRSGKIINIGSMLSFQGGKFIPSYAASKHGVAGLTKAFASEMGAYNVQINAIAPGYIKTENTAPIRADKARNDEILERIPARHWAEPYELMGIAVFLASDASNYINGAIIPVDGGYLVS

SEQ ID NO: 858 - protein, 228 aa, Lactobacillus paracasei
KDPGALDLASEMQKYDFLNRLIATGCVAVVRGDNTQTAIKTCDAVIAGGITGIELTFTVPHANEALETLTEKYAGRQDVVIGAGTVLDPATARLAIIAGAKFIVSPSFNSDVAKICNLYAIPYTPGVFTPTEIQSALEVGVDLVKIFPGSVAGINMVKALHGPFPNLAMMPTGGVSLANITDWFEAGVMLVGAGSNLVDGASQGDYEKVTVTAQQYRAKIAQIKDTRR

SEQ ID NO: 859 - protein, 339 aa, Lactobacillus paracasei
MPTVLTLGEMMLRLKPTNQQRILQTSAFAADYGGAEANVAASLALLGDQVQYLTKLPENSLGHTARNTIRGLGVDTQKILWGGPRLGIYFFEKGASVRNTNVVYDRAGSSFATMKADEFDWPVLLNDINYFYFSGITPAIGSEQQAAVFAACQYCSDHNITVICDMNFREKMWSPEAAQAFFKTVMPFIDVCIANDEDFEATLGIKAFDGNMATGIDQLADFKEGMLEVTRRWPNVHTVASVVRNIHSVEESQWTALLVQNDKVYQGPTFDMHIFEGVAAGDAFGAGLVHALIHHFEPQRTINYAISASVLKLTIGGDLNLVTNAEVEASMKTNSGVNR

SEQ ID NO: 860 - protein, 214 aa, Lactobacillus paracasei
MQSLDFELSGDPTQAPQMAKYMKHQFPFLGLKTPERKAQTKPLLKASRGEDLPTIRVWIDALYQRDAREYQYVAIDLALYHIKRWQFSDMQVFRQLVVQKSWWDTVDAWRKVFADYVKLHPDQKLAVFNLFFDQPNFWLRRIGINLQLLEKETMDTALLSKAILADLDTNEFFIQKAIGWSLRQYSKFDPDWVRTFIAVHALSPLAIREGSKYL

SEQ ID NO: 861 - protein, 229 aa, Lactobacillus paracasei
MDQNKLKQEAAQRAAEFVEDGMTIGLGTGSTVVYLVEAIAQRIKDEHLNLTGVATSVRTRKQAESLGIPMKALDEVGQIDLTIDGADEVDKHFQGIKGGGRSHLIEKIVAINSARNIWIVDETKLVDTLGKFPLPLEVIPFGSGKLLQRLADEGLKPAYRLNEDGSKALTDSKNYIIDLHLGKIEHPHLLAEWLNKQVGIVEHGLFLDLVKTVVVGTTHGPEILDAHRG

SEQ ID NO: 862 - protein, 654 aa, Lactobacillus paracasei
MTKMAKHSWMAVFLAICLIIGICGNLMKSGAVLWGAVVLLISVVTFAAAHNLGPLVNRLNARQMRIMIGIGLTLMLVGQVLILIFLPDTIYHDPYRILSQADQMAAGHNIWNTTYFWRYPNNVSLTYLLSLWFRLTSLVGMSTNAASHILTITLLDTFIIMTLVTLKQLSERNSIVLGGFTFLVLSPFAYTYYLQVFYSDLPSMLILLMIFRILWRWRIKSNLQRICAGIGLTMLVLVGQLLKPNLIVLLPALFIIVVILWHRKLLRTTKLTVPFLLIVAGFGLSVPTTQAIHTAANFHPNAAYELPVTSWMLMGVNTNSDGMYSTKDIEKAITLKDKQAVEQYDIQTIQTRVKKLGVFGLMKLWLVKIGILLNVRSIQDWYNGGFQSAPTWYDQHSQFLRAVTAVSYQVVTIVLWLTLIIRLLAWRPDLRDETALIGLLAIVTALGYLAFHTLLWETEERYGQAIVPLVLFALGALPNTARKRVVIPKRTRNRLAVGFALAAILGLSTFSGLLAKDYPNTIVVAAQRSQLSTQYHAKPQLIAPNTVMSEEISLNGASNYISVQIHQAAGMKVTLTSLSTGKVYKLKPAATVYKLETNIAAGHYRITAKNTSGIGQQVDVVNTQRYQLAEYPLVVNGVKNATASFVYTSLYQPT

SEQ ID NO: 863 - protein, 313 aa, Lactobacillus paracasei
MQKLTIVIPAYNEQEVLKDTVPRLWSIERDVVTQNFLSEDSDILIVDDGSSDNTWSIIESFHKQHSKIRGLRFSRNFGHQAALIAGLTEAIKTTNMTITIDADLQDDPEKIMEMVQAYSAGADIVYGVRTHRETDSWFKRTTAQGYYKLLRLLGVQMVPNHADFRLMSKRAVQTLLTYPERNMFIRGLIPKLGFQTVKVYYKRTPRLAGESKYPLKKMLAFAWDGITSLTIAPVRLILLLGTLAVMLAFGMSVYSIIVKVLGLTVHGWSSLMVSLWFLGGLQMMSLGVIGEYIGKMMTEVKGRPRYTIQTRLD

SEQ ID NO: 864 - protein, 223 aa, Lactobacillus paracasei
MNIKKDYFWGGGLLLLFALLTWSVVMQVAWVGELDRSVQGIIKYDTQMDTRIFEVVALLGSPPVVISLTAAICGYLWVKGRRSDSIWIGACQLLGSGLLLLIKLLVQRPRPIHQLVADTGFSFPSGHVMCSMVLMLSLLMLMLPKIKEQENQFVAILLSMIWIGMVATSRIYLRDHFASDILGSLLLANGLWFVMLPQARYIDALIVKKAAQRSAFRPQREDK

SEQ ID NO: 865 - protein, 218 aa, Lactobacillus paracasei
MALLLLTSFITNLNQLIPSLIAHTGNWIDVILFGVIFIETGVVIFPFLPGDSLLFLCGSLAALGNGAINYGLLVGLLTGAAVISDALNFEIGEHFGAYLTTSQKFKRVMKPAYLQRSQTFFKKYGHIAIFLGRLIPIVRTFVPFTAGIGKMHYRDFAIYNILGGFSWVTLATGAGYLFGNVPFIKAHFELIMLAIIGISLFPMIVIAIRKRGMTADEH

SEQ ID NO: 866 - protein, 463 aa, Lactobacillus paracasei
LKKRKQNQSSAAIMQRSLVSMVATLTLALGLLIVAAVGHQLYEQVVLSTDHIAASLKQTVIDGDDDWENWRKNSTLDTSSTYVHVHNMRQDAKVKNYYSPATKKVQLAKSFPFLTQLRYQANQGLFYYQEVHAKGIRYEIWQSMNSYLAVLIRVLVVTMIVLVLALVVSPIFIRRLAHRLTGPLSDLSQSTKHAAEHAKTGVVMLPVPDKPTEVTDLAKDFNDLLKQLHDRQEQQKLFIMNAAHELRTPIATIRSHAQLIERHGRAHPEIVLKSVNYITEESRQMQQLIEELLQLSRADRLTLDTHLLNLSETVQHLAEKLASAFSQTIEVHVTPNMSVESNESAIEQILDNFVTNAAKYSPADTIIAVNLTRDDDGNAVLAVLDQGAGISAEDKSHVFERFYRSANVRGTVSGTGLGLAIANQLATINNGRIKLRDNQPHGTIAELILPLARTKERHQLNES

SEQ ID NO: 867 - protein, 233 aa, Lactobacillus paracasei
LKSTLLLVEDEAALADSLTTEFELENMSVIWAKDGAEALTLFKNNEGKINVIILDWMLPKLDGFSVLRKIRQSSQVPIIMLTARDYIGDKVAGLTGGADDYITKPFEMEELVARVEVALRHNRQAVSPATIFQVDDLLVDTDHKRVQRGEVIMPLTQREYELLVELVAHQDEACSRDDLLAAVWGTDFDGQPNILDVYIRNLRHKIDDHSGSKKLIHTVRGVGYMLSANVASI

SEQ ID NO: 868 - protein, 461 aa, Lactobacillus paracasei
MNQNRQFSIVIAGGGSTYTAGIVMMLLENAERFPLRALKLYDIDEARQATIAEAIAIELKEKAPAIDFTWTTDPQTAFTDVDFCFAHIRSGGYKMREQDEKIPLKHHVVGQETCGPGGIAYGMRSIGDIIELIDFMEKYSPDCWMLNYSNPASIVAEACRRLRPDAKILNICDMPVGTQRRMSQIIGLQPKDLEVRYFGMNHFGWWTSVKDKAGHEYLPQIRDYVAHHGYLTQIEVDTQHMDASWQATHKKAQDLLAVDPHYLPNTYLKYYLYPDYVVAHSDPDYTRANEVEDGREKRVFSAAQKIIDAGTSDVGSFPIDSHASFIVDLACAIAFNTHERMLLIVENNGAVANIDDDIMVEVPCIVGKDGAEPLTQGKIPMFQRGMILNQAMVEKLVVDAWINHDYQELWQALTLSKTLPSAQVAKKVLDDLIEANREYWPELKHDEHEVHLISESAVSEI

SEQ ID NO: 869 - protein, 350 aa, Lactobacillus paracasei
EIICBCMPNENTLQSRISSLGHVINQTGNFGLFLYGSLERLLIPTGLHHLIYTPFLYTSLGGVEEIGGHIFEGARNIYYAEMANPNIHLLSRSVIWDARGISKMFGLIGACLAMYQMAKSENKNKVKAILIPAVVTSFLAGVTEPIEFSFMFIAPLLFVVHAALSGLSMVVLNLLNVRAIGPNGFLDFLLYNVPLGVGKTHWPMYIVVGIMFFFIYYFTFRFLIGRFNLKTIGREADAEETKLYSKAEYQEKKQAPPVSVPKGATEVPVATIIEALGGADNFESVTNCYTRLRTVLKNPELVNETVLKNETGASGVIKKGNNVHVVYGLAVTKVRAAVDEALGFDSAEVE

SEQ ID NO: 870 - protein, 75 aa, Lactobacillus paracasei
LRYPKRAYTFSVDYFSTPESVDPFFAGKAQRKSTNGNQIAVGALFFLSRLLRLDAPLAVRQRNACQGLYSKTPNL

SEQ ID NO: 871 - protein, 332 aa, Lactobacillus paracasei
MKSKFRWQWWAVTLGVFLIVIAIFSVKLYADRHAAAMAASKTHAKSVSEHEAAVASSRRHAARKASKRHVAAVSSRRRAAAEASREEAQSKAAQVGQNHIAEANQYAYPVAQVKQEMDAPYTSPIKEKVVFLTFDDGPNTVNSPKVLDILSQAGVHGTFFVVGKQVSLETAPVLKAEYDAGHAIGLHSMTHDYSLLYPSRVGATAVIENEAKSAQAAVQQVLGSDFRSHIWRYPGGHFSWKGLAAADVALSRLGLDWIDWDAAVGDALSPAQEPKTEDAMLQYHLRSLNVYPASNVRVVLMHDALGKDLTVKTLPRIIQYYRDNGYKFGVLE

SEQ ID NO: 872 - protein, 774 aa, Lactobacillus paracasei
VIDIDTRFNRQNFNATLLLFYLRYRPWQIWIIFPMGYAWLLFRFKRIDITTFQARYWQWLFKQPINESRWRRLGQRLVKKSHHKVKSDTWIVAPIPDKLLDWLLSGGRHIGLDLDEQGYPLPAARPLAEKITYLRTDSLVVSPHFYRQIVRGTQLQPVTKIYANRKFFTSFRQYRWHQCGLVTRNIVVLAVLAIITGVATIYMSSAAYDLKLTKMVFTSPTLLLLNFMPIFVIMLIAYALFNRMMLAVFVGQIPAIIVAMVNYFMLQYRDYPFDFADISLASEASNMGARYSYVPPAKYLFVIGSLLLLTVIITLLLKPVSARLNVRLVMVFLLLLGSAYGLSRYYLVDDHYVLANDDPWGPDADRYVVNGYMFAFIHSVKNDWLVPPDNYSADNAKEALNKYQYQSIPADKRINIITVQLEAFQDFSKWSDLDIDPSVYAGLHEVASEGMAGQLTTTIFGGGTIDTERKVLTGFSDMSPINGMTNSFVHYFNEQNYITRFMHPGDAWFYNRQNIDRYLGFQKTLFRDNYYDQHVSDADVVPDTLVFKDLVKQLKQVNANGKQFFNQTVTIQNHGPYDTVFDGQALLPWKKGYNKKDYAIINNYLTGIKETSDALLELKNELDQLDEPVVLAFWGDHNPWGGDKNSTYKMLGINLKQSTHEGYENYYNTPYVIWSNQAAKKILTTDFSGTGPTMSPMYMLPEIFTHAGWQGSQFMQVLQKLEQQVPVFGTKNHYMINGALTTKPAKKTEKAIKTYDDIEYYLKSNYLMNQKDLK

SEQ ID NO: 873 - protein, 349 aa, Lactobacillus paracasei
VVFYLGLFAIMMIFMLLGRVTMSSIWAWLGVIILALVAGLRYETGNDFLPYKTIYAGDYSAGQVEPGFLFLRNLFNWIHAPFWLFLLAWAVVTLTLFYFFAKEYFRPAIIPIAYYLSRFFFMRDMGQIRASLVCVTCMLALKFVYDEKPLPFLVIVGLSATIHVSALFFLLIYPFWLLFRRINFKWVLGFLVFGAAVGFVAPKILSVIIVHTLPRYAPYVTNANYLSSGLFDPVTLMQVMICITGFYILNRGMVSNALIGGSEKFKFLMVVYLFATLTLLSLSQLSTIGGRLSTIATTTETIVLPTIVFSIMPKKTRTLSMVGVCAVIFVLIFLISGAYKTFIPYQMAF

SEQ ID NO: 874 - protein, 211 aa, Lactobacillus paracasei
MTNANTHQFISDESVSGQEFRTLRNNIALQVSRDDVPVLLMTSATSGEGKSYVAANLAASFATEGKRTLLVEGNLHRPILASVFDLKAQDGLASLVDVALESVDVDKLVVDTKINRLAVAVAGESLADPAQLLASAAFKEFLQQVKTKFDIIVIDGPAMADASEAGLIAELASGVIVVAKADGPSKRLVKQTIAQVRDLNAELVGTVLNQA

SEQ ID NO: 875 - protein, 230 aa, Lactobacillus paracasei
MENLLSMKELMVSLRRSWWLALCTLLLGAAVAAGFAYGVMKPAYSSTALTVVNQQKNNTESVNQMLNQNQYDSELLATSKSLFKTSAVFDEASAQLLKKDNLNISSGDLQKQVKVDNEDNSRAFSIHATAKHSKDAALIANEMAAAFQKTISAITNHNDTVTILAQATPSSAATSTKPMFIIVLGAVVGFLIGLAWIVLREIKKATIKTKETLGQIANAPVLGVITLKKL

SEQ ID NO: 876 - protein, 479 aa, Lactobacillus paracasei
LRNRFEVTRKSIVWSYAGTIFSMASNFILLPIIFHFLSSQEIGYWYLILSINGLIALFDFGFDPAFARNIAYIWSGAKTLKSRGVDQEHDHTAVNYHLLASTIHAARAIYMILALVAVILVGIFGTIYMNAFVFSKLPAAEYKWTWLVFCFSLFLNLYFGYFSALLRGSGKIDSVNKAQVFSRSLQILLTFGGFLLYPSILASVIGLVMYGIIFRTICNHFYWQDEEVRAHRDALKSPMNWKEIKDVFLFIWPNTWRDGLVSMSNYVTSQGMSLMAGAFLPLSVTGVYSVGVQFASAIGTAASAINGAYNPILQSNFVKQDFDSIRDKTSKAVAAYVWLFVIAVVGTLLVIFPLLKLIKPASVPTLQVFLPLLLYYFLYQQHSVHASYIANANIIPYTKAFLISAGTNLLGLWLGLELTDGNMYFLLFFPILVQGVYNNWRWPSYYYKMIHSSLFSSIKNGTIAWGKTFANFFKSGSNV

SEQ ID NO: 877 - protein, 378 aa, Lactobacillus paracasei
MKILFVSTGHVDDDSRLLKESATLQAAGHDVTILGWREDPHGRMTTDTFDFDGQTLKAIFTGIKISYSFKYFKVFAFMRFEAFLYRWLSKHLHEYDAVQACNVHTGYITSKVAKKTKTKLVYDIFDYAPDTRNYPEWYRKMVVHWENVTMATADWTLICSEDRRRQIEPAKPQHLAVIYNSPLDSPVATNAEAVDPTQKDFKIVYIGGLSPYRCLPELLGAVEKKPALSLTVAGQGQYQDMFADAGKRDPRIQYLGVVPYDQVNGIEKTADILVALYDPVLKNHLYASPNKFFEAMELGKPLLMIEKSGMSDWLIKYGFGAVCGTSEADIADGLQRLIDKRQNWAKEATLMRQIYQKEFSWSLMQQRLRDIYQSFEVK

SEQ ID NO: 878 - protein, 321 aa, Lactobacillus paracasei
MYQLSIIIPIYNGEAYLERLLKSIGVIPPSVELILVDNGSTDGSVKIIQAYRAAHPHTKVVFEKQNGVASARNAGLALAKGKYIWFIDADDAVRSDALLRILQIVTTIDFDLFIFNYQPLEQGAPLPQTNAQINVNSQKVGLPEILHEMLGSSRDVVGGFPHNKVFARDLIGSDIFPDCSFAEDLAFFVPILLRSKHIYRLHEVLYYYYQNNDSTVHQVDTKKLTDYAKVVDQIERQLRQSGLASNRDINEYVLRRRLSIFFQNLAGPKDPEIKKQIRQRMRQYSFKQLVAYRKDKKLMVKIMLYKLRILEVLPFLLKYVY

SEQ ID NO: 879 - protein, 557 aa, Lactobacillus paracasei
MSINRTKLLKTSIIIVILGLISFLNILPLLNFNFATSYMGDDFFFHVQRVLALSNIFKSPVNFDVFAHTATMANIFYPWETVYPLYLIYHTTGDFIFSYKLFYFLITFLTAILAYWCLFKISNNTFSSFCFAALYVFSFYRSTNFFVRSALGEAVSMTFLPLVLLGLYYILFDDYNKWRSLSVGMTLITYSHTLSLFMTSILIVVGFMVSLGFLDQRKARIKSLFTAGFWTVILCSPYLFLVINTSLNNKLYLNWQPALHGLPLTDWLMNSLGNRMYPNLNVRSSLGASVVIAGVLALMLFIIVKRSRTAFSTFCLWGGLGIMLISTSLFPWFLTNNTIFGRIQFVWRLNAYISLLLLASFSLILGTVIRKNVLLKSVFLLALIAGLTIGNTTALATFTAAKAEKAPREGTLVKNVKNIFYGDYTPEQVQSKKNLQQILQKQFFLNAQQINPVYHFTDNDFTVQVDNPTQSHARLTIPVFWYASQVVTVNQKPVHSKISKTGATLVTIPKGSSVISVSYQYPKSVVVFIVIACFGLAAIFMPLIFRNTGSAKVTKTD

SEQ ID NO: 880 - protein, 579 aa, Lactobacillus paracasei
MHEKNKLSWAHELAWLLGIVIMALIVLSPQLSYHALAVGDDWEFHWNRFYEAAMQLKTGKFNFFQSLYSFRQSGRIINAVYGSAFAYCHGFILIIAKTWFRAEIISSFLCLVTAGSGMYFLTRYCQVKRQMAFAAAVLYMGTPLVLFYVTDSALRGWGAALLPLTTIPLIRMVINHEKPISPVLFGLSAATLMAVQNFTVILYVISAAIFFIPGLYLAKNKWRTILDAVAAVGVAVALNASTLAAIYELHNEHLVMPYKVTDLLGSASRLSLGNMTRLDLGLILSAMILFQLVFAALNWKRLKIVEKLINLDGFLFLWLSSPLFPWNFLADHFNVLQTIQFPQRFNPVALTMMILGTTISVQKLNINAKTERTRLFSALFISVAGLNLVNGYTWVNEKATAWQGDQVAVSADSTIQNQAEIRDLFNHAYDQANIFGVITKNTPDYLPVPNVKNTLYAYDAYKQQILHNHVNVRKQVDADSRLDFTWQAKKRKSTLMPVIVYKHSTVFLNGKKLEPSQYKRSNIGALIVTPRLGENHLVVGYAPSKLFWAAAIINGISLLGIFGYGLLKLIQFLRSCVKQ

SEQ ID NO: 881 - protein, 693 aa, Lactobacillus paracasei
MGKKEKKLKNKVFWTTAAIASSLLFSQVVLGTPVSAAENDSANTGTSAQSSQDQTAPFHEMNQHSNAAGATTTEQAPAAPARRARSFSSNGTLATSGGAQANAQTFAANSLTMMSFTIGDKSVPRTDVVDVASYQYWLTQANFNTLRSLGVRGAVVKTSEGNFYQNPYAGKQIQYAKNAGMAISVYHYVHFSSQAAAINEANYFANTLDALNVDKQTNVVADVEDNDVVGDVGANLNAFWQTLNNRGYNNHVLYTGKYYSYSNAAIATVGKNRTWVADYPYTPSASSLWNQDFGAWQYSSLAYLPGASSPVDVSVDYTGLFTQANTVVPKPETPSYDPILSTKAVNYDTTIVNQDSRKDGIYADAPYHTSANTAISNFDGVAYNNQSVHVLAETVTSRGTYLQVRAQDGKVFWIDKNGTAQLFFDKIVSNKSVNYAATIQQQGRSDGIYTSGPYHTSALTSGGNSDAPRYNGQRVQVIAEAVTTRAGGTTYNQIRLANGQTFWIDKRGLQMADEAGFDKITLSKTVSYLAIVDQSHRADGLYQEGPYHTSSATAIGNSNTKSLNGQLVQVIAEATTSRSTKSTYVQIRLGNGTTYWTDKLALTSMSPLSPILSTSDVNYNAVVNQKTRVDGLYADGPYHTSITTLVGNDSAKQYDGQNVHATIEQKTDRATYVKVQFPDGHIYWIDKGALTIR

SEQ ID NO: 882 - protein, 406 aa, Lactobacillus paracasei
LGIWNYIYRPVPVSDYKVLLEGAQDIVNGTFGKHAAQPSDYFRYYNFQIGYAYYLSLLMRVFGYRLLYFKIVEMIVITLTVLILFKTLRLYVDVHTATFGAGLFAIFPYIFIGAGIINNQHEGLLLEAAAIYFILKRQSWQNLLLAAACITLAQTLRPTAVVVAMAIAATLLIQAVYHRSHQRLLGTIAFVAAFWGLGWIINGLFIISGVAPYGIKGGNPYYKFLIGLTGKGVSGKYTTSARKSQLYYDLKAYHFDYGLYKQAAADKLRRVFVHGVNLQDVMDRFTSFLGNVDNQYNLGGDQAFLERHSLLISSLNFSGIIIYAGTVLGTFKRVVTEKVLIDRVAYLLPALIYGMFFFAYIVMETQTRYRFEQYYALFLLATPVIYRWLKIIQRKMFTDNLTDPLS

SEQ ID NO: 883 - protein, 466 aa, Lactobacillus paracasei
MKQSAEWNGFKRLLTMIGDVGLFNLSILLAFYWRFGVDIPEWNFKMYEGSAIYISLLFLLVNFFLGVYVYYNRRISDIIFNTVLAQLITILGLTMITFMGRFFAFPRLVLGYSFLLSILILGVWRVFIYYMYIRFTSNYKVAVLSYEHELPAVLENFNSAKNNKHKVTYVISDHFVENAKAIIDKVDIFYLTKSLPDETRREIIDIIIKREKTILLPSTFDNLLMLRPNLMNFEDESVMGITQFRIKFESAVLKRIFDIVVGLLMLILASPFMLVTALLVKLTSPGPIIYKQTRITLNQREFKILKFRTMSATAEAKSGPVLATAHDSRITPVGKYLRKFRLDELPQIFNVLKGDMSIVGPRPERPYFVNQFNEQEPHYYLRHNVRAGITGYAQVYGKYASDYHSKLKFDLLYIKTYSIFLDARILLQTIKILFDKVSSQGLDEDPEPPRQKLHDIVVEQDITHLS

SEQ ID NO: 884 - protein, 246 aa, Lactobacillus paracasei
MIPKIIHYAWFGTKPPAFVEARVQEWREKLPDWEFKFWNDQNFDLSQYAFSEKMFQAGKLGYAADELRYAVLYQYGGFYLDTDMIVKKDLAPFLKQRMVWGFQYDNSILTSFIGAEAKEPLLAKILDVYAGRRFPELQNDMQNMTSNPVVTKILMKLYPEFRMNGKQQELASGILVYPRDYFTYASRNRSANYMEHLFDNSWGSANLGLRGRFKHIFKTFFPYLWADISARRGIKSAERDGIPDQR

SEQ ID NO: 885 - protein, 251 aa, Lactobacillus paracasei
LKSAPRVSVIVPAYNAAAYLPATIQSVRQQTFQDFEIWVVDDQSTDDTVAVVQKLMTQDARIKLVQLSANQGVANARNVGVAHAQGQYIAFLDSDDMWLPKKLEVQISFMQEHQADFSYCNYDVVDDHGTQVGQRKVSQTQLTYQEMLKGNRIGLLTVMLTRKTALQYPFPQINHEDYACWLSIARSGIVAYLASDLILAKYRKHQTSLSSNKLQAAQWTWTIYRQHEHLGFFKSLYYFIHYSLMGITDKR

SEQ ID NO: 886 - protein, 311 aa, Lactobacillus paracasei
LSNYLVTGGAGFIGSNLTELLLTDPKNTVTIVDDLSMGLRENIPDSDRVTFYEHSITDHDFMSRLLIDGKFDYIVLLAAIASVADSVERPYATHLVNQEANLSMLETLRTHQITFKKLYFSSSAAVYGDSPALPKAETMAVKPLTQYAVDKFATEREVLNYGRLYNMPVVCTRFFNVYGPKQNPKSPYSGVLSIMMDALKADKPFTFFGDGEQTRDFIYVGDVVRAIRGLLETPSARDDVFNVANGQQTSLNQVAKELEKLTGKTLHATYQEPRLGDIRDSYAQVDKLDQFDFMPHTPLAEGLAKYVASLQ

SEQ ID NO: 887 - protein, 220 aa, Lactobacillus paracasei
MHSFIDAYSWINLRYLLQGLGVTLEVSIVSIFFSFILGVILGLARYVKIKYFSAIVGFVIDLIRNLPLLLILFFTYFALPDIGIRLNVVAAAIIAMSIFESAMLAEIVRSGINAVPRGQMEAARSNGLTFYQAMRYIIMPQALKKMIPPIVSQFISLVKDTSLATIILLPEATYHAQIIYGQNINYMIPMFVALAVMYFVVNYALSLASRWLDRRLVQSN

SEQ ID NO: 888 - protein, 214 aa, Lactobacillus paracasei
MWSILTNNWGTFMSGVGYTLASSILALIGSLIVGTLFALLEISPFKSLRVIGRIYVEIVRNIPLLVITLAFYVIVPQFIVKIDGFTAGTIGLLIYTSAFIAETVRAGIEAVPGGQMEGARSIGMTYNQAMIQIIFPQAFKMVIPPLGNQFINLVKNSSVLAFVAGFDLMYQGKLIAATTFSTFDTYLIVGVFYLVLTMPLSYLMRYLEKKWVTA

SEQ ID NO: 889 - protein, 274 aa, Lactobacillus paracasei
MAKLWKRMLLPLLLVLLMMPLSSCGKSVADRDILTTAKTTNTIVWGVKADTRLFGLMDIKTGKIEGFDVDMAKAITKQILGSKGKAQLVQVTSDTRVPMIKGGNVDAVIATMTITPERQKILDFSDVYFNAGQSILVKKGSPIKSVKDLKKGTKVIGVQGSNSVDNVKKAAPDTTVLQLSDYAQAFTALKSGQGDALTTDNGILYGMSEQDPNYIVTGGTFTKEPYGIAINKGQKPFVQAVNKAIKQLKQNGTYAKLIKKWFGDVPGFSLKEVE

SEQ ID NO: 890 - protein, 245 aa, Lactobacillus paracasei
MSMIEFHDVNKYFGKFHALKNINLTVDRGEVVTIIGPSGSGKSTLLRCINGLERITSGQLIVNDFDLADKKTDMNRIRKNVGMVFQHFNLYANKNVLQNVTLGPDLVLKRNKQEVEQEAHDLLKMVGLENKADSFPGELSGGQQQRVAIARSLAMKPKAILFDEPTSALDPEMIGDVLDVMQKIAEQGMTMVVVTHEMGFARHVGNRIVFMDDGQILVDSANVDQFFDDPQEPRAKEFLSKIINH

SEQ ID NO: 891 - protein, 326 aa, Lactobacillus paracasei
MLTVIDIINRVLGYFNVADKPKGKAFTWVALIANFYLLYVAIQNLRYPDFRIRGALFMLAFVVFLYFIGLNFLYYFTNKTTKFDISPKVEKWLGSNAAKKTAVENELRTQLGAAPAQGVFSQDQLLTADVTMTEEQQANLDTLVDSLVKQGVLSLNYQGLDDKAVGRVAQETQQPVLAIGAPFPLPFFDLQHLDSKLVITGGLNALMAKPLATVDRVGLLPVEAAQRDYHLVVANVFLIGGEQKLLGRSGLRKEAQPYSLTVQLAYQDKATTGDRQHEAEPLDSRHTTRESQRETAKMTNEPAPSTSQAASKPLPTRESRRHRHDE

SEQ ID NO: 892 - protein, 146 aa, Lactobacillus paracasei
MAYRTPPLLPPTAIVSLIVLISAYNIVNTINPVNQPKSATEQSELVSKIKSESASRAGQSASSHVAPSQASASRQPEASQSQAETSNQDQNDDNSTVSSAASTQEPSSSDTTSTPSASASTSSTTPSQQNNNQNGQETDTTGSGGQ

SEQ ID NO: 893 - protein, 148 aa, Lactobacillus paracasei
MDNTTIALEELKQHGYRVTKQRESMVDYLGRNQHRYTAVTILDRYMRTQFPGVSHDTIYRNVKSFIEMGIVESRMQDDQIVVKLQCDFQHPHHHHFICTNCGKVIELKMCPLNYFEKQVPGAKIQSHNFELYGLCAECQQHADRLKNA

SEQ ID NO: 894 - protein, 37 aa, Lactobacillus paracasei
MAEKTDYASAARRLKSKNPKTRSRAKRVIKAVKKPVK

SEQ ID NO: 895 - protein, 200 aa, Lactobacillus paracasei
MKAAHKLIVITGATGTGKTTVSGYLRDNYRIHRVMTHTTRPARTGEKNGVDYYFETPASFATKHFIEKVTYAGYEYGSSHESLEKNWTKHPFLSIVLDTKGAITYVRELPKEVVVLFLTIDNPTVLKDRLLGRGDDPAMVAARLKSPEYKRDLTLPDELKPFATVIKNDSWDEAREQVDQFMKTLALKSCGLARIDLEQK

SEQ ID NO: 896 - protein, 151 aa, Lactobacillus paracasei
GNATFAMILYPRTEINMVTITDQKPTMPEVLALYKSVGWSMYTRDPARLERALTHSLMVLGAYEGKQLVGLIRAVGDGETILFIQDLLVLPEYQRRGIGKQLIEALLARFPEVRQRVLLTDDDPKTRSFYKAAGFVESQQMGVIAFYHDQH

SEQ ID NO: 897 - protein, 400 aa, Lactobacillus paracasei
MKLKQLVTGFITVATLAGVGVSGVAPTTVKADDDKSSLTAKNDALLKQIQTANEKTAKLSNDVSNKALDIKNAEEKISASQAKIASYNQQIVKAQVEVGKRKDNLKEQLISLQKQVGNSVTGNVYFDFVLNSNSLTDLVGRSLTVNKLSQASAEALQAVKDSQAKVKALQTEQEAKQETLVATKSQLESDKAKIESLKSDAEKSASDLQQTLEANKDKLAQLAASEDAAKAAAATAAVAATPSASSTSTASSSAASSSANTSTTSASSSASASQAPASNTSSVSVSGGSIASNAAKYIGVPYVYGGTSPSGFDCSGLIYYAAKEAGISLPRTSQAQSTLGSYVSVSDLKAGDLVFWGGVGSAYHVGIYIGGGQYLHAPAPGQNVTIQSMAYFAPSFGRRL

SEQ ID NO: 898 - protein, 424 aa, Lactobacillus paracasei
MTDRGKILDELKWRGALNQLTDEDGLRKLTEEKAVSVYCGTDPTGDSLHVGHLIPFMILKRFQLLGHRPVIVIGGGTGSIGDPSGRNSERVLQTMDTIAANKKKLTAQMENLFGTDDFRIVDNYDWLSKLSMLDFLRDYGKLFSVNSMLNKEVVASRLENGISYTEFTYQILQSVDFLHLFKHEDVQLQIGGADQWGNITAGIDLIHRIEGPEARAYGLTNPLMLKADGTKFGKSAGGAVWLDPEKTSPYEFYQFWFNQDDADVEKFLKFFTFLSRDAIAELVEATKTHPEKREAQRELARAVTKFVHGQKAVDQAENISAALFSGDVAELSADDIKQGFKQFPTVEAPETAENIVTWLVDTTKIEPSRRQAREDIQNGAITINGTRQRELDFEVDPSTHFDGQYVIVRRGKKRYFLVDIKAAK

SEQ ID NO: 899 - protein, 314 aa, Lactobacillus paracasei
MDAGRNILKDEQRRFARLKSAQHAAALNLIVYGGLTVAELWIAQLAHSRALAADGLNNLTGVASALILLWGLQISQQRPDSEHRFGHWRFQTIATLFSGLIMLVVGLDVVIDGYHGLQAWYQGKLQVPGELAVYVSLAAGLAMGTVSLINHIRAKQLDSSVLRAAAKDSFADAVTSGGTLLAILGAKAGWLWLDGGAAVAVGCLILYAAWTILRESIFELTDGFDTKKIAAYRQTISAVPGVKGVQSIEARYAGDAVLLTIGIRVNPNMTVADSYDLGERVERRLMDEYDILDADVKAYPADRDPKEAPQDPQK

SEQ ID NO: 900 - protein, 111 aa, Lactobacillus paracasei
MAAYSSAQQEALKEFKQDIGHLNALSNSSRQKLIMILGTADNDTGLKVNDLADAIGLSQPATSHHLKHLKDIGMVGSRREGNMVYYYLTLDDTIARLERLTSALKRQNENG

SEQ ID NO: 901 - protein, 309 aa, Lactobacillus paracasei
MTTTTTFHGLGADNTLTVYADGANELLNQSISMINAYAHLLSLYDEASLLTLINKQAGKEPVHIPVRPVFNLIAQAIAWSKRGLGYNALIGPIIKLWRIGFDDAHVPTAEEVTAALALTDPDLVELDSENQTVFLTKPGMALDLGGIAKGFIVDQVYDLWDKTGVEGGLIDLGGNQRLVGNAASGVPLWQWPITDPRTPRKRSIATLTTTPKAVVTTGIYERHSAINGKEYHHLLDPNTGYPVESDMASITVVADSGLIGDVLSSIGFYAGIPAGYDAVEAEGEEAIFVTKDTRVYQTSGLRETLAVTM

SEQ ID NO: 902 - protein, 592 aa, Lactobacillus paracasei
MFQFDSFTDRRPFGAVQKGTAVTLTAQADGAVTQATLVIMPDEHCDQTQSLPMTKSPNGYTVTFTPPNAGLWFYHFELQSDNGRERFGAVGGGFGGLGQLYPENVDVVNYQMTVVTAFDPVPAWYQNARFYHIFVDRFNNGNADGHVNAPKENSFLYGRKTDRPMYIRGNDGEIIRWDFYGGNLTGIQQKLPLLAARGINALYLSPIFQARSNHRYDTGDYFAIDEVLGSLHDFKQFLAAAHQLGMHVILDGVFNHVGADSRYFNAVNEYSDVGAANSLDSPYASWFSFKRFPDDYNSWWGVKDLPAINKDNQDFHDFIAAKKGSVISYWTDLGVDGWRLDVADELMDDFIQQIRSTLDQFPERVLIGEVWEDASNKQAYGKRRQYFEGGELNAVMNYPLRSMLIDLTNGQLNAAGFVRQLMTLKENYPTNAFAFNFNNIGSHDTPRILTMLDGDRRKLQFIVSLFYWLPGVPCLYYGDEAGLTGGKDPDNRAFYPWGHEDQAVLDIYQIALQTRIDQPALAAGAAFFPFTFEDSFGFVRQNDTQTLVVLANPTGSPQVLQDPHAELVPKSLRALLPVGTMVPAGGVIWQQI

SEQ ID NO: 903 - protein, 802 aa, Lactobacillus paracasei
MSLTKEQFITEFKDIALKLYAAPLDDLSTQQLYQALALLTRSYIGQPWAETKKRYDQEETKQVFYFSIEFLPGRLLQSNLLNLGILSEVEAGLNELGLRPQKIFDAEADPGLGNGGLGRLASAFMDAMASVGMAGNGNGIRYQYGLFKQAFVNGYQVELPDDWMRNGFAWETRKENRAVTVKFGGWVELRPSRSGNLRVIYHNTDDVLAVPYDVAMVGYHNQVVNNLRLWSAEAPINAGTDFTLEQKERINQITQILYPDDSDASGKQLRLRQEYFFTSAGIQSIVRHYRRTHNSMAGFADRVAIHINDTHPAMAIPELMRVLMDDEHVSWDEAWRITLKVMSYTNHTLLSEALEVWPIDMFSGMVPRIYQIIQEIDRRFRLVFVPQFGQAMIDRIAPLGNGQVRMAYLASIGSHAINGVAPIHSELLKKDVLHDLYQIFPERFNNKTNGITPRRWIQIGDRPLSHLLDKKIGTTWRKNPLALRQLHDFADDTRFLDDLNAAKAENKRALAKYIDQVVHVKVDPDAIFDVQIKRLHAYKRQLLHVLGILDAYLAIKRGEKRPKRLHIFGAKAAPSYVYAKEIIKVMNAVADLVNGDPDVSKYLQVVFLPNYGVTIAEKIIPAADISEQISTAGKEASGTSNMKLMSAGALTLATLDGANIEIKDAVGDDNVEIFGLTEEAIAGYYQRGDYHARDFYDQDPRLHAALDMLVNGQIPGIETEGRDIFNSLLTYNDEYFVLADFESYLAANERLDKLYQQPRIWAKKALANIAESGRFSADFTVQRYGREIWHVVAKTPEDDHEA

SEQ ID NO: 904 - protein, 481 aa, Lactobacillus paracasei
VLKVLFTAAESAPFYKTGGLGDVTYALPKAIKKQGVDIRVAIPFYEKKFPAKYLPKVKDLTHFTLEMDGRPVYVGLKTIKLGDVTYYLIDNRQYFDRDGLYGYWDDGGRFGYFQMAVIEMLQVIEWIPDVIHANDWHTAFIPVLLKEKYGWIKPYQQIKTQLTIHNLQFQGWFPPSTLATVFGIGREGFNDDGFGQDGSINWLKGGINYADLVSTVSPSYAKEIQTPAFGEHLDGTLRKQSGKLVGILNGIDSEVYNPATDQNLAYNYDAKNLAGKAKDKKALQDEMHLPKRTDPLFAMVSRLTRQKGADLLVDALENFLVQNNVQVVVLGTGDQDLEEDLSSLQDRFPGQLAVRIDFDEGLAQRIYAGADYFMMPSAFEPSGLAQMMAMRYGTLPIVHETGGLRDSVLAYNAETGAGDGFSFWDYNAGVFTNILRMAKSVYADQPKVYAKLQQHAMVKDFDWHHSAAEYLKGYQRILGKA

SEQ ID NO: 905 - protein, 389 aa, Lactobacillus paracasei
MRKGDLAAIIDLNEPDDQIQPLTAARPIGTLPFAGRYRLIDFPLSSLDHANVRSVAIFLPKSGRSVTDHIRSGSTWNMDQITGGIFTYPYMAGRDYEDPKLRARYFDDYLQFLRKSSAQYTIIMGTQNVANVDVDAIVAYHQAGESPVTAVYKNLPEEAMKPEDLTLDMTELGTASSVVPASENRGHLKEGKIPAFMDIYLIGTIDLIDLLTDASEAPTFKRLPQILREAVLENNANAFEYTGFLAKLNTTQRYFDANMSMLEDQNYQALLYSANSIETKNKNEIPTFYSTESKVTNSLLGTGDFIEGTVDNSILFRNVHIHRDAVVDHSIVMQGSKIGTGSSVKYAILDKGVVIGPNLALEGTPEEPLVFSKNQKVFQPDGQGVTARA

SEQ ID NO: 906 - protein, 380 aa, Lactobacillus paracasei
MSTEMLGMILAGGQGTRLGKLTKTTAKPSVPFGGRYRIIDFTLSNLANSGVNTAGVITQYQPLELNRHIQNGASWGLNERGAGVTILQPYASSEGEKFFEGTAHAIYQNIAYIDSYNPQYLLILSGDHIYKMDYQAMLDYHKAKKASLTVAVMPVEKEEAKRFGIMNTDDTDRIIEFEEKPAKPKSNLASMGIYIFNWPTLKQYLTESYATDGAMEDFGHDVIPAYLTHNEASYAYAFRGYWKDVGTIQSLWEANMEFLNPNNPLNIGNRNWRIFSQNEALPPMFLTKTAKVAGSMIVDGCYVAGSIQHSILSQNVKIGEGSVIKDSMIMPNAVIGKNVTVDHAIVGENAIIGDNGKVVGKPNEISVVGYGEVLGRTEKE

SEQ ID NO: 907 - protein, 699 aa, Lactobacillus paracasei
MIQGLKDWLYLFNSGQDFQSYNRFGAHEVEPGKWSFLVWAPHAQQVNVEGDFNNWQGSPLKLQGTTGCWYGELAAAKNQLYKYRIIGPDGIAHEKIDPYGFGFERKPGSAAKLVDVPRITWHDEDWLAKRAKWRPYDEPLNIYEVHLGSFIRDTNAGPDGGYMTYQDAIDKLIPYVQELGYTHIEFLPLMEHPLDASWGYQLMGYFAPTSRFGDPQDFLRLVDAAHTAGLGVIMDWVPGHFIKNTDMLAQFDGTPTFEYTDPHRAENVRWGTWNFDLGKAQVQSFLISSAMYWLDHCHLDGLRVDAVSNMLYMDYDAGKENDRNKDGGRDNLEGIAFIKQLNTKIFAKHPDVLMMAEESSAYPQVSAPIDTGGLGFNYKWNMGWMNDTLKFFEQDPVYRHSDMNLLTFSFMYMYNEQFVLPFSHDEVVHGKKSLMHKMPGDRYNQFANLRTMYVWQATFPGKQLLFMGSEWGQFLEWRDWSELEWTDLNDPMNKKMQHFTTTLNHLYKARPSLWQQDHEPDGIKITIADEPDVLSYIRYGKQKDDFTVVAMNLVPVQKDHFRVPVPSPGTYEIILNTEDAAFGGTWTKWQQTLTAEIGENHDVPAWLDVILPAMGALLIKPKQLKPLPKKPLALKGKQPTKALPKHETPLSLAGHQRQPISHQDDWGTSPARSQPRDISKVNHQQSKKLGGKAHNAPQS

SEQ ID NO: 908 - protein, 343 aa, Lactobacillus paracasei
MSVNIDWNNLGFDYMQLPYRYVAHWKDGAWDEGKLSTDPNLTMNEGSPILHYGQGAFEGMKAYRTKSGKIQLFRPDQNAHRLHNSADKLLMPPFPEDRFIDAVKQVVAANHEYVPPYGTGATLYLRPILIGVGPNIGVAPAKEYIFDVFAMPVGPYFKGGMVPTKFIVADQFDRAAHYGTGQSKVGGNYAASLQAGKFAHEHGYGDAIYLDPIEHKYIEEVGSANFFGISKDGKTLKTPKSPSILPSITKYSILALAHDRFGMTTEETKIAITDLDQFGEAGACGTAAVITPIASITYEDHEHVFYSETKVGPYTQKLYDELTGIQFGDVPAPEGWVVDVPFN

SEQ ID NO: 909 - protein, 296 aa, Lactobacillus paracasei
MLRRSLITFALVVSGLLITTAAGTTIQRQDLAGSRTSTREKVNTVSSSNDLLDATAAKAPASQAAAHPQWSVRTVSVTKPTSAASSSQTAASTSVASSAPASQQAVATSDSSDSNTGASTSTAEVTVSAAPSAAQTATAAQPAQQQPATQPAQQPAQPQAQQAPAYASRVLMFAGVTVPYIIGNESMTAAPGTGAATWGGQANYSNNSGQNTHFIGHNPGSFAAMLSLGIGSPITVTDAAGNPRTYHVYQLATVNPNAVTASGQDLWNAITGTGGGQRITLQTCVGNYWRLIAFAR

SEQ ID NO: 910 - protein, 284 aa, Lactobacillus paracasei
MINRKGGLMQKTMRHPIFKWFWIVAALELIAISINMFYAPHAVAAGGATGIAILVQEVAGIQVGITTMGVNLLMLLLAWFFLDRSTLKRILFGSFMLPLLLWLTPEINLVTDRLLAIIVGSVVFAFGVGFLYQMDASSGGTTVPPLIFKKYFGLKPSVMLLATDVIVSLFNIPVSGVEAFILAVFALAITGLVMNYVETGFDRKKAVYIMSPQLATIKQQVRDETPHGLTVQRVVGGFSDESKEMLMVVVEQANFRHLIDLVHAIDPNAFILTMAATEVHGGSI

SEQ ID NO: 911 - protein, 643 aa, Lactobacillus paracasei
MDLYSELTAKYQTVPAIATEIINLEAILNLPKPTEAFMSDIHGEYNAFQHVLRNGSGNVKSKIRSCFRDEMTEATLQRFAFLVYYPSERMAAIHREMAGDDLQQWYLTTFRRLIRLLAFTATKYTRSKVRKAMAPEFVYITEELLYNDADTPDKLAYYWQIIRNLIVLEQADQWIAATCQTIQRLTVDHFHVVGDIYDRGPAPDQVVESLIRRDRRHSVDIQWGNHDILWIGGAAGSALCIANLVRISARYNNLSILEDVYGINLRHLARLAEQYYQDNPAFSPKMERSDRPITEAERLQITQIHQAIAMIQFKLEGPVIKRRPEFDMDHRLVLEKLAPDFSTIKLNGDTYTIENGCFATVDPADPYKLLPEEQEVIDSLVESFTHSEKLHRHMDFLLDHGSMYLRYNRNLLLHGCVPVDEDGNFIGLTIKGTTYTGRQLFDMLEANLRLAYSQPTENADLATDLMWYLWTGPNSPLFGKHDMTTFERYFISDPKAHVEGRNPYYHLRKDPEFIKKILAEFVLDPEVGHVINGHTPVKKGTDPIMANNKMIVIDGGFSKPYQKTTGIGGYTLLDNSYGMQLVTHQPFTTKADAIANLTDIISTRRVVETEARRRTVAETDIGTELQDEVEVLKRRLGELREED

SEQ ID NO: 912 - protein, 133 aa, Lactobacillus paracasei
MIKLYTSGSSKSSREARAWLEANGLPFQEISLSKQGISKPQILELLARSEDGIDSLVSRRSKAFQALDIDFDALSLKEAVALLSEHPAILRRPIIVDDRRLLFGFNQDSVRVFLPREVRRQKLWAALLSTSSV

SEQ ID NO: 913 - protein, 716 aa, Lactobacillus paracasei
MANFNDPFFNHDMDDVFNQMLQGMGKGESARYVVNGHEMTPDEFAQYRATGQLPKQGDEIPVETTGEQAVKKGGILEKLGRNLTQEAKDGLLDPVIGREHEIQETAEILSRRTKNNPILVGDAGVGKTAVVEGLAQAIVKGNVPESIKDKQIWSIDLSNLEAGTQYRGSFEEKIQNLIKEVKAAGNVILFFDEIHQILGAGATGGEESGGKGLADIIKPALSRGEITVIGATTQDEYRNTIMKDSALARRFNDVTINEPTAADTVKILEGIKKLYEQHHHVQLPENVLKAAVDYSIQYIPQRSLPDKAIDLIDMTAAHLASKHPIVDKVELEKQIKDLNAQKDAAAKAEDFEKAANLKKTIADKQHQLDGTKDEKPVVATPNDVAAAVERLTGVPVSKLGASDIERLKGIGKRLKGKVIGQDEAVEMVARAIRRNRAGFDEGNRPIGSFLFVGPTGVGKTELAKQLALDLFGSKDAIIRLDMSEYSDRTAVSKLIGTSAGYVGYNDNNNTLTEQVRRNPYSIVLLDEIEKADPQVLTLLLQVLDDGRLTDGQGNVVDFKNTVIIATSNAGFGNETLTGKKEQDEDLMKRLAPYFRPEFLNRFNGIVEFSHLTKKDLGKIVDLMLDDVNATLTKKGITLTVTAAAKDWLIEQGYDEAMGARPLRRVIERNIRDKVTDFYLDHLKAKKLQADLVDDAIVISEKQPTAVKSKKVTDGAK

SEQ ID NO: 914 - protein, 280 aa, Lactobacillus paracasei
MKILITGAQGQLGTELRHLLDSRDIAYRGTDAHDLDITDEKAVDQYFKDYQPDLIYHCAAYTAVDKAEDEGKALNQKVNVDGTRILAKAAAAIDATLVYISTDYVFDGDKKDIYTVDDQPAPRNEYGRAKYEGEQQVQKYLKKYYIIRTSWVFGEYGHNFVYTMLDLAKTHKELTVVDDQYGRPSWTKNLAEFMTFAVDQKLAYGIYHLSNDNSCNWYEFASAILANKDVTVKPVSSAEYPQKAWRPRHSILDLSKTKATGFKIETWQDALKEFLQVIEK

SEQ ID NO: 915 - protein, 341 aa, Lactobacillus paracasei
MKLMITGGAGFIGSNFVHFVYRHHPEVQMIVLDKLTYAGNKANIADLLGDRVQLVVGDIADKAVVDKWMAKVDTVVNFAAESHNDNSLINPDPFLHSNVIGTYTLLEAARKYDVRFHHISTDEVYGDLPLREDLPGHGEGPGEKFTVNSRYNPSSPYSSTKAASDMLVHAWARSFGVRATISNCSNNYGPYQHIEKFIPRQITNILSGIKPKLYGTGKNVRDWIHTNDHSSAIWDILTKGKIGETYLIGANGEKDNKTVLELILKLMGKPTDYYDQVKDRPGHDMRYAIDASKTREELGWKPQYTDFEEGLADTIKWYTEHRDWWQDEKAAVEEKYQEHGQ

SEQ ID NO: 916 - protein, 190 aa, Lactobacillus paracasei
LSLKVIPTKLQDVKLVETDVFGDNRGFFTETYTRDKFLAAGITNDFNQDNQSLSAEAGVLRGMHYQMAPDAQTKLVRVVTGVVEDVLVDIRKGSPTYGQWEGYILSEFNHRQLFVPKGFAHGFITLTPNVNFCYKVEGFYAPQSDRGIAFDDPDIGIQWPMSTDHLIMSDKDKKHPQLKDAENNFVYGEI

SEQ ID NO: 917 - protein, 290 aa, Lactobacillus paracasei
MKGIILAGGSGTRLYPITEAISKQLVPVYDKPMIYYPLSTMMLAGIRDILVISTPRDIDRFQDLLKDGSQLGLNITYKVQDKPNGLAEAFIVGADFIGEDSVCLILGDNIFYGSGLSKLVQRSAAKTSGATVFGYQVNDPERFGVVSFDDEHHVKSIVEKPEHPASNFAVTGMYFYDNQVVDIAKNMKPSPRGELEITDVNKAYLERGQLDVELLGRGYAWLDTGTHESLHEAAGFIETVQKRQNLKIACLEEVAYRMGYIDRDQLRELAQPLKKNDYGQYILRLADEKA

SEQ ID NO: 918 - protein, 254 aa, Lactobacillus paracasei
MIDVHCHMLPGIDDGSKDLMTSLDLAQAAVADGITHALMTPHHMNGRYTNHAADVILMTDEFQGELDRNNIPLTIYPCQEVRINGQLLDAIDHGDILTCDASGHYVLIEFPSDDVPLYTQNMLFEVMQRGMIPVIVHPERNTRLMKHPGLLYQMIERGAFAQVTASSYVGTFGKKVQQFSEDIIDAGLAHVFASDAHHLPGRSYEMSDAFKRLTRKRGEKKAHIFEENARALVNGDPLVRFNEHKVEKRLLSRY

SEQ ID NO: 919 - protein, 298 aa, Lactobacillus paracasei
MKKILVRVLLVLLVAALGFGGFVYYMVHNSTSQIYSYNKKTNKSSDDKTTSKKPVSYLLLGTDTGALGRSYKGRTDTMIVVVINPKSKTTTMVSVPRDTKVDFDDVTIKINAAYSYGSSDTAMSAVEKLLNIKLDGYLLVNMKGLEQLVDAVGGVTVTSPLSFNYEGKSFVKGQSYDLSGSDALKFSRMRYDDPQGDYGRQMRQQQIITAVIGKLKSNPTTVISQKFLDAVGKNVRTDVSLGSVKNLATDYRDAGNTIKSDQLHGTGQNIDGQAFEVMSDSEITRVHNVIQNALDSNK

SEQ ID NO: 920 - protein, 296 aa, Lactobacillus paracasei
MYRITLLSPFFGEKFPPTFPILLNSLKDNPTIKFVIPTDIDFSTIDNISNVQFVKTSLPALKHKIDLMLGYHAHIISPYKLVDFKPTYGILFNEYIKDSEWWGYFDMDLVFGNISRFLTEDLLDSYDRIFTHGHLTLYRNNELVNNLWNYKYHLHEVPNFQTVATHKAIFAFDEWGWGKNKGRGISYALHQVPLVRQFDDISFFADLTPNLFSFRTTNGTNITKFEYYQGSLAGIDQLQNKHPYLYVHFQKRTMTNDVTDYTKPIYIVPNMFLNKIPVSIDLMKERSVCVKGGFEM

SEQ ID NO: 921 - protein, 431 aa, Lactobacillus paracasei
MTEQLSNEPQSENVLITGISRQQPDFDYTMTELGELAKADNYTVVGEVRQSLDRAAAATYFGSGKVDEIRELADVKNATTIIINDELSPSQLRNLEKQTKLHVIDRTQLILDIFADRARSKAAKTQVEIAQLQYALPRLHPSANRLDQQVGGGAGFATRGSGETQLELDRRVLNKRISHLRRELKDASVGDQVRRARREGNDIPVVALVGYTNAGKSTTMNGLLNLFADRPEDKQVFEKDMLFATLDTSVRQLTLPDNRKFLLSDTVGFVSKLPHNLIDSFKATLAEAANADLLIQVVDYSDENYPEMMAITEKTLKEVGIENIPMIEAYNKADLREGTRYPEVTGQRIVYSARDKNSLEALTRLIKADIFGQDEEHTYLIPFDQGQLVSYLNQETVVKATDYREDGTLITAVVNPVQKGKLARFAVKEEV

SEQ ID NO: 922 - protein, 293 aa, Lactobacillus paracasei
MLSYTIIYNPASGHSKGPTAAEQLKTKLEDRQHQVTMAPTKSADDAREFAYHAQADIVVAVGGDGTINQVVAGLAPRKNPPLLAILPEGTVNNLAKVLHIPLLLPLAIKNILEAAPQPLDVAQVNNHYMVSTLTLGVLANAALSVTQKKKQHFGPIIYLMKGFKVLAQHQHWILQLDSADGKWQKDTQFLLITMTNSVGGFTNAVPDAAPDDGRLHVFLAPKLTLWRSLLAIPYFITGNFQKLPGMTYFATKELTIKTPKTLQSRIDGDPSTKTPLTLKVISDHIQVLAPNVG

SEQ ID NO: 923 - protein, 551 aa, Lactobacillus paracasei
MNELDKPQKQYIPWVVVGLMDFVTVIGFDDIIYNFQNQGLVAFTSWIIMTFFYVIPYNLIVAHMGSTFSEHGGGITSWMRETNGDTVGYYAAWFYWITGLPYVVDVANSVVISFGWIANGNGNIQANLGNAWFGILTAVIFVIFIWLQHFFKNKSLEIMSTIGGGAMFIMTVLFVVMTFVGLSKGAPIATRPFDFKAFIPKDFFSLSFLSTFGLFVFAMNGSELAAPYTKDMRHPARDFPKALKMIAIMTMFLTLFGTFSLGVYFNAHHLPNDLKMNGSYYAFQAIGRQFGLGNSLMYLFAVVQGIYMLAQLAVILDASTRVFLSDVAKRFMPRQLTKMNEDGLPINGYWMTTILCALIMALGALLPKINDIFNWLLNLNGIVSPLSTCFLFWSYTMVRLHQDRFPTPAYTYLKNRKVGLLVGIWMLGITFLLGTLGFFPTDATAETFALMLVLNIVVPIGMVALGVLMPWIAQRQRKARNGLAFGRTTWLGFTVIILLGLVSAATYGMHVNLLNHLNPILQWSIIFVVDLVIIGVVAKVTANGRRQISTD

SEQ ID NO: 924 - protein, 252 aa, Lactobacillus paracasei
MDKQPVVTVDNVTKTYGKKGEKQTPALKGVSFEVQPGEFVGIMGASGSGKTTLLNILSTLDTPTSGSVLIKGADVTKLKGDALSDFRAKKIGFIFQDFNLLENLTGRENIALPLALQNVSAKKQAAAVDSIAQTLGINEVLDHYPTELSGGQKQRVAAARALVQKPDILFGDEPTGALDSKSARELLDTMEQLNKEQDVSILLVTHDPFSASYASRILFIKDGQIGSELVHGDKSQEAFYQEILDTLGTFQK

SEQ ID NO: 925 - protein, 602 aa, Lactobacillus paracasei
MLTKLALGGLKNRFRDYAVLFSGLVIASAVFYMFMSLATNTSFLKKNSPIGFTPFIFGFGAVLLAIITLVYIVYANSFLLSMRQRDYAMFMMLGAKGRKIAQLIFLETVAIGLLATVAGILVGMVGTTFVGQWLINTLHAPATGFSAFWLPAVLWTLGFFIVLFILSAFYNAGKLLKTPMLRLLHQAQTPNRIKQRKGIFVLQIILGLILLAVGYYSMYAIAKIGIMAIPLALVTIVLGTYFLFNSVFVALIGLLKRNHKFAAKQLHTFTLSQLSFRIRDYTRILSVVAMLFALALGAITVGLGFTHDIPDLASQATAYDLTVASPNAATRAQISRLQDVTAKQDYTIKSDAKTVYISQQALDAHPLEIKANDGGLDTPNIKVTSRNFAEMTERYPSSFGIFIGNNRGKQMKVADAATFAKLGNAETLTTFKVKDFGQNYDTIQKIVELQSKQYPRLWSSNGDQKFMIYALVNSMFSGLAFMGFFLGIAFLGMLASTLMFKILSGANYDKSRYLMLQKIGARPRALRRSIRQEIGALFLLPGFVGIIHVLFGLQLFKTMLRAPYGHLALPFGLFIVLYALYYLATVWMYQSIVINKNLAEKA

SEQ ID NO: 926 - protein, 219 aa, Lactobacillus paracasei
MKGITVYLVRHGQTWFNHFNKMQGWCDSPLTDNGIKDGTKTGVILRNVAFTHAYCSDTMRATRTADLILSKNVTGKIPLTVTQYFREQFYGYFEGEDSSKTWYEVGFPHGAKTYPEILEKYGVDASKDFMHDADPFHEAEDARTYWTRLMKGFRQLRAENHEGDKVLMVSHGTTIRSIVDKFGKNDGYVVTDSPRNGSISKILLTDEGIKVLSYNEFEA

SEQ ID NO: 927 - protein, 321 aa, Lactobacillus paracasei
MAKGLLIVNLGSPVSPETKDVRRYLREFLSDQNVITMPKALWQPILRGFILPFRSWRSATFYKHEWTQAGSPLIAYTQVTRDRLRERLPDWDVQMAMNYGGEYPIGETLQTMAARGDAPIVVIPLFPEYTQSTTKTILDKVAASGVKTVVIDRFYDHSDYQKILAQQIDDAYEAGAYDTVILSYHGIPTAMVRHGDPYQQECETTTAGVKQYLKKVPQTKVEMCYQSKFGPVPWLKPYLRNRLMELAALGKRNVLVATPSFVADCLETLEENNVQNYQTFRANGGKNFATVRPMNGCEPFCDFLAKLAEDKIAAEANHGKA

SEQ ID NO: 928 - protein, 450 aa, Lactobacillus paracasei
MARPDERLTVQREKRSLDDINRSVQVPSVYESSFFQKFLAYSGPGALVAVGYMDPGNWLTALEGGSRYHYALLSVLLMSILVAMFMQTLAIKLGVVARLDLAQAIAAFIPHWSRICLWLINEAAMMATDMTGVVGTAIALKLLFGLPLMWGMLLTIADVLVVLVFLRFGIRRIELIVLVSILTVGIIFGIEVARADPSIGGIAGGFVPHTDILTNHGMLLLSLGIMGATIMPHNIYLHSSLAQSRKYDEHIPAQVTEALRFGKWDSNVHLVAAFLINALLLILGAALFYGVGGHVTAFQGVYNGLKNPMIVGGLASPLMSTLFAFALLITGLISSIASTLAGQIVMEGYLNIRMPLWERRLLTRLVTLIPIMVIGFMIGFSEHNFEQVIVYAQVSLSIALPFTLFPLVALTNRRDLMGIHVNSQLVRWVGYFLTGVITVLNIQLAISVFV

SEQ ID NO: 929 - protein, 153 aa, Lactobacillus paracasei
MAYTVDFKTVSTIGLESSPVAAALAGLRANEARYIWNKYKEPYITYPAAEKPDSLAWVNEILAERDLQISAKPLEVSDLNLPDLHWVEVYYQDGLAINVMYSLSDPKKRAVGFKLSDGMAVPTELEGKFKFARQKSKLAGTIRGSFFVIKGSY

SEQ ID NO: 930 - protein, 301 aa, Lactobacillus paracasei
MKQGTTILTLDNGYHLWTNTQGEGDIHLLCLHGGPGGTHEYWENFGEELADLGVQVHMYDQLGSFYSDQPDYTDPEIAKKYLTTDYFLGEVEEVRQKLGLDHFYLIGQSWGGALTQLYALKYGQHLKGAIISSMVDNINEYVDHINLVREEALPPSAVKYMKKIEKAGNWDDPQYQKYVDVLNRGYVDRKQPPAISHLISTMATPVYNAFQGDNEFVVTGKLKNWDISDQIHNIKVPTLLTFGEHETMPLKSAQRMAEVIPHARLVTTPDGGHHHMIDNAPVYFKHLKQFISDVENGTFND

SEQ ID NO: 931 - protein, 609 aa, Lactobacillus paracasei
MESISLLIVLTAAFLTPLLMAHFHINSIPTAVAEILVGIVLGKSVLGWVRTGGEMGSLSELGVTILIFLSGMEIDFSLFKPQPKTTDGPKQPNPVMLAITGFLTIIVLSLGFSYFLQLIHFFNYPIFATILFTTIALGVVIAALKEKELLHQPIGQTILLIAALGEVVPLVSLTVYSALAGKSDRNLWLLLLLLLAALFLLSRFKRIYGFLATIDKSTTQLDIRLAFFLVFALVTVASRVGAESILGAFLAGMVMKLLGPRQETQDKLTSLGYGFFIPIFFIVTGANLDLKALVADPKSLSLIPLVLIGFFIAKIGLIPVLRRRFKPQNALAGGFLLTTTITLVIPTLTVGRNLDILSDQQSGAFTLAAVIACVAGPILFSTFFQPEPEHFKKTKVTFIGGNLLTVPIAQHLSPDRYEVKLLTDKPENYHTYNSEINIALADYTESALKAAGAYDCDIMVLGDFDADTNYDLATMALAEKVPRIIARFAPKDATSDRYDRLRAQGVEVFNALEANVALLRSLIETPSTLQILDDTVAGIYEITVRNSRFAGLELKNLPFIDDITVSQIYRNKKFVAPHGDTQIHLGDHLIFSGDKHVIRDIREQVEKLN

SEQ ID NO: 932 - protein, 64 aa, Lactobacillus paracasei
MSQNNKSKKQGQGFFNRRSVIVGTCVLLGLLISLPFKQILLGVAIGLAVGYVLEAWTPLLRGKL

SEQ ID NO: 933 - protein, 763 aa, Lactobacillus paracasei
VAENEQAKEQTHLTGIMKELSGAESRLSKEMAKTKSEEKNISDNFFNDFSLNFTDYAETIETAASIQQQQRVLDERTNAWKQSAQQLATVKRLMGNPYFARIDFQEGREKPETIYIGLGSFTNEAGKFLIYDWRAPISSIYYDGGLGKVTYQTPDGPQQVTVSLKRQFVIKNGKIQTMFDTTETIGDQMLLEVLGEKSDTQMKTIVTTIQREQNQIIRDTKADLLFVQGAAGSGKTSAVLQRVAYLLYRYRGNLSSSQVIMFSPNQLFSDYISNVLPELGEQNMVQFTYYQYVTRRLPHIDVQNLFSQFEQQLTPVQKKIARVKGSLDFFETAKKYATSLEKSGLRFRDIRFRGEVFFSRRRIHEIFYSYNENYHMGNRLTATKERLIKMLNRKIESEMKSQWVQEAVENLSGEEIRSMQQDGPKEFKNSDDEYRFFARQLVMRGFNEIQQDIVRNRFLNIRGQYVSFLREVPAIYDLEAEGISADDWQAEVDHFITLFKERQLPMADATPYLHLYDLITGRHGEREMRYVFIDEIQDYTPYQLAYLKDSFPRAKFTLLGDLNQAIFTKDDSRTLINETSKLFDPEKTRVVQLTQSYRSTKQVTDFTKAILTSGQKIVAFNRQGPLPKLVVRPDEAGLMAALQDQLKINNEAKQTTAVIAKTLEAAEAIYEQMKAAGIKVTLIKSENQRLAAGVIVVPSFLAKGLEFDAVVLWQINAANYHEEDERELLYTVASRAMHRLTMLASPDVTPLLDKVPADLYERG

SEQ ID NO: 934 - protein, 158 aa, Lactobacillus paracasei
MVKMHDTLAVSSYRVFPGMLNAHQTLFGGQIFTWIDDVSSIAAQRLGRRGLATGSLDMVHLAAPVKMGDALVIRCMVSGVGHRSLEVFIQLIGEHLATGERFQVGTAFATFVARHKEDGPLPPVEAESEFEKRLLAGYDERRADYRKINASFGEVPLD

SEQ ID NO: 935 - protein, 469 aa, Lactobacillus paracasei
LAKRYVGSCTTVLVGKKASIDGSTIIARNEDGESPLHPQKFVYVKPEDQPRHYQSVLSKFAIDLPADPLGYTATPEAEDGHGIWAAAGINSENIAMTSTETITTNSRVLGVDPLVAAGIGEEDMPTIVLPYIHSARDGVQRLGSLLEQYGTYESNGIAFADKDEVWYFESIGGHHWAAIRIPDDAYVVAPNRFNITDFDFASDDTMSSADLRDLIETYHLNPDAEGYNLRHIFGSATIKDTRYNNPRAWYGQKYFNPEFDTTPIDQDLPFICRTSKKISIEDVKFVESSHYENTPYDVYGTTGTPAQKKLYRPIGINRNQELHILQIRNNVPAAVAGIHWLAFGPNTFNAVVPFYANVNDTPAAYRETGDKFDVTKMYWLSNLLATFGDYDFSLFKDQEDVFEQKTVAACRHLQLTTDEAVKDAKDIADHLTAANEQMATIAMANSNELLGQMVAAAAPKMKLQFTLHD

SEQ ID NO: 936 - protein, 96 aa, Lactobacillus paracasei
MLNQIGKFILSILLALFLVPTFRRSPSAFWYWAWYVLLVIFCVSGTGFGIWLLVLARFRTTAGIIVFVGILLIVLMPLFLIRATTQFNRYRHRSQK

SEQ ID NO: 937 - protein, 120 aa, Lactobacillus paracasei
MLELVGEFLLSFFIEPILDGVIAPLLAPTFKQESSLRTNSLRLGITLILNTVIAGGGGWLLFESATTSPVSGAAIIVGLSIFSLGFVLIVRAIIKYGAYIRELRHIRTAKRDAEKPYQEL

SEQ ID NO: 938 - protein, 308 aa, Lactobacillus paracasei
MQSEMNYYKFDRAEWSQFHSQNFTNVTDEELAQLRSLNDEISLDDVKMIYSPLRHLIHIRYEDYQGDMFTLSRFLGMQRNPHTPFIIGIAGSVAVGKSTTARLLQLLLSRAYPEKRVQQMTTDGFLYPNAELERRGILDRKGFPESYDMELLIHFMNNVKNASGALRAPKYSHQIYDIVPGEYELIDRPDILIVEGINVLQLPSKQPIYVSDYFDFSIYVDANPDLIEQWYLERFGILLDTAFTDPNNYYYQYAIGDRADAFAMARQVWRDVNLKNLNEYILPTKNRADIILHKTTGHEIDQVSLRKW

SEQ ID NO: 939 - protein, 517 aa, Lactobacillus paracasei
VANDQNKDYDKIIVLDYGSQYNQLITRRIREFGIYSELKPHTITAAEVKKIAPKGIIFSGGPNSVYDEGALGVDEDLFKLGIPILGVCYGMQLMAQRLGGDVEPADNREYGKADIEVTDDSAKLFRDLPKDQTVWMSHGDLVTRVPEGFRRTATSINCPISAMDDDDRKFYGIQFHAEVQNTQYGHEILHHFAFDICKAEANWSMDDFITKQIDKIRAEVGDKRVLLGLSGGVDSSVVGVLLHKAIGTQLTSIFVDHGLLRKGEADQVMESLKGKFGLNIIKVNAKDRFLGDLKGVTDPEKKRKIIGRDFIEVFNEEAAKLNGIDFLAQGTLYTDVVESGTDTAQTIKSHHNVGGLPEDLKFKLIEPLNKLFKDEVRELGEKLGMPHALVWRQPFPGPGLGIRVIGEVTEDKLEIVRDSDYILREEIAKHGLDKDIWQYFTVLPGFRSVGVMGDGRTYDYTIGIRAITSIDGMTADFARINWDVLQEISSRIVNEVKNVNRVVYDITSKPPATIEWE

SEQ ID NO: 940 - protein, 226 aa, Lactobacillus paracasei
MGAKRKKRYIVRVGDFEVPLIKTDRSYPQFDNAILDLGRQTAKMKEMLERPELVTHHQFLPVVLREKIFLKMHFDDKAKRLKLDKKIRPIVEVAHSDSVIFSLYAAMLNKYYEQRVADIGIKEVATAYRRGRGSNIEASKEVIDQVFLTKQCWIIKSDFVGFFDNLNHQLIKQRVLDLAGGYKCKLPADWYAVLHALTKYRDIHADAIPDEMLSYAKKHSKLSDEP

SEQ ID NO: 941 - protein, 389 aa, Lactobacillus paracasei
LPGQLLIQTLKRPQLTLQMLLDETGFSRAAFFRRISALRLYLRKAGVTISLNPLALMGPEARVRQVYRQLLWQFVDFAHPLFSEIFPQSRQLMRELDKAGLIQSDFSRAQLLFAANVHLHRLLANHSIVGTLDFDELAPRPTLTAALPSAFDNLPRKAAEDETWHLFLTQWRVPRFHSEQQFDAATLVGYHAARNTPAWQLVEKIRNEFSRTVVGIAPTVTTDLALAGNLLKILISERIFPGGAYIDLTRTASPMRAFYPRLEAALEAFFAREAPLENASKEIIDGFYQLLWPFMTDSAIADKLKVALDPLMPQPLYETVRLNLTQPAYIRLVTTEQQPDLVISAQNLAPGEEPIVPDTPVFYLASDRFESWSQLYQELFARSRKLIAH

SEQ ID NO: 942 - protein, 108 aa, Lactobacillus paracasei
MKRDKQADEAAVVDMNDTLMDYAHKRQPHVDDLAEELAKRAKDNINAIDDYLKDDGEARKEYQAIATGYLRDKYDLEGDDLTAARDELVHAAIHYLVGHTKVLDDWQR

SEQ ID NO: 943 - protein, 489 aa, Lactobacillus paracasei
MSLITWLILIILVLNTFGAIFTVLREVRDISTTWAWLLVLIFLPIVGFGFYLFAGRGLSTKKLQRIQHEYESGVKAFVSLQKHENARNKLLPPTDYTPAAKALTAFFLNTAQAPVLAHNQVQLYTDGEKKFAALFCDIEAAKDYIYVEYYTIYNDELGNQFQQLLIKKAKEGVVVKVLYDAWGSMGATAKWWRRLTDVGGQAESYFSSKHPITDFRLNYRDHRKIVVIDDHVGYIGGFNVGDQYVSRKPKFGYWRDTHLRIIGNTIYALKIRFTMDWNATVSKKDEIAYSVEQDSADSVTADSLTAGATPIQIVASGPDRPTQQIKLGYTKLITSATKSVWIQSPYLVPDDTVIDALVSAAMSGIDVRIMIPDMPDHPFIFRATQYYANYLTRAGVKIYHYEHGFMHAKTVVVDNAIASVGSANFDIRSFKLNFEINAFIYDRKVASSLGQIFEADMARSYLLTPELIAKQSSWLRFKQDFSRLLSPIL

SEQ ID NO: 944 - protein, 200 aa, Lactobacillus paracasei
VNQDLLNLLKQRRSIYALGKDVKQNPDDLVDLIETVIQETPTAFNSQTTRAVFLFGEQHDKLWDIVVKRLESEVPTEQAYEATKQKIASFKAAYGTIMYFTDTDVVKQLENDFPLYAANFATWAEQAQGSAQLNTWVTLANNGIGANLQHYNPIIDDLVREAFDIPTNWNLRAQMPFGSIEGSAKDKDYMDRKDQFKVLK

SEQ ID NO: 945 - protein, 132 aa, Lactobacillus paracasei
MLKLYTDGATKGNPGPAGIGILVSGLPHQIQKHAALPAMSNHEAEFAAAIAGFELLIQAGLNTTPVAFYSDSKLVIQAIEKQYAKHYPDLAGRLLTLIGQFPLVLPNWLPDRANRGAHMLAQQGLRQSETKI

SEQ ID NO: 946 - protein, 134 aa, Lactobacillus paracasei
VPEYRTHYQPAWIDFSMFWSMIVIGISLATIVQLESTKPSLLAIGIAVVTVLVAIIQVLLHRLVVHEQGLKLVSLFKSNTSEMTWPEIEGFTFGHLTVILKTKRYGQVTFVLFGKKRKQKVVSLIQKGLKESAK

SEQ ID NO: 947 - protein, 557 aa, Lactobacillus paracasei
MSDIEIAQANEATAMWPITKVAAGLGLSEDDLELYGKAKAKLSFSALNALKDKPFGKLVLVTSINPTPAGEGKSTITVGLGDALQQRGKHPVIALREPSLGPVMGMKGGATGGGYAQVVPMEDINLHFTGDMHALTTAVDTLAALIDNHLQQGNTLNIDPRRILWKRALDINDRALRHVTIGLGGPTSGVPREDGFDITVASELMAVLCLAENIADLKARIGRIVIGYTYDRQPVTVADLKVTGAIAMLLRDALKPNLVQTLEHTPAFIHGGPFANIAHGCNSVLATRTALQLGDIAITEAGFGADLGGEKFMDIKTPVLGKTPDAVVIVATVRALKYNGGVALKDLQTENVEALAQGFGNLKRHIHSMQSYGVPVVVAINRFTSDTDAEIQFLIDACAKLNVKAVTATVWADGGRGGLAVADAVLAALDQPAHFTRLYDPQSDVKTKIKTIVQKIYGGADVDYEGKANSALRTIVKNGWQDLPVCMAKTQYSLTDNAKTLGAPEGFTIHVRDIIPKLGAGFLVVMTGSVLTMPGLPKVPAALNMDVTDDGKISGLF

SEQ ID NO: 948 - protein, 154 aa, Lactobacillus paracasei
VLIYLIIAAALVLIDFLIKAWVTAHIPLGESQQLIPGVIDLTHIRNTGAAFSMFEGKQWFFYITTLLAFGVVAMLWRDSLHKPIYRLGLTLITAGAIGNFIDRLRFQYVTDMFHLEFLDQWRFNAIFNFADMCITFGVILVLIFILFDHDKAVA

SEQ ID NO: 949 - protein, 306 aa, Lactobacillus paracasei
MTSTFTITTEQGRIDKVITAHETTHTRSQVQKWLQDGLVTVNGQPTKANYKVASGDVIAISIPEAKPLEAIPEPIPLDIVYEDDQVIVVDKPQGMVVHPAPGHPDGTLVNGLLYHTDLPGINGVIRPGIVHRIDKDTSGLLMVAKTEKAQLSLSAQLKAKTSIREYLALVHGTFKEDEGTIDAPLGRDPRDRKRQAVVAAGRHAVTHFQVLERFEHYTFIKCILETGRTHQIRVHMAYIHHPVAGDPLYGPKRTLPGKGQFLHAAKLGFVHPTTGQLLVFEAPVPPIFEKTLADLRAGIDKTRNVR

SEQ ID NO: 950 - protein, 182 aa, Lactobacillus paracasei
MAQSKQVVDEVTMKRALTRISYEIIEQNKGLNDLVLVGIKTRGIYLAHRIAKRLEQLEGLQVPVGELDIQFYRDDVHKIDHDHQPDVEGAQLPVNITGKHVILVDDVIFTGRTIRAALDALMDEGRPRKISLAVLVDRGHRELPIRPDFVGKNIPTSLDEQIQVQVSELDGKDGISIERMEG

SEQ ID NO: 951 - protein, 435 aa, Lactobacillus paracasei
MAFHNDEAVLDIGDKPKFGQWVGLSIQHLFAMFGSTVLVPILVGLDPSIALFSSGVGTLMYILITRGKIPAYMGSSFSFITIMQALMKGAGYPAIAQGTIAVGVVYLIVALIVARSGSAWIDRALPPVVVGPIVMVIGLSLAGTAATDATMRTISATKSVYDLRYFAVAMITLASVIIYNMYLKKFISLLPILLGIITGYLVALLFGIVDLTPVQQAAWFDLPKFEIPFISYQPQVYWGAILSMAPIAFVTMTEHMGHIMVLNKLTKRDFFKDPGLNHTLAGDGTASIIAGLVGGPPVTSYGENIGVLAMTKVHSIYVLGGAGFFAILFAFIGKLSALIRSIPSPVIGGISFLLFGVIASNGLRVLIDNKVNFDQKRNLMIASTILVIGIGNASLQFSGYQFSGLALATVIGIFLNFVLPEHAANEEEAEKNDLI

SEQ ID NO: 952 - protein, 313 aa, Lactobacillus paracasei
MTLSNFTDTSFQDFVSAEQVDDKSAMALINRAEDFKAGQTVHFPEPIYAANLFFENSTRTHTSFEMAERKLGLTVIPFDPAHSSVSKGETLEDTIKTIGAIGVNIAVMRHAQDGYYNDLLGAWPTTAIVNAGDGAGQHPSQMMLDLMTIHEEFGHFDGLSIGIVGDLSHSRVARSDMQMLHKLGATLHFAGPEQWYDSSFDQYGDFITVPELVKQVDVLMLLRVQLERFNADHRQAFSKETYHAKYGITDDLAKTMKPGAIFMHPAPVNRDVELASNLVDGPQSRIFTQMQNGVFMRMAMLEAVINARHFGEE

SEQ ID NO: 953 - protein, 421 aa, Lactobacillus paracasei
MLIKHAHIVSDTEYTADIQITDHIISAIGQSLAPRDHEQVIDATGAIVMPGLIDVHVHFREPGFTAKETIKTGAAAAAHGGFTTVVAMINLKPVPDTVETLKPLLEKNQTDAKITVLQFAPITHDLHSDQVVDMAALQAAGALGFSNDGVGVQDADTMYQAMQQAAKLHAPIVAHIEDASLMHGGVINAGPVAKKLNLPGIINQTESSQLARDLELAAATGVHYHACHVSTRQSVDLIREAKKRGVNVTAEVSPHHLLLDENNIPGDNPMFKMNPPLRSRADHLALLEGLQDGTLDMIATDHAPHTAAEKTGSFKTAAFGIVGSETAFSTLYTKLVKSKMFTLKQLIARMSTIPAEKFDLPGGHITVGGPADLTIMDLDTPYTIDPADWFSKGKNSPFIGDKVNGQTLYTISQGQIAYARA

SEQ ID NO: 954 - protein, 360 aa, Lactobacillus paracasei
MKRYLILEDGSVFPGVGFGAETVTTGEIVFNTGMSGYQETITDQSYNGQIITFTQPLIGNVGINRDDYESIDPTAKGIVVRDVARVTGNWRSQMTLDEFLKRKHIPGISGVDTRALTKKIREVGAMKASIVDAADEHAFDQLKALVLPKNQVQQVSTQQAYPAPGTGRNVVVIDFGLKHSILRELAKRQCNVTVLPATTSASTILELAPDGVMLTNGPGDPKDVPEALDMIRGVEGKIPLFGICLGHQLFALANGANTFKMKYGHRGFNHPVREIATGRIDFTSQNHGYAVDPDSIDPDTLLITHVEINDGTVEGLRHRLYPAFTVQFHPDAAPGPHDADHLFDEFMEMMDAFSNRTQKG

SEQ ID NO: 955 - protein, 1060 aa, Lactobacillus paracasei
MPKRQDIHKILVIGSGPIIIGQAAEFDYSGTQACLALREEGYEVVLVNSNPATIMTDTEIADRVYIEPLTVEFVSQILRKELPDAILPTIGGQIGLNLAMKLSNTGILDELGIELLGTKLTAIDQAEDRELFKNLMQKLHEPVPESAIANNIEEAQQFADKIGFPVIIRPAFTMGGTGGGIANNEKELAEIAENGLNLSPVTQVLVERSIAGYKEVEFEVMRDAADSAIVVCNMENFDPVGVHTGDSMVFAPTQTLTDKEVQMLRDAALKIIRALKIEGGCNVQFALDRNSFKYYVIEVNPRVSRSSALASKATGYPIAKMAAKIAVGLHLDEIKNPVTKKTWAEFEPALDYVVTKLPRFPFDKFENGDRTLGTQMKATGEVMAIGRTLEESLLKAVRSLEVGLIHPERPAFAKLSDDELSKQIIQANDERLFYLAEAFRRDYTIEEVAELSKMNPFFLDKIKHIVELERELAAHKADLGLLAEVKRYGFADEEIAKLWGLHADQVRQMRKEQKILPVYKMVDTCAGEFASDTPYYYSTYESSTESVKSDKPSVLVIGSGPIRIGQGVEFDYATVHSVKAIQKAGYEAIIMNSNPETVSTDFSIADKLYFEPLTLEDVLNVIDLEQPEGVIVQFGGQTAINLAEPLANRGIKILGTSVEDLNRAEDRDLFDQVIKSLKLPQPEGGTATDKAGALAVADKIGYPVLVRPSYVLGGRAMEIVHDATELDNYIDRAVSVSHDHPVLIDHYLVGKECEVDCISDGDTVVLPGIMEHIERAGIHSGDSMAVYPPQTFSQDIIDQITDATIKLSRTLNCIGLMNVQFIIHDGKAYVIEVNPRASRTVPFLSKVTNIKLAQVATLAILGLSLKEQGFETGLLPNQSGIHVKSPVFSFSKLNHVDSLLGPEMKSTGEVMGSDTTLAKALYKAFEAAGMHLPQFGRALITVKDADKAEATALAKRFREVGYQLVATSGTAKAFEKTGITVSTIEKLDSGQETILEDIANRKIQLVINTMSADKKVSSDGFRIREAAIEHGVPLMTSLDTAGAILKVLELQAFSISPIKS

SEQ ID NO: 956 - protein, 291 aa, Lactobacillus paracasei
MAIQLPGFTMKNPLMPASGTFGFGEGYAKEYDLNLLGALVTKSTTLAPRIGNQGTIFADGPDSTLNAVGLKNPGSDVVLHEKLPWLATQYSDLPIIASIAGVDVAEYAAVAKKLSAAPNVKALEVNISCPNVKQGGMAFGTDPEVAAAVTRAVKAASSVPIFVKLTPNVTDITAIAKAVEQAGADGLSLINTFVGMRLDIATGKPLLDNVTGGVSGPALLPMALHMVYQVAHAVRVPLIGMGGISSGHDAAEMLAAGATALAVGSANYYQKRAIPKIAAELAAIQEGQTVL

SEQ ID NO: 957 - protein, 239 aa, Lactobacillus paracasei
MTPIIALDFKDKTTTLDFLSQFPKEEHLFVKVGMELFYAEGPAIITEIQQARPVSIFLDLKLHDIPNTVEKAAWQLGKLGVAMTTVHAAGGKDMMIAAKRGLLAGAKAAGHPAPKMLAITQLTSTDQTMLTNQLSIEIPISQAVQHLAAIAQASNADGVVASALETPLIRSVTRPDFLVVTPGIRPYGAAVGDQKRVVTPGRAKRLGSSAIVVGRPITQADDPVAAYQSIKEAWETAHD

SEQ ID NO: 958 - protein, 213 aa, Lactobacillus paracasei
MTKLETQIASDLLRIQAVTLRPDAPFTWASGMKSPIYTDNRLTIGYPDVRSKIAAGLAQQIVAHYPDVTAIGGVATAGIPHAALVANLLNLPLVYIRSKPKDHGQGRQIEGHLPADAKLVVIDDLLSTGGSVLGAVAAAQKDGATVLGVAAIFSYQLAAVKTNFADAGLPFFTLTNYTALIQTAESQGAITSTQLASLHQWREDPVKWGAQFQ

SEQ ID NO: 959 - protein, 283 aa, Lactobacillus paracasei
MITVAIPMGSQPDILTLVTRARSELASTLADKLQFVVFDSGSNVDQADTWTFHQARDEADAVTQAVGLVAQGKADILLKGIVQTHTLLKELLRPDYQLRLQKVLSHVAIIHLPQLNRPLLLSDAGMNIDPDEDRLAAIVENAVGVAHQIGLPKPKVALLSAAENFNPKMPSSVLAQAVAKQFETRSDAVIAGPISLDLALSPASVAHKHYEGVIQGDADVLIVPTIDVGNVLYKALMLFTDARSGGTIVGAKVPIVLTSRSDSVDSKLTALAFAIAQLKGGAS

SEQ ID NO: 960 - protein, 373 aa, Lactobacillus paracasei
MTMHPKRDVVIVINPGSTSSKIALFKAGKMVAERTLNHSLAELSQFDAVIAQKDFRMQAIQEFLADQDFSASEVLAVAGRGGLLKPIPGGTYAVNEAMLDDLTAAKRNEHASNLGAGLAQQVADQYGVKAYVVDPPVVDELQPLARISGLKGIERHSAAHVLNQKAMARQVLATMGKTYATSRVIVAHIGGGLSIHAHENGRMIDGNNGIDGEGPYSPERAGSLPLVDFVAKVLAERLTLAQVKKLLASQSGLRSYLNDISIKNIVARIAEGDETAKFYLDGMIYQIKKQIAEMAGVLNGQVDVIILTGGAAYATAVTAPLQHDLAWIAPVVVRPGEMEMQALYEGVMRVLNHEEPVRVYQSDASTIKGGTGR

SEQ ID NO: 961 - protein, 471 aa, Lactobacillus paracasei
MTMNTDLVVLGGGPGGYVAAIRAAQLVMQVVLVEKAKVGGICLHKGCIPTKSLLHSGETLRLMQSAATFGGIIEGKVGIDFAKIQARKATVVDQLYRGVQGLMKKNKITVLNGTGAVLGPSIFSPVSGTVSVTFDDKSKEDVMIVPKHVIIATGSSPKTLPSLPIDEKMILTSNGMLELTALPKKVAIIGGGVIGVEWASLLNDFGVDVTIVEFLDQLVINESQSIARELQKQLENRGIHIQLGAKVEQATIKNKQVALTIAEQTDPLIVDKVMVAIGRQPNVEGIGLQNTSIKYSAKGITHNAFYQTTEDHIYAIGDVIDTLQLAHVAMKEGIIAVEHMAGLPVAPLNYNDVPRCTYTDPEIASVGYTSSNYPQDRDVKIGRFNFNANAKAIILGDTAGFVEVLRDVVTDDIIGVSIIGAHATDMIAEMSDAMYLDASATEIGDAVHPHPSLSEAIQEATLDTHKIAIHK

SEQ ID NO: 962 - protein, 334 aa, Lactobacillus paracasei
MQKMKTTGKLKTTGLSRETILDVYKAVMRGRRVDERLWQLTRIGKFSFNISGQGAEVGQAAMALAFDYDKDYFLPYYRDLTAVLMWGMTTKDIMLAGFGKEADPASHGRQMPSHYGSKAHNIVSHSSPVSTQYPISAGIAYGAQMRGEDYVTVVTTGDGSFSQGECAEAMNIAGVHKMPVVFVVENNGYAISVPDKEQYAVEKLADRGPAFGFKGIRVNGSDFAETYLAFKQAVTDARQGNGPTLIEIMVERLTSHSSDDDQRVYRSAEELAEIKENDPVKLFQQQLIDEGYLNEADIDRIEKELETEINQATDEAEAMPDPDPAKITDQLYAE

SEQ ID NO: 963 - protein, 328 aa, Lactobacillus paracasei
MAELTYLEAIQQGIDEEMAKDENVLIFGEDVGGDKGGVFGVTKGLAAKYGDKRVFNTPLTEIAIGGMGVGLGLVGFRPIAEFQFADYILPAVNQLNSEAARMRYRSKGDWTVPAVFRAPYGGGVRGGFYHSQSTEKIFAGQPGLRVVTPSNPYDAKGMIKTAIRSDDPVIFYEHKRLYRLLKAEVPETDYTVPIDKANVIREGDDLTVIAYGAVLQHALTAAEKLAGEGVSAEIVDVRSLYPLDRETLVAAAKKTGKVLLITEDNKESTIMSEVAAMIAEDALFDLDAPIRRLAGPDVPAMPYAVGLERAFLVNEEQVYNEMKALAAY

SEQ ID NO: 964 - protein, 441 aa, Lactobacillus paracasei
MAIEQILLPGLGESVHEASIINWLVKPGDHVKKYDPLAETVSDKVTTEIPSNFAGVIKAYLVDLDKEVPIGTPIMSIEVEGAASAPEPAAATSSPVAQPTSPPTPVPIPAAPSKPSATGGKRFSPAVLALAEEKGIDLNDVIGTGNNGRITRKDVLNYTPSASAPTSVPEPQPVSDAAQATTQVPTAPPASAIPEAPKPAPETINFEPGIHDQIVPADGIRKTIARHMVQSATEIPHAWMLVEADVTNMVKLRNRMKDNFKQQEGISLSYFPFFIKAVVQALKKHPKINTSWQDGNIVYHQDFNISIAVATDDYLYVPVIKHADQLSITGIAKEINRLAQLTRAGKLTSADMADGTFTVNNTGSFGSVASMGIINYPQAAIMQVESINKKLVVTDDGIKIADMVNLCLSLDHRILDGLQAGRFMNDVKLNLSQYNIESDLY

SEQ ID NO: 965 - protein, 314 aa, Lactobacillus paracasei
MKITIAGVGAMGGRYALMLSREGNDVDGIDGWADNVNAINEHGLQANFDGEQVVAKIKAYEQTKIDPSAVADLVILFPKSMQLDGMMQSLKPVITDHTKILCLMNGIGHEEIIEKYVTRDNIFIGNTMWTAGMEGPGKLKLFGSGSVALRNVEDGEAATAAAKKIVKLLSDAGLNAEYSDNILYTIYKKATVNGTMNGLCTILDCNMSEFGSTSTAEDMVVAIVKEFSAVAAKEGIDLNVPDTVDYIKTTWDPNTIGHHYPSMHQDLITNHRLTEIDYINGVIDRRGKKYGIPTPYCTFLTQLVHAKEQLLHAK

SEQ ID NO: 966 - protein, 426 aa, Lactobacillus paracasei
MKLTENKLIVKYYDYDLLVIGDHSYPVIVMKKYISSCKGKKFQNLNDVKKFVDFLFEGMSFLHEMGIVHRDLKPENILIDKDGNYCISDLGIAHFDTNNFPEFYKTLQNERLANYAFSAPECLSEKGISPNKNMDVYSVGQLIQWAICGSLHKGTNRKRFWECDLEYMDKDYLYSLDLVVDKAISNNPQERFDSINDMRRELCRRLKQKKVIDPFDEMQLLQEMITDAYPEDYGEFTCIDDVQQITAILKNIKCSKFSENSFWFNEGIGNNKITRFEQFDNGVTLINSYELFVKKIWLSLGLSMYNDLIILEIETENIEPFKNEEESFFEGYLIDGKYMIPASKTMSGKFRHQGKVINLEEVKADVRYRYTAKRYFFLGTRWTNAIQSISDDLINDFQSTDINTLNMKALKQVLSSNKSPEVSMLL

SEQ ID NO: 967 - protein, 214 aa, Lactobacillus paracasei
MQKTFIAVCTLFLGLGLVGCGHLQQASPSSSSKKTSQQTSSNQASQSSSRSSKIASSTSDASHSTTKQPLWSNAKSAKLATFMASWSKTMGQQYESYWQGHSVDMYGLKIPDELGQAGTNQPGSMAMAVGDKAVTWALSTNGKSNAEYTIVAIYSDAAHEPYLGKHVYLFTLHNGQPEVLVTQQNQGNDNNWLYFSETQNQELRLAFAKIVQGD

SEQ ID NO: 968 - protein, 109 aa, Lactobacillus paracasei
VSLQEKIAHRIHNLRLSKSMTQEQLAEKANMDVSMLARIERGSRGDIRISTLEQIVKGLDVSLREFFTFGDDQDEVMTLAASVTLIKDPEMIRALQKIVDAALGKTMKR

SEQ ID NO: 969 - protein, 531 aa, Lactobacillus paracasei
MSSSSHLPLTSTLIIVAALAGGGIATSTLVTLPATVNAASDADATPVYTDFSTFKPIAGPITVVTPGATPTAPPEKISANGHDYFYNYTSGKRLLYLPIAQAYQPNLAHIKSLVDAALQQKGSQHDDTVAQITASDLAKAIQADSVLRPDNAANNKIFTDAGLVAKGGSVETFNPDPSAVKWTDEVVANRITASFPKGATSYGLAIGRLPSGEFVAYINYAAKPTVSSQDTYTVSYKTLDGKSLKPDDQVASDKIAVLPFPDFSYIYWKKDDAAHTVTMYYQPADGAYQPEMSDVTDTFYRLLNKERANKGLAPLNLDPQLQNAAQQTASADANQLANPQNPRTVTPADRSAPDTNLITLSSDTIPFEHDEGEGAEDLVATGILQLDDRPGTLNLGDLYQPDVTAVGFGATMGQDGHMYYTIRLSEKKNASTNENPADDPSQSASDPATKNDQAGVPPTAEKQANAPSSPTPQKTNVAPAADNAKHEEQNASKDLPETGNRVFEKGGIVGFLMLLATFGLGMVQKMRSKRF

SEQ ID NO: 970 - protein, 255 aa, Lactobacillus paracasei
MKKSLANVQARRADIERLVDRHGIATVKGLALRLKVSEITIRRDLKILHAMGRVKWHNGLVEAIAGQGGGEQRTLAVIAQRIAAAVPNYIARYSTLFMNANSLCLQVINELAKIPVTVITNNPCATACARHEGTKIMITGGRVSTKKSVLAGSVTLNFLSSRIADVTVIGCDGISVDGGLTSSNAEAAAIDSMMVTKAKKCVICLADYRKIGATQQYHIADLGMVDVLITDSFADEAVLQQARRKGINVIQVTVW

SEQ ID NO: 971 - protein, 68 aa, Lactobacillus paracasei
MAVDKTVLFKTVNLGTICIFVKIALLKSASLFLNGKSLNTTKNLGQNLKILPEVFIICQTNFPYQTVT

SEQ ID NO: 972 - protein, 252 aa, Lactobacillus paracasei
MKHRNRLFWLIMLVAGIFLIYSTESPVPIAARNTVKQGIINVWTATTDTVSTWLNGGPRSVAKNGASIASTAPSQASHVPSATPSQAVDATPALSIVQGHQLRSVYYYHFDDDLPQSEHDVFLKAVKAYNATGIVKLVAGQGKKSDNQITFSSYKKEMSAKSFGSTELGAGGPTIIVETYGSQVTVINHARASLNLSYPLQSVNDAVAMHELGHALGLDHSQSKASVMYPITQGVSQLSAGDIAGLKAIYGS

SEQ ID NO: 973 - protein, 1192 aa, Lactobacillus paracasei
MRAKRQQLWSALTDKEHKVTLVHSKHHGWLAIGLTAFALGTAGFSLATSGQVVHASDQPSTSQQSKANNGRVWTLRPVSQIEAQIKASNSKVYDIQWGDTLSTISEALNHTGFTTSVDRLAAINRIANVNLIYAGAKLSLQGSGDNATVTTQNAAGTNQTFNLNPAKPARLTPAQQAEVKYTTIGGSGSGAGQQGISSGTGIDQAAEDAALKAAATAKAKAEAEKAAILKQKEEAEAKLTALLNTENAQTLTDLQAKRTAAQAAVDAAKTKVDAAQAKLPAAQTAVAQAQAAFDTANAAVNAKQAAVDQASAQVKTLSAQMTDLQNQLNTLTEQTKDNPDSQATITTVKAQLAVAQGKLTSYEGQLADATAALAEAKQAANQAVQNLNTANQALISVDNEAKAAQNDFAQAQTTLKALPTSVASQNSQAAQAVKAQLAELNTKINQLDQKIKTLDTQIATWQDQLTTAQTNVEAAKANITTAETQASKVDTTDHQQTLTAVQQTVADAEKTIPTIHVPQDTEKQVTINKDENGQVLTDLTGYKLLTAGTPVKTVETLANGDTITTYTTTNIYHKIAHQVVNKTVNVDEAGNILTSTDGYTKVSSSDKSVDTTDPKTGDITTTVTTTVVWKKTETPTHVTVNKTVNVDEAGNVLTSTDGYTQVSSSKKSVDTTDPTTGNITTTITTTVVWKKTETPTHVTVNKTVNVDESGNVLTSTDGYTQVSSSKKSVDTTDPTTGNITTTITTTVVWKKNETPASTHTYDLKTVNEDKSGHVLTNTDGYSIVSSSKESVDATDPKTGNITTTVTTTVVWEKTPQRLIKNQTVNLDEAGKVLTNTNGYNQDSSSVKTTDVTDPVTGDVTTTFTTTIIWKKDTTGNNVINKTINVDENNKVLTSTDGYYFLGSGTTWLSSGGTTTVSVTNKYHKTQATTVYKEVDLDEGGYPLTDKTGYIKVSSTPTSTTALAGNWDTVTTVTTTNIWRNVEAAGTIIGAIKSVNDATTKLIEKQVQANDQRVSIEQAEAYTDADLTLAVAKKFNVLVNGEQARTGRTQTVLTSDPKAYKMEAPRAVEVMYKFSHTRPVNPPATGSQNVTYQKGEVYMNRSTENISTSSLWKKDVDGNADKLSTLIANAMFQQYIVDERPENNHGVTGGHYENIINSGFKNIVIGVYVVDQGDYYAASTAVATGNDGTYNGN

SEQ ID NO: 974 - protein, 143 aa, Lactobacillus paracasei
MHAVIGIFIFELFFAAIGLMLPIHHDENAYDALLIIQLASILSILVITISTTVGRLGLNNREVTAEKYPAALKKLRTKTIWAGALTLVDFHVLLALFSLQERPITESLTSPRQLLQTLLFGIMFCPFMYFFEKKNLKIVHPDV

SEQ ID NO: 975 - protein, 67 aa, Lactobacillus paracasei
MNRVRDYRRAKKMSQLALAEKIGVARQTINLIENGKYNPSLALCLKLAWTLKTDLNSLFWRKENESN

SEQ ID NO: 976 - protein, 280 aa, Lactobacillus paracasei
LKIIDRVAKVYSLGSVKHLQALHNGKTSAAWQVETMNDRYIVKTIQSQKQAVFEFAVSNAVRQKSLELTPEILLSTACQPFVVIEGQTYQVQAFLSGTERLPSLRETLKSYRQMRQVLDQFDYSFSPPDSRPLVALWRTHLETLSEKKPALFHQIAAMVPELKRIDQSRDAWIHGDLGKWNLLVTNSGQVVVIDFGEARLGPKLLDFAALFQGFMPKNKQDLTAYLNEFLALSGIQITDRHLFLMTVQLWLVKGLLIVINEQASLAGVFQNAIELVSSLV

SEQ ID NO: 977 - protein, 132 aa, Lactobacillus paracasei
MATIKLSQAFVDLMKKKHLDQKTLLLITDDGGGRYSLQGGACSIGTKFTLIVLDQPDSDYQVKLENDAGLDLYTSDYDMIFFASGLAMDFQNGAISIKDDAHAYLDGSVRIANGADVLAAFKKGIMVSGATC

SEQ ID NO: 978 - protein, 533 aa, Lactobacillus paracasei
MQTILRITSIRYRWLLGLLTLRVLIDGFNVLISMLIQLGLTVALSGQVNLLVAIFAGMLAAAVVYTGIYFLSGVVTERLKRRVSGDIATALMANFLQDDATQVPDNGTATNLIVTDTQHIMQFLDAGVLPLVDFGITVFLGVIYVVTQSWQLALMFVAFGGLFAGVSRGLFRQQNQAQTTFIQIDDKHKAFFNDFLANVAVVRNLNVFAYSRQRHADYFQQAAPSMRQMATASGALAGIFNGGVYLAEVLTLMVGFAMLTVTGSSVAGLLGAWNAGVCSILWPFLGLAPTIGFLAQQRTSIDRVLPRLTQQVMPVFSPMKGDFQPDTIKIRGTKVSFHYPQTNREILQHLDFQIHNQGITFLIGANGAGKTTLLKLILNELQPTTGKIEIQGVPAKIKSASLFAFVPQRSVMFTASMTANLLLASQADPTKLPALLQQLQLDRYAADLDQTLQPNQLSPGEQRRLGIIRGIAADRPFIVLDEPLSDIDAVNQQAVMQLLRQEAKKRGVVIITHTFDFVTAADQVLKVGDHHDN

SEQ ID NO: 979 - protein, 551 aa, Lactobacillus paracasei
MITDLKKVWRLVDSPLVSILWLLALGCAGLELSLAQVIQSVMQHAAFTVSMITLAAATALAIGLGRSVMAKLQTRGQYQLIQRIQTQLMAALMNGPIATDNQASGRRVNGFTTDAQTAAPLLMRSMTALVVGGFSFLAAGTFGLFSSWQLTLLIIGLCATALLIPKMMSGRLQTAQNQRQIENSQMQESLLQILNGRELLKSYQKEQFGMQLFNGAYQKFSQAQYQMGMQQVKTVVMGFSLGLVFDIAILGIELLFVGFKVITIGQFAAFSMLTPSFTWLFYSMPSQYAELTRNLVSAKRLLPLIQSLHKEELAGGQSRQKPAKFVLRNVTYTYPDATQPTLNQLQLELDVTAHAKMLITGPSGGGKSTLLRLMLGLLVPQAGTIQFEDTDKRDLAAAANSMSFVPQVVALFEDTLANNVTLGRQVSDQQLTLVLHQVGLTDFIARLPQGLATLVHGQDGVNVSAGELQKIGIARALLAQRPMLLLDEPFANLDAASAQTLGLLLRQLPVAMIVISHRHDIGRFWDHAVVLKDGQLHVAGEMLPGDYSRKI

SEQ ID NO: 980 - protein, 87 aa, Lactobacillus paracasei
MFNWLILGHIIFGLVAFAGSLLLALGFRTSFHSLTAVQKWGIGLSIGGLFATMAFVMFTAANLMPAILFTLAGIALLAVLMRKSARA

SEQ ID NO: 981 - protein, 110 aa, Lactobacillus paracasei
MSSLKQLQKELSDVGDFLVALGDEKRQAIIIALLADQPCQGKRVSELTTATALSRPAVSHHLKILKQAGLVAYRREGTRNYYYLSHDTSSINQLKQVLDDVTSVIQEAAK

SEQ ID NO: 982 - protein, 226 aa, Lactobacillus paracasei
MTKVLVVLTNTTRYQHTDAPTGLWLGEAAEFVDAMQQANIAVDYVSPKGGFVPLDPRSMKYTNPAIMKIYEDHDFQERALTASLRPEQVNPAEYDAIYFTGGHGVMWDFPDNQALQAIALAIYQHQGYVTSVCHGVAGLLNIKDQAGQYLIAGKKITGFTHAEEILAGKQKVVPFLNKTVANKYNAHFVQKRAYKSFAVQDGQLITGQNPFSVKALTDLLVPQLKH

SEQ ID NO: 983 - protein, 556 aa, Lactobacillus paracasei
MQKNHLVTALITGLALATILVACGSKNTSASGSRQTLNLSETDDPTTLDVNDMRNSNENDILSEVQEGLTTIESTNGKDKVVLTGAKSYTKSADGLTYTFKLRDAKWSDGKAVTAQQYVDSFQRLLKKENAFAQASSAYFIKGAEAYNTGKGSVADLGVKALDAKTLQIRLAYAYPSLLSDMATVIYYPVRLDKINKVGNKKWKTDVQDQVFNGPFKLTSWKKDDKITLKKNKTYWNAKKVKLQTVNYTTVKKPSTVLSLMQSGQLDALSASGKLISDFNQLAKSSKLVSRKQNGSTTKVLIMNQHNGGTQGLFKNVKVREAFSLSIDRTSYNKAVNDGRDKPTYTMVPQSLDVSGTNYGEYVGNPLKTAQAQYNTKAKRQALLKEGLQELGKSTDLTKLNFVYLTLGSDDTATWLKQTIQENLGVKVTVKTAPDTASFIQMRNDNQYDLLANGWLATADPNAYLSLWNSGNGFQKFFGGYNSKTFDDLDDQLNGNLTAAQRLTLYKQLENQLVAKDFGVVPLTNPQSRIYINKSVKNLQTTVFGGTFNYTYASKE

SEQ ID NO: 984 - protein, 317 aa, Lactobacillus paracasei
MVKLIVRRFVELLIATFLIATATFFMVAAVPGDALSAQTDKLPAATRAQVYQNTGLDKPVLERYGITMNNMLHGQFGESISDPSVTISSLIRDRLPASARLGIQQMLFGIPLGLLLGILAAVYKNTWLDRTVTIVALFLMSIPSLVLGLLLQSYFGGKLGWFPIIGWPSGDQTWWGGWIYTILPTIAGGVTYIAIYARLLKNSMVDVASSEYVMTARAKGLSESQIVLHHIVRNASIPIITSLPVTLAFGITGSIFIESIFVIPGVGQYFVTALNDRDVPIIMGETVLLAILYIITMFITDMLYTLADPRIKLYDRA

SEQ ID NO: 985 - protein, 327 aa, Lactobacillus paracasei
MAASNQDFQFFKKAPTVGSEAASVGSDATFDQSGATPEINVHEGVPKSVGFWASARHKLFKDRLAMFWTVILILIVMVALIGPKIQHYDPNLIRVDSRNIGPSTAHWLGTDRLGRDLFTRLCLGVQVSLLVAILSTILAIGFGTIYGMTMAFFGGWVDEVMMRIIEVFNSLPSLLITMLLMIVLGDGVWTMLFALAVTSWSSSARQARGLVMQLRGLDYVTAAVMLDTPLWRIMTRHLVPNMMSILILDIGQSIPQNIFGEASLSFLGMGIQAPNTSLGILISNGQDQMLQHPMQLYVPILVLVAIVFAFNIVGDGLRDALDPKFQS

SEQ ID NO: 986 - protein, 103 aa, Lactobacillus paracasei
MQKHHWQIVAGAFAGLLLVTTGLALRQNHFLLALLWGLHQTFWLLAGVTVFLLAMRLIWHTERPHGHLTAQFIKHLPTNLEMSVLTAINLFGGIIVDLFLYEK

SEQ ID NO: 987 - protein, 362 aa, Lactobacillus paracasei
MANIVTVKNLKVVFNEGNEQVYAVNGVDLSLHQGETLALVGESGSGKSVATHALLGLLGKDAVVTADEMLYGEKDLLQTSRRQYTHLRGQELGLIFQDPLSGLNPTMRIGRQIGEGLKVHRHVHGHALKQAVFAAIEDVGLADPALIARKYPHELSGGQRQRAMIAMALVMQPKVLIADEPTTALDVTLQAQILALIKAQKVKHDLSVVFITHDLGVVANIADRVAIMYAGKIVEVGTANEIFYHPQHPYTWGLLDAVPSSDDQRDQLFTLPGTPPDLHQPIKGDAFAPRNPYAMPIDFKKEPPLFQVSPTHFVRSWLLDPRTPHYQPPVTIQKRWARFAQLHAEQTNDPVVESQQAGGVPV

SEQ ID NO: 988 - protein, 292 aa, Lactobacillus paracasei
LTEPLLTMNDLSVTFYKGRQAIKAVDQINFTINAGTTVGLVGESGSGKTTTGRAIAGIGPISGGDVLFGGQSIRHFSHAARKDFRRQVQMVFQDPFESLNPRQKVVDIIAEGIDNFHLATSREARLAQVLRLLTQVGLPADAINRFPHEFSGGQWQRIGIARALAVQPKFLVLDEPISALDVSIQAQIVNLLRQIQHEQHLTYLFIAHDLSMVHYISDKIVVMYQGRIVEAGDTDAIYHHPLYPYTQTLLASVPQADPMLEQQKPVLHFDRQALDPTASLVEAAPAHWVLAQ

SEQ ID NO: 989 - protein, 186 aa, Lactobacillus paracasei
MLSYVIDDDFKLALPRPRLDSAPLFAIIDQERDDIGRFLPWANGLKTEAEEATFLRSVNDHFGREESMNLVLWYRDEPVGMISFNHFRPSDESGDIGYWLKQAVRGHGLMHRAVKAMCQIGFEEYGVNKVIIRAAVDNAPSNAVAKKAGFHHDGTHRAGEKLADGFHDENEYSLLRSEWLQMNRKV

SEQ ID NO: 990 - protein, 235 aa, Lactobacillus paracasei
MNDVVVSVKHLTKEVALAQGNTLKVLDDISFDVNQGVFVSIVGPSGSGKSTLLYCISSLLPPSKGKILIKGKSPYEWRASKLAKFRRKEIGFIFQDFQLVSSLSAYDNLLLPGILNGQKIKPPMVDALAAKLELTAELHQSIDALSGGEQQRVAIARTVLADPDIIFLDEPTSALDTHSRQLVMKLFQELVNQGKTLIMVTHDLELAGETSRSIVLRDGRIEREIQMPAAETVRI

SEQ ID NO: 991 - protein, 458 aa, Lactobacillus paracasei
MLKIIAKQFLQHWKIWQALLPIFIVSGIVFSTSLILLTAMATIPVASGTDYGVFMQTPIIIGGVVLCLLTNNAMKQCIDFFDDTNDVMLLLGASPVQLSFLMTGQVLLTGVLGAVIGMLFAIPAGRGFLSLLPVSASSESLVRLPLSFSWQMVRTVLILQALLIVMTCMRYCLKTYQRRKGALVASLHKHRKIVGSFLGIVTLIASLVVTILLFLKPVPDPTSANAYNNSMKGSMNFLLLLWPLVIISMNFLIRPLFIKMVRVIVHIPSMAKQPMIRSAFHDLQHHEEAVIKLIRPVSVIVLLAGNFIALFLNTKLLVDGNNGGAVIYDLAVSLIFVFGAPIMISLASILTSISLFKMKTAAESDHYFFSGCTPSWIFNLKLTEIGAATILAILITFLGTSLFAIPLLRVAFLGGGDLSKANWTVNILLTFGVFGIFFLCLTLVYWSERTHRKAYVNE

SEQ ID NO: 992 - protein, 246 aa, Lactobacillus paracasei
MTNTWTMMRTLTRQRSLTAFKTFIVTLVATVVSILLAMFTGEAKITVDFVLTLLFAYAVIGGLVFFVRLAIIQERVWVNNYYRSVPTTNLKLYTANLLATCLSFLIYAAFEGVVILALAVTRWGINLPTGDPMTVLVEMGIFLIVLGIFIWAFISLVHLLSVTIMAFLPETRIRLVQWIIYLVVIIVASFIFDQVQRLFLLPFGGYDSNTLTGSSSVLVGIGIFIVTILLISAVNVYLLEKWVETK

SEQ ID NO: 993 - protein, 237 aa, Lactobacillus paracasei
MTTNMITVKQLTYKRNRKVILDDLNLDLVQGHFIGLLGANGAGKTTLMRLLNGVATTFHGTIQIGSSESIVERKQLSSFSESLNGVNPNRTLKQIATYYADMYLDFSEAEFANFLKTFDLDSHQKLAALSKGNRKKLIAALTLARQTQLYLLDEPFEGIDSMTRKRIISNLIAWKPAAATVIISDHHVSDVAKVLDEVVIIKDKHVVAQKNAEELREKTGMSIENYYESFYEGSDQQ

SEQ ID NO: 994 - protein, 125 aa, Lactobacillus paracasei
VEFDDKIPIYYQIKQYLYQEIITDRLKSGDQLPAVRQLAADLTVNVNTVQRALTELIQEGVLETKRGRGNFVTNDMKVLIDMKKRVIATELDRLYHQLSELNLSDEEMKDAFAAYVDEQEVKHDN

SEQ ID NO: 995 - protein, 283 aa, Lactobacillus paracasei
MKKWIKVILAVVIVLIISGGAWFWMNRGSAPSTARAAGTYQTPTLFVHGFGGGYGSEKDMIADLSKHPGYQQVLRYTVTNTGQLSVSGSWSASVKHPLIAVVFSSGRPDAPTLGKILKQLKKRYGIKNFNAVGHSAGSAAWANWAVTPDKQGMPQLRRLITIAGPFNGFPGMPGMNGGQHITLAKDGRPNVMSDRYKPLYDNRRYFPKTAAVLNLFGNLGKGTDGRVPVNSARSLRYVVAGRAKSYTEREITNSKAQHSQLHEHNPLVNRYLYEFLNNGKITN

SEQ ID NO: 996 - protein, 140 aa, Lactobacillus paracasei
LLPVEGLSCFSHDVILLEIVLMAQLLKVGIFLEKSHFGISGEDLQQLPLSFLERYLFLAFGWGQMLQYQWLRLIEIGQHLFNDRNSLIWVITSFCNFQLSFERIRIGDRDQVVYFLAHVSITFGNSKLVISKTNLSEYIQ

SEQ ID NO: 997 - protein, 230 aa, Lactobacillus paracasei
MHIDQVIRERRLALGLTQEELANKIGVSAPAVSKWEKRVSYPDITLLPALARILGTDVNTLLTFSVTMDPEESRHLYEKLMTTAKDAGWQAAVDLAEAQIAHYPSMNSLQLMIAAFLQSLKSQIPEADWPSVYQQIVAIYQTAEKSTDLPQAQVAAQSLFYLYLKEKDFDAAEKQLTLLPPEVVAYNAMEPKLKLQRGQLKDAYISGEKLLGTGLGAVSLTECTHSSWSC

SEQ ID NO: 998 - protein, 245 aa, Lactobacillus paracasei
MTIILLFLGFLVGAFIMTMGGGGGAFYLGIMTGVAHLSPGTAAATSLFTAIPALAVGCYSHYRTGNMRFHAGNEILMTAVPATIIGSLAAPHIPEVVYSWAIAVIFVVLGVQMLRQSFARKVKKATQPAWFAYVLGAISGLMVGVAGLSGGGPIMADLMLMGLDMPHAAATSSYALVALSVIGCLLHATQGTIAWQVGGLLMLGSLVGAAITPRILNRFDPRLLTAILRPILGIMLLIMAVAQVW

SEQ ID NO: 999 - protein, 469 aa, Lactobacillus paracasei
MAKTTIEVKETNARHALLVISIVALMSFLGVLTETSMNVTFPTLMHDFNVSLTTVQWVTSGYLLAAALIMLSSAYMKRRFTNRQLFVTAALLFIIGDLMCAMAPVFWVLLAGRLVQAGCVGLCSPLMVNIILDTVPTSKLGTYMGVANLIILIGPALGPTFGGAVANFFDWRMIFWSTLPFAILLLVLGQGRIKQYTPTSDFAFDWLRFTALGVALISLTVALNGVSDRKWLTACVGLLIVVTAMTVFVWLSNHHAKTLFKLDVFHDPGFLYSFLPYILLQFSNVGINFLLPNYVQTVDGASAFIGGLILLPGSVFNGLGQPVYGWMLDHFGGRLPLFLGNTLFTLGVLGFTIFGRHISVLWVTILYLIFAIGRSMAFGNSTAYGLKVIQPDDQSDANALYSTGQQVTGSMGTTVLAGMMTAVTMPGLSHAQNVGIGSQLAFGLLLAIGILNFWLYARLFKLTSTKKVE

SEQ ID NO: 1000 - protein, 212 aa, Lactobacillus paracasei
MKNVVTDPEKVTRILKTATEIFGQQGFIKSKTDQIANQAQVSKGLLFHYFGNKQALYLDAFKYAYHRIYDHMDPKKWQNAPGLAAMMTTAVKYELKLQFKFPAEYRLMMQAYADLPHFPEPLRQQVQQETTAISAEADRIFREKIEQLPRREGLSVDDVFGVVSALIAQQTAVTTRLIASGHYRKFEDLQSVVETMARQLLIVEHGFLPDES

SEQ ID NO: 1001 - protein, 538 aa, Lactobacillus paracasei
MRHSNRNAGYLLRANLKQNLKFSLIWLVILIMMIASGAGKLEAAFAGGASGSKEIVKMLRAPGMAAMFGAMPKVDTYNTAIVFAGVMVVFMIILQALWVMPLMIRNTRGQEESGLLEMVRARNVGRTAAITAASLELLIDSAIMGILYFVSLAAVNMGGTDLYGDFLFSLGMVIANLLFGAIALLFAQLTNNTRTANMLSYMVLTAAYLVRLVTDIQHQNLTWLSPIGWFEKANFYTDNNVWALGLALLVSILLAASATMIARNRDLGAGIIAERTGRAKAAGWLRSIPALLWRTERGLFAGWLIGAVVFGGVMGSVLGGVGDILKTNPLYRKILDVGQINAANQTMVLSFLGMYLGIFVALAVTAGVQVAFRLKRDDSLGYLSVIHAEKPTRTTISVSYYCFGLLAGVFVLSAGLLALFFTGNTVLSHPLPLKYLGRLFVASVPAVISFIALGIALVGLWPRLSSLFWLYMGAGLIVQIFRGLFDLPKHAGNFTPFGWIANVPVESVDQTWLIVMVVSAIVLFILGIVGYRRQDLSL

SEQ ID NO: 1002 - protein, 305 aa, Lactobacillus paracasei
MTTAIIELDHLQKNFGKFAALKDVSFTLAPGQVLGFLGPNGAGKSTTIRVILGLLKKSGGSVTVFGKDAWRDDAAIHPRIAYIPGDVYLWPNLSGGEIIDLLLRLNGRQHNQKTDELIKAFEFDPKKKARTYSKGNRQKVALIAALSQDADLYIFDEPTSGLDPLNEQTFQQEVLKLKRAGKSVLLSSHILSEVERMCDSIVIIRDGSVIESGNLDQLRHLSRIKIEVTTATPMTALAKQAGVHDLTYRDSEHTKAVFTADRDALGTIMTTLAANTVVDMQSTPPTLEDLFLRYYGKQGETHAAQ

SEQ ID NO: 1003 - protein, 256 aa, Lactobacillus paracasei
NADPHLDLNDTLRHQLHHRSIRQFKPQHLSSATIRTLLDVAQHTASSMYLQLFSVIHIINPEIRAQIAKISTQTYLNGNGELFIFIADLNRVAKLTAAAGQSLDRLGRMDKFLQASADATLALQNMVVASESLGLGTVTLGSIQNDAQAMIELLHLPKYTFPLLGLAIGFPDDDPDEKPRMPQQLVAFTNHYDEPVPSPTAMTDFDRTVSHYYATRRGDPREESYTDLAIGAANTTPAKRGDLFKVLKHQGFFPES

SEQ ID NO: 1004 - protein, 279 aa, Lactobacillus paracasei
MKQRKQETKRLIDENNQLRKQLNAENRHYYEDLLVYMRAHTLLRDDFIVEQNLLAILQDLIDAQQSGMNAQTYFGKDPERTGSEMLKAIPRNIADFAWFNLKLILMMFMIFWLPQLTRPVTKFDVGNLLIVAIISIVAVWGVEWIIGSYAFIHPTRMQTVAFYAGGGLLFVVIIGLLAFFKSSWEITLSSSTVLVITSLGLLVGIVLPFFHRLTGQDRILYFWSMFILLLGFLSRLPFLQRFMHAKIDLGAWQWLLYVGMVVVPVLFVLTVWWIRRRKK

SEQ ID NO: 1005 - protein, 112 aa, Lactobacillus paracasei
MATDTNSQMLKGILQGCLLILLSREELYGYAISEALNDFGFVDIPKGTIYPLLMTMERKGLLISHLRPSPDGPSRKYYAVTAEGMAARQTFQQQWSQLKDHVDQLINEEDKP

SEQ ID NO: 1006 - protein, 237 aa, Lactobacillus paracasei
  misc_feature (5)..(5): Xaa can be any naturally occurring amino acid
NADPXIDREDCTASECENZYMEFDEPENDENTMKIGMIGSGNVGQVLTQLFVQAGNEVVIAHRGSVDALEDLARILGAEAGTVEQAEAQEIVVLAVPFLAIKALPEPLAQDPIIIDATNYFPDRDAWIAEIERHKKTTSQIVAEHFQSSKVVKAFNTIGMTVLARLAQPEQPVDRIAVPYAGDDEQAKKVVASLIWTIGFEPFDLGGLATSFPAQADGPLFLVNETAPVLRQHLNPE

SEQ ID NO: 1007 - protein, 180 aa, Lactobacillus paracasei
GNATFAMILYPRTEINMKLHFSKAQLNDLDTIMTIETAGFTPQEAATRTSMAARIANYPDTFIVARAGGTIVGYVVGPATDQPTITDDLFSTSQPNRPDDPYIAVLSLAVSPRHRHQNVGSQLLEQLTQVARTQNRQAITLTCLQRLIPFYEHQGFQNEGRAASTHAGEIWYNMVKKMLY

SEQ ID NO: 1008 - protein, 187 aa, Lactobacillus paracasei
MDKRLVKISKTLSMLLRHHPEKLGLVLDQYGRTDWKTLVRRFNAHYQMHLDRQVLQAIMAQSTKKRFALEGTTIRAVYGHSVPVMPLTPATEPPQWLYHGTSHQAATVIAKEGLLPMNRDFVHLSEDVATAQQVGARHDTHPVIYRIAARDAAKNGILFYPTSSRVWLVSELPARFLHHLTSYFRRP

SEQ ID NO: 1009 - protein, 85 aa, Lactobacillus paracasei
MKADEPDDLRLNPKQFANLVVESHQVPDDKDPETIVKRKLTLYLTAYYLAERFNELQQTTLSHAPSRKNYQELLKKLEEERFQDW

SEQ ID NO: 1010 - protein, 449 aa, Lactobacillus paracasei
MLLTVIAYAMIVVFMYVIMTKKLSPFTSLVMIPLLFAIIAMVAGVANKGTIGDFVLKGLTTTANTGIMLLFAILYFSIMLDAGLFDPITARMIKIAKGDPMKVLMATAIVAMAVSLNGDGTTTTLICCSAFIPIYKKLNMNMMNLGVLIILQNTIMNLLPWGGPTARAMAVLKVDADILTYLLPGMILALAYVVFYVAPRMGRAERKRLGVRELTDAEIDEMTSVVDPEVSEIRRPNLFLFNGILTIVLIAWLVASSFIKAIAMPPLLLFLVGTCIALMVNYPKLGDQSKRIGANGGDAVQVVILVFAAGVFMGLFQGTGMAEALAKSFTSIIPDSLAGFWGLVIALISAPGTFFLSNDGFYFGVMPVLATAGRAYGFTNMQMALASLMGQAFHLLSPLVAFIYLLLRLTGLDMGKWQREAGKYALGVFAIFVVTVMLFGHVPFYLPQK

SEQ ID NO: 1011 - protein, 108 aa, Lactobacillus paracasei
MFNWLRRRKQTPSTKEQVPPQMSAPAAPVDDDWIDVPNYLAVDPASELPVSLIAAAVTADTAPDAQLVLKHLYVENPEAKRVGLIASAIAAGDGQANYVVKSIKKKVE

SEQ ID NO: 1012 - protein, 135 aa, Lactobacillus paracasei
MLRKFKITIDGKTYLVEMEEIGGAPAAQPAPAAPATPAATPTPAPAAPATPATPAPAAPVAPTGEGEVVTAPMPGTVTKILVKDGDAVTENQPLMILEAMKMENEIVAPKAGTIGQVFATLNQNVNSGDNLISII

SEQ ID NO: 1013 - protein, 374 aa, Lactobacillus paracasei
MEALIHGITTITLGQIAMMLIGALLMYLGIKKEYEPTLLVPMGLGAILVNFPGTGVLTQVVGGTKAEGVLDVLFKAGINTELFPLLIFIGIGAMIDFGPLLQNPFMLLFGAAAQFGIFATVFVAVFFGFNIKEAASIGIIGAADGPTSIFVSNQLAPNLLGAITVAAYSYMALVPIIQPMAIKAVTTKHERRIRMTYKAEGVSKTTKILFPIIITIIAGFIAPISLPLVGFLMFGNLLRECGVLDRLSNTAQNELVNIVSILLGLTISVKLQADQFLNIQTLMIIAFGLFAFIMDSVGGVLFAKLLNLFRKDKINPMIGAAGISAFPMSSRVIQKMATDEDPQNFVLMYAVGANVSGQIGSVIAGGLLLSFFGA

SEQ ID NO: 1014 - protein, 47 aa, Lactobacillus paracasei
MKIDPVAVEQAGELMLIGMGGVFIVLFIIYIVAKLLLKFAPAKKAAK

SEQ ID NO: 1015 - protein, 334 aa, Lactobacillus paracasei
MATLKRIWLALNPQEAAAWQALLTTAGLAADRQVDYTVGIFEGETLLATGSLSGNIIKEVAVTPATQHENLLAQVIQALLDRLDDDGVTHSFVYTKPTTVKFFLSLGFKQLAATDAVVLLERGYPNLTDYVASLEKQRRPEKPAAAIVMNANPITRGHAYLIEAAAKTNPVVYVFVLSAERSLFTADERLALVRKVAVRWPNVVVLPTNDYMVSNTTFPSYFLKERADADVAAVQARLDAALFKQAIAPVLGITRRYVGEEPLSPVTAIYNRELAATFGSAIELIVVPRLMIDGDVVSATRVRAAMAQQDWKTVQQLVYPEVYQEIKERSTHGN

SEQ ID NO: 1016 - protein, 101 aa, Lactobacillus paracasei
MEIKHPATAGTLESSDIQITLSPATSGVAIQLQSSVEKQFGHQIRSVIEATLAKLGIENVAVDANDKGALDCTIKARTIAAVYRASDNKTFDWEEINAWIN

SEQ ID NO: 1017 - protein, 292 aa, Lactobacillus paracasei
MDKLRRTMMFVPGANPGMLRDAPIYGADAIMFDLEDAVSLKEKDTARMLVYSALKTFDYSSVETVVRVNALDAGGDQDIEAMVLGGINVVRLPKTETAQDIIDVDAVITAVEEKYGIQNGTTHMMAAIESAEGVLNAREIAQASSRMIGIALGAEDYLTSQHTHRSTDGAELSFARNYILHAAREAGIAAIDTVYTQVDNEEGLRHETALIKQLGFDGKSVINPRQIPVINGVFAPALAEVQKAREIVAGLKEAEAKGAGVVSVNGQMVDKPVVERAQYTIALAKASGMEVD

SEQ ID NO: 1018 - protein, 510 aa, Lactobacillus paracasei
MVKNTLNRDIPEPYADQYGVYGGEFANIKPYDEHARHINPVKPDHSKLVASIHDAIVATGLKDGMTISFHHHFREGDYVMNMVLAEIAKMGIKNLSIAPSSIANVHEPLIEHIKNGVVTNITSSGLRDKVGAAISSGIMKNPVVIRSHGGRARAIARGDIHIDVAFLGAPSSDEYGNINGTKGKATCGSLGYAMIDAKYADQVVAITDSLMPYPNTPISIPQTDVDYVVQVDAIGDPTGIAKGATRFTKNPKELKIAEYAAEVITKSAYFKNGFSFQTGTGGSSLAVARFLRQAMLDQDIKASFALGGITNSMVELLKEGLVEKIIDVQDFDHPSAVSLGENADHYEIDANMYASPLSKGAVINQLDIAILSALEIDTNFNVNVITGSDGIIRGASGGHSDTSAACKMSMVIAPLVRGRIPTIVENVNTVVTPGASVDVVVTEVGVAINPARTDLIEMFKNLKVPLFSIEDLKKMAYQITGTPEAIEYGDKVVALIEYRDGTLIDVVHNV

SEQ ID NO: 1019 - protein, 179 aa, Lactobacillus paracasei
MFKLTILDGPQVDLGQMLAAKDARVVKERALLVAAPTNTLLHVTLRIPGPVKTGTRIEAVFSAVMQTLTQQLGEVVRSSDIDLLPTGPEAYFLTTLSPLSLKRLMVAFENQQRFCDLLDLDVITLRDAELYQVSRTDLALPPRACLVCGGDAKACARSRRHGLPEVQQVVETIVKESAS

SEQ ID NO: 1020 - protein, 467 aa, Lactobacillus paracasei
MPKQKVQFMETVLRDGQQSLIATRMPLSDILPILDKMDAAGYASLEMWGGATFDACLRYLNEDPWERLRKIRKAVKHTKLQMLLRGQNLLGYKNYADDVVTDFVTKSVENGIDIIRIFDALNDTRNLRTALEATKQAGGHAQLAICYTTSDFHTIDYFIKLAKDMADMGADSIAIKDMAGILTPQKAFDLVTGIKQEISVPLEVHTHATAGMAEMTYLEAVRAGADIIDTAVSPFAGGTSQPATESMLVALQDLGYPTDVDLSTVSDIATYFAPIRDRFRESGQLNPRVKDVEPKSLIYQVPGGMLSNLLAQLKDQGQEALYGDVLKEVPRVRADLGYPPLVTPLSQMVGTQSLMNVMSGERYKLIPNEIKDYVRGLYGRPPVAIAPEMVKKIIGDAPVVTQRPADLIKPQMPEFRQAIAQYAHDEEDVLSYALFPDQAKDFLGRREDPFYDVPEQKVSLSFEPTHD

SEQ ID NO: 1021 - protein, 231 aa, Lactobacillus paracasei
MNQVVPAVKRNLDLSENRPIKEAVYEALRKTILLGEIPSGERINEKNLSENLNISRTPIRYALERLDEEDLVERKTGIGVIVKGISINDAYEIFDIRKELDVLATRKAMRLMTPAQFKQMRALLEETDRLNDAGRVPEVMAKFTEFNNFIYDASHMLRLKMIVNQLQNYLIYFRDISINGDDRRNLAIQEHWLIYRGMLNRDDDQIKLITREHLGHSLQYILKVMKAKNIE

SEQ ID NO: 1022 - protein, 280 aa, Lactobacillus paracasei
LNEQTIAQAAVTSLRAEVLLAPKPGLVDPESNGAHRDMNVTTFEASIHALAPYFGQYLHAGLTAATVPQLYQQLRTIGVKAEKAMMTATVGVNTHRGANFSFGFLLGALGWLLQKQSLKQLVMHDFAPLFPAVAQIAQGVSGDFRDLSEKKQLSHGEALYMKHGVTGVRGEALAGYPTIRTVILPYLRQTTTRGDLRYLQLMVHLMAQVEDANVLHRGGPAGLRFVQDAAKALLHVPASRLPNGLRALNAEMIARNLSPGGTADYLSLAYFFDALMQQTG

SEQ ID NO: 1023 - protein, 141 aa, Lactobacillus paracasei
MTYEEKIGTERFDAMVADFFANRYFDRGMRKWQGYYLSDHTAALKKQSKSEALVYPPLPLQDQAVIRAILLQAYAEGQTVTAQLNLQTPSGQMLPPIRGKVGGLTDSDVVNIADQNMAIGSIRHIELIPFAASTHQKNTPD

SEQ ID NO: 1024 - protein, 193 aa, Lactobacillus paracasei
MKKWFLLATAILTFSGVSGAALYQHQANAGTDTKTVTVTTPKKQPAATVKPKKENATASSTVAVTNSSAATTQPSEENSSSSTVATVHTEKASTASTTQATPSVSAEDVSNTAPVYLGTWQNEHVTLTITTDQLTVVQAGVTTKTGYKVTPEGNGFVLIPTDVGADAIYLVPVSGGLEWVAPGVAAPLILHHA

SEQ ID NO: 1025 - protein, 269 aa, Lactobacillus paracasei
MQVEKDVIYDSAYNLAADLYVPDEANGGAIVYAHGGGWFRGDKENESDLGEYFADAGYLFAIPNFRLAPKYLYPTAQNDFDHFINWLLASPYDFDRERLGLLGASSGGTMVLQNSLASGYPLVAWSPVVDFANWVQKNQMVKASVDGKKELGLTEIHEIHDSFYKYFVQTYLGGLDPRLLTAVNPTNHLTDQLGPALLFNSADELMPLPSALHFLQQAAMFGRDIGLHVVPGTGHARDYTSFALPETKRFFDHHLFTTVEDKTLNKATD

SEQ ID NO: 1026 - protein, 293 aa, Lactobacillus paracasei
MRYSFTTKVTRSTTVKRWLAEQGVSHRLFKKMLVDHLIWVDGQASDNGPVEAGQIIRFEIPTSKTLTPEFAPLEVIYEDAYWLIVSKPAGLTSVPGPHTPNSSLLNRIAGYLVEQKIDAPQPAIMTRLDRDTVGLVLAAKHPYAQGRFDQAHQRTLTKHYLAVVSGKLPSPKGEIDAPLKLAADGIHRIVAADGQTAVTKYRVLKEKTNTLVDVQLLTGRTHQIRVHFASLGHPLIGDHLYGQPDARIPYQALQATRLNFTDPFSEKRITAELPVPALFNQLLTEAPQIEPTI

SEQ ID NO: 1027 - protein, 205 aa, Lactobacillus paracasei
MTFVLPDLPFDYAALEPYIDATTMHLHHDKHHQTYIDKLNASLDGVPQAAGKSIEQLLTGLDALPESVRVSVRNNGGGHYNHSLFWTMLSPESTIKPDGQLLADLESTFDSFDKFKAEFSQAALSVFGSGWAWLVKDNATLKIVTTANQDSPITYHQYPLLGLDVWEHAYYLHYQNRRPEYVDAFFKVINWQTVENRLMHPDTNA

SEQ ID NO: 1028 - protein, 49 aa, Lactobacillus paracasei
MRNNIILGNNETGERIYLTSKNKRNTPDRLQLKKYSPKLRKRVVFTEVK

SEQ ID NO: 1029 - protein, 191 aa, Lactobacillus paracasei
MSNNRMLGNEFQTAYESAGGTDILKFLANVKQAFQCITDLTARITGMPDSVKSESVSQLLVQQLDQTTFAESAVRQWEDDLHRFAAYLTPLEPPIAILDSWDTLNDFLEANQALLSSLQNVPLLTQETQEVKTTSQLFVYPAEPLFQVVQADTGESDSIDLAGLADADPEGVAEIAQNHGVTPFAAFNAQP

SEQ ID NO: 1030 - protein, 344 aa, Lactobacillus paracasei
MKRIALFALMVLVISPFLIAAGQKTTATTPEFAVTPVLPSNQKQADAGYFDLQVDPGQQENLQLRISNLSDQVQTYTIAVNPAYTTDSGAIAFDRAMPPLNQDARRLNTLISGPEKVSVPAKTEKLVNYILKAPSQHFIGVISGGFYVSPENDSSTNKSVSGVRFTNRFAIGITTILRQDFKTPNPPLLAMTKAGIGTINHYAAVQATISNPSGNQFGDITSDYALSKTGTKKALITGHFVGQAVAPHSFFTQSILLNDRKLMAGDYSLKWTAKSGDFSWTKTLAFHYSGHLPKNTLQPVVNKPKTKAPDNPQLPWIITGIAIALLLILTGTWGWSTWHRRHNQ

SEQ ID NO: 1031 - protein, 190 aa, Lactobacillus paracasei
GNATFAMILYPRTEINMLKGSRVAVRPFELTDVEDYFAYAHLKQATLPAGMTPLKSQAAALEHIRRFAREKQDLALVYRQHVVGNIGVYPRDLSPLTGDDMTREIGYILHPHFWHRGFMTEGLRLVIDDQFHNGIQAVWAGVFPENIASINLLQRLGFDFQFEVPLPRGLTPDQPRNERYYRLLPNQFEK

SEQ ID NO: 1032 - protein, 183 aa, Lactobacillus paracasei
MTVQTEYQQAYNKRLAAIEADPRLTVLSSMNQPQDAAQKKVSQYIVFTDFKFDEQKQKTNSIYVYTPFENVDKYGHSKADYQSQLLFETNRWDNGMHITVLETLGSESRLAFYDFENMGLAQLALKAFINLATKADIAQVDGTISSFDKVNLTKLRHIFTKFGFTIKLTDPQTGIGKISRKMQ

SEQ ID NO: 1033 - protein, 558 aa, Lactobacillus paracasei
MAEEKRYGADLIVESLTNHGIDYVFGIPGAKIDRVFESLEHPKSEKSPQLIVARHEQNAAFMAAGIGRLTGKPGVVLTTSGPGASNLATGLVTATAEGDPVLALSGQVKRADLLRSSHQSMRNADLFAPITKYAAEVQDPDNVSEIIANAYQAAESGKQGASFVSIPQDVTDSPVNSEPIKPLVAPKLGPASPSDMTYLAHAIKEASLPVLLLGMRASSSDVTAEIRELLSVTELPVVETFQGAGIISHRQIDNFFGRVGLFRNQPGDMLLQHSDLVIAIGYDPVEYEPRNWNADGKARIIVIDDVPAEIDHNFQPETELIGDISQTLDILVPLLRGYQVAPGSKRYLEDLQAKLQDSDVPPAIADQKVLHPLSIVAALQERVTDEMTVAVDVGSHYIWMARHFRSYEPRHLLFSNGMQTLGVALPWAIAATLVRPGKKAVSVSGDGGFLFSGQELETAVRLHADLVHIIWNDGHYDMVKFQEEMKYGRAAGVDFGPVDFVKYAEAFGAKGLRVNKPSELGQVLDEAFATPGPVLVDIPVDYSDNAELGAAMLPDQIY

SEQ ID NO: 1034 - protein, 236 aa, Lactobacillus paracasei
VNTDRLYQHGTLAMLVPGLFAGTQKIEELLQHGNTGIGTLTGLDGELVIIDSKVYQVNAQGAVREVGSEEEVPFANVHYQADKSVGKLQGLDLSGFQKTVLERLQTANLFAAVRVEGRFTQMHTRAVLPQQPPYPTLTETASGQKEFNAENIKGTLIGYYSPDLYAGAVSPGFHLHFLDADHHMGGHILGFELDSGELFLQKFSDFQLHLPTTNDAFLKQKFDTATLVADIRKAEN

SEQ ID NO: 1035 - protein, 47 aa, Lactobacillus paracasei
MNPNRNGLNARCAVAKGVDAEMPDLFRNPTLGQLDNIRWTVANIAGR

SEQ ID NO: 1036 - protein, 484 aa, Lactobacillus paracasei
LAQSESNQVKRELKTRHLSMIALGGSIGTGLFVASGSAIATAGPGGAIAAYVGIGLMVFFLMTSLGEMATYVPVSGSFSEYASRFVDPAFGFALGWNYWFNWAITVAVDVSTTAIVMHFWLPDVPGWLISMGFLALIFVINIISVKSFGETEYWLSLVKIVTVLVFLVVGLLTIVGIMGGNGPIGLKNYTTGAAPFVGGLPATLAVFVVAGFSFQGTELIGITAGESATPETSIPKAIKQVFWRILLFYILSIAIIAAIIPYTSPNLLGASVDQVAISPFTLVFDRIGLAGAASVMNAVILTSVLSSANSGMYASTRMLWAMGGSGFAPRVFQKTNNRGIPVAALLLTTLVGAFTFLTSIMGPHVYQLLVAASGLTGFLAWLGIAVSHFRFRRAFVKQGHDLSELKYHAKWFPVGPILAIIMSLIVIVGQDLQAVQNFAWGRLLVSYMSIPLFIVLFVWYKVKHRTKMIPLDQVDLSAHRDHRN

SEQ ID NO: 1037 - protein, 219 aa, Lactobacillus paracasei
VTTDFTKRLLAFLNAHVRPDSDFDVYHEHELVLNLARIALNNEFLGGDFMHIVDYYQPEGLPYTETKLYHTLQTFIAGLPDTPAYRRFLGKNAGFLRIIHYLLAPYLRYFSETPVVQVKLVYLGHDLLNRRLVNFLDDLSVVDLLPDDAPCQEADLVITSVDNEAAIRAAAPSDFKGEVATWIIDDDDSAIFQLYMLIRRLYLGKTASARSSETGTFKW

SEQ ID NO: 1038 - protein, 290 aa, Lactobacillus paracasei
MLYEQTFLDRADLQKFQMFAAIKDTNVQTYTINTLSQHLDLSYQQGYNILQELFRDLTVLTKHPEKMKRKQISLLVDIDITVDDYHLYLLQHAIAFQFVDYIVQANHPSTDKFCRAHYISRSTLVRKTSALRNLLKRYQLKLSFSDLGFAGQESRIRLFLFAFYWIGYHGVDWPFKVLDEQKIVQEYTALPSAKKNPVDILEEVLFWAISRVRISGNHFVDGAAPFDKIFDEYSPFQYPVYTKEMFPAYDTRFMKSENDFFYSQQNRTITFLPTDATSDAFIRYLSDKKP

SEQ ID NO: 1039 - protein, 525 aa, Lactobacillus paracasei
MEANHDIFLSMSDAEKLNLFHAIISARIAQTPVRTQLAGDHAHYSVVGDVNLKQIAAITNRNYGSVYNTYTGLVNSLEEILGRKHASTKMLFAIPIDEFRYDLVKKSNPYRFLDAVLYKRYQNFDDFLMASDSSKATILRHLKPIRGYAKTSGVQFSYETLSFIGSELNIRIFLGLTYWLATNGADWPFENMTHERASEILDAVLKAFKGGDVNVVTRELLLYYIAVAHQRILTGQVLTHDPDSQILRYPMPNLFSPIAEALTDGHPVLDGLSEQQQQGESDALYFLFNFAPLYIVSDGPLERRVIERYNRYNPEIYQLIQAFFACFPYNFKLHLQLPEETYNLLLANMLSVTVSVLVFKKDFTTTLLAEFSSNMQQTKDDPAFYAQIKATLEKVVDEEHLESFDGYIDVLAEALYRNLHQLLIQFQPPKKIVVAPVVEQTITGYIDLLAFLHAIPFVELASPNANLKDADLVITTSVAPVKKVAGKAQIFPWHINVSNDHYGQLYALLRELWDKKVLEDARFIY

SEQ ID NO: 1040 - protein, 427 aa, Lactobacillus paracasei
MLDLKLIRQKPEWAKEKLAARAIKGEEIDELLALDTRRRQVTVQTEELKAKRNDVSGQIAVMKRNKENADDQIKAMREVGQKIAALDKELAQLNEKVTYILVRLPNFPADDVPMSLNEDDSREEYKWGNMPTFDFEPKHHWDIGEKLGILDFERAAKVAGSRFVYYKGAGARLERAVYNFFLDEHQKEGYEEIIPPYLVNNDSMFGTGQFPKFTDATYTITNDGEPLTLIPTAEVPLVNYYRNDIIDAEKLPVNFTALTPAFRSEAGSAGRDTRGLIRMHQFNKVEMVKFCKPEDSWKQLQNLIHDAEDLLQKLGLPYHVITLASNDASFTSAKTNDLEVWMPAQDRYREISSCSNCTDFQARRAQIRYRDDDGKLQFVHTLNGSGLAVGRTVASILENYQQADGSVKIPDVIVPYMQGQTAITKED

SEQ ID NO: 1041 - protein, 440 aa, Lactobacillus paracasei
LKSSAEWSTRWPERISYGLSDAADNLIFQMMTTYLLFFYTDVYGLTPSAVAILFVVARVADVVESFIIGIMIDHVHSRFGKSRPFFLWYSVPYVAFAILTFVTPNFSYGGKMIWAYVTYLGLGFLYTAVNLPITSILPTMSQNTRELTLLGVIRQFFGSSVQIIVAVFTLPLVWLFGHGNQQKGFLGTIIVFGIISLFLILNTFVHVRERFSNPHIAHQPVKVVLNMLAHNQPWIIMSIVIFMYWLVTAIKNQTTIYYFKYTLGDEGLVPWANGFTLAALIGVLMIIRLTDHQSKKKTMLHGILIALTGQAIIAAGVYGKWLLVLFAGVFINSIGNGIIIGLVSIMIADTIRYGASMGIQAEGILASTDDFGVNFGLGIGGLITAGLFHVSGYVANQSQNAATLSMINWNYVWIPLVIYAGMYLVLNLYDEQRIIDAIEK

SEQ ID NO: 1042 - protein, 256 aa, Lactobacillus paracasei
MNHLIVTPTALFFAVALVTVAFFISLKEKIGLEKDLVIGVIRAVIQLTIVGYVLTYIISVNRAWLTLLMVAIIVFNAAWNARGRARGIPHAFVISLLAIAVATGVTIGLLVLAKAIAFVPSQIVPVSGMIASNAMVAIGLTYRSLNSQFHDQRQGLLERLALGATRYQTAITVVREAIRTGMSPTIDSAKTVGIVSLPGMMSGLIFAGVDPTKAIMYQIMVTFMLMAATSIGSTISCYLAYPQFFNGNMQLRTPHS

SEQ ID NO: 1043 - protein, 216 aa, Lactobacillus paracasei
MADAIFDIQNVGLTVSRRTLLANISFKVAPGEFVTISGPSGSGKSTLLLLLATLLTPTEGQIIFSGQPQQEYETTAYRRMVSYCYQQPSLFGETVEDNLAFPFQIRQKPVNHDRMVKALADVNLPADMLTKNITELSGGEKQRVALIRNLIFTPKVLLLDEITTGLDAATKDTVHQVMANFTKQGVTIITVTHDESELAAADRLITIVDGRMEVTA

SEQ ID NO: 1044 - protein, 87 aa, Lactobacillus paracasei
MARTKEKLSRAKNVKNDEFYTQWSDIEKEVNAYIEYDKDVFRGKTILLPADDPFESNFFKYFATHNRKRKWGNQKWQMQFLTYKTLV

SEQ ID NO: 1045 - protein, 163 aa, Lactobacillus paracasei
LGVIQLDAHADFAGKRQVKLLDIDHANFWSQLEVDSSINPILKFGVREVVPQSLHNDSRAGIFSVDQFLENIVSTIAKSPKIPYFLSIDVDVLDPSIISRTGTPVPNGITFKQLNRAISLITSKVNIIGADIVEFMGENRVENGIVANILLDLINDLASDDHE

SEQ ID NO: 1046 - protein, 445 aa, Lactobacillus paracasei
MNEKELFHAIVDYSSLEINEKDKAHHFFSSVENNDPWFALRKAIIHNHLSILVDHFRSPIQTQHEVEQIQLLTDADYNYERGSSYPDLESRFHRLLPSYSQSQTFFHKRTLLFSSGMAAISTALNFGGHSLIPARKKKLLIFGTYFETKMLIRSLGSSFFPYFCNSWQEFSSQLALDFYDVAYIEPLAWNHKIVKFDESNLQQMLSSLNLKNLRILIFDTTLSGVSEFDTLKLFKNANTNLNCLIFTISSMIKTNQFGLEFTNAGIMHLFAQKRTFYLSTFEKIIEHLQKLRSTTDQSLSSLSMSILTEPFLSEPVLVSSYTNLIKTSNALFYSIFTESLKESFCTVETSLDPRPELTAPFSLISLKDSEYSKYQALLKKVFLLVKANGLCVDPGTSFGFQKTRIDLIRYNIENDVNYLRVSPGAFVSDHKQLVEIIQEKIGGNT

SEQ ID NO: 1047 - protein, 388 aa, Lactobacillus paracasei
MWEGEVVKETFLKSLDFKTSPALIYDIDSIKSKSLQTLKILNKFPTWQLYFSMKASRSPIILQTIASLEEIGIDVSSVYELQFAKTFRFKEISATGPSFNTTAIEGLSQNSQLRFYFDSMEQIRAVPISLMRHWHSGIRISVPSNLSRFDYSRFGLSREDIKSINQTPTLSCLLRHVHVHFEMTSIDEWKRVVKHISSVIPNPSNVYTIDFGGGLINLAPTPAHLEQSLSEMNEYIVRLFPNIRKIIIEPGDFLVINAGFLKTTVVTIKQVSSNVSLLGVDSSPWSLAPWTKLHVINLTSIFKQGLPRKTYRIFGNTLFEGDWFMDNSRQSPRTFELPTVGVGDSLLFSQFGAYTMSTYRPFHLLPAPKEFSYQHNSINNSKETGCHE

SEQ ID NO: 1048 - protein, 332 aa, Lactobacillus paracasei
MNDILINVEDLVMNYKIRDDSKKNPLSFFKTSYSEVHALKNVAFQVRQGDIVGYVGENGAGKSTTIKILLGILKPTSGSVSVFNQNPFKKRQSIAHSIGALMGQKSQLWWELPLQDSFNLLQEIYNVKSSSDNSWINNMIDLLNVGDFLNQPVRELSLGQRMRGEFIATFIHQPKLVILDEPTLGLDVSTKKSILEFLLAVNQEYQTTIFYTSHEMKEIENLADRVLLLDGGTLQYNGQMNTLLGMFSQFRIVKAGGVSKNASFKILGLDLYRRNHDSTDFILDTAKSSENLALASLKQHFPSTPITVYPIDLEVILSLKEDNTKWTKFGVG

SEQ ID NO: 1049 - protein, 261 aa, Lactobacillus paracasei
MDKIWSRLTLVKTQFRRQTYYRFNTLMTIAGALMAATVQFFVWKSVSLWGHSDVEHISQYAIFATSYALLIPTAPVARRISQSVMKGTVAYDMIRPISLFNLSLFLQIGHFLFTLLTVSIPLSISYHFLFGVKFPFTLSINSLSILCASFFGLFIAFEIGYSIGLLSLITTRTGGFLSMFDGLMIFLGGAYLPLNIYPSFLKDLTSLTPFASIQYFPLQGLSNGSVPSWQLITQLFWLALLICITNIQESKLRQRLKIAGG

SEQ ID NO: 1050 - protein, 262 aa, Lactobacillus paracasei
MFRYIKIYLFFFRTDIKRIKMYRSNLIASSLGYLTESVATFFSIWLIFSQTNVLGQWKSSEMFALFAYTLLLMTIWEFFLVNTLEIPYLINNGELDVFLLRPVSLLYQFIIFELDEEALFELVTSLGMLLFAISISGPNISIMSFALFIGGTLSAILSLQALYLAISSSAFWFQSADGLRSIAYQVLQFNRYPLSIYPRLIQTLMTILPFGMYGYFPLHVFLFPNTSMYEILYSLLAGPVFLLISYNLCWKQGLKKYSSSAG

SEQ ID NO: 1051 - protein, 223 aa, Lactobacillus paracasei
MFIDTANLDQVKEMLSFNQFEGVTTNPKLLLKEGHPRFEQLGKIRDLKPGVLFVQLVGDTEEELLADYHELRKRFPDNDDTRMAFKIPLFEPGYRAVSAIRAEKPDECLLGTAVYSVRQGFMACVVDCDYIAPYVNRMEQLDIDPYSVIAETHSFYKSTDTHIKIMGASFKTASQVMAAIKAGAENVTISYDIFQQLMTNAAANDAIRVFNEEGHQLDKTAGI

SEQ ID NO: 1052 - protein, 126 aa, Lactobacillus paracasei
VSSIAEIVKYETKILEVGSEARGFKDINMAILFGDEAPDALRSSCFIINVNKILEPIEAGDVMTFGDQVYKITAVGNEVNTNLGNLGHTAIVFDGSTTPELAGSLYLEEKAYPELDVGTTIKIAKA

SEQ ID NO: 1053 - protein, 372 aa, Lactobacillus paracasei
MADQKWHSIQVVKGSGGYGGPLTITPTEQKHKFIYVTGGNRPAIVDKIVELTGMEAVDGFKTSIPEDETAVAIIDCGGTLRCGIYPKKNILTINVLPTGKSGPLAKYIVPKLYVSNVDVNQITALPDDAVPDQSLNGVPFDQRGEAGKQHAALAASAASQATATEAQTTEAKDEAAAEAREAKFDTNKTITAQMKKPNFIARIGIGAGKVIATFNQAAKDSVQTMLNTVIPFMAFVALLIGIIQGSGLGSWFAKLMTPLAGNVFGLIVIGFICSLPFLSPILGPGAVIAQVIGTLIGVEIGRGNIQPQYALPALFAINTQNAADFIPVGLGLEEADSKTVEVGVVSVLYSRFLNGVPRVVVAWLASFGLYAK

SEQ ID NO: 1054 - protein, 189 aa, Lactobacillus paracasei
MQYVSDFAAGFMKLFQTGGKTFISWMTSIVPVVLLLLVLMNTIIAFIGEERIERFAQKASRNVLMRYLVLPFLAAFMLGNPMCFTLARFLPEYYKPSYYAAQAQFCHTSNGVFPHINPGELFVWLGIAQGVQKLGLNQMDLAIRYMLVGIVMNFIGGWVTDFTTAYVSKQTGITLSKTVDLSARNGQEA

SEQ ID NO: 1055 - protein, 169 aa, Lactobacillus paracasei
MNVLILGIFIAAAFLLQALMGYFQIRNFAHNYHEVRQDGRVLIGKNPRRFRQGSLMLIGLDHDDRIQEIRVMKGLTVFSRFRDVNQFDGELVAEVGADYTALQKLSRTERECFLNAYRNYVNYKTNNLSFEDFDTSRVSMFSLPIFNEIGIKMKAIPQMLTNVFKKNTI

SEQ ID NO: 1056 - protein, 637 aa, Lactobacillus paracasei
ABCHPERNREGLATRLNSLDYRLLRYLLANGTSDLDELAESENVSTRTMQKYIHELGESLGDAAEIRINKNGYFLHILDYRQFSLIQSGVFKQNIDNNDKQKRQAEILFRLIKERQFIPMDEIADQLTVSRGTLLKDLEACRAWLKNYDLQIEGATSRGVKLQVGSTVDLTMLIYNHLFDYVQSRIFTDKTLVASVVSRLNSAKIKTSTTQIFEKIMQIIVFLKKHHYVFSGISPYYTNLMDDSPLFINIVGDIEDRCHVSFSQEEYDFLAFPFNLYANKLLSPAKLKVKVHENKAMFDQIASEVRALVDAKIDYDQFYETTKYHLIFLINRGIFHISPSDYLTDKMLQRFQLAADMAILMIDKLEEKMGIHIADVEINYLTVYFEMALQHADVNVPDQPRVGFYSNMGQSVLQYLQNQLNTMFESQVTITAYQDEEDILKHQDELIMVFTDRPLAHKLRIPVVMIGDIFRDRVLETKVRVSAVQHEIDAGRIIWRPQVFENRASMSYEAVLRAALKPDSDAGLVDPGFIDRLIKHESTTKFVLDNGVAIPHAIADIDENRLFLHLSVLKHAIPVGGKAVSYIFVIGIPRVLGKKALEDLSMLYDLLFLLAVNEAAMNNLRKISGSQDPLTVVTEGL

SEQ ID NO: 1057 - protein, 266 aa, Lactobacillus paracasei
MSDWLGLDGKTIVVTGGSSGIGAAIVKELINNGATVVNGDLKEGDFKDPNLKYVHTDVTDPDEVENLAATAEKINGEIWGVVNNAGINKPRVLVDPKDPHGKYELDVKTFEQIFSVNVKSVFLVSQAVVRRMVKQGHGVVVNMSSEAGLEGSVGQSVYSASKGAINGFTRSWAKELGKYNIRVVGVAPGIMEATGLRTPSYEEALAYTRDTTVDAIRAGYSSTSTTPLGRSGKLSEVGDLVNYFLSNRASYITGVTTNVAGGKSRG

SEQ ID NO: 1058 - protein, 242 aa, Lactobacillus paracasei
MLEQLKQEVYEANMQLPKLDLVTFTWGNVSGIDREKGLFVIKPSGVDYEDLTPDDMVVVNLQGEVVEGQLNPSSDTPTHTVLYNEFPDIGGIVHTHSPWAVAFASAHMDIPNLNTTAADTFYGDVPISEALTQQEIEDAYEENTGKVIVKTFKDRGIDHNAVPAVLVSQHGPFSWGATPAKAVYNAKVLEVVAEMDYHALTLTHQDVHLPQYLLDKHYYRKHGKDAYYGQDNAKSVGHAAKA

SEQ ID NO: 1059 - protein, 273 aa, Lactobacillus paracasei
MLKAIALDMDNTLLNSQKEISVTNQDVLRYLSRKGIRVILCSGRPFATLKPFLDQLHLTKNDDVCICFNGGLVRLVRDHTVIKSSTLTKSQIQPVYDLVKEKGFHLDVVAEDQVYSLTEFGKSSYESMIPKQMPFTDTTFAKVPAKLSIFKVVIAGDPEMVDAASEAAQSLEGVTVTRSRRTLLEIMPPNVNKKNGLKAALNFYRIPREQLAAFGDEENDQDMLDYAGIGIAMGNAIPEIKKIADITTQSNDEDGVAKFLIDYFQISPTAIHP

SEQ ID NO: 1060 - protein, 289 aa, Lactobacillus paracasei
LNSLGIYEKALPKTDSWQQRLQQAHDLGFNFLELSIDESDERLARLDWTKAQRAEVRDASWQTGVRLHTLMLSGHRRYPLGSADPAIREKSLEMLYKAIDLAGDLGIRNIQLAGYDVYYESKTVTSREYFIENLKRGVAYAAAKEVMLDIETMDDPFLNALTKIKDIKAQIRSPWLQAYPDVGNLTAWPENNVGQELERGIDNIVSVHLKDTLPVTAESKGQFRDVPFGDGTVDFEGCLRTLKRLNYGGAFTIEMWTEKADDPLAEVKKAKQFFDDLFERVGVEQEPVV

SEQ ID NO: 1061 - protein, 256 aa, Lactobacillus paracasei
VKNSMANVQARREKILSAVDQSEPVAVEGLAQRFNVSITTLRRDLKALSDMGQVKWHHGLVERTNVVTASNHGSRSGIELIKDTIAAVPAYIVKNSTLFVNSSSLCWRAINQLAIMPLTIITNNIKATECVRHPETSIILTGGEIRYPKESLVGTVAMQILETMQSDYTLIGCDGISVAGGVTTQNIYEAQINSTMISRTKQKVICVADYRKVGVTSNYHVADLTGVDILITDNFANEKVVRDLRRQGIDVIQVSN

SEQ ID NO: 1062 - protein, 213 aa, Lactobacillus paracasei
LAKPNLQVALDNNTLESALADVRAVGNIVDIVEAGTILILQEGTIAVRALRALFPDKIVIADTKCADAGTTVARNMGDAGADWMTCICAATIPTIQAAQKEVKEIQIELYGNWTKEDAQSWLDIGVTQAIYHQSRDALLSGGSWGEKDLAKVKMLVDMGFRVSVTGGLSVDTLKLFEGVNVYTFIAGRAITQAPDPAKAATDFQNEIIRIWGK

SEQ ID NO: 1063 - protein, 101 aa, Lactobacillus paracasei
IICBMKILVSCANGSGTSLMMMRSVQKAFKRLNIPITQIEHTNLAEGKSTAKQYDMVFTTTNFVDMFKDAQSKGVQVIGVKNVMSDKEVEQHVREDTDLVK

SEQ ID NO: 1064 - protein, 506 aa, Lactobacillus paracasei
MQQILDFLVKIWDYFASNILTQPAYMIGFIVLLGYILERKPLYESIAGFLKAVIGYMILMVGSGGLVNSFRPILTGLKDRFNLTATVIDPYFGQNAVTEGLEKTFGRTFGDVMLLLLFAFVFNILLVRFQKWTKLRAVFTTGNVQVQQAATAFWILLFCFPKMGRIEVLLVMGVVLGLYWAVGSNMTVRYTQDLTDGGGFAVAHQQMFGIAFVSWLADKFKAREVKAKKKARRLEDIELPGFLKIFNENMVATGILMLFFFGIIMLILGKSYFVGVFAATKGASGLAPNASFLFYIMTTSLGFAVNLTILQLGVRTFVGELTESFTGISDRLLPGSVPGIDVAATFAFGEPNAVTIGFLFGALGQFLAIGALLIFHSPTIIIAGFIPLFFDNAAFGVFANRRAGAKAAMILPFFSGLIQVFGAALISTWIGLSKFGGYLGMFDWDTVWPFFTVLMKILGIAGIVVVVLILVLIPQLEYRHDPKNYFLMVTDYEQYKENMAKKKVTK

SEQ ID NO: 1065 - protein, 152 aa, Lactobacillus paracasei
MLLKDFLEKDLVDIRPEPAKDWRDALQQAAGKLIEHKYILPGYINEIIANVEKNGPYIVIVPGVAMPHAMAESENVLGTAIGFAKFPEPVIFDSDDPDKQAQLFFTLAAKDPKQHLQNIGDLSDMLMTEGLIDKLLAVNSVDDFKALIDAGS

SEQ ID NO: 1066 - protein, 356 aa, Lactobacillus paracasei
MADKNINNITREKWILSTFPEWGTWLNEEIADKKVKPGTFSMWWLGCTGIWLKTAEDTNILVDMWCGTGKQSHGNGMMRKGHQMMRMSGVQKMQPNLRNQPFVIDPFAIKDVDALFVSHIHSDHLDVNTAAAVNKNCPDAKFYGPEKVCEIWQGWGVPAEKTVVVKPGDVVTIGKTKVKVLEGFDRTALITEDDPNVKLAGKMPQDMNKIAVNYLFETTGGNLYHAADSHYSNLFAKHGNENKIDVALGAYGENPRGITDKVTSIDILRMAESLNTKVIIPVHYDIWTNFMADPKEIEALWQMRKDRLQYKFKPFIWQVGGEFTFPDDKDRMEFMYDRGFHDAFSIPNDTPFPAFL

SEQ ID NO: 1067 - protein, 242 aa, Lactobacillus paracasei
MLEALKKEVYDANMELPKLGLVTFTWGNVSGIDREKGLFVIKPSGVAYEDLTPDDMVVVNLQGEVVEGDLNPSSDTPTHTVLYNEFPDIGGIVHTHSPWAVAFASAHMDVPNLNTTAADTFYGNVPVSEALTKQEIEDAYEENTGKVIVKTFKDRGIDHNAVPAVIVSQHGPFSWAATPEKAVYNAKVLEVVAEIDYHALTLTHEDVHVPQYLLDKHYYRKHGKNAYYGQNSAKSKNHALKA

SEQ ID NO: 1068 - protein, 356 aa, Lactobacillus paracasei
MVDMMKAAVLMSAGDVQYKDVPVPEISDDDFLIKVAYSGVCGSDLPRSQKENGARLYPLIMGHEFSGTVAKMGANIKGFKEGEHVAVAPLLPNPDSIYTKMGLYGFSEHYNLIGTGSNGGFAEFVRVPKGHVLHLPDSVDLKTAAGIEPATVSGYGLARGHIQAGDTVAILGCGSIGQFAIQNAKLYGASNVIAVDIFDDKLELAKKLGADYTINGKTQDVVAEVQKITKHGVDVAVDCAGTRFTEIEALEITRRDGNVVFVGISGDNLPIEKDVFEQHVLRGGLNIHGSWMSYTMPYPGRAWSIVIDAMSKGKMDFKSMISQEINLNELGDTLKKMYNKEIEFNKVIVKVDSSIA

SEQ ID NO: 1069 - protein, 481 aa, Lactobacillus paracasei
MLTTVKLVFDTFGANVFVPVILFFIALILKVKTQKAFLSALYAGVGLTGFTLLLNSYTPIISKVIKKMVSDTGVNLPVFDIGWQGASLVAYSTQAGMIFLVVAFILQTVLFLIRWTDVFQPSDLWNNYSYMVWGSMCFYVTKNMWLSLLLMCLLNMYSLLLSDSIAQRWSTYYGYPRTTIIALHNLEPAIFGILMDPVWNKLGINKIKLSPEYLQEKLGFLGEPISLGFFLGFLLGILGNFKHLGELASWGQITQVAIATSAIMAIFPKIAGIFAQAFAPLSQAASRSIRKSNKAKGSENQAEGKKPRLWFLGVNDAVGFGETATLITGILLIPIMVVLAILLPGNKVLPVIDLLAIPYWIEGLIALSNGNMVKTMINSVIWFSLGLYMCTATAPLFTHIASSGIGVAIPTAALMVTSFNILGKPFFGLIFYAFLSQNIFWIGLTIVLYLILWAAFQKNKDAFRAYLERAAAKNATAATDN

SEQ ID NO: 1070 - protein, 104 aa, Lactobacillus paracasei
MSKNINLLAVCGSGTVTSSMIAGEIQDELGDEGYSVRATEARPTEAKQLIDGGKFDLIVYTSPLPKAEYGVPVINGTGLLTGIGEDEFWDELKKTVAKIIDGNK

SEQ ID NO: 1071 - protein, 169 aa, Lactobacillus paracasei
EIIBCACMPNENTMNLKFEQQFIYPNLDAESYADAIRKMSKNLLKAGFVSPEYPDQVIAREKDFPTGLVLANMNIGIPHTEAEFVSQTVVSVATLNKPVEVHSMIDPDETLQVSMMFMIAVSDPKGQVKILRELMRLFQNQDLMQKVMAENSANEIYQLLTANIVKETE

SEQ ID NO: 1072 - protein, 795 aa, Lactobacillus paracasei
MDQTIEKSTDYSSDAYLTEVDKYWRAANYLSVGQLYLKANPLLKQPLKSSDVKVHPIGHWGTIAGQNFIYAHLNRIINKYGLNMFYIEGPGHGGQVMVSNSYLDGSYTEIYPKIEQNEQGLQRLFKQFSFPGGVASHADPKTPGSIHEGGELGYSILHGAGAVLDNPELIAAVVVGDGEAETGPLATSWQVNKFLNPITDGTVLPILNLNGFKIANPTVLARESHEELTAYFKGLGWDPHFVEGNDPDKMHILMATEMDKIVEEIQGIRNNAKNNHDEHRPAWPMLVFRAPKGWTGPKEWDGEPIEGSFRAHQIPIPVDQNDMQHADKLVQWLQSYKPNELFNDDGTLKDDIKAIIPKGNKRMSMNPVTNGGSLAKHLEKPNPSDYALDNKDHGATEGQDMMVLGAYIRDLIKLNSNNRNFRGFGPDETLSNRLNKVFEATKRQWMESTNPPYDALLAPHGRIIDSMLSEHMDEGLLEGYTLTGRYGFFASYESFLRVVDSMLTQHFKWLRNAHEEASWRADVPSLNVIASSTAFQQDHNGYSHQDPGVISHLAEKKTEYIRAYLPADANTLVRVFDKTVDSKQTINLIVSSKHPRPQWFTDTEASNLVEKGLGIIDWASTDQGVEPDLVIASAGSEPTLESLAAISILHKSLPDLKIRFINVVDLLKLKKDDPRGLSDAEFDMYFTKNKPVIFAYHGYDDLIKDIFFDRHNHNVHVHGYREEGDITTPFDMRVRNELDRFHLVKEAILDVSSIAEKGAHLDQQMDDILQKHHDFIREEGTDLPEVEQWQWEPLR

SEQ ID NO: 1073 - protein, 251 aa, Lactobacillus paracasei
MEIDERRHSILNEVNQNRNVKISTLSKQMDVSRETIRKDIYSLAKQGLVSAVRGGAEAIVDDPTSRFDQRKAINQQAKQKMAQRALSYIKDGATIFLDSGTSSYEVAEALKQNPRHDLSIITSSTFVAQTLLVMQSIQIVLLGGVVRRDEGSVSGPIALQAIDSIYADVGFFGCGGINDVSGITNRYLEESQTAKAMKQHCRTSIVLADHSKFGASSLVSMFKLDDVDFIISDPGINRDLARQMGVDNLVI

SEQ ID NO: 1074 - protein, 104 aa, Lactobacillus paracasei
MSKRINLLSVCGSGTVTSSMIAGEITDNLKGDGYHVIATEARPTEAKQLVDSGNFDLIVFTSPLPKAEYGIPVINGTGLLTGIGEDEFWDKLKATLTDMEKEKA

SEQ ID NO: 1075 - protein, 299 aa, Lactobacillus paracasei
MQYLAIDVGGTTTKYGLVSATGALSQQGEQPTMRASLADFMASLTGLIRLHKAHVAGIGLALPGVIDSQQGLVKASATLPFLEGLVLGTQLTTAADLTVPILIENDGNAAALAEHWRGNLAGTMNSAMVVLGTGVGASLFLNGQLYHGSHYVAGEPSFMVTNGLNPITREQTAAGLSAVATINAMADALGVHEEPIGQRVFQALTDNTSEAAVILRTFTRGVAAMIYNMQTVLDLEKVIIGGGISAQPWVIKEIRDGIEAYQQVTSLSARTIRLPVVEPAKYRNAANLIGAVAPLVVRD

SEQ ID NO: 1076 - protein, 320 aa, Lactobacillus paracasei
MSNETWGAIATWRMAHDGVKKASQILQNKGSAADAVEELIKMVEAYPYYKSVGYGGLPNENGVVEMDAAFMDGDTLAQGAVAGIHNVFHAVSVARALSHEHYNSFRVGEGATQYAQLNGFEMRNMLTERAKKRWEKRRAEIADAKVKPYDGHDTVGAITLTPTGSMAAATSTSGLFMKRPGRVGDSPLSGSGFYVDSEIGGAAATGLGEDIMKGCLSYEIVRLMGTGRTPQQACDEAVYPFIEKLQRRYGQAGEFSLIAMDHAGHWGVATNVEFTFSVATTHQAPVILMAHPGPNQTTTIEPITQEWLDAYEKRIKAPIE

SEQ ID NO: 1077 - protein, 446 aa, Lactobacillus paracasei
MEKATLAAMYDTHRDEFLAALRQVMAVKSVRGQQAEHAPFGSGPRAVLTAVAQLGAAYGFKTAVVNDAMAYVQWGEDDQHYIGIVGHLDVVPAGDADWHFPPYALSEKDGRLYGRGVLDNKGPSMACLIGMKLLKDAGFQPKKTIRLIFGSDEESGSNDVPLYLASEAPPEFGFTPDCKFPVVYGERGIVNYRITTPIAPASIKQIGAITGDQARDHVPDKLTMAVNGQPITANGIRVPTNAPEKGVNAITELAKKLVTEQLVIGELASYCQWLIDSLAEKHFGEGLGMAFEDADSGRLIVTPYSLQKTDDAMTLGLAMRYPVTYHEADVSKALAAAVPAGSQITIVRSMPSVLHDKHDPRIAQLTQAYEKMTGNDGTPVTTTGATYAREMPNIIAFGPSFPGQKGIAHKEDEWMDEADLKLNMMIFMDAMIGLTERDPTRLETGA

SEQ ID NO: 1078 - protein, 239 aa, Lactobacillus paracasei
MAKFEDVANELSRRVRDGVYTTSQRLPSEYDLAKEFDVSRLTVRKAIDLLIRQQLLVKSPGKGTYVMTYSDKVESGRLGLQGFTEAAKAYGKKSRTEVISFGPLDPVPEEISRVLALDTRVNKEIDMLVRRRFWDEEPMTVEHVAICHEYVAGLKPHDFEGSLFALLEKRVAIAYSHQEVEAMLMDKKMAKLLHGKKGDPLLRVHSVTYTADAKPILFDTSYYRADKYSFKSTLTRDTH

SEQ ID NO: 1079 - protein, 527 aa, Lactobacillus paracasei
LTISIDALSPFELSLYLEKQIQSAPDAPILNAGRGNPNWTAPVPREAFFLLGQFAVQETRKSSSALVGKQIKAAPERMGRLQTFLTTHPGPGADFLNWICQTDQQLLGMTPAAWVSAACDAVIGDNYPAPVRCLSVCEQPLKAYMIRELFDDRQVPLDVFPVEGGTAGICYLFDTLMHTGLLAAGDRIALLLPTFAPYLEIPKLPHYAFDVVRIKAQRVTTGDRASYVYPQAEIEKLRDPKVKAAFVVNPSNPTANAMGLENISQIEAIVNTDRPDLMILTDDVYGTFVPHFLSLFAALPHNTACLYSFSKYFGATGWRVGAIALAKDNVFDELIDQLPKAVKAKVSARYQSIASESTTVSFIDRIVADSRDIALNHAAGLSTVQQVMIALFSLYGLMDEGQAYKDEVVATCRAREQQLFSTLGLTRPAPARDTAYYCDIDLLAWGTQRYGAVFARYLKQHWTTTRLLVALAQQQHLMLLKTSPFGSDTWSVRVSLANLPTHDYAEVGKRIIALFDHLQMACETEAK

SEQ ID NO: 1080 - protein, 400 aa, Lactobacillus paracasei
MSPSTPVHEDKRSPMLALGILSISFLMSVSNAVSGTIPLMEKYFSDVSRPNVELLIVIPTGGVLLGTVISGLVSNLLGKKYTVIAGLSISLVFGIIPAFIFNYPAILISRAMFGVGMGIFTPLSVSYITDLFPEETRNRLLGWRNSVGAIGDSIMLFIAGFLINISWHTTYLVFLFLLVPILLVMFFVPKHYDNIVSEDGKEVEEDVKVKPTTNFGVIQLAFIFLLVCLFYSAISLKLASYVVNNHIGSAAAATRIFGFLVLCSIFSGLIFEKIAKWFGKYTVTIFYIITAISMIVMAFTTSIPVLLVLVLAAGFCNGIINPALTARMVHYSPKGSMNFTTSIIIIGINIGFLIAPYFFQFFGEMIGNAGPANMILWSGIFYVLLAVYDLVVVKKDKLTI

SEQ ID NO: 1081 - protein, 344 aa, Lactobacillus paracasei
MNDNVAWFKQAKYGMMIHWGLYSLLAGEYRGESSSAYAEWIQSKFQIPNAEYGNLATAFNPLYFDAKKIVALAKQCGMQYLVVTTKHHDGFAMYHSKVDAYNVYDATPFHRDIIGELAEACQKAGLKFGLYYSQDLDWHDPNGGGYKSNDVETAGTTWDNSWDFPDEDQKNFDLCFENKILPQIKEIMSNYGDIATAWFDVPMTLSEAQSQTIYDTVRELQPNCLINSRLGNGKYDFVSLGDNEIPKNKEDMNKTDVDYNEITGFKPSPLGLYETAGTINDSWGFSYHDQNWKTPRTLYRYKQHLNDFGINYLLNVGLDPLGRVPMMAEENLLAAKALEDDATR

SEQ ID NO: 1082 - protein, 165 aa, Lactobacillus paracasei
MTTTNNEEIRPITPADDAQVAALIRECLKAANLDKPGTVYFDTGLDHLSEFYAAKPNRQYFVAEREGQILGGVGIAEYDPAHKVAELQKFYVHGKLQGHGLGKRLLRHALAYAQQVGYQSVYLETYHTLATAVHVYQEFGFNELPGPLITAQHSLMDQFLVKKIQ

SEQ ID NO: 1083 - protein, 190 aa, Lactobacillus paracasei
MYELSILGALMSRDMSGYKLRQVLGSNLVPRREISNGVMYPVLQQLQHKGYITMSLAENSPRHEKVAHITDIGQKHFYALMAAPVPVDAKRESVYLFKFRSLAAVDFAEQLQILTEYENVNDQDLNVYTTLQKHLQQHTKPGKSDPALLKSTINTLELNIALCQTKKQWVAQTRTRILQQQTTEGGMHHA

SEQ ID NO: 1084 - protein, 524 aa, Lactobacillus paracasei
MPNATMITTPKRHQWLALTAMSMGVFMGLLDVTVVNVALPTMVNDFNTNFTNLQWVLNAYTLVYAVSLLIMSKLGDMYGRKKVFLGSLILFVLASAVNGMASSLIVLDIGRGIQAIGGAGMNSLSMALVASNFSGNKRGVALGILGSVIGMSTASGPLIGGFLVENFGWPSIFYINVPVGIVAVIMTLTFVNETPSYGQHERIDFAGMLFSGLGLFSLIYGLIIKEGHPHWSWMDIRIGGWIIAGFILIALFIWTESRVQQPMMSLNFFKQRHFVGTIFVAFALGASLYSFNTFLTALMQNYIGYSALQTGVRQLTISGWSLVLGPISGYLGTRFSKKRMISASLLVGACGFLVMLNAMGPRVSFMDLMPGMLMIGFTNGIVSPLINTVGMEGVAPQQMGMASGLLNIFRQLGIVIGVVGFGLMQATQYENYLNTHIHTVGMPSQMTTGIHAALIKAGPFSGHTIAWSKRLTETPFAQKLQSVVVHAYDNGMAAVLIAALVVILIGSLAAAVLMRKESHADVHA

SEQ ID NO: 1085 - protein, 183 aa, Lactobacillus paracasei
GNATFAMILYPRTEINMKLEPIDRWRSATTKLFKELWGSDDMVLSGIVYHLNELAGFVAIDEQNILGMITYLDRGNTLEVISLDSLRANQGIGSALLQKVETTAVLSHKTGVELITTNDNLHALGFYQRRGYRLTQLFPEAVDQSRKVKPQIPAVADNGIPIRDELRLLKNILARSEGMRAEE

SEQ ID NO: 1086 - protein, 167 aa, Lactobacillus paracasei
MLKDGLVVIDVQYGLSAAHHYKQLLANINQRLDAYHAADHPIIFMQHTDESMPYNSHDWQLDTQLHRAPSDRVILKYHSDSFFQTGLAATLHGLHVQTIEVAGLQTEYCIDTAIRVGHDLGSKAATIHGLNSTFDTPDLSAQQIIAHHEGIWDGSFAEVVRDEGVKL

SEQ ID NO: 1087 - protein, 484 aa, Lactobacillus paracasei
VDYFKTSIDQLHEQLRSGEVTSSQLVDETLAGINQLDAEVDAFLALNADGAKEKAAAVDAAGIADDQPLAGVPIAIKDNIVTKGVVTTAASKMLANFNPIYDATVMQKLDAAGAINVGKTNMDEFAMGSSTENSAFKTTKNAWDHTRVPGGSSGGSAAAVAAGEVIAALGSDTGGSIRQPAAFNGIVGVKPTYGRVSRWGLIAFSSSLDQIGTLTRHVKDAAQLLNVIAGHDERDSTTADTPVPDFTAKIGRDIKGMKIALPKEYLGKGVDPAVADKIKAAAKQFEDMGATVTEVSLPHTQYAVPSYYIIASSEASSNLQRFDGIRYGFRAKDVKNIEDVYVRSRSEGFGPEVKRRIMLGTFSLSAGFYDAYFKKAGQVRTLITRDFEDVFKDYDLIIGPTTPTVAFKIGEKVTDPVTMYMNDILTIPVNLAGLPAASVPAGFVDGMPVGLQLIGKHFDESTIFQVAAAFEAQNDYLAQIPGGK

SEQ ID NO: 1088 - protein, 98 aa, Lactobacillus paracasei
MISKDSVAHVAGLAKLQFSETELEKYTSQLSEILDMVEQLESVPTQDVPVTTQSIHLENVMRADVAKPGEPVADLLKNVPTKKGTLIQVPAIIDKEED

SEQ ID NO: 1089 - protein, 383 aa, Lactobacillus paracasei
MKKFLTLTLLAGAAVLLAACGKLNFDSGSSSTSGTKTGSYQTTGTVDNSMYQGVIKNGRYQTSSARGLTLQQNDQGENNFNIKSMESGLENLAKAQFPTDKYSFEEGQLLSTATAKSWLKREAKDNKDGLNPVDNGKTDPDTRNPIYLQQILEQDFMVQDGNSMKLGGIAIALGMNKVDYYTKTEYGAQYQTEISDEAIKKQGEAIAAKVVARLRAMSKVPNNIPIIVGIYKNAEQDSLVGGVYTEQTTSKTGTNLGDWKKLDQQNEVLPVVSDHKAINSTVANDFSNFTNQVKGFFPTLAGITAQAHYEGGNLAGMNITVNTQFYGLTEIQSFTQYISTAASKYLPSGVPIEITIQSTQGMQAFVSRSSGDKGFYTHVFGSY

SEQ ID NO: 1090 - protein, 674 aa, Lactobacillus paracasei
VLTKPAAQFTLEEAQAEVEKLRKQLNQWRLEYYTKDAPTVTDNVYDDHYRDLQALEEAYPKLVTPDSPTQEVGDVINSDFAKVQHPIPMLSMGDVFSFEGLSEWDARMQSNVGHPVDYNVELKIDGLALSLIYENGKLVQGSTRGDGNVGEDVTRNVLTIASVPKQLKQPLSLEVRGECYMPKAAFAKLNARQETEGGTPFANPRNAAAGSLRQLDAKVTAARELDTFIYTLIEPEQFNVTTQHEAIAFMQALGFTTNPSSEVAGDMQAIDTYIKKYTTDRDALPYGIDGIVLKVNDLALQAQLGNTVKVPRWEIAYKFPPEEAETVIHDIVWTVGRTGVVTPTAVMDPVQLAGTTVARATLHNADMIRDKDIRIGDTVMLHKAGDIIPEVSRVLVAKRPVDTPPAPIPEACPSCGQKLVHLDDEVALRCINPMCPAQVQEQLTHFASRNAMNIDGLGPKIVAQLQAKHLVKDVADLYHLTAADLAKLDKFKEKSINNLLSAINNSRQNSVERLIFGLGIRHVGGKAARILAEHFGDLDHLMTASQEAIADVPNIGPTIAEAIVTYFKAATVQKLITQLREADVNLRYTGPTKPVVKNSFVAGKTVVITGKFAEFSRPALTKQLEGLGAKVTGSVSKKTDLLIAGDAAGSKLAKAQSLNVPIMNETELLANLKD

SEQ ID NO: 1091 - protein, 751 aa, Lactobacillus paracasei
MVMDAALKGMNDKQSEAVLATEGPVLIMAGAGSGKTRVLTHRIAYLVEEKHVNPWNILAITFTNKAAREMRERVGKLVDAEIARDIWVSTFHALCVRILRRDIDKLGYNRAFTIADPAEQLTLVKHILADFNLDPKRYDPKSILGAISSAKNELVDPQTYANEQANSPFTKVVAQVYAEYQKRLRSDQALDFDDLIMQTIVLFEKDKETLAFYQRKFRYIHVDEYQDTNEAQYQLVHMLAEGYHNLCVVGDADQSIYGWRGANMQNILDFKKDYPKAQVILLEQNYRSTKTILSAANDVIQNNQNRQAKTLWTENREGDKITYYRAQSETDEAIFVIRRIEAEIADNHRKYGDFAILYRTNAQSRAIEEAFVKSNIPYKMVGGHKFYDRKEIRDALAYFRLVVNPEDDMSFNRIVNEPKRGIGNTSVEKLEAFANEHDWSLLEAAANAELSPIAGKARGQLAKFGKMIQQLGTRRKDLNVTEMMQAILEDSGYLSTLRAAHNLEADTRIENLEELLSVTQGFDSRYQPENEDSDIFVDFLAELALLSDQDDVEEDAQEVTLMTLHAAKGLEFPVVFLVGMEEGLFPLSRASMDESELEEERRLAYVGITRAKQKLYLSNAYGRMLYGQRQNNPASRFIEEINPDLLEVIGNTQPKSDIPFINRTDRAFSSPYSRHADQKTATPVTVQAAPTTGAGKTSWEAGDKVKHRKWGTGTVVKVTGTGDDQELDIAFKDNGIKRLLAAFAPIVKVAS

SEQ ID NO: 1092 - protein, 62 aa, Lactobacillus paracasei
MGSVVTLFLNGWASRFRTRPDFETAHFAGSKLCPPRSSPIAAEPARTTGEDSRQIGRETLYI

SEQ ID NO: 1093 - protein, 106 aa, Lactobacillus paracasei
METKYGRHSFFDGGLLAYVGWTILGTLITIFTLGICYPWALTMLYGWKINHTVIEGHRMHFFGSAVSLFGNWIKWLLLTIITLGIYGFWVFIKLEDWKAKNTRFVS

SEQ ID NO: 1094 - protein, 263 aa, Lactobacillus paracasei
MKKFWLGFGLLLLILAAGCGVQHKVAKSSSSAASLRSRKSPSSRSSAAIKQTSMLARLKAKSQTTLVYAPFGDSLSVGLFADSKTSRFTTLFADQLHRLTDKKVTEEGIAEVGKTATNLGVPALPALIAQHPDLITIEFGTNDAVGGATPTALADYRQALTTIVATLQKQTTAELILMTTWSPNHGPYAAADLQFDAVVKQIGQTYHVPVADLATIWQNHDDVTGPAGTAITDFAGNGPRDTFHPNQRGHDQIAALLKKTLEE

SEQ ID NO: 1095 - protein, 398 aa, Lactobacillus paracasei
MQDVLKFCPNCGQPIKPTDDFCPNCGFDLRKARLEAQSTQEPASTSPAEAPKATQSATVAASTQPAQQQVHKRRRWPWIVVGAVVVLLGAAYLGGSMYYGQNRQVAELADEMTSGDADDMAEVAIANDGTPLTESDLKPLARLTKNRLYRSTLRTMIMDKQTNGMVQVVKQGSYLLLFPKYKVKLGTANVTVKTNLDAAAFTMDGNQIQPENRSGSYTIASQLPGLYALKLSGTHEGSTKDFNREVIVPLKGQPEALTLDAATAAKTVTPTHDATSGSSASESHDDDDDDDYDDNGVTKTNRQYPSDASKRNDNHSTDGVVGRWESGDTATFNFNSDGTYTATSNGTPTNGKWEVVYRDGNILNIKFTKDDGSSVVEPFALDDGDLIETNLKIKWDRD

SEQ ID NO: 1096 - protein, 58 aa, Lactobacillus paracasei
MLHSEKWRPLMVTLIVIAAIFAAFFVLEAFSGMGMGFFHSNMMSNVSSWGSHIGGCMR

SEQ ID NO: 1097 - protein, 435 aa, Lactobacillus paracasei
MAYDYSHEPHRTVFLIDNKSFYASVESIERGLNPLRTLLVVMSEQENTNGGLILATSPMAKKIYGLKSNVSRQRDLPVDKHLIVVPPRMNLYIKKNLAINDIFREFVANEDLWPYSIDESILDLTHTWRLFGKTPRAVAQLIQHTIRHRLGLYTTVGIGDNPLQAKIALDVYAKHDPNLIGQISYQTVPDTIWQITNMTDVWSIGQRTAAHLARMGITTMKQLAHANPYALKQELGIIGTQLFALAWGIDRTKISERVITREPSIGNSQVLPRDYSNQVEIEIVIKEIGEQVAARLRHHHKRAGEISLGIGFSYAESEKDGRGGFHQTKRILPTNRDGDLVATLQLIFRQNWHGEVIRNVAVYTGRLAPDTGEQLNFFEPVDQQIKATNLERTLDTIRDRFGFKGLIYAKSAMHGGTAIQRASLVGGHNGGNSYD

SEQ ID NO: 1098 - protein, 111 aa, Lactobacillus paracasei
MAAIAMTKDLKLMMARLTPLFKRRRQTRYWLSLVNQTYTPAYNFFMNVQPKDQRQRSIPLHSLINYDLADLETFIGLLRQHTQLTIEYVGFEEIRWPESNRVIQWRPRRDE

SEQ ID NO: 1099 - protein, 167 aa, Lactobacillus paracasei
MKIAFKLLLWVLVTGVILFPALLLILFVIGLSVVVSGAMAISAVGLVLGIIFVALVGLSIMIPCLLLVIRFMTFRTVNVRFQHHGERVVLPVTVKLTGRTIYHAIYENFRAGRRRGRHLLSAWGFGFETYFHEDLQAYLADQILAQHGPEMAESFVVDERHSYSIAY

SEQ ID NO: 1100 - protein, 144 aa, Lactobacillus paracasei
VKQFYIVDSSMLPEVVGKVIAARALLQNGEVKQVSEAVKQVGISRGTYYKYKDYVFLPDPEMASRKAVISLMLHHDRGILSEVLTTMSQAQASIVTINQNIPIHNWASVVMSFDISALQGTLDDLVTKLGDIRGVSDVHLVSVE

SEQ ID NO: 1101 - protein, 69 aa, Lactobacillus paracasei
MKVQHTYHPHHFSWHFVVVAVIVGFVVFIECWPHVSDNTLMGSALVTGGLCIGSIRMAHHHDKDQEKQK

SEQ ID NO: 1102 - protein, 177 aa, Lactobacillus paracasei
MTIRRIQQNDFADVDALLHAAFNASNRGYNGEAELVAGLRRDPNYDSALEVVAMMDGHLVGYGLMTAASITPDAHMQGVALAPLAVAPEYQGGGIGVAIVTELDMRATDLRRDFVSVVGDRQFFGRLGFQKAAKYKLDPPFPVVTEDHLIKELVPGVLASVRGKVNYPAPFLTQIAN

SEQ ID NO: 1103 - protein, 491 aa, Lactobacillus paracasei
MKMLYQQLIGFFSVIMVTLVIVSILFIRSTTNTVWENGFKQLEQYTDVLKNNAVDENTYVINARFIQNAEEILSDQHVHFVIYDANNVAKYPVSQKGQMPAIKASYWKKLKQGAAVAVPEMMTNPISGHAQSMTIYYQPVFLSEKLLFVIAAFAPVEQIQSSISKTEHNLLIAFVLSTLAAFIISYFIASYQVRRINQLRRATHQVAEGNYDVEVKIKSRSHDEVAELADDFRDMVTSLKASQQEIQRQEDRRRQFMADAAHEMRTPLTTINGLLEGLAYDAIPEESKGKSIELMRNETNRLIRLVNENLDYEKIRTNQILLSKQTFNARTDLDNIAEQLAQKSEEAGDKITIDAPADLPTYADHDRFVQILFNIVQNAVQFTKNGQITIKAKVGYHQTEFAISDTGIGMSKDQMKNIWERYYKADPSRKNTKYGESGLGMAIVHQLMGQHGGTIHVDSTLGKGTTFTLTFPDEATAPKQKQPGADQQTSS

SEQ ID NO: 1104 - protein, 242 aa, Lactobacillus paracasei
MKLLMIEDNTSVAEMMAMFFQKEKWEVVNAYDGEEGLAKFKEAPDSFDIITLDLNLPKMDGMQVAKEIRKISQTVPLIMLTARDTESDQVLGLELGADDYVTKPFSPITLIARIKALHRRAEVGAEVGAEQTTSEPPDGFDVETDHFKLSTKTREAYLDGKQIEGLTPKEFDLLHTLSKSPKQVFSREQLLQLVWDYEYYGDERTVDAHIKKLRQKVEKVGPQIIQTVWGVGYKFDDSGLDR

SEQ ID NO: 1105 - protein, 131 aa, Lactobacillus paracasei
MILLIAGCMQLLMGILLAVFRPRHQSGFWGYTSYLAGVNAESFRLAQRWFCQALIITGALEAGAGWLIHFLAWDNFFIVWLFLAVLLFLPGFVYTETRLKHYLQAHDALPYDYVSPDDAPKPQRKKGFKDL

SEQ ID NO: 1106 - protein, 102 aa, Lactobacillus paracasei
MNDKVKALLSILESAGFSHDDLAGTVAELNDAVNDGKSTSIQLVSPGAAARYIKRINDETVFTARFRHSDEPDLLNNESNDERIENPNQDSCIVVSYDPAKQ

SEQ ID NO: 1107 - protein, 763 aa, Lactobacillus paracasei
LIDVINNQAFHLHNDQISYICALLPNGQLGHLYFGPRLSLTKNDLAYLSQGPSPFAWMANFSDDQEFALGDAQQEYPVYGTGDFRQGSLSVTQDDMPIYPNFVFKDDQLTHTKTRDLHHPTSFGNPALTDVLTIHLEDKTAQLLLTLQYTIFADSAAIVRSATLTNQGTAPVMIQRMLSGVLNLPQGRYDVVHLSGNWAKERHIQTQPLTQGTFSVESLRGASSHEQNPFVALHTAGQPFAAGDTYGANLIYSGNFLDSTEVNEWDQTRLLTGIHPASFSWRLDPKTSFTTPETVFSYSSGGLAGLAQANQRFVARHIIDPQWRQKQRPVVLNSWEATYFDLNEKKLLKLAALGKQVGVDCFVLDDGWFGTRDNDLSSLGDWFTNKHKFPDGLGHFAQEIHAMGLQFGLWFEPEMVSPRSQFFQAHPNWVVRPKKGRISITRNQYVLDFSNPAVVNNIFEQMQKVITETNLDYVKWDLNRSITEAFSPYLEKIGHPQGEFFHRYVQGVYTLYQKLLTAFPHLLIEGCAGGGGRFDLGILFYSPQIWTSDDSDAIERLAIQSGTALAYPLSCMSNHVTAVPNEQVGRSTPLVTRFRVAAFGILGYELDLTKLDARTLATIKAQIAYYHALQPLVLKGDFSLLLPRQSNGQNQVAWLLSAHDRKHLVLGFFRVLADADSRTVQYMKVPLAKSDTPYWVNQHTGPISGDVLQRVGVRLPVQFNGANRAQAQLIGDYQSALLTFDSVASLDHIESQQTDADKQTVAH

SEQ ID NO: 1108 - protein, 289 aa, Lactobacillus paracasei
MKSGKFVGPDRAAVIENIRRAVAAKAFNVKVEEHDPTFSEAQETAIIDHYLHQRQRWTFRVKTLICRLLVNAYAVRVTSDVEVVGVEKIRAIKSGGVITSNHFSPFENMAIRKAVRLAGRHRMYIVSQDTNLAMKGLLGFVMNYDDTIPLSGRPSFLNGPFMQMLTKAFSGHHWVLIYPEQEMWFNYRKPRPPKRGSYFYAAEAGVPIISCFTEIRDLKARENDQLREVSYVLHVLDPIYPDRNLSVRDNSFQMMQRDYAQKRQAYEAAYGKPLTYAFSDQDIAGWDPQ

SEQ ID NO: 1109 - protein, 318 aa, Lactobacillus paracasei
MPQQTTVPIFFSVDDGYVPCLAVALTSIRTNKDPQTDFVINILNSGLLQKNQTRLAALAAPHFTINFIDMDAVTQQISGDTNKLRGDYVTLTIYFRLFIADMFPQYDKAIYIDADTVADGDLAELFTTDLGDNLVAGVADPVMMTYPETIEYIQRDFGVQPGEYINSGVLILNLAQMRQEHFSDRFLHLLKTYHFTMIAADQDYINVIAQHRIKYLPKTWNMQTGVPTAAESGGKLIHYNLFGKPWHYRDAKLAANFWHYAPASGFETDLKQQLAAFTPADQQSDRDSMAAMLKTAVQVCHTDNTILNAIKHGEQVAL

SEQ ID NO: 1110 - protein, 279 aa, Lactobacillus paracasei
MTMNIMFCGDEKMTDGVLIATLSLMRHTDQPLHIYVLTAKLNVNGHAYQPFSAVTAERMADLMRQENPQHRLTRIDITDLFMANPPQANMTTMFTPYCMLRLYADLIPELPDRVLYLDTDIVCRRSFSNLYQEPMKDVDIAGVLDHYGKWWFHHKLTWFDYINSGVLLMNLASIRQDGLLVRCRRLIRHRWLFMPDQSALNIIAKSKQILPRKYNEQHKVETDTVFQHFTTSFRFWPRFRIVTVKPWQISAVHQQLGLHEYDDLLNDYRQLAPKLKEVS

SEQ ID NO: 1111 - protein, 254 aa, Lactobacillus paracasei
MAKVVTYRHLTDDVVAAPDQETEIPDNYRWEPSWRFRIKANLVYAGSWLFAQGYCRSVLHVRNRKALRQAAGRGYFVYGNHTQPFGDVFTPMRVNQSRRVFTLASPANLSVPILGRIVPYGGGLLVPSKLHQLRPFAQAIRRVIKQRHVVMIYPEAHVWPYYTGIRPFENGAFHYPVTTNAPVFATTMTYQARRWRQKPRRILYVDGPFWPDEQLPLKARQQQLEAQVRTAMTTRAALSTATYIHYQQREEADS

SEQ ID NO: 1112 - protein, 462 aa, Lactobacillus paracasei
MQAKKDDKPELARHLKSRHVQLIAIGGTIGTGLFLGSGQSIHTAGPSILLAYLITGGICFLIMRALGELLMSDVNSHTFIDFISKYMGKDAGWVTGWTYWICWVAVAMAEVTAIGLYIRFWLPGVPQWLPGLIALAVLLLMNLVSVGLFGEAEFWFALIKIVAIIGLIALGVFMLFVHYKTPVGYASLSNLVNDGGFFPKGMSGFLMSLQMVVFSFVGIEMVGLTASETKDPHKVIPEAINEIPMRILLFYIGALFVIMCIYPWRDVSPVNSPFVEVFRNVGIPAAADIINFVVLTAAASACNSSIFSTGRLLFSLTLTGKSKSARWTAKLSRRQVPARAIMISTGAIAVAVILNLFLPESVFALVSSVATISFLFVWGMIVLAHLRYKKQHPRGTDFPMPFYPYSNYLILAFLGLTAVIMIFDRAMLSALIFAVIWIATLFTLRRLHADHKAHEDKTKDGI

SEQ ID NO: 1113 - protein, 152 aa, Lactobacillus paracasei
MSLLSVAYLLIAIISVGVTIFDIIQVRIHAQPKVWRILLYLAVAAFSLVLTLQQSQHFDDLVSGAFIVVMFICFACWQKGLADAAMIGGLGSIRLYQNLSGVVLQANAGGTLLLAQAGQVTVLKLQFRQSPTDLQSFLVDKMPPEQIQIVTG

SEQ ID NO: 1114 - protein, 336 aa, Lactobacillus paracasei
LAHEHLEKLYNVLDESTTILHQQLKTSFIAAVIEAGEDLASGNVMQEDGVPNDEAKKKLTALFDQIKLATYEPEEIRQAIQLVLVKAIKVDGIEPNKQVTPDAMASLATFMVTVFAQHLPKKMQVADLAVGTGNLLFAVMNQLHNARQVAVKGYGIDNDETLLAVAGMSSTLQQLDVDLFHQDALDNLLFKDIDVVVSDLPVGYYPVDERAKQFETAAAKGHSYAHHLLIEQSMRVLKPGGLGLFYVPSQVFRSEEAAGLTAWLAKSTYFQGLLNLPEDFFADQKAEKSLLILQKPSSDVKRAKQILLGQFPDLNDRDAFAAFIDKVKDWAAANIA

SEQ ID NO: 1115 - protein, 110 aa, Lactobacillus paracasei
MKIRGSVLINTLILFALLLMLTVGAMQRFRDWQESYQVLEQVEKRQFTEAYNHWREQMSDKSKSEADSSTSAGKESDTSAIRSAPPAIGETKEATKEQLEATRSGIHALE

SEQ ID NO: 1116 - protein, 153 aa, Lactobacillus paracasei
MPKRVDQHIRSRLKGFTLIEVVVSLILLAAVMLLWRPVLLHVTRFTLQDHVLITSLQAEHDLQMFVRDKKLRSVALMSVRVRSPEKAYTINFYQTKHFRGMVRVMGSENGHMPLFTHLTGVNFSKVAQGFRYRLYLTTSQKIDGGVQIDEDTR

SEQ ID NO: 1117 - protein, 106 aa, Lactobacillus paracasei
MGAVLIPKSTKTLTGSLLIEHLAALGVLLLAVGWLMVLVRLYDRVVVESRQRTTAYYAARVALVHLPVPGGETTVQVGPDVWQVTVNTQEVKAHAQKGRSTYTFTP

SEQ ID NO: 1118 - protein, 146 aa, Lactobacillus paracasei
MKRLRGFVMLEVVAVVVVLAGLTLAAVPLGQSVIRRNQETKFLETMREQWELLGMKAYATHKIGTMSVNDEARQVTFSLFNGSKRILPFPPSLKYDDKIPTKTTREPSGKLKGNRSVNFLSQDGYYWHITLQFEWGRFLFQKVPKH

SEQ ID NO: 1119 - protein, 107 aa, Lactobacillus paracasei
MRRKRLRAFTLIEVIAALGVIILLTLALVLTIQGQMKRVESQNLKATVATVNSQIEMAYNEPDADKKSLKTIPDLVREGVITDAQAKDLEKGKATMSGDNPPKFKVP

SEQ ID NO: 1120 - protein, 315 aa, Lactobacillus paracasei
MPLVIQERFCRQSAALIAAGFSLPDVFAYLRVSLPKYRPIWERIETDLASGIGLPEAVGHQALAPILFQQLQLAQVHGDLAKALAVAGDYLGLRVRNRQRIGQLLIYPLVLLGMLVTLQVVVVFGVLPALALPQSHLVHTQLMTMGGGLAAGLLIWLGWHRLTLAQRLQLLQRLPGVRGVMQVYYQFQFTAGAAHFLLAGAEIADFCRHLITVGGPLGDLGARIQQKIQQGAELADALHEAFVPPEVARLLTMGQTHHLVATGLKLFGEQLFLQLQQRLERLVNLVQPLLFLLIGGEILLVYLQILLPLYQSFGG

SEQ ID NO: 1121 - protein, 288 aa, Lactobacillus paracasei
MQSVNELLTIALEKGASDIYYLPSPQGYLIRLRVPTGLVTIAERDSKRGQQEINYLKFMAGMNVAEHRRVQLGAFYQKESAAFLRLSSVADFRGGESLVVRIIKGIPDAAGARHLLDRLLGILLQKRGMLTLAGPTGSGKTTLLYQLATRLAESRMVLSIEDPVEINQPQFLQLQVNPEADMTYPQLLKAALRHRPDVLLIGEIRDRQTAQSACEAAISGHIVLATVHARSAADTPLRLSSFGLPDELVAAALTASAAISLQYRPMIHPVAEVVVFKQVGQADQEVVS

SEQ ID NO: 1122 - protein, 243 aa, Lactobacillus paracasei
MSGHSKWHNIQGRKNAQDSKRGKIFQKLSRELYMAAKQGGPDPSGNPSLRLVMDKAKAANMPKDNIKRALDKASDRDAANYDEVTYEGYGPGGVAILVEALTDNRNRTSSTVRVAITRHGGNMAAAGAVSYMFDRKGYLVISRDDLDVDEDQMLEDALEAGAEDMQTSDEAFEIYTDPKEFAQVRDALEEKGYKFVQNELTMVPQNLTPIPEDKVEQFQAMIDQLEDDDDVQEVYTAGDWPDD

SEQ ID NO: 1123 - protein, 163 aa, Lactobacillus paracasei
VTSFKKHWGLWLAAVLLFVLFFSSSMTYKEQTTVPLLERLLHNEPFKQALSGIHFNYAGEQQSIAEVGYFKFVEFFIRKGAHVSIFFLLGLGLTQGTFMYQKNRWLHWPLMVLSCTGVAAFDEFHQMLTGGRTPLFQDVMLDTAAAAVAVTLMWLWLWRQKRH

SEQ ID NO: 1124 - protein, 601 aa, Lactobacillus paracasei
MSYPINWNLDSIFPGGIDSPQLADRISDVTAKLPQLESKVAAWAPDHDAPEFTDFITLWQLLEDIGKGLATTSSFVEMIASADTANLKTGPVQGQLTTLYTRFQNINNPLAKKLAAMSQAAFDQLTTTSALSASRFGLQEMRDQAKELLDDQTETMINDLAVDGFTGWSDHYTTLSGSLKFPITQDGKTTELSAGQTQNKFEGDPDTKTREQVFNVWEQTWDDHASLFGETLNHIAGFRLTNYRLHHYPDYLFKPLQYNRMQRATLDQMWHTISANKQPFAAYLTRKAELTGKPTMPWYDQWAPVIVGDFQPKTYTFDEAAEFIVNNFAKFSPKMAAFAKQAFENGWIEAEDRPGKRAGGYMTSVPDVKESRIFMTFDGSASGVSTIAHELGHAFHSSILKDMPLLRQDYAMNVAETASTFAELIVADATVKAATSPAEKLNLLDAKMANPLAMLLNIHARFLFEDSFYQEREKGIVSVPRLKELMTTAQQQAYAGGLSSFDPMYWADKLHFYFDNPPFYNFPYTFGYLFSSGIYAKAQASDNFEDDYIALLRDTANMTTEALAKKHLGVDLTQPDFWQQGIDLAAKDAQQFMTLSEGYLK

SEQ ID NO: 1125 - protein, 603 aa, Lactobacillus paracasei
MCGIVGVIGKKNATQILLKGLEKLEYRGYDSAGIYVNDQAGHDHLIKRVGHISNLEEAVTPDVQGVMGIGHTRWATNGGPTEANAHPHVSNDERFYLVHNGVVTNANELKQQYLQDIELQSDTDTEVVVQLIALFAREGLSAKEALRKTLKMIQGSYAFSMVDRLDPTVLYVAKNKSPLLIGRGKGFNVVASDALAMLSETDQFVELKDQEIVTLTADAIHIETIDGKVEERKPFTVKVDDGEVSKGTYPFFMLKEIDEQPIVMRRLVEKYTDDHGNIVLPEDLLKALQQADRLYIVAAGTSYHAGLVGAPLFEQLAGIPTEVHVASEFAYHQPLLSKHPLFIFLTQSGETADIRQVLVSVKERGYQTLTITNVASSTLAREATFMLQLHGGPEIAVASTKAYTAQIAVEALVSKAVGEAKGLQAAKDFDVIHELGLAATGQQALIDQKDRIHELATDMFKTTRNAFYIGRGDDYYASMEAALKLKEISYVQAEGFAAGELKHGTIALIEKNTPVVAIISDPVTAARTRSNADEVQARGAKVLHIAMASQAQDGDQIVVDEINPLLAPLLTIIPAQLLAYFTSADRGYDVDRPRNLAKSVTVE

SEQ ID NO: 1126 - protein, 454 aa, Lactobacillus paracasei
MTKYFGTDGVRGIANKELSPEMAFRLGRTGGYVLTQHKEDASRRPLVLVARDTRISGQMLADALIAGLLSVGIEVLDLGVITTPAVAYLIKIQGADAGIQISASHNPVADNGIKFFGADGYKLSDDTEEEIEALLDAPEDKLPRPAAEGLGTVDDYPEGALKYTQFLEQTLADDLSGIHVCLDGANGATSGLVSRIFADLETDFDTMAISPDGLNINANVGSTHPQALSKFVVEKGADVGLAFDGDGDRCIAVDEQGNIVDGDKIMFILGSYMKSQGRLKQDTVVTTVMSNLGLYKALEANGMKSVQTDVGDRHVVEAMRKDGYNIGGEQSGHVILFDYHNTGDGMLTGIHLLNVMKKTGKKLSELAAPVQDYPQKLVNVKVADKENWQAYPEIQSAIDTVEKEMAGDGRVLVRPSGTEPLLRVMAEAKTEDLVSRYVDQIVDVVKQEMGSKED

SEQ ID NO: 1127 - protein, 362 aa, Lactobacillus paracasei
MNRLWDNPWVNRLLALLLAIGLFAYVNVESINNTRQSANDDTTLVANKTQTVKVPLQVNANTDKYFITGYPSKVSVALTGTASLVTMTANTQNFRIIADLTKLGVGKHRVRLKAEGLNKDLSYSISPKSVTVDIQVRDNKTMPIQVRYNKASIASGYAAGEPKLSTRTVDVTGARSVIDSIAQVVANVSLSHNTRSTVDQEVLLQALDENGNTMNVVLAPQTVHVTLPISQPSKKLTVELKQTGTAVSGRTYVLSSDTKQVTVYGDQSSLDKLSKLTVDVDVSGISTTTTRTYNVTDLNDGISAASPKSLKVTVSVGNTGNDDNNNNNGGSTASASTSSSSAASTSSASESDSSTSTSDNNG

SEQ ID NO: 1128 - protein, 285 aa, Lactobacillus paracasei
MRTYLTNLLTWSTLINLVDILVVWYVIYRLIMLVRGTKAVQLLKGVFVIAAIKIISWFLQLKTVGYLTDLVITWSVPALVIIFQPEIRRGLEHLGRGSLIFRSNNNQHEVEVRMVKELDKAIQYMSKRRIGALMTIQKSTGLEDYIETGIPLDADISGELLINIFIPNTPLHDGAVIIRDNRIAVAAAYLPLSDSNLIPKELGTRHRAAVGISEVTDALTIVVSEETGEVTITNNNNLIRNLTRDDYMKFLTAQLVPKEEAPNPNPVVSFFSRRFKSRKKKEGKQ

SEQ ID NO: 1129 - protein, 244 aa, Lactobacillus paracasei
MQTNQAVQVSALTQGYGKQIVLKDINLTLNHGQILALIGPSGAGKTTLVSTIMGMLRPRTGQVSVLGQAVPNRPLLAKIGFMAQTDALYESLTGAENLTFFAKMQGVPHAQITKQMAYAANVVNLQPALKQPVKDYSGGMKRRLSLAIALISQPQLLILDEPTVGIDPELRQQIWHELHRLADQGVAIILTTHVMADAEEADTLLMIRNGTAIAHGTPAQLKADYQTDSIEAVFLAAGRQQDAH

SEQ ID NO: 1130 - protein, 320 aa, Lactobacillus paracasei
MRIEALINRILKEMLRDKRTLALMFIAPLFIMTLIFFLFQSNTDTKADLAVHAVDSALTKAIDTKHVRLHQVKNDQPIALIKAHDYAGVLTQDGDKLTLTLANADQGKSAILKQTLQAASIKLKMQAAATALKIQATTLQKLATALKQATRGAAQIPEPHQPKTPSYTLTTHYRYGSADSTYFDTLLPILMGFIVFFFVFLISGIALLRERTTGTLYRLLATPVRRGEIISGYLLGYGIFAIIQTLLIVGYSLIVFKIQILGSIPAIFLINLLLAFTALALGLLISTFANTEFQMLQFIPIVVIPQIFFTGLIPIPRLHN

SEQ ID NO: 1131 - protein, 215 aa, Lactobacillus paracasei
MVNSKSKKKTLTALSNKGLGVFGEVLNTLHSVADTVNKVTPKIVDEGVKVIDSHLEKHKDDFKMPGLSQISVAEAKRILALYPINFSLVLVTPDIKLAQQRPNVIIKTSPKENTKVTPGSFIRVFYADDNVIAISRQLADDQASKKQGMRSRTRVDNQDRIIPVMKGIKLVSSGVNTFAGKLTFNKKIKNSLSKEPLDPSDPVITQETKKTRPSS

SEQ ID NO: 1132 - protein, 417 aa, Lactobacillus paracasei
MNAEQHVPQFRFKGFSDSWEQHKLSDGTNKIGDGLHGTPKYSEDGDVYFVNGNNLVNGQIVITSETKRVTSNEQSKDDKALNENTILMSINGTIGNLAWYRGENLMLGKSAAYIEVSDFDKKFIYTYLQTRPVKDYYLNSLTGTTIKNLGLKAIRNTNIYTPTIDEQAKIGVLFQNLDMTITLHQRKLAKLKELKKGYLQKLFPQNSEKVPEFRFKGYSDAWEKRKLGETNSYFTDGNYGESYPKESELSDKENGVPFLRGSNLRNGELIEDNANYITKEKHAELTSGHLVEDDIVLAVRGSLGALGYVKEENIDWNINSQLAVIRTDKSELSGKFLAQFLLSWRGQKELLSRNTGTALKQLPIKQLKDVPVPIVNLDEQKEISALFTSIDNLIAATQCKLDLLKKLKKGYLQKMFC

SEQ ID NO: 1133 - protein, 59 aa, Lactobacillus paracasei
MTKQDETHRVMFTLTDQAIAKLNQLVAKKQQEVNQNPDLAKYHVKVTKSNIVEDWLSKQ

SEQ ID NO: 1134 - protein, 246 aa, Lactobacillus paracasei
MKSGGRIIFNPIGTDLLISQDSIDKQQGYPVIKASQLVQKARHQLTAKELKLIDFMVSKVRRDDSGFRPLQTTIKEINQVMEFGRGTKSLTETSKSLLSLSNKGFWFQKDEDTITIARWLQTAEIKKDGSATLELDEKLAPWLLKLVGSRAQYSLSDIVALRSKYSLMLYQLLMSWRGSMGVNGTPDEFLEFFGHTNMKWWQFNGRYLQPAIDEINQKTGIKVHYAARKSGRTISEVEIDFTGDAS

SEQ ID NO: 1135 - protein, 174 aa, Lactobacillus paracasei
MSKTVKELADELGVSKQTIRYHYRNIPAKYVVKGKDGVIRIDPIAEGIIRNKVVNNRHKNTGKYTDKDSKFTGKEKYDDQRNILVEQLAKKDEEIKRLHSLLEQAQKIADQSQQLQLMAENKLKKLSVPQNEPDSESKPVDSQIHEQDSEFPRRSENSPENKGSFWHRLFGVGK

SEQ ID NO: 1136 - protein, 505 aa, Lactobacillus paracasei
MEILTDYMPWIIAAIVLILIFIFLATHRKTALPNEVLIISGAMISGKHSFRDVNGNRVKLITNGGSFILPILQRWDVLSLNTRTIEVATPEVYTQQGVPIIVNGTVILKIGSSQEEVATAAEQFLGKNDEQINSEATEILEGHLRAILGTLTVEDTYQNRDAFAEKVQDVASSDLAKMGLQIISFTIKDIADKNGYLDSLGKKQIAEVKKNAAVAEAAASRDTRIQQAQADQEAKQQEIERQTQVADAEREQQVKMADFKKQQEIAQAQADQAAIVEQMKAKQVQKEKDIELAQKDAELQEQELNASVRKQADADLYKAQRAAEAQKATQIAAAEASAKQVELAAEANANATKAIGEAEAGKTRAIGLAQAEAIAKQAEAARQLDESGRFKMTIEAMPKIIEAAMSPYANVDSIKLYGDGDLTGQTSGSLVKQLDMLQEVAGIDIRGMLNGALMHQAGNQPVVDAIKDQHAAAPKPPAEATMAPKKETTDDDPKPTPSRMAEKNK

SEQ ID NO: 1137 - protein, 126 aa, Lactobacillus paracasei
MVAWLTQQVFWLQILVIIGAMLLAIGLLWMLFSLVLLPLIAFLQRLLAPVENTTSVSDRDYLLGTVTLAVSDGHTGEVMVTGGGLARQTYPAKLWSGTHQTLAQGTKVVIIELKQGIAYVDAFRRA

SEQ ID NO: 1138 - protein, 347 aa, Lactobacillus paracasei
MKQDAKTITMNILNGLSVGIIVALVPGAILNAIVKLLLPSFPQLAVVTYMTGAAMTLLPALSAVCVGMLAKFTPIQTSSLALAAIVGAGNYHLTKTGLKVAGTGDVINLAITLAIGYLLIVLLGDALKAYTILLIPSLVLVIAGGIGMLTLGPVSSITKYIGVVVHDVTALQPIVMGVLMGIIFAVLIVSPISTVGIATAISLTGIGAGSANLGIVGAGFALATYGWKANSFGTSLAHFLGSPKMQMANILSRPKLFLPMAINAGILGGFGAALNIQGTPASAGFGFSGLVGPLAALDAMGSVTVGNVLELTLLFFILPIALAYASHVLFTKTLHYQDPEDYALNYN

SEQ ID NO: 1139 - protein, 330 aa, Lactobacillus paracasei
MTKILMYTVRPDERAAIDAWVAANDIQVDTNTVEFGPDTVDLAKGYDGVVIQQHGAIPEEMVYQKLKAFGIKQLTLRITGYDIVNLDAATANGLVVTNVPAYSPRSVSELVLAQVMRLIRHLGEASAREAKDDYSWTGLEAPEIHNLTVGIIGAGKIGSAVARIFRALGATVIVSDPVKRPELADTVSYVDLNTLLTTSDVVTVHTPLDGLTTHLIDADALRKMKSTAYLINAARGPIVDTEALIKALNDHTIAGAALDTIEGEAGIFGEDRSQTLVDNQTLETLKAMPNVEISPHIGFYTDAAVKNMIDISLDDVKTILEGGKSAHQVN

SEQ ID NO: 1140 - protein, 387 aa, Lactobacillus paracasei
MALVDRMNQEVKQLKPSDILQFNAAISGIEGIVKLTLGEPDFPTPEHVKAAGIASIENNESHYTQSKGLPGLRAAASHYLATKYNTKYDPESQILITAGATGGIYSSLTAMLNKGDTVIIPTPIFPLYIPIVLLNGAKPIFIDTSEDGFILKPEKLQKAIEANKDTVKAVVLNYPTNPTGVTYDRADLEALAAVIKQYEIFVLSDEIYSELTYTGKHVSMGEILPDQAVVLNGVSKSHAMTGWRVGITAGPADVIQQIGKVSEFTITSVTTNAQRAAEEALKNGMDDTQPMKEAYMKRRDFLIKALTAAGLTVPNPDGAFYIFAKLPERMHDSWKFVYALAREAKVAVIPGASFGPGGEGYVRISYAASMADLKLAAERIAKYMATH

SEQ ID NO: 1141 - protein, 60 aa, Lactobacillus paracasei
MIEYLVFFVLLGILIASNLVIAVLDYRKQTQRDIPPKQKRRNFIKNIFLGSFDLFISFWP

SEQ ID NO: 1142 - protein, 106 aa, Lactobacillus paracasei
MDEKQAIIVKMLELQHLFGEQTDGTAQMIVLKIKQAIDKLASKRTQGMNIGPQVRSIGYFIRDEMREHHYQLTLEQQTVLLDMESKALDIERKFQPGLALSRIIPF

SEQ ID NO: 1143 - protein, 234 aa, Lactobacillus paracasei
MNYSITPNSTFPVVNITMGQDETIQIESGSMIYHNGLVELSGHMNSNGKKGLGGIMSAIGRSVTSGERFFITTATGTAPDAELAIAPGNPGVIKELTLDDTHQYRLNTGAFLAMDTSASYHMVSQKVSGALFGGTGGFFIMETAGTGTMLVSAYGDIIPIALDGSHEYVIDNSHVVAWDSKLNYNIQPASGVIGFTTGEGLVNRFSGSGIVYIQTRNIEALADLVRPFIPSSKD

SEQ ID NO: 1144 - protein, 126 aa, Lactobacillus paracasei
MPQADCIFCHLPQTSIVLENDLAVAFWDIHPVSQGHLLVIPRTHRSNFFDLSEEELLAINRLIHAGKTLIDQQYHPDGYNVGANVGLYGGQTVMHCHLHLIPRYRGDDPNPAGGIRKMLPNGQEFA

SEQ ID NO: 1145 - protein, 634 aa, Lactobacillus paracasei
MCGIIAFADKTILNKKPVINNMMDMIKHRGPNSSGEYINDNVALGFRRLSIIDLKGGSQPILNEDGTVAIIFNGEIYNFQSIRKDLIAAGHVFKTHSDTEVLLHGYEEYGMDELLKKIRGMFAFLIWDDNKKEMFGARDFFGIKPMYYYHDGDTFIVGSEIKAFLKHPKFKKQLNKEALKPYLTFQYSALDETFFKGVYRIPEGHYFTLKDNKLTIKKYWDMDFKANNLSFEDTVAAIDKSVSESVDAHRISDVEVGSLLSSGVDSSYITALLRPEHTFSIGFDNKKYHEGVAAKELSDKLGLDNTSDIVTEKEALDNFPLIQYHLDEPDSNPSCVPLYFLTKLAHKDVTVILSGEGADELFAGYANYGFHTRSHAIRVFADGLRKLPKGVKYTIAHGLKKMPNFHGRLHLYESTAPAEEFFIGEALVFHEGQADKILQPEFRQSESVRDIVTASYKKVRHYDDEVKKMQYLDIHQFMPKDILLKADKLSMANSMELRVPFLDKEVAKVAAGIPTKYLINSHNSKYALREAANRHLPEEWASREKLGFPVPVKQWLEDEPFYKTVRKMFEQDWVKEFFDQDAILDILDRTYRQESDDRRKVWTIYTFLVWYKVYFIDDEVPHYIADSSKEKLEA

SEQ ID NO: 1146 - protein, 75 aa, Lactobacillus paracasei
VASGINGWALAIYVRGPYVQVSGPASAFRKTAGISGSVGLYHSRDDHSPSYIPKKRKKTEIQVPTGELGSPKLRI

SEQ ID NO: 1147 - protein, 356 aa, Lactobacillus paracasei
MSIAIRPFVKKDLTRFVSAISPLLSPSAVNFALITDTHDKAKFATTYYGPTGYWHVREQQWLSGQLPLALRVHLGDLVDGSEAPWLTRLRLRNIMADYQSGSVPFLVTKGNHDDNDKFAEKRAGHRGSFLPEVNQTLIFKPNAEQTGVAVSQEGLMVQDFPNLRIIVLNTADVPLIDGHKAFDVKKTLAVSFAQLRNFALALKGAGKRDVLLLSHAPALKENGQPALKFNGRAVHELLRAFNFHASGVLHTGEAPAFGGRLRFDFRQSSGRVVGYLAGHYHLEADYIVNGIHYSLQNTSALMGRHHGLTTKFNRRYDRRFGLPSEYAGYVVSVDTQQRLLSLYGYGAASRVRRFQY

SEQ ID NO: 1148 - protein, 304 aa, Lactobacillus paracasei
MSLSVFLELVEIKAKTASVFPFLLGTLFAWYHYHTLHIAELLVFFVAMLLFNMAVDANDNYQDYKRSERTEALRFREKTNIIGVHHLNPSMIGWMVVGMMVTSGVLGLWMVSRTGWPLLVMGLFSFAVGYGYAGGPRPISATPYGEFFSGFTMGFVIFLIAVYVNVFNVAAFSWPLIGSVYLASGLAQCTIAALLLANNIADQEEDETLKRRTIVHYLGRFRSIIFFYGLYTVGFLMLIAAVALGLLPKLTLLTLITVPMVVKNARGFAANPVKKLTFPNAIKNLFITTLAQVVFLALGVFLNI

SEQ ID NO: 1149 - protein, 322 aa, Lactobacillus paracasei
MIHPLWHRFPMVYQQLEQIQQRLEHVAVLREPQVHALIQQQINAGGKMLRSGLMLMLARLGNPDNDDLITAGAAIEALHLATLVHDDVLDHADLRRGSDTVSAKSGNREAIYAGDFLFAIYFQLLSEQNPATTDLATNARVMKHIFMGEVDQNGPSAPLIPSVSEYLKAIAGKTAALFALATYTGATIGQLDFTEKKAAYRFGRQLGMAFQMIDDLLDYTQTTATLNKPVLEDLHNGIVTLPLIYAYQNVPEQLAPLVGTAAKIAANSDRIAAIVSEHGLPQARQLATRYTDKAINALAPLPDARIKQELRKLTQQLLRRDH

SEQ ID NO: 1150 - protein, 401 aa, Lactobacillus paracasei
MAKVLSINAGSSSLKWKLFEMPSERQLAEGATDILKQSTVKIKYGTDQAYESATPICNYRDAVANLLSNLQTLGLVQNLDEITGIGHRVVAGGELFSAPIVIDDRVLAQIRALRDYAPLHNPVEADCIAIFRKMMPWALEVAVFDTAFHQTMKPVNYLYSIPYEYYQKYGVRKYGAHGTSVRYVSAHAAKMLRKPLAQMRMIVMHLGAGSSITAIQNGQSVDTSMGFTPLSGVTMGTRSGDVDVSLIGYLMKKLAITDVDQMIDILNTESGLRGISGISHDVRDLEAAAPTNPRAKLALDIFVNRIVKYVGAYAALMDGVDVLVFTAGIGEHSSDIRARVMQSLDYLGARIDASLNTQIHDNAGDITAADSKVKTLVIPTNEELMIVRDVMSLSQAVAQAE

SEQ ID NO: 1151 - protein, 295 aa, Lactobacillus paracasei
MLTVTGLTKRFGSATAVHDVSFTIQPGEILGLIGQNGAGKTTTFRMLLNLLQADHGNMTWNDQPLSLLSRETIGYLPEERGLYPKMTVVDQICFFGELHGMKRAAVMAVLDQWLDQFQVKGKPTDLVKDLSKGNQQKVQLIAAMIHNPQFIILDEPFSGLDPVNAGLLEAGIRRLRDAGSAIIYSSHDMGNVEAISDKLVMLKNGEVVLSGALNDIRDQFGQTRLYIQSPLTQEQLLSFPGVVGVAQRSRGFLVKLAEPQAGHDIFTAATQQGYIPEFSQQAPSLDEIFRMKVEA

SEQ ID NO: 1152 - protein, 423 aa, Lactobacillus paracasei
MKKMDVIFRQVFFKNLKSKTWLWIVLGPLVLAAVFGGVFWLMNQTNQTSKIGVVTSSPALTSTLKASSDDDQRYISYSSTAAAKRAMADEDLDGVLTISTQPTTHASLIERTDGNGINQTQLQSVLAQAHTKEVAAQLKLSTTQLQSLFATPQLATTSVSVDKGKLVSRSAKTQKSGAMVGFILGMLIYTFVISYASMMAQEIGTEKGSRIEESILTAITPQAQFFGKLLGILALMAVQMAIYGVVTLAGGLLLQRLPKNPLSSLMTNIDLSGISLNMLLFSLAFFFVGTLTYTVLAALTGSLVANQEQIGQATTPIVMLGMLGYFGALIVAGGTSPILNIASYIPFLSTMMMPVRLGAGQVTAVAGWSALGINLVFLILFTWLTVKFYQTNVLSYSDGGMLKAFKRSWQLQRAARKPKPVKS

SEQ ID NO: 1153 - protein, 131 aa, Lactobacillus paracasei
MRIVISNQSGKPIYEQIEDQIKTAILSGQLKVNEQLPSIRSLAKDLRISVITTTRAYHELEAAGFITNVQGKGAYVLGQDSALVKENALREIETYLNQAIDTAKMARIAPEELHTMLDTLMHTEGDTDNDN

SEQ ID NO: 1154 - protein, 288 aa, Lactobacillus paracasei
MTTDLLTVTNLTKRYADYQLANVSFSLPAGYIMGFIGPNGAGKTTTIKAILDMIKPDSGNISVLGQTTPQAREAIRDQLGIVLDGAVYPDSWPAEAVNRYVGPFFPNWDTAYFQQLLRDFDIPTKPKYHDLSMGTKIKLQLAAALAHHPKLLILDEPTSGLDPIARDELIAILQDFIRDEQHSVLISTHSIMELAKVADYVTYLLAGKITFTGPLSDLLDRYLLIKGGPNDLTAAIKATLIGLQESPVGFSGVWPADQAAMLPDNMIQEPVDLETLMIAFGKGGHPHA

SEQ ID NO: 1155 - protein, 214 aa, Lactobacillus paracasei
MRNVAKLVALDMGALYSGTHKYRGWSYLVAFLIVLIAFLNGDAATPLAGAITGTSVGILMMPFASVDRHGLEQLYTMLPIRRREIVASHYLFGLLVMLMIDLYAAFIVAVGMIARFNPIHDYHAIIWMVFFATGLVLLQMTLSFPLMIGLGFQRAPLAAYLPIGIVLLAVFIEASLDLDLAGLRPWLTAFSILLIVAFAFSWWLSTYLYKRREF

SEQ ID NO: 1156 - protein, 261 aa, Lactobacillus paracasei
MYQDLNGKIAIVTGGSKGIGAAIAERFGKEHMSVVINYLGDHEGAKQVADTVIKNGGQAVSIHADVSTEDGIASLVETATAHFGGLDVWVNNAGMEIKEPTHQVSLEDWNKVIAINQTGVFLGARAALNYFLEHHQAGNIINITSVHEQIPWPTFASYAAAKGAVKLFTQTIAMEYAKQGIRVNAIGPGAIETPINAEKFADKAQYDQTVSMVPMNRIGKPEDVSAGAAWLASSESSYVTGITLFIDGGMTLYPAFKDGQG

SEQ ID NO: 1157 - protein, 373 aa, Lactobacillus paracasei
VKVGVVKEQKAGEGRVAVTPENVKKLVDAGATVLVEKSAGVGAGFPDADYAAAGGTIVSHAQSWDSDLVVKVKEPDEEEYQYFKPGQVVWGFQHLASSPATVKAMQAAGTTAIGGETIVENGELALLKPMSAIAGRRSVIMGAYYLEAQHGGEGILLPGTPEVASGTVVIFGGGNAAFNAASLALAMGCRVTIIELKKDRRDWLAKQFTGEALTLLPSTPENLAAAIKTADVFISTILIPGAKPPKLVTTAMVQSMKPGSVLVDVAIDQGGTVETIDAPTSIDDPVFTKYGVIHYAVPNQPGAVPRTATMALAVGNIKYLLAIAKSGIDGAIKNDPALASGVNLYHGQITNKGLAESLNLPIVSLETALKTQH

SEQ ID NO: 1158 - protein, 339 aa, Lactobacillus paracasei
MMTATQTVSIKDVQEASHLIHEVGRVTPLIQSMFLSRTVTHGDVYLKLENMQLTGSFKFRGAYNKIRHLSDVEKARGVITASAGNHAQGVALTAHLLDIDATVVMPKTAPLAKQQATSGYGAKVVLAGDTFDESRAFMEQKAKEDGLTIVDPYNDPLVIAGQGSIGLEILDQLWDVDTVIVPVGGGGLITGIATVLKHFNPYIHIVGVQSENVHGMTASLQARKLTRQCTGPTLADGTAVAMPGDITFGLAEELVDEMVLVSEEEIAEAMKDLLQRTKTVAEGAGALPTAALEAHKIAPQWLVGKKVVALVSGGNVDLERVADNIDHFFKSDPTGHFIG

SEQ ID NO: 1159 - protein, 641 aa, Lactobacillus paracasei
MEKTFSKHTVAKTHYVPYATDGAKENSGGSTAIMIMGAILATIFAASTAYSGMKAGLTVAAGIPGSIIGSGMVGVFAKKKGIFGKNLLQGMSSGGESIASGMIYVLPAIIIIGGKVNFFAGVAVGALAVLFAVGVASLVENYLLVEENGKLMYPESTAISEALDASEAGGDSLKHMGIGFGIGGIITLLTTQVFGWVNSVMTFVGNSSYRWKISTEVNPMLAGIGFVVGLDVSLTMFAGSILANFGITPLIAYFTQMAGGGAHVWNDTHMLMSQMNIDMVAGSYTKYIGAGMMLCGGIIGAIKLIPVIVTSIKKTLNARNDVGEEKNSLGVVSLLVAAIAIFIVGAFLAGNIVIAIIAGILSLVLALLFVIVSARLAGTIGCSNAPVSGMTIASLVVMTLVFALMGWTANAHNEILLLFGVFIVTAISVGGAYTQTQKVNYLVGGRRSEMMKYFMIAALIGVVVVVGTTVILAPQLAIKSANPPFGLPQANLIATLTTGILSGNLPWIMIIVGIIIAIVCWMLGLSIMTVALGFYLPISTTSIILVGALLKLLIEKLTKDKALRETRLSSGVSLSSGLIAGGSIIGLIGIILHVTGVLSNRVPAGFAGSNGMAVILLIIMAATIVIPLMRIKQPARKAQKQ

SEQ ID NO: 1160 - protein, 118 aa, Lactobacillus paracasei
MTATDTLQHLIYEKNPAIQYTKKGGKITIIRPQNHPIQKFCRHYLHMKIPAVSYLHLDAYGSFVFSKINGHRSAAVIGKELAKKFPEADDHRDDRLMIYLNQIAKNDHLIQRLNANTR

SEQ ID NO: 1161 - protein, 475 aa, Lactobacillus paracasei
MIDRIEISACTSMMVGKKASLDGATYISRNEDRLVAIYPKRFVVQPAVTGRKETYVSPYNNLTVPLPESGYRYTSTPDADQSAGPNEEDGFNEKNVGESATESVYANERVLAYDPFIKNGLAEDSMTTLVLPFINSARDGVRYLGELVKKYGSAEGNGVQFNDQDEVWYMEIVTGHQWVAVRIPDDCYAVAANQIAIQDIDFNDPDNYMWADGIQDFVKDHNLNPDADHWNFRHIFGTDTEKDHHYNTPRVWFAQRYLNPEIEQDPESAELPFIRKANRKISVEDIQYIMKSHFNETKFDPLGHGNEHDRKTYRAISLSRTANSHILQMRNANQNGAAGVQWVGFGIPAFCPHVPFFTNATDTDKSYSEFPKKMDLSSAYWLYEALAMVVESHYAEFIEDDLAYQKDLNEWARRKIAEVDQAAAGMSGDDLTTYLTEQNHAIAKHYNDTTRDFLFKLITMGTNLSKLTFKMDPNL

SEQ ID NO: 1162 - protein, 443 aa, Lactobacillus paracasei
MSEYDFDVLYLGSGHGAFDGAGPLAASGKKVGVIESDMIGGTCPNYGCNAKITLDTPVVLQRMAERMQGIVSGSITINWSELVAHKQAVIKPLPTNIGSNLKQTGVTIIHGHGKFIDPHSITVAGKTYTAENTVIATGRRPHHLDIPGTELAHDSRAFMDLKTLPKRIGILGSGYISMEFATIANAAGAEVSVFMHADKALREFHQPFVKAVMADMTKRGVKFISSADVQALKQTAQGIAIQYGDHQEQQVDWVLDATGRIPNDDQIGLEAAGVTFNQRGIPVDDHLQTNVPNIFASGDVLDKPQPKLTPTATFESYYLYQLLSGQTTDPIDYPAIPSTVYTTPRIAKVGVMPEEAADGDYQVVRNHIPDDWYHQTDQETMGDSILIFDRDHHLVGATEFSAQAEDAINTLLPAIVFHFSKQQMWQMAHIFPSESAAAWHKIR

SEQ ID NO: 1163 - protein, 472 aa, Lactobacillus paracasei
MQLSQTKEMPQARVHVAHPAMAMIGLMIGAFVGMFSETSLNIALPSLMTALNVSQGTIQWLVTGYMLVIGICMPLSSLLSKWFNTKKIILFALGAFILGSVVSAMGAVFPVVLIGRLIQGIGTGLILPLMFSVAMQIFPPYKLGTVMGMAALVIMFAPAIGPTITGLVLAKFTWHYIFWLFVPFLVLAFIFTLTSMENVYQQTQTPVDWLSIVESSIGFAGIVVGTTMASDAGWLSLEVGLALLVGVIGLVLYARRQLSLTNPMLNLRVFANKQFTVGTLLVMLDFGVILASMYLLPMYLQRVMGLPVAMTGLVMLPGGIVNAAVSAIAGRMYDSHGAKWLSRGGFVIAILGVLILLNSGAQSPLWWIILGHVVLMIGAPLAMSPAQTYGLNSLSGAESADGSALLNTLQQIVGAVSTAVATSMLALGSAKAAGQTGLTIGSHFGFMFVLILAIIGLIVAFQVKKPQASRDL

SEQ ID NO: 1164 - protein, 188 aa, Lactobacillus paracasei
MDTREKLVATAASLFQKEGVRATGLAQILTVSGTPKGSLYYYFPNGKAQLIEAAITYAGQHILEHVQRDLDRYKAPDAALAGQLESMATEMQEKGHLGGNSISLIALETGDDPELQAACSAVFTQLETLYIKKLTSAGIPPDRAQPLGQFIQASIEGAIILAATKDNPDLLRQTADQLTRLIKLALAA

SEQ ID NO: 1165 - protein, 482 aa, Lactobacillus paracasei
MTYLNFPKNFLWGGATAANQLEGAYQEDGKGLSVADVLPQGKDRFAIVNRPDFNWTIDKSKYRYPNHQGIDHYHRFKEDIKLFSEMGFKCYRFSIAWSRIFPEGDEKTPNASGLKFYDEVIATCLKYDIEPVVTISHYEMPLHLVTKYGGWKNKRLIEFYKHFAETVLTRYFKQVKYWMTFNEINSAWAFPVMSQGLVANNGGNDKQTIFQAWHNQFVASAWAVKIGHALDPKLQVGCMLLYATTYSYDANPVNQLATLQQNQAFNFFCGDVQVRGEYPAYTDALMADNGFKFTDLNFSAEELTLLKNHPVDYIGFSYYMSAVVETVEKEHAEVGGNLLSGVKNPFLKASEWGWQIDPIGLRIALNQLYERYRKPLFIVENGLGAVDKPDADGKIKDDYRIDYLKQHIEQMGAAIHDGVDLMGYTPWGCIDLVSASSGQMSKRYGFIYVDLDDAGQGSLNRYKKQSFNWYQRVIASNGTDLG

SEQ ID NO: 1166 - protein, 625 aa, Lactobacillus paracasei
EIIBCACMPNENTMNESGLAQQLLNLIGGKQNINQVWHCATRLRFTLKDRAKVPKDKIEALDGVITVVEASGQFQVVIGNNVGDVYHEVVKLEPSLSEGETSGETAAQGKMTFKSAFNSLLTFISGVFTPFLGAMAGAGILKGLLSLAVVMGWLTAKSGAYQIWWAAADGIFYFLPIALAFTAAKQLKVNQFVSMAIAAAMVSPGIVALGAKATTIDFFGIPVVPANYTATVLPILLVVVVQKFLEPVFNKLWHESVRNIMAPLCLLVVIVPLTLIVVGPISATVSSWLATAIVSLNKSVPILAGLVLGGFWQVIVIFGVHWALVPVMMNNIAQNGTDLMMPILLPAVLSQAGAALAVFLRTRDAKMKSLAGSSTITALFGITEPTIYGITLKLKKPFYLACVAGAVGGMIVAISGAGANAAALASVLSLPTFIGKGFGLSVVGDVVAFALGTVLTYFFGGINAGAKTKTAPSANSELGEALAAPVKGVLVPLTGLADEVFASETMGKGVAIVPENGIVKAPVAGVIRLLYPTGHAIGIQSDKGSEILIHIGIDTVNLKGKHFQPLVAQGQHVEIGMPLVQFDHEAIEKEGYESTVMMIVTNSDQYQIATLGQGATDDRPVMTLA

SEQ ID NO: 1167 - protein, 285 aa, Lactobacillus paracasei
MIIQNVLNNNAVVARHQQREVIVVERGIGFRAKKDAKMALRDSMKVYVPEDQAKLKIATATIASLPSAYLDLAAGIIQEAEKRLQTTFNSYLLIELADHVHFAVQRLHEKIVLHNKLLWEIQVAYTQEYEMGEWALHQIAAQLHEQLPEDEAGFIALKFVSNDLNHQQTVNSLAFTQTLASLTKIIFYNLGLDMNVKTPDYQRLVIHLKFFLQRMYAAAPSPLSLKMENYDYVLLKHLQQDYARAYHCMEDVDRFMQQKLAIAIPKNEQIYLTMHIARLAKSLAE

SEQ ID NO: 1168 - protein, 543 aa, Lactobacillus paracasei
MIRSLLRYTHHLTGAIIISFLIGLVAELTKVVVLVLAAMMLFDPQNASHLLIPGIIAVVIVGLGSFGEQYAGHFVAFHVLAELRGAVYRKLVQLAPAKLDSQGSGKLLKLIGSDIEAMEIFYAHTIVPVAIGLIYGVLMVAVYSSLNGPAAAVVLVSYAAVGLLIPYYRHEQMTAKAQAADRQKAVNQQYLLESVRGMAVLRQLEVADARMKTGNEGFDHEATAFQQSQFGQLLKNMSATLVILVAWLFIVWLSGWTQPQPLQQALLAVFPLTFGPLLALTNLPASLLNGFAAARNLLNLLQEAPATSAAIDATQTLDQIATIQVDHVTFKYPSRDETVLRQVSLSLHAGEIVGFVGASGSGKSTLAKLIMGWYPLTQGRILIDGIDLTKIDPASLRAQVNYLPQTPVFFSESVRDNLTLHDSTITDAQIWTVLDQVKLTSRLRQAEKGLDENVVSGQLQFSSGEQQRLELARALLHPSSVLVLDEPTSNLDTENERLILDAIKAYYHGIVIMISHRAESAAYADRLYRFADHRVSAASTAPK

SEQ ID NO: 1169 - protein, 563 aa, Lactobacillus paracasei
LLGLLKYGRDQRWAGVIETVFDWLPTLLPIMIALNFAAKRPGNALIITVILVLIWLGYVIGYERHHRHAWAMSAKRELRDHYFEALYQRNNAGDATAADNAVIQRDLGGLNNLDMFYSTLFPTLIQAGLTFLLLIGLSVWYGSWLAFLPLACVFLIGFAMMFLGKKMSAQNKAHLAGFLRMGGRFMNDLSGMNTLVMYNAADRYAKKFADDSEYFRQATMNLLRTQLQVLFVINGFVYLTVFAGGFVTALQLAAGQLPAAGAFATWFALAMMMVNARQLGYFFHVVKSNGPALAGILATIAKSKTTPATVKITDNRPLKQLVLQDVAIGYEADAPLVSDINATLVPGKLYGLAGENGTGKSTLTQALLGQLTPLSGTIMADNTPVTALSNAQRAAVFGYVAANDYIFSGTIKENLLLGNQFGDQWQQHLDELGLMHFVTDLQDGYATEVGEGGRLLSPGQRQQLAFARMLLADKTVYLLDEMTSSIDAANAAIILAAIKRLSRQKIVLFISHDLSAMAEADVVWFIHDHQLISADHAQLYRDQPAYRHLVDNPEAMLKEGQPS

SEQ ID NO: 1170 - protein, 141 aa, Lactobacillus paracasei
VRWLKKYVRPFDYVIVIVLFVACFLPVGIFSLTEANVNTNQKVAVISINGHVKRRIQLTTHTRHQQFTLYPAKGQYNIIEVQGARIRDKEDNSPDQIAVHTGWISQVGQQSICLPHKLLIEIKPAQAGTGTSGDTGGLVHP

SEQ ID NO: 1171 - protein, 366 aa, Lactobacillus paracasei
MKKLIVLSATLLVSMGLAACSSGSSSSSSKSSSTTSQTSNAKVKINTGADASAKVPAAGTLVMRQLYAAPHGKQSFAAVNVTLNGDTIVSAKIDEFQYVKKSSDWTGVPNSNKDFGKSYPKGQFLIAKAENSKPYSALMKKEAKATHTWEENETAITNFVKGKKIEDLKADVAKVKDTKKVSDVVSGATFADTAGYLQAIYDAATTGMVAEGIQTTDNTITEGQVLAAPHGTQSFGIVTVAMQGDKIANVFLDEFQYMPSKDFGGVPNSNADFGKGIKSGTVLASKRANSEAYSAIMKSKGKATQTWQENSNAIDEFAKGKTIAELETAVSDLKGKKKVSDVVSGATFTDTSGYLTAIISAAKAAK

SEQ ID NO: 1172 - protein, 225 aa, Lactobacillus paracasei
LNLAYYPFQLITTKPSEVTVIDTASPKVLTDLIEALRNDLDKVVLSNDQLEPQEIRKASLWIGDPRLELDLDKLFQRLIYKRMELLIENQRLVELSDQSQQMAMDLIQDPFLSDLPVTVEPGGKLEQIMKYCNVHFDETVTTESTSKIEALIQTLTKLEEMKLVILTNVSHYLSARDFFAVTEQIGDTELQVVLIEFSKVNRRKYFEKCQYIYIDEDFVDSRELD

SEQ ID NO: 1173 - protein, 137 aa, Lactobacillus paracasei
CRISPRASSCIATEDENDRIBNCLEASECASMRYRVMRLMIMFDLPVLTSENRRNYRKFRKALINEGFLMMQYSIYVRVCSTKKSAEFLEHRIAAMKPPIGTVQTLMVTEAQYQAMHFLVGEAKQDIRNSADRTVII

SEQ ID NO: 1174 - protein, 329 aa, Lactobacillus paracasei
CRISPRASSCIATEDENDNCLEASECASMGWRSLIVTQHCKVTTKNRTLVVQTDSEVNNVPIEDINQVVFTTTRALLSADAITTLAEANAKVIFSGRDGQPVTETTNLYSDRRKADLVRLQVNWPKSLVENLWTKIVAAKVSIQAQVTKLCGYDNQSLLDDLDTLEINDHSNREATAARKYFKLIFGDDFSRSDICATNAALNYGYSILLSTTNRAIVSAGHITEIGMHHSSVANQYNLGSDLMEPFRPAIDYWVANQKFTDLTPNIKYGLIALLNLEVTFNGKKALLQNALDEHVENCLAYLDGKRNNCRIEVEFPNEVSSDAFNDHV

SEQ ID NO: 1175 - protein, 1390 aa, Lactobacillus paracasei
CRISPRASSCIATEDENDNCLEASECASMTKLGKPYGIGVDIGSNSIGFAAVDENSHLIRLKGKTVIGARLFEEGKAAAKRRAGRTTRRRLSRNRWRLSFLRDFFESHITPTDPNFFMRQKYSEISPKDKARYKYEKRLFNDRTDAEFYQQYSTMYHLRNRLMTDPSRADVREIYFAIHHILKSRGHFLTPGDAKDFNTNDVALDEIFPALQDAYAQVYPDLGITFDEDKANEFKTILLNEIATSIDTQRALVKLLLAEEDDKDILKQQKQVLTEFAKAVVGLKTKLNLALGTEVDSSEATAWNFSLGQLDDKWAGIESAMTDEGTEILDQIRDLYRARLLNGIVPTGKTLSQAKVDDYTQHHEDLQLFKAYLKQLEDDGTAKAIRQLYDRYIDGDDAAPFLRENFVKALTKDVTAHPNTKSPELLERLAQPDFMLKQRNKANGAIPVQMQQRELDQIIKNQAVYYDWLAAPNPVEKHRKSMPYQLDELLNFRIPYYVGPLVTAKEQKAAQGGVFAWMVRKDPEGNITPYNFDEKVDREASANTFIQRMKTTDTYLIGEDVLPKQSLLYQRYEVLNELNNVRVNNEKLSIEQKQQVIRELFERHNSVTIKQFAENLRAHGDYAHIPEIRGLADEKRFLSSLSTYRQLKSLLPEAIDDPAKQADIENIIAWSTVFEDAAIFKTKLKEISWLGSEAITKLSNIRYRGWGQFSRKFLNGLTLGNGHTIIQELLLSTNNLMQILTDETLQKKMTELNADKLKTANINDAIDNAYTSPSNKKALRQVLRVVDDIKRAADGQDPSWLYVETADGGGTPGKRTRARQHQLQEIYANAAHELIDTAVRGELEDKISDKADFNDRLVLYFMQGGRDIYTGAPLNIDQLSSYDIDHILPQSLIKDNSLDNRVLVHAIINREKNATFASTIYAQKMNATWRQWHEAGLISGRKLRNLQMRPDQIDKYASGFVARQLVETRQIIKLTEQIVAAQYPDTKIIAVKAGLSHQLREELEFPKNRDVNHYHHAFDAFLAARIGTYLLKRFPNLQAFFTYGKFTKADVKKLRGFNFIRDITHAEDKIVAKDTGEVVWDKQRDVDELDRIYNFKRMLITHEVRFETADLFKQTVYGARDSKEAGGSKQLIPKKKGYPVDIYGGYFRENTAYLAVVKVTKKTETIFKVVKIATSQVAALNKARSRSTAEELSVLTELLKPKFSKVGKNGKITDTPFEVVLPRVPREQLFYNAKYGFFMVNSDTMFHNFQEIWVSRSDQKILQQIRKAKIDYPNVDQDLDNLFHNLADQIVKYFDLYSIAGFKEKISQSQNTFNDLAVDDTDQSVGKITVINELLKGAQANGMTGSLKVLKISTPFGFTQDKSGVLTKDSSIIYQSPTGLFERSVRLTDL

SEQ ID NO: 1176 - protein, 264 aa, Lactobacillus paracasei
LEATKLAKRKQWPVPFSQTEPHFTFNNWLKFFSVVLFTYLLFYTRNPIGGFFNMSGTTFLNVANGWTRAVVVFGGVLYCAIIFAGAVWAAGWDGLSQLFASFRWRDIWYVFAYGVLYLIASTLGRILGDLVPIRFGVDFVNTLEAAQFGNLGAFSLISFRAFFMTLATQLTAVMIFLASQQLFSRLAIKHRRWALFLTYLLALAVTAVVTTTPLAPHVFVNIASGLVAQLPLYWVYRRSRNILVVTLSAFILMHVMIGLAVMLG

SEQ ID NO: 1177 - protein, 382 aa, Lactobacillus paracasei
MILIVDLVLIIIFIGGFGWGIGTVKRYQVEPNTSRTETNTDSLYSESRFEKTLQKFKRLDLMVRLGPVKDAKTFNYTPDEFNVKYSSQPIVSGLKATKTLNAETGEVEVCTTMTPQGVTVAGDYLLTTAYDHDGFHNSVMYIQDLKTGKLLNTVVLNGRPHVGGLTYDAKNDNIWICGRRNNAAEVFAIKLKTALTYNVDKKAKAVAYSQRAQLGNISRASFVTYYENALFVGFFNPTGKGNIQRYPLNDKGQVVGKSLTSSISNQFDVLTQSVLHQDILSKIQGMAFYGDYTILSQSYGGGNSTLYIFKTDPKKTIFRASDAIDTFDMPSHLEQISTHDGRMYMMFESAAYAYRHRSTNQLDRVLSMNLEGFVQLVLKEEK

SEQ ID NO: 1178 - protein, 122 aa, Lactobacillus paracasei
MKKILIGIGIFIGLVILGGAGFYAWYTQSTPYYTQITTTGKKFDVIDDETGAARDIDYAYTQMAYDEKGHGTEVDFNGHKSRPLKMQAYLRLDYSTRRNQVISWEVVPKEKVPKAALAKLNR

SEQ ID NO: 1179 - protein, 107 aa, Lactobacillus paracasei
MTNEHKVLRGLSYISVIFAPILFPILVWIFTPQGSVTRDTAKHALWLHIIPTLLSIFIFMIIGGVGFFTNSINATSAVSLILLLVAMVVDIGMVVYNIYTGIKIITS

SEQ ID NO: 1180 - protein, 575 aa, Lactobacillus paracasei
MHWLKNEHWVRPDLKRYRGLLVWSLILGVMTFVFAGALMFTSGFLIDKSATKPLFAAIYVTVVLTRAFGIGRPVFQYIERLTSHNWVLRITSHMRRKLYKVLETDAAFVSEHHQTGDILGLLADDIGHIQNLYLRMIFPTVVGAGLTVIATLLLGWFNWGFALWIMLLLLFQVLILPWWGLVVERFRKAEQKQLNHDAYVSLTDSVLGLSDWVITHREKDFMSQSLAAPKKLAASTVKSKRFQWRRDFVGQLLFVLIVISMLIWTNLEWTGNQASANWVGAFVLVVFPLDQAFSGIAQGVGEWPTYRDAIRHLNDLQPVTRQLPQQQAVPTQFKEMTLQHLSFQYTPKDPELITDIDLTVHSGEKIAILGPSGMGKTTLLQLVLGDLTPTTGNVLVDGQDVLTYQQHRTNLFAVLDQSPFLFNTSIVNNVRLGNEQASDADVAAALKAVKLDQLVAQLPNGINSSVEEAGFGFSGGERQRLSLARILLQDAPIVLLDEPTVGLDPITEQALLETMFTVLQGKTILWVTHHLQGVNQTDRVIFLEDGRLTMNDTPSHLAKNDERYQNLYALDAGLR

SEQ ID NO: 1181 - protein, 580 aa, Lactobacillus paracasei
MIDKTLMRLSGMKRIMTMLAGFALVQAFVILLQGKFLAEGIVHSWNRQSLAGLWLPLGLFATAFVIRQLIVWVRNRIGARFAMTSSAWLQAQLLKHLYALGPAAVAKEGTGNLVTMALDGIPEAENYIELILNKILNMSIIPWVLVAYIWYENWLTGFTLLIMFPIIILFMVILGLAAQDKSESQYAGFQKMSNHFIDSLRGLKTLQLMGISRQYANNVYDVSEDYRKQTMGVLRIAMLSTFALDFFTTLSIAVVAVFLGIKLMDGAIPLYPAMVALILAPEYFMPIRDFGTDYHATLNGKNAMKAIWQVIDQPLPTDTNVLPAFSRWQAQDTVTINHLDFTYPNERAGIQDANLQFTGTEKVAIIGASGSGKSTLLNLIGGFLQPQKAAMTVRGTKVPHMTQAAWQDHLSYIPQDPYLFADTIAANIRFYRPDASDEDVKQAAEAAGLSHWIETLADGYATRIGEGGRGISGGQAQRIALARTLIDTNRSIWLFDEPTAHLDIETEAELKETLVPLFKNRLVIFATHRLHWLNQMDRVIVVDGGKIIAEGTPSELAAHSKPYQALVHEMRGEFNALVEK

SEQ ID NO: 1182 - protein, 337 aa, Lactobacillus paracasei
MSWLQILWFFLLFVLFSGFFVLEGFDFGVGMSTKLLARNSDEEDQLVATIGPHWDGNEVWLITAGGAMFASYPMWYASLFSGFYIMFFLVLFGLIVRGVSFEFAAHAETKRGRNIWRWALACGSLIPPFILGMIFTAIIQPLPITKAGDVYPTLGNQINLLTIVGGVAVTLMMLMHGLNFIRLKTTGDLRKRARDWNSKLYYLLYAGEVVFAVLLFFMTDFFKERPISTLLILVVIVGSTVAAHVGVLKDNEVLSFVGSALGLVGVVGVIFNGLFPRVMIGQDAAMSILAKDASASPLTLTIMTIVAVILLPIALAYFIWSYVVFHKRIQAKGAVSE

SEQ ID NO: 1183 - protein, 474 aa, Lactobacillus paracasei
MLLAMDVLSLARFQFAMTTVFHFFFVPFSIGMGLVTAIMETMYVRKKNETYKKMAKFWGKIFLLSFAVGVVTGIIQEFQFGMNWSNYSRFMGDIFGVPLAIEALLAFFMESTFIGLWMFTWDRFKPAVHAIFIWMTWLGTTLSAIWILSANAFMQHPTGFAINQATGRVKLVDFGAVITNPQLWVEFPHVIFGAFTTAGFAVAGMAAWRLLKKDQVDFYKKSLRVGLIVGTIASACAIGFGDLQTQFIIKDQPMKFAATEGIYKDTSDPAPWTLVELINTKDHTTSGNIEVPYLLSLLSYHKMNGAVKGMETANKELQAKYGKDRDYYVPVKTLFWSFRVMAGGGVLLFLLGVLGLWFSRKKKDTLLNQRWLLYILGFALWLPFIINTAGWFITELGRYPWVVYGLYSIADAVSPTTTAGQLLFTNICYFLIFTLLGGVMIYYSHRVLKKGPEGDLNTDYGVNSDPFAKEAFAK

SEQ ID NO: 1184 - protein, 434 aa, Lactobacillus paracasei
MRMVDLITKKRDHKALTNEELTWMIEQYTAKAIPDYQMSAFLMAVYFNGMTPEERSHFAFAMLHSGDVLDLSDIPGIKVDKHSTGGVGDKISIPLAPLVACLGVPVPMISGRGLGHTGGTLDKLESIPGFNVAESETQFKQQVQQINEAIISASGEVAPADRRIYALRDVTGTVESIPLIAGSIMSKKLASGTNALVFDVKVGNGAFMKTTEDARALAKALVGISKTAGVKSVALLTDMSQPLGITIGNSLEIAESIGILKNRGPKDVHDLTVALAAQMLVLGGKAASLEIASGLAEDALRDGRALNAFKQLITAQGGDASVVDDPRKLPQAKYRIAVKAAESGIVDQIDTNALGLAAMQLGGGRAKKDDILDLAVGLVLHKKLGTPVTKGDTLVTLHADTENVDAISNMVRSAYHIGDKAPKKTPLIQEVIRP

SEQ ID NO: 1185 - protein, 339 aa, Lactobacillus paracasei
MDFQTLHQLSKTELHCHLDGSLSLSCIRQLAKMIDRKLPATDDELRRLVQAPADSENLGDYLKAFDFVAPLLQTKKALQLAAYDVVEQAAEENVRYIEIRFAPVFSLAGGLSLVEATQAVIEGLHQGMATYDIMAKALVCGMRQLPNTDNQTMFKTTAPLLGSTLVGGDFAGNEADFPTNVCAPAIKTAQSLGVPLTFHAGECHCPQNIAEAVRLGIPRIGHATACFDQPALIEKIVETGTTVELCLTSNLQTKAARTLAEFPYQALKKAGAKITINTDNRTVSNTTLTQEYQRYQQAFGTTAADFLAFNLNAIDAAFIPDADKKSLRDRLHQDYATYC

SEQ ID NO: 1186 - protein, 80 aa, Lactobacillus paracasei
MLINQTDVIATQLQQIAYPYINAITETGVPITITTNQKQRDDPAFWQSISAILKARLWVPVSKKYHELTDHDWLATPEMP

SEQ ID NO: 1187 - protein, 162 aa, Lactobacillus paracasei
MDQFSISNLADWLEAHNDDLMAKKTQLDPNKVYAIVDYLKVLKKPAEKYLHMKQADYYTTESDHKLNLPDDNAPLTATHDRIMVNHVDGSIKNDQLNFTYNHEPVFDGGYTPQRDLNIVKYGLEVIGAVATSGHIETVSAALSPDAVLTLVLAATAFSSYQA

SEQ ID NO: 1188 - protein, 57 aa, Lactobacillus paracasei
MMLSNREPYPIIDYLGRPIKLSLFVTYRLRIKNGYILALRRNQHQQVIPNLMAKNAS

SEQ ID NO: 1189 - protein, 306 aa, Lactobacillus paracasei
VKRVRLWGIFLAILGSSFWGISGPISEALFDQGIKVSWLISSKMIIAGIVLMLVAFWKERKAILAPWRNTRDALQLILFILFGMIGMQYIYFKAVAVANAATATILQYLSPVVVLIFLALRLREKPRRIDIVTICFAMMGTALVVTKGHFTHLAISPNAFFWGIMAALAAAAYTLLPAGLLHRHSPIVVTAWAQLIGGLLIDVFDPFWKEIPHLDHAGWAGYWFIVIFGTIIAYSVYLASLQFISPTAATLLDAFEPLGATVVSVVFLHMHMGFAEILGGVIIILTVAMMAMATPHGPKLEDRSPD

SEQ ID NO: 1190 - protein, 204 aa, Lactobacillus paracasei
MVKSNDHAEEAKTEAALQRYQERKRYTDWVAKMSPAMRAYHDHEWGVPVHDDQKLFELLSLEIFQAGLNWELVIGKRAPFNDAFHNFAIKQVAAMDEEDVEQLLQRQDIIRNRKKLEATITNARAVLKIQAKYGSLDHYLWHFVNGKPLVNRPKSRAEIPTKSALSVKIAKDLKNNGFAFVGPVIVYNYLQGAGLIDDHVVMQD

SEQ ID NO: 1191 - protein, 148 aa, Lactobacillus paracasei
MDQEYDRLLVPVDGSKEAELAFNKAIKVALANRAHLDVLNVLDTKQFIGSYGGMISGDAVYQLTQDAQEYLDNLKDQAKSAGLDDLDIHIRFGNPKTVIATDFPHDHHNDLIVIGATGLNAVERVLVGSVTEYVNRTAPCDVLIVKTK

SEQ ID NO: 1192 - protein, 129 aa, Lactobacillus paracasei
MITNGVGSVLRQIRKGRGESIVEVAKATHTSPASFTKWENDQTIPSERSIRKLAEYYNTDPLELLSVAYPDKYAQKQENEQPVGDGPSIRVEDLLGNNSVLTYNGVPLAAGTKSLVAAFIAGLIIAQPE

SEQ ID NO: 1193 - protein, 262 aa, Lactobacillus paracasei
LEPNVLDIKNGLNFRDLGGYKTKSGQLVKPKKVIRSAKLSELSDQDLQYLSDYGLIADVDFRSPEEQAAEPDRYPEHATYHFVPVFPTDETKSSEQADALQKSFSRDPHAGFENMVKTYADIVKMPSAQKAYRQFFDILLSNDDENGAVLFHCTAGKDRTGMGAVYLLSALGVDGHTIHQDYLATNDLIQPMVEKNLAAARKHGATDALLANIQDLGTVSGAFLDSALATIDAEYGSMRDYLQDELKLTPAEKRDLRELYLQ

SEQ ID NO: 1194 - protein, 380 aa, Lactobacillus paracasei
MDLKMMIKAHAKELGIDKIGFTTADNFAALKPSLLAQKAAGHTTGFEHQNIDERLYPDKIFDQPQSIIAIALAYPAKIHERPPRTGPKRGRFARASWGIDYHTVLDRKMASLIKFIKRTAENDPNLRFKPMVDTGELIDVVVAQRAGVGFIGKNGLLITPEFGSYVYLGEIITNIKFAPDEPMTSQCGDCTRCIDFCPPKALLGDGRMNGQRCLSYQTQTKGYMDPEFRPMIRNVLYGCDICQQVCPFNKGKDFHIHPEMEPDPETVLPELIPMLTLTNKDFKTRFGKLAGAWRGKKPLQRNAIIALVNLHDRSAIPHLLEVIEHDPRPMIRATAAWAVGKLQSSSNPEIETFLKTALAKETTPEAQVAFQDALDHLTQH

SEQ ID NO: 1195 - protein, 121 aa, Lactobacillus paracasei
LKLYQGLTQVQVNEEMADDTPDFTITTDLTKPLHYSPSELYHYLDAVLKPGSRHDQNNLKYVTDAAFIGENFDFNSIPYTAKLKDFEEKMAFARNLVSDLNRHVSVNLNTKNHTFELLFVD

SEQ ID NO: 1196 - protein, 178 aa, Lactobacillus paracasei
MQTKTLTRMGLLLAVLIGLAFAPPITVGFLGVPIVLQNMGVMLVAMLLPTRPATITIGMLLALAALGLPVLTGGRGGIAIFLGPTAGFMYGWLLTPIAYAAITHYLKPDFWLTKVLGMTFGGVLLTEFLGAAWLAATTSLGFVPALASVLIYIPGDLLKMALSVLVVQQLTAVIPALR

SEQ ID NO: 1197 - protein, 134 aa, Lactobacillus paracasei
VTIDEVSKKFNLTKDTLRYWERIGLLPEIQRNQSGYRDYDEHAVNWVYYIMVLRKAGMSIESLSEFVKLLREGDQTIAARKSLFIEQRDALIERRDNINKTLRYLDYKIDHFEDHMLGYENEKLAYEGKLTEEK

SEQ ID NO: 1198 - protein, 157 aa, Lactobacillus paracasei
MASKVLIVYYSWSGHTATLAKYLQQATDADLLALRVPEQTFSSDMYDTSGRAKHQVASGNLPHLTTVIPDLTGYETILVGGPVWSAAPSTPVLSFLKQEQGSRAVFRPFYTDACTPGAYEQAFKQAAGQLQVKQGFGMAGDNVAQKKAEISAWLTTL

SEQ ID NO: 1199 - protein, 379 aa, Lactobacillus paracasei
NADPDEPENDENTISPRPANLDEHYDRGENASEMKAAVFLGPGKVETQDVPKPQLQKPTDAIIKIVRASVCGSDLWWFRGISHRDANSLVGHEAIGIVEEVGAEVHDIHVGDFVIAPFTHGCGHCAACLAGFDGDCMNQEAGGNGGYQGQYLRFTNANWALVKIPGQPSDYSDEMLNSFVTLADVMATGYHAAASAEVKQGDTVVVMGDGAVGLCGVIAAKLRGAKRIIAMSRHEDRQKMAIAFGATDIVPERGDEAVQKVLAMTNGAGADAVLECVGTEQSVDTATKVGRPGAVVGRVGVPQKPEMNTNNLFWRNIGLRGGIASVTTDDKQLLLKAVLNGEIHPGKVFTQRFDLEHIQDAYDAMDQRKAIKSLIVVEG

SEQ ID NO: 1200 - protein, 217 aa, Lactobacillus paracasei
LIKNILIMAANGQISRLIENQILNDDQFANVHLTLFLRHQSRLAQLAKNPRVTLVEGSLDRLDDVKKAMVDQDLVFVGVVDHSKGSQQTQNVIAGMKAGHVQRVIYTNVLGIYDEVPGTFGKWNKATIGNGLPSALKSDQLLEQSGLDYTTLRLPWLNDRDVKYQLTHRDETYVGVSGSRKSVADVVLKIIADPDYLKNDSVGIADPDTAGSDRPVY

SEQ ID NO: 1201 - protein, 76 aa, Lactobacillus paracasei
MGKERPVAFEDAVLAIIMTILVLELKKPETMNWSGLWALRANFFAYALSFFWIGLMWASHHNNWHLVKKLIDKQLV

SEQ ID NO: 1202 - protein, 186 aa, Lactobacillus paracasei
MDAPYPNMQDLPDLPSESGNDQPIWQALAKKIPSVADRRVLVIHCGDGWFCRHALNGGATAVLGIDTDAVAIQDARAVASSDRLRYRIMPDKWLKLLTGPYDLIVGSFDQSPEELRAMTHVLSALLSPKGQLIAAVAPSKQPIGDDLAVDELISSQLVINRWYQVTDKRLTQTEQLYLLLSSRVSH

SEQ ID NO: 1203 - protein, 354 aa, Lactobacillus paracasei
MKKLLSTVLFSAVALSAVALSKPSHVSADTKNTETATVSAPASDKTEADVTYNGGATTVWTSPTAGQQVKRYVTTGEHVKFVNSKKVFAEIWYETEDHGWIPERYLSINTLQQLAPLTKKADAAAAPTQTTSPAEQAAQAATASANAQAASSAAAQSAAASAAAQSAAESAAAQSAAAESAASVQAAAESAANQQAQQQAAEQAQQAQQAQQQQVQQQQVQQQQVQQQQAQQAAAQQKQQQQVQQQAVSQPVAQTTQTTQPTQSATNKGTFKISFYDPAVLGSNMGYSGVAANLSVFPKGTVLRITMSNGQTLTRTVNDTGSFAAGNPNQLDVAMPSGQIPAAGILSATVEVLQ

SEQ ID NO: 1204 - protein, 206 aa, Lactobacillus paracasei
MKLTVMQHTDTEDLGTIKDWAADKQVNMVTYRPDQGDPIAQLNPAEMDGLILLGGPMSVNDDFDWLAVERILIRSLNKLGRPVLGICLGAQQITKAFGANVYRMPQPEEGIGTVRGTDGTLLNVFHWHGEAMSRLPGSTLLYENEHAVQGFAYHDHIVGFQFHLEVTPDMIAEIGAAAGKPQGPVNPGILDHGHQVLAATLDRLFL

SEQ ID NO: 1205 - protein, 247 aa, Lactobacillus paracasei
MEQVKMYQETMAAFKARPEMPKTQVISEPLPQTPAKGTEPPQIALRNVDVFQLMSELTGKIGVMNFASPVDPGGGVAVGARAQEEAIAKGTYLVPALEQHMADYYELNRRKPNRGLFSQKLIYAEHVRQLFDDQGRRLTDKYVDIVTVAAPNRRIDATLDDATAMNDIAFKILQTLRAFKAHDVDQVILGAFGTGVFGNPVAPVAKLFRKALLLPEFEGAFKRVYFAIYDPAMTTIKPFAAALKGQD

SEQ ID NO: 1206 - protein, 463 aa, Lactobacillus paracasei
MESGQIVPNLLVMLVTFLFAAFFVACEFALVQSRPSALEEMIDNGTGRKAKVERALRMVHNLNEYLSTTQVGVSLAGIILGWIGETTVEFLLVDLFGLTHLSLPNGSLHAVGAILGVIILTYLEVVLTEIVPKNISIDYPIKTLMLVVTPLHYFHILFYPFVWLLNVSATGIVKMMGMKPADEGNEAFSQAEILSLSKNAVTTGDMEQNDVIYMQRAFELNDKTAKDIMVDRTSLFVIDITTTVKEALRDYLTQGYSRFPVVANGDKDKILGYVYIYDLVKQGQVDPSVKVSKLLRSIINVPEVTPIHSILAQMIKKQTPIVVVVDEYGGTSGIVTDKDIYEELFGTVKDEIDDVSDEYIRQTDDPKVFRVSGKTTLWDFERYFHTNIKAFTDSEIITIAGFIMEDHPDLKLHDKVKIDHFNFTVADFSRGFANWFDVTQDPKPVKQTVAEEVKEAKNDDNKH

SEQ ID NO: 1207 - protein, 484 aa, Lactobacillus paracasei
LTTTDVNGHPYNRLLLVITLLIGTFTTFLTQTILTTAYPTLMADFHISASAVQWLTTGFMLIMGIMIPVSAWLLDKFNVKYLYLTAMTIFFLGSLICWLAPDFQVLLAGRLTQAIGVGMSMPTFQTVMFTIFPPGKRGSAMGLAGIVIGLAPAIGPTLSGWILLNHTWRALFAVIMPIAAGVVLLAIYSMRKVLPTSNPKIDIPSIIASTLGFGGLLYGFSTVGDAGWTDFQVLISLAIGIIFVALFCVRQLRLETPLLELRVFKSRTYTLSVILTAVAFMSMVGVEMVLPMYIQTIRGESAFHSGMILFPGAIMMGIMSPITGRIFDKIGAKRLAVAGLFLLVAGSLPLVTLTANTPIIYITTIYTVRMFGITMVTMPVTTAGMNALPTHLINHGTAVNNTVRQVAASIGTAILVSVLSVVTKDATPAASGRLLDPIHYTNAMNNAVIAGYRAAFAVSLVMAALGLVLSLFLKTDVIDRRDAS

SEQ ID NO: 1208 - protein, 164 aa, Lactobacillus paracasei
MIILLLIVGALAFFWAVVLMQPSRRRQLTIWVSAGLVLAPILLLSVNDLYHVGFNIDETTELQPLAPMDDQLQISRRPIGTAKKHFSYRYLIISDATVHTATPSTTVSTRIEHGTIPQVAVTTQKLTYSNALTAILFAGSGEQGKAIGKIYTFTLPANWQIVDQ

SEQ ID NO: 1209 - protein, 185 aa, Lactobacillus paracasei
MIILASHSPRRQELLKRIVPDFESHPASINERALPVLDPPAYVQSLATAKGQSLVPSYPGATIIAADTMVAFQGKLLGKPHDRAEAKQMITALGGQTHQVYTGLWVRLDNGSVRQQVVTTDVTFWPLSEADVESYLAEDAYQDKAGAYGIQDAGALLVKSIQGDFYNVMGLPISTLYRMLLAEPQ

SEQ ID NO: 1210 - protein, 651 aa, Lactobacillus paracasei
MPKIHQLSATLSNQIAAGEVIERPASVVKELVENSIDAQATQIDVLISAAGLQEIRVSDNGIGIAPDDVATAFLRHATSKILTTRDLFNVHSLGFRGEALASIAAVADVKLTTATDSGIGTQIHVKGGEVEAQSTAAHRRGTDVEVNDLFFNTPARLKYMKSQQTELGKIVDIVSRLAMANPDIAFTVSHDGNMVVRTAGQGDLRQTLAGIYGLSVARSMVDFKAQDLDFRVSGLTSLPETTRASRNYLSLVVNGRYIKNFQLTKAVIAGYGSKLMVGRYPMGVINIEMDAALVDVNVHPTKAEVRLSKEDQLSHLLSEAIRTRLAKENLIPDALDNLPKRERYDLDQLELTLNKISPKTMPSVQPQQGQQLRENTTTNLADTAAEEPTPAPTSPDLEIGDLDDQPIFNEPQRLAAWDQRYQRLASNVVPTLMADEPEPDISHVESAERFPNLTYLAQVHGTYLLAESGDGLYILDQHAAQERVNYEYYRQAIGEVSNDQQHLLVPIVLDYSAADAISIRDHRDVLESVGLYLEDFGQNSFVVEHHPTWFKAGQEEDTIKEMVDWVLRDGRMTVAAFREKTAIMMSCKRAIKANHHLDDRQARALLQKLPECENPFNCPHGRPVLVHFSNTDLEKMFKRIQDSHESGEMQA

SEQ ID NO: 1211 - protein, 860 aa, Lactobacillus paracasei
VNFVPQKTSETPMMQQYNEIKAQYPDAFLFYRIGDFYELFNDDAIKGAQLLELTLTARNKSADDPIPMAGVPHHAVQSYVDILIDHGYKVAICEQMEDPKKAVGMVKRAVIQLVTPGTNVDIKAGAAKSNNYITAVMPHAAGYAFAYADVSTGELKVTDLKSKFALQNELSALATKEIVVPEELTDDDAGMLKQGERLLSVQPDAEPTSEGSYVSQALTDPAEAAVVQMLMAYLLNTQKRSLAHIQKAVAYQPSAYLEMDQDARSNLDILQNSRTGRKGDTLLSLLDSTKTAMGGRLLKQWLDRPLLDIDAISVRQNQVQDLLDHFFERSELQERLTKVYDLERLAGRVAFGTVNGRDLIQLQTSLDQIPAIQDVLGKLDDGSFKALRSKMDPVSDVAGLIRRAIEPEPPISVTDGGLILRGYNQKLDSYRDAMKNSKQWIAELEASERKATGIHTLKIRYNKVFGYFIEVTKSNLDKIPEGRYERKQTLTNAERFITPELKEKETLILEAQESSTALEYDLFQDIRDKVKAQIKRLQALAAQISSLDVLQSFATVAENSHYVRPTMHAGTHDINVKGGRHPVVEHVLGRDSYIPNDVIMNHDTDMLLITGPNMSGKSTYMRQLALIVIMAQAGSFVPADVADLPIFDQIFTRIGAADDLANGESTFMVEMLEANAALSHATASSLILFDEIGRGTATYDGMALAQAIIEFLHDHVHAKTLFSTHYHELTSLSDSLAKLKNVHVGAVEEHGNLVFLHKMMPGPADKSYGIHVAKLAGLPADLLARADTILKQLEADAPNKTAPAPAPQVEEQQLSLFEEPKPTPKNSPILTKLAKFDLMAATPMDAMNFIFDLQKHLKKK

SEQ ID NO: 1212 - protein, 609 aa, Lactobacillus paracasei
MMHLKRLFIGRPLKSSEEGGQKLNIFKALAMLSSDALSSVAYGTEQIVLVLTTLSAAAIWYSLPIAAFVLVLLISLTLSYRQIIHAYPSGGGAYVVASENLGKNAGLTAGASLLIDYMLTVSVSVSAGAEAITSAIPALYGKQVIISLIIIFILMSMNLRGMSESANFLMVPVYLFVVVMTGMIIWGLYQVATGAIPYKATSFVGAAIPGVSMALIFRAFSSGSSSLTGVEAISNAVPFFKIPKEKNAAKTLAIMAAILGFFFAGITFLNYWYGIVPVAKVTVLSQVAKETFGGAGIMYYVVQFATALILAVAANTGFSAFPVLAFNLAKDKFMPHMYLDRGDRLGYSNGILTLALGAAALITIFQGSTERLIPLYAVGVFIPFTLSQSGMIIHWFRHRGKGWIGKTIANFSGALISFAILVILFAYRLLDIWPFFIVMPLAIFMFYKIRDHYDKVAEQLRLPVEVAQHDYDGSTVIVLVGNVTRVTRAALNYAQSIGDYVIAMHVSMDENPNKEKETQSEFRADFPEVRFVDIHSSYRSIEAPTIRFVDIVARNAAKRNFTTTVLIPQFVPRKKWQNILHNQTNFRLRAAFASRENVIIATYSYHLKK

SEQ ID NO: 1213 - protein, 145 aa, Lactobacillus paracasei
MAQTRPSHSGPLTLRSLSALAHAHTKKRGDLMKLIQNPIRLNASLHKMLPNTMRYLYNRKPVKFFELYTLGSVHVYYVEGFDQVDVVLTHDKRTIKDAEIDFVLEKLLPDTPKADLKIDHAAKSEIEHEVHRKLKVHDVVIIEKA

SEQ ID NO: 1214 - protein, 544 aa, Lactobacillus paracasei
MAKEIKFSEDARAAMLRGVDQLANTVKTTLGPKGRNVVLDKSYGSPEITNDGVTIAKSIDLEDHYENMGAKLVAEVASKTNDIAGDGTTTATVLAQSIIREGMKNVTAGANPVGIRTGIEKATKAAVDELHKISHKVNGKKEIAQVASVSSSNTEVGSLIADAMEKVGHDGVITIEESKGIDTELSVVEGMQFDRGYLSQYMVTDNDKMEADLDDPYILITDKKISNIQDILPLLQEIVQQGKALLIIADDVAGEALPTLVLNKIRGTFNVVAVKAPGFGDRRKAQLEDIATLTGGTVISSDLGLDLKDTKLEQLGRAGKVTVTKDNTTIVDGAGSKDAIAERVNIIKKQIDDTTSDFDREKLQERLAKLAGGVAVVKVGAATETELKERKYRIEDALNATRAAVEEGYVAGGGTALVDVLPAVAALKEEGDVQTGINIVLRALEEPVRQIAENAGKEGSVIVEQLKKEKQGVGYNAATDEWEDMAKSGIIDPTKVTRSALQNAASVAALMLTTEAVVADKPDPNANNNAAAGANPAAGMGGMM

SEQ ID NO: 1215 - protein, 93 aa, Lactobacillus paracasei
LLKPLGDRVIVEVVEEEEQTVGGIVLANNAKQKPQTGKVVAVGEGALTPEGKRLPMAVKVGDTVLYDKYAGSEVKYEGQDYLVLHEKDIMAIA

SEQ ID NO: 1216 - protein, 248 aa, Lactobacillus paracasei
  misc_feature (4)..(4): Xaa can be any naturally occurring amino acid
CAAXAMINTERMINALPRTEASESELFIMMNITYMSLQKHGLSIIGAYLVALIGNLLIFQILPVGRLSLGLATVISVLAMIAAGFSERQLVIANAIEEPGVAAPQQRVFWGLIGIVGVLVAQLVGSWLETFLFKIPQTSSLIHQQLSSMATNPWYFLVIGLAIPVLEELTYRKVLFGNLVNVTGIFGGALITSLLFALTQPGGHWLSATLVGLVLAYDYRHTGAVSTAIIARLGSLWVVWLYYLAHTL

SEQ ID NO: 1217 - protein, 352 aa, Lactobacillus paracasei
METRSNRRQQQQKPRRFRWGKLISLIVVVGLFTTGAYALRLYSQAKYAINNTYHATKHVSTDIANKKPFAVLLLGVDTGADGRIEKGNSDTMIVAVVNPKTKKTTMVSIPRDTAAELIGTKEFNMQKINAAYNVGGSDMAINTVSKLVNVPISYYLTINMGALEKVVNAVGGIDVVVPFSFQDPYTGNQKFTKGPMHLNGNMALAYSRMRHSDPEGDYGRQKRQQQVIKAILKKAISVGSLGNFTKLMDTISKNIATNMSFDDMQSIFLNYRDAAKTVSTDHLQGVNAWVGDGAYQIASDAEMQRISNKLRTALGLQTETISNEETKQNAKNTQFDFKATTDQNYIIFTPYD

SEQ ID NO: 1218 - protein, 342 aa, Lactobacillus paracasei
MGEDRLLKLVRSRHKVLLRVIVVFALLLSAVNLGQSIQNYHNEQKYVMDLAQFEESKQEAKKNHLTFYNNKSYEEYREDQRHLFIPNQKGQLLSDLISGRFFTVVSYLIPLIVGLAIASIDQASGFNAAIFSSGFRRRRVFATRYWYGFLSLLGVMMLGSGITIIGYYVAIPAMYVGLSGMNLLGVLLMNIAVVSFMYTIGTAIGTIFASPFWMGVFGLFGTWFGATAADRLIYSTMRSNPVRLSGNNLFFAYFIAAMVISIIGYFATRWLFDHISLENAGNVLLLPKLRWVVMIYALAVIPYGLGQWLLNNELLSYTVSIIAILALGFWWWYRERPQKKLA

SEQ ID NO: 1219 - protein, 295 aa, Lactobacillus paracasei
MSLTITKLQKKIADQAVLNNITFSLSLGQVVGLVGPNGIGKTTIFRTVTHQYRADGGTIELDEQDLTDHPEQRENLFYLDNQHLFFRKYRLDKIAGDYQLLYATFDQARFMALIKKFGLQGSQRFQSLSKGFQALVMVALALASGAPYVFLDEPFDGLDLLIRERIVNLVVDAVADGKRTFLIASHNLVELDGLSDRVLFVKAGRISQDLTLEDVRQQAIKLQLVFKTKAIPDVIREQGRILTIRGRVIEAVFPHFTPEVKAAIAAEEPVLNESLPLSLSDLFKVEFRAKNAEVK

SEQ ID NO: 1220 - protein, 121 aa, Lactobacillus paracasei
MATDPYAHLAYYERLVLQIKAQVVQGVLLPGDKLPSVREMAKQEQLNPNTIAKAYKQLEADGVIYVEPGRGSFIAEPLRQANTKDIAAFRPKFDALVVEAQSLGISIPILQAWLNEKEGQA

SEQ ID NO: 1221 - protein, 217 aa, Lactobacillus paracasei
MAETIIPKATAKRLPVYYRYLNFLANSGTTKISSTELSDAVKVDSATIRRDFSYFGALGKRGYGYDVVDLLNFFKKILNQDRLTNVGLVGVGNLGHALLNYNFRQANNIRISAGFDINPELAGTIQSGVPIYPMDEMIKQIKDQQIEIVILTVPIDAAQHITDDLVKAGIKGIMNFTPIRISVPSYVRVQNVDLATELQTLIYFLEHYGPTLKEPEA

SEQ ID NO: 1222 - protein, 650 aa, Lactobacillus paracasei
VIILQAQQVGRSFNGNELFANVNLEIQNGARIGLVGPNGIGKTTLLEILTGIAPPDAGQVTTMKNLSIGYLAQNSGLDSDKTIFKEMLTVFAPLQAMARQIHDLEVKLGDPQLIADKEAFAATMKQYDQLQHDFNEQNGYGYEAEIRSVLHGFQFGETTYDKPVGTLSGGERSRLALAKLLLEKHDLIILDEPTNHLDIETLSWLEGYLKTYPGAILTVSHDQYFLDHVVTEIYELDHHHATHYKTNYSGYLKQKADRQAQAWKAYNKQQEEIAKLQDFVDKNIVRASTTKQAQARRKQLEKMDVLEKPAGDNKTVHFNFTPTRPSGNEVLKVEQATVGYEPDKPMAGPIDFQVNKFDRIAIIGPNGVGKSTLLKSVLGKIPFLKGNAKFGANVDVGYYDQEIQQLNPKNTVIDEIWDDHPMMPEKDVRSVLAAFLFLADDIQKPVSALSGGQKARLELTKLALKHDNFLVLDEPTNHLDINSKEVLEQALKDFSGTVLFVSHDRYFINELATNVVAIAPTGSTTYLGNWDYYQEKLTETQAEAAAAAAAQPTAKTETAGATSYQQSKEDARAERKLQREVDDLEQQLQDLSQQEAKIQKAMTAPDVLSDYVKMQTLQTELETVQKQTAKVEDAWEEKGIQLEDMHADNN

SEQ ID NO: 1223 - protein, 111 aa, Lactobacillus paracasei
MAEKTIMLVCSAGMSTSMLVQRMKKAAEADGLDVDVFATAAADADNKLASEPVSVLMLGPQVRFMESQFAAKVAGTNIPMAVIDMRAYGMMDGEKVLRQALALIDEKASSK

SEQ ID NO: 1224 - protein, 341 aa, Lactobacillus paracasei
VAARELILAFESSCDETSVAVVENGDTILSNIIATQIKSHQRFGGVVPEVASRHHVEQITLVTDAALKEAGVTYDDLTAVAVTYGPGLVGALLIGVTAAKTIAYAHHLPLIPVNHMAGHIYAARFVKPLAYPLLALAVSGGHTELVYMQSAGEFEIIGDTRDDAAGEAYDKVGRILGIPYPAGKEVDRLAHLGQDTFHFPRAMDKEDNLDFSFSGLKSAVINTVHHAHQLGQELSREDLAASFQAAVVDVLVHKTQKALHQYPVKQLIVAGGVAANQGLKEAMNESLAVNFPDVDVIVPPLRLTGDNGAMIGAAAHIEWAKQHLASESLNADPGLSFTHAS

SEQ ID NO: 1225 - protein, 179 aa, Lactobacillus paracasei
MFMLRKFKSWFDRTTPDELSFKPQTITVRNKEYLLRRMTEDDVDAALAIERRIYHDTPWDRYAFFSELRKVRHSLYLAVEDAGQLVALIGTWFTLSEAHVTNIAVDPAYQHMGLGRFLMQFMIGRAIDYGSQKMTLEVRTNNDIAKHLYRSLGFQDGKIKKGYYVSNHDDALDMYRPLP

SEQ ID NO: 1226 - protein, 240 aa, Lactobacillus paracasei
MRLLALDTSNEAMSVAVLDNDKLLAQTTINRKRTHSEQLLPAIDDLVAASGLQPEDLDKIIVADGPGSYTGIRIAVTTGKTLAYTLNIALAGVSSLAVLAANITDTKAMIVPIMNARRNNVFTGVYQWNKGRLINVVTDRHVPLKLLLTELATLHQPVIFVGSDAAMFRAQIIETLGGLAQFAPSWLNLPQALRLGQLGKDLPPVSVYDFVPRYLRLTEAEHNWLEAHPGRGHDVYVEKV

SEQ ID NO: 1227 - protein, 201 aa, Lactobacillus paracasei
MFAGLIIVVVLALVGTGIWALQLERRIVTMQLATHKMMFPNQVRSGRKTYIRNLYRENTIAKWVRRLGLIGSIVGGLTLAYAIGNQFYSEFGQLPIIGNFYVFPTDYLTERDHALWVLAVATMIAGVAWSWLAKWLHDALLAANKTTGVQSATDLYWTPDEIIHQRLWLKITLQGLLVVGGVLLLIAAMTGALPNPGEAWI

SEQ ID NO: 1228 - protein, 172 aa, Lactobacillus paracasei
MQVLSFSSPKLSTRNMVYMAMLMAMQIVLGRFSFGTPWLKISPAFFATILMGYYFGPWLAAGAAALNDQLSIMIFSPGANFPGFTISAAIAAMLYGMFFHGKKVTVLRTLLAVGMVLLISNIILTTLWLNIMGTPWQGIIWPRTIKNVVMLPIQTALSYGTLKAIERIRPHL

SEQ ID NO: 1229 - protein, 324 aa, Lactobacillus paracasei
VTKHILVLHTGGTISMTENSEGDIMPSQHNPLLGADSFVPADVELTTEEIFNLPSPHMTPERMLELVKRIRQAEKEGSDGVVITHGTDTLEETAYFLDLTLDSAMPVVVTGAMRSSNEIGSDGLENLQSAIKTAASDDSRNKGTLVVMNDEIHTARFVTKTHTTNVATFRTPTFGPVGLVTKDGVRFFQELINQEICAIDHLVDKVFLIKAYAGMDGTLFDALPEDTHGLTIEALGAGNLPPTTLPAIQRLLDRNIPIVLVSRCFNGVAQAVYNYEGGGVQLKKMGIIFCQGLNGQKARIKLQVGLSDGKQGQDLADFVDNAVS

SEQ ID NO: 1230 - protein, 247 aa, Lactobacillus paracasei
MGKVYEDDYRIPGFAGDRYGRAGLANMMNVMLEISERQLETLHAGMDAINEFQAGWVITQYHMDIQRMPRIEEPLRVGTEATTYNKFFTYRDYWIDDAQGQRLVTVNSNWVIMDLRTRKIVDVIPELVERVGAVSDRKIKRFPRLKKITTPDGQEDFHVRYFDIDSNGHVNNAHYLEWMENSLGYDFLSTHTLRGADIRYEREVAYGTTPVAQYQHDPDDPTKTLHRVVTGEQVNAEAQMIWQDFKA

SEQ ID NO: 1231 - protein, 285 aa, Lactobacillus paracasei
LEQQRSFGSHTTGTLYLVPTPIGNLGDMTIRAIEILKTVDLIAAEDTRHTQMLLNHFEIKTKTISFHEHNTQMRIPELLAKLANGETIAQVSDAGMPSISDPGKELVRTAIDAGVPVVPLPGANAATTALIASGLPPQPFLFYGFLPRKAGEKNRELEKLAHESATLLFYESPHRVGKTLAAMQTAFGDRQAALARELTKKFETFIRGSLSALQTYAAGDLKGEFVIMVEGAADKPAVDVTVPLKMQVEAIVATGAKPNAAIKLVAKQNGLAKQVVYDAYHELEK

SEQ ID NO: 1232 - protein, 112 aa, Lactobacillus paracasei
VEKKELYDGFLTLEKHAQQMLREIAAMKDDMAETLERNAELEIENKHLRQHLAELEKDDNKTSDGGVELSKSKQNLESLYNEGFHVCPMFYGQRRVNDEPCAFCTEIIYGEN

SEQ ID NO: 1233 - protein, 325 aa, Lactobacillus paracasei
MTKFLIDSLQPKLVAQFARIIDRKQLAQSYLFVGPKGAGKLALAEWIALRLFCQNVQDGAPCGQCPECERILNHNHPDVMVVKTETQSIKVDDIRGLKQEMSKTGVEGNQRVFVVEDADKMTAGAANSLLKFFEEPVPGMTVILTATSKNQLLPTILSRAQVITFQSPDRSAVIAKLEEGGATSQMARVAGRLTGNVADAQALLASATFQDRVTKVFQLLERLADHDPESFVRVQTQLLPIAKDADSQRQVLALIGLAYADALNQHFQVTSMQQLDLPAIGVLAQRSSAQLTTALQAILTAQVRLSQNVTFQSATEQLMLKLLEG

SEQ ID NO: 1234 - protein, 109 aa, Lactobacillus paracasei
MKLILAIVQDKDSNLLSSQFIDANIQATKLSTTGGFLKAGNTTFIIGIADDRVDEVLKIIKETSQTRQQFMTPPVNLDATSDSSMAYPVEVQVGGATVFVLPIEAFHRF

SEQ ID NO: 1235 - protein, 214 aa, Lactobacillus paracasei
VTGTFITFEGPDGAGKTSVLKTLIPQLEQHVRVPLHLTREPGGAKISETIREVILDPANTAMDARTEALLYAASRRQHLVEVIQPALAQGDIVVCDRFVDSSVAYQGGGREIGPDAVLKMNQFATAGLEPALTLYLDVPVQMGLDRIKSHQNERQYDRLDQESLAFHERVHDAYMTLIVDNPQRIVSIDATEPLEKVVAACFQTITRRFPELFN

SEQ ID NO: 1236 - protein, 87 aa, Lactobacillus paracasei
MFGRKQVKVKEEKDEELMMLVYRVRDQMSAQRKLVATFREVDEQTKAQVALQTGLFDFLYREARTRQIKGELVARVAAEQIAEYRDL

SEQ ID NO: 1237 - protein, 199 aa, Lactobacillus paracasei
MQYPEPISKLIDSYMRLPGIGAKTATRLAFYTIDMNKDDVTAFAKSLVAAKEDLHYCSICGNITDEDPCAICRDKSRDQSTILVVEQPKDVMIIDRAQDYHGLYHVLHGVLSPIEGRGPEDLNIESLLKRLKANKAVKEVIIATNATPEGEATAQYLARLIKPAGIKVTRLAHGLSVGSDIEYADEMTLMKAVEGRTEL

SEQ ID NO: 1238 - protein, 102 aa, Lactobacillus paracasei
MRGMGNMQGMMKQMQKMQKEMQAAQKELYATEFEGKSASDMVTVKFTGEKIMKDIQIKPEAIDPDDPDMLQDLIIEAVNQAMGTIDKETQDKMGKYTRGLPM

SEQ ID NO: 1239 - protein, 566 aa, Lactobacillus paracasei
MVSYQALYRVWRPQQFKDVIGQEAITKTLKNALITGQTSHAYLFTGPRGTGKTSVAKILAKALNCLHLEDGEPDNTCEICQAINNGSLTDVIEIDAASNNGVDEIRDIRDKAKYAPTQARVKVYIIDEVHMLSSGAFNALLKTLEEPPAHVVFILATTEPHKIPATIISRTQRFDFRRITPEDIVKRMRFILDDKQITYDDAALKVIAKAAEGGMRDALSILDQVLSFGDNHVTTEDALDVTGGVTTAVLGKYLAAVLAKDHAQALKMIEDLLASGKDPGRLIEDLIEYLRDLLVNQQAPTLLGDLEKSLLDDQFKILSENFKPEQIYHMIDVLNSTQQQLRMTNHPEIYLEVATVRLSETTTPQVTAAPAQAENPQFEKLTAKVKQLSDQLKRVEANGGTIPPPTRTRKHVKAKANHVNRKAIYPILGAATKQDLTNLKDVWPNLLGLLSITKRAMMKVSEPVAASPNGVIVSFDYDIYVERAMNDAALMTELESGLQKLTGKQPKIVLVQSDVWPTIRQDYIQELKAPENKEQKADTKPQIPPVVSKLTELFGKDAPNVTIKND

SEQ ID NO: 1240 - protein, 168 aa, Lactobacillus paracasei
MDEHDINQFMDAALTEAKKAAAIGEVPIGAVIVHQGEIIGRGYNLRETTQDATHHAEMLAIQAACKTLGTWRLEDCSLFVTLEPCPMCAGAMINARVATCYFGATDPKAGVAGTFYNLLADTRFNHQVVVVSGIKADESATLLQTFFRTIRAKRKAAKRAGQTSENQL

SEQ ID NO: 1241 - protein, 109 aa, Lactobacillus paracasei
MTKSKYLALGGAVAAAAIAAGAFVCAKSLTEYFERQHQRRQVEGFVKKIFGDSDRVQTVLDKLSDDDVASLLRVSDKLRSLKDSASEYAGSARDQGMAAIDRLKAALSH

SEQ ID NO: 1242 - protein, 198 aa, Lactobacillus paracasei
LNHYYTNDPDLAHDEHSFDFELGGHSLRFTSDNGVFSKHTVDFGSRVLIATILAEELPTGPILDVGTGYGPIGLALAKHFPDRQVTMSDVNERALALAQRNATDNAISNVTIVESSMYDQIDGQFGVIVTNPPIRAGKTIVSGILAGAAEHLLPHGQLYAVIQKKQGAPSALKLMKTIYPDASIVKKEHGYYILKATK

SEQ ID NO: 1243 - protein, 869 aa, Lactobacillus paracasei
MKKLFRETGSFLKKHLTTLKVLFVLAVLVFVIFEVGRISQDLNGEQMRASLATQSPVSLLILLVVGLIAVTPMLTYDFVITELLPGHYKPAYVIKSGWIVNTFTNIAGFGGLLGASLRANFYHEKASQKQVLFAISKIAMFLLAGLSLWSMIGIVVIFVFGIGAEFANYWVWLVGGAAYFPLLMIISHVRDSEFFADMPLKRQLRLTLGSFLEWGGCAAFFLLIGYFLEAPIPLSSVLPLFMVANVIGVISMVPGGLGSFDVLMIVELGQLGLDSSAAVVWLLFYRLFYYVIPFLIGAGLFAQDAGKRLNAYLEGLPVQLIRKAAFGFLVVFLYFSGIMLLLRGVAPDLAFQNTLYQRLYPYTFLFLDRVTNVIVAFLILGFGRGIASRVKRAYWPTVIVLIVAMVASLREDNHLRFIVFLILVVIALILTRRELTRDRLALSWGNKLIDGAVFGLTFIFYAFAVFYNAPAIHHRHVPDVFLFPSERMFFTTLIGVMLAALTVYLIFRYLSAPTKSLADPYDEARLKAVVAKFGGNEVSHLGLMRDKSLHFYQVDGEDRVFFLFKKKADKLIVMGEPVGDETQIPAAIADFMKQADDQDMSLVFYEINESLTMKLHEFGFDFMKFGEEGYVDVTTFTLAGTKRKGERALMHKFEREGYSVELLKPPFDDALLDDLQTVSDSWLDGRSEKGFSLGFFDRHYLNQAPIAVVRAPDGKIVAFATDMPTGNNEVTSIDLMRSSADAPSGIMDEVFIHLFELAKDRGFKYFNMGMAPLANVGTSSYSFIEEKIAHLVYEYGYRFYGFQGLRSYKNKYVTEWVPKYVAYRKRTSLLFTLLQIMMVVNQKVTFATPNKWWPKRLAWVSRLGQGIDK

SEQ ID NO: 1244 - protein, 137 aa, Lactobacillus paracasei
MLMQTHLYQELPVYQDTQIGALKAIALKLTNDFNFDYQEVLSSLLASAGEQTQTINDQAILTYGHVTSLTEPVVIGFDFGKALPWAAGHQISQAIVLLVPVDTAEATIQDRLQTISAAIAQDQDLKTMTQTATAAIA

SEQ ID NO: 1245 - protein, 310 aa, Lactobacillus paracasei
MANIHDIARLSGFSTATVSRVINQQHYVAPSTRAAIQAVIDQLDYVPSTMAQNLSAGKTRTIGVILPHTDHPYFEQLVTGILNAAMAGNYHAVILPSRYDQSLEQDYLEDLRRHAYDGLIFTSHGLGLRTIAKYQKYGPIVVCENPGKIKLAAAYADRTPAYQEAFQWMGNQGYSKIALLLSRPYAQSATSKLTINSYVDVFGKRPADEMIVYHMRTFEDGYQAGARLVNEHPDFILGNGDDITAGLRQYFVDHHLPIPPLMGQENQLSSRLLQMSTIDHHVTAIGAAALKLALRDDIAQTVIQSDLILR

SEQ ID NO: 1246 - protein, 1902 aa, Lactobacillus paracasei
MQRKKKGLSILLAGTVALGALAVLPVGEIQAKAAISQQTKGSSLANTVKAATAKQAATDTTAATTNQAIATQLAAKGIDYNKLNKVQQQDIYVDVIVQMSAAPASENGTLRTDYSSTAEIQQETNKVIAAQASVKAAVEQVTQQTAGESYGYVVNGFSTKVRVVDIPKLKQIAGVKTVTLAKVYYPTDARANSMANVQAVWSNYKYKGEGTVVSVIDTGIDPTHKDMRLSDDKDVKLTKSDVEKFTDTAKHGRYFTSKVPYGFNYADNNDTITDDTVDEQHGMHVAGIIGANGTGDDPTKSVVGVAPEAQLLAMKVFTNSDTSATTGSATLVSAIEDSAKIGADVLNMSLGSDSGNQTLEDPEIAAVQNANESGTAAVISAGNSGTSGSATEGVNKDYYGLQDNEMVGTPGTSRGATTVASAENTDVISQAVTITDGTGLQLGPETIQLSSNDFTGSFDQKKFYVVKDASGNLSKGAAADYTADAKGKIAIVKRGELNFADKQKYAQAAGAAGLIIVNNDGTATPLTSIALTTTFPTFGLSSVTGQKLVDWVTAHPDDSLGVKIALTLLPNQKYTEDKMSDFTSYGPVSNLSFKPDITAPGGNIWSTQNNNGYTNMSGTSMASPFIAGSQALLKQALNNKNNPFYADYKQLKGTALTDFLKTVEMNTAQPINDINYNNVIVSPRRQGAGLVDVKAAIDALEKNPSTVVAENGYPAVELKDFTSTDKTFKLTFTNRTTHELTYQMDSNTDTNAVYTSATDPNSGVLYDKKIDGAAIKAGSDITVPAGKTAQIEFTLSLPRSFDQQQFVEGFLNFKGSDGSRLNLPYMGFFGDWNDGKIVDSLNGITYSPAGGNYGTVPLLTNKNTGNQYYGGMVTDADGNQTVDDQAIAFSSDKNALYNDISMQYYLLRNISNVQVDILDGQGNKVTTLSSSTNQTKTYYDAHSQQYIYYNAPAWDGTYYDQRDGNIKTADDGSYTYRISGVPEGGDKRQVFDVPFKLDSKAPTVRHVALSAKTENGKTQYYLTAEAKDDLSGLDATKSVKTAINEVTNLDATFTDAGTTADGYTKIETPLSDEQAQALGNGDNSAELYLTDNASNATDQDASVQKPGSTSFDLIVNGGGIPDKISSTTTGYEANTQGGGTYTFSGTYPAAVDGTYTDAQGKKHDLNTTYDAATNSFTASMAVTNADYAAQVDLYADKAHTQLLKHFDTKVRLTAPTFTDLKFNNGSDQTSEATIKVTGTVSADTKTVNVGDTVAALDAQHHFSVDVPVNYGDNTIKVTATDEDGNTTTEQKTITSSYDPDVLKNAVTFDQGVTFGANEFNATSAKFYDPKTGIATITGKVKHPTTTLQVDGKQIPIKDDLTFSFTLDLGTLGQKPFGVVVGDTTQNKTFQEALTFILDAVAPTLSLDSSTDAPVYTNDPNFQITGTATDNAQYLSLAINGSHVASQYADININSGKPGHMAIDQPVKLLEGKNVLTVAVTDSENNTTTKKITVYYEPKKTLAAPTVTPSTTEPAKTVTLTANAAATGETVQYSADGGKTYQDVPAAGVTVTANGTFKFKSTDLYGNESPAVDYVVTNIKTDDPAQLQAAKQALTNLIASAKTLSASGKYDDATTTALAAATQKAQMALDQTDASVDSLTGANRDLQTAINQLAAKLPADKKTSLLNQLQSVKAALGTDLGNQTDPSTGKTFTAALDDLVAQAQAGTQTADQLQASLAKVLDAVLAKLAEGIKAATPAEVGNAKDAATGKTWYADIADTLTSGQASADASDKLAHLQALQSLKTKVAAAVEAAKTAGKGDDTSGTSDKGGGQGTPAPAPGDTGKNKGDEGSQPSSGGNIPTKPATTTSTSTDDTTDRNGQHTSGKGALPKTAETTERPAFGFLGVIVVSLMGVLGLKRKQREE

SEQ ID NO: 1247 - protein, 299 aa, Lactobacillus paracasei
MKKKMRLKVLLASTATAFLLLSGCQSNQADQTVATYSGGKVTESSFYKELKQSPTTKTMLANMLIYRALNHAYGKSVSTKTVNDAYDSYKQQYGENFDAFLSQNGFSRSSFKESLRTNFLSEVALKKLKKVSESQLKAAWKTYQPKVTVQHILTSDEDTAKQVISDLAAGKDFATLAKTDSIDTATKDNGGKISFESNNKTLDATFKDAAYKLKNGDYTQTPVKVTDGYEVIKMINHPAKGTFTSSKKALTASVYAKWSRDSSIMQRVISQVLKNQHVTIKDKDLADALDNYKKLATTN

SEQ ID NO: 1248 - protein, 114 aa, Lactobacillus paracasei
LNKDAKIICDRIDQHFHPRRNHQYHIDVVNVPFLGKFNFFYKDMSKTERQRSIPLHSVESQDIEYLQQILRGIREHTNLSFEFHGFINGERWASNDRIIERQPSEMELSDGNLF

SEQ ID NO: 1249 - protein, 50 aa, Lactobacillus paracasei
MGTCSDVHKQFSHSKLPKPAYVNLLPFCGTFVNFIYLNLHFQYYAEKYSL

SEQ ID NO: 1250 - protein, 287 aa, Lactobacillus paracasei
GDSLLIKELIPASEACYLHYDRLASELKLNLRDLFLQIGIVIIILGLGLFVYNLSNPVDKSSTTNSNHSTKKSAIIESSADDWVPNKSLFKKNRGNLVYAPMGDSLTEGFFATQDETRYVSSFADYLNEGLGYNVSVGGISGYGGISKNGVAGVGSIIRQAPDLVSLEYGTNDADQKRGISPATLAENLTTIIEDLNSSQKPPKIFLMTTWKNDSDGSYDKAIKKVADKYGYPVVDIRNIWEDPDNSGPAGKTTFKGKSDDFHPNDKGMELIAQKMYTDTYKYISGN

SEQ ID NO: 1251 - protein, 188 aa, Lactobacillus paracasei
MDGVAIWQYTSAFGLSQGLDGNIDLLGVTDNGYSKQPVTPITPAPSKPAQSTAATDADYAQTGVFKPSATVNIRTGAGTGYASVGSYSPGESVIYDHVYIRGTYVWARYLSYSGRYHYVALGVNGGESYGSRSSGYTSPVSHTYYTVRSGDSFWSIASKYGISMYTLAANNGKSIYSVIHPGESLYIR

SEQ ID NO: 1252 - protein, 161 aa, Lactobacillus paracasei
EIIABCMPNENTVLGFVVATHGALSDGLIDAAKLIVGNIDNTVTVNLILGDDIDALNQKIADGITQVNKGDGVIVFTDLFGASPYNQSVLAISKLPKAQQKKIYLLTGVSLPMFIEAVNQQMIDANVDDAVENILNQANDGVTKWSSNDIADVGASNDDDF

SEQ ID NO: 1253 - protein, 297 aa, Lactobacillus paracasei
MTQQEQLMDWFIRYSSILKKRSTHRQKERFLQAFQTDVNAIRDDFNVDEFKLHPKDPYTYHNVYVGDMHRATQIICTYYDTPTVVWRDYAYFDIKQHEQSTTWLIMFTALSYIIAGGLFTWLVTIPMLAGGHLISVPSILMVVGYLAYFLMLGQMTRGWPSRHTLIQNSSSLVALLGILGAQRKPTVAFAFVDAGCTNDAGLKRVLRRKKGKCRFFMVENIGGDTPLYAITKDTVHQYRDIEGFENTTTDMKMDDRITYLISAKKYGDRFVLPLAQLRQKKINALNMEVLSHFIESL

SEQ ID NO: 1254 - protein, 167 aa, Lactobacillus paracasei
MGVVNLARVDQRLIHGQVMLTLSQRAGVNSIFVVDDAVAKDKFMKDLYKSAGARTGQKTIVMTEEKAKYYWDEFTFKDYSCILIAKTIDTMYNLVKHGIPMKEMNIGGIAQAHDDDVQVTKAVYMTKDGAEKLKDLHDNYGVENIYFQTTPAASKTGLASVLAKFGL

SEQ ID NO: 1255 - protein, 291 aa, Lactobacillus paracasei
MDTTKNKNAIPTTQAGAPEQLTKHDIDRAYMRFFFADEIPHSFDRYIAGALLYAMMPILRKLYKEPEQLKAAYKRQMLFFNTQATWGGGIITGLMSSLESERARQEYSREDITMTDDIMYNTKAGLMGALAGIGDAIDSGTIQYIFIAIALPWAQQGSGLGALIPFVLFACYQLGIGLFFARTGFKMGRSATTLMASSGVQTAISMLSILGMFMMGIIAGSYVKVSSPLKFILSGKKFVVQDTLNTVLPGILPLTVVMGVYFYYVKKGLKVTQSLLWLTGILLVLAAFHIL

SEQ ID NO: 1256 - protein, 285 aa, Lactobacillus paracasei
MQTLSVWQSMAIGLWVSAVMSRWLLGNATLTMRFSPLMTGFVVGVIMGDVTSAMKVTAAIQLIYMGAFSPGGTMPSEPAIAAAIAVPVALLGNKSPGAAIAVAVPVGLLGSYLYQFRFFLNTFVGKTTDRAIENMDDRALSRSIIWYPTIVSFLLFTPVIFIALYFGAPVIASFVKGLEGTVFIHMLNTVGGALASIGIAVTIYVIGQRKYLAFFLLAYFMSVIFTSLKITMVTYAIIGTLLAFIFVLSQGAFSGDKKTVQTDTGDSGNTSAGDSDSAEDDDDDF

SEQ ID NO: 1257 - protein, 374 aa, Lactobacillus paracasei
MLQNLQVKIGPEFYCYSEGALDLIPKLLEEHSAKNVLVIHGTKSWEKAKPYLGKLENTKTLSTYYEKYHGECSFNEGKRIADICADKNIDFIIGVGGGKLCDLTMYTASIAHTKFATVPTLASNCAPWTPLAVMYKDNGLAEGKTVHINRQASFLVMDPRIIIDAPINYFVAGVADTLAKWYESDMILEEGQYKNEPMLQMARYAALMCKDKIMKEAEPAINDMKSGKMSDEFVHISEIVIAIAGLVGGFGDKYSRNTAAHTIHDALSAYLPQIHKFLHGEKVAYGIFFQLALENRYTTIDELIPFYQKFHLPMSLKDLGVWPMNEDTMGHVLKLANGKEKIHLLPFEVTEASLKKAMFDLEDYMAKKEPFSPK

SEQ ID NO: 1258 - protein, 328 aa, Lactobacillus paracasei
MNYRIAIVNSSSFGQVFKEHLEQLQSLGDVDRFRFPADIDGVSLAKKLQGYNIIIASVTPVFNHQFFEHKDELLLLSRHGIGYNNVDLVAARAHHTTVAIVPPLVERDAVAENNVTNLLSLMRRTVASNQATHEGRWRDRAQFLGHNLSNKTVGVIGVGNIGSRLVEIMHYGFRATVLCTDPRQNDIAISQHGGKKVELSNLLAQSDVILLAASLGTDDYHLLDQRAIAQMKQGVYISNAARGALVDEDAIIANLKNGKLAGYATDVLENEPCSGNHPFLTLPNVIVTPHTSAYTVECLHEMGEKCVSDVLAVINGKMPCNTVSAPNR

SEQ ID NO: 1259 - protein, 293 aa, Lactobacillus paracasei
MAFNYLESLIKRKIANRTPIDKKISDYLVVADDGVLTMTITQLAHASGVSETSIYKYVKKLGFTGYGDFKINLASNAARRQNAEQGITVLTDIKPNDQPIDIAQKVVQYNVALLHDFSDFIDADKLNKTLGLMYDAHSLTFIGQSGSSAIAFDSYHKFLRSKYPCNYIFDYHIQLSYATKLGPDDVVFLFSHSGVTKETIAVGKQLLKSGAKIITLTGSPASPLIQLSDVSFVLFTEEVAAKAESISSKILYTTLTDILFLNLMFHDEKANQAATQKIRNALSITRAGINTDK

SEQ ID NO: 1260 - protein, 354 aa, Lactobacillus paracasei
MKMSFRWYGGNDSISLDQVKQIPGVTGVITTLHGKPQGEAWTYEEVEALKREVATEGITIDGIESVHVIDSIKVADENRDHYIDNYIKSLEAIGQNDIHMVCYSFMPLFGWTRTQLAKPMTDGSTTLAYNWDTIDNIEPDQLFELVNNQTNGFRLPDWEPERLAHVKDLINQYRQVAEDQLFDNLVYFLKAIMPTCDKYDIKMGLHPDDPAWSMFDLPRIVKNKQDLIKVLTAVDDPHNGITFCSGSLGSDQTNNLLDIIDAIKGRINFVHLRNLKHTGYRSFDETACNSDAGDLDMYAIIKKLNEVGFDGVVRLDHGRNIWGEVSMPGYGLYDRALGSTYLEGLIEAVKKESK

SEQ ID NO: 1261 - protein, 328 aa, Lactobacillus paracasei
MMNSKSQANIKDVAALAMVSTATVSRYLNGNLKRMSTATATRVKAAIEKLNYVPNAAARQMITKQSQLIALIVGNTDDYFSTELFKGVSSILEANGYIGTMFDSDSDIVREKHLMETVNSHGFDGLIIQPFSTVSEIKTLMSRDVPIVLADRETPQAPWPQVVTNNFDAAKQATAYFVRQGFTHFIVLTSELAVATNRRERYRGIKAAAQNVDVLEVSESSYNHKRIHKQLIELLMRDTERTVIFSLKERWLLEFIPNLVLEGYVDNIKATATAFADTETARRIEPKLKLISQDPFLLGASAGEVMVNDLTGHSDRNQAVIVVPAKFG

SEQ ID NO: 1262 - protein, 228 aa, Lactobacillus paracasei
KDPGALDLASEMLPKYETLNKVINAGVVSVVRGATKDEAYKTAEACIEGGIKAIEVTFTAPHADEIIAELLEQYRDDSEVVIGAGTVLDPETARIAIMAGAQFIVSASFNKEVAKICNLYTIPYTPGCMTPNDIQSALTYGADLIKLFPGSVVGQGAVSAIHGPFPQANLMITGGVNLENMHEWFEKGATVLGAGSNLTGAAKKGDFASVITQAKKYREELERINANK

SEQ ID NO: 1263 - protein, 180 aa, Lactobacillus paracasei
MTLINDVMQEINTVMGMVDEDQLTQAETVIKKNKRIFVLGAGRSGLMAKGFAMRLMHIGYTVFVIGETITPAIQPKDVLISVSGSGRTGSVLEPTEKAKQDGVKVVAVTSNGGSPLGQLGDTTIVVPGATKGGDGVQSIQLLSTLFDQSVHVTLDVLCLMLSRRDHVSNDAAKAEHSNME

SEQ ID NO: 1264 - protein, 207 aa, Lactobacillus paracasei
MQLQVAIDRVTLEEATALAKQLDPLVDIIEFGTSLVKDYGLLTLRDHPLHLQNAKLLIDLKTNDEGTYEFKQGYTTEAAILTAMAASSHDTLEQVYNVSVQQGKEILIDLLEADSSRIAQLTGFDQAIFGLHHSKDADVGFDAVATTAQFHRDFPQIKRLAVAGGINMEQASQLAQQDIAETVIVGGEIVGSSDPVAAAKTFMEVIS

SEQ ID NO: 1265 - protein, 320 aa, Lactobacillus paracasei
MSEVITIGEPLTTFASSEPDVSLVDVEKWHKIMGGAELNVAIGVKRLGHSVDYISRVGNDPFGEYIIKTINQHQVGTKYISEDDDYFTGHQLKQLVTNGDPATFNFRKNSAASHLEPRVIDQVDLSDVKFAHMSGIFPAISDTAEASFRKLYKRLNDANITTTFDPNLRPTLWKSHDYMVKTINELAGYADIVLPGIEEGKILMGSDDPEAVADFYLNGERTKTVIVKIGADGAYVKAKDGEGYRVKGFHVDKVIDTVGAGDGFALGVITALLEGKSMKSAALRGNAVGALQVQTLGDNDGYPDQDGLAAFYAKEGVTEN

SEQ ID NO: 1266 - protein, 430 aa, Lactobacillus paracasei
MSSTFIAILLLITFVLFIGYILKGGNLMIGFFVMAILWAVIGLVPFNTAIQKIFAEPATNYGATIIYIVFGSWFGRVLVESGIAPAISEATNKVGRKQPLLAAILVSLVTMFIFVSAYGVGSVIAIGVILLPIMLSVGVPRDIAATAFSMSIGAPMYINVVLYNQIKVFFPKASYDSHYLQFGIVAMIVQILAVVIFLFIFRKRINPANAEMNLEIIGAGTNNQAAINNVPKIAYIIPIVPVLMNMLFHWDAVPALTVATIIAMLLTGKMRHYKEFLNFMNGTIKQAISDIAGLVMFLMSLAMFTGAASLNASRFKPIFEAILPNSHLILAIALGILAPLALFRGPLHVWGAGAATAAVLSGTGLFNDPFLLPLLYVPTLMAVSVDITQSWNVWELDYMKVQSKDFLKYGVPVMWIVSIINEFLVYKFFG

SEQ ID NO: 1267 - protein, 249 aa, Lactobacillus paracasei
MTLILNTWIFESDVKSGTKQADLVDRVAKLGADGIEVRREYFTDLDSELPEVAKRAKTNNLIVNLSVPDVVFEDDGSLNPKLDEYFKEGQILGLKKIKFNTGHFDRFTGDLKKDFARFPLDEIEMNVENDQTAVSGKVSTIKTFLTAANSAGLTSLGYVYDMGNWGFTHGDAEQAAKELAAFTHYIHLKNVINNNGELTTSDDLDRGMFDWRALLKLLPSDQYYALEYPMATDAQISSQIKLFKDEVGA

SEQ ID NO: 1268 - protein, 85 aa, Lactobacillus paracasei
MAERTFIDPEKFALSFADAAATPLDDKTEVVSAAKKYLLSYLTAYYLVEDFNGIEKENFKSQTETHFRDMTFEQLLDRVQHLNKY

SEQ ID NO: 1269 - protein, 319 aa, Lactobacillus paracasei
MALISLEHVTKEYDGKPVVNDLSLKVDQGELFVLVGTSGSGKTTTLKMINRLVDPTSGVIEFADKPLTSYKMRDLRWDLGYVLQQIALFPTMTVAQNIAVIPEMKGWSRQKIRTATDELLTTVDLPPAEYRNRMPSELSGGQQQRIGILRALASRPKVVLMDEPFSALDPISRTQLQDMLLHLHRALKTTVIFVTHDMAEAMKLGDRIGVMRGGKLLQVDTPEEIATNPANDFVADLFKGAQANQGLQVTLSQLAPFAADVSARHAVGGNLTLAEALPLLDAHEALRVNSEHGAFVVNTHSVVAYLASAFVDQNTETKE

SEQ ID NO: 1270 - protein, 110 aa, Lactobacillus paracasei
MDASLRYQALDRGQINLTDGYTTDAQLRQYHLVALQDDKGLFPIYRGAPLMRTAFAEKHPQLVAALNKLAGQITEKQMQTMNYAVSVKNEKAATVAHRYLVQHGLLKEVR

SEQ ID NO: 1271 - protein, 82 aa, Lactobacillus paracasei
MVKKHPAELANLLATYEPNGTAMDMTIATLKRHQVAVLAAVTSPYSNGPIEGVNRLIKSLKRSCFGFKNQLNFFKRIYQITA

SEQ ID NO: 1272 - protein, 309 aa, Lactobacillus paracasei
MVTAADNITGLIGNTPLLKLNRVVPEDAADVYVKLEFFNPGGSVKDRIALAMIEDAEYKGVLKPGGTIVEPTSGNTGIGLALVAAAKGYHLIITMPETMSVERRALMRGYGAELILTPGADGMPGAIKKAQALSKENGYFLPMQFQNPANPDVHERTTGQEIIRSFDGGTPDAFVAGVGTGGTLTGVGRALRKINPQVQIYALEAAESPMLKEGHGGKHKIQGISAGFIPDVLDTNLYQDIIEVTSDQAIDMARHVSHEEGFLPGISAGANIFGAIEIAKKLGKGKSVVTVAPDNGERYLSTDLFKFED

SEQ ID NO: 1273 - protein, 271 aa, Lactobacillus paracasei
LENSPLKIGILNVMHDKADTKTRLQHVLTHTAIPVDLHFYYPMTHYAGRTVPEAVSSILDPLDIHEVATMDGFIITGSPIETLEFDQVHYIAEVRTLLKTLSQHVPNQLYLCWGGMVALNYFFGISKLILPHKLFGVYPQTILEPHPLLKGLKNDFKSPHARYAEMDVRGIHADPRLTINATTTKGKLFMVTEPTDTQTFVFSHIEYDRWGLDSEYKREVAAHPEIDYVRAKHYYHHKNDYDHPKFNWKKTQRTIFDNWIQHVADHRNDNH

SEQ ID NO: 1274 - protein, 299 aa, Lactobacillus paracasei
MSLKDEIDGHTVLAGLLAHPAGHSMSPAMYNATFEKLGLNDAYLSFDVDAPELTHALQAMRSLHFLGGNLSMPNKQKAIPLLDKLSPAAKLIGAVNTIVNDHGVLTGHITDGIGFMQALSNDGLDIRGEKMTLAGAGGAGTAIAIQAALDGVREINIFNRRDASWQNAERNVAIINDQTQGHATLFALDDQPALKASISDSVIYVDATPAGMKPLETISNVPDGDWFTPETIVFDTVYAPRETKLMQLAKEAGVNHVYNGINMLINQGAAAFHLWTGLQMPVDYIRETVFGEPAAVAHS

SEQ ID NO: 1275 - protein, 385 aa, Lactobacillus paracasei
MLGIASSILSQYKAQFASNWGAQQLSNGTVDVSMVVSVIAAFGLGRLIAYPFAGPVSDHFGRKVSGTIGIGLYVIFFIGIITVNSFWAAYLIGVLNGMANSFLDTCVSPSLMEMFPESASIANLLTKFAVVTAQFILPFFIGGVAAAGLSFRTIFIICGVALAADAIAIIVFPFPKREKPQLNAAGTPEKMHFSIGSVAAILIGFTSSTTFMVWLNCNQELGAAYGVKNPATLQSLYAVGAGIAVLLTARLIKAGLKESTVLILYPTIAVVMLALCYFVQTPVILYIGSFVIGYAAAGGVLQLATSTTISFFPSHKGTATSLVMIASSIANYAVLSAAAGLTKAFGDAAPRMIILLNIVITIVGIGLALVVKTQEKHVLAVSQVH

SEQ ID NO: 1276 - protein, 298 aa, Lactobacillus paracasei
METWISGTTGLLCLLGSPVGHSGSPAMYNFSFQKQKIDAAYVAFDVTKEQMPEALNAMRLFKMRGGNVTMPCKNVAATLMDELSPAAKIISAVNVVVNDDGKLIGHITDGIGFVRNLQEHGIDIKGKHLVVLGAGGAATAIQVQAALDGAKQITIFNRQDEFYSRAESTTKKLAEAAPAVKVDVVQLENTDRLKAAIADADILVNATTVGMKPDDGVSLVDPSFLRADLVVADTVYNPLKTKLIEDAEKVGAKTAPGKGMLLWQGAAGYQLWTGQDMPVKAYQAFEEEREPDRLETGV

SEQ ID NO: 1277 - protein, 277 aa, Lactobacillus paracasei
MADWLGLKDKVVVVTGAVGGMGTHFCEAFAEHGAKLVLVDIKKDAIQTAAKKLADQYGVQTLAVATDTTDEDEVDAAVQAVVAEFGKVDILVNTAAILRFSPFEDLRLDEWKTAVNINLTGYFLMSQRFGRQMIAQHHGTMVHISTVAADFPETYSGAYSTTKAAVNMLSKQMAAEWGQFGIRSNCVMPCLVKTPMSADFYKDPNVLDGREHLVASRRIGNLDDIANAVLYLSSDRSDYTNGDELRVDGGLGIMMQDMIPKPGGRREYAIKAHQAAK

SEQ ID NO: 1278 - protein, 288 aa, Lactobacillus paracasei
MTLTHPITVSSWTLGDQCKFEDRVKAAAKAGYDGIGLRAETYVDALNEGLTDQGILDILDQYHIKCTEVEYIVQWCEEPRTYEQKYKEQTCFHMCHLFGVEHINTGLMESYPVDFTAKKLQELAHRAALAGNLIIALEPMPYSGMPDLKKTWAILQGAGAPNVMMLLDMWHWVRADQPFDLLTKEQAKRVISIQLDDAYKRPYAKSILRDESMHDRLAPGTGFEDRTEKFIKMIKEAGVDPKVIGVEVISDHYMAKGIDWVAKYTYDTTVKTLQAAWPEILKETVATH

SEQ ID NO: 1279 - protein, 297 aa, Lactobacillus paracasei
MNLFHLRYFVTLAKSQNYTRAARQLNITQPSLSNAIHGLEAELGLALFVRQGRNVVLTSEGREFSRIVDHSLTILDSGIEQLQHQNNEQTVIKLGALRTLSTRWVPGMVREFLQNSQQDVRFEFTNENGLSPQIIQGLRAKHYDICFCSKVDEQEDIAYFPIASQALVVITPTDHPLATRNQIELSETLAFDQVTFSKRSGLAPIIRQLFAECGGQPHSVYAIEEDEAVAGLVANGFGIAVVPNMPLLKTLPVKIIPLSFPTWQRIFYMATLKDHYQSPAAKDFIDFVHAHHADIRQ

SEQ ID NO: 1280 - protein, 167 aa, Lactobacillus paracasei
MRTQTKTSVMKLAAVGAVAGLVSGLVKLGWENILPPRTPERDATNPPQTFLQQHGLTAAQTHATYTYSDHQIPWVSLLIHFGFSSSLGALYAVAGHYVPLFKLGYGSMWGLGVWAGAHLWAMPALKIVPAAKDQPVEEHLSEAVGHMVWNTVNQIVISDMLREKSGN

SEQ ID NO: 1281 - protein, 480 aa, Lactobacillus paracasei
VADTKKQLRWYNVALIAFVSVWGLGNVFNNYAQQGLSVVTSWILIMAIYFVPYALIVGQLGSTFKDQAGGVSSWIKETGTVRLAYYAAWTYWVVHIPYLAQKPQAILIALSWLFKGNGNFVNTVSSMTVSLICLALFLLFLWLSSRGLTTLNRIGSMAGTAMFLMSILFIILAVTAPLMVKGVHVATPDMGDIHTYLPKFDLNYFTTISMLVFAVGGAEKISPYVNNTKHAAKEFPTGMLVLAGMVAFCALLGSFGMGMLFNSNQIPTDLMANGPYTAFAMLGSYYHVGNIFVILYAIANALASISALAFSIDAPLKMLLSDADPHFIPKKLSHLNKKGTPINGYWLTGILVSLLIIVPALGIGNMNELYKWLLNLNSVVMPLRYLWVFLAYYLLNKHLEKFQAEYMFVKNKHVGMIIGGWCFLFTALACLLGMLPKINYLNDPGTWWFQMGLNIITPVIFLALGLILPFIARRDEARLL

SEQ ID NO: 1282 - protein, 844 aa, Lactobacillus paracasei
MTEATHFYQAFQPAHYELYLAINRANKTITGKTTITGEAKQTAIALHQKYLKVSALQADGQDVPFTIDDPAEAIRITLPQSGKVTLTIDYTAPLTDTMMGIYPSYYEVDGVKKQIIGTQFETTAARQAFPSVDEPEAKATFDLAIKFDEQPGETIISNMPEIREENGVHYFDTTVRMSTYLIAFAFGDLQNKQTTTKSGVKIGVFATKAHKPNELDFALDIAKRSIEFYEDFYQTPYPLPHSWQLALPDFSAGAMENWGLVTYREALLTIDPDNTSLETKQRVATVIAHELAHQWFGDLVTMKWWDDLWLNESFANMMEYVAVDALQPDWHIWEAFQTLEAPMALQRDATDGVQSVHVQVEDPAEIDSLFDSAIVYAKGARMLVMVRALIGDDALRAGLKAYFEAHKFGNAAGADLWTALGKASHLDVGKIMQSWLEQPGYPVVTAAVVDGKLTLSQQQFFIGAGKDVGRQWQIPLNSNYAVAPQIFAEKKVTLGDYAQLRKENGKPFRVNVGNNSHFIVQYDEQLMTDILANVDQLNAIDQRQIIQDLRLLAEGRKNSYGNIVPLLPRFAASHSAIVMDALFRVAGDLKKFVAPDSDAEKQLQAFFDKLSAGQLDRLGWTPKADESIDDQLTRPYILSMALYAKNPDAIAQGHELFTANQAQLVALPADIRMFVLENEVKHFGNADLFDQLLKAYTQTTDSSYKADILAALTSTTDPTQIAKLVDKFEDADTIKPQDLRSWFRGVLNNHAGEQAAWDWIRNEWQWLEKTVGGDMEFTTYITVIAGVFRTPERLTEFKAFFEPKLQTPGLTREITMDTSVIASRVSLIQAEQQAVQAAVAEAVK

SEQ ID NO: 1283 - protein, 1836 aa, Lactobacillus paracasei
MSKTLASLELLQLTFQDFVLMTTGGNNVYKLNPFSQEKRRYKMYKAGRHWIYSAIAVLGGAGILMFQPTQTVFADEASPTASVTTLAKPHTELKDKQPVTASPTPTDNPQPSVDKPAVLAIETQPTSAANQVEAPSAKPADHSKAASDSHAASIVSATPTPTPKTAPVATDKVKVTVSVETPASPVMAPTVAPRSAVQTKPTPAPAKPPINQAVLTKGNVQPLWDENIKGQGMVAAVIDSAVEPHDMLRLNDNTTAKISKETIADFAASHGYGTYLNDKLPFFYDYTTNSNTNLHLDNHIQGEQIAGIIAGNGQERPDGRYILGVAPEAQILSMKVLGQAKSLTTNNVARAVYDAVALGADVIYLSLVKTVDVEDPTAEDQAAIQFAADHGVLVIKTTSNNGNAMAIHGTSVPGGTTAGYITTNDSTLSLTGGGLSALTVASENSALGTKSAMAYNSSWGPTTDYKLKPDLTTPGEKSVSIGKNNTLATKSGTAAASAYAAGAGLLVMQHLKQTTKLTGVELVKAVKLALMNAATPMMDHDYPGNFVSPRRQGAGQIDVAKASGLTVTAEGTDQTGSVSLQQFEAAPTFTITLTNHGTTDQTYTVVPGHPLTQTFDTAHTNGIYAVALPGATLTTATPTFTLKAGASQTVAFTLTLDQTVRLHQVIEGFISFKAADDSQSISMPYMGFYGSTNAEVVFDNAANEGRSTFTGSYLLDENNYPLGIADPLTLSDIVNSGSYNVNWETVAASAKDNKVAFSPNNDGVSDAVIPRIFVKQNLQQVAAQILDTDGHLVRVIDLENDTAKSHYVQDTNYNTDLTLSDSMRRHPDGFKWDGKVYDRATGKLVTAEDGRYVYQFVGTTYTAGIRNRQGINLPVAIDTVKPTITDFTYDNGDITFNYEDQGVGFTQYSAAVLAIGLRTYEVPLGNDGTKNTGTVTYQLSDDQLDALETGDGKLTLTITDLAGNSSRQTIQAVAGEYLPEVDTTPTPQVRWSIPIVHGNGLRMDGNYEIRTKDDKYTVQVMVPKDGDYLVVLKDSVTGNVYVERSDQTTGIATFDVENPYFYANLDVYALYEPQFGTFIKSPAIPSLLVFHDPDAGAYSNDNTKTESFDDEATAKNAATRLSSAEPLPGRKFSDNLLSAIPTSGLMFTDLNDNSLTLVGVDKASHCYDAEHQLLHIRGKIKDPSHTDLQIFATPNPSDSQNRAILAADGSFDVTVPFKSTEEKNVGYALTTINATGQKVTTDGFLQIILDTTPPTLTVSDTDGMTVDANGVYTAETSADIFTLEGTIDDNVDGYRLYSNGSNVLTQHARAGFNIHQPAATAEAGANRTNPYDPVPFKRGYILPVGTSIVRLEAVDQVGNRTVKVFKIKKVAVTENSEPTESDLEDQTVTDSPEISSTESANDGDGVTDASAVMASDDTRDPQSEDREVKDSAEDAFVEHVVDEDLVEEAKDDLVPDGGNDSEETTSSKTVLSEAKESDENIFPDGDKDVENDISAEGILSEAKEPGDETTSDGDEDTSFEAVLSDAKMSKDNVTSNEDNDATSDISSQEALSETEASKAEVAPNDDKAIEDTNDAKSAVDSIEDAQGNVSFDDATTPKNDSSSVVTDTEVKDTLVKTAVLNDKVPQDSSDINEEKAAKPETSSQAVIHEAHDSAADTDSSDKVNASHTALTATADEKIDIGAAFASVLTENGKKKMPSKEGIKSAITELTTDPKAKRAFKDDKNNEKEVSAHAAIKTERKDSFESTANGGDKDAPKITVPNATTDNDLATKINAAPTPAMSTRNDAQSGVSSKLPQMANSHRNALQILGVIIISLMTTLGIVVTDKKKREKNKVNS

SEQ ID NO: 1284 - protein, 2235 aa, Lactobacillus paracasei
MNRVKPFSQEKRRYKMYKSGRHWVYSAIVTFGAASFLMMQPAQGVSADATTPPPTTQTESKQAAPTATAADSPASKPASTTTGQVSSSADARATTAASSAPTATAKSARPAPVSSQAKPEASAKAKQPTQPTSVTPSTPTTTNTKTAQKTVSQPAQKAPAAPAKPAPIAKPAPTSNPENKASLTKGNVQPLWDQNIKGQGMVAAVIDQGVEPHQDFRLSDAKAAALSEDQIKAFTASHGYGDYVNEKIPFFYDYTNNVNENLKFDTSNHGQHLAGIIAANGQPSDSKKYVTGIAPEAQLLSMKILGKSSSDSLNNAARAIYDAVDLGANAINISFGMGVDIDDPTAEGQAAIKFATDHGVFVTVATGNNGHAGGIYDKSASNGITTSYQPANAATLTTPSATPSAMAVAAGNDVLDAKAALISASSWGPTASYKLKPDITAPGEKVASTLLNDELGKVSGTSQANAYVTGASLLVMQNLKRSTNLTGAHLVKAVKLALMNAANPILDINYPGQIISPRRQGAGQIDVAKAANLTVSAEGTDDAGSVSLQQFTGSKSFVITLENRGTDQQTYTLDLGQPATEVIDTANNKTVHDRTLSGATLTTATPTFTLDAGASKKITFTLSLDDTVKLNQVVEGFIKFKAADDRQSISVPYMGYYGSTNDEAVFDKPANEEGSIFKGGYLVDNNHNPLGITDPTSLSELVNNPTNGFTWQTIGAKVQNNKVAFSPNGDGISDTITPYVFTKQNLKQVIAQILDQDDKVMRVIDQETDTTKSFLEVGSTINADLAKSISMFLNPDKLKWDGQVYDQTTGQMVPAKDGIYTYRLIGMTYTPGENNMQTMSLPVAVDTIKPTLSNLAYSDGKLTADYSDQGVGFTAYSQAKLTIGSATYGIPLNHDNKATSGTINYQLNDDQLANLKTGEGKVTLTITDAAGNSDQGSIKAVVGENKTIESNFIWPQVRWSMPDTKGNLTRSDGRYQALTKDSTFTAQAMVPKRQDYIVTATDYVSDRQYIGTLDKATGIVTFNIDATGQPYANLTISAFARDGFGEFIKSPKTEDFIIFIKKNAAAYSNAKTQTKPFADEATAIKGAKFFSGAAHLTGRSPLTSTKGKMINGIAFLDLNNNKRTLVGIDSASTFYDAKLKTLTLRGKVSDPKNSKLRIFVTPRQNDPQNEVTFAADGSFSMTMPCNPTEERNIGYVLTTLDKDGKEKTNGGFLLLYMDTTLPTLELSDADSMKIDDDGTYLVTTDADTFSIKGRVTDNIGGYRLYSNGNNIFTQQNLAGFNAHQSSAAPNQLTNGYNPYGAASFDETYQLTDGLNIITLQAVDQVGNTVTKTFNVTKTPKLLKEESLDELEITPEQEDQTPKNNAGEAPVTTSSSDEKTEVTPSTEPTMVNPEDSKVETSNPVVEIDTSKEAQSDGNDDTSTNTPASVTTGVDENPVDNATTMPNHAKGVDSDAEATEATNTKDNTPGTTAPTSTDPATDKESPTKSEVDPTATSLPDSQVVETATATTVNEDKGNKTDDDEPTATNLTTSKDSAIQPKSDPAASLQSNDKAVEAAIENDKIAEKEGHQSANTQPAITDVTTDKDSAVKPEIDPAASSQSNDKAVEAAMEDSKAENDKGSKSDSAETNIAPTMAKNSGVKSEIDLTAIAPRDNTATSSGTAKENADVKDDKGNKTDTVESAVTDTEDDNEGTVKSEIESVATTPSSNTATATEITKENTPTEDEKDNQVNVVETTATHPKSIKDRATKSEIESEATAPSKTEVGETVAEDAKGEHDKSNKSDDVEPTVSDRKTDEDRAIKSESDTSAITPNEDNIDETTVEEAKAEDNREAAAGTIATVAADPKASEDNSVKSEMDATTIAPIDNKAIETVTETTGVEKVESHKSTDTESPVTDPAIDKDRAVNSDITPATASPTADKAPEATTESVDVENTESHHPDIGETSVSDSQAGKDSAAESKVDPKATPSSDNTTTGSTVETRTTGSEQNTQINTSKTTVTPATDDKKVSSETIAPAKTSDDTAEFGTATTTSGQNTLTKTEVESSNHATNHPDTTDSSTDATSQPDEPTISIEATKPTPSTEDNPVQPNVDQKVIDQKSDKDNQDNPTAIEKNPKSKVTDDEETISQTRQKDPKSNIVEKEDDTILVVQKDLKAKMVKDAEPASPLDQKTSALKQKESKEKTLAKSVHSTKAAAKVLPPMGMQNSHWLQALGIALLGMVFALSIGLTSRKKHEKNNCN

SEQ ID NO: 1285 - protein, 209 aa, Lactobacillus paracasei
MPSTLKRLVGLELKANECSTSLIVLGCGLLMPVVFTMTPSNLAQAAMPGELFLPLLTIFAFGSLFLPEQTVEIGAVINSKQTQLWWLYLLRFIWYAVVLAMLATVLIGVYAFLNVGVNLLILWFDFVVKILLVGSITVLSYSLSRSLAVAYLLPTTYFALCIGYRYLGAVNMMTFMRHRAVSDNWIQLLLAGLFLAISFLSLKSRPVRG

SEQ ID NO: 1286 - protein, 382 aa, Lactobacillus paracasei
MKLFWMEVKRQTTSLTFTIYTLLVMAFVLLNMWPMLARNVAALPTSTNSYDDITATDFQTRKTNGVGQLRYDYQHNTYVTYPLGFAKTVTLPKADQARVRSLLTQANQAETQATLVKALGQVDRLIGGQSAYSSQNIQGFASRPMTKAEARQDHNLILKKDRISGTFARLFADYAGIVMGILPTVVVIAYCYADRRSRATTSLQSKMTSTWRLVGSRYLASLVTLLMPIFLMGIVLTIQIALHYQGYQIDYLAFFKMTGLWLLPTVMVSSAVGFLSDALFGNFLGFVVQIGWWLSTMMIGARQVAGNYGWLLIPRHNSLHNVAYYEAHLPELLFNRLTYAALAIGFICLAVVLLNLQRGGKFHAINFETLGRVRTQSQRVQH

SEQ ID NO: 1287 - protein, 293 aa, Lactobacillus paracasei
MEKINIEGLTKRYRGKAAPALDQVSLEIETGMYGLLGKNGAGKSTLMKILTTLEQPTAGTVEVCGVPIKAAKAIRQQIGYLPQRFGFYPNMRVVDAMTYLAVLANVPAREQSQRIQHLLEEVHLADKARTKIKALSGGMLQRLGIAQALVNRPKVLIVDEPTAGLDPEERIRFRNLLTDFANERIVLLSTHIVSDIEATTNTIGILDQGRLLFNGTTDQLLLAANGHVFEKEVSVAKLNEFKRHRRITEQVTDGTMVKLRFLAASQINTSAQVLPTLEEAYLYLQMKHEEAFL

SEQ ID NO: 1288 - protein, 371 aa, Lactobacillus paracasei
MDKLKQRLTRFPIKKALLHLILIGTIAAALVVLVYLLIWHVVMMPIATALAKRWFIGGMSLYFGGAIIGSFAMLYAVMNITARLFYRVKLGPPLDQLQYGVTHIQAQDLDFTLQPTSDDELGQLVAAFEEMRQALRKALETAWQLADDQKQVNAAFAHDLRTPLTVLQGNLELLTFNEEGQPPDQHLLDEMQRQLDRMNNFIKTMSHVTSIQNIRLNHHAITEAQVEQQLRSEVDKLPTAKTIDWQVDSTRSTDNKLSVSPDAILEVFDNQINNALRFAKAKVGIHLTFNDQQITLQVCNDGQPLTATEQRKVKLPYFSNDKAAHHLGVGMYICNQLCAAHRGYFKIQNREHAAGVCSTAVFGYFDGSAKS

SEQ ID NO: 1289 - protein, 232 aa, Lactobacillus paracasei
MLRDESLRATVLAVDDDVDILRMLKRYFALRLPTFHLITAESGASALQRLTNNPDLILLDVNLPDTDGFSLAERIRAITSVPIIFLTAWVTDEDKVRGLGAGGDDYVTKPFSLAELGARIKAHFRRESQPQKRARMAIFDQILIDYRAKQVSIGDQVLSLEKKQYQLVELLSLNPGQVFSREQLYEKIWGYDALGDDRVITEHIRRIRLLFDRYQVTSPIETVWGVGYKWTS

SEQ ID NO: 1290 - protein, 538 aa, Lactobacillus paracasei
MVEAWRYYWFQAQVDATTMVNGLIYFIRRLPILGKKIPTKLYRMGAVKSLIAIIMSCLMFMMKPLIAVLLLAMDFLVANAYNDFIHPLPTTFTFRAMVAVTIYTLGGLLFRGLVFRYIPVDLKAIKLADYFVLDRLALARGLTRIQQVIGIVLGPFLPFFGLTMITQNYWILFVGLGVSVFSWFWHGFIPRLTWSNHRLGMIAQILYWCGLVGVPIALVLTGKLTPFVTGLFSPIGLIICWIGVFGLWWYQHRFSNDIPLLMASIQQSVITLNKVAATQKQQFLATGTAMQKKLTLDTTVSVKVNQRLGNNYLNALLFARYRSQLWKKLRTRVLWISGIGISGLILLKLFAIHSVGDLTPIYGALFFVMYLASLGGPIVQLLFVNCDSAMLFYPFYRQPKAVLSGFFYRFWRIVQYNAVTGALIYGLLLALQLVTPVPDHLNFYLVLLLEVCGMVLFFSFHDLFIYYLLQPFTEDMEVVSPLYRILYWAMYWVAWVFTQVHLSGYTYALAIGVITCIYVVAGTIVIYRVAPKTFRIRY

SEQ ID NO: 1291 - protein, 244 aa, Lactobacillus paracasei
MKQLEIAHLDKAFDQQVLFKDASFMFNQGKIYGLLGRNGSGKSTLFNMIVRNLPYDHGTIAVDADDGRGLITDYADTSVGMVYTQPHLPAFMTGLEFVNYFMSINRTRLEQAHSSVQATDFFEMAGLSQADANKLLRDYSEGMRNKLQIVVSLMLRPPVLLLDEPLTTVDVVAAHEMQQLIVAMKAESVVIFSTHIMQLAQAICDAVVLLHNQQLTELSGLDIHSQAFEDAVIARLSDEVRADG

SEQ ID NO: 1292 - protein, 358 aa, Lactobacillus paracasei
VTKRTRRPLGLIDIVIGCLLLAGFGVLCYPFASDAYVSYQNQQVIDRYRQQEARKNQMVLRREYNDYQQKNKQLAASQQVPGVASFNHAVNDQGTAKTAAKRNQQILTRQTVAQLTIPKIGLSLPVFDHTSDWLLQFGACLLDGTSYPTGGKNTHAVISAHRGVPNAELFTRVPALKKGDKFFISIGNHKLAYQVFKRQVIEPSDTRQLRIVPGQDLVTLMTCTPYMINSHRLLITGRRIPYVKADDEASSWAVWWNKLKLIVALLGAVIILGVIGFVIRSLMLGRKHYLLEVPAEATQVVVKRGRHTHSFKSDQTGVTDISLPGNHYRVAIVTPLGRTKYKAYVKKIRDKKFTLKRS

SEQ ID NO: 1293 - protein, 334 aa, Lactobacillus paracasei
MKKTIAKKVLTLTSTILMTLLMVLGFNGTRVQADTNDTTTQNVVLTKYGFEKDVTAIDRATDQIWTGDGAKPLQGVDFTIYNVTANYWASPKDYKGSFDSASVAATGTTNDEGQLTQALPTQSTDASGKTRAAVYLFHETNPRAGYNTSADFWLTLPAKAAADGNVYVYPKNVQKTTYERTFVKKDAETKEVLEGAGFKISNSDGKFLKLTDKDGQSVSIGEGFIDVLANNYRLTWVAESDATVFTSDKSGKFGLNGFADNTTTYTAVETNVPDGYDAAANTDFKADNSSSDILDAPSGILPHTGGTGTVIFAILGVALIAFGAVAYRKRRNGF

SEQ ID NO: 1294 - protein, 238 aa, Lactobacillus paracasei
MTKSFRPLVILTFCLALLVSLATTTLQQTQAATVPTTVDVVLHKLLFKDTLPTQQANNGTTKPDFSQADVPLNGVTFTVYDVTADFWQLVSKNGGAIEAAQTTLSQDSYQPASSSLIAQVVTAGQGEAYFGDLPFRQGQHAAVYLFKETAAPKNIEASQNLVVVMSSNLQHGNQSRIDLFPKNKIVSRHTDAPKKVPKKTRQLLPQTGDTVAAWLSTLGLIIFATVLAFNMKKQKIDN

SEQ ID NO: 1295 - protein, 909 aa, Lactobacillus paracasei
VTKMTAKVARTGHLFAVLLILMSMLTGLVTSGSSVVTAAANIRPTYQTDANGTYPTNSWQVTGQQNVINQRGGDQVSGWDNNTIWNGDATDTTNSYLKFGDPNNPDYQIRKYAKETNTPGLYDVYLNVKGNTQQNVKPVDIVLVVDMSGSMESKNNGGTDRAGAVRTGVKNFLTSIQNAGLGDYVNVGLIGFSSPGYIGGGNKTTGPGYIRVGLGKAGNTSQQQAINSALSPTFNGGTYTQIGLRQGSAMLNADTSGNKKMMILLTDGVPTFSDKVKNSVVENGTLYGTNFGTTRDEPGYTAELKNSYIDSSGDRIYDTWPATLGEAKKAKDSGNVVHALGIQLAGDDGYWSEGYMSDEDVRQNMELIPTSPDLYEDADSADAVEAYLNNQAKDIVKNFNTIIDGTITDPIGTQFQYANNQATVTSVGKQTVPASELPSAAIQDGQLTVNHMNLGQDQEVQIHYQVRIKTEDAGFKPDFWYQMNGETLLTPKAGAAAVDFGIPSGRAPATTVYVQKQWRQLSNQSLPDTLNVTVQRKVADGSLDPNWQQTLVLKKADNWKASFTAPAYNNQGQSFSYVVKSEDASGIDLSSFISSQNMDQQTATLTLTNQQYGFQFQKKTTDGTDLSADQLKAMQFNLTQYSDNSFQQASKTNAITSTDLQALAPGYYGIQEAAAPTGYQLDGTTYLFQLTSDGQWQYHGTKDNVTSGSVINGQQTLNPVGDKSDDFTVTGDHQQILTLTKYDEPKPSMTLRVIKQDNQSQYLAGAAFTLQPSAGEAETITSSATSEGQAFATKLVADGTYTMSETKAPDGYQSNPAKIAIQVATTGKEATVTIDGEALKPGESKNGYTLAIDGSTITLQAINQPLAILPHTGGQGYQRLLGIALGLISAAFLLLLVVLIKRRVVKQHD

SEQ ID NO: 1296 - protein, 194 aa, Lactobacillus paracasei
MRYGYARVSTEGQRLESQIEELRRAGVDEIYQEKYTGTTTGRPVFKQLLSKLQFGDILVVTKLDRFARNTREALDVMQTLFDHHVGIHILNVGLIDETPTGKLIFTVFSAFAQFERDLIISRTQEGKKYARAHNPNYHEGRKKLYSDQQIRKAFDAHMHGKTYQQISKETGISTATLKRRIRDLSTEHCSVAEM

SEQ ID NO: 1297 - protein, 492 aa, Lactobacillus paracasei
ABCHPERNREGLATRMEEAPHHFVDRSLLTQNFNRADVEQIEQIIKEELAPSTLKLNDYALINLMMHLLIMIQSLHHDDTLLSRDAYSSWLNTYDAAIVTKIIKRIENVFNLILNKHEREEIHMLFHANVDHLPLSDRDKLTTTVGDNIVRAMNSLFAEVQHIFGIDLDNDYFVFPFSLHLDKLFSRAMQGSSLNSPLTESLKQDFPVVFELAVFVSFRLSQLLHIPITEGERAYIALHIGAELDRQKQHSEKIRTAIFSPNYMNLNTQLYQHVSKQFEHDLNVVALVNDPSELDKLDVSLLITTVPQASSMAYRVVTISPFMTSKEKSTIMATIEEHRCNVQRNFLRRYFDIYFGEQFFFTLQPIMQRDQVVTLMCDQLERRHIVSPSFRQHVFEREEAAGTAFGTVALPHSVYMEARQTTFSVGIAKNSIRWGERRVNIVVLAAISQNDQQRFMRLYEALITMFSEPQVATALARVRNFEQFKNVVKTNM

SEQ ID NO: 1298 - protein, 288 aa, Lactobacillus paracasei
MLEATYTLANGVQIPKIGFGTWMIDADADAAKAVHEAIDAGYRHIDTAEAYGNEVGVGEGVRASGIARKDIFVNTKLAAEIKNHDEAVKAIDESLKKLNLDYIDMMIIHAPKPWAKYDEPNRYFEGNLEAWRALEEAYKAGKLRAIGVSNFDPTDLENIIKHARIAPMVDQVLAHITQTPFKTIDYAKAHNILVEAYSPFGHGEMFKNNAIQAMAAKYHVSVAQLGMRYLLQLGLLPLPKTVNPEHMKANADVDFSIDDADMTTLKQMKPLTDYGQFQNFPVYSDRLS

SEQ ID NO: 1299 - protein, 142 aa, Lactobacillus paracasei
MSKSYSIGEVATMTKLSIPTIRYYDKEGLIPELKKDASGARCFDDQNLGALEMIECLKTAGMSIKDIKTFMQWNLEGDTTLKKRRDFFDHLHVTVLAQMADLQRTLDKIEYKQGYYRQAVADGTEKYVKAGIRHSQVVATDR

SEQ ID NO: 1300 - protein, 451 aa, Lactobacillus paracasei
MQKRKKLSLLEVFGLSIAMVAPTGAMSFNTASAAANAGINMPIAFLLGGIGVLFVAISFVELGKRIPGDGSAYAYNAKALGEKAGFISGWLLVLTYVTFVFSSGAIVGNFADVFLSHFGIHLPVNLYNIIVLLLGGWLSHKGIEFSTRLTLVLELLAVLVLSVLTVVIIFSGGRSGNSVQPFIPQPHMATGLGMGMVFALMSFAGFEGSATIAPRATHPRKAISIALLGAVSFAAIFYFLVSYAEVIGFGSAHIGDLAKSTAPMNFLATHYLGTNAAIFMDFAAMVSYFACYFGALNAGAFMLEALGKSGYLHPWLAELSGDKQTPTHALDGITGLALIVYAIFAIGLGVSASDMYNWFGTIGMLGLLTVYVLVNIGAIVYFRKDKGRSMFKHVLAPVIGILVLIYPIYTSLWPIPAFPMNTFPYIAIIWFLIGLWVATKRRNVETSLEDF

SEQ ID NO: 1301 - protein, 375 aa, Lactobacillus paracasei
LDDLSEFVDQVPLLDHHCHFLIDGKVPNRDDRLAQVSTEADKDYPLADTKNRLAYHGFLALAKEFALDANNPLAAMNDPGYATYNHRIFGHFHFKELLIDTGFVPDDPILDLDQTAELVGIPVKAIYRLETHAEDFMLEHDNFAAWWQAFSNDVKQAKAHGFVGFKSIAAYRVGLHLEPVNVIEAAAGFDTWKHSGEKRLTSKPSIDYMLYHVAPLIIAQDMPLQFHVGYGDADTDMYLGNPLLMRDYLKAFTKKGLKVVLLHCYPYHREAGYLASVFPNLYFDISLLDNLGPSGASRVFNEAVELAPYTRILFASDASTYPEMYGLAARQFKQALVAHFNQLPFVDLAQKKEWINAICWQTSAKLYHQERELRV

SEQ ID NO: 1302 - protein, 447 aa, Lactobacillus paracasei
MGDEAVIEQLTEKQTELIEFLYVDYNGLTRGKVIPLASLKAKLADGIGLTKATLNVSERDTILPVADMTPIGELRLVGDPASAHVLPYMPQVATLMGDIYNLDKTPYASDPRSILKKVVKQLADAGFTVKMAYENEFELFTGDKDHREPAMPHVAFSTESMDFAYPFILKAIDQLQKVGIMPNAYYPEGGIGQHELSMLPSDPVTAADNEVIYKRIIKNTAKAFDLYASFAPKPLVDSAGSGAHIHLSLWQDKEDAFFDDKAAMQLSTIGQYFVGGVLKHIQGLLALTCPSANSYQRLAPGHWSSAYATYGQDNREAAIRIPSTSWGDPASSMNIELKASDATANPYLAFAGLLAAGLDGITNHMQPDGYCDVDPASLSQAERDAKGIQLLPRTLSQAVDAFEADSLFQQVFGKQLVDAYAKIKREDDQYYAKLALEKIAALHRELY

SEQ ID NO: 1303 - protein, 250 aa, Lactobacillus paracasei
VKPKIGIPTDELIEVNPVMPNNHPAYAPHDLKEAFIKLDALPLIIAFPDDVSQTEQLAQDYVQLIDGLMLPGGPDVDPTFYGEEPHPKIGMTLYQKDLFEIALIKAALAANKPIFGICRGIQIMNMAMGGTLYQDLESQYPDLKIQHPQATLGQFATHHVDLTPDSRLAALYGKTTIKVNSRHHQAVKTVGKGMRVTAVAPDGVVEGMESIDNDLFLGVQWHPENMWQQEDPQQLVVFQDFLDRIATHQK

SEQ ID NO: 1304 - protein, 249 aa, Lactobacillus paracasei
MSDIYDDPAFFKAYSQMDRSKKGLAGAGEWHELKTVLPDFSGKRVLDLGCGYGWHCRYAAEHGAKNVLGIDTSGKMLDEAAAKTTDQRITYRRMDMQAIDQLPDQFDIILSSLAIHYIEDYAQLMKKISDKLPVGGHFVMSVEHPIFTAQGKEEWVTDDQGHNLYWPVDRYFDESKRKTDFLGHQIKKYHRTLTTYLNTLLDHQLRLNRVIEPTPTDEMVKTIPGMADELRRPMMLIVATTKTAYTHEK

SEQ ID NO: 1305 - protein, 355 aa, Lactobacillus paracasei
MEITAITAFPRQVKLKTPFKLALGELRDITTLIIKIETDDGVTGYGEASPYAPVNGETNETEQAALPVFVNALTGCDPRNLEQVHARMDVVMAGHTALKCGIDTACSDILGKAASLPLWQLLGGHSHIVTTDITIPIGTPAQMVASARTYVAAGFTALKLKAGDNEAADIAAINAVCAAVGPTISVKVDANQAWTVSQTLRIAAQLRAPNLIAIEQPVPDWQLLSLPLLRAQSPVALMLDESIHNAHDAADAIRLSAADLINIKLAKSGGLFGAAAIDATAAAAGVPCMVGCNAETRLGTAASAHFIAAHENVHYGDIDSFMLLAETDWLSGGFTADGPTLTLSDRPGLGVDVRL

SEQ ID NO: 1306 - protein, 337 aa, Lactobacillus paracasei
LTDWQGYQKINEKYHLNGATIIVNPTEILSSWQNGAADFSMKRPFTLQTTSGLGSLSKQFTADSVLLLNAADKLDIEASLVDYVPNYRYADQVTLRQMLNMASGIPDYTELLLTDYAKRMPGASESHLSYPILEDLGHGDEITEVISLLNQHPLDFTPGEKGVYSNSNYLLLGFIISKITGDSLARFFEEHFFEPLAMTQTRLGTQYAEANSYDDLDVTAGKPVVLGRGAYQGGDGAVVSSLTDLAKWAQAVLRHDILSEKDWHEALTLTHNFYGMGWMHSKTPNWFSHAGHVFGYWTYFDVSFDKQLAQVTLNNMSPGDEARKTWQTEMAAWRETL

SEQ ID NO: 1307 - protein, 577 aa, Lactobacillus paracasei
MATKAADQLVSVLMDWQVKHVFGLPGDSIDTTVDALRRHQDKIKFVQVRHEEVAALSAAATAKLTGGLGVCLSIGGPCAIHLLNGLYDAKMDHVPVLALLGQVTTSNMNEGFFQEVNTPKLFDDVAVYNKTVMASDNLGQIVDTAIRTAFTEKGVAVLTIPDDLPAQKETASYQDSAAAFALNVPKVDPKQLEDVASMLQQAQKPLALIGRGAEHAGALVQKFVEANHIPFIQTMPAKGTIADDHPNSLGNVGKLGTKPAYEAMKATDLLFMIGTNYPYTPYLPAEGQAKCVQIDTRPENLGKRYSVDVAVDGDVGTFFTELNAKGSLRDDDRFLKACQKNMESWNKWMSEKRLLATNPASPEAVFATIDQTAPKDAIYSIDVGTSTSWGARFLNVQPTQKYTISAWLGTMGCGLPGAIAGAEAFPKRQTISVAGDGAFAMVMQDFVTAVKYKLPIIMVVMNNQKLAFIEYEQQSAGQLNYEIDLADMDYAKIAEAAGGIGYTARSNDEFKNALAKAYKETDKPVLINTYVQDDAPLPGKIVGDEAKGYMKYGSEYLENYWKIPSMPPLKDIMRQFF

SEQ ID NO: 1308 - protein, 293 aa, Lactobacillus paracasei
MPLVNAAELVKAAHKGHYCIGAFNTNNLEWTRAILAGAQELNVPVIIQTSMGAAKYMGGYEFCQTMIEATVKAMGITVPVVIHLDHGNYEAAKEAIAAGYNSVMFDGHDLDFEDNLEKTKEIVKLAHAKGISVEAEVGSIGGEEDGVVGEGELADVEEAKTLAATGIDFLAAGIGNIHGQYPDNWKGLHFDRLQELNDAVKMPLVLHGGSGIPQEQVQKAITMGISKLNINTECQLAFAKATREYIEAGKDQQGKGFDPRKLLKPGTDAITDTFKEITGWIGNKPVKMVPEAL

SEQ ID NO: 1309 - protein, 191 aa, Lactobacillus paracasei
MLAEKHRCAWGQTSNDLMREYHDEEWGRPSHDSRHLFELLSLEIMQAGLSWQTVLNKRAAFKQAFANFDYRQVQQMAPKIPVLLENTQIIRNRLKVTAIINNARVIAQLAAKGEDFDHYVWAFVNNQPIRHHITSHDQVPNTTDLAKHMSKQMKADGFAFTGPVVIYSFMQAAGLVNDHEADCFVNQILDE

SEQ ID NO: 1310 - protein, 203 aa, Lactobacillus paracasei
MQENLSQKILDLLDSGRFLTLKEIAKLLKMPEKPVEETLLHLVGLQKMNRRHFAGRDYFQTTQPQQATSKLSAVADDYLDQRQAAHALGVARTCYHHLAGKAGVALFDQLLAKKMVVLTAPNVYQLTEKGRHAFAQFLGRPVHQLNIQTCIDFSERRVHLAGKLGNDVMAKLVAEHQLALTQNRCVQVTQPIKIQPLEVRYAG

SEQ ID NO: 1311 - protein, 387 aa, Lactobacillus paracasei
MKERRLSFLFFLVMFVIGTDTFLVSPLLPTLTQYYGISTSLSGFIVSAYAVGYMISALLIGPISDRHDGKRILIIGLMVFTLATAGCGLANTFAMMLVTRFVAGVAAATAGPQIWAAIPVLFPKTQVVKVMGYATAGLAVAQIVGVPLGSYLAVWSWRFPFFFVGVIALMLTMLVVRFMPSLNEAITSRLATGIYRKLFQNKTVLKLLGAYLLFQTANFCGFAFIGTWFAKSLHLSVGAIGSFILLIGVGQFVGSLLGNRLVTWLGQPHAFLLEFLLFIAGYLVLPFTNSPLTATVILAFIYTIGGALLPLFMSTLQEHAGSARSTISALANAVMYLGEAIGGVIGGILIKQFTGFSGIAVFTAIGASLAMLLYAQQGYFKQLQTSR

SEQ ID NO: 1312 - protein, 97 aa, Lactobacillus paracasei
MDIKQSTDEIAFKQRIFFALSEPGRYTIVRMLYHVGHEMGCNELNQHVEIDKSTMSYHLRTLREIGMITTRTQGRQKFVTLSTGKIESVFPGLLEKL

SEQ ID NO: 1313 - protein, 478 aa, Lactobacillus paracasei
MARTTDRQRNTRSPRQARRQLNKLLRDPIVKPHNAAAVRIRLDEMMAILQHRKYRPEQPSSTNQVNTHGQVQFDLARWYPEGGRLRYTLRPRGALLPIAFTVQDFGNHRKSLTRGLALAVAGAAHQLDQMKAANKLPLIMQPFSDWVHLLAIGLQNWLENGQVVFSLADLNGAYVLTSMPTAPATWLARLFGISLGNPDQSLADLRRQRQEQADRLTTRLAAKFAIEEAPLVQAANDRAAKSIQLDAATMAMLASDQAPLRSQKDVVDRLARGDYIVIDTEFVADRNQLDLTEISLLRVRHHQVDGAFDIFTQLPEDHHVMPFSVKITGITDDLLSQYGQPLPLAKAAVEQLLKHELVVGFALSNDLRALRAGLNVDIIPVQAFDVAALARKTFGIGKKHTPSLQHYKEALGVDLPSHTALSDAQTTMALLEHLIWEGSPLITKDIGFEQRPPEHANDPEPYQKPDPSNDVSHPRTKT

SEQ ID NO: 1314 - protein, 142 aa, Lactobacillus paracasei
MQDERWNHPLYTATAINDEGLEGHAYIPGGLKVQTSSPMNDHPGTNPEQLLGLSLSTCLEATLEAVEKEHGLPHTGAVRVKVAFIGARAEYQFLVHAQVMVKGVDFDTAKAFTNEIENRCPVSKLLKNSGNYTIETVTDFKD

SEQ ID NO: 1315 - protein, 339 aa, Lactobacillus paracasei
MKKIINAPGDIVPEMIAGLAASYPQYLKQIPDTTAVVRNDAAFKQHKKVGVISGGGSGHEPLHAGYVGQGMLDAAVAGQVFTSPTPDQIYAAIKEVDQGAGVLMIVKNYSGDVMNFDMAKDLASVDDITVESVVVDDDVAVKDSLYTQGRRGVAGTIFAEKIIGAAAEAGLSLDDLKKLGDAVVKNTKSFAVALHAATVPEVGKPGFDLKPDEIKFGVGIHNEPGTGQEKLPTSKQLAKQLISKLTAEFKDPQAHKYAVLVNGMGATPLSEQYIFMGDVLNELKTEKLPVSFTKAGNYVTSLDMAGISLTMLALDDPQWLTYLNASAHTVGWGDTDVKR

SEQ ID NO: 1316 - protein, 193 aa, Lactobacillus paracasei
MLNADTLTKWMTNFETRITKEKDHLTELDRVIGDSDHGNNMERGVEAIKAAFEKTPPTTDLAQDFKTIAMAMLSKVGGASGPLYGTAFLEMAKLAKTDTDFGDLVDAAAKGIAKRGQAKTGDKTMLDVWAPAADLIKQGKLDDAAIDKLVASTEPMIAKRGRASYLGEKSVGHIDPGAASTGELLKAYLDATA

SEQ ID NO: 1317 - protein, 122 aa, Lactobacillus paracasei
MALGILLVSHVPAIANGVETLIKQVAKDVPITTAGGTSDGKIGTDLDHIQKAIGDNPASELLVFYDLGSAKMNLDIAEEVSDKQMHVYDVAFVEGAYAAAALLEANVTLDKIEAQLKPLKVK

SEQ ID NO: 1318 - protein, 187 aa, Lactobacillus paracasei
MSTSDQTKAHLAKVLKVQMQHKPLDRITIAELSAAAHVNRNTFYYHFDDIYALLKWTLEADIGRKVMQDLGAATWETKYQLVLDYIMANQVFCLNAFHSVGRDMLEEFLFQSATDMVKPVVLDIDPATPAQTVTDICNFYGAAIVGQVLLWLAQSLKEPERNLIKRADLMLNGSIAFIVRKRSLGPQ

SEQ ID NO: 1319 - protein, 42 aa, Lactobacillus paracasei
MKKFLLTALGVALVAGGTACYFANKMELFKDDADAYKKFESR

SEQ ID NO: 1320 - protein, 564 aa, Lactobacillus paracasei
MIKHKAIMIGAGLANMAAAVYLIQEAHWQGDQITFYSLDDHGSNDGAPTVDTVDEYWNKNHPMENTKGYVARGGRMLNYRTYVDLMDLLSRIPSATEPGLTAEEDTRQFDAQHRTFDKARLMEGGIGIIQAGHLGLNNTDRLLLTKLIMMPDSEEEKLDNVSIADYFKDDPHMFQTNFWYMWETTFAFRTQSSAQELRRYMHMMIYEFTQIEHLVGVNRTRYNQFESIMLPLINYLKEQGCKIILNRRVTAFEFKDTAMTDEITVTGLTILNTETDDEEHVAVDDDTAVFFTNGSITDSATQGDFDHAAVENMDYGAAASLWKQATEHFYNLGNPDKFFADRSASEWVSFTLTTKDHLLLNEIERITTQVPGNALNSFMSTQPITALGQKDVMMSIVVHHQPHFTTQKPNETVLWGYFLYPRRYGEFVNKPYIEMTGKEMALELIGQLAKVDPGPGNIRDHQDKIMASIINNIPVYMPYASALFNNRAKVDRPDVIPAHSTNLAFTGEFAEQPFQMVFTEQSAVRSGEIAAYHFTGIPMSHLVKTPRYDKDIKTLMRATKKMFE

SEQ ID NO: 1321 - protein, 326 aa, Lactobacillus paracasei
MDYELKLRRHASREIDKYWENFQKSTSYQHLLTVPGFSQVPPDEIRLILVTFFVHAFDNLRSTIQALDTEHVAAGLQETLQTYHDDALDRSESLAIAAELLKTFMLWLIATNEIKLTILEFVDALMNVFVTATYLLGLTEEEALTSPFGNDDFDLPGVDDAFSDPDNDVDFDSENMAELFQLTMTFLESKTWLQVPKPVQNQELFGATTLFLAHTIQSLFGHDPKNWTAQDIKAAMSMLLYDKKTIGPDQRAVIGQMVAIFIRSTTTSHLWTPTQRQALATAAESRVQELVAAKPAPQQPTSNPTETTTNNRVVPIAGWQKHKHDK

SEQ ID NO: 1322 - protein, 338 aa, Lactobacillus paracasei
MCSSMTIKSLQGDIFWGRTMDYNTSFFHESPVGGVPGKIVSLPANKALPTQSAKWTTKYAAVGVGIDQSTALFDGVNSEGLAGDLQVLVECSWASADSLKQRGLKAIKGEEFVTLALTTCKNVDEVRALAGEYGLLDEPYEFGGQGVKIPLHYTFVDPSGKGIVVEPTDHGAFKLYDSIGAMTNSPEYGWHETNLRNYVSLNDNNYPKGSELGDYHIEPIELGTGYGMFGLPGDYTSPSRFLRAMFVSRNLDPFNSKDGIRVLYNAFKTVLIPQGLGRDPQHQVLTDYTQYWSGYDLTKKTIFVQDSDTLTMTTKTLDPTITDVTYEDLAKTEQFNQL

SEQ ID NO: 1323 - protein, 288 aa, Lactobacillus paracasei
MSRWKKAIFTGIALVSLLTLTACGKATSSNSSHTSSKSESIIIGSSGSDYQIWQHIAKSPQAKKAGLRIKVKQVSDGNVTNSATAEGQLDVNAFQSYAYFQQYNKLNPSEKLAALGTTYLEPMGLYSKKYKQLREIPDGATIGISNDPANATRGLLLLATTKLVTLKSDFNALSTVKDIQANPKHLKFKEVDPSVQMLPDLDAELISNTRALDGGLNVLKDSLVHEKLSQTTRANVNILVTAVKNGKKEEFKKLVPLYHDPTIQSWIKKTFSGTKLDVNKPISYLQQK

SEQ ID NO: 1324 - protein, 476 aa, Lactobacillus paracasei
MDAKERLMQIVEDKQNEFIKASDQIWHTPETRFAVEKSVQPYYDVLEKEGFEIKKGIADMDYSFEATWGKGKPVIGMLAEYDALGNLSQVAGATEHQPIVAGDNGHGCGHNVLGTAALAGAVAIKTLMEEEQLSGTIKLFGCPAEESGYGKAFMARDGIFSDLDIALANHPMDSMSGWGSSSLAVLQCYYQFTGIPAHAAAAPEMGRSALDAAELMNIGVQFLREHIIDSARIHYAFIDAGGESANVVQPSAKLYYFIRAPHVDQAKAIFARVDKIAEGAALMTETKLTKEFDAGCSDFIANKPLTRAIDRNLDIVGPLKLTKEELAFEKKLSETVSDASKQNLYHRAKHSFPDWTEEQIKAEADSGIALHKLPLEFSDETAGSTDVGDVSQVVPTAQFTNGFEPQGTSPHSWQWVSNGISSVAHKGLLLGGKVFALTAYDALANPQLVEDAKEDFAAHFGNKLFESPIPAEVKPR

SEQ ID NO: 1325 - protein, 399 aa, Lactobacillus paracasei
MATVIGKTSRSSETMLITSLMAGYSMVYMDKSMISTAIIPIASQFHFSSGQTGLMMSLFFLGYSLMQIPSGWLADRFGSKRVLMASLFIIACFSYLFGIANGLLFFIVVRFCAGVGHGGYPPSCSKAIAENFPKERRTFVQSLILSTSGIGGILAFTLGAQLVDMNWHYAYIAMGTLFLVALLFVWRFVPKGQDGNRKASDQTEKTSFLAMLKNRNVFVLFLAMLLLNVLLYGNMSWLPSYITSTFNLSISQAGMILAINAVFQTIATIFAGQLLSKLFLHKEKRVILIATLMVAALLVGFVLSSNLYISVVLLLLISMISVTAFTAIFTWPHKIMDANIIGSSIGIINTGGTLGGFLAPMVIGFLVQAAGGSFVPAFLFMAVMSLLCGMTVIAVKTKA

SEQ ID NO: 1326 - protein, 741 aa, Lactobacillus paracasei
MNRMVHVDIQEIVKEENVTHDWRLLMVLEGQIKVAIFQTDYKLVKDNFIILNPNERFSISATVPALILAVTINATHLTTILPDTSKQRFWNLPMSSPNQTSNNLAACRRLLHRMMITSLSEDVDEATVAATGLALMGHLRAHYLWHEESKSIFDHDQLVNTVITKLETEYAEDISLRLVADEMHVSYNYLSKKFKEQTHLNFNRYLNAIRLRHVELDLKYTDKSITQIGIDNGFLQPRTMARNFQDRYGMSPQKFRHTLAANLPSIDSTRQVITLSREEALVRLAGQLAEEDLASIQPVTSQQKRLDVQTAQVLTHKTATYTVNVGDVLNLNNQECVTQLNQLTEEMPIAYIRVFGVSKVRTDPIFSTVVTSEKNLMSAFYAILAVGAQPIIRLSVEMVLHCSPEDLIARFEAIAQMFGKSVVRRWIIEFEYDCLVSDNEDSQTVISYFLQSNNWQRIGVHVTEKNFHHTEKDKKMNLGNRFVYLSCDYLFLRTEIKEDLSELKSRLDSIQERLAPDRQYAPEIALDDWNTLAGNDAVTVGTFFRSALIKEILRQNNGFDNVSFWLSITSRISIIPDTTDECLSLFLYGTIRRPVYFVVRFLDALIGERILSSPWFSCYRNGEDYTVLFSNPTYIDPRMSISDSLMQYQSQELQLQLVGLRGQRYRIVSELLDKDCGGIYNQWLKVGAVINYSPQYIKYLATMTQPRLKIEDIATTDGKLVLSATQSFNSMRVYRIRPLND

SEQ ID NO: 1327 - protein, 910 aa, Lactobacillus paracasei
MRNIGKLVALDWKRIVKSPFAFLLILALVVIPSLYCWFNVWALWDPYSNTQDLTVAVYSADKSTEFRDKKIAIGDELVTQLKHNKQLGWRFVDSKKAVQEGVKSGKYYAGVVVPKDFSTDLLSFVDGKIHKPKLDYYVNEKINAIAPKITASGASTLQNTISDEFVSTVAKTLVTVFNQAGIKLDDNLPMIRRFASLVTNTNDQLPTIEKYIAEVGVLQSKMPAIREKLAAANEMATYLPEVNQMAQKLTAANGYLPMVADAGQLAVDVRSKLPEVQQAGAQLNTVTTNFGQLESAVTKAVRVTSQGITVVNQVDGTLPALTDFGKNAQAAIGTTKDEVLPKVSTALDVVQNAVDAGLTLIAAANTSLSADLTALQNQLQQLDTSSDTAAIKQAMVARLTALADRQGKVAANATSLADTLTRLQTSLNKLTGKDDQPLAGAITRLRDVATTATAVQTAASDLAKDVPNLSTNELQSRLATLNDVAQKFASDANTLKDLDLGTSVKQVLNAFKAALADAATTLTKINDQVLPELPSLLSGTKDLLTQANTFLVKTQKQLPALKQELTDANTLLNGHMNLITSGITTVADLYQNDFPSLKTKLTKATNFINQDLPGVESDLTSTLALANEKMPQLQSGLDDAQTLIKDDWPTLKDAIQKGATAIKKGEKSVDLSQLIKLLRRDATKEAGFLAKPVELKQTSFYHIPTYGSQSAPFYLALCIWVGALLLGAILITEYQLPESLAHATVKQMYTARWLTFAGLGMLQGLIAALGNLFLIGTYVVDKPLYLLFAMLLSLVFVSILYMLISLFGNIGKGLGIIILVLSISGAGGNFPVVLSGKFFQAINPWLPFTYAVNLLRETVGGIYWPNLWQDLIILVAFGVAFFLLGLFLKEPIRPWIEKMHHITRKSKIIE

SEQ ID NO: 1328 - protein, 30 aa, Lactobacillus paracasei
MSIYEALSLMIMFGLFILELITLVLKLNDR

SEQ ID NO: 1329 - protein, 36 aa, Lactobacillus paracasei
MLKILFDHMHGWARVSFFLAPLAIMGEALLTCNNRP

SEQ ID NO: 1330 - protein, 532 aa, Lactobacillus paracasei
MASIVDVGLAKKDMTYVWHTAILMAVIAIAAFALGAICNAFSSYAALKMGQNLRTHLLAISLADRDPQALKPETLITRITNDVTQMQTLVSMLTRGLVRSPMLLFGGIVMSIIVSPRLSWIILIALPILAIYIYVIVRRSLPLYTAMQGQVDVMNRIMSENLTGAKTIKAYVLEDHQLTQFNTENRNLQTISQRAVLATVTLAPLIMLVLNLAVVAALAYGGNLAISHTITTGEIMAFVNYMIQITTAMTNTVNLITTFSRAITSSARVNAVLAEEAGTEASGTLPAPAGSTIQFEHVNFGFSQSRPILDDINLTVPSGQWLGIIGSTGSGKTTLIALLTRLYEHYQGKITVGGTDIQQITLPALHKKITVALQDSLLFSGTVAHNLSYGAPQATPTQLANGVAIAGATEFVGTNYVAPVEEAGKNFSGGQRQRLNLARAIIPDPDILVMDDATSAVDQETNTEIQNALVKARRNRTTIIISQRVPNIMDCDQIIVMQNGQITARGTHTELVKSSPFYAQLVQTQLGGDYID

SEQ ID NO: 1331 - protein, 603 aa, Lactobacillus paracasei
LINLNGRRGPRNLHPEKVTLVDWKQTVRRIWGHLDTDRRKLLIVFGLTLFTTLATIVGNRVNGIVVDQFITKGRLRELFIVSGLLAGMYFLSSIFTYFQTSITTKVAQRTSAAIRHDLFAKMQRLPMRYFDTHDNGDIMSRLTNDVDNINTALMQTFVQLYTGIISVVGMGIAMLLLSPLLTGIVVLASVATFFYSRTAARITQKAFTIQQQELGSLNTQIEENVSGKQLVQLFDHQQDTIDRFNETNVRYTAAAYRAQLFSGVIGPFNNMTNNFAYLLITFAGAVAILRGGTSITVGVIFTFLIYLRNFTGPINNILNLINTLQLSLASAERVFQVVDAEPEKDAPNAVELDHTAGNVKFDHVSFAYDGKTEVLHDISFTAHQGEVVAIVGPTGAGKTTIMNLLTDLYPLTSGSITLDDHDVTQITFASLRRLVTVVQQESFLFTATIRENIRMGRPDATDAEVETAAKAANADGFINQLPDGYDTMLSENASRLSQGQRQLLSIARAFAAQAPVLVLDEATASIDSNTETDVQHAMNRLMQQRTSFVIAHRLSTIRNASKILVIDQGKLIESGTHEQLLAAGGFYAKLYNSPLADMDKMKR

SEQ ID NO: 1332 - protein, 562 aa, Lactobacillus paracasei
MMNEIPWWKKSVVYQVYPKSFNDSNGDGVGDLNGITEKLDYLADLGVDVLWLNPIYRSPQVDNGYDISNYRDVEPQLGTMADFEHLLQAAHDRHLKIILDLVVNHTSDQHPWFKAAKSSVSDPHHDYYIWKKPVDDHEPNNWGSSFGGSAWEYKKDLGEYYLHLFAKQQPDLNWENPKVRQEVYDLMRFWLDKGVDGFRMDVISLISKDPAYPDGPLIQGKAYGSYYAGAANGPKVHDYLQEMHEQVLSHYNIMTVGETPHTTAQQAQLYTAADRHELDMVFHFDHMHLDYGQYGKFSTNRFKLVDLKEVLARWENTLAQVDGWNSLYWSNHDQPRPVTRFGDEGQYRIRSAKMLGTVLHMLQGTPYIFEGEELGLKNVHFNQLSDYNDLETKNIFKELTQQHHESPEAAMKAIYLHSRDNARTPMPWDGSEKGGFTTGQPWLGLNPDHKQINAAKDLADSDGVYHYYQHLIKLRHEEPLITTGVFELLAPDDPNLFIYLRKGEHETLLVAGNFSSEERTWSVPDDLQAKDVDVLIRNSEISDSLEKTLTLPPFGAVVYKLQ

SEQ ID NO: 1333 - protein, 138 aa, Lactobacillus paracasei
MKRTIVLASHHRLAEGLKDTLDFISGGGQDIVTLAAYLDNQPVEKQVDEVMTAFPADRDVVVLTDMTAGSVNQKFFKYRTRPHTHIISGMNLPLALGVAMEPADQYISDARIDALIQEAKDAIVNVNEIQVEEDDDDE

SEQ ID NO: 1334 - protein, 747 aa, Lactobacillus paracasei
LNQKNQVSGDHYRFTVITNKMIRMEYQSAGQFEDATTQTVVNRDFGKPDFQVTRDQEGFAVQIETDSFHLYYRGGEFNGANLFIDTKYNFQTHYPRWHYGDPDVKNLLGTARTLDGADGAVSLDSGIMSKDGFTILDDSTSMLQAGTSIRNRPVEEIDLYGFAYGHDYRKALYDYYQLTGFPPMVPRFALGNWWSRFYPYTQESYLALMDRFQKAGIPIAVAVLDMNWHVTDIPTTYGSGWTGYTWNKKLFPEPEKLLATLHAQGKHVTLNVHPAAGIRPSEVQYPEVAEAVGIDPASKQPVLFDLNNRKFIQAYFNLVHHPLEKQGIDFWWLDWQQGAARSRAQIDPLWSLNVLHFLDQVKEKKDQALILSRYAGPGSHRYPIGFSGDSIASWRSLTFQPYFTATATNIGYTWWSHDIGGHMHGSYDPELSLRWLQFGVFSPIMRLHSSDNPFMGKEPWQYDLETDKSMTRFMRLRAQLVPYLATADVLTHQQGMPLIEPVYYRYPEVKEAYQFKNEYFFGSEMLVVPITTPSDDTTGLASAEGYVPAGTWTDLFTHQQYTGPAVVKFYRNKFQYPVLVRSGGIVPLADDAMAAIDDLPEAMTVTLFPGKQHAYVLHEQTAAGKAQTKFSWDPVAGTFGMTVTDPNHIIPEKRTYQLQIVGVKTTMKPFSGRFDQRLTLDLEAEDQQAIKLQHIFAILQHAKVAFDLKKQLWQSVNDMPASRAALTVASLAPATLSDALLEILLND

SEQ ID NO: 1335 - protein, 283 aa, Lactobacillus paracasei
MSDVQQTTNQPSATQPKLTKKERHSAILRYMAMGVNNFNYETQQGPSVVWAFSKVLRKIYPDDDEYVAALDNHFKYFNTTTAMAGMILGATLAMEERDGIKSKDAVQALKTSLMGPFAGVGDTIIWILLPTIMGSIAGYMALQGNPLGAIIWILVDILLFWVRIKLFDIGYDSGVKLVTTMANQLSAFTEAASVMGITVVGTLIATVVKVYTPLQFQFGKVKLAMQTGILDKIMPALLPALVAWMVYKLLGSKKWTPNRVIVLILAIALVGSFFGILGIEPTK

SEQ ID NO: 1336 - protein, 269 aa, Lactobacillus paracasei
MPHILQDILIIFLASYATLDNQGITIMNYWPVTVGLFAGLIMGDLPTAMTIAGTFQLMSLGVAGLGGASVPDYGLATIVGIYLSARTGAGLGAAVAVGLPVGLLTIQLDVLIKIVNNFIAHKAQAYAHAKEFNKMRMINWLGPLFFALKNFIPMILIVTVGPSAISALLKIIPKWLTNGLTIAGSMLPVVGIGMLMHYMPLKKYIWVLMIGFVMSAYLKVPILGVAIIGLALAIYTYQNLISASKKKEAATANGADASDDDDEGDDYDE

SEQ ID NO: 1337 - protein, 163 aa, Lactobacillus paracasei
MTVVLARVDQRLVHGIVVNQWAAEVQPKRYMVIDDAVSQDEDVKASMRLSKPAGTGMSIIDTEKALTNFKAGKYDAQRVFVIAKEPSTMLKLLDAGIEIPRVDIGIIFAEDGRTQISKFVSVNQQEVADFKELEKRGVPVNIRYVPADSPEPFDKAIAGKDIK

SEQ ID NO: 1338 - protein, 335 aa, Lactobacillus paracasei
MATISEVAKLAGVSVSTVSRIINHKPHVSPRKAALVADAMAKLGYTPLQAARQMRGSGSQTIAVTVPYITNPFFSELVAAIERTADERSYKTVIVQTFGQKSHELNALEFLKTNQVDAVIMCAIENDWDLIKQYRQYGLIGICNEYVADPEVLMVRADQEGGMYAGTKYLLNRGYRKLAFCTGQQAIRYNDKLEDLNSDRYRGYLRALREFDLEPAVEWQFTDVGTIADGQDVLQRIMVMKHRPDAVIAGSDQAAAGMIAEAQTMQLKVPEELAVLGFDDQPLSQVVARPLTTIHQPVHEIGDRIANMVADDLEEKTVEARQVVLPLSVVVRQSV

SEQ ID NO: 1339 - protein, 89 aa, Lactobacillus paracasei
MPHYQLTQQSRFKKHLKQLLQAGRFTQNDFEQVTNYLKTGDPLPEKYDDHVIKSRKPDRALFIKGSWLLIYRVEDLTVRLLDVGRHGDI

SEQ ID NO: 1340 - protein, 275 aa, Lactobacillus paracasei
VTAMYRLIAVDLDDTLLNSHKQLSPATISGLKTAIAAGIKVVPCTGRPLPGVHATLEALGLEGDDQYVIVQGGGVVQSASGKIIAEKFLNHQDYQDFSTFAASVASNGIDSNVLTPAGEVYTADRNISRYTVLQAWENTAGIKVREPQEMPEDFVIAKGMLLGEPDKLAAIQPQAETEFGNRFTVIRSMPFMLEIMPHGVDKGWGLAQLTQHLGFSADDVIAFGDEHNDLDMFDFAGTSVAMANGQDIVKKRADFITASNDEDGVVKALKHFAII

SEQ ID NO: 1341 - protein, 469 aa, Lactobacillus paracasei
  misc_feature (8)..(8): Xaa can be any naturally occurring amino acid
NADHPERXIDASEVDKPKIIVVGASHGGHQSVLELLHRYPDADITMFEAGDFVSFMSCGMELFLENQVTDVNDVRNFRPDDLIKRGAHVLNNHEVTAINADVKSVTVRDTKNGTTQDYPYDKLILSSGVRPNSLPVPGNDLKNVFLMRGYDWATNIKAKLEDPAVKHVTIIGAGYIGIEAAEASRKAGKQVTLLDMIDRPLGTYLDPEMTDILAKELTDKGVELKLGVKIEAFTGDEAVSAVKTDAGDVKTDLVIQAAGIKPATEWLKGTVNLDKRGFINTDPYLRTNLPDVYAIGDATLVYSIPAQQKVPIALATVARREARYLAENIFAENPARPFKGVVGSSALSVFDYHFAASGLNTFTAKRADVNVHTAFYTDSLRPDYVPEANGNPQVCVNLVFDPQTHRLLGGAVLSTYDVTAQGNVLALAVQQQLSLEDLAEADFFFQPGFDRQWSLLNLAAQHALGEPRF

SEQ ID NO: 1342 - protein, 229 aa, Lactobacillus paracasei
MSAIELQHIIKNFKTPTSDVEVLKDVSFSAEPGSLSLVLGPSGSGKSTFLTIAGGIQTPTSGVVTTAGQELDKLSGKARDALRLDKIGFVLQSYNLVPYLTVGEQFTLVDKIKPKNNLSHDELDQLLDDLGIGDLVNQYPASLSGGQTQRVAIARALYPDPAIVLADEPTAALDSPRVAVVGQLLADLAHKRDKAIVVVTHDVRLEKFADRTFTLLDGQLSEGDTSNAA

SEQ ID NO: 1343 - protein, 353 aa, Lactobacillus paracasei
MYLSLKEIWHEKLRYGLIIGMILLVTYLVFILSALANGLAQQNTQAIESWDTSKVVLAKDSDINLSQSLLTSEQTKAIKLGKSQAYVGTIGAVATSSKHSEIRSTMVGLDWNQYIGKDMQLVSGHRVQSDNQIVVDTQFKNEGYKLGDKVRLTTNGQQYTIVGFTENAKMSVAPVVYGTMATWRKLHNLPDAFTASGIISKSADFKVNNSDLKTYTADTFIQKLPGYSAQNSTFAFMIGFLFVISLIVIAVFLYILTMQKIPNYAVLRAQGVPARTLVKTTIAQALMLVSFGLILGGVLTAVTARFMPMGVPMIFSAGLSIAVVIGILLTGLLGAIVPVRTILKVDPVTAIGG

SEQ ID NO: 1344 - protein, 167 aa, Lactobacillus paracasei
MASTTFQHLDAAKQQRVLAALITEFSQYPLAQAQVARIVKQADIARGAFYKYFTDLDDAYRYAFGQVIGRLHAGITGPTMRQDPYTATADFLHEASESRDRDFIRLHFTKNSGLVNVARPQVPADATDWAVASLCHSAISEVLADPADATLILAHLKAALSQLQVKE

SEQ ID NO: 1345 - protein, 254 aa, Lactobacillus paracasei
MAILMADVSSWQPESDSWFRKLADVGVKAVVVKLTEGTTYRNPKAAAQLAAGRRMGMQVHGYHYAHYHNSADAVAEGRFFGTTAKALGLPTESVMAADVEDPGLSGELTGLTNVFLQTVKAIGYPHTDLYTMASWLTTRRFDRVALIPKNLWLASYGVNQPGVDNVGTWQFTNNFQGLGVDMSYDFFGHYTTRLTGTLNDGVARVPTIRFHTVQPGESWWAIAHQYGHDMDKLAALNGKTILSVIHPGDQLRVN

SEQ ID NO: 1346 - protein, 50 aa, Lactobacillus paracasei
MDKELLTYVLDQAVGVVIAVFLLTRIERRLDVLITSIEKFMTKLDAKDRL

SEQ ID NO: 1347 - protein, 176 aa, Lactobacillus paracasei
MAQEEAGFALYLAHQGVVYAVLAQLGIRRDRSDFQDWRDDGMLVYLNYFNRYRDPLTDEAAIRKFNKLAWHFVYLTLMQRMQKNRQRSVIEQLPSNITLLQKTTFASTVLNVQTSLEWDGQLQRLAAILTPMERTVLGLRLADLSDAGIAGRLQISRQRVLKIRKQLQAKYRQVVG

SEQ ID NO: 1348 - protein, 422 aa, Lactobacillus paracasei
MQPSRKIASNIFKGSLGNMIEWYDWYVYAAFAVYFSPSFFPSHDPTSELLDAAAVFALGFLMRPIGSLVMGRYADRHGRRAGLTLSILIMASGSLLIALLPNYQTVGIWAPVLLVVIRLFQGLSLGGEYGTSATYLSEMAEPSRRGFYSSFQYVTLVSGQLIALGVQIILQMYLTETELSSWGWRIPFAVGAAGALLVLWLRLSMDESNQFQHMSTSQRQSAGTIRALLKYPKQILTVVGLTLGGTICFYTYTTYMQKFMINSVGLPKGTVALINFAALFIFMCLQPLAGYISDHIGRRPLLFFFGIGSTVLTVPLFWLMQTTKTPLMAFLLMLVGLILVTGYTSINAIVKAELFPTEIRALGVGFPYGLTVALFGGTTEYIALWFKQAHHESYFFIYVSLCALISLIVYWRMTETMHAEWD

SEQ ID NO: 1349 - protein, 228 aa, Lactobacillus paracasei
VGFATLFEVLQHLAPYLGITFWIIGASALFVLVFGALISLVHFSHSRVLELLYNGFVSLMRATPVLLLLMLVFYGMPFLFQLVGIDISWWAKTSFAILAIGLENSAYFSENLRSAYASIPQSQYDACTSLHFSRIAAIRRILGPQVFAAALPNIGNTLITIVKNSAYVYVIGITDLYEQAQIIAQASFGKQQVVVFIALSLIYWAICAAIQAFFTQLERRRSWSGGAK

SEQ ID NO: 1350 - protein, 222 aa, Lactobacillus paracasei
MTIFWQDWQQIIPSVWTSIYIALLAILFGIPIGCLIAWIRVKRPPILNQLVGIYLSFARGVPMIVVLYILYFALPNLTTVLNGGKGLHIPATVVAVAALALFSSAYFGETFRAAYQALDPAQLEAALASGLSKRTAMKRIVLPQAAALALPNVFNSVMDIVKGTAIIYNIGLLEITGTSILVGSKTYQFIPAYLAAWTIYLVLYWLVSAIFHLIKRQVTYLH

SEQ ID NO: 1351 - protein, 292 aa, Lactobacillus paracasei
MKKSRLALIAGTAVLALFLASCGKSDTASSTSSSKVKTVQIVGPSASQPYQIYKSKDKLSGYNGDILAAIQKDLKNKYKFQYQVTEANSVFVGLQSGKYDLAVGNYYYSTERAKTYDYSRNPTLLSDLRLVVRKDDNKITDLASLAKTNGKLEPIDVADPRYGIVENWNKQHPEQKVTLKSSGFVDTANQFKDIVNKQYDAILYPRTNFDTAQKKLNESLKLSKSIAVFPVVYYYHKSSTSTQLRKDIDKELLKLRKNGTLAKLSQKWLGSDPFTAKNDRVTDVTKSYAQEK

SEQ ID NO: 1352 - protein, 249 aa, Lactobacillus paracasei
MGLLEVKNLSKTFKGKTILANLNLTVNAGETLVIIGKSGAGKTTLLRCLNLLERPTSGNLTLGNNTYDYSRLTAGDIRTIRDQLAMVFQNYALFNNKTALENITEPLIYGQHQTKAEAQKTAQTLLEQLELTDKANLYPAELSGGQQQRIGIARAEALRPSIILFDEPTSSLDPALVGTISRDILSLREKGQTMIVVTHQLDFAQRIATQCAFLNEGHLVEVAPADQFFTHPAQPETVAFLNAAKEAEA

SEQ ID NO: 1353 - protein, 349 aa, Lactobacillus paracasei
MKATIIGAGNTGFACAADLARHHITTTVYSRDPAKAAKLTENPFAITGRFTTTQPLNVSSDLAASIQSADVIIVATWANVHTTVIDALRPLIHRGQAIIFLNGNWGLLQAVAAFTPAWLAEKRVSILETSGMPYVAQWQVHSLHISEIKAEVTVSTYGAKEASIKGINLLKQLYAQVIESPNILQASLSALNPIIHVPVSLFNLSRIEHAASFHILTDGLSSAARAYIMHIDDERKHLASALHIPYSSIVHQLATQWGTDFDTLREVFHGLPTYRDLPAPDSLQSRFIVEDLPFGIDPLVKLGEVLGVSLPYSEKLAAFAHAVFDQVPEPDLGFINAETIAAVQGTGSA

SEQ ID NO: 1354 - protein, 394 aa, Lactobacillus paracasei
MATAVHFGAGKIGLGFIGDLLHQSGYHIVFADVVEKTVAQLRKEKQYRLFLIDHDYQERIIDNVDAVSSIQDPTGVVEAITHADIVTTSVMASNLPKVAPLIAKGLKARLEKHLPKMTVMACENAIMGTDILKKAMLDSGEMTSEQLEQAAVYPNTAVDRVVFDGHHQGQDGIEVGDAYELAIERGKLLDPNSEPIKGAEYVDNLEMYLQRKIYIINCGHAISAYLGQVHGYHTVQEVLHDEVLLRQVKAAMAESAAALEAKYHFSKQSLQDYIETMFVKRMTTPGLSDPVTRVGREPIRKLSPNDRIIGPANECESFGLDNQYLLRGAACALLFHNPDDKQAVKMQQFIQTHGIEKAIAQYTKIQPNSAMFEKLLKAYWEAKAKLPANVGNAK

SEQ ID NO: 1355 - protein, 667 aa, Lactobacillus paracasei
EIICBACMPNENTMDLKVAQAKVQKFGATLSAMVMPNIGVFIGWGLLTALFIPTGWAPNKQLNELVGPILTYLLPALIGYTAGANIYGRRGGVIGAFATLGVIVGSSVTMLVGGMIMGPIGAILLKKFDKLVKGKVKPGMEMLVDNFSLGILGFILVILGFLAIAPIITGIQNFLSAGVNFMTKRDLIPLTSLFVQPAQILFLNNAINHGIMVPLGLQQAAEAGKSILFLVEANGAIWVGTALAFAKFGTGIAKKTAPGAAVIMFFGGIAEVVFPYCLMMPLTILGPMAGNIFSLTVLSLFGGGTVGPPSPGSVFAFYMMTPKSSLLVNSIAYFGALAVSFAVTGLILKFVRQPNASKMLSSFDTAAVATAGPAAPAVSEELQTAEKDDGIAVAPKNQLRHLNRIIFACDAGMGSSAMGASILSAELKKVGLSPEVDHMAVADIGDETSRADLIVTNESLEPRAEMMSKGSLPILTVKNFMDRTEYQRIIDQIRTMVGDTDDHVTQKQAAEETAITLQVAEQVLEKPLFPVENIVLGASFQDKNAAISACADILIEGGYVKPFYKQEMFAREEDLSVYLGDGVAMPHGLTQSDSILHSGICFVQVPDGVDFDGNTAYLLVGVAGKGEEHVQLLGQIAQALTEDNNIQKLREAKDKQTVLSILKLSEH

SEQ ID NO: 1356 - protein, 187 aa, Lactobacillus paracasei
MEAKSLKTIISELDQYAPMIDDTQVETVAKMAFQANRIFVGGAGRSGFAGRGFAMRLMHLGLHAYFVGETTTPSIGEGDLLVIGSGSGSTGSLVVDAKKAKAVGAKLATVTIYPTAEIGSLADAIIAIPGETPKNETGAADTAHSVQPMGTLFEQLSWLTYDAIILELMKLTGETTDTMFPRHANLE

SEQ ID NO: 1357 - protein, 215 aa, Lactobacillus paracasei
MKLQLALDDISLVDALVLAEKVRDYVDIFEIGSPFIIQEGMRAVREFRRYFPEKKILADTKIMDAGEYEAELTFKAGADYCTVLGVTDILTIKACLAAAKKYGKQVFVDTICVPDLNTRIKELEDVGVDSISVHVGVDEQAVGQTPLNALKQVKQLSKHSQLSVAGGIKVSTVDQYQALGADIIIVGGGVNHADDPVATAKALADKIHSHENVSA

SEQ ID NO: 1358 - protein, 253 aa, Lactobacillus paracasei
MAKLSAIDRQKQLVDLISHQGTMKITELATYFNVSRETIRRDLQELDNSGAVKKWYGAVMPVQDFNIPPVEQRMASFHEQKLAICKKALSYVSQRSTIFIDAGSTALTFASLLKETAGHTIITNSMPVVNELVTSQNHLISVGGSVDPLTFATMGTQTLGFIEKIRMDMAFLGTSGFAEHNGPSSNSLDDVEIKHKIIQNSRLNFVLADSSKASSSSLSQYANWHDIDYLITDNSLPAKIKDQLTAQTEVVTV

SEQ ID NO: 1359 - protein, 220 aa, Lactobacillus paracasei
VRCILFDMDGTLINSEAKYYAIWDQLLADNGYHLTVDFYRHILGMPMSGIQQTFTDHYGTGFPFDTLFAAFLKRRTALVQHGNFELIPGTRAFLKACGHHQISCGLVTSSYREETQAILEKLDLASYFQFALFGNETQHGKPDPEIYLQAIAKSGFPPDEVVAFEDSKNGILSAKNAGLAVYRIENPIPIDADILDLVTASFSNYDEALEFFHLNKEKLQ

SEQ ID NO: 1360 - protein, 34 aa, Lactobacillus paracasei
MANEIVKYENRLNSIPLRRFNSREMNLWLCVNWC

SEQ ID NO: 1361 - protein, 59 aa, Lactobacillus paracasei
MTKQDETHRVMFTLTDQAIAKLDQLVAKKQQEVNQNPDLAKYHVRVTKSNIVENWLSKQ

SEQ ID NO: 1362 - protein, 251 aa, Lactobacillus paracasei
MKTKPKKALAIVSILVISSIFLISKYFYHPTDLALENKINITDVKATSYQSSSKIDLRFKTTKNATYMISDLNKYPIATGRSSSGKVELKRIKVNTRYVIITCQGRGKKARISLKLPNEHRVYMSSIVILPVNRGEDLIKYGYNNQKLFKLQLIHAIHESTPSGEKIVLQVKVTNYDYDLETLPNEANFSLILSTGEKIPLRLSSKYNKLNKGKSSIFKYYATSNSPLSLENVKLVFDNGNLDSPWSFYLN

SEQ ID NO: 1363 - protein, 367 aa, Lactobacillus paracasei
MKARRTLLTGVAILLSFLIFWPLRPLQANSDTSLDKAETVALPPNTMKFSKRITPEELVTQIKSQYKYSFPKYNGTITAYTNTQYHNYLDGKTSDYISPSYISLLDNRREQVETLYKYNLYSSGNNLNPVTNYDVSPYSAVGINSTWFNLPNGVIVINSPYLESSSVPNPSTTYEGSTSFGIGPNRIASAAHCFYDADAKKYPDGGITLWGDANVNGHPRGVTAFTSFKIPSSYSNGKDFSNDYAAAIVQLKSGSLPSTLSLSTSTSNNTQASSIGYPGDPQAGTPYDSQGQMVFSPGTVFPDPDDPIGLYQSSSVRAYHGMSGGPLLDPSNRVIGINVYEYSPNDVEIAWGFKRMTPSVVSFLLNS

SEQ ID NO: 1364 - protein, 182 aa, Lactobacillus paracasei
MSKTIKELANELGISKQAVSKKLTANLRANHVTTVTTNGRQHLVIDDDGVSALKAQHIASHNQHPTANQSTTNVVDNNVNLVDELKNRILAQENELSQKNKQILAKDTQLENMQKLLDQSQQLQLMAENKLKKLEAPHNDTESGSELAEDQTHERAPEAPVKAESSPEQPPSFWQRLFGTGK

SEQ ID NO: 1365 - protein, 156 aa, Lactobacillus paracasei
MAGTIRYNLTYGATRNYTDEELWHVLDMAYAKTFVEAMPQGLDTEVGERGVKVSGGQRQRLAIARAFLRDPKILMLDEATASLDAESEMMVQKALTKLMHGRTTIVIAHRLSTIMNANRIYFIENGTVSGSGTHEDLIKSHPIYREYVKDQFGKAA

SEQ ID NO: 1366 - protein, 195 aa, Lactobacillus paracasei
MTKTSEDLLKAFGGLIQKRPFMGAVASSLRFGDRQRQPNQLRLLRLLDNKGELTNSDLVEALDIRPSSVSALVQKLEDLGLISRRESETDKRVQLIALTDDGKKFIETTGKLKTDLPDQIFSGLSEEEQAQLLTLIEKLSADLATRDDLSWPEGKQFDDMREWAARFHHGHHEHGPRRGYPGGFGGGPRGFDHRF

SEQ ID NO: 1367 - protein, 365 aa, Lactobacillus paracasei
LAETMRYCPNCGFKIPAGTKFCPNCGADLTIFNARVAGETDFGREQSQQPAASEPVREQVRGERSRRQRQSGSTSIKKSLVLTDDSFDHFIDWLATHMVYTLIGVMVLFCVFSFSTIAGWVLAVGCAVAIYVVANRRPVASYTSRFNDDDSGDSDDDIWTAPRPAAGQSVPPYPNPYMTQPDNGPMAQQAQKMSNRSPHWWSHLGTTAGQPRRRGGIIWLVYLIASLVAFTAAYAWPFGAGSVATANVGGSLYDLVRSAVTLAETAATNTGVASPQTNLPYLALILAGIGPVLGLLFGLFRSRGMMRFAGMLGLLGYGALYFAYAPLMSSANNQIQGLLNPGIGFSVGIGAALVMFVTARLLPRD

SEQ ID NO: 1368 - protein, 335 aa, Lactobacillus paracasei
VHRGKAWVLAGFGVLMFLLIGAFIRHSQLAEPHAPATVSRQRQSAITKQSSRKTQAASTPSQTAPSIAGSTVAQTSSSLAAFTFSAPTLQRSWSYMAYVPAGYDPHKRYPLVLMLHGMDGDDTNLVQLVDSKSLLDEAVNSTGHPAVVVFVDGGNSFYVDSPAEKMQTAIMQDLLPHLKQQFALLSQADAYAVGGVSMGGYGALRLVLAEPQQFRIAAALSPAVWQQVPEAAQSRMPAFLTHGQWDQARWDADQPANMLTADRLAGLKVYLASGQADTTVPFTDVTHFASQLQAVGVTPTTSWSATGTHGFNYWQQALPAAYQWLLQQLPRATTN

SEQ ID NO: 1369 - protein, 262 aa, Lactobacillus paracasei
MEYCPNCGVQVSADEAFCHNCGFNLAQYRAEKGGLAQEQPAQGQGSEVNGQMQTSQPSGQQPLASGAVPPNATRRRSNGGGGQKQPHGRPWVIVSIVLVAAVVLLAAFLFFQNRQQQARTEALDSSSSAAASASASSIAAASASDSRVAESTSASASQEAASESLANARESAEDSRDDDESRSDSDLSNREVAQMAADYDDFDLDDYRVEVTSPATNMKEVDVYDKDSGALHGKYRYDEIHDQMSKFDDDSGKWTLIHGDDD

SEQ ID NO: 1370 - protein, 138 aa, Lactobacillus paracasei
MMQSESNISGLIYQLAKLQKYFLNQHLSNLDLNSDQAKVLTFIAANPGANQRQVSVELSRGPASVSNLIKSLIQRGLLEKRMAPHSERERQLFLTDEGETTAEQVRDLFQVLEKAFAANVPDPEALTVTLKQVLKALQ

SEQ ID NO: 1371 - protein, 99 aa, Lactobacillus paracasei
MSLTIIERRNTEKELAANFNLAGVTLEQAAQDLATTPEHVEAVLQLQVDQIEEPWILRNYLNKQLAAQGKTPLPYSRLQGDPAVHWFLNTDLIAKGRLN

SEQ ID NO: 1372 - protein, 428 aa, Lactobacillus paracasei
NADHDEPENDENTBTANLDEHYDRGENASEALKNFRFQNKTDIRFGTGRLDVELHDAVSQFGSRVLFVYGGHSIKKSGLYDTVTGLLADLQLTELPGIEPNPKIDSIRAGQKLAKDQDIDVVLAVGGGSVIDAAKVIASAKFYEGDPWDLVKDRGVTRRKLQQLPVVDILTLAATGSEMNSGSVISNPVTHEKLGTVGPNTPAVSFLDPSLTFTVPARQTAAGSMDILSHLLEQYFDRSKNNDASKGMIEGLMRTVIKWAPIALKQPDNYDARANLMWSATMALNGIVSVVNENGWTVHSLEHELSAYYDITHGVGLGILTPRWMSFILTKDATTAEMLAQFGRHVWDLEGDESYAVAQAAIDATFDWISRLGFPMTLPEVGIKDTQHFDAMATAAVANASLETRAYVPLSVEDVETIYQASMTDGLA

SEQ ID NO: 1373 - protein, 327 aa, Lactobacillus paracasei
LTQPILEHDSVAFQAARNAENQLWADFHLKPKTRWFKIAPDDLRVRVLEFGHGDPVLVVPGNTGDPYALAPLLPQLVGYHVFVMARPGGGLSDGFDHEQVDVHNFAVDLFSQIMDKLDLKSAPIIAHSMGAHWATWFALAYPDRVQQLILLGNPGRMLMTKTPTLLKMAMMPGLGKWFMKRQIPKSAKRAWGPLHRMGTDPAAVSALPQSFADCVYAFDHLPNYQLATLSLLRTMNQEKYHNALKESQLRELSVPMTLIWGTNDTFANPELGQEIAAVVQHGELLTVNGAGHEPWIDDPKKVGTIVRLRLKENHLRAAVSQTSANEW

SEQ ID NO: 1374 - protein, 145 aa, Lactobacillus paracasei
MTTLNTSTIQALIPNRYPLFYIDHVSELVPDESLVAEKYVSVAEDHLVGYLPDELTMPPTLIIETLAQAASILILKSPKFAGKTAYLGSISKADFSAQVPTGSVLTLAIKMVKVRENMGVVATTASIGDELVCHAELHFVVEANA

SEQ ID NO: 1375 - protein, 149 aa, Lactobacillus paracasei
MSQKPSVKRINDKLIRVYTDILRMEEEELRKSQFRDLGIKEMHTIDAIGIHATPSSSDVAKRLHVTEGTLSVAINNLARKGYVERLHLESDKRVVNLRLSRKGRLMYRAHLAFHQKMVASFVKGFTEPQIELIERALDNLNEFIDEYRH

SEQ ID NO: 1376 - protein, 320 aa, Lactobacillus paracasei
LEILASAYSVPATRIENDQLRQYMDTSDDWIKERTGIKARHVVTNQKNFDLAYDVAQQLLAKAQVAADQLDFIIVATMSPDYATPAEANRLQAALQADHAFAFNINVACAGFEYALHVADRLMTSPTVHQGIVIGSEVLSRLVDWHDRRTAVLFADGAGGVLINDQGFPVQAVDLKSFGDTEMALVAGEQTNHSPFAEAPSAKPSPFFKMNGRAVYQFAISEVPRSINRALTQAAVAVDDVDWYLLHQANARIVQSVTKKLKADPAKFPINIDEHGNTSAASVPILLAQLAEDGRLQRGQRLVLSGFGGGLSVGSLIVTY

SEQ ID NO: 1377 - protein, 79 aa, Lactobacillus paracasei
MTNEEVLPKVQNIIADQLDKKPEEVQLTTNFKNDLDADSLDIFEIINEIEDEFDVKIDTDESIETVADLVNFITEKAEA

SEQ ID NO: 1378 - protein, 328 aa, Lactobacillus paracasei
MSPLMERLGVKYPLFQGGMAWVADGKLAASVSEAGGLGIIGSGHAPASWVKEQIDIAKSLTDKAFGVNVMLLSPFVEQVIDVIVDAKVALVTTGAGDPSRYLERLQQNGTIVMPVVPSVAMAKRMAKDGVDGVIAEGMESGGHIGSITTMALVPQVVDAVDIPVVAAGGIADGRGVAAALSLGAIGVQMGTRFLTSTSSRIHQNYKDAVIKAKDVDTLVTGLYVGHAARVLKNPMSRNFLKLEKKIALSDTTDFSAVEELGNGSLRKAVLEGDREHGSFMAGEIAGLVKREESSEDIVEDVMRQAKEILAGSKMAALLTGQVDVQAQA

SEQ ID NO: 1379 - protein, 307 aa, Lactobacillus paracasei
LRFAYVFNGQGAEVPGMGIDFYQNTLIFKEIIDRADAVLDFDLPQFLATGDFAAHPDALQPALVAYSVAMHEVAAAALPDETALAGLSLGEYSALIAGGGISLEDGLKLVAARGKAMAAACQAHPGSMLAVMTGDTAVIAAACQQVPDVWPANYNGPKQTVLAGSKAGLAQVEAWLSDQGVRTVPLKVAGGFHSPLMADAQPPLRAALDQVHVFDPATPVISTTALEPFSAENMRSILAAQVAEPTKFADVVRQLKAAGIDTVIELGPKPVLSKMIKRIDRSMTTHLISNAASLNAVIDLNNGVKAD

SEQ ID NO: 1380 - protein, 242 aa, Lactobacillus paracasei
LKLTDKTAIITGASRGIGEAIARNFAEAGANLVLNARHEFPTELIKELEAFGHGVVTVLGSVDDPATGQQLVATALDKFGSADILVNNAGITSDMLAMRMKPEDFARVVSVNLDGTFYVSQPVFKKMLKARTGVIINLASVVGLTGNIGQANYAASKAGIIGLTKTLAREGAMRGVRVNAIAPGMIATDMTAALSQASQDQILAEIPLKRFGQPEEIAHAARFLVENAYITGQTLTVAGGLG

SEQ ID NO: 1381 - protein, 406 aa, Lactobacillus paracasei
LQRVVVTGMGTVNPLGHSVAETVATMDAGKIGIRPITKFDAEKTGITVAGEVEGFKPEVRMEKRLSKRLDLFTQYGLYSAIEAYEQSGLTKDDVDSERMAVIFGSGIGGLTTIQEQVTKMNAKGPDRVSPLFVPEAISNMVAGTISQYFGAHGPSYVVVTACASATNAIGEAAMRIQSGKADVVITGGAEASVNEIGIAGFAALSALSKAADPAKASLPFAADRSGFVLGEGGGAIILESLEHAQQRGANILGEVVGYGATSDAYHMTAPDPSGHQAARAMELAIEEAGIAPSDVGYINAHGTATKANDAMESKAIHDLFGDDVLVSSTKALTGHLLGAAGAIEAIMTISALHEGKLPINVGDAEQDPECPVTLVDAANRDVEVDYALSNSFGFGGHNAVLAFKRW

SEQ ID NO: 1382 - protein, 149 aa, Lactobacillus paracasei
MDTEMIEVLIKQLEQSSLHELELTLGNDSLHLVKASAAPAPIVNTQATVPSQPVTPETAVPAEPEAPTGTAIKAPLVGIVYLSPKPDADPYFEVGAHVNKGDVVCIIESMKMMNEIKSTVSGTLKAINVDNESLVEYDQALVTIEEDRA

SEQ ID NO: 1383 - protein, 146 aa, Lactobacillus paracasei
MLETKKTLEAQEIQAILPHRYPMLMVDRVLDLKPGESVVAQKNVSINEQIFQGHFPGNPIFPGVLQIEAMAQAGAIALLSMPDFKGKTAYLGGIKKAKFRHMVRPGDVLRIEVTLEKLIDNAGLGKGKIYVGENMASSADLVFAIG

SEQ ID NO: 1384 - protein, 454 aa, Lactobacillus paracasei
LFKKVLVANRGEIAVRIIQTLREMGITSVAVFSNADRHSLHVTLADEAICIGGPRAADSYLNMRNVVSAAILSGAEAVHPGFGFLSENAEFAKLVTDAGLAFIGPKPTAIDQMGDKAVARQTMIDLGVPVIPGSHPLQDVETALAAGEAIGYPLMLKASAGGGGKGIRKLTDAAALKAEFAGAQAEAQAAFGDPTMYLEKVIVPAKHVEVQVLRDMHGHTSVFPERDCSLQRHSQKMVEESPCPVLTSPERRKLLHLAATIAEGVDYLNAGTIEFLMDQQHHFYFMEMNTRIQVEHPITEMVTGVDLVQAQLRVAAGDEVALTTPEPSGVAIECRLNAEDPYHDFRPDVGTLEQLRFPTGGMGLRVDTGVAPGDKISPYYDAMIAKLIVHGRTRDEALAKMHRALIELHVEGVKTNRDFALALFQAPTVLAGKADTAYLNRDFLPKWQSVSRPV

SEQ ID NO: 1385 - protein, 271 aa, Lactobacillus paracasei
MSQPQLTQEALAREAALPENLWIQCPYCKQGSYRESLGNAQVCPHCHYGFRITAKKRLSLIATATEEWDADLVTSDPLDFPGYTEKLAAGQAATGLKDSVWTGQATIGGQSCALGIMDPKFMMGSLGTVTGERLTRLFEKATSANLAVVLFCASGGARMQEGIHSLMQMAKVSAAVKAHSNAGLLFISVLTDPTMGGVTASFAMQGDITLAEPHSLIGFAGRRVIEQTINQKLPQNFQRAETLLQSGFIDAVVQRQDQPSYLGDLLALHTA

SEQ ID NO: 1386 - protein, 257 aa, Lactobacillus paracasei
MTDKETLAYETVQAARAPRPYRTRELINGLVTNFHEFHGDRSSHDDPAVIGGIGWLDQQAVTVIATDKGQDLTERLQTHFGSPEPWGYRKALRLMKQAAKFHRPIVTLINTPGAYPGKEAEANGQGAAIADLLYTCADLPTPILAILIGEGGSGGALALAFGDEVWMTDKSMYSILSPEGFAAILWKDASRAKEAAAVMQLTPQDLLAKAVCDRIIPDTGTTFATTLKAAIKPKLAELVATDPQALIAKRQQRFRKF

SEQ ID NO: 1387 - protein, 393 aa, Lactobacillus paracasei
MLEKKFYHTMFSHSFNIPVRVDYWDHTEETYGTGEPTITIKMKKAIPVRDLLKNASLALGEAYMRGDIEVLGGTRPLQQLIAAAYANAGSFMRNKKLMRFLPKQSHTEHKSKEDIHSHYDLGNDFYKLWLDPTLTYSCAYFEDWSDDLETAQLNKIDHILRKLNPQPGRTLLDIGCGWGTLMLRAAKTYHLKVVGITLSKEQFKLVSDRIESEHLSDVAEVLYMDYRELNREPFDYITSVGMFEHVGKENLEGYFKDVAKLLKDDGVALIHGITRQQGGAVNAWINKYIFPDGYVPGMAENLNHIVDAGMQVADLEPLRRHYQHTLEIWDTNFNNHRNPIQQKFGYEFTRMWDVYLQAAAASFESGNIDVMQYLISKGPSGKDLPATRAYMYE

SEQ ID NO: 1388 - protein, 291 aa, Lactobacillus paracasei
LTNLLVIGATGNIGQPLIRDLQDDPDVHLFAGVHNSEHAKQALNGLKVQVRRFDFLDPATFEQALADIDKVFFVRPPQLAKPKEDMYPFLDALVARHVKQVVFVSLLGVAHNPMTPHHQIEKRIVELGLPYTFIRPSFFMQNLNTTHQADIVGHRDLFVPAGHARTSFIDTRDIGATAAVVLRDPAYIGQKLDITGAQALTYADAAQIMTMELGVPITYSKPSLWRFRKVMLQRGLPKNYVNVMVMLYLITQLGNAKTVTTTLPNVLGRPAISFEQYVHDYRAEFLPKPLS

SEQ ID NO: 1389 - protein, 492 aa, Lactobacillus paracasei
MKEATWSTAARYQPYSSWAPDYIMKLKAQVAASKWRTKTHVQPDTGLINDPCSLNFFNNKWHLYYQQFPFGPVHGLKSWAHAVSKDLFNWCRVPGDLLPDNEYDSHGAYTGSALVTHGTLRLMYTGNARDDQWHRHSTQLGAVLGADGRLFKDPKPLILTPPAGYTQEFRDPFLFNYEGQTYVLIGGQRPDHTGAILLYAKQTDKSWRFVAPLSIPDEFCGYMVECPNITFINGKVVLVYCPQGLDQDFFEYENVYPNIALVADNFDPATGNLTHQRLQNIDKGFDFYATRLANTDDDGTLAISWLGLPDTTYPTDDDGWAGVLSYVRQLTLRDDHVCLYPHPAIKNLRETAVEDQPVVQQHDDEWTVTNLEGAFELAFTLAAGQKTTIHLPDGGHDQLLIHLDSDSGQGMIQRENRNNGGSLRQFGFPAGKTVEIRLFIDVSVFELFIDQGYRVVSGRFFGNEAPTAARITPPSAASDVVSWNLKKDNGGL

SEQ ID NO: 1390 - protein, 333 aa, Lactobacillus paracasei
MATISEIAKAAGVGVTTVSRYLNHHPYISAEKRARIEKAIHQLGYTPSAAATSLRAQATGNIGVLVSRVTNPFFAGLFDAIERELHAHGYQVMITQTYDDPEAEERFLKQLKSRELDGVILASVEAPDRVAAVAKAFPGRVVVVNADVQIPGATSLVLPHYQATRDALDYLFNQGHRRFAYVSGGTISGAHHGQSRTQAFLDFMQAHQLLVAQDLLFGQIHTAKEGQAIGKQLASLGPNVRPDAVFTNSDEVAVGVIDSLLAADVKVPDDIAVMGYDDQPFAPFAKIPLTTVHQPVASMAAAATHELLKGLGRQVAQDTQPTLHLSLKIRQSA

SEQ ID NO: 1391 - protein, 555 aa, Lactobacillus paracasei
MTNETSRTWWQQGIFYQIYPASFKDSNNDGIGDLPGITAELPKLKELGVTTIWLSPVYKSPMVDNGYDIADYQAIDPRFGTMADFDQLMATAKDFGIKVVMDLVVNHTSDQHRWFQAALKDPASPYRDFYIFRQGHDGQPPNNWRSNFGAGSSWTAVPGEPNTYYHHVFSPQQPDLNWENPKLRKAIYSMINWWLAKGLAGFRVDAITFIKKDQDFASITPDGSDGLGKVKRKTENRPGLDQFLKELNAATFKPANAVTIGEASGVAYDQLGDFIGENGYFSMIFDFHYADIDVASGSEWFKQTNWTPKMLGEAIAKSQLAIQKVGWGANFLENHDQPRSLSKYIREPQYRNAIGAKALALLYFGLRGCPFIYQGQELGMVNAVRTNIDQFNDLSALDNYRRALAEGYSEDVALTCVNRRSRDNARTPYPWDDSQNGGFNAGHEPWLPLAKQAAGVNWQAEHDDPNSVWTVYQTLCRLRNASPLRADLIEGDFAPLDAHNDNVIAYARGQHVQIFVNLSSKSAAVDLPAGHVWLNNYPDVGTSLQPYQAILIEVK

SEQ ID NO: 1392 - protein, 570 aa, Lactobacillus paracasei
EIIBCCMPNENTMAKNYEEEAKAILKLVGENNVDSVTHCQTRLRFVVKDRKAIDDKALEKLPEVKGVFYGSGQYQVIIGTGVVNDVYAAIAKLSTVNAIYGKDDADTAGKTSNEHKTVVQRLMAMLSGIFIPIIPVIAATGLFLGLKSAATNAQVLKLFGAVPSDIPASLTSVISVLTDTVFAFLPALIVWSTFRYFKGTPIIGIVIGLMLVSPILPNAYSVADGSAKAIMLFGWLPVVGSQGSVLTALVAGFIGAKLELFFRRHMPNVLEQILTPFLTMLVTFAIMIMGVGPIVHAIESGMLVGVEAVIHLPFGIGGFLIGAAYPLMVLIGIHQTMIAIETSLLASTGLNPLITLEAMYGFANLGVALAIFLRARSNKAKATSMGAFTSQLFGVSEPTLFGVLIRYNFRPLIVTVLTSGIGAAILSMLNVAANSYGLAVVPSYLMYIYNGHALLWYTIVSLGTVVAAFVATNAFAIPKEVLTPDGDVETANAVISSTVSDNKVYAPVGGETVALDQVSDPVFASGMMGEGMAIKPAEPDINKVYAPQAGTLSVVADTGHAYGLTTDDGM

SEQ ID NO: 1393 - protein, 394 aa, Lactobacillus paracasei
LAKETHHVVIPDAIMEDLDIKDGEQVEVTLKDKEAVIRPKRTDTGTQTISLRFFLIPTVLAGIAFLAYFIYFQILQVPMTGKNSIAQMVIVLGELSGIATFAVAYIQNHRQIHGRDHRRRYWRIFPTMLLSFAIILAFVTSVFFWVIGYMFEGVSFDIYTATGLFLLFISIVNYLMIYSALSISTSFITTLFLSTFVGGVIGAIVTNSSRQWWQHNVSFLGTNKALNAWQFNLTIAVSALLWIALVDYLFVPLMAHRKNDWRLITMRIMLTVAAIALLGVGLFPNNRGLMHILHTQSAWFLNYFIIGMIIAVRWLLPGVSREFLSTSYIIGGIIIFAAILFQFVHYLSLTAFEMIAFALAMSWIMLLLQNIHRLYQKDESTFVVTVTTDKVNTD

SEQ ID NO: 1394 - protein, 188 aa, Lactobacillus paracasei
MTEADHEIRYAEYMNMINMTYSEAVAYLLNKYGPVKDNYFNEKSYQCFLNGEIKSISKGKYARTSEGLYTHHVDENRAENLSDLRFIRYYQYPFSMHRKDRLVYADLIEHLILHAIIAKETDGRFGEKGYSVFLAPNVDQWFISKKMPEPEWMKAVYRRSFLTKEEAKRLLEQIDSGPRAKVARYYRI

SEQ ID NO: 1395 - protein, 1016 aa, Lactobacillus paracasei
MGATLESTFEKRLIEQLTRGISQWTYRPELKTEEDLWRNFRQKIEQNNVAVLDGHPLTEQEFRQIQNQLQFGTFYDAAKWLAGENGVAKVQVQREDATLGTVRLEVVRREDVAGGTSSYEVVNQIEMPKVFADYQNRRFDVSLLINGLPLIHIELKNADHSYMDAFRQIKKYLSDGMFNGIYSVVQMFVVSDPYHTRYIAPASGTKMNERFLTNWVDEHNQPVETLTDFTDQVLSIPQAHKMVTQYTVIDSIRKSLILLRPYQIHAIERVREATKHQVSGYVWHTTGSGKTLTAYKVARNLLQIPSIDKTIFIVDRVDLDQQTTSSFMAYAENDTIDIDETEHVRDLIKKLKSTDRTVIVTTIQKLNFVMRRFADKQGTRDYERLTKLKIAFVVDECHRAVTSRKQWEINGFFHHALWYGFTGTPIFEQNARKEEGNLPRTTAEQYGERLHEYTVKEAIHDGAVLGFQVEYINTIRDDQLTELIAKRTGESLADVAKMDPVEMEKNLLSSDYLNKNHMWKVIEGIVNHSQKKLGLYNGRGNSYTALLTTSSISQAQKYYELFKELRAGKAPFTMNKRTSELLPDFPKVAITYSVTENDLDSTLNQDAMRKSIRDYNEMFGTSYSLENINLYNANINDRLARKQARYLSREEQLDLVIVVDRLLTGFDAPCLSTLFIDRKPMQLQNIIQAFSRTNRIFDKNKQYGQIVVYQLPNTFAKAVEDALILYSNGGENEVLAPEWKVAHNRLKKAASSLKKFKIDPSGPPISELPDATLKQFAKAFQGFDKGLAAAQVYSEYDSDEIQDEIAIDSQDIEAYTSAYQNVIDELKRRRQTEGPEEDDLDIEYELETVRQDTINYEYIVNLIQAYVSDSRDDKPAVSQKRVEEISNYVDRLKNNNEKLGTLMESLWRKIQANPKEFQNQNVQTLLQTMKNETIEHLVKDVATTWGADPAEALFYAENFDPKKESNPGEESLKRHMDYEMYKEKTENPVKKISYWREFKDAYSNLIREEILPLNQD

SEQ ID NO: 1396 - protein, 532 aa, Lactobacillus paracasei
MAQMTSQTLYQALWNSADILRSKMDASEYKNYLLGLIFYKYLSDRMVVYASDQLEEKTTDLDKAQQIYTDAYNDKDLHDDLISNVSDEFGYHIQPDLTFTALIDKIDHGTFQLEDLSQSFRDIEQSSEFFSGLFEDVDLYSRKLGATPQKQNQVISDVMKQISTLDLVGQNTNDILGDAYEYLIGQFASDSGKNAGEFYTPQSVSRLITQIAMHGKEDVRGFTIYDPTMGSGSLLLNARRYSNERLSINYFGQELNTSTYNLARMNMILHGVPINNQHLHNADTLDQDWPIEEPTNFDAVVMNPPYSAHWQPSKGTENDPRFVSYGLAPKSKADFAFLLHGYYHLKDTGVMCIVLPHGVLFRGGAEGRIRKALLENGAIDTVIGLPANIFFNTSIPTTVTVLKKSRTTRDVLFIDASKEFEKAKNQNHLTDDNIQKILETYINRKDVDKYAHLASFDEIKENDFNLNIPRYVDTTEPEKPVDVVKVVADIKKNDEEIARLSSELAKDFDDLVANNDEAAKQLAALKELFKNE

SEQ ID NO: 1397 - protein, 402 aa, Lactobacillus paracasei
MSKDAKNVPALRFKGYSDAWEKRKYGDIAKSFQYGLNAPAKKFDGINKYLRITDIDDLTRLFKQESLTSPDTNLSNASTYLLKQGDVLFARTGASTGKTYKYRKGDGKVYFAGFLIRADLKPKFDSEFFYQTTLTDSFLDFVKVTSQRSGQPGINSKEYANKAIQVPELSEQQRIGSVLAIYDNLIAATQDKIDALEQAKKALLQRLFDQSWRFKGYSDPWEKRKVSDYLCESRIPGSNGLKAKKLTVKLWGKGVVPKNETYSGSIKTKYYVRSANQLIYGKLDFLHAAFGIVPQSLDGWESTIDSPAFDVNTSIGNAAFLLALFLRPNFYLREGIRANGSRKAKRIHEDTFLSMSISAPQRKEQDQIAVVLDKTELLIAATQSRLSSLELLKKALLQDLFI

SEQ ID NO: 1398 - protein, 308 aa, Lactobacillus paracasei
MNLRTQKFHMYFKQWIELYKEGAVRPVTYQKYQMSHKHLVTLAPDLHMDELKRRTYQELINEFAANHEKQTTLDFHHHLKAAILDALDEGILEQDPTRKVVIKGTVSRVHKVKFLNQHELTKLLALLDLDHGLDWDYFLLLIAKTGLRFGEALGVTPMDFDMAKLTLTINKTWDYKSATGSFAETKNTASVRKVPLDWQVAMQFATQIKSLPQDKPIFVTDGQRVYNETANDILERKCKRASIPVISIHGLRHTHASLLLYAGVSVGSVARRLGHANMSTTQKTYLHIIQELENQDNDKIMRYLTSLM

SEQ ID NO: 1399 - protein, 398 aa, Lactobacillus paracasei
MFLEFAWNAWEKRKLGEVVERVTRKNRDLVSTRPLTISAQDGLVDQRKFFSKTVASKNISNYFLLKAGDFAYNKSYSVGYPWGAVKRLDKYPSGVLSTLYIVFKPKKINSQFLVTYFEGTTWYVSVSKVASEGARNHGLLNISASDFFDQQLFFPTKKTEQESIGLTIKVLDDLIAATQDKIDAFEQIKKAFLQHLFDQSWRFGEYSELWTSHLLGEITSKVTEKNTENLYHETFTNSAKYGIVEQQSFFDKLISNEANLTNYYVVRENDFVYNPRISNLAPVGPVRRNKLNRTGVMSPLYYVFKATNAAYPMFLEYFFKGESWYRFMYLNGDTGARSDRFAIKDKVFEQMPVKLPEESEQKKIGALLQNLETVMNQTQERLQKIRTIKDSLLKSLFV

SEQ ID NO: 1400 - protein, 711 aa, Lactobacillus paracasei
VSINLNQPAKYYFGVTILKGNAELIVSQVIANNRTINIPVYQRRYSWRREQLERFVADLKTAYANQRERYFFGSLILNATGDTSTVDVIDGQQRLTTVSLFLIAIRDFLGSSDVDYQRVNEMFLIDRFDRDSIAKNRLHPVPGDEEQYVDVLVNGMSAADTIFKSTYAYFWNVLQQGDLTVREWLSLLEQRLQVMNIVVDQYDDAQLIFESLNSTGMNLTESDKIRNFLLMGLKGDQQAAAFQLWQQNERLVGSEELSRFYRQYLTSLARSSKPVKENEIYSDYRRYVGLTKDFDQIAQLKKEQAAAKLFAEITAPVTVAIKDQRVKSLLIRLGHLNNDILVPYLLQVFAKTRDGVLSADQLVEVLRVLLAYLARRLFIGVPTTGLNLLFAALDRQVEHYVDQAKVDYVEGLKLVLTQIVKENKRFPTDQSLKDALVEKDYYHMSSMSLWFILDELNNASGEEQDLFDAAQSGKYSIEHIMPRVVNSSWQKALGTDWRLVHNVWLNRLANLTLTGFNGQMSNRPYIEKRDMADGYRKSGIKLNQWVAQFDKWDEATLQERQADLLTRALTVWPRPNVSTQLATDDPNSWDTLDMILEANPTGTKPVAFSFVDDQVVQIKSWTDLYNQLIDLLWDADPSNFFAMANSDESLVKHVNEVEADQRYRQLGDSDVAVYAGGDSAWSRVQHIKRLLAGSDHDLSEVNVKTRKVNHS

SEQ ID NO: 1401 - protein, 268 aa, Lactobacillus paracasei
MSPIDTINRVINMVSLVILLFYIVKTYRQVRSLDFLDYFVLYLKHRQTIYAEMQRNPQMRQKQLLSLFVSLMILTFWVIGSLEKLMTAWNLGNLINALIVLWLFGYFLYQTWQTKYLNEQNRYLTFANHFQQQHFNDVMAIFQRKLTAWSAEDDEDAQARKRFQRLFDQVSEQARRQRKAAMLSDDMYALFDDHLLLRADSKPLTGSEKKLLSYYVGYWDAGPYNDYSLSMIEEMDDQERRIVTKVLNVTMAMMGLGLVLLAIRQILG

SEQ ID NO: 1402 - protein, 102 aa, Lactobacillus paracasei
VEGVPHVDGVELIDEEKRLLLHLTVTLCHTNGGADTCQPHDSANSAVTHVVLRLRVDVRHEPFNAEDVVILLFELNDVVPDGLILLLMDGHFTMCPLVVGCS

SEQ ID NO: 1403 - protein, 242 aa, Lactobacillus paracasei
MGRKGSRYTLEEKLFYIGLVREGGWAPWAVQREYGVRHNQVRQWLERFEATGVDGLKPRSVHQKYAEEFKLEIVQKYLAGHTSYPVLAREYGIPDNSVIVRWVSLYTSGQPLQTTGRARPMKDGRKTTQIERIEIAQWTIANDYNYGAAMQQFKISYGQVYAWVKKFKQGGESALEDRRGKAKKDNGQLTEIERLKLENKRLQARLVHVSTEAAVLKKLQELERRNAGQTNNIRPFNNLHKK

SEQ ID NO: 1404 - protein, 191 aa, Lactobacillus paracasei
MKINWKVRVLSVKFWLAIVPASLLVIQTVAAVFGYNWDFASLGKELTAVVNAVFALLTIVGVAVDPTTEGVSDSQQALAYPALITTKAAKIKALEDQIKALQGETDNSKQLYPHFAYADSADGKIGFSTTSSIGKSYMGAYFSHDDEDGNDPSKYEWAKLVGPSYGDPVGEEGPKGESTTQAAPSSVAPQQ

SEQ ID NO: 1405 - protein, 116 aa, Lactobacillus paracasei
MPPAKASGYFYGRKYKDVDFKSWIDMFVELGGGALFGWFASQWRMHRKHGKAIDSGLVGLLHHEVYMLCNHHIEVGYISTDDLDDLNYLFRSYKALGGNGTGEALYNKVLQLRIKN

SEQ ID NO: 1406 - protein, 43 aa, Lactobacillus paracasei
MSDFEFCGTLYSWGCPIEQYVGRQITEDQYKQITGSDYAASKS

SEQ ID NO: 1407 - protein, 96 aa, Lactobacillus paracasei
MKIKIWLDEQNRLTNWAYEAEDAKVGSTEDGQQIIEATYVSQFFEDHASLVDGKIVADEGYDPANDHPLPGPSPEQQMIAALYARVTKLEDGGKNE

SEQ ID NO: 1408 - protein, 811 aa, Lactobacillus paracasei
MEYYFADRKSNILGVGSTDGKGEWRIDNDIEKQSVDNRPAVELSLDIHFTTDQEQAVNEMAKATNFILYQDEEGNAHQMVIESVDHDSLGHIHSIVASDAGNDLINETVGAYKADKPYTIADYITRFTNDSGWEIGINEFPDNVRTLEWTSEESSLARIIAVAKDFDAVLSFGFEFVGTNLVKRVINIRHETAGDSLIFFEMNKDINNIVTHLDTYDMETSIKAYGAVPESTNGSTNQDPINLIGYKWTDPTGQFVLDQYGFLHDTIAVQKYSRLLSNSNPNPTQSDWNRVKTFDSKSQAELLQAALADLKKYNHPNETYDIDLVNSPYVPLNQTVHIADENQQLFLSAKVLSIQRSRANHSVQLTLGEFAHETVSFDERLSDLANQMANMAKTLKFYPWTRYADDDKGTNMSALPAGKKYRAIVWSDKTSVPSDNPADYANRWELIQGEDGANGKPGPKGDDGISSYLHTAYANSIDGKTDFSVTDASGRSYFGQYVDETQADSTDPTRYLWALFKGQDGRDGKDGSDNVPVVTVGPSYPAKPKAGDQHWLTDEDGNLAAFAIFDTTSGWDSKPIAAKALNVETFNGMTFNGVTFNGSTFISSFNHIQPDGFPNTISGTTKISGGSMVTNATLDSNSKQTYQSKVDQLGLVSKSMYDGKEVSSVDARQGMLTLKSLYNPSGKDVTLASTFTAADSVFYQHIDSGLETNDVKSLKIGYSRKGPNVTIGIAFEMKTGNGWVKIANIRPGYSPFNNDDAARLLGSMSYTGAACELYVSAGGIYIIPWRSQGGYAGSLSFITRDAYPINDAVVN

SEQ ID NO: 1409 - protein, 705 aa, Lactobacillus paracasei
LYDFRETTPFTGADDNQLPAEAMLIDGQYIENLVPGYRTLQVGGRELLKQSATSNVIGISDGETLEYVRNPSREITVGYQLIADDDDAFRTAFYKLSGILHGDTHQVSFNDDLSVYWNAVLTDVDDVPKGRNAITSSFTLFVPDGIAHSVATKTFDNMPYKDVPVNMLTDSGFESGNVPSVTWGPSAIGTIAASSGGATLPIPFGNYMLKIDSNDTSTVLDQFAMYPLANAVLIKSGETWTYSYYYASAGTAAGQASDYLLSGSNANPIFGLSMGHGNRITTGGQTTWHRFTATFTATADVTVTHLRFGFVKSGTNHGWICIDNIKLEQEPTVSPWSPNLADPEYYSDTITVHNGGTYPVEPVITATMHADNGMVGIVNDRPGILQFGTQEIDGFTTEESEVALDLAAVQGSHMDNQAATNNPYWGGDPSMPNEQIGNAIWTHDDYDGWKVEPNWPSITGDHKYWNGPSIKHNLVQTHNGNYKSNLTWDVMTRFQTGVSKVGALETTLESDSKPIFQMILKDNSALSDQLWWMCYYKDQLVVNEQLDRSIFTNEKFIQLELQKFGNSVVFRVSPWVGNQGRETTITRQFTFADAADTETKQFSTWFMRDKTWGESTMYLIASTVKWQNVSWYTNIKNRFSNGDVLKIDVANAKTYLNGSLDPTMHTIGNQWEQFELPPGDTEIVITPSSWAQPFACEVEIREAWL

SEQ ID NO: 1410 - protein, 1029 aa, Lactobacillus paracasei
MADSFSVEAILSAVDRNFSGTFNNIASSASKVGDSFQNSTKPAGNFVSTVSKIAGAIGLTKVVGAIGDGVRSMVGELDESSKAWQTFESNMTFLGKTPAQISSIEKSLQSYAQETIYSSSDMASAYAQFASVGVKGVGRLVKGMGGLAAATDNPKQAMKTLMEQGTQMAAKPMVQWADFRLMLEQTPAGMAAVAKAMGMSTKELVQNVQAGNVSTQQFFDGIEKAGNSKAFQKMATSYKTVGEAMDGLQETLANKLQPAWQAMSKVAVGAISGIIEKISAINFDSVIASIGNFFSPFSALILNIKTQLSSLGKGDSMSGLSSVLQGVGSVLQTIWSLVGSLANVAFVNLISIAQKVGDAFNSAFGNGQISGIFNVIKQAVTDFGVAAMEAMTTVGNFIANLPWKAIFNGVKGALIGLVAVLKPIAAIVKAAFANDIVKSFAAAILGAVGAFKVMGLAIGGFSSVLGVFSKMIGPIRGVISVITNFGTIVKTAGGVWKAFGLILGMNPWVLLIAGIAAVVAGLVYFFTQTKTGQKLWSGFVSWLQGAWQGLVGVAQAVWNAISGAFTSAISGIQTAWGGITDFFSNLWTGITTTASAAWTAFTTTLSAIWQGAVTAATTVWNVLSTFFTTLWNGIVAVATAVWSTFGGSLTTIWNGIVQIATGVWNMLKAVIMGPILIVIDLLTANWTQLGADLQLIWNSIVSAAGQIWNGLVTYFSGIWSLIQTYAMTVWNTLVSTLEGLWNGAVSAASAIWSALSSFFSGLWSGIVSTTEGVWNSVVSFLSGLWSGTVSTAEGIWNALPGFFSGLWNSITSFFSSAWNNIQSIVIGAATSIFNGAKAVWSGFTGMVSGIVNGIKGAFNALRNFSLADAGRAIMDSFFNGLKAAWGKITDFVGGIASWIRKHKGPIRYDAKLLIPAGNAIMNGLNAGLTDKFSDVQSNVSSMAQAIADSAAVTMPAVNTSPFDASLQSLNNSLQGATLSSNLDVNYTRKQTIEVPLYIDGREVARATANPMQTELNRLTKISNYRKGLV

SEQ ID NO: 1411 - protein, 117 aa, Lactobacillus paracasei
MTLVEYELRMEAYQLKQVDRQNEIAQQAWMNQQVQATTGIKNPKPKFKKFDDFFDKKAAIDNVRSNYEPNYEVSQMSTTELKQNRAQVFAKRMAEFQRLKREGKIIPLSERKEGAHG

SEQ ID NO: 1412 - protein, 110 aa, Lactobacillus paracasei
MQLTINGKEYELNFGVRFVREMDKNMGAVMHGINFGMGVAKALAGLNAYDAAVLSDTIYSATVTSKKRPSANEVDDFIDSNSDLDSLFKQVANEMNSANAVKAVAKNMKA

SEQ ID NO: 1413 - protein, 199 aa, Lactobacillus paracasei
MANELKVLEGMDVVALARKHSDQATVSGQIIPWQTSLSFDPSVDSDSTVTKDGNVATRSSASTDLEVEFLNNTAAIADVMYDSLFDGELLDFWILYRKRKNAEGKYLAWYMQVTVQEDSSDNDPDDHSTRDVTFSVNGTPKRGWTTLDDETQEQVDYVFLGVGKVTDTDKTGGGVQWDSDKDPGTSVSGETTTTTTTSK

SEQ ID NO: 1414 - protein, 134 aa, Lactobacillus paracasei
VIQITSPEQELYDYFYAFSQSSGYKTYDHLPMQQENAPYPFVIVGDIQVVPTATKTSLNGNVLITIDIWGDKKQRFTVSDMAERFFRAAIGQVLTDDYRFYGRVEDHSKEFTQDQSVPDTVLNRATLILNLNIL

SEQ ID NO: 1415 - protein, 121 aa, Lactobacillus paracasei
MSKAGISYNMQIKGMDKLVAGLLKRAKMDVVKQIVKQQTAQLQTRSQQMTGTVYAHPTGATKRGIKLSLEDGGLTGIVGMSMEYNPYTENGTRFMRARPVLKPAFLYQKVQFINQLKQAAK

SEQ ID NO: 1416 - protein, 100 aa, Lactobacillus paracasei
MRLDHEVTFWLDDEEYDPQTHQYGDVKKVATAVASVTDMGTDKSVQLFGNYAQKAKVIRLVEPVTVNWSYLTIDDEATHYALNTDRVPLQNATLIVGETK

SEQ ID NO: 1417 - protein, 124 aa, Lactobacillus paracasei
MANADPVTLADLKTMMEIKTDAQDGALNLIIKNTTQALRFKLGLRTDEAFPSELAYIALEVCVRRYNRRKNEGMTSYEQEGQSFTFKSNDFDDFADDINDWKEANGKNAKSLGTVSFISGYPKR

SEQ ID NO: 1418 - protein, 337 aa, Lactobacillus paracasei
MPEFSGATAKLNLVEPKVFADYVLEQQTATNRLLSSGILTTDPIIQAQLLKGGTYVTIPTLHSLSGEAQTWNDTSDITVGNVDSYSAIAPQMYQAKAFGYTDFGQLSTGAPVAEQIAGQFASFWNIQDNKLLIAVLKNAFLNADLQAVKSYGMDTPAPLAAGDFIAALSRMGDVASPQLTKIVLNSAAVGAMRDQNLIDTIQPSNGGTPISYYNGIEIVEDDALPVAADGTTDAFIIANGAVSYGLANPENSYEVKRDSLGNGGQTAVINRRTLAMQIAGTSFTDVTKVAGLGYSTINASATSMYDLVGDPRNIGIVDYRFTIDKKFVVAGINVPKG

SEQ ID NO: 1419 - protein, 215 aa, Lactobacillus paracasei
MIPKILMPMNLQFFAEDNPQGDPVDPPKPKDGDPVDPPEGKKQEEPADHDPDGKHVYTDEQVNEIVKKRLARAEKEKQAAVDEAAKLAKMNADQKKDYELQKAQKERDELKSQLASYQMGKQARSMFEDAKLSVTEDDLKHVVTPEAESTEANVKWLIAHDQTVAERIRQELLKGSTPLDPSSNRKTKSLKDMDLLERSKLEREDPEMYKKLLTK

SEQ ID NO: 1420 - protein, 330 aa, Lactobacillus paracasei
MTTTTQQQIASNSAYWNKRTAAERKWIVENLKNDEAFNARIQEYFDKALTNIQKDIDSELAKYAAYSNDSMAGARQAVMATDIKAYQAEAKSIVDDARKMYNGGPLKYSDFSKDVNDRLKLYNATMRINRLEMLKSEIGQEMLDAHMKVNADLISKLSDDYQSEIKRQAGILGETVSKGGYTDLAKLLSKREGDYTFSQRIWINQDILKAELDELLTAATIQGQSPLKIARKLRGQVAETVNNHRYVTERIARTESARIQTQAQLDSFNKFGYDYCKWVAEPSACDICKEISEGGRAGRGIYRVDDVPDIPAHPNCRCSIAPYAPDDETE

SEQ ID NO: 1421 - protein, 490 aa, Lactobacillus paracasei
MQLIRSRTQANTSKEVAIILTVQGKGSITDGDVFIFPVDTAITGDDITNFISANDELARRKYLPAKKMYLGKHKILHEDAKDHGPDNRLVGNLAHYIVDTYNGFYIGIPPKITLDNTQDNAVLQGWNDTNSVQDKLSEISKQASIYGRALAFLYQDEDSKTCIAYSSPINSFLIYDDTVAHKAVAFVMYWHDDNNNLTGKVYMKDGIYGLDMVRFKGTDGFNPFNEVPAVEFFMNTERQGIFENVETLIDALDKVLSQKANQNEYFDNAYLVLKGLKLDEDDDGNPKLDLNGNQIIYAPDADSAQGVAEFLTKPDGDAIQEHLIDRLISMIYQISMVANLNDEAFSGNSSGVALQYKLLPMRNLAANQDRKFTQSLRELYKIAFSVGTILPESKSDDWQKLNFAFTRNLPENITDEADAASKLKGLVSDQTMLSTLSFVDDPKAEMKRIADETAQKAKDAAANSPSSPDFQKLLNGGGNDDNNDSTTDSE

SEQ ID NO: 1422 - protein, 417 aa, Lactobacillus paracasei
MTTPIDQFKGKQLDIINWWRRYPDKQTIIADGAVRSGKTFAMSISYVLWGMIMFDREQFGIAGKTIGSLRRNVIRPLKQTLQQVGFSVVDRRSENMLEISIDGRTNLYYLFGGKDESSQDLIQGITLAGMFFDEAALMPQSFVNQATARVSVTGGKYWFNMNPEGPYHWFKTDWIDQADDKRALRLHFVMKDNPSLSDEVIDRYEHMYSGVFYQRYILGQWVLADGIVYDNFNKDEMVSNPSQQPSRYYVSVDYGTQNPTVFLLWGKCGSVWYCLKEYYYDGRHSSRQKTDDEYARDFSQFVGDIRCEVIVDPSAASFITKLRERRYRVIKANNDVLNGIRETQTAMNSGEIMFTPGLTNLFKEFASYVWDDKASQKGEDKVVKAHDHAMDAMRYFVMQVIKRRNAAHTFKNTSKYF

SEQ ID NO: 1423 - protein, 229 aa, Lactobacillus paracasei
MAKGKYQEWQTPEKLALIEGWARDGLTDEQIAHNIGIKRPTLYDWKKKYSDISDALKRGKEVVDQMVAGSLVKRALGMTITNTTYKMVPIRDDVLEAKRARWRNEHQIDHPEFTRKELVQASIENVPTYEKIPIMVNENELAPDTSAQIFWLKNRKPELFRDQAFKQLNEAQAEKVAEEVRKSKAEADIMEAKASAYRTPEGQDGGLNKLLAAIDESIPKGGDVNDNSD

SEQ ID NO: 1424 - protein, 44 aa, Lactobacillus paracasei
VAFYLPSPKDVYKNLKDKLKKQRDKTKADKKKQPSKDNPGVTTA

SEQ ID NO: 1425 - protein, 76 aa, Lactobacillus paracasei
MAQMITTKYGVYMPKVEAWTIGKIDREIVRSRSNQVKTRGGYAHPESKVCLSKRGWILWHSTCRHQKTSIRTSRTS

SEQ ID NO: 1426 - protein, 382 aa, Lactobacillus paracasei
MQWTDEQISGIRKLASEGFTRREAADKLGISYDALQGKARRLGIEFQKPLKNEYDSDGTQSSETILKVIRGHKMTPREVLEAHGYDYAKWELVRATSNFWKQTPEATLYQSKIQIRPLVEAEQYESLMNDIITHKEPYQAKAPIFVESDRYLVIPAFDTHFNGHTFDIYAESLKRQLGIIQRGHYAKILLILGGDLAHVDNINSTTAKGTQLETTDLGETVNEMEQYFETLIEAIIKNANECEVMYCAGNHDPSVGYMFARLLKRAYSNQTNITWDISLKHYKGAMLGHNFIGATHGDKGKNNYLAKYLDEFGFMLGTAQNRELFTGHLHSEMSKDLGGFVQRQVSTRKPTDKWTDDIGVVAHKTFELVEYSDHDTRAIYYV

SEQ ID NO: 1427 - protein, 84 aa, Lactobacillus paracasei
MKLYLVVCETGDADQWEGGTAEVDVVFATTDKAKLDDYMSTRIHGYDNVVTMELDNKYPEGTKSSKCLASWWEEGPCYDDPTDI

SEQ ID NO: 1428 - protein, 83 aa, Lactobacillus paracasei
VTHYILTMADGETIEIKERPEYFDFNVVPKIENGQGYIVDHNQLGKKYFLRNVVSLLALNESVYQQQVESQKLPKMRQIGFTK

SEQ ID NO: 1429 - protein, 150 aa, Lactobacillus paracasei
VVRATRYFSPIDHDKTIENAKEVLGNYWHHKRLAQRTKIALRSPVMDDMPKSPSYGNKAEEKLVSHADELYYLNACENAINVIEDEDYRTILWETYIISPSKRLTNDAIVAKLKMERSAFYIARNRALYAFAELCPLVTLVKKQSGHFAD

SEQ ID NO: 1430 - protein, 122 aa, Lactobacillus paracasei
MTNETKQDVFEDALRALEEFGEQGSSWEMAYDDLSARYAAASDGDTDCLYCHEPHKLIESELGNFLRIGMTGGNEWDRIEPKKINGAAMHTCEAVGFDNAEVDDPIVINYCPMCGRRLEGKQ

SEQ ID NO: 1431 - protein, 69 aa, Lactobacillus paracasei
MSKYFEEISQLDRIDKKMKFKIVGPNGETEIKEFRSQYEADLYCERLNHERLERLGLIEYLNTPAIEFE

SEQ ID NO: 1432 - protein, 74 aa, Lactobacillus paracasei
MKIKHAIAYIILASLAGVSIYGLTGALWYALIKPAIEFGIVKSLTILFFLIGLLTVIWIIFWALEKLIDWLLEE

SEQ ID NO: 1433 - protein, 81 aa, Lactobacillus paracasei
MSFPKTRYFKATGNLKAEGRIYLKDKIYPAYLMEDTPGYGKAARFYDLSAENGQFNFGNNLLDELPYEWNVVEVNENGDEI

SEQ ID NO: 1434 - protein, 131 aa, Lactobacillus paracasei
MSNETKWEVFDDLLDSYDDAIAVPGALHPTGELLDYDSRYAAALPDDMPVIPKAQSDWIKQCKANDDSLSFALGDETTSIEVAKTFRVWGGYTDKNKDRWLKLQDTFARAWVLGVWRVEETGEIVKLEAEK

SEQ ID NO: 1435 - protein, 67 aa, Lactobacillus paracasei
MAFVELESGNWINTDFIESIFKANPITTVWEARLNHGEATDITDADRVRILKTAGFVRIKKEKDNEQ

SEQ ID NO: 1436 - protein, 187 aa, Lactobacillus paracasei
MSEEKLYAVKNDDGKYFDCEYAKFLPLSESYCPVMVSEDNAKAIVHDYGGHVVVLTEEPKKVVLSKTDALRQGWLVARYGRYNPDAVSNILAKYKDEAWGMIDAYVNGYTVAREKKYLVFKELGGKQKNQQVAQAYRSFTFPNTITWSIEERKNMSTLSSGRLTESEIEQYGLQDCEKEEVTDDGIR

SEQ ID NO: 1437 - protein, 36 aa, Lactobacillus paracasei
MEPEVDDVYISQVTGEPVYVDIKGTLYKHTKVEDEK

SEQ ID NO: 1438 - protein, 121 aa, Lactobacillus paracasei
VNRIIIPLPLMTLNQYIKVERGNMFGGAKVKKQATETVMLAVRKAMNQGVKFQWGKPLSFDWYWYDKRTDPDNIAFQHKFIFDGMQKAEFLENDNWDHIVELRDRFFIDKANPRVEVEEID

SEQ ID NO: 1439 - protein, 84 aa, Lactobacillus paracasei
MQAIKSTVNVGDLVVVPDRVFMGVRDLGGVARIIRIERYNARGTRQDINKPVIFDGNASKELITTVEMVDGKQRQYYLKDVKPA

SEQ ID NO: 1440 - protein, 109 aa, Lactobacillus paracasei
VTAEEMTNRALQHLDKHLLAYEASLNQTIADIESDYDQGYLDVTEAQWQDIIVLLGAVIHADTRMICEASESICADGGVSGSLLRLLWLAKHFATLDFSMKPSIKQEAF

SEQ ID NO: 1441 - protein, 260 aa, Lactobacillus paracasei
MESTKGLFTHADVQKIIEKRGMDVSKLPTQAEIERRFYERSMAALNRKKARAIYRYSVFPGNVPAKFTFEKWRPEMQTDQQNSRNLGNRAYKLTKQMAEVPKNVVLFGPRGTGKTSLALAMLTSLRDEGQLGLFISTAELSNLMGLQYDAPDVRKRLAGIERAMKEAGVLLLDDFGTEGGMKLDIKPVRRDMQELMYRVANARLDFESNSPRLSTIITTNNEMSELEHMYNSKLISRIIPKSKDCTLNFEKLTDVRGKRS

SEQ ID NO: 1442 - protein, 283 aa, Lactobacillus paracasei
MDLFKLIREFYIQQSVNPLSTGQIALWHGLVYQCNQLGWPSEFNMPNRTLETLTGLSRQGIVKARNALKQSGLIDFQTNGVKATTYSVIDISRKLSTSDSRQPGSQADDSVSNSRQHSRQPSRQHSLQGSLQPSRQHSSTYTKQDETKLDKTKRQQTTAPVKAAERPTEEPSSSSSSILDICNFWEGNGFGQLSPFTRESLVDWVDDMRKAGSPEPEKLVLKALRTAVESNVRNYKYVNGILKNWESKRLLTAAAVEANDSERQSNRTPHTEPKKENWGYGVD

SEQ ID NO: 1443 - protein, 274 aa, Lactobacillus paracasei
MQENNQKSLTVNKDNYYSLDTSFKYQSATWFKKFLTCEAEAMAELQGKWTPRGDPTALLVGNYLHSYFESKQAHESFIKGHPEMFSTRGSSKGQLKAPYKQADAMIATLEADENVQRLYQGEKEEILTGDLFGVEWMGKLDCFDSTKSFFLDLKTTQSLHKKYWKPGERQPTSFVDAYNYQLQMAVYQELIYQNYGTRPRAFIIAVTKEDVPDHAVIEVPQYRMDEALEEIQDSTEHVEAVKSGQVRPHRCEACDYCKATKRVATIISMDELVE

SEQ ID NO: 1444 - protein, 287 aa, Lactobacillus paracasei
MTTQYDLTKMPVKQLIETQAIRNKFAALLDKRAPQFLSSIASAVSLNPSLARVDQLSVINSAMVAATLDLPVNPNLGFVYIVPYKNQAQPQIGYKGYIQLAQRSGRYQRLTALPIYEDEFKSWNPLTEELEYTPNFHDREASEKPVGYAASFKLTNGFEKMVYWTYQQVDDHRKRFSKSGGGAEPKGVWKDNYEAMALKTVIKSLLTKWGPMTTDMQSAVSADEKPVEADPELRDVTPEDPNSIEDALNAPAEPVTKSEVKPDALKPDITHDPNAGKQPEIFDGQQG

SEQ ID NO: 1445 - protein, 135 aa, Lactobacillus paracasei
MLDYNTAVLNEYQRREALEDKAIADWESYHGAVLPKDMDIEQAEEFLATADEYEVDTKKPWFYQSCATSRYEGAFNKDKAKEYLQDWINIHGPERFLKDAASSTYPKAELVEIFFSDDSLDIIDFMKNQGFQEWK

SEQ ID NO: 1446 - protein, 39 aa, Lactobacillus paracasei
MDTIKRAQKNPVAPTTGNQKLSRYYYDLILSRKAVDDHA

SEQ ID NO: 1447 - protein, 42 aa, Lactobacillus paracasei
MLEAIMSVLFDPSSAFWKYLLVALAGIMIGATAVGGWKQWTR

SEQ ID NO: 1448 - protein, 73 aa, Lactobacillus paracasei
MEQGFTLIDPTKPQRTRKPFKPKIYWTPKDVMAHYQVSAATVSRWKKRGAPFVGPGKTQRVEPEKMERWFARQ

SEQ ID NO: 1449 - protein, 182 aa, Lactobacillus paracasei
MKATISSPLNRFATRTNTPQKVIAYAAKLGRSTINNYFHGTPIRANEATDIANSMNDSELSYEMANLFLGIPKLFSGDGIYHDLRGLLFTDKREEDEEKASFIKHDIEGLANDPNFTRDDAKNLKAYAFEKLDSTVADLTELNAICEMLGISIMDLFSERLPHYQKLHYMRKDEQAWNKDSH

SEQ ID NO: 1450 - protein, 48 aa, Lactobacillus paracasei
MEREAMIDFLTRIYPEVPAFAFEQMPEEQLKGHVNEWLAEDADQLAMG

SEQ ID NO: 1451 - protein, 38 aa, Lactobacillus paracasei
MQVSNGVVFILAILYGLYKLRTIHVLSGEVVMKLLITP

SEQ ID NO: 1452 - protein, 103 aa, Lactobacillus paracasei
MNEELKQHALRIAEILQEQGNPYQRIEIDADGIKKISTDWSEPAETSKNPSKLIIKGHPYAMINVTRNNELIASISASDCITAKGFFVHFVDNEKDARFTSDD

SEQ ID NO: 1453 - protein, 80 aa, Lactobacillus paracasei
LNEKLKERRKEFHLTMQDISNMIGISKGYYSLIERGERRVSYELAFKIATALKTKPDLIFLEYQSTLSKHNSAQREEAVK

SEQ ID NO: 1454 - protein, 111 aa, Lactobacillus paracasei
MSFGERLKELRNEKKMTQSDVGKIINVSKASVSLYEKNERTPDQDSIKKLASYFNVSTDFLLGVTDVRSKPEQIDISDSKNDTIMTFEGRPIPPEDLEIIKRLLRGGKHDD

SEQ ID NO: 1455 - protein, 139 aa, Lactobacillus paracasei
MMTEFTSEMLREVLNYGFDRGVGAELTYKLKPYTPSVSNPETRWIAVNMNWHEPKQLPYQAAHEIMHVLHQDPACLYFYSASKNSIEGEANIGGIHILVPLYFAGIDKEDANLNQFMKAFDIPASMEDAASEAIKGFYI

SEQ ID NO: 1456 - protein, 201 aa, Lactobacillus paracasei
MAKKVMGADGKQYKVKKPFYKRVWFWVLVIIVVAAIGGGLNNKGKSSSESTEKTAVSKTDKSSSTTASSSEPEDKVYKVGEVASYKGYEIKVNNVKFDQGDDINTPDSGKQYVIANITITNNTDKSQDYNPFFFKLNADGNKTDFSEITTNVEDTLHSGSLDKGATVTGNLVGQAKTDAKSLQLQYQPSFWNDKSIKIDLK

SEQ ID NO: 1457 - protein, 76 aa, Lactobacillus paracasei
LAGFCLITLGLSWHRDHMYHVKLIAKLTENMKGLDENSERVKSERDYVQTLLAAYIARDDVRFEELAKEKNKHGNW

SEQ ID NO: 1458 - protein, 122 aa, Lactobacillus paracasei
MAIGSSFRIVKIIDPTAFVINAGHMNHIYKGDKFQIMGNQGVPVVDPDSGKTLGTLDEVKAVIVAETVYDNMSICRSERTQPGYSVLSAITRHQELDVDKSQITGGTPQSSPIKVNDRVVGI

SEQ ID NO: 1459 - protein, 76 aa, Lactobacillus paracasei
MFRPKAKMQSPEKNVQALVSSLSYWQAINLRVNLLNSRFPDESTEEHYRRAVAEYSDFSQLEYELSAAINTHSFVH

SEQ ID NO: 1460 - protein, 141 aa, Lactobacillus paracasei
MANSTIRQADILLRECTVMQVATLDTDTGFPNIVSLTPLKSHRSLKEILFYTDRDTTTIHNVLEKPVVAVYCFNELHHSSLLLRAKTAVLTAEEVLPNFAENLNTFQKSLQYDRPVIIRCTPLTVKIRYNNDIEFSKLNEI

SEQ ID NO: 1461 - protein, 67 aa, Lactobacillus paracasei
MNGPDTLSEAHFIGLIIVLIGVYFALFGHRHHWVRWLIDPDKPGSNLWWAAVFIIIGVLMMMVRKMQ

SEQ ID NO: 1462 - protein, 333 aa, Lactobacillus paracasei
MEDHNLHDEAEAEKELREYIYVDTDLMNSLLAQFDEGLSTLTTRMNEKTSILTQVATKGGRKSAKISGGVPGIANGSGSAEDSHSMADESSTHNRHQYSENIVYGDYGVEILEGYLKKQFVPVENAEPGDLVLYKDSFSLYDFDSLEAGTNPEIIDPVLRLSTDNVSEEKLDGLKKQLRVLQARTRNASNAKMQIDDMKKKIQKAEQKITEDKSSQENFRSVYAMVNFFSKSMPNSVIVSTEQTVVFAQKSLFRLSPSQLQMLQKNPRTLYIMGIVENKSDNTNWKHQTLTNSQLAPRDIGAIASYLSSIALTNFGISQKEDSLRIRPISMYF

SEQ ID NO: 1463 - protein, 67 aa, Lactobacillus paracasei
MKAFKIQDAVKLYSSLKKTYEREDSKIQKMQEEIDREMKKASLTTKPSAEHQGPKRHLKIHRDRPNS

SEQ ID NO: 1464 - protein, 394 aa, Lactobacillus paracasei
MASITSYKLKDGKKAWEFYIFAGVDPQTGKEIKIHRRGFPTEKIAQQEATLAEAEIIRGHSHYQTERILMADYLNQWITKLKVNVKEGSMIIYRYNLKKYIIPKIGDIRLAKYTLKEHQEFISSLFNDGLSLNTVKLINGTLHNALKKAVAIGYITKNPTVGVEFSAYAKDNSKKLHFWTKDQVGSFIEAAEEDKDPMWLSFFVTLIDCGLRVGEAMALRWSDIDFSKNTLSVNATRIYRAETGSNAGKIALDRPKTLSSKRTEYMTARVNDLLQQQYERHFSHGNVQGFRFSTSHNNDFVFTYSSDAKFGQPLRSRATTGAFNRITNRAGLPHIRIHDLRHTHAVLMREAGLSLDDIKDDLGHKDISTTQIYAEISPAKKKENHQQFEKYLNQ

SEQ ID NO: 1465 - protein, 446 aa, Lactobacillus paracasei
MSYIKFDSSKLDKFVHANELEQMQPLVTAADKELREGTGAGKDFRGFIDLPVNYDKDEFARIKAAAKKVQGNSQVFVAIGIGGSYLGARMAVDFLSQTFRNLDPDLKFPEVYFAGNSISGTYLADLLDIIGDRDFSINVISKSGTTTEPSIAFRVLKAKLIEKYGKDGAKERIYATTDRAKGALKQEADAEGYEEFVVPDDVGGRFSVMSAVGLLPIAVAGGDIDEMMRGLGDGRKAYASADLKENEAYQYAALRNILYRKGYTTELLENYEPTLQYLGEWWKQLMGESEGKDQKGIYPSSANFSTDLHSLGQYIQEGLRNLMETVVWVEEPNRDLTIPEDANNLDGLGYLAGKKMSFVNRKAYEGVVLAHTDGGVPVMTVSIPKQDAYTLGYLIYFFEAAVSISGYLNGINPFNQPGVEAYKKNMFALLGRPGYEDMTKELNARL

SEQ ID NO: 1466 - protein, 285 aa, Lactobacillus paracasei
MGFLLALIPAIAWGSIGLVSGKLGGNAYQQTLGMTFGALVFGIGTLIVMRPVLDTKIWLLGIVSGLFWALGQGQQFQSMKYMGVSMTMPISTGMQLVATTLAGALLFHEWRNGRDVTLGILALVLLIVGATLTSRREQTDDFTTQSGVAKGLRTLLISTVGYAGYTIIVNAGHLGALAVVMPQSIGMIIGALLMGIGHQPFAKATAKNILTGLLWGTGNVFMLLSMANVGLAVSYSLSQMGIVISTFGSIYLLGEHKTRKEMIWVSCGSALVILGGVVLGIMKAK

SEQ ID NO: 1467 - protein, 201 aa, Lactobacillus paracasei
MLFLGPFYNWINTTSLSRVNHFPLVRLIVFSLDKTILYLLIFAALRCLWLLVTKRRTTFGRELKLGIFVGYLMLLFALTVFRDVYYPWQLHFHWNRPLSVINIRPLVETLKLQHAASHFDLWYQSLGNIAWFMPLGFGIPWVSKRRRRLAGTVIFGLLTSLSIETLQFLLISGVADIDDVIFNVIGAIFGYSLYRLFHHRK

SEQ ID NO: 1468 - protein, 751 aa, Lactobacillus paracasei
LKRLRLNRLAQWIRSTRIGFLACLLFLVWAKTIFGYFVDFSLGLNDPLQYTLLLLNPLGTGIIFLSLGLYPKHARRGYLIGVIVYILSTLLLLANVLYYREFSDFLTINTVLGVSKVSQGLGASSLSMVKPHDIIYVIDIVLVALAYFSYSIWNIWRYIHNEPLRWPHFGLTLDTRQLPFHFPQAVTVFGIALFGLIMAVSEMNRPQLLTRTFDRNYIVKYLGLAPFTVYDAAKTAQNNQVRAQADSSNLDPVLQYTRSHYAAPNASYFGTAKGKNVIIIHLESFQQFLIGQKIDGQEVTPFLNSLIKEKDTLSFSNFFHQVGLGKTSDAENMLETSTFGIANGSLFSSLGTENTFEGAPAILNQRAGYTSAVFHGGSASFWNRDNVYKSLGYNDYFSGNFYNHDEKAATEYGIKDKLMMAETPKYLEHLQQPFYAKIITTSNHNPFYITQADSDFPDAGTDDATINGYFRTAHYLDEALKEFFNYLKASGLEKNSLVMLYGDHFGISNDRNTTLAPLLGKDPSTWNAFDDAQLQRVPLIFHMPGLKGGVNSTYGGEIDVLPTLLHLLGIDSSRYVQFGTDLLSSQHDSVVAFRNHNFVTSKYTVLGSKVYDNTTGKLLTLTPALEATIAKDQKSVDTRLSLSDDVANRNLLRFYVPLGFKPVNPNQYDYNQSLSNVLSIERNLGSKSTSLYSENNDQSTTGLYQTDAPELADDTDPITTFPDKVQDQTEASSSSESSSSSDVNVTTQPSK

SEQ ID NO: 1469 - protein, 248 aa, Lactobacillus paracasei
MHFFERTFSGFRYHRRYYIVMMLLSVAFCLISIMLMTSEMIDQSAQAAFLQRLNSFGTQNRQTILLSTQVGQAHIQMVQAAQSMLTKVVFADGLLWLAGTAWLWRRRRSETDALYLVGKSSMSIGLQYAFEAIFSFLISFIVSIFLVVLLNDQLIYFLTTTNRSVFAHLLQQKYDSIEMNHAFEQLFARHLTGFTRETLFYYGSKTDDMTQPTGFLSALGNGLAVIFITNIGLVTPLSMLRKRRALPR

SEQ ID NO: 1470 - protein, 189 aa, Lactobacillus paracasei
MLFRSKLLDIYRENFAKLFTPTTIQYLYASNENDLIALHDQYVRDFINGGVIKQVGFINSRHTGILDYLSVRNNLCINGRCKDSDFLPEWLSTNSPILDQPAATLNTMQRIYLQFYRGLMGKKRYLLLTSSPAIFDPYVTRDFLTEANHSLQQTNSCLLVLTTDQSLLNANPNHAWQEPPVLTLSALTK

SEQ ID NO: 1471 - protein, 431 aa, Lactobacillus paracasei
VIPRYSRPEMAAIWSEKNRYAAWLEVEILAAEAWSKLGEIPAADVQALRAHAKFDVDRIHEIEAVTHHDVVAFTRDVSESLGAEKKWVHFGLTSTDVVDTAQGYLLKQANEILRADLAALKASLAKLAKAHKDTVMMGRTHGVHAEPTTFGLVVATWYSELKRDIRRFEDAASDVEAGKISGAVGTFANTPPAVEAYVTEQLGIRAQEISTQILPRDLHAHYIQTLGLIATSVERFALQIRHMQRTEVHEVEEHFNKGQKGSSAMPHKRNPIGSENVSGLARVIRGYETPALEDVLLWHERDISHSSAERIMLPDATGLLDYILHRFTSILDNLDVFPDRMKANMNLTHGLIYSQRVMLKLIEAGLSREQAYDLVQPKTAVAWDEHRSFRPLLEADPKITDRLSQADLDDAFDYHYHLKHVDEIFKRVGLA

SEQ ID NO: 1472 - protein, 369 aa, Lactobacillus paracasei
VTQFISPGATIGIIGGGVTAFQMANTANSMGMRTVVLAPTQTDIAFEKADIPLVGDATDRTALKELTQLSTVMTFTDENVDGSLLAELATANQLPSGVDILTVTQDRYLEKVFLDDLNMNILPYTQVITPNDIKEAVDTIGYPALLKPIQKGMGVDQQLLLSTADDVARAQQLLQQRPYILEAYLQDIKEVAVIVAKAGTEVRIGPVIQNYFDRHQLKASSVRADVDPAVIVEIRRIAAKISEKLAYTGIFSLEFFLASNGTLYVKRVYPGPKLYGHLMLNTSDISEYELHLRAILGWPLPELQLAEDGVGIPLRSEDMDAVLTQIQIKPDWRFTFYPTGGELTGEIQIVGDLKAIKASVNATGHFVIQ

SEQ ID NO: 1473 - protein, 442 aa, Lactobacillus paracasei
MKNKAISNPKAAALGLQHLLAMYSGSVLVPILIGASLHFTSEQMTYLVSIDIFMCGIATALQVFGNKYFGIKLPVVLGCAVQAVAPLIMIGQKFNFQTMYGAIIVAGLFVFLIGGAFSKLRFLFPPLVTGSLITVIGLSLIPVAFQNLGGGSTTAKDFGNMTNLMVGAFTVLLILAINVWGKGFLHSIAILVGLIAGTVLGGFLGLVSFQPVIEASWFHVPTPFYFGVPQFEWSSIVTMILISMTSMVESTGVFFALGDIVGHKIEADDLKRGYRAEGLAVMLGGLFNTFPYTTFSQNVGLVQLSGIKTRKPVIFSAIFLVILGLLPKIGALATIIPAPVLGGAMLVMFGMVAVQGIRMLQQVDFDNDKNLLVAAISIGLGLGVTVQPHIVQFLPKTIQLLFGSGILMTSLSAVLLNWLFNSPRRTQEMSVDEGLNERDSDK

SEQ ID NO: 1474 - protein, 192 aa, Lactobacillus paracasei
VKLLEDRIKKDGQVIGTDVLKVDNFLNHQVDPDLMADLGHEFYRRFSNEPITKILTVESSGIAPAIATAMEFHKPLVFARKHKSLTLKDHLYTATVYSFTKKTSNEIAISRKFLSADDNVLIIDDFLANGQAVEGLMDIIAQAGATLSGVGIVIEKTFQKGRKLLDEKHVRVESLARINAFENGQVIFAPED

SEQ ID NO: 1475 - protein, 211 aa, Lactobacillus paracasei
LAKRRRHFTLKIIPLAAWLVIGFFAIGVTLVVGSYWAQQQTEVTQKQEVADEKAAVRAKKVAFIKRLVPTAQAMQKQYGVLTSITLAQAILESNWGTSALAKDYHNLFGIKGTDPATTKVLRTQEYVNDKWITVDGRFRVYDNDSESIRDHALLFVNGTDWNPQQYATVRAAKDYKTAAAALKTDGYATDPDYPQKLIHLIETWNLTQYDS

SEQ ID NO: 1476 - protein, 160 aa, Lactobacillus paracasei
MLRFVKVAPEARLHYLDLLLIGDEDPNMLRRYLDAGTLFAAIDETVPVGVAMVVPVDATTIELKNLAVLPARRRQGIGASLLRHVGLVYAPDYQDMLVGTGDVDFENLRFYMRQGFRFDAIRKHFFDQYAHPLYAEGMQLQDMVVLRRRLLLTSSDKTKE

SEQ ID NO: 1477 - protein, 66 aa, Lactobacillus paracasei
MEHGTVKWFNAEKGYGFITREDGSDVFVHFSAIQGDGYKTLEEGQAVTFEVEDSDRGPQAVNVNKD

SEQ ID NO: 1478 - protein, 70 aa, Lactobacillus paracasei
MDVKVIKLDTSLALSLPSGSSFKQGDAFLLVPDKSGSYSLVPKINNPYAEAKSLSLYQPEEWADIEHNFR

SEQ ID NO: 1479 - protein, 321 aa, Lactobacillus paracasei
MHIGMRTVKTAVGTAAAMLIAYELHLEYWTAAGIITILSVQNTTKASFRLVAYRLLATVLGFVIAIGAFLVLGYNALAFGLFLLIFIPLTNVFAVQSGIVMTAVLVTHFMMAKSCSWFWIKNELLLLAVGAGVALIANLFMPSLEAKITEFQAQVEAEMREILDHMSQQLGPDHIKSADNWANLSDLKMTLDAAVAWANRHSDNQLLADNDYFQAYFEMRDNQYELLRQMQDSLDRIETPVEQAAVISDALAMTASVLTEDNPATQLVTMVKKIQRDFAKSALPTDRASFESRARLFYFLEDFSRLLQLKRNFNNIISSQN

SEQ ID NO: 1480 - protein, 212 aa, Lactobacillus paracasei
MKKLLILLASLAVLIVGCSATLNPKSQLKTTTATVQTQVQQEQDALKTIGSTVNAFPSAFEKAYQENPQTDLKKENGPVKKLLDRRAAAFKSLEAANSALVGANNTLTKLNNQPSEDTPQTQLNNVLTSLKLAKLDHKTLVSYYREMLTAEDTFFSATADSDTSQDDLESQISQLNQYYSSLNQQIDVMTANLTTVTSQTTKLAKAIKSMRD

SEQ ID NO: 1481 - protein, 309 aa, Lactobacillus paracasei
MPQSVAIIIPCHNESENVPLIYRELVKTFRDDLTALQAQIWFVNDGSSDDTLQQIKQLQAKDGQVHFIDLSRSFGKEAAMYAGLSTAKADYYAVMDADLQDPPAMLPDMYAALQDGYDMAGAQRTDRSGEARMRSFFSDLFYKFINKVSQTQIVPGARDFRLMTRQVVEAVIQMTERNRFSKGLFSWVGFKTKYLPYRNIERQHGETSWSFMGLLRYALDGIIDFSEAPLTFVSILGIVSFVGSFLALIFIVVRAAIYGDPTAGWPSMVSIFLMIGGLQLFALGIVGRYIGRIYLETKRRPIFIAREIK

SEQ ID NO: 1482 - protein, 579 aa, Lactobacillus paracasei
MHAQTSSAKLKTFMTQNAVWLLPILAMVLVLLVQWPQLHLPYIFHQDDTMPQLRRLESYVTSVRHGQYFPKVFPEAVRNFGYAFDAYYPSLMLLPYVWLRLMGMGVVGAYDGYQALILIVTVLAAYASFLKIRRKPLAAFVFSMVYTTAVYRALDAFVRGALGENLAFIFLPIIAAGMYELYVKRTDNWFLLAFGVTGLMYAHMLSLVMVLEFLVGGFLVLVGMRRVTWRMVKYTILAAISTLLMGLGGYLPMIEMSSHIALKLSESATIWPNFILYSLGDLFENSLSMYASTSNMQNVGQAFRPGMGIFMLMTAIVLVIRWRKLNQAVKVVAGLGLLTIFLSTNLFPWSLFSKTIFGVIQFPWRYLELTTLFLSLAIGLIVADRPASSHVAWGLVLATCIVGFSYAVNINATMLNANIYRITDENATAYYEDATGGGSEYAPEDFDSTTFFKKTTYSVTASHQLTRLTMPTQTYNDMRFTYTSSKPVTLKLPKFGYVGYHVTISGKTVDYWPSGKNAQITIAAPAGTHRVRVVYTGTALQHVTGWLSLVAALGFGGWWLLRETRRQRATDERITTGSE

SEQ ID NO: 1483 - protein, 887 aa, Lactobacillus paracasei
MSRFKKHRTWPLLLISFSVTFTISLIVFAALKMAPFGSSSILANDSAVQYVDFFTYLKHALMGTAGKAYSFSNSLGGGMYANWTYYLLSPFNLIFVLVSRQAIPVAMLFVTALKYSTAALAAQVLASHRYGKNWYTLVFSVSYGLSGFLIANFLNIMWMDGVILLPLVILGIDRLFEEHRLIPYVVPLSLSFITNYYIGFMVAIFSALYFCWQWAIHHQPQLLRKIALFVGGSLLSGMIGAIVLIPTYLALSASRLSSAGADFTIKPLFSLIDLPSKLIPGSFNFAQLSNGLPNLYMGMIALLGAVFYFLAPAISVRERLISGVMTVILMLSIWLNPLVIMWQGFRAPVWYLYRHSFIVIFWLLLLGLRGLANLPSVSRLRMIIASVVVGGVVFIPTAWRMGSHKYVTLTNLVLGGVLLLVAAILLYSWAHHLFPQKWVVGGLLTLLVLDMGANAYTSLKAISFISKADFTVTSKALNAAYTEAKTLAPNTFYRVNSDTQRSMDDPYQYNFNGISTFSSVLNTSTINALTNVGAIGSAGRVKNNDLTWPLESLLGVRQLLLVNTQSTKTTTPEYQQISSRIIDNPRYDLPAYKLIGHNDYFNIYQNPDALPVATQIYRKVPTQVQANPVLQQNAYFSTFTPETIGAIFTTTDFSGITVDNVKPLTTLTNAIATKKDKKLGATITLNVNPSTEQRYLVMGENMRKNMAISINNVPLKNDPDNGSKTVSLPIDAEKPTTVTLTFNRNIDQIDLDHFALYTLNRQPFEQAVAAAKQHAPKQVVKNGSVTLTTRQNNSGYIMLTIPYEKGWQVDNKQVKIQNYRGFIGLKVPSASLKFTLSYHTPGIKAGWTVTSLGLIGLIALAFLEYWPRNGKHAILVNWPARFRTMWQ

SEQ ID NO: 1484 - protein, 276 aa, Lactobacillus paracasei
MFRIKKVLNVNVVLAEQDGHEYIAFGKGIGYRQKVNACLPDNAIFKKFMPLDDSRKSEMIQSLNNIPPVYISITSQIVTYAEQQLQLSLLPSIYYALTDHLAFSVQRYHSKQSLGNRIYWEMKTYYPEMFAIGEYGLTVVEATLQLALPREEAANIAFHIINATPAAAGKANILEVTQLVDNVLQAVRALTGGTIDTTSLNYERFVTHMKFFAERYLGDTMLADDGQLLTSVYTVYPEAAKIALKVQKAIIAIYEKEPTKEELAYLIIHIHRVLTN

SEQ ID NO: 1485 - protein, 129 aa, Lactobacillus paracasei
EIIBCACMPNENTMSDHQKITDRIMAAVGGAKNVKTLNHCATRLRFTLADKTQFDIQRLEQMPEVLSAVNSGDESQVVIGANVTKYYAEITKNYHIREAGDGTKPSADHEKNILKRVLNALDCNNKVTT

SEQ ID NO: 1486 - protein, 187 aa, Lactobacillus paracasei
VHDIRKTVDPQVLRFFMAGTQYRMPIRYSETNLKNAANSLNRLKIARENLTYRRRGAETGVDPQITKQLQTLKDRFVTAMDDDINVQNGLTVLFDLAKLLNEYANEETVKSESINDLLNEYDAWLQIFGVVFADQKSLDADIDALVKARDAARAAKDFAKSDQIRDQLAAQGIILEDTPQGTRWRRQ

SEQ ID NO: 1487 - protein, 142 aa, Lactobacillus paracasei
MTFDPKQLNGIALAYMGDAVYEVYIREHLLKRGLVRPASLQRAAKDFVSAKAQAALIAGMEEANLLDSDETDIFKHGRNAKSYTHAKNTDVVTYRVSTGFEALFGYLHLIGRDDRVAELAAWCIQYVEEGKTGHGKKAASNN

SEQ ID NO: 1488 - protein, 259 aa, Lactobacillus paracasei
MAKKPQATTEHDPDEFIFGRHAVEAALKAGTAATINKLFVQTDLKSEPIQHLVGMAQKKKILVSTAPKQKLDLMSDQGNHQGVLLAMTPYAYATLDDLFKNAADKGEDPFFLLLDNLEDPHNLGSILRTADASGVHGVIIPKHRAVGLTSAVAKVSTGAIEYVPVARVTNLAQTIKTLKERGMWVFGTAMDGQDYRKWDAKGSTALVIGNEGKGISPGVAKLMDATIAIPMVGHVQSLNASVAAGILMYQAFASRHEGK

SEQ ID NO: 1489 - protein, 179 aa, Lactobacillus paracasei
MREHIMIVDGYNVIGNWPELAKLKAEDHFDVARDRLLDILAEYRSHENAKMIVVFDAMYVPGIGKSYAKWDLQVVFTKEDETADSYIERLAQDMNSPLMQLVVVTSDQAEQWTVFSRGALRISSRDFLKEVQRSDREFNHDTANYAAHLARRNSPWNNDQLFLLDKMRRHLERRPKPKE

SEQ ID NO: 1490 - protein, 244 aa, Lactobacillus paracasei
MEILKPTFMEPQEFFELIDDSNGQLRVLLTKVSTSYKNLDLPSLRELLDVYDSNMGKETPQYMLKLVIVSCIANLEKKNPIFSDEEEEHIQQFLLAEGPWFHFEYLIYANLCHSLSHPINDRILRHMLKKYREFHLSSYDEAFFGTFYNISARYLQDRDYERSSTMLDMISEFPAKHTALYVRHHVTFVRLVVSIHEHKNQSAKTDLAVLLRATKLIDPSLYKMNIEWLKLLDLDPESLLATNV

SEQ ID NO: 1491 - protein, 168 aa, Lactobacillus paracasei
MTHHQTREENEKELAERKHEQTLEKNENYTDPQNDPAQANIHDAKRYGEVDHMDTDEENSDLDHGRLTGNEDAPESTSGNPHGDQGIHDSQRYGEADHMNTDEETSGLDVGHLTENDHSESGFEDDEHHGQQEKHDSEQERYMGGNSADEDDELAKKLGDRRGMPQDS

SEQ ID NO: 1492 - protein, 148 aa, Lactobacillus paracasei
MSKYRKFLLMIFVSTVIMYGMMFLNVFSFTHIHISVTRILMALMMGAAMAIIMLLFMWQMYPSKKKNGLILVISAVIFVASLFMVRTQTGVSDISWMKAMIPHHSIAILTSTEADLKDPEVKKLADEIIETQKKEIKKMNQMIERLQE

SEQ ID NO: 1493 - protein, 216 aa, Lactobacillus paracasei
MGGAIGFEREYKSRPAGMRTHILVCVGAALLALIQEQITAQTVDFAQSQPKLMQILTADQTRIIAQVVSGIGFLGAGTIIMTKQTVKGLTTAASVWAVAAVGIALGSGLYVIALTGFIAIMIALAVISYLVPLPRIRRLQVEIEHGEETVAYIQSFLKERQVLIENLDLKITRETIESERKYLIMLTLTVPKDVDEDKLVIELSDNKDILMIQIIE

SEQ ID NO: 1494 - protein, 441 aa, Lactobacillus paracasei
MKKVGLILTAVLACLVLLGGCGKKTADADKDTTTNVKSSKKVTLDFWSFWGSGARREVIESIIKDYNESQDKVKIKYSYQPWGDIWTKSLSAITAGNPPDVIVQDINSVAQRADAKQATDITKYLDKGINKRFYSQLFKTTQYQNKTYGLPFNTDTQVIFYNKKIFKNAGLTDKDLPQTWSELDAVARTLDIKKDDTFTRIGFYPLWSLDTQVWALNADDGTSWFNGKNQVKIDTKNKRKALQWILDAQKYYGKKTINRLEAEFGSGVADPFLSGTVAMRAQNINYYTTIKENAPKNFEFGVIQLPEFQKGSGHKTWGGGFTLEVPTGAKHVKESVDFIKYLTSDKVQEKFGAASFDIMANKKANTNLINGKQLDETGQMIYKTADQAMSSTVLTPIPLSAPDYNNLVNEQIDAALLGQKSAKQALKDAQTAVENLVKQHK

SEQ ID NO: 1495 - protein, 302 aa, Lactobacillus paracasei
MTKRSLRQKQEARWGFFFVAPFLIGFVLFMFGPMLFSLIGSFTDYNLTSKMNFIGLNNFKRMFLKDDLFWKSLYNTAYFTIFNVPLTTLFSIFLAVILNQKLVGIRFFRTIFYLPAVLSGVAVYILWMQLLSPSTGLINTILSWFHITGPSWLFDPNWTKPALIMMKLWSAGGAMLLYLATLQNVPTQLYESAEIDGAGIWQQFRHVTLPMITPIIFYDVITSTIGSLQIFQEAYVMTSNGQGGPANSLLFYNLHMWNKAFVGFDMGYAMAMSMVLFMIVSVLTLINLKLAPRWVHYAGGDQ

SEQ ID NO: 1496 - protein, 296 aa, Lactobacillus paracasei
MATEGQRLSHTIVTKKGASKQRTRFIKTISSYLLLGGISLVLLTPLLWMIFTSLKPMTEIVQFPPTFFPKTIHWENYLMAINSFPFWSYAKNTLIIAGSVVIGNVLANSFIAYGFAKLNFPGKRILFALVLSTMMIPGFVTMIPQYVIFSKIGWVGTYLPLIVPSFFGNAFNIFLMRQFYLSISNELIEAAQLDGANHLYIWSHLMIPLTKPALITIAINSFNGAWNDFLGPLLYIKDPRQYTLQIGLQVFKNQSTTQWHYLMAGAVLVLLPTILLFFFAQRYFIEGMNLTAGTKG

SEQ ID NO: 1497 - protein, 192 aa, Lactobacillus paracasei
MPKYSNRFVNLIHWIPRLVILNYLWVLASLPLVTLVSSTRTTAYLVMQCRQEDRISKNIWQTFWQTFKTTRHRFDFIRSFILVLTVLDCWLLAKMTSPLSKTALAALILILLGCTLLSSWRITLTAKYKHVSWIQVFIYCGQHFGPLLGQLLFNIVVCLALFLFGQGFALLAGISTIIGLNIGFTHYFINSN

SEQ ID NO: 1498 - protein, 148 aa, Lactobacillus paracasei
MDTVRGGRGSKAAVLTIVDRVTRLMATTKLENLSQNAVLKGFARLMLDFPGPVRSVTVDHGKEFSCDQALTKRYRIPVYFCHAYHPNERGTNERFNRELRYYFPKGTQFDQVSEANIQRATALINNKPRKCLRWQTPVQAVSKPLSRW

SEQ ID NO: 1499 - protein, 148 aa, Lactobacillus paracasei
MQTPLGLSTLVLFLTLFIQEIRINNKQIRRSQRKVYLSYVIIFFSLFLFNASVHQTRLSTFGQSDIVQFLGEHEAGIHMNGKGYHLIWTKRSFLSTVYFYNLYERRGLFFYRVNSKVIYYTIHPSREVDHGAVKTFLYYTKKEGKIVD

SEQ ID NO: 1500 - protein, 179 aa, Lactobacillus paracasei
MNKTVKELADELGVSKQTIQYHYQRLPANKRQKDSQGRNLISSDLERIIRNKVAKTLPPNNHQKDRQTSTNSDKNNIDIIATMKDEITYLRADRDKQFAAKDQQIEKLQKLLDQSQQLQLMTAQKLKQLEKPKNERESDSKEKDEQIHARASGVPKAVENSADKPVTFWQRLFGERNNK

SEQ ID NO: 1501 - protein, 259 aa, Lactobacillus paracasei
MVSAGRILWTSDRDFNKDEIRDQRYFLVAEHNDLITKARHDLNARELKIMDYVVSKIKPNDEHFNLIDTSMYELTRVLDLKRSGRTYSQLAQNLEDMRAKSVKIYNPSERRLTLTGWFEVVDIWENGQVKLRINKQFAPFLLKLKDSGHYTQYFLEDTVRLKSKYAILLYKLMREVDKDHGQSIGILQGTPEEYMAWLGSPSKYQYKYLKNKVLNPAIEEINCKINDMELELLQARRGRKVVQIEIHNNFARRKSLRYQ

SEQ ID NO: 1502 - protein, 361 aa, Lactobacillus paracasei
MIEFKNVSKRYAEGDALSNLNLTIPDGKFVCIIGKSGSGKTTLLRLINKMIKPTDGSILIDGVDISDIGDNQLRRQIGYVIQSIGLFPTMNIRENILIVPRLLKWSKTKQAGIAEALLARVDLPKEILDRKPKELSGGQQQRIGVIRALAANQKIILMDEPFGALDPITRSTMQDMIKKIQQDLNKTVIFVTHDMAEARRLSDYLLIMNNGKVEQFGTAGSVVNHPANEFVKELVGIRKQSDTTPEDVANPIKVLSNDEYMQEGQHYSEEFGPSNVVVIVDNNSQPIGFLEKQRISENEDKKPSRKINIQSEFSVVNNTDDFAEVTEKIILSPEKMFIIIDGDGKPVGTINREKVANIIRA

SEQ ID NO: 1503 - protein, 475 aa, Lactobacillus paracasei
MTKNYFIGIDGGSQSTKVTIFDAKGIPVVSVQDRLPSLDTPQPGIVEYPEDSLWESLCRALKRLLAKFSGDLDDIAGVGLGSIRFCRAYLKTDGTLAYPVLSWMDDRVSRPFDGKIPDVAYITASTGYLTVRLTGNFNDTAANYQGMWPIDTDTWDWDESKLKDFNVTRNMLFNLMMPGDRLGLVTAYASKVTGLPVNLPVYATANDKAVEALGAGMLSDDTAVISLGTYITGMVSGTGNKQSAKNFWTNFGSEPRRYLYESNGIRRGMWTVSWFKEMLGDAYTAAASKKGKSAEEVLNLEAEKVPVGSDGLITILDWLAPVEEPFRKGAILGFDGRQSRAHMYRSILEAIGMTMGANVKAMTDELDIDLSRIVITGGGSNSDLFMQIFADVFGIPTTRNVVNDAAGIGAAICAAVGEGYYSNFKDAIAKMVKVDKTFLPDTKSHKLYQQFYTNVYSKVRPQTDPIFKKTFEMFG

SEQ ID NO: 1504 - protein, 260 aa, Lactobacillus paracasei
MNMEITEFNMNFFSLKGKTAIITGGNTGLGRAFSVALAKAGANIFVPSIAPDDGTTEKLVTDAGVKYHFMQADITAEKKPQQVIEEAVETFGSVDILFNSAGISLLDDVLHFDRDKWDPMIRLDLTAAFEMSHEAAKVMIPQKSGKIINICSLFSFLGGQMSPAYAAAKHGIAGLTKAYADELGQHNIQVNGLAPGYFATAITKATRSDPKKNQTVLDHIPANRWVDVADLMGTAVYLSSRAADYVNGTLVVVDGGYLVR

SEQ ID NO: 1505 - protein, 243 aa, Lactobacillus paracasei
MQDGLDILREVMVAGYKPSVARVYSKADAATQFPKFADGKCVLLFMTEGAPEISRANFDGIQKITNKHDELSPIDSKLIEGWFNQLNWGPKQVEDEKEDILKTNDVGFTTEIAADWENIGRIFDAVVDRVPKEIPDMIWIGGHSSHSYINGTNIYFVYYYHVEGISPEEEITKYHNPINKIIVEESLKHGGTMVHHHGVGKARAPWIKEEYGSSFYILKTLKEAFDPNNIMNAGSIIPEKYLD

SEQ ID NO: 1506 - protein, 155 aa, Lactobacillus paracasei
MQRENISDIIETYLKTILAQEAAVEIRRAEIARRFNCVPSQINYVIKTRFTPARGYIVESKRGGGGYIRIVKVKLTDDQDLIQIMRQHIPSRLRMRDARDLIQELFDNGLIARQSGNLMLAVMDHETLGIFDQGAEEHLRSRLFLAFLDRLRYER

SEQ ID NO: 1507 - protein, 835 aa, Lactobacillus paracasei
MDNLFTPSAKNVLLLAQEQAKYFHHHAVGTEHLLMALVMEKDGIAGKTLRQLGVTENDVHDEIERFTGYGTVDAAGQASDSYLPYSPKGKEILAFAGDEAKRLGALKIGTEHVLLGLLREDDILAARILQNLGLSLSKTRQMVFKKMGIADTAAKRRPMARGGARQDGQGTPTLDGLARDLTQMARENRMDPVVGRDKEVRRLIQILARRTKNNPVLIGEPGVGKTAIAEGFAEKIVSGKVPDDMVNKRLMMLDMGSLVAGTKYRGEFEDRLKKIIDEIYKDGNVILFIDELHTLIGAGGAEGAIDASNILKPALARGELQLIGATTLDEYQKYIEKDAALERRFATIQVDEPTEEEAEQILKGLRPRYEAHHGVTITDEALHQAVALSSRYITTRFLPDKAIDLVDESAAKVRLDKANVETKADKLQDELAKLVADKEDAIDHQDFETAANIRTQEADLKTKLADTPEPVNESGVRTDIKVTGDDVAEVVSQWTGVPVTQLQKKESDRLVNLEKILHERVVGQDEAVSAVARAIRRARSGLKDPTRPIGSFMFLGPTGVGKTELAKALAEAMFGSEDAMIRVDMSEYMEKFSTSRLIGAAPGYVGYDEGGQLTEKVRNKPYSVVLLDEVEKAHPDVFNILLQVLDDGYLTDSKGRRVDFRNTILIMTSNIGATAIRDDKTVGFGAKDPQADFNAMKSRMLDELKKAFRPEFLNRIDETVVFHSLNKAELHEIVKIMTKTVLSRIKDQGIDVKITPAGIDAVAAAGFDPEYGARPIRRALQTGVEDQLSELLLTGQAKTGDLIQIGAKKGKLTFTVKENKGKQKENGASKEPVKA

SEQ ID NO: 1508 - protein, 1194 aa, Lactobacillus paracasei
VNYGKHRTRRSYARIKEVLDLPNLIEIQTNSYQWFLDEGLKEMFDDIMPIDDFQGKLSLEFVGYQLLEPKYTVEEARQHDANYSAPLHVTLRLTNHETGEIKSQDVFFGDFPLMTKQGTFIINGAERVIVSQLVRSPGVYFHSETDKNSRVTYGTTVIPNRGAWLEYETDAKDIAYVRIDRTRKIPLTELVRALGFGSDQDIINMFGDNDSLMLTLEKDVHKNTDDSRTDEALKDIYERLRPGEPKTADSSRSLLYARFFDPKRYDLASVGRYKVNKKLSLKTRLLNQVLAETLADPDTGEVIAQKGTKVDRQVMDKLAPYLDRDDFKTITYQPSDQGVVTDPIELQSIKVYSQVTPDKEINLIGNGHIGKKVKHIVPADVLASMNYFLNLQEGLGSIDDIDHLGNRRIRSVGELLQNQFRIGLSRMERVVRERMSIQDTATVTPQQLINIRPVVASIKEFFGSSQLSQFMDQTNPLGELTHKRRLSALGPGGLTRDRAGYEVRDVHYTHYGRMCPIETPEGPNIGLINSLASYAVVNPYGFIETPYRRVSWDTHKVTDKIDYLTADEEDNYIVAQANSPLNDDGSFVDETVLARHKDNNIEISPDKVDYMDVSPKQVVAVATACIPFLENDDSNRALMGANMQRQAVPLVNPHAPLVGTGMEYKAAHDSGTAVLANNAGTVEYVDAKQIRVRREDGALDAYNLMKFKRSNAGKNYNQRPIVTIGDHVDVDEIIADGPAMQNGELALGQNPIIAFMTWNMYNYEDAIVLSERLVKDDVYTSIHIEEYESEARDTKLGPEEVTREIPNVGEEALKDLDEFGVVRVGAEVRDGDILVGKVTPKGVTELSAEERLLHAIFGEKAREVRDTSLRVPHGGGGIIQDVKIFTREAGDELSPGVNMMVRVYITQKRKIQVGDKMAGRHGNKGTVSVVVPEEDMPYLPDGTPVDICLSPMGVPSRMNIGQVLELHLGMAARNLGIHVATPVFDGANDKDLWATVKEAGMASDGKSVLYDGRTGEPFENRVSVGIMYYMKLSHMVDDKIHARSIGPYSLVTQQPLGGKAQFGGQRFGEMEVWALEAYGAAYTLQEILTYKSDDVVGRVKTYEAIVKGEPIPKPGVPESFRVLVKELQALGLDMKVLGADKKEIELRDMDDDEDDIVSVDALAKFAAQQEEKKAHEAAAQATDGKSANSTDDKK

SEQ ID NO: 1509 - protein, 1220 aa, Lactobacillus paracasei
LIDVNKFESMQIGLASPDKIRSWSYGEVKKPETINYRTLKPERDGLFDERIFGPTKDWECACGKYKRIRYKGIVCDRCGVEVTRSKVRRERMGHIELAAPVTHIWYFKGIPSRMGLVLDMSPRSLEEIIYFASYVVIDPGDTPMEKKQLLTEREYREKREEYGQTFNAKMGAEAIKELLQDVELDKEVAELKEDLKSAQGQKRTRAIRRLDILDAFKESGNDPAWMVMDTIPVIPPDLRPMVQLEGGRFATSDLNDLYRRVINRNNRLKRLLDLNAPSIIVQNEKRMLQEAVDALIDNGRRGRPVTGPGNRPLKSLSHMLKGKQGRFRQNLLGKRVDYSGRSVIDVGPWLKFYQCGVPREMALELFKPFVMRELVKRDMASNIKNARRKIDRQDDDVWDVLEDVIKERPVLLNRAPTLHRLGIQAFEPVLVDGKSIRLHPLVCEAYNADFDGDQMAIHVPLSDEAMAEARMLMLAAHHILAPKDGKPIVTPSQDVVLGNYYLTMEQKGREGEGMIFKDTNEVLMALQNGYVHLHSRIGIATNSFTDKPFTDDQKQKIMVTSVGKAIFNEIMPKDFPYLNEPTQDNIVNGVPDKYFIDKGEDINDYLEDAPLIDPFKKGFLSDIIAQVFKVYKVQRTSDLLDDMKTLGYTQSTNSGLTVGIADITNLKEKPEIVEAAHKKVATVSKQFRRGLITDEERHDRVIQIWNDAKDDIQQKLVDSFDPNNPISMMSDSGARGNISNFTQLAGMRGLMAAPNGGMMEVPVISNFREGLSVMEMFMSTHGARKGMTDTALKTADSGYLTRRLVDVAQDVIVREEDCGTDRGLVVSAIREGNEMIEPLYDRLVGRFTMKDVLDPKSGEVLVKRNTLMDEDTAQMIVDAGVESVTIRSVFTCNTKHGVCQKCYGRNMATGEQVEVGEAVGTVAAQSIGEPGTQLTMRNFHTGGVAGGEDITQGLPRVQEIFEARNPKGEAVITEVTGEITAIDENPAEHTREITVKGETDTRTYSVPYASSVAVAEGDHINRGERLTGGSIDPKQLIKVRDVMATENYLLSEVQKVYRMQGVDIGDKHVEVMVRQMLRKIRVMDPGDTNILPGTLLDIADFKEKNTQAIISGGIPATGRPVLLGITKASLETNSFLSAASFQETTRVLTDASIRGKNDPLIGLKENVIIGKIIPAGTGMATYRHEEPKSVGTVSDSVYSISDIEKQMKAKDGQQGDTDKK

SEQ ID NO: 1510 - protein, 164 aa, Lactobacillus paracasei
MLITVLLLIVLYLVRHHSLTTRCFHCLLAVLFGLSIHTWLTFLLASGLIIFSVADWHERTVPFFSFTGWCLTLLVCFPHDLFGMMLLAVMIGGLAVVSQGLGSADVMLIALLACVLRLEAALIVTLIACGTACLHWIAARPPSLPMISHLAAGYACFALVNGGL

SEQ ID NO: 1511 - protein, 2724 aa, Lactobacillus paracasei
MRELGGKKTGHFMLKVGIYLTVILGMIVQLISPALALAAENPTQAVTGTLTIKNQDEQGSPLNGAKYEIQNESHQVVANSEISKDGQATVPNLPVGNYTATEKQSVSGYTALEQTKNFSVTASGNVTLLFKSRASATLDSGSSSSTAAKPAAAKTPEAEPSATPDAKADTELPNIFTKVALKDGNDQPLGTEVDQQSAVKMEMTFTLPATSTPFPAGASFTTTLPKDQIAFPESGGGNFSGDVASYYFDATTGQLTIKLLKATSNGSWLVHIAASFKALTANDSLNQTLVFHTKDQDTKFPITFRSNAKPVVVYAPTTTPQSLNPTGIAGTAKFNLNGNETSKTDPTKWDSDPAKRSKNADMALTLTARGSGTDYLKSLTFNDSDLAKIKVSSAPVNILGGFSEELKPLVAGQDFHAVLSDDKRTVKIYLTGGFKKTTGYQVDYTATIDRSLDDTGKVGSALVEGYRYLTGSQSSDGYDYDSVTMRNSGVAITKSGDITNNFRALNWKINWNYSMDTMKAGATLTDRFGKQTSGKDEHDQPNIETDGNQTLDTKSLKVFQVTFDEWATPIVSKVDIAQYFKLTEKGDGEFTLTYLGGGDLPENASFQIQYQTKLKNTPKNGDNLTNIVNDQKNHYDHATYPVRLPSGITKVGGKIDAYNGQMTWRINANRVFRNMKNGKIFDLFPDGVDKLDNDPTADNINTISGENVSANVDDGANDGILVYAQNPDGARTLLKPGTDYDMSTQDADVQSAVKQYNDKDKTNPINANGQEKGIRGFVVTLKGAYAETDSQIVIYTHTKLDMLKLGQVGHDPDALKKALNNRAFFFFDLPPGDDDVASGDSSSTPTPEEGAFSGALKNSWSDAPDTQYWGVLVNQLGLPYGHMHLTDILPRFDGVNYELIPDSIKFYEVTGPDGVDPSNTGDPASSNDVKEIKTSPYYGTGGWSSTALKAEDAAQQSLLPTNTPNTWLKNNPNLAQQLDFDFPNIGTGRVWVVFKTMRANQWNYNDPNFANNATVTDTEPTTAIPTFNPSASKSAQSYWTPISKTVSADAKLKNVLNWQVNLINIQDKYRPMVNPIIEDTLDPRGTGAEINATSFVVKLKVGIADPITLKEGDDYTLALDGNKFTITFKRTFGNLTQEANSPLNNYQVSVDYATSSKNSGWAYNSSSVEWDGSQTTQKPSDGVPPDARIANANGYLPYWGSGISGETLTQLANLVVEKKDSVSGTPIPGVKFRLSDGTHTFEATTKLDSTTNKALATFQGLPIGIDYTLTELSTPAGYKPLAPQTIRLNATSDTGTAIQTEAVENEPYQITLSKYDNRAKGQSETDNKHYLLPGATYDLVDTDTQKTLKSGMKTNADGKITIGTASSFSGQYAGDKFTPDLKDGEYVLEDLKPGNYKLVETQAPDHYCGDAHDQATITSGPDKQVWEDSLKAGSVAAIISNKAPSATVTAYNQKKPGQLDIKKQAETITDDKFPDRQPMTGAEFKLYRYGDDGKVDQSKSWDATIISQDGTFIFDSPDLYEGKYQLVETKAPEGYVIPDDLAKGVDVNITGDETLKLPTITEPVYRRALQVAKTDGNFGNPIAGITYALYQNDGTEIAKDLVTDENGQVNLPFNLPAGKYYIQETKSLPPYRPNSDKHPFEVKQTDQTQTAGNLETENKEHPIKVNVTNYQAKTLNVKKVDRTYATHVLPGAVFRLTNSAGYTRDVTTDENGIASFGDLLLGSYSLTEIKAPAGYRLDNTVYPIALSSAETPTAITVNKEIADDPYQVNLTKYDNRVKKDDPVSQKKYLLPNAVYKLVDVAANKTLKADMKTNADGQLTFGAASSFDSPLKDGEYAIEGLKPDTSYRLVETEAPKHYEGDAADQARYPSGEHKQDWESSLAAGSVDFTIKADQTQLKLTATNQKKPGQLDLKKQAETIKDDQFPDRQPMTGAEFKLYRYDEAGKVDRSRSWDATITNNDGTVSFKDSDLYESKYQLVETKAPDGYVIPDELAKGVDVDITGDQTLTLPTITEPVYRRTTSVAKTDGNFGNPIAGITYALYREDGTELAKDLVTDKNGQVNVPFSLPVGHYYIQETKTLPPYRPNTDKHAFEVKQTDQTQTASSLATENKQQPIRVNVTNYQVKTLNVQKVDRNYAAHVLPGAIFRLTNSAGYSRDITTDENGLASFGDLLLGSYSLTEVKAPAGYRLDKTVHAITLSSAITPTPITIDKQIADDPYQVTLTKYDSRVKKTDDAATRKQYLLPGATYKLVDAVTNKTLKADMKTNTDGQLTFGAASSFDTSLKDGEYAIEGLKPDNSYRLVETQAPEHYEGDAADQANATSGVQKQRWEASLAAGSVDFTIKTDQTQLKLTATNQKKAGQIIVTKKADTTTDDRFPGKMTMIGAQFAMYRYREDGTVDHSHAWTTTITNQNGIVTFNDHDLYEGKYLLVETQAPRGYVIPDDLAKGIDVNVKGDQKVALDPIIEPEFRRAIQLQKTDGNFGNHLAGITFDLYGSNGNVLAKDLVTDEAGQINLPFNLPIGDYYFEETKTLPKYELNTDKIDFKVEQTDLTQTVSALASQNKQQPVTVQVANYQINSLVIKKVDAADSNQVLAGAVFRLTNDKGYSKEFTTDVNGLVTFDNLKLGRYWLTEVKAPAGYTINPDYAKPVAVDIKSGDTIRMTIADQRHVLPSTEGGNNGNDVRHDQPSRRLLFGSFGDRDAITLVLLGIVILVIAGSTVILRRRKRS

SEQ ID NO: 1512 - protein, 138 aa, Lactobacillus paracasei
MPTINQLVRQGRKSISTKSDSPALNFGYNSKKKSLTNNPAPQKRGVATRVGTMTPKKPNSALRKYARVRLSNLIEVTAYIPGIGHNLQEHSVVLIRGGRVKDLPGVRYHIVRGALDTAGVDGRMQGRSKYGAKRPKKK

SEQ ID NO: 1513 - protein, 156 aa, Lactobacillus paracasei
MPRKGSVAKRDVLPDPVYNSKLVTRLINHLMIDGKRGKASTILYDAFDMIKKQTGNEPLDVFEEAMKNVMPVLEVKARRIGGSNYQVPIEVRPDRRTTLGLRWIVQYSRQRGEHTMDERLAKEIMDAANNTGAAVKKREDTHKMADANRAFAHYRW

SEQ ID NO: 1514 - protein, 700 aa, Lactobacillus paracasei
MANKREFPLDRTRNIGIMAHIDAGKTTTTERILYYTGKIHKIGETHEGASQMDWMPQEQERGITITSAATTAFWKDHRVNIIDTPGHVDFTIEVERSLRVLDGAITVLDAQSGVEPQTENVWRQATTYGVPRLVFVNKMDKIGADFDYSMTTLHDRLQANAHAVQMPIGAEDKFEGVIDLIEMKADLYDEDELGTKWDTVDVPDDYKEAAQKAHNDLIEAVADVDDGIMDKYLEGEEISNAELKAAIRKATINLEFYPVLAGSAFKNKGVQMLLDAVIDYLPSPLDVRPYHATDPDTGDAVELTAGDDKPFAALAFKVATDPFVGRLTYIRVYSGTLEAGSYVLNATKDNRERVGRLLQMHSNHREEIPEVFSGDIAAAIGLKNTTTGDSLTDVDHPLILESLDVPDPVIQVSIEPDSKEDQDKLDVGLQKLSEEDPTFKAETNPETGETLIAGMGELHLDIMVDRLKREFKVAAKVGEPQVAYRETFTKETSAQGKFVRQSGGKGQYGDVWIEFTPNEEGKGFEFENAIVGGVVPREYIPAVEQGLKEAMANGVLAGYPLIDVKAKLYDGSYHEVDSSEAAFKVAASMALKNASKSAGAVILEPIMHVEVVAPEEYLGDVMGQITARRGRVEGMEARGNAQLVNSMVPLAEMFGYATTLRSATQGRGTFTMTFDHYEAVPKSIQAEIIKKNGGGVATKD

SEQ ID NO: 1515 - protein, 344 aa, Lactobacillus paracasei
VSSQERITTILLRLLRGDQLNKQALMTEFNKDESSIRRDISVIKRAFDDVFSEPAPFIAASSGDYRLKPNLHAAGRSLDDGQLLAIALILTASRGLSSVEMKQLMAQLLPAGPEHKGLDRLTKNPVFEYRGVPKISLTNRLARLSQAIVNHELISFDHVYHGEMRHFDRRLPTGLFFGDLFFYLIVDGSDEQADDDPDEGKFVRFRLDYMRNITYHRQQPTHDHDERFRGGRLQNHTWYPYLGKPINLEILYSYDPQFVLDRFPEAIVDWKNVRDRPFIKNPYARKVYHITIPVNDGFGVRMWLQGQGDLVKVLVPKHIRDYVVWVLRKSLKNYQNEDDTGKYL

SEQ ID NO: 1516 - protein, 187 aa, Lactobacillus paracasei
MSYIGQHLPAFKLNAYQHGDFHEVSDTDLKGKWAVICFYPADFSFVCPTELGDLQDHYERFQAVGAEVYSASEDTEFVHMAWAEASPTIKKIQYPMLADPAGKLATALDVRDEASGQAFRGTFIIDPDGVIQAYAVNNFGIGRNADEILRTLQAAQFVAAHGDQVCPANWQPGAKTLTPGADLVGKI

SEQ ID NO: 1517 - protein, 145 aa, Lactobacillus paracasei
MKFDHYKKLVNSTLDILLGFLAIVVVIFMLRYILDIGSLILQPLSTALFGKVIQEVTSFFMLFEFVIMLVRYIEEGHHIPIRYLILISMTAILRQLLVLHDRGTETLLLTLAILVLAGVLTVFSFVSGDFKQSQDGKNVDIDQHF

SEQ ID NO: 1518 - protein, 102 aa, Lactobacillus paracasei
MAKQKIRIRLKAYEHRILDQSADKIVETAKRTGATISGPIPLPTERTLYTVLRSPHKYKDSREQFEMRTHKRLIDIVNPTPKTVDALMKLDLPSGVDIEIKL

SEQ ID NO: 1519 - protein, 210 aa, Lactobacillus paracasei
MARKGILGKKVGMTQVFTDNGELVPVTVVDVTPNVVMQVKTVESDGYEAVQLGYGDMREVLTNKPSVGHAKKADTTPKRFVREIRDVALSDYEIGSEVKADEFAAGDIVDVTGTSKGHGYQGNIKKDGQSRGPMAHGSRYHRRPGSLGAIINKVFKGKKLPGRMGNHTRTMQNLQVVAADTEHNVLLIKGNVPGANKSFVTIRSAVKAAK

SEQ ID NO: 1520 - protein, 207 aa, Lactobacillus paracasei
MANVTLYKQDGSENGKVELNDAIWAVEPNENVVFDAVVMQRASLRQGTHAVKNRSAVSGGGRKPWRQKGTGRARQGSIRSPQWRGGGIVFGPTPRSYAYKLPKKVRRLAIKSVLSQKVLDSDLVVVDGLNFDAPKTKAFATVLDGLKVSDKALVVLEDGNEVAAKAARNLPNVKVVPAEGINVLDVVDYKKLILTQSALQKIEEVLA

SEQ ID NO: 1521 - protein, 100 aa, Lactobacillus paracasei
MEARDIILRPIVTEQSMAEMDNRKYTFEVALHATKPQIRKAVEEIFGVKVVNVNIANVRGKKKRQGRYEGMTRRRRKALIALSADSKEIKIFADEDNDKK

SEQ ID NO: 1522 - protein, 278 aa, Lactobacillus paracasei
VAIIKYKPTSNGRRNMSGSDFAEITKTKPEKTLLVSQSHTAGRNAHGHITVRHRGGGHKQFYRVIDFKRNKDGMAATVKAIEYDPNRTANIALLHYEDGVKSYILAPKGLKVGDKVYSGEDVDIKVGNSLQLKNIPAGTTIHNIELKPGKGAQLARSAGVSAQLLGKDNDKYVTIKLASGEVRLILAENRATIGAVGNEQHELISIGKAGRKRWLGFRPTVRGSVMNPNDHPHGGGEGKAPIGHPSPMSPWGKKTLGKKTRDHKAKSEKFIVRHRRAK

SEQ ID NO: 1523 - protein, 93 aa, Lactobacillus paracasei
MGRSLKKGPFADAHLLKKIEAQADNDKKTVIRTWSRRSTIFPSFIGYTIAVYDGRKHVPVFVSEDMVGHKLGEFVPTRTFRGHNTDDKKTTAR

SEQ ID NO: 1524 - protein, 117 aa, Lactobacillus paracasei
MADQITSATATAKTVRIAARKARLVIDLIRGRDVAEALAILEFTPRSGSPIIEKVLKSAIANAEHNYDLDAQNLYVSKAYVNEGPTLKRFRPRAKGSASPINKRTSHVTVVVSEKEA

SEQ ID NO: 1525 - protein, 220 aa, Lactobacillus paracasei
VGQKINPTGFRVGVIRDWDAKWYADKDFAAFLHEDIEIRNFINKKLQDASVSRIEIERAAKRVNISIHTAKPGMVIGKGGSEVENLRKQLNKLTGRQVHINIVEIKKPDLDAKLVGENIARQLEQRIAFRRAMRQAMQRTMRAGAKGIKTQASGRLNGADIARREHYNEGLVPLHTLRADIDYAWEEAATTYGRIGIKTWINRGEILPEKPKQNSVKGGK

SEQ ID NO: 1526 - protein, 144 aa, Lactobacillus paracasei
MLVPKRVKHRREFRGKMRGAAKGGRNVDFGEYGLEALESHWITNRQIEAARVAMTRYMKRGGKVWIRIFPHKSYTSKGVGVRMGNGKGAPTGWVAVVKREKIMFEVGGVSEAVAKEALRLASNKLPIRTKIVSREEVGGQSNEG

SEQ ID NO: 1527 - protein, 64 aa, Lactobacillus paracasei
MKAKEITALTTAEMLDKEKQYKEELFNLRFQQATGQLENTARLSQVRKNIARIKTVLRQQALNK

SEQ ID NO: 1528 - protein, 87 aa, Lactobacillus paracasei
LAERNSRKVYQGRVVSDKMDKTITVEVSTVKMHPVYGKRMKYSKKYYVHDEDNTAKTGDIVRIAETRPLSRNKRFRLLNIVEKAVII

SEQ ID NO: 1529 - protein, 122 aa, Lactobacillus paracasei
VIQQESRLKVADNSGAREILVIKVLGGSYRKTGNIGDVVVATVKQATPGGVVKKADVVKAVIVRTKSGARRADGSYIKFDENAAVIINADKSPRGTRIFGPVARELRDGDFMKIVSLAPEVL

SEQ ID NO: 1530 - protein, 103 aa, Lactobacillus paracasei
MKFKTGDKVRVMRGKDAGKEGQITKVLKDADKVVVEGINMIKKHQKPNNANPQGGIIDKEAPIHVSNVMLLDPDTNKPTRIGSEVKDGNKVRIAKKSGTAIDK

SEQ ID NO: 1531 - protein, 180 aa, Lactobacillus paracasei
MENRLEERYSKEIAPALVSKFNYKSTMQAPKIEKIVLNMGVGDATQNAKLLDEAVDELTLISGQHPLITKAKKSIAGFRLREGMPIGAKVTLRGERMYDFLDKLINVSLPRVRDFHGISPKSFDGRGNYTLGVKEQLIFPEIDYDKVNRVRGLDVVIVTTANTDEEALELLTQVGMPFAK

SEQ ID NO: 1532 - protein, 132 aa, Lactobacillus paracasei
MVLTDPIADYLTRIRNANMVRHESLVVPASKMKKDISEILKREGFIRDYEVIDDDKQGVIRIFLKYGKNNERVISGLKRISKPGLRSYVKSDAVPKVLNGLGIAIISTSEGVITDKEARAKNVGGEVLAYVW

SEQ ID NO: 1533 - protein, 176 aa, Lactobacillus paracasei
VSRIGYKVIKVPAGVTITKDGDNITVKGPKGELTRHFAPEIEMHQEGDEINFTRPDDSYKAVHGTMRANLNNMVVGVTEGYKKEMKLVGVGYRAQKQGEKLVLNVGYSHPVEMTAPKGVTVEVPSTTQIIISGISKQVVGQFAAVVRSVRAPEPYKGKGIRYVDEHVRRKEGKTGK

SEQ ID NO: 1534 - protein, 119 aa, Lactobacillus paracasei
VISKPDKNKTRQRRHARVRGKISGTSERPRLNIFRSNKNIYAQLIDDVAGVTLASASTLDKDIKDPENKTAASAQVGALIAKRAVADGHKVVVFDRGGYLYHGRVAALAEAARENGLEF

SEQ ID NO: 1535 - protein, 167 aa, Lactobacillus paracasei
MASFIDPNQLDLEDQVVSINRVTKVVKGGRRLRFAAIAIVGDKNGHVGFATGKAQEVPEAIRKAVDAAKKSLIEVPIVGTTIPHEVIGHFGAGEVLLKPAEEGSGVAAGGAIRSVMELAGIADITSKSLGRNTPINMIRATMDGLTQLRTREQVAELRGVSASSLED

SEQ ID NO: 1536 - protein, 61 aa, Lactobacillus paracasei
MAQLKITLTRSAAHRLPKQRKIVKELGLARVNSSVIKPDNAATRGAIFQISHLVSVEEIKD

SEQ ID NO: 1537 - protein, 146 aa, Lactobacillus paracasei
MQLHELKPSVGSRHSRKRLGRGTSSGQGKTAGKGTKGQLARQGGKTRLGFEGGQMPLFRRMPKRGFNNINRKEYAVVNLSDLNRFDDGAEVTPAALIDAGIVKNEKNGVKLLADGKLEKKLTIKVAKASAAAKAAVEAAGGSIEVI

SEQ ID NO: 1538 - protein, 441 aa, Lactobacillus paracasei
MLRTLKNALKVKDIRNKILFTLAVLLVYRLGTLIAVPGVNAKALQSIGSTGLISLLDTVSGGGLAQYSIFSMGVSPYITAQIVVQLLQMDIVPKFVEWSKQGEVGRRKLNQVTRYLTIIFGFFQAIGITAGFQTLSSMGLVKNPSVSTYITIGIILTGGTMLLTWMGEQITDKGLGNGVSLLIFSGIIARLPSGLQELYRDNVQVYSGAEIWKGIAFMAALAIIVILVITFVTWVQQANYKIPIQYTRRVTSAGSNSYLPLKVNVAGVIPVIFASSFIVTPQTILMAFQKNHSGDGWYQVMTNIFNMQKPAGTAIYTLLIILFTFFYAFVQVNPEKVSENLTKQGSYIPGVWPGKETENYISRLLMRLSTVGALFLGLVALLPQLAANIWGLPQSIGLGGTSLLIVVMTAIELVRQLDGLLMKREYIGFIRGDLIKGDSKK

SEQ ID NO: 1539 - protein, 218 aa, Lactobacillus paracasei
VNLILMGLPGAGKGTQAERIEDTYPIAHISTGDMFRAAMAAGTALGKEAKGFIDKGQLVPDSVTNGIVKERLAESDTDAGYMLDGFPRTIQQAEALETITADLKKPLDAVINIDVAPAKLVDRLSGRFICKTCGATYHKIYNPPKVAGTCDRCGGHEFFQREDDKPATVKNRLKVNIEMNTPLLDFYEKKGLLHTVNGDQDIDKVFAEIKAILAAVAK

SEQ ID NO: 1540 - protein, 72 aa, Lactobacillus paracasei
VAKDDVIEIQGTVTDTLPNAMFKVKLENGAEILAHVSGKIRMHYIRILPGDKVTVELSPYDLTKGRITYRFK

SEQ ID NO: 1541 - protein, 38 aa, Lactobacillus paracasei
MKVRPSVKKMCEHCKVVRRKGRVMIICSANPKHKQRQG

SEQ ID NO: 1542 - protein, 121 aa, Lactobacillus paracasei
MARIAGVDLPRGKQIVIALTYIYGVGKTTAQKVLKNAGVPENVRQDDLTPEQEDKIRAALDSVKVEGDLRREVNLNIKRLMEIGSYRGIRHRRGLPVRGQNTKNNARTRKGKKASMAGKKK

SEQ ID NO: 1543 - protein, 129 aa, Lactobacillus paracasei
MAGRKTTRKRRVRKNVESGVAHIHSTFNNTLVMITDPRGNAIAWSSAGALGFKGSRKSTPFAAQMAAEAAAKESMEHGMKSVEVAVKGPGSGREAAIRSLQATGLEVTAIRDVTPVPHNGSRPPKRRRV

SEQ ID NO: 1544 - protein, 312 aa, Lactobacillus paracasei
MIEFEKPNITKVDESTNYGKFVVEPLERGYGTTLGNSLRRILLSSLPGAAISSIQIDGVLHEFSTIDGVLEDVTQIILNIKKLALKMNTDEDKNIEIDVNGPAKVTAADIVADPDVEVLNPEQYICTVADGGHFHVRMTVKKGRGYVAADQNKSDDMPIGVLPIDSIFTPISRVNYQVESTRVGRRNDFDKLTLDVWTNGSISPREAISLAAKILTEHLDIFVNLTDEAKNAEIMVEKEETHKEKMLEMTIEELDLSVRSYNCLKRAGINTVQELTNKTEADMMKVRNLGRKSLEEVKNKLADLGLGLRKED

SEQ ID NO: 1545 - protein, 127 aa, Lactobacillus paracasei
MSYRKLGRTSSQRKALLRDLTTDLLINERIVTTEARAKEVRSTAEKMITLGKRGDLHARRQAAAYVRNEIASVEEQDDNSVVVKSALQKLFSDLAPKYADRKGGYTRILKTAPRRGDGAPMVIIELV

SEQ ID NO: 1546 - protein, 223 aa, Lactobacillus paracasei
MHNWLKQRAPWQIGLYVIGIWSLIAIVWVLLLVLLTPPNGSTGGLLMPGVDHLANGSVIVQWLSYAWLISMLSGYLTGRQYRKQKLTPALPKTLIPLTTFWVIILLLAQWYPLSWLTKPHSLDGFLLLAMLSFVVIMPVGICAAYAGLFVNGSRYLTVIFLVLLLMTMHTNQLIVNGNSQFGMVMLNATPMRVQAWMLLVGSLIFSAVFAFLSTNPDIVKNNF

SEQ ID NO: 1547 - protein, 278 aa, Lactobacillus paracasei
VGNVIRVQHLNYTYPEAKQQALTDVSFDVAKGEWLAIIGHNGSGKSTLAKNLNGLLAPESGTVQVAGMTLSEETVWDIRAKVGIVFQNPDNQFVGATVADDVAFGLENRGVPRPEMIKRVDEALDRVGMTAFADREPSRLSGGQKQRVAIAGIVAQRPEIIILDESTSMLDPAGRQEVLGVIRELKDELGLTVLSITHDIDEAAEAHRIILLNDGKINEIGTPSEIFSHGMELLRLGLDVPYSEKLKDALAQRGIAMPKDYMDNERLVDYLWTLHSTM

SEQ ID NO: 1548 - protein, 281 aa, Lactobacillus paracasei
VSFTYQAGTPFAGDGIKDVSGVIRDGSYTAIIGHTGSGKSTILQHLNALLKPTSGTVTIGDKVITNETNNKNLKPLRQKVGMVFQFAENQLFEQTVAKDIAFGPQNFGVSEKDALALADKMVKMVGLPHDVLEKSPFDLSGGQMRRVAIAGVLAMQPEVLVLDEPTAGLDPSGRHEMMQMFEQLHREQGQTIVLVTHQMDDVADYADTVWVMAEGKLIKTGTPREIFADPAWLKANQLGLPKTAQLAQQLAAKGFHFDPQPLTESELADQLVPQIGGGQRG

SEQ ID NO: 1549 - protein, 264 aa, Lactobacillus paracasei
VDKLLLGRYIPGDSWVHRLDPRTKLIASFYYIGIVFLANNWQTYLMMFVATLFMIWLSGIKIGFFLKGVRPLIWLILFTVVLQVLFVRGGTVYWHWGWLWITEFGLINGAFIFVRFVLIIFMSTLLTLSTQPLSLADAVESLLKPLRVIRVPVTELALVLQIALRFVPTLMDQTTKIMNAQRARGVDFGEGNIFQQMKAVVPLLIPLFVSSFTTADELATAMEARGYQGGDDRTKYRILRYHRRDWVAAGGMLVLTGLLLLLRA

SEQ ID NO: 1550 - protein, 247 aa, Lactobacillus paracasei
MTHYKVTLAYDGTNFAGYQVQPKQRTVQGVLQKALTKMTKGQPVHVDGSGRTDSGVHALGQVISFDYPGNIPAESMLKAMNSLMPLDIEILKAEIVDADFHARYSAKGKRYLYRVARGYYTNPFNRLYTGHYPYKLDVQRIEVALKDLVGTHDFTSFAASGGVIVDKVRTIYEATVREDPVTNEIIFEFYGNGFLYNMVRILVATALEIGNGRRDVHDFQRLFAVKDRQQARGTAPASGLYLKEVYY

SEQ ID NO: 1551 - protein, 253 aa, Lactobacillus paracasei
MTYSTKQLADLAGVTPRTLRYYDKIGLLKTQRDPDNQYRVYTQAEVDRLQTIRFLQLFEMPLAQVKVLLDGPAENLTAALKQQRKRITAKRDQLSLLLTTLDQTLEKGVDTMTDDEKFAAFKDQSIKANEQQYGEEIRQQYGDDIVEASNKKFRDMSQAQVAQLTALQQEILDALKPVVGTTDFNTPEAKRVFKLHKQFLQMTWPSEQYSQKAHRGLAAMYVSDPRFSKYYEDGTGKAGAAETLNAIVRHYTR

SEQ ID NO: 1552 - protein, 73 aa, Lactobacillus paracasei
MASVDPEKTLFLDEPMNKVFDWSDSEAPVRDALWDYYMEKNSRDTIKTEEEMKPVLDMSDDEVKALAEKVLKK

SEQ ID NO: 1553 - protein, 236 aa, Lactobacillus paracasei
MAILIQLKQVSKTYGTGHTAVTALYPTDFTLKAGEFAAIIGPSGSGKTTLLTIIGNLQRPSNGQIIVNHQDTTHLNEGQRTDLRFNTFGFILQASNLIPFLTVKDQLTLVDRFNHHHKHETTMSALFDMLGISDLVTNYPAALSGGERQRVAIARALYNDPSIILADEPTASLDTKRALQVVDLLADIAHHSQRGVMMITHDTRLLDAVDTVYEMRDGHLKTLTDEGMRKIKASAI

SEQ ID NO: 1554 - protein, 352 aa, Lactobacillus paracasei
MFLAYKEITHNKARYLLVVVTFVLISYLVFFLTGLATGLARNNRTAIDALPGNYVLMSKYANKNLLSSTVTKQQVDQADTHQAALLGQVSVVAENTKTNQKVNSNIFGVNLSGKLKPPVTSGRMPEDSNEVLADDSVLHYGLHQGDHITLNGSDQKYHIVGLTHDRLFYTVPVFYTTLTTFRQLKYGQSRVQNVSVLISPHAFKKVPAKMEQVTRATLINNIPGYTAETSTFALMIGAMIGIMLLIIGIFMYILTIQKISMYGVMRAQGIRTRAIIAALLCQILMLAVVGVAVGAGLLMLTELILPKTMPFYANSILFFSIATALIVMSLIGGLFSLRRILRIDPLAAIGGE

SEQ ID NO: 1555 - protein, 203 aa, Lactobacillus paracasei
MNQREQQKKATMQRILTTAQILFMTHGYAAVTTRMIADAADVQQPLLYHYFKTKEALYLAVVMHVSEAMAAKIVHEQTDSQHFVANVNRLGHLLTDDNDMNLQLVLHDIGNLNEAARFKVFQAWQKGLLNPLDSFFTVFKQRLAPDYQIREVTLYFLTVLSVYLQPNERPTSNRITFKRQLSLDRALQMFCTGVQQKGTIQQD

SEQ ID NO: 1556 - protein, 148 aa, Lactobacillus paracasei
VRTTFLAKPGEIERKWYVVDATDIPLGRLSSVVASILRGKNKPQFTPNVDTGDNVIIINASKLKLTGKKASDKIYYHHSQHPGGLKHEIAGDLLRDNPARLVEYSVKKMLPTKNTLGHQQFLKLHVYAGEEHPHLAQKPEVLDISNLI

SEQ ID NO: 1557 - protein, 130 aa, Lactobacillus paracasei
VAQVQYAGTGRRKNSVARVRLVPGTGKITMNGKDVRDYLPYENLITDLSQPFGITETTGSYDVLVNVNGGGFSGQAGATRHGIARALLTVDPDFRGPLKKAGMLTRDPRMKERKKYGLKKARKASQFSKR

SEQ ID NO: 1558 - protein, 420 aa, Lactobacillus paracasei
MAITKTTTGSYKVEVFYPKDIRTVLGTDEARYRKTVSTKLEATTLEKMVKKQIRDAERKLNAGTISKNGEILFKDFYKKIWWPLYVAGASGRSRTIPSEETQDNTAKIFRLHLNPMFGEYSMNYLNLNPMFVMQELTIMSEKYANIRTVKSYVNQMFDTAEIAEYIDVNRMEKPLRQISSPKQKRLAERRKALGEYLTADQLIAWLDCAKVDCEVGKLKFEDYLLFLITLNLGDRKAESYGLQWKHVDLREGNVLIIQALKKSGKLGPTKTGKETSHVIPPFLIPMLKEWQEKQDQQLGNVGIKSGPDQFLFTYTNFRGGINQPLHADYLNYRMNSIYKRHADRLVRATPHKLRHTFATLARQGGAGIQEISEALTHGNIKTTRIYVNTPDIIDLDAHDKFAARLAEAREKAIADENKFI

SEQ ID NO: 1559 - protein, 80 aa, Lactobacillus paracasei
MHYTEIDNLVPVILAAQDGDDEAMSKLLDMFSHDFDREAAFGKSYVDPDLRQQLQIKFVFSVPRFDVAKHLAQPSARSKS

SEQ ID NO: 1560 - protein, 132 aa, Lactobacillus paracasei
LSSEREVSRMFIKYMQRVLRNERINIYNAHLNDIKEMPLEYWLLEEIAEPYHLDDFKLTNDEVAKLEDFIEDDQLSEAVATLSTADKIVLYEYYYSELNAVEIGSRTGKSSQGVNKRRRRAIKRIKDAYANM

SEQ ID NO: 1561 - protein, 125 aa, Lactobacillus paracasei
LKIGMLTKRELQIMQILWNSATALSVREITSLSDNLSQNTVQAVLRKLLSEHVIEVDGIGQSGTVHTRNFIASLSQEDYFKKIMSPSALKNLVSHFIDSTTETSEIDELASLVREKQKDLRKNSK

SEQ ID NO: 1562 - protein, 76 aa, Lactobacillus paracasei
MRNITLFTRNGCPQCRMTKRYLDTHKIPFTEHNINEEPQYIDYLKQKGFQQVPVLEADGLDSFSGFRPDALKQLAV

SEQ ID NO: 1563 - protein, 723 aa, Lactobacillus paracasei
MSLKTISPDQVTYYALNNEINIPVNDQIPLNKDKEALQAFLTENVAPNTMQFDSLADRLKYLVDNHYYEADFLNKYQPAFLEKLDQFLSAQHFQFKSFMAAYKYYAQYALKTDDGTQYLEDFKDRVFANALFFADGNEDLAVDLADEMIHQRYQPATPSFLNAGRARRGELVSCFLLQITDDMNSIGRAINSALELSRIGGGVGLTLSNLREAGAPIKGIEGAASGVLPVMKLLEDSFSYSNQLGQRQGAGVVYLNVFHPDIISFLGAKKENADEKYRVKTLSLGVVVPDKYYDLIKANADMYLFSPYSVERVYGKPFSYVDITKEYDNMVANPAIKKYKIKARDLENEISKLQQESGYPYIINIDTANRANPIEGKIIMSNLCSEIMQVQVPSKLNNKQEYEVLGTDVSCNLGSTNIPNLMHSRDFGRSVEAMVRALTYVTDHSNIDVVPSVQHGNHQAHSIGLGAMGLHTYFAKNHMFYGSPESLDFTNIYFLLLNYYTLKASNKVAQERGESFHNFENSKYADGSYFDKYTEQVWAPKYDKVRALFDGIHIPTQADWEALKTSVMKDGLYHQNRMAVAPNGSISYINDTSASLQPIVNRIEDRQEKKIGTIYYPAPDLSNDTMPYYQSAYDIDMRKVIDVYAAAQQHVDQGMAMTLFMRSTIPAGLYPWKDGRTDKMTTRDLNILRNYAHHKGIKSIYYIRTYTDDQEEIGSNACESCSI

SEQ ID NO: 1564 - protein, 326 aa, Lactobacillus paracasei
MAKQYIAINWNAIEDEVDKATWEKLTEQFWLDTRIPLSNDLDDWRSLNHDEQWVVGHVFGGLTLLDTLQSQDGMASLRQNIRTQQETAVLNNIQFMESVHAKSYSSIFSTLNTPAEIDEIFDWTNHNEHLQYKANKINDIYHNGSALQKKIASVFLETFLFYSGFFTPLYYLGNNKLTNVAEIIKLIIRDESVHGTYIGYKFQLGFNELPEAEQQTLKDWMYDLLFDLYENEEKYTNDLYAKTNWTDEVLTFLRYNANKALMNLGQETAFPDTADDVNPIVMNGISTSTANHDFFSQVGNGYRLGQVEAMQDDDYQFSTEDEDHDK

SEQ ID NO: 1565 - protein, 293 aa, Lactobacillus paracasei
MELQTLRNFIEIADHGSITAAARTLGISQPGLSCQLKDLEKELGVKLLVRGNRRVTLTEDGTYLLNRARELTAIAERTKNNLQSKHALGGDLYIGAGETSGKRLVLHVAQELRHQYPGLHVHVTYGSDEGLVANLEAGMYDFILRPGKQQTQYESLLLPVRDAWGILMTSDDPLTDNLLMTPTDIGDSELILPRATHARNTFEHWLGQGMDPAYIVGTYDLTVDALGMTAVGLGRALCLEYLATQSPNTSLTFRPLAPALADPVALVWKRDRELSRIAQRFLSMMKQTIKDSE

SEQ ID NO: 1566 - protein, 634 aa, Lactobacillus paracasei
MTSEVRYQDDLYRAVNGAWTDQAVIPDDKSSTGGFQDLADEVEEKMMADFSAIADGKKTAPDKYFASAVTLYKQAKDFKTRDAAGFAPALPQLHLVAGIKDLADYNQRAAELLQEHLIDPPFNFYVDADMKDTSKNVINLMGPRTILPDTTYYAKGNQNGEQLMAIFKDMMAKLLAYTDLDDATQKATLAGALAFDAEIAKHVKSSEEWADYPKAYNPMPTAEVVEKLKPFKFADFLQKIFKQVPETVVVNDPRFLDEFTQLFNEANFSNYRDWLYVTRLNSLVSLLSEPLRQLGGTFSRALSGAPKAPDQTKHAYRLANAFFSEPIGIYYGRTYFGEKAKADVTQLVQKMIATYKRRLSNSDWLSQPTKDKAILKLDKMVLKMGYPDKPEDVYDLLHVNPDKSLIDNINAMQLVELQYNFDKLTKPVDRTVWNMPGHLVNASYDPSKNDITFPAAILQAPFYSLKQSASENLGGIGAVIAHEISHGFDNNGAQFDELGNMVNWWQKADYAHFNKLTEAMIQEFDGLETEAGKVNGKLVVSENIADAGGLAAALDTAKREPDVDLHAFFINWARIWRSKSRLERQKMLLAVDVHAPHELRANIQPRNLDDWYTTFDVQPGDGMYLPPEKRVQIW

SEQ ID NO: 1567 - protein, 337 aa, Lactobacillus paracasei
MYYVIMKSHDIRENLATEQYLMNSKQFDEPLLLFYYEKSSVIVGRNQNTLEELNQKYVEDHNIVVTRRLSGGGAVYHDLNNLCFSFVVDSDSEEFGDFKSFTQPIVDAIHTLGATSAEVSGRNDMLVDGKKFSGSAMYTRNGKTFSHGTLMLDVDMSVIPNVLNVPEDKIKSKGIKSVKSRVTNLRPYLDKKYQNLTVPEFRDILLTRLFGVDDVAEIKDKEYHVTPEDEVEIKKIYDDVYNNWDWVYGHSPEFTTKKRKHFDYGTIDARFDVKEGKIANVKFYGDFFGPKDVADVAGALKGKPYTSAAIKDTLDAINTNEYFTNISKDDVVNLLVP

SEQ ID NO: 1568 - protein, 75 aa, Lactobacillus paracasei
MAQRPEEITNLLQDALHTQHEVAINTIDRHRFKGRVVDIEAATVKPYNERGVITVATGRGAKRIQAYAISQIKYN

SEQ ID NO: 1569 - protein, 311 aa, Lactobacillus paracasei
MKILNSFSLKPEQRQTLEAVGHTVIDADKLDDATAQQIDVVYGWNAAATRVNFDRLQFVQAMSAGVDYLPLAELAKHHVLLANTSGIHAEPIAEYVLGALFTISRGILPAIRADRDMWTLRQERPPMTLLKGKTAVIFGTGHIGSTIATKLQALGLHTIGVSAHGRPAAGFDQVMTDVATHEAAGRADVVINALPLTPDTKHFYDEAFFAAASKQPLFINIGRGPSVDMAALTQALKNKQISAAALDVVDPEPLPQDSPLWGMTNVLLTPHISGTVPQLRDKVFKIFNDNLKTLISSGQLASHQVDLTRGY

SEQ ID NO: 1570 - protein, 380 aa, Lactobacillus paracasei
MRYQLVATMAAGLESVTTKELKALGIQTRTENGKVYFEGDDKTIALTNVWLRSADRIKIVVGQFKALTFDALFEGVKALPWDHYLPLDAAFPVEGRAVRSQLHSEPDVQAITKKAIVEKMSAVYHRTTRLPETGATYPLEVSILKDIATLTLDTTGSSLFKRGYRIAKGEAPLKENFAAALIMLTNWHPDMPFVDPTTGSGTIAIEAALIGHNIAPGLQRQFTFENFGFFDQPVLQTVKDEAMDQADFDRELDIQASDINGDMIEMAKLNAQQAGLLHSIQFKQLAVKDFSTTKENGVIVANPPYGKRLNDQAMVRQLYAEMGQAFAPLTTWSKYILTSDMGFEKAYGSKATKRRKLYNGTIRTDLFQYWGKPNWHHDRA

SEQ ID NO: 1571 - protein, 76 aa, Lactobacillus paracasei
MQAQPGETRAVFLRAETKAFRNWNVSGLDPNDRTLVIRVKVLTCRFLLLFARLKEPRIFYLQIPYTKIPVIITTTF

SEQ ID NO: 1572 - protein, 131 aa, Lactobacillus paracasei
MDSNKETKFSIQYGPKDILDKKFKNKVRGYDPDEVDEFLDGIIRDYEAFTNEIDRLKEENTKLFSRVDELTKQLSVSKNVSAQTPQTNAAATNYDILKRLSNLERHVFGSKLSDSSVDNHDDGNHSDVDQY

SEQ ID NO: 1573 - protein, 191 aa, Lactobacillus paracasei
MVGKRLWVTGYRAYELNVFGSNDPKLKVLKTSLKNTLMQFLDEGLEWLITGGQLGVEQWAVEVALGLKPLYPDFKIAMMVPFTDFGKQWNEDNQGQLAALRGQVDFSDAVSQAPYQQPAQLQGYTRFMTIHTDAALLVYDPEFPGKAKWDYQAAEAMADRRDYPVQLITMDDLEETAQAMAEAENEHFQND

SEQ ID NO: 1574 - protein, 208 aa, Lactobacillus paracasei
MTIHYPNGNPYKDGTQFSSQAISRPTIYGGRGMTLEEELNISNQYYRSIDKAVVYKKPTPVQIVKVDYPKRSQAVIREAYFKTPSTTDYNGVYRGFYLDFEAKETKNKASFPLKNFHQHQIEHFRRCLKQSGICFVVIRFATLKRLFVFPAGRLIDCWDRQPDGGRKSIPLKDIVTNGFELHPQLQPVIPFLDGVDWLIETKVGNVRG

SEQ ID NO: 1575 - protein, 768 aa, Lactobacillus paracasei
VADNQNMSRMARRREDKFTKESAPKPPKRLWRRILKWTLLAILAFFILGVGLFSWYAKDAPEVTQAKLESGGSSTIYDRSGNEITTLGLESRDYVKASEIPQQLKDAVVSIEDRRFYDEKLGVDPVRIIGAAFNNLTGTSDGLQGGSTLTQQLIKLSVFSTKSSDQTLRRKAQEAWLAMQVQQKYSKDQILEYYINKVFMNYGQYGMSTGAKFYFNKSLKDLTLAQTAFIAGLPQSPAGYDPYEYPQKATQRRNAVIDAMLRDKKITATAAKQAKATPITDGLKPKQQQTNTATNDKVIDSYLTQVIAEVKKKTGLNPYTDNLDIYTNIDMGAQRRLYDIVNTDEYVNFPDDAFQTGVTMTDPNNGQVLAQIGGRKTGDVRLAYNRAAQNTRSNGSTMKPLMDYGPAIEYLNYSTYEQMTDEPYTYPGTSISLYDWDKKYQGRISMRTALEQSRNIPAVKTLSTVGMANAVKFLSGLGINLPSSEQYLSSAIGASVNTVQEAGAYGAFANGGTYYKPYYVSKVVTADGNTQTFNSQGSRAMKSSTAYMITDMLKGVLTKGTGTSAAISGLYQAGKTGTTDYSDAELQQNPALNATGIAKDAWFTGYTRSRVISVWTGYDKPTSHGISYAEQTISQEIYKALMTYTSQSLTNRDWTKPDTVESYNILKGSNPGTAITGGSGDTTKELYVRGHGPSSRKAAVESSSSSSSSSVSSSSRESIESSSSVSSSEPVVSASASSQPSNQEPSASSSEPSTPSGSGSGSGGSNNP

SEQ ID NO: 1576 - protein, 153 aa, Lactobacillus paracasei
MTDSIVPSKRTVHRESWDQYFLELAEKVSERSTCERATVGAVLVQDHRIIATGYNGAISGDPHCDEAGHLMRDGHCIRTIHAEMNAIIQCAANGVSTHGATVYVNFFPCLNCTKALIQAGIKRVVYAQDYRNDPYGEALLKQHHLDVVRLSQQ

SEQ ID NO: 1577 - protein, 229 aa, Lactobacillus paracasei
MKIHPSLAQEEAPFVTDAEAKQLFDQIMALYPDPQPTLHAEDPFQILVAVMLSAQTTDVAVNAVTPKLFAAYPTPADMAAAPVEAIAAIISRLGLYRTKAAYLKALSDILVKEYAGKVPNKAADLVRLPGVGKKTATVVLSDAFNIPGVAVDTHVSRIVKGLGLVPQNATPVQIQARLEALMPPSEWIKLHRSLIRFGREYLRASDPQVPAGTQWAFLETHYLPLGGKS

SEQ ID NO: 1578 - protein, 207 aa, Lactobacillus paracasei
MTDFKTYLEAGQFSLSNLLFDHYATLGLTQTEFMTYLFIDQWQASHHQAPDLKVLAARMNVAPNAIYSAIETLIQKQAIALESVPDGHGRMRDHYDLSPILAKLPTSAGGTPTPATSQANVDAQTNVFNQIEIEFGRPLSPIEQETIRDWLTTDHYLPEVILLALREAVLNSAYSLKYMDRILLNWERRNLKTPQQVQADIRRHQEL

SEQ ID NO: 1579 - protein, 432 aa, Lactobacillus paracasei
MTEQIRIIDAKEHVNEEVKIGAWLTDKRSSGKIAFLQLRDGSAYFQGVVSKADVPEEVFSLAKELRQESSMWITGVIHQDSRSHFGYEIEVRNIELVGDSHDYPISPKEHGIEFLLDHRHLWLRSKRQFAIQQIRNEMIRATFEFFNNEGFIKMDPPILTDSAPEGTTELFETDYFDKKAYLSQSGQLYAEAGAMAYGKVFTCGPVFRAEKSKTRRHLTEFWMIEPEMAFCHQEESLKVQERYVAYLVQSVLDNCAYPLHLLDRDPEVLKQYTKLPYPRITYKQAIKMLQDAGMDVKYGDDFGSPEETYLSDQFDQPVFVLNYPKTIKPFYMLTDPEDDQQYVCADMLAPEGYGEIIGGSERETDYDTLKNAIEHAGLDLDEYEWYLDLRKYGSVPHSGFGLGLERAITWVCKLDHLREAIPFPRMINRLKP

SEQ ID NO: 1580 - protein, 391 aa, Lactobacillus paracasei
VHLAKRILNVAPSATLALSNQTKALKAKGADVIDLSIGQPDFQTPKTIDEAAIAAIQAGNASFYTAATGIPELKQAISDRIFSQDGVRYPASQIVATTGAKFALYALFQVYLNPGDEVLIPVPYWVSYEEQIKLASGTPHLVMPSEGHKVSVDDLEAARTDKTRALIINSPQNPSGVVYTRTELTLIGNWALQHHILVITDDIYRDLIYNGTTFTAMISINPDIVANTVLISGVSKSYAMTGWRIGYAAGPEKLMQAMATFISHTTSNPAAVSEYAAVAALTGDQQIVETMRQAFEERLNLFYDLLAEIPGFDMGDKPQGAFYLFPNIKRAAQLSHYGTVDDFISALLAETGVAIVPGRAFGMPDHARISYCKDLDSLREAARRIREFVGK

SEQ ID NO: 1581 - protein, 162 aa, Lactobacillus paracasei
MRHRRFDWVKFFVITGLIVLIIGAIGVYAKSLSPYQQLRGQAEKIATNRANLKTINGFWWYNRDKSYLTVAGNTKKNQAVYVVIQEKTGKVNILNQKSGITRQQALQQINQSASPKKILNASLGKRGSEFVWDIGYLSKSGKLNYVTYSFRSGEQLNAIKNL

SEQ ID NO: 1582 - protein, 928 aa, Lactobacillus paracasei
MNAETIFAVVDLETTGTSVKDGDRMIQFGCALMQHGKIIQTISQLVNPDRSVPVAIQRLTGLDPNRLVAAPYFEEIAKTLHQLLTDTVFVAHNVNFDYPFLNAEFERVGLPKLQLAAIDTVELAQILLPEISSFRLPDLTSYLQIEHDNPHQADSDAISTAKLLRQLAARFQALPSPTQQALVARGSGLLRETGDYLKAIAKPLKPLKRGFVQVGPLVLRRVPTATQETFASAAYPATDLEKRHLLQPRYRFRKAQARMMDAVFAHAQEGGPQPLFIEAGTGLGKTLGYLLPYAYVATAEHKLVVATSTLVLQSQLIQTAIPTLAAVLGRDLPAVEVKSPQHYIDLNKFAASLHQESPSRQTQLLQMKLLVWLTQTTTGDLDELHLTTYRAPLFMQIRHTGDSGTPFINPYYTLDFYRRLRASIDRAAIVVTNHAFLSRHADLLDLEAPFLVVDEAQHFADNTAAAFAQRIDLAQIRRQLRHLWRLSDPDEDRSLVNVYQNDRQMLPVLAQLNALTTTAQETIEILQHQIYRHFFNGKTTADQGFVSLSLDQAAINWLVTSQTDNIKTLIKVIGRIQVIATKLDADFNGRQHFFLKSDGQRFQALAALTVTLIDQRDRLKLLLARLPELVAGQTAVASLTLRQMHDVSSLGLSWDIFQVGSAIQQLLQRFTAPVFVGATLTTDRSFAFLTAQLGYHDLPETAFLKLRSPFHYRDQAKVLVATDAPAAGAVSAEAYADYLAAAIELLADNRHQTIVLFSSLATIAAVYQRLAHRPIADHKELLAQGVTGSAEKIAKRFAVGDQSLLLGAASFFEGIDYPDRLLEMVILTRLPFDAPEAAITKARYERLQVAGRDPFTEDALPRATLRLRQSFGRLIRTETDRGIFIVLDPRFITTRYGRKMQKSLPNIKPMTLPLTDMPGYIKMWLDRA

SEQ ID NO: 1583 - protein, 1234 aa, Lactobacillus paracasei
MTQFTTSQQAAITHDGHDVLVSASAGSGKTTVLVERIIQKILKQHADITRMLIVTFTRAATAEMRTKIQTALKKALTERRHELSGEDRRHLANQIAMVNAAKISTLDAFSLQIVQTYYYVIDLDPGFRLLTDETERYMLQERVWDDLREQLYASDEAPAFEQLTANFSGDRDDSGLQDLMFELIRQAGATTDPKAYLEGLATPYAPEKWEATFSQQIWPRVKGQLLQIATSLTQASALANQLPNPIWYQQIQADLAPLQTLLETNAPTYDTVRSVLISHEFAAWSRISKGLDDADKDTKNAAKDLRDAAKKTWQNKLAPTFALAAEQIGDLLREAQPLVATLANVALKFEDALIAEKAARHVQDYSDIAHNALRILQQKDPQTGAPIADNYRASFDEVMVDEYQDISPLQEALLAAVSTTTPGDRFMVGDVKQSIYGFRLADPQLFIHKYQTFQDAPTDPAAPERIILAENFRSTKNVLAFTNLIFSQIMDPEVGDLSYDNAAALKYGALDYGDAHPAVKVLLYSKATSDEDSSDASELPGDADDNEPVDIATGQTQLVLAEIQRLINDPDAQLWDRQAQEYRRIHYRDITLLTRQTSQNSLIQTQFAAAGVPLFVADTKNFFKTTELMVMLALLKVIDNQKQDIPLVAVLRSPIVGLSADQLALIRLAAKQVPYYDAVTAFLQAEPKTPLAQRTHDMLTHFFNQLSHFRDLARENDLVTLLWAIYQDTGFLDYVGGTPGGSQRQANLQALIDRARTYEAGGFKGLFAFIHFITLMQKQDQDLAMPAQVDPDNDAVKLMTIHKSKGLEFPVVFLMQANKHFNMRDQTGTAILTKQGIGIKWLDPETRVEYELPQYQAAKAARQNQTLAEEMRLLYVALTRAQQRLYVVGATMSGNQLTSADKTVEKWAAAAEGEALVLAPQVRSGATSYLDWIGPALIRHPQARGLAETTIKPALVGDETEFTIEIDVNPQVTPTATPEKVSDDSGTMVDLSAWFKKAYPFQAATTTTGFQSVSEIKRAFDDPDTIDLVNADRFLGPKPPMRDLTAPAFLTETPSGISPAAIGTATHLLLQLVDLAKPITMASLRALRDQLTTTQVIAVDVAKHIDLTALIRFFETDLGRLLLAKPQQVHREVPFSMLLPADQVFEALADDPGEDVLIHGIIDGYVSDEQGVTLFDYKTDHNPNTAVLVDRYRGQLNLYAQALQDLQPKPVLHRYLVFLRTGTVVDLVASGAGK

SEQ ID NO: 1584 - protein, 344 aa, Lactobacillus paracasei
VLDQYLTQLRDAGQTLADVTAADVAAAVPPLVAAITKRPGYEILGSTHRMAYLTSRLSRLLIQVLTNMRQQQRRTGFRPMRTELQFGRIGDTRGLPGLSWPLPHGGRVNVRGKIDRLDVYRESDAQRFMVVDYKSTQHRFDDSDAYYGIALQMLTYVEAMANVPADPPFVPAGALYFHLQDPKFKFSTDLDLDIDRLKAFKYLGFLVAKDGADLAAVDKTISAETGGRSMMVPLGFKKDGAFNYNQSNILTPEDLSAYLLHNQALIIDAASRILAGDIALAPFQYGQESTVISNSDYQSIMLFDPATGFDHYNHVPKLKRKEVLGRVTTDPTQIPHHRQEDSQA

SEQ ID NO: 1585 - protein, 840 aa, Lactobacillus paracasei
  misc_feature (822)..(830): Xaa can be any naturally occurring amino acid
MGLQFILGDATTDHAGTMATMVQANLQADSQNQIFYLVPNHIKFEAEVDLLKRLRAQAASVNGVYAQNRVQVLSFSRLAWYFLKNTALYQQPRLDRASNTMLVAKILGESKEELTIYAGEAHNTGFVTQLADQLSELVTGRITAEDLNTTVAALTPGDRHRAKLRDLGIILDHYEAEIGPYATNASLLSGLQQVMRNQDLSHTFIYLNDFNVFSASETGLVETMIETAAEVTVSLVLNKPYPAAPPVAPNLFLPAGRLYHRLYQKAKTMKVPIRLDRFAKPRPLSEGMKHLADWWQTSTNLQPQAPAQTAQNKEVELAVATDPYHELRTVARQIYQAVRQGARYRDFLILARRLDPYAAVIPAIFEEFNIPQFTDLERPMKDHPLVVLIESLFAIQDHDYQYQDVMRLLHTELLLPENMDIAAFRDALDTTDNHLVRTGITGKKRWTQTDPWRYFQRNPNADDSQLDPEADKTAQINAIKTLVADTVPQLLRQWQTAKTGREAAASLYQWLQTTGVIDQLNVWRQTANADGDLSRSQANEQAWDTFTQLLNDYATILGEADFNRDQFRELLAAGFASATYTQIPSTLDSVVISETGLVRLAKAKHVYVIGATNTAMPDVPNDSGVLNSEERQLLAAQLPDDRFLPEQGPTTTLGDPFINYLGFMAASEKLTLSYPMQNTQENSENQASPYFRQLAQALQLTPATWAPAGLGTSLKAVLGSPRAMLSDFVRAAGEAQHQKLPLSRSWQGVLASLKQTKLAPLAQKLAGSLTYQNDPGRLDPTLAVQLYGRDMNVSVSRLETYYRNQFEYFLKYGLLLQPRPEXXXXXXXXXVFSMRCWINI

SEQ ID NO: 1586 - protein, 311 aa, Lactobacillus paracasei
MEIGTGKSYAKIILLGEHAVVYGEPAIALPVKSVGLSARVTPQPDGRQTVTSSFFTGNLNAGQLTNFAGIAMLIRRLLIFFNAKNQGFHLTITSALPSERGMGSSAATAVAVVRAFYDAFQTSLSHDTLLNWAAVSEKALHGNPSGLDAATASAERPQWFVRGKAPRSIMMPRNGVLLIADTGVAGQTKIAVGAVADRLKQDPKMYRPLIKDIGDTVRQAALALAQDDIITLGQLFNRDQADLSALGVSSPDLDRLINVAIDNGAYGAKLTGSGMGGCMIALAASDQAVAITTALKAANAAKVWEYHFESK

SEQ ID NO: 1587 - protein, 334 aa, Lactobacillus paracasei
MTTYARAHTNIALIKYWGKANRKLMLPATSSISLTLNDFYTDTAVTFDPSLNDDRFMLNGEEQNPVAVSRFLDRVRHLGKISTYAQVTSLNHVPTAAGLASSASAFAALATAASRAAGLNLSPTELSRLARRGSGSATRSIFGGAVIWHRGHNDASSFAEPLAIQPSLPLRMLVVTVSAEKKAVSSRKGMANTVATSPYYEAWVASNESLIEPMITALAEDDLALIGKLTELSSMRMHAAIMAEEPPFTYFLPETLRAWQLVQEQRALGIPAFATMDAGPNVKILTTEPYVDILLTALRPVFGDRILSTRLGPDASIITKEQFDDTKSAIASQG

SEQ ID NO: 1588 - protein, 344 aa, Lactobacillus paracasei
MTQSQQSHRKDEHVFLAEKYFQSVAHAGFDQVRLLHRALPETTMAAVDLKPDLPFNWQWPIYINAMTGGSPQTGKLNAQLGQLAQALGVAIASGSQSVALRDPQLVPTFATLRDHDPNGFILANVGAGHHATAAEAAVAMLKANALEIHLNAAQEVVMPEGDRDFMWQANIKSIIATSQVPIVVKEVGNGFIREDLQSLQQLGVQFVDVGGRGGTNFATIENARRSGHDFAYLQDWGQTTVESLLEARGLGLAMLATGGVRSPLDVVKALRLGAHAVGMSGLVLHHLIQTGYEATLAYFQNFLHQLRQLYALLGVTNWQELQEAPIVLSADLEHYRQARGLPGI

SEQ ID NO: 1589 - protein, 443 aa, Lactobacillus paracasei
VQLPEAFKEKYTRLLGDEAAAFLATFEAPAESGFRRDPAKPWPLDESLTEPIPWSPWGYYGKVAGNDIDHVAGLVYSQEPSAQFVGTVAAPKPGERVLDLCAAPGGKSTQLACYLGDTGLLVSNEINGPRSKVLSGNLERWGTRQILVTNNDPDTLAKAWPQMFDRILVDAPCSGEGMFRKDPDAIQYWHADYPAQCAERQKQILKTAVKMLAPGGTLIYSTCTFSPEEDEQIIAWLLTNNAFTLTPIKQYPGMEAGRPAWADGNPELAKTVRLFPHRLRGEGHFVAKLKLAGAPASHQPARLPLKPLAKPAKDEVDAFVATSLTKQPGGLFYRHGDFLSILPTTMIPFEHVKVVRAGLGLGSFRKKRFEPSHSLATALNPDDFQTVIEVDADGYARYRHGETLPSKVSGKRFVLLTFEHKPFAIGKLVNGTIKNYYPKGLRV

SEQ ID NO: 1590 - protein, 318 aa, Lactobacillus paracasei
VKKLFLIDLLWIGLAILAGLVWSQHDQNEYASQLDHLGMSETAQEYVTTSSRSITTAISELDKTDFKGYQVQFVAKQVVYVYQRGTVASLPLDSGQWFSAGDFASSLPVTVVGRDLADKLYTGSNNQRYLQVNGQYVPVLGTVGTRKGSPLNKVIFLNASAQTTNSKLKLKQVKIYVDGASQHSKALKTAFKAKNIHRVHFSDSNASTWWHAYGQTALFSLFLLLGAGLLTMLMVVLMGPLQTAGLDLNMRARYLRGVLSSCGGHIGVSLFLGGLFANWWFYFTTRTNIWVFLVVLTIAAIFFLRYLIHRKDKASATT

SEQ ID NO: 1591 - protein, 247 aa, Lactobacillus paracasei
MDYWSTLNRLAKQYARIGPLKSQLTAMKNWQASIAAGVLPAHALPWLGLSTPQIDAALTQPQAQLQELLQLDHLLHNFRRYIAFHDGMWSFVHEDLFATWHRLYGPQRYLEVAAGNGYVSAGLRAQGDKTITTDAHTWTKENVTGRQPLVPVKTATANAALFLYAQQVDAVVMAWSPDKDPNDVRFLHIMQHYFPTKQLFVIGERNGATNSRLFWQEARTVPDRRLFALNRAFGHFDAIHERVYRLQ

SEQ ID NO: 1592 - protein, 116 aa, Lactobacillus paracasei
MADTSDQAASQDQAYFDKMKQQILDALETVIDPELGVDLINLGLIYGVDLDESGKCTVEMTLTTMGCPLTDMLDADIKRALTTIDGITSVEIHLVWYPAWGPERLSRYAKMALGIH

SEQ ID NO: 1593 - protein, 62 aa, Lactobacillus paracasei
MPLVHIDLIEGRSPEQLKALVKDVTDAIVKDTGAPAEHIHIVLNEMAKEHYSVAGVLASDKA

SEQ ID NO: 1594 - protein, 264 aa, Lactobacillus paracasei
MTSGKQIINRFEDFAPLSLAWERDPSGLQLGNPDKPVKTVLVTLDVRPEVVTEAEAIHADMIFSHHPAMFRPVHNLDLRVPQNAMYAQILKDDLLVYAAHTNLDRVQDGMNDWLAEALGLSQVVPFINEGEGANMGRIGLLPDKIRLEAFVEQVKAAYNVKGLRVVARDLDRLVQKVAILGGDGGDAFNDAKQAGADVFITGDVYYHTGHDMLAADLPVIDPGHHIESIMKGKVATLINEWADAEGWDVKAIPSKLSTDPFTFM

SEQ ID NO: 1595 - protein, 236 aa, Lactobacillus paracasei
MDHIHLSKRLQAISSFIEAGERVADIGTDHAFLPIYLVQQQRISFAIASDIGAGPVAIAKQNVADAGLTAQISVRQADGLASIMPDDAISTVVIAGMGGQLMTDILEAGQPQLDGTETLVLAPNRHQYDVRLWLDQHGYGIIGEDIVEDEGHIYELMAAGRTRPDVPYSEADLRFGPILRRQKSPTFMKKMHREAEKTEAVLEGLADAQMVPLEKIREQEKILSLIKEELDAHDER

SEQ ID NO: 1596 - protein, 422 aa, Lactobacillus paracasei
MADKKTATEVDKTTKKTTAKPAAKTAAKTTAVKAAAKKTTAKKTTVKKTTASSKRTTKTTTKAFDDAVKAVIKDYKKKKQITEDDLTDKLVKPFELKSGAIDDLMQKIEDNGIAIVDENGEPAAISLKKQKKVSKKEMSDMSAPSGVKINDPVRMYLKEIGRVSLLTADEEVALALKIEQGDQEAKQRLAEANLRLVVSIAKRYVGRGMQFLDLIQEGNMGLMKAVEKFDYRKGFKFSTYATWWIRQAITRAIADQARTIRIPVHMVETINKLIRIQRQLLQDLGREPTPEEIGAEMDMPTEKVREILKIAQEPVSLETPIGEEDDSHLGDFIEDQDATSPEDHASYELLKEQLESVLDTLTDREENVLRLRFGLDDGRTRTLEEVGKVFGVTRERIRQIEAKALRKLRHPSRSKQLKDFLE

SEQ ID NO: 1597 - protein, 595 aa, Lactobacillus paracasei
MIPEATVDKVLKAVNIADYIGQYVQLRKTGQNLFGLCPFHEEHTPSFSVNEPKQIFHCFSCGRGGNVFKFVMDYDNATFPEAVKKVADFAGMPLDVQVGHAAPVDPEISKQQHILQDTADLFHHILMNTEKGQTALDYLHKRGLTDDTIEAFQLGYAPEERNLLVAFLNNRKVDYQDQRASGLFVENQEGKLFDRFNDRVMFPLTDSHGQVIGFSGRILSKDKTQAKYLNSPETKLFNKRDVLFNLHRAKADFGRDGAPILFEGYMDVIAAYQAGVKTGIASMGTSLTTEQVDIISHLSKRLTVCYDGDEPGQKAIERAVAMLADHPRLQTDVVVLPDGMDPDEFIRARGAEAFQAQVKSVLTPTAFILQFLARGVDMNNDQAKLTYLNAALKTIGKISNPVARAVYVKQLADTTGVPESALNQSLPAPQQAVQQQSSAPVSYQTAPVNQPVRPIDRYTAAQRQLLYYVWHDDLVMQRLKNTAFTFPAPHFQTLFTGWLDFLHEQPDGELAGFLDRVDPDLSGVAASVAMQVLPEATEATIDELIQTITSASTVERLQAIKQAITEAQRLGDKQKLGELTVQYVNLMKLLKQQQG

SEQ ID NO: 1598 - protein, 689 aa, Lactobacillus paracasei
MTHQYLIEIGLEDMPAHVVTPSLQQFHDKTVAFLKENHLDHGAIDQYATPRRLALLIHDLADKQADVEEDVKGPAKKIAQDADGNWTKAAIGFSRGQGMTPDDIVFKTIKGVDYVYLHKAIKGKTAAAILPGMLDVIKSLTFPTRMKWGAYDFEYIRPIHWLVSLLDDAIVPMKLLDVDAGRTTQGHRFLGRPVTLGNAADYVAALKAQFVIVEPAARKQLISDQIHQIAADHQWQIDLDADLLEEVNNLVEWPTAFAGNFDEKYLKIPEAVLITSMKDNQRYFYARDASGKMVNAFIGVRNGNADHLANVIAGNEKVLTARLEDAAFFYAEDQKRSIADDVDRLKAVSFHDKISSMYDKMARTRIIADLLADRFDLSATDKSDLDRAASIYKFDLVTSMVGEFPELQGIMGEHYAQLAGEKPAVAQAIAEHYEPISADGALPESLVGTVLAIADKFDSLMSFFAVDLIPSGSNDPYALRRQAYGIVRMIAKHDWPFAVAELQTTIADALKAAGKTNNLDFAAHQQDLNAFMIDRAKQVLQGQKIRHDIVDAVTVRADADLAGILDAAKILSAHADDTDFKPVMEALGRVLRITKKQQVKVDVDTAKFENPSEGQLYDATVATAKKFDDEPTEADYQALKALADPINAYFDATMVMADDQAIRQNRLAALLQLAALIKQFGDVSQVIVK

SEQ ID NO: 1599 - protein, 298 aa, Lactobacillus paracasei
MTKKMDIQTMILTLQKFWGDKGCMLMQAYDVEKGAGTMSPYTFLRAIGPEPWNAAYVEPSRRPADGRYGENPNRLFQHHQFQVVMKPSPENIQEYYLDSLAALGINPLEHDIRFVEDNWENPSMGCAGVGWEVWLDGMEVSQFTYFQVVGGLEVSPVTSEITYGVERLASYIQDVNSVFDLEWGDGVLYGDIFKEPEYEHSKYAFEVSNQEMLLKFFDAYEKEAWRLMDLGLVHPAYDYILKCSHTFNLLDARGAVSVTERAGYMSRIRKMAHKVARAFVAERKKLGFPLLQHQTEVK

SEQ ID NO: 1600 - protein, 389 aa, Lactobacillus paracasei
MASIRSYKLDSGKRRWKVSVYVGIDPKTGRKKYVVKGGKLTRQDAIKAGRDLEKAVQNGELTAAPRPDKVARKFKDVYEEWLKSYKLTVRESSWSKTRDCFNLHILPDLGDMYIDKITPQDVQTAVNKWFKQSPVAFKRYFVHINRILTYAELRDYIPHNPARRIILPRVQDKIGSTNDFWDRRQLEVFFNCINPDRELYKYVLFRILAYAGLRIGEAMALEWEDIDFKKRLISVNKTVSLGVHGKLIVNPPKTRASRRDVPVDSETINWLKRWRIEQPDYVYGYVRLSTHHQLLFTTKTGNRFRVDKPRMWLSTIIRNNNLAPVISLHKFRKSYISNLLIAGVAVSTVQKMVGHTDPRITLQIYARVHQEQEVEAAEKLAKYLKTGKK

SEQ ID NO: 1601 - protein, 108 aa, Lactobacillus paracasei
VVMTAKEVHQGRIDRGLTQGELAKEVGLSVGSINSYEHGTRSITKAAESKISLAFKRIKPLNEQPAQATLLAELSDANTRFQWEGTLLRPTEVELIKVIAKTLVDQRK

SEQ ID NO: 1602 - protein, 74 aa, Lactobacillus paracasei
MSKKIDQARVIEQSYVRRDLMRAVSELLDSASDKHSTDELIDAVASIQSVTMALEHKSAVCGLPGLRGWDGEEY

SEQ ID NO: 1603 - protein, 385 aa, Lactobacillus paracasei
LRFKTKLVLTGVAIMAAFSFALPTPVKAAKNDIGVDWSVYQGNSGKTVEGDRFAIAQIGGTQGGTIYNQSTYSSQIKAANDDGLRVHSYLWYGVGGSSDIGRQALDYFLPRIQTPKGSIVALDYEDGASGSIEANTDAIIYGMQRIAQAGYTPMLYSYKPYIVAHVDYNRVLSQFPNSIWVAGYPDYQVRALPLYSYFPSLPGVAIWQFTSMHALGGLDGNVDLQGVTDNGYSKQPAQATTVPSTPSQASTSSDTDYAQNGIFRPSATLNIRTGAGTGYASIGTYAPGESLMYDHVYIHNGYVWARYLSYSGRYHYICLGVMGGESYGSRSSSYSAPSHTYYTVRSGDSFWSIARKYGISMYTLAANNGKSIYSLIYPGESLYIR

SEQ ID NO: 1604 - protein, 110 aa, Lactobacillus paracasei
MKDLIVQIAVAVIPILGAWVAKVLLANKQALTLVQVLEPLAQAAVTASEQSGVSQAVTGAVKKSKAVDSVETQLKAMGFTKVDQQTVENAVEKAYADLKNTVEATYTKGA

SEQ ID NO: 1605 - protein, 71 aa, Lactobacillus paracasei
MLMEIKEDIAQIKQQLTGLPSTDDKADRAYNASQDNARDISSLKKMVWSIWGVLGGTIGVTLFVYIIEKYL

SEQ ID NO: 1606 - protein, 43 aa, Lactobacillus paracasei
VTDYDQCVLFYSWGIDLTPYVPVMITPDEYKQITGKDYVGGKS

SEQ ID NO: 1607 - protein, 96 aa, Lactobacillus paracasei
MKIKIWLDEQNRLTNWAYEAEDAKVGPTEDGQQIIEADDVSQFFEGHASLVDGKIVADEGYDPANDHPLPGPSPEQQMIAALTLEVAHMKAAKSSD

SEQ ID NO: 1608 - protein, 1123 aa, Lactobacillus paracasei
MEYYFSDRKFNIMGVARTTGKGEWLVSADSEVKTTDDRPAIALTLTIPFKTEQEQAIDEMAAENNFVLYQDEEGNGHQMVIASVTHDTLAHIHTVVCTDAGNDLMNEVVGAYTADKAYTIADYITRFTNDSGWEIGINEFPTDVRTLTWTDEDTSLSRIKSVAKDFDAVLSFGFVFVGTTAVKRVINIRHEETSDSLISFEMNKDINNIVKTVDIYDMETSVKAYGATPDGSNDPINLIGYSWTDPTGQFVLDQYGFLHDTIAVQKYSRLLSNDNPNPTQSDWNRVKTFDSSSQAALLQAALADLKKYNHPNVNYEVDLANAPYVPLNQTVHVVDENQNLFLSAKVLSVERSRAGHYTKLTLGDYANEQPNLYSALKDMAVKIENIPKTVQYYPWVRYADDNQGTNMSAFPTGKKYMAIVWSNKSSVPSDNPADYAGQWALIQGKDGADGVPGAKGADGRTSYFHTAWANDVSGQSGFTVSGGDGKKYIGTYSDFKQADSTNPADYSWALFKGEDGDVGPKGDQGLPGAKGADGRTAYTHFAYANSQDGNTDFSTTDSNRKYIGFYSDFSSGDSTNPSNYSWSLIKGADGADGKDGVPGKAGVDGKTSYFHIAYADSSDGKSNFSLDTPGSRKYIGSYTDFTQADSTNPSAYSWQLVQGPKGDTGKDGVAGKDGVGIKSTQIMYAQSTSGTATPTTGWTAQVPTLIKGQYLWTQTTWLYTDNTGESGYTVSYNAKDGNTGANGIAGKDGVGIKSTVIEYAVSSNGVTKPTTGWSATIPSIAPGQFMWTRTTWSYTDGTNEVGYSVAQAGATGPKGDTGPQGPQGPQGPQGVPGSKDVPYTYIQLGTPASPKKGDLWWHGTTLNDATALQYYNGSTWVDQSIQQAVLSIKKLQSIEVDTSTINSPTINVPFSHVSIEGSNVKSTGTLSLNGASYVISGNVEDTNGKPNGQNYHTEVNPDGLLSYITQTDGTTQMRTSRISMGVLELTDLVSGLGNSAKYITSTFNAHDAVDYYHKDSGLETNDVKNLNISYSRKGPNVTIGIAFEMKTGNGWVKIANIRPGYSPFNNDDAARLLGSMSYTGAACELYVSAGGIYIIPWRGQGGYAGSLSFITHDAYPTNDAVVN

SEQ ID NO: 1609 - protein, 645 aa, Lactobacillus paracasei
LKQAGMKITYSGVDITQWMYVQMVERDVGTNHVNTMQKVGISDGQMLQYMSRDVKTIVVTGIVMNDNLVPLRRSLAAAIDTDEPQQLIFGDEPDKYYLAIVDSQPTFTEGFRSGTISISFVCPDGGIAHSVATQTFDNKDPKWTGSPLNLLAGTSDQETSATVDLNNWNAPSQHPNISVTSGQKFAYQIFITNHNTVDLTAGIDAFSGTAWKVTYVGNIIKAGTSGYSSVTFTIPSGVDNIVANAARLVTRVPSSKTTVYWQEEKLATGTVVSPWSPNPADPEYYTNTITVHNGGTYPVEPVITATMHADNGFLGFANSQGGVLQFGNPEEVDGYTSEESEVALNLAAVQGSHMDNQAASNNLYWGDNPATPNEQIGNAIWTEDSYDGWKVEPNWPSITGDHKYWNGPSIKHDLIKTHNGNFKSNLTWDVMTRFQTGVAQVGALETTLESDGKPIFQMILKDNSALSDQIWWMCYYKNQLVVNEQLDRSIFTNDKFIQLELQKFGNSVVFRVSPWVGNQGRETTITRQFTFADAASVETKQFSAWFMRDKTWGESTMYLIASTVKWQNVSWYTDIKNRFSNGNVIAIDVANTKTYFNGNEDRTLHTLGNQWDKFLLPPGDTIIQLMPSSWAQPFACEVDLKEAWL

SEQ ID NO: 1610 - protein, 1525 aa, Lactobacillus paracasei
VIEVAQQINATMSTKIALDLLSASESVKSLTAVVRSSQNAWKAQEAEMKSAGDAVGAAQAKYDGLGKSIESQQSKIDALKAKQAELKGNTADVAQQFLKYQQQIDGATKQLASMQSQQDRAKQAMDYQKSGLAGLQQEYTAAARANQAYVTRLEAEGKQQEANKAKMDGYKSSITNLNEQLSKQSAELDKIASASGKDSDAWRTQKTRVDETATSLAKAKSSMTGLQTEMDKANPSVFNRVKEAISGTNKQAEKTPGLLRKIVEGGLITNALSSGWQTLKGRIEEATAAGMEYEKQQDQMNAIWLTLTGNAEKGQAMVDMTNKLAVKFGQDTDLVNELNQQFYHVFDNQPKTEALTSAFLTMGDAIGLSSDRIQQVGLDFTHTLSGSIVQLGDFNQLTDAFPMMADAMLEYEKKVQHNSQLTMTDLRAQMSAGKISAQDATNVIEELGQKYTKASDNLMQTIPGMTRVIKSRIPALIGDIEKPFLTAQNPVLGAISRWSQDKNTDKEFGKLGQAMSKGLSTITSAFAKAFDLSSGPKAMDKMIGKLSDAVTKVSQSIASHAGQIKTFFTTISTTGSAMAKISWVALTSGLKVLNPLLKSLGDFADKHPKLFGDLAAGFIALNLAGKVLPIAAIAGFTKTIGGMYSGLKKLANSKFAEIIKTKLGKLNSGWIGKSMATITIAYDAISDIKDLTKAFSKGGTVGQKFSAVGESAGTLIGGGIGAFFGGPLGAAVGATIGKTAGKWAGDAARKFTDGWNAKKKPANSWLGGLGWDARQMTNNVVKWWDGINKSTDAAQKKQQKQQEAANKQAQKEWNDFWKGVGKGWDGFLKTVNGWGKSLSTAWSKVWNPISKKMSSIWKNIVKIAKTGLDDLKKIIVYPVAFIVGLFILAWRKVEKPFKDVWNGLVKFVKPPLNTISKTISSTTKGIQNAWDKTWGAISKFFSDTWNSIVKIVSSSTNWIVKNVTNFLNAVQKVWDSIWKAIFNFFGDIWNGIVKIYNNASNTISKGISATLNFIQNVWNKTWGAISDFFGNIWNGMVKFFTPIIHGMADTIGSVIKDIKNVWTDVWGGVGSFFSGIWDGIKKAAQSGINFVIDVIRTGLGAVNGVLGFFGVKKVGLPSYVHFAKGGEVGKDGTQLAMVNDDGSNNYKELIHKKRTNQWIYAEKRNTILPLETGDRIYNGKESKAIADMYGIPGFAQGGIIGSVWDGVKDASSWVVDKAEDVGKWIGDKFEAIVDWIAHPVKHVTDLVEKSISGLVNLAPVKAFGQLGEGIFKHAYSGIGAWIKKELKKIEDSMANPGGSGVQRWKPYVIRALKANGFDASAYQVAAWMRVIQRESNGNPRAINLWDSNAKAGIPSMGLVQTIGPTFNAYKFPGHNDVYNGYDDLLAGIHYMKAIYGSGSSAFARVSGPEGYANGGLITQPIHALVGEDGPETILPLTKTSRAWQLLGQAVTNINHNLGNGAVAESESSGTDDLGKKLDNIADLLTKLSFVLQVGDDQFYPKVAPKVKQYNDRRDRFNAYWKGGTV

SEQ ID NO: 1611 - protein, 51 aa, Lactobacillus paracasei
MKKQAVMYFHWSIQDFDDADYFEMLEMMSAKDKKDRPIDPAIMWKQYQEKG

SEQ ID NO: 1612 - protein, 116 aa, Lactobacillus paracasei
MKIKVSQLSNRVHEVKTSNRNMEKMYDLQLLMAKADDVTDMEPVEIIKMQRDMLHDSIDFLTTVLNLNKQEIEKLGDLEFADTIQAVNYTFERMMGMSDEDIDLAAKKQDASKSKD

SEQ ID NO: 1613 - protein, 203 aa, Lactobacillus paracasei
MATVGLYQIQLALVDAQQKLISGTGAGLGTDGIYTVDHKDLGAKTANITNLAGTIAKTYGNNNVQDVTVGTSEPSVALDINNLDFAIKQQVKGFVSDSKGGYTDENLKAHVALLITTQTIDRLHFVYYGFGDGIMTETAANIRTDAAAEQRTDDTLTYTALTTMAFNNQPYKIYSDLDSGFDKANMYKEVFGGYVLPTPPAGE

SEQ ID NO: 1614 - protein, 126 aa, Lactobacillus paracasei
MSAVGDAVTMLTQAKIANINAVKGNNLPQELVDNLNKTVVLITDAANDPTAYGDNDFWALNQEVEVQIWYSQELETDPETIEIAMMKAFTHQHWQVAAVRQRTLDPDTQQLFNTFYFSRTKNIGGI

SEQ ID NO: 1615 - protein, 139 aa, Lactobacillus paracasei
MEMDEALEQWLEQVSKAAELSISDQEKITKAGADVYAKKLAETTKEKHPNTKGTGGKYGHLSEDISGKKGDIDGDHNGSSTVGFGDKAFVARFLNDGTKKIHGDHFVDNARDDAKDAVFAAEQDKYEAIIAKLNGGGDR

SEQ ID NO: 1616 - protein, 114 aa, Lactobacillus paracasei
MVSSFKPSDFSRTVELGSPKSHTTGAGLNITSFVPAYKLHYKQQKRTLTQQYTLVGTRLDNSITIIVRHDARNIEQKQARLDGITYDISDISPDDSNNAIRYDYLTLTKVTKGA

SEQ ID NO: 1617 - protein, 96 aa, Lactobacillus paracasei
MAEATIDPNKIASDLMTELNLDESELPTITSLVNTAINIINRSSDAPEDDTLTIPAIKTLTQATYYDRSLTNGMPKGLLMMLAHLQASSGGDNNGK

SEQ ID NO: 1618 - protein, 643 aa, Lactobacillus paracasei
VKNEDIRTFDVKIRAETGLANENSNNQAENGQNMDISGVAAVFNQPSIKGDFTEYVDQNALNNVDLSQVLLLYAHDFSNILARVDVGTLQTSIQPDGLHFNAQLPDTQLGHDTYTNILNGNIRGMSFGFKIAPGGDSWSVNSQGNTIHTINKIDQVFELSLTPIPAYTETSVQVQRDLAQFLSSKKEVVKMAEKPEEKEEQSVDDQKRSIEQLQQQLSDLKAQVKTKVVIDKPEEEKRDATPDMASDETTAQQTSGDLVSMIATLQAAIQSLSQQLADQQAPSQMDDDVPDDDNNVVLDEAKPKQETAKTEKHDGNPDEVTTAQDVEQENKRDGAKKMAKNLTADKVEDEEVRDFKEFLKTGEIKRDSTGFDSNAGEAVLPSQVLDIMSQPKDPAQLGGYVTKVQVSAPTGKIPVLSKASAQLVSAAELADNPQLANASLTQVNYDVQTLRGSLPISLEMTQDYPNITSLLTQYVNDIKDQTEQHKIGAVLQTATPVAATSIDDIKDAFNVGLSNYTDRMFVVSESFFAAIDKQKDAEGRYLLQDSITSPSGKQLFGAPLVVVADDVLGKSGDAKAFIGSVKNFVVETVKGNINLSWQRNENFEQVLLAALRADFKAADTAAGKFITYTAPVTPTVSTATSGN

SEQ ID NO: 1619 - protein, 366 aa, Lactobacillus paracasei
MSIWNPYERMQKRSMTIPSTNLSSYIISGGQVLPNHLVDASTALNNSDLYAVTNLLSSDIASASFEVAAPFDKVINNPNNLISPFNFWQSAVVQMLLTGNAYIAITRDSNNVPMRLEMAPAAQVVVTLADSSADISYAVNWGDERGTINYPSANMLHFRLMASGSNGQQYIGISPLESIASQVNIQDYANKLTLSTIKNAINPSTVIKVAEGALSPEEKEATRKAFENANTGDNAGRPMVLDQLYDVQNLAINADVSKFLTSNDWSKTQIGKVFGVPDSYLNGQGDQQSSLDMTKSLYSNTLRRYVKPIESEMTAKFGIPVNIDESQAVDADNDLLISQIQKLLSGTTPAITPLQAQQMLAKRGVI

SEQ ID NO: 1620 - protein, 60 aa, Lactobacillus paracasei
VSKLIMLKELLPTVLFVSGLIAIVTSAYLFNSTIGTLVLGSVLLFCGWLLTPTSKAGGSR

SEQ ID NO: 1621 - protein, 630 aa, Lactobacillus paracasei
LVDYDLTLPDWTVERAYKQQRDNGAYDQIADKYHDPMTAYAFQVLEGTTMAGKDIKLACWRHLQDLTRISSDDFPYTYDLGKCHEVLNFASICPDVDTGKPLPLMLWQKALLCSSQGWRNEKGERRFHRVQFSVARTNGKTYITNILLAYDYLIASDGMYNQDMGYIAPVVAQSKKGWRYIQLTFDRLGELTDVKRTYKTQQIKTLDDVVRSKKTRNQLLRLSHESGQFDSYHFRLAVADESGDDGRIGTIKENIGKITSGQVQVYDHQFWSISTAYPDSTSSFYLDEKLAREAMQKDYSRELDDVLLINYSQDSEDEVDDPSSWTKSNPILELKKDTMLPSLVSERDKKKLDGTLDEFKNKNLNMWIKASDNRYLNIHDIENAVANKPPFSISGHDVYIGFDLSKLADDTAVAFIYPYQLAGETHYYIQQHSWVPLSHTGGSIAEKEKQDGINYRQAEQLGFATIAKGRFGYIDEDSVTTWIMSYIEENGLNVKFFVFDRWGTSDVLDKLSQEEPFPLMPLKQTSDKLDKPTHEFKKAIREGRVHYDDDPILKYALTNAVIVGSSAGIKVDKDRATSKIDAVDAVIDAFSRAYYAFSDFDPDADNDKNRSPLSGMSDEERHKFLMNVGF

SEQ ID NO: 1622 - protein, 154 aa, Lactobacillus paracasei
MGRKMKITQDASDRADQRARTEELAKKTSGMEPLQVTPPRFLQGYAYTAWRELVPLLNAAGLCKQVDKPLVIALCQQIQLSRQAYEDINENGLSMGTRKNPAAAILNDATTKIKSLSDALGLSPQARASIVLDNQDDDDGPTLKQALKAGDKSW

SEQ ID NO: 1623 - protein, 40 aa, Lactobacillus paracasei
MLSQQETSNLKAQVVHKQGSANGWLFSYAKTENGALVTYI

SEQ ID NO: 1624 - protein, 335 aa, Lactobacillus paracasei
MTDRYFETEDGQKTIALLLHGDDLASTSEYLMGILFDKDKREQLFRQFLEFETDVSYDWFNRYYSQEMTRISKKHKSYYSPPELGRLATQLVDVARTNGDVEATKRNLGATNYDVASGTGQLTIANWDENRRKHSPFSYKPSMYFYVAEELKQEGKPSRSIPFLLFNYLIRGMDGVVIAGDSLSRSISQVYFIQQPEDNHLGFSSLNVMPRTPDVEQAFDVKAWIDEPVKYIEDKDIMPRFIVDQLIGTKQPEQAPEQAGEDKQLGIYKKRLNVIRNMTKDNDNGKDYDGKLTESDKALIDFFDTLMPGFAQFEMEKNKERQCLANKRQATLKLK

SEQ ID NO: 1625 - protein, 172 aa, Lactobacillus paracasei
MLAIKWHHTNQLASELLSYRRQSTWQWQTLSAGHKSARYIRRAVMQYQSKYSYDTVNVRYMDDGEASIVIQRSTQMNQLVRPSELDHSDYYWKGVMKVLGDFNSQVTSSAAQASYEDINIECNDLLANEVTKQLFESGWYSTTHDYGNDVVTITVDIHRSMLKQRWNSTNDR

SEQ ID NO: 1626 - protein, 58 aa, Lactobacillus paracasei
MNGKLFYLADENEYVFIVNMALTPSIKDTIQADMVERLGAPVAVISDCDSFEYLSGGH

SEQ ID NO: 1627 - protein, 88 aa, Lactobacillus paracasei
MIDKQNEVQTSTGNKLSGFTITGIVMASVGFLLNFFSIISILGIIFGGIGIAKAKNTKDKTWSIIATGVSIMETLFWVAIVYSTLAAL

SEQ ID NO: 1628 - protein, 161 aa, Lactobacillus paracasei
LCHAVVSISERYCAKHKAIHEQEWQAKKDAYHKSKLARAIKAQQAKQYDQTERDPEAVAFYHSKQWKKVRDAVYVRDMATDQVTGEVLGDRKVVDHIIPFRLCTAKQALDSNNLWVLSYQTHYRKTKLEQIISQQPNGDNKLKHLDRAWWTKVLREKKEDK

SEQ ID NO: 1629 - protein, 137 aa, Lactobacillus paracasei
MNNFSGIGRIAMDAKLGNNVLSSLLAIKRIYKSNDNQTADFIPITLFGKQADNFDRLTKKGDKIGIDGRIKTSTYTNQQGQTEHGFSVVIDHFYLLSTKPNNASTKLSDATFHSLNSQLRSASSKAKVTVTDDELPF

SEQ ID NO: 1630 - protein, 256 aa, Lactobacillus paracasei
VLSEDTVKQLVSMPCFISNVSKLAYMLHDNIETASQELLLELLDHRLKSWSNDDVTLAVQRDLPSLKWRIKYARKDLVRLSHRDATREVEKAQMLAGMEPQPSNPDEVLEALKLIPDLFSNANTRDWCGSILRFGQKETMARFNQSPRQFANKLVKVCKYARSHRQTKKPSSNAKELHILSEWDSIMADPDTSDNDIQAFINSHQDFIDEVIDDPQVAYQSHLIKDFAHAGKDKYILVNLMAKREQELDRRKIDNE

SEQ ID NO: 1631 - protein, 209 aa, Lactobacillus paracasei
NMDMTIFPRTEINMENTIYKQTHLEYFIKATLKAQIKSLDDEEFHQCPAPFSNYSVSKSGMVYSRKLNRVLRQRVNNCGYAVINITCDNGQKKCTGVHRLVALTFCDNKWGFSEVSHKDDDKLNNNASNLEWITRKDNLNKAHRLELMKTAGGHGRSVRKVNDDGTFQDYKSIKSASEANGLSNTSVSGSANGTLHLNKPFHFVLPNEN

SEQ ID NO: 1632 - protein, 410 aa, Lactobacillus paracasei
MGYKNKELLTNWANNIDKVAELTKHSTTRTAKKSRLNELLTSVSTGKILGATEHKIDGKKMLSIHKLTTNVVPAFIECLGSPEQLPAFLRAFYPEVLQRKDYKQACSIATSNILQMPSGRGSGASQAIKNLFVPANKFDPWRDDKKLMTDVWQAVNLIAANQVTGHQLSLESGRGIYVTKDLIMDMLEHPEKATKTKIANALILMRIAGAVHLMQPSELTDSGLKLTQFNHDGKLVNSHHVYTLGDFNIADWSLVSDNFNLNLNTQISKEMLIQLFGEKVASDYFPDLHGGIGKTEIDFFMTLKAQSGYTNEVIMSAKAAADTISSLTSVKDRTARLYTDQVCNAKPVEMEKMSKSDAKRLGYVLGGYKDTKPAEKLIVSTTAAALRLCLEKVAGKNDKLKKELKTRMHR

SEQ ID NO: 1633 - protein, 329 aa, Lactobacillus paracasei
MRYSRKTSRSGFKRWGKTGTVSGLVLIIVLVLISILHFHNRNTPAKIVQGKIFSYQVETHGKTEMQGHVVFGTAKEGYGVIFYLTESDDSINEWNKSGKLASDLTKVSEEKGVTWSSSKQGYQLDWPNGLAISQDLEDNTLQHYFMSINKISGLFNMTLSGTETFVFDADHSIVDKVQLTQIGTLNESTLQSDDKNRSSADRGATNQYQSSEEAIPSRQENKGNSSNTIGENNSPNIKVTPAAQFSSFAFTNTSDKPITIDPRAIMPVLNYGPALKVPNEVLKEGAITIQPGQTHNYPNFFGNAVQNATSLSIALDTGGNVIWNWESSN

SEQ ID NO: 1634 - protein, 289 aa, Lactobacillus paracasei
MLKKMVVFSLLALTMAGCGSPSANDKPKSTSSVEIASKYYHQLDKKEQSKVFFTFKAVADDSQDGGKYIVDMKVRNGTKSQLKFDLSKFILSTSNTGTPIKSVKHGDLTIAPMRTKTVTGLFDSATAANFNGVGEFCYLSRDFLLAYSYGADKAAGATTDNLKVASLIAQNKAATKKPSASAVSTQSQAATSAPASEASQQVSQASTQPTQQSQASSAPVHVVNSAEQAKQIAAPFLNVYDASGLRATPVGDGWQVGPQMTYADVIVHYNGRVFSPANPATGQPDHWLN

SEQ ID NO: 1635 - protein, 102 aa, Lactobacillus paracasei
MSEITPKAVKVWLAANILAIEFDNGQTRYMRSHFIKDYLDAWSPTRGKGKRVNLIIAPTWEWFGANPQIAEDGTLTLFDKDTYTPEELWKNSKERIDEVSGT

SEQ ID NO: 1636 - protein, 103 aa, Lactobacillus paracasei
MARTLPKAVKVWVAANLLAIEFDNGQTRYMRSHFIDQYISAWSLTKGKGKRKLLLVAPTWSWFGANPVIAVDGSLTIFGHDQYTPEELWGNSKSQIYEVSGVH

SEQ ID NO: 1637 - protein, 215 aa, Lactobacillus paracasei
EIICBACMPNENTMKQKVMDGLQRFSKAMFVPVLILPIAGILIAIGNIFTNQKLLEVVPFMNNPVTKGFGLILSGSLVSILTNLGVIFCVGLAVGLAKKKKAEAGFTALLTFLVFINAMNKFMELRGILSKAENLQGTGQASVLGVQILDMGVFLGIILGLTVGFIHNKFVDTEFRSAFQIYGGSRFVFIVLIPVTVMLAVLLTYVWPFIQMGIS

SEQ ID NO: 1638 - protein, 1029 aa, Lactobacillus paracasei
MKKFLVSIGLLGMMVLSTGTVTGYATDDSASAVATPSSATSSSEILKAVNDELVATEVPVQGAKPIEKAATVTSRAEYVTMRARWRDRLIATKPDMSDPNVKAYLTDLAAQSQTLWATMDRSANRSRLWPKKSSDTTSADYTSMFTNIKMLTLGYYNPVSQQHQNPEVYQAIIDAIDFMETAKKYNGSYSTGNWWDWQIGSAQQLDDTLILLYNDLHRQDPEKLVKFVQPLLGYAKDPNIQWPAYTATGANLTDISISVLASGLLLEDDKRVALVQQNLPKAMGLVTAKDGIYADGSFVQHTFFPYNGSYGNEMIKGIARVSSTLVGTPWAISEVQFANVFNLIDKGFLQLMVNGRMPSMVSGRSISRAPGTNAETTELETGKETLANLTLIAEATPATLKQKIYQAVATWVTQVGERYNFYDKPRDYAALNGLKTALHQATAQKDDVSSLNIYGAMDRVMQKTPTHAVGIAMYSNRIANFEYGNTENSHAWHTADGMVYLYNNDLNQFGEGYWATVDPYRLPGTTVDTVSLPDGAKSSSKSPQAWVGGATDGTTASVGMALNKVNEGQNLQAMKSWFLLDDQIINLGANINGTTAADIETIIDQRQIDPATTKITVDGQVYTNQKTVSQWANINTADPENNVGYIIAKGNAPVTINQATRTGTYKDINGYFPSDTVYKHTYATLAAMHGATVKNGSYEYVTVPNATDTKVAQLAKSPDYTVLANTGELQAIKTKDQVMANVWTKADQLDGLVSIDQPAAVIIKALGNNVYQLTAAEPSQTGNLINFSFNNPVHLQGKTEAIFSTNGHVLTFNPADLAGASRVVTFKLDVPVDRTTLAATIKTAGNLKAKDYTKASFATLTQALTEAKAVIADLATDQQTVDDANTALVAAIDGLVKTADMKALQAALTAVAKLDAKTYTDASWRDLQAAIDAAKDVLTLDEPTQVMVDHATKAVFTAQNALVKRSQTDPSSKTPPTQPLPADKNGQHQKMQADMPQTGDKVIQWLSLAGVGMLLLIGGLMIWRQRREQ

SEQ ID NO: 1639 - protein, 66 aa, Lactobacillus paracasei
MNHIKDGMHMLVVSLTTFVSVYLLVVMTASIEMSFMWRWFLFFVVGGSSAGIASFFYELLSGESVD

SEQ ID NO: 1640 - protein, 1047 aa, Lactobacillus paracasei
MKKFLSLLLVVALVLSSAAFPRPVEAAELYPNIVLSKTNREWKDFIKLLKSTKVGTKEGEAVDISLKPSSTFKEERIASNLVIEVGQVGRDIVEVKSSDPETLAATLVNKSTIRLKRGIGTNSKVSISVKYRLTWKFDMRAGQLGPFTSFQYYTVNSNNYSPVEIEYSESMEMKIPLGFLLARNAKYVLGEKWNTASRSRMMVSATDADGSPVNYSDSRIGATIPDELSKRIKNGRIDANIDSPVGLFFKSSGGRVDSPGKATSSYGNAVVLRGFEAQNGVESTRDAAGAFALIEEDGSPKIIATSGAVNDNDKIHQEFPGKFYVETALFSMNNVNDLSLANQSPTKVITANGDEKKQDFLDRWGSARAMSVNYGDVFKAKEAEGKIGYTQASNYTSLDTYQQPKEIFFEVTKNGYKPLAINQLSSKKISVTQKDSQSTIAQQLQNTIDTKGNSNITIEKFSEYPDVDTAGEKTAKVLVSQTLSSGKKVSYPYEVPVTVIAKPGELKTREAIYKLGEKWNTENRSRMMVSATDTDGSDVPYSDGRVGSSNPDEVKKALKDDRIDKLFKASVELVFASMGGTVTSISPVEAKYGNAIVLRGYEYGPRDSAGVFALIEENGNPKIIATSGKSTDNEAIHSSFPGKFYVETALYNMNQHTELALDKSTPTMVIKANGDDKKQDFLNRWGASRTLSVNYGDVFKAKEAEGKIGYTQDSTYTSLDRYQQPKEIFFEVTKNGYRPLQINQLTFKGLVVPPAVKKEAIEKEVKTAIDKNKQATVTFEKITDYPDTTHDGFQDVKVQVSEKLTSGNKVFFTYTIPVVVKDTDDQSDDQFILTAKNITAYSNQLANKTSDQLAAFILKQSQAQAWEKNKQTPSEKIKMITTDLKPEFGTYQATLAIGKLRKEISINVLASNNMIDLTIPKSLAFGSTDVDPGQIVSPNYEIKNRSKTKVKVVLQQVKTTTKSSIKLVHVNDPDPVNASESARLFLKGNEKFAANKIPLDDSTANQELGTLDDQAKTSVSLSGQYFGDYSSRQNLAMDLTFKFEVLH

SEQ ID NO: 1641 - protein, 123 aa, Lactobacillus paracasei
MMKKGQLSFFLMALFFFMNMPPHIGLAETNASIEVEGIIGNQSVDVTDKNDAGKSPIVQRKEPNDKIRQEMPELGADAAQAQVFLMLGLLCLSGAIFVYWTRKYQGEDGNQGTASNATKKVEP

SEQ ID NO: 1642 - protein, 206 aa, Lactobacillus paracasei
MKKTKLLTLCGVLAIGASLLGSTQVYAYENGQNDPHAATNTLEVKKTDSATISAEGTFEPFDPTKLPDPAKPTPKKDHKAWVDVKIPSKVLFSQTDVSEGIISPNYEIQNLSAKGVKVSINDFTDGDNANKLEDRLDLNLNSDGKKVALRSTDKQKVPSFPTEIGTITSQNGKIQFTLAGSVKKGFDFTKETVKANYKLVLKFEVQ

SEQ ID NO: 1643 - protein, 170 aa, Lactobacillus paracasei
MRKNKKLKLVCLLLLLVGIVSIGSYVYLHRSVPNVVANGGGAEDTSFVKNMTDEELKEYLQEKADKSKFHLKLDTNMVFNAANEVGTVNILNPASNQYGIRVQTRLEGQNKVIYDSGLIKPKQYVEAGELKANLKRGVYKTQSTVTYYELADSSTKVGETAVVGQLSVNN

SEQ ID NO: 1644 - protein, 495 aa, Lactobacillus paracasei
MEELLESNLLRHFRIVRFLLGREWVTIGELAHTLRIPSRTIRQSIGEINQYINPAKIESSQKFGIRLTYDAQLNSFYIYASIYKQSAHFLIIENICIHRYATLAVLAEKLFISQSTLKRKIAVINQTLEKYGFWIDSKSVDMVGDERKIRFFYYCYLLEKYDVLDLVAPEQELRVIDELISEFFAQFPSLQGPERQVFSYLNKLRTMLFISFKRLKKGCRLDSHDQIDEQYSLLLSEKLSKKIAVCYHIDCTKDVLHQLFFLFFNRRYAWSANDLQKKAEHDEAIAKVRRTLLAFFAKIEKSEQLVLINKDELLLLLYNATSYTWTSAKILHNPSEDFFVNLNHYHEGFARRIKKELVACLNREQLDIYLDDSVINQLLFMLVTAWKGLMDQLEASAPRVKAGIFFNTSFEHSQFLLNDISYHLKSRLDMTLITAKTITELRQQCQHVDMLITNLSMLPSPDCHIVSIQANLTPKDFENIFSVYSEIVNANVTAS

SEQ ID NO: 1645 - protein, 249 aa, Lactobacillus paracasei
LSVMKFDKLVSGKNLSETEQEVLHYMVANIDRVLDMGVRGVAKANYTSATTVMRLAHKMGYRGFVELQYKLMTMLRHDSMGTAASDQQDQLLTAMTSHNDLSTIKTVAQRIAAVENRYLYVYAAGFSGVIGNYMFKKFQILGKRCFFSTPGDSAALLENYLEDLGLFLVVSKSGETQSVLDKARLVSSLPIPIVAFTGNPESTLAKIADWTLTVPDEFPLDDLNQRASLFYPRMLAAFELVIGEVEKLD

SEQ ID NO: 1646 - protein, 161 aa, Lactobacillus paracasei
MFGLFKKEKSDVFTAPVTGQLMPLDALNDGVFSEKMMGEGYAVAPEEQAVYAPIAGTISSVFPTKHAIGITSDAGLEVLVHMGLDTVEMNGTPFETKVAAGDQVKAGDLLSTVDVAAIQASDRDAAIVVIFTNMDKVKDFSPIKAGPVTHGDAVTTLTYAG

SEQ ID NO: 1647 - protein, 377 aa, Lactobacillus paracasei
MRKFWIGAASILLSVALVNPVNSQAITMTKKQAQEVTETVQKTMPTEQRVSDLEDAAIYYYWNGGQLKKNEKKVFKGVTIKSNFDVIEQLFKEAIKIDPQNLNLQMDLASTYRMQNNNAAAAKMWQNILKKDHTNFDARLKLAAFSKVTGDTATYDDNIAKLQAQNAEKTATFTKAFSQIDEIGKLDIQTKIPNDLPKDSHHYFVVLGYALSPNGKMQPTMKKRLEIALKAAKKYPKSKILVAGGVPENKLTEATVMQKWLVAHGIAKKRIELEDLSTNTVENALFSVRELVDRGATSATLITSATHMRRAFLLYQMAGDIVLASNTSKNDKAPVFTQVAYVDDKKALNNYGMPEKNAITDDVLRLNGVWQLPGLQR

SEQ ID NO: 1648 - protein, 451 aa, Lactobacillus paracasei
MNIIYIHTHDTGRLISPYGFKVPTPHYEEFYADALSFQNAFSVAPTCSPSRAALLTGVYPHQNGMLGLAQRGFELENSLHIAQVLSHNGYLTALCGVQHEYKYYTDHTEAANFLGYQLDLSTDNTGMDEEHLVDWDTNNADNLVKWLDHYNDEKPFFISYGMHSTHRKYPQNVSPDVSIDQARPPINIVNTPETRADFAAFETSETYADRNLGVILEALKHNGLYEKTIIIVTTDHGVAFPFAKSTLSDEGIGVLLAIRLPNGTRGTYDGLVSQIDIMPTLFDLINIKKPEYLEGRSFANLLQGQTYSPDEEIFGEINFHTSYEPVRAIRTKRYKYIRYFDDYDRLNLSNIDNSITKKFYDKHGLRNFVKPREAVYDLYYDVYETNNVIDLPRYKEEVKVLRTKLLKNMKKTKDPLLKGPIPIQPGWKVNHRSSVTAHVSDPSEYEQPSKE

SEQ ID NO: 1649 - protein, 145 aa, Lactobacillus paracasei
EIIABCMPNENTMAIIIVGHGNMPDAAKFSIKMITGLEENIFAVSLTPDQGNEDLQRQLDEILTQNTETTRWLIFTDLLGGSPNNLVTTHMFQKSGVQIISGFNLPMLLSAVLNPNQSSDQLLKEGKRGIKDVIKKLRTVDTDEE

SEQ ID NO: 1650 - protein, 158 aa, Lactobacillus paracasei
MDIKNVRVDSRGIHGQVATTWIPLFDINRIIVIDDDSVKDTTQKMALKLARPEGTKLSILSADKAYIRLTDPLAYSGERTLILFQKISTVKSLAEKGYHFNEITLGNIPNREGTKKIEKTINLTSDEITIVNGLIASGTTIIYQMVPKDRPVILEEIK

SEQ ID NO: 1651 - protein, 246 aa, Lactobacillus paracasei
MKKNSEPLYVCIARNLSSSIEDGQFKRGDKLPKELQLTKQFHVSRVTVRQAIQILAEKGYIKKVQGSGSHVIYSPSRFQLDRSAQIQSYSEELKQFGQTPQYSVLIYELVNTPTVICNKLELLSGDIRSYYYERVVSNENGPFVFERGYMPFQYFPSLTVQHLESSKTDYIEHVAHITVDHSHQVLRAVMSDGRAMKLLNLKESKPLMEDEHITFSTAGKAVFYTSSLFDTDIYQANFVKFRHSLG

SEQ ID NO: 1652 - protein, 282 aa, Lactobacillus paracasei
MAIWQAVLIGLFAYLGRNQVPWLFGTTGGWYGIGRPLVAGLIVGIILGDIKAGVLCGVAVQAIFLGQITPGGAVPSDLNLAAYIGIPLAVVSGGSPATAVAFAVPLGALGVGLHNFTMTIQAAFPHRADRYAEKGDARGVRRMNIAATSVSFLERFLIVSLTCYIGAPFAQSLLKALPQFVLSFLQVGGQLLPALGFAILLKQIINEKWMVFLFIFGWVFTASFGLTTTSLLFIAIAIALIYVMAAYRKSGQLTVTPTGVESAASVRNTIESENTEDDDYEE

SEQ ID NO: 1653 - protein, 284 aa, Lactobacillus paracasei
MMTMRNNKKTDRQQPIKLTKKDVAKANWRWNFFALSSQNYERMQGGGFAHSMSGAIEKLYPEDTKNRAAALKRSLTFFNTEPQLGSIIPGITLALEEAKANTQDFDEDIITSTKNALMGPFAGIGDSILVGTLNPILLSIGIGLSSKDGSPIGPLLFLISWMTIVVTMKYYLFKRGYTMGLDAVKVLTNERLKNMITTGLTMVGLIVIGGVACTTIKAPIIWKFTSGKMIINIQKIFDGIMPNLLPLGVALVSYYLVDKRNWGTTKLMVALLLFAAIMVALGVM

SEQ ID NO: 1654 - protein, 513 aa, Lactobacillus paracasei
MKYKSYISDLHVNLHPDQMEKLDQWYQHMRKVADFFTIAYYPYHMVSVNSDFETEEEIDPTLMQKQWENIINYLKIRGRKDKFISFLGYEWQGTGEDGDHNIYFKENHGEILLMPRYHDLVAAFKDQDVIAIPHHLGYSVGNRGKNWTTNDDEFSPIVEIYSHHGSSESDQTNLPMARHHHMGPRVDGGTVKEGIKQAYHFGIIASGDNHEVPALVKHGRAGVWAENYTKDALWSAIKNRRTFGFTDSIIKIWMEAADQPMGSIIESDNPTETITAKVTSNSKIERFELYKDGCISAIGLAPQPTDTNNKEITFKFKVECGWGPDVKFFPDLAEKDWIGQITTSGTFLSVEPVYNSFQNDYKLINEHTVNFTATSHQSVKKDNWMRDNSLKNEGFIFEVTAPINSEISITINNKKSKLTVKELLAKSHLSVYEDEAKLLLQERANLTEYYRSDSWYHNAYKVKFHRAATKNEYMINQTFTIPVTEHETNYFVKVVQADGQTGWSSPVWIVEKK

SEQ ID NO: 1655 - protein, 113 aa, Lactobacillus paracasei
MPDYPSNISRAQFALIQPDLENFRKHTRPRGSGAKFAWQLHSSILSDKKRGIVRMNYFKGRHFQQDIIIIAVGYYFRFSLSYRDIVELLRDRGVSVHHTTVMRWVHHYGPIFT

SEQ ID NO: 1656 - protein, 463 aa, Lactobacillus paracasei
MVTNKQKRLSKATIDHANHVAIVAIAEANGIALVQQSNGYWRGVEHDSLVINDKKNLFRWNSRDVGGGALDFVQHYLGISSFREAVAYLNHAALERVETTTHKVREPFQYSFKNSPNFEQATKYLTTVRNLDPQIVDLLHRKGFLQQDEHGNAIFVWSRKDKIVGAMVQGTRIDHEHLGKRGTFKQIAKNSQENFGFNLSLGKPERLLMFEAPIDALSYWSLHRGLNHVTLMSMDGLKPNTVKQGLIYFCEKTGHAPSEIAFGVDNDPSGHVFYDQMRAEHALASVPYTSLIPADQAIPHECLAPVVSAAKQAAIPTVALMAYLKVAVNLQPGHGIANGYHYQDALTKGSFADLPEFAKQLKPYLQPNGLDWQAYFKQQAPDLTIANRNNLITRITEVAQRYQKGDFQVVRDVPKDWNDRLQIHERSKSKGLTLDQKIAAAKERAVTANLRIAPKHHDQALER

SEQ ID NO: 1657 - protein, 735 aa, Lactobacillus paracasei
MAITKIHAINRSTKDAIKYIIDALKTRNGELVEGVHCDTPTASFEFEMLADMSHRYNGNFERVGGRQVEGQHLRKTAKSYHLIQSFSPDDHVTPEEAHEIGLQLMRELIGDDYQFVIATHVDKDHIHNHIIFNAYSMTTLKKFRSQPYITANRIKEISNRLTAEHGLSVSLKREEQLDKNGFVHEKDVHQSFRAELRRRLRFVASRATSPEMFDQLCEQLEITTTKRGQDRGYRLPDQQRNIRDKSLSDIGSYTSAGIKETAAENAHNQRRLIALIDDVYPMCDSLDDLTFMLQQEHDVTLKRQRNGSYQFTFHDGTKVPAELLPPAYQLNYMNEHWHDPSALKAKVAVPDVLAEYQEQTKSKMTNTETLMDLSDDQVLSVDEKGALVQLEVPNEGQLTVHLNRYELRGDPDHLQVALQANYYYTLTDQSGKRPRAVSIRGEALIHAIDLDQGLNPELVKVPPQAVFGHSDKGLTITLPDAGYERVFFPNDAVSYDRLHQQYTVQVGNHWHYNATPFATLNDPEPKSVSLTGAALKPALKSTQPMLGRWLIANRQRQYMQAQQADVKRLSTTLGELRANHITDRQSLGRQVTAVKAQLLDVQQKIEMLHDKITNYNDLAKFIFTRNQYQPIIDKLEDVSPKEQHRLTKKYQHEINMYQTAVLHLQNRDFNPLLTNEEMASVITDQEKTLRSLEQSLKQQTIMVNKWEDIADLMDDLQGEPPQEEQEQQHHHDIER

SEQ ID NO: 1658 - protein, 133 aa, Lactobacillus paracasei
MAEDNEQRERTIQKHTRLNLREEQALRLRMAMAGNPRFNSFSIQSLLASQIIHIDFTDTKQLIEQMARIGNNLNQLAHVANESESLTQEQMNVVKSEVYDLFLAVNDLLLHRLDVVHRYEQVVLNGNHENTRN

SEQ ID NO: 1659 - protein, 91 aa, Lactobacillus paracasei
MKIIDEMNEFDRDIILLHRKFVSEDTPPAILQKVKAVRDDISNDLTGITDPIEKEFTLECYDETIRKLSDLSVEDYQKWLSQNENLEGFEL

SEQ ID NO: 1660 - protein, 324 aa, Lactobacillus paracasei
MPTSSQEKQPPKSTKELLALAQDGAKKVFSTDEYREYLKFISGFHQYSVRNQLLIYLQNPHATFVAGYHTWKNQYHRQVNQHEKGIRILAGGEHKYEKRVRQPDGTIKRVKESKVFCRPAAVFDYSQTSGEPIKMFTHELTGEVPNYATIYSKLVQATDFHVGFSHEMPSSETKGVTRPLKKEIQLRSGMSEKQTIKTLIHELAHSELHCDPKLKLDRSTMELEAESTAFIVCQHLGIDTSDYTFPYLAVWSKDKDLSQLSKSLTRIQSTAEKFNKTVDQNLEKIREKPLTLDQKIERAKTIATTENIAKKEQGLVQATQEKTR

SEQ ID NO: 1661 - protein, 381 aa, Lactobacillus paracasei
VGRKKDKETDTIKITNQEGIALATDPQPFDDGLAQLQAASDHLFDLAQHGSCQITAYHRDQVAFSVKIKLPIEGKIEDLITDLISQRQEVTSPPATDVSVANETEPDSASEPVSTDSLAADTTPKRTRNQSHRTVAKKPKRTAIKLPSISLPKVSRSFLKHLITIAVLLIIAGGFLFGTKLVVDAYNAPPSYTSLIKKGDYLQAGKLYPNRRDDVRKVLTDQSNVKQLVKFQRSYPKAETAFDLAYLQHNWSKVIKTSSQVALSQERQIELAVAYVHTKQFDAAELINEQLESKTLSEVIALGYVRQKDFDKAKKINDSLKDSTIKQAIEVGEKYAAGIDAFNKIANDPQQSAEKRQQAKQTVKTFEHALSTLGESRSTNS

SEQ ID NO: 1662 - protein, 76 aa, Lactobacillus paracasei
MASTSLEKRIKSKENRIKELEEQQKKVQQQLTAARRDLKVLKADKVDALLSESHLTYDDIAKLLKKESHDEAPGFH

SEQ ID NO: 1663 - protein, 174 aa, Lactobacillus paracasei
MEEHRWRHWLLPLYAVLITVLMVVGWYRWSDSQSVLQETKTHLNAITGGESKKVDKRVLVFADLVFGYRADQQKRHDQLEKLSTKAIADQIVPPANIGKAGVGPDLSYKVTYQDREVTYTQVGSETIAMARLAYTITSDGNRIKNDLVLRLPMKQQKIIGCTLYRLNQSQASHD

SEQ ID NO: 1664 - protein, 825 aa, Lactobacillus paracasei
VANNWKDMLLNKQHHDPKDALVSSDPSRFKKALRGNKYRIQGVGGFGGKRFVRKKGQFRRGLLAQNAKHKKKQASWVKRFRHRSREALQHGAIETAKKSTVLAATNGQQNEEQNDPTYQTLSKTTQGGSRLKARLKRHRNRKGKRLAKKLGKPVQTSYSRKSVRKMMKQRALKGATFSWRHPISSIRHLLKAILMLPVVIKSMAILLLVGLVFGLIALMSSMFGWLVPTMSTTADSKPLTDAYSYITELDTDVTKKVIDSMANTDGNGRSLIINGQEATTDGIELISDFDRELAYLSIKYDDFTVDDAFKQKIKKLHDQMMSVTVDSKTVTVNLSSFDEWEKNHPKALSQDDKDRLDAMGQVGQYRTQEILGSPFEDQNATIMVNDRYAWRMRGGQKNMSNHIRISSETGKKIVAVMSGTVTACSNGSVTIATDGKRTVTGGLKAVTVKPNQEIKKGDQIGISEKNITLQLIKITQQSAPDESSSTSSLSSTSESVSQAPGLSSKNSSSAFSSTVAASSAPLPPVEEELNPAFALPNVKYTYATTYGLVTSGGDLTGQDFDANKFHAAWVKYFSNGVLADKESYSIDAAKKAGVNPALIAAIMGTESSWGTSAAVRGANNPSGQMSGGTIIAYPSLEAGIDATGNTLHNLVVTRGLNTVQKLGAAYAPIGAINDPNNLNLNWVPNVNKLLAIFGFKSGDSIGNITLHNGGNSYPVGQCTWWAKARSGWAANNWGNGADWGSSAAAAGFSVDHTPQQGALVSFAAGQMVGNWQADPVYGHVAYVESVDSDKGTITISQGGTGFKQQPGPNLQTLGNVGAYTYIHPR

SEQ ID NO: 1665 - protein, 818 aa, Lactobacillus paracasei
MFTRTEERSKNTKKTGHSKALKLLQRHKKERGKQERKNAPSRATQDSLAYRAMYEDGLCEVAPGVFSKSVAISDINYQISDRDHQSDIFSKYAEFLNGFDSESTVQINIINRRKDIRQFMQETSFKHRPDDLNALRDEMNHIMRERVESGNTSLLKEKYVTFTQHADDRQRAKTSLNQLQANVVTSFHQMGSTARPLNGLRRLQLANATLRPGSVLHFDYDDLKYSGLTTHSVIAPTSFNFKHAKNRFTMGDQVAQVLYLRDYPPEISDRLITDLTDIMADLEIAIQIHPIDPVKGMKMVQTKKGFMQKQKADEQQKAMKAGYDPDILPENLTHSLDEAEDLLQQMQDDNQQLFDVTFLVMAQGKTDQQLDEIIEQVKAAGRRHSCEFANLDYLQEQALNSVLMWGQNYVPVSRTLTTSAAAIFIPFTAQELSDSSGLVYGVNQVTQNLVTADRRNLKAGNGMILGRPGAGKSFASKQEMLSVRLRDADSEVLIIDPEREYSAVAQALGGEVIPISQGAAAHINPMEINEDYGDDEDPVIFKTDFILSMCDMLLGGKNGLSAERRTLIDRACRLTYQRYFEQHTAMPTMVDLSNTLKQQPEEEGKQIALELEPYIEGSLSVFAHQTNVDNDNSVVVYDVKDLGKNLRSMGMLIVLDQIWNRITKNRNSGKRTWIYVDEMQLLLSNEFASNYFFELWSRARKWGALPTGITQNVETLLLSDNARRMLSNSEFVLLLDQAANDRDQLTEMLHLSEQEEGYITNADSGHGLMIAGDAVIPFENDFPKKTKLYKIMSTKPEDMEQYISRKKLHEDGGEVSGE

SEQ ID NO: 1666 - protein, 123 aa, Lactobacillus paracasei
VALRVRVPKEIKTYKERIIGTMDLRQLICATIAFIYSAGIIYFLVWKLHWSMDSAGNVLIPLDMPVLAFGWIRPKGMPLEKYIGIILHYQQMNGLRIYENRREVSLHVHKNRGKIKEYKEDRP

SEQ ID NO: 1667 - protein, 277 aa, Lactobacillus paracasei
VDNTIKGFIKFILNSVSGSAKANGITETLAGWSKDLYGFATTIQTNVMMPVGYMILALFALLELYRISEQVEAMGGGSDAGVRLISAALVKVAFCKIAMDSMNLFMNAIMQVSITLSQDIGKLVNSGHMGTIISVDDIYSPLVKEGFWTKLMIMVLLLFVMLITMLATVLVNVVVTGRFLQMYVFLAVSPIPIATMPHHEFSGIAKNFFKSFMAVSIQGTLIYMVQLFYPFLMKTAFANVDKSGVLPLIASLMGFSILLIFAVFQTNSWAKSLTTAM

SEQ ID NO: 1668 - protein, 68 aa, Lactobacillus paracasei
MNVLSQAISLMSKFAIAGGSIYAAWGLVGLGGALKDHNGPGIQSGIWTIAGGGLIIAAGALFNSISLT

SEQ ID NO: 1669 - protein, 631 aa, Lactobacillus paracasei
MDKEKAKNLAWNFGLVAIGSSAVYIVGSGLTRAVYNVQDKDAKSILDKILYVSNNLGKVAWWPPTFNGKPFLGGLILLAVVALVVLYALTNKKNYRPGEEHGSAKWGTHKDILPFEDTRNPDNNLIMTATEKLYLNDLDHKRPMKLQRNQFVTVIGGAGSGKTRTVVVPNLLQRSSSYVVTDTKGQTLRWVGNFFEKSGYKIKVFDLVTRKHTDHFNVFAYINNEDDVIEVVNAIMQNTTSPQSKSDPFFDKGEKALMQALFDYLRLEAGNPDNRVVANVPNVLDLVRAATIEEDAGGNTTPLDLIFEDFKKDFPDAFGLKQYGIFKLAPAKTAMSIVISLGVRLAPFDVPSIIDITSDDTLELEKLGDEKRILFLILPDQSETFNFLVSLVYQTLFTTLVEHADHQANGRLNETVVCWQDEFANSGQIPQFDKRINTLRSRGIFCVPIVQELSQLKERYPKSYQAILGASDSLLYLGGHDSETAQYISQILGKGTIDVQRYGESKGNNGSFNQNYDKIARDLLAPDEVDRIGGDQSIYMLRGVPPFLSQKYQLEKHPRYKELQMDHSDYVYQPQLKSENNKGGEVETEESKSESDFLANVSQEETKDDDVKENEQGSDILTDVNLLDTYR

SEQ ID NO: 1670 - protein, 158 aa, Lactobacillus paracasei
MDNQAAEYVLRLSTLSAQALLKALAVKLPSKAMDMSKQAIHHQRTTGKQNIAELQKRGALEHVDIIKTDLRALGKKFKKYHVDFSIRRDKETGMYHVFFKGADVDRVQLVLQKVVKDFDKTPEHGQTLQEKIEKAKVTAKERNQKEKKPRQRSKERER

SEQ ID NO: 1671 - protein, 506 aa, Lactobacillus paracasei
MAKKKKIAAILLISAIVLGGGGYTAYQLNAAPASQSVKKSSTPSKQWRTPSKKVEQKQKNTKPSSNKADQTIKDALAPDLPNSDKSDQTVVAFPFSKNDLSKQLESSNSQSLISLADQATAEQNTPKAADNTGTTPEPKPLTDKQTTDTKTTPSVEPSPTPNPAPEPIPEPNPTPDPNPTPTPEPNPTPDPNPTPAPVDQAPTISFADDLHLHLGQKSFNLMDGVSAHDVEDGDLTNKVVYGSTVDVNTEGTYQVTYQVTDSAGHKTSATRDVVVTNDAPVIHVSGNNQTEVGHAFDPLQGVTADDYQDGDLTTELKVAGDVDTSKLGNYELIYTVTDKNGAVTTLKRSVTVFATAPTLDVSKVPTELKVGDQFNPKANVTAVSPYGDVIVAVDGSVDTSKPGSYELAYTATDKFGQKTVKEVTINVVADKPTLDLSKVPTKLKVGDHFDPKASVTATSSYGDVTVDVEGSVDTSKPGSYVLTYTVTDKFGQTTTQNLTVTVSETV

SEQ ID NO: 1672 - protein, 88 aa, Lactobacillus paracasei
MFNLVLQTKDIKEAKRKNGLLEIRFPHPKEKALLLKLRHAVLSIETGWPILPDTTCIGEIVRVLPSKDRVIVAYVRPQNEFKRFIEAY

SEQ ID NO: 1673 - protein, 92 aa, Lactobacillus paracasei
MAEPVGIWLHDRNLKLISKDHDALSYRIQASWVKDHTDYPIKPGMTVVIGNIKPPNQLKNVLVLKVGSAELKRDGSLVISGERIKSVPKNLI

SEQ ID NO: 1674 - protein, 52 aa, Lactobacillus paracasei
MLWVILKCSFWVLLGFILLCELAAIRISGLCSREEERQEALEKHLQQEKSAP

SEQ ID NO: 1675 - protein, 54 aa, Lactobacillus paracasei
MKMMVKTGGIILVSGLLLAGCGNQAKASTPKTAGQPQLNGEVSTFSDSLLSDFL

SEQ ID NO: 1676 - protein, 91 aa, Lactobacillus paracasei
MRFYEFNIDHHNYYALIAADTPEEAKRIYQNEIDDAIDDLMPHEVSLDQAAEVLLEADDLADFHDELVQKEKQALKGEDDARTIVIDSNLL

SEQ ID NO: 1677 - protein, 76 aa, Lactobacillus paracasei
VLKQTKVPFVNGVGKTLPHLEKGVRYTFVDHGYYMTALRPGETEEIKPELPEQKWEYRRHHPVKEWRIGGNHHAIL

SEQ ID NO: 1678 - protein, 72 aa, Lactobacillus paracasei
MKAIDQLLVFMQQHRLTSIDYATYDRARRLYDHDPVRQREWIEILAESKTDQRIVVRHGVLGSSVKAVSLCA

SEQ ID NO: 1679 - protein, 78 aa, Lactobacillus paracasei
MQQRKKLQQHEVVTEFVNMTKLGKITTVEDYFKYRRAHMHDLSLQERHLLMAWLNRSKTVRLKGKRHQNAVHSEIEMR

SEQ ID NO: 1680 - protein, 75 aa, Lactobacillus paracasei
MAILARLGVVRHAFCVRTFDQRVLINHADGTFYDRDLASVEAIEQLYPKIRSVYNSDHTMIAKRKHPQAALYKLS

SEQ ID NO: 1681 - protein, 245 aa, Lactobacillus paracasei
MNSKEFNQRKREAFPEEVALKNLKELTEAERAGLHLLMIQTSDPDEREDILAEAQKTANQRAEEAKKHSYAAIKERLTQEQTETDTELKSFTQHRNRHVKVLGKVTMMAGYFMTPKRIRPTKYYWLVPDDLVIPDRPLGRVAHVRGKDGQLQDVMVLYVTKQKQRQLQDGRVIPDQFMIEFTNQYASSVQVKQGQGTERQRQKNYRGPFDSAQQKHNRVRKVIRRHHRVHKELANLEKGKKKDKN

SEQ ID NO: 1682 - protein, 353 aa, Lactobacillus paracasei
MAQDSFKYYEADSVYGNLFFQFPKVLMYGSQYSKLSSDTKLAYMVLKDRLEYSLKNHLVDEENHVYFIFTNEELKSLFNCSNTKVAKIKKELEAAHLLHQKRMGFQPSAGRQLPNRLYLADLAVNPQDRYLRSQETSETAQTLDKSRLPKIRSQYETAQSLGNKRLPKIRSQYEFATNESQTLDKSRLPKIGHNLYKDLDITPRDNKETENLDFSTNQYSPELLRKQNQDLVQNAKDYLPETANGGLFLNKEGVELLGLWCRSPKQMRRFLGIILNAKKAVEREHEGTAIVLDDPRCQEMINKTMRRFFNVLRSDSKKINNVENYLFGAMKETLVAYWNKSLMTANGGDPDEF

SEQ ID NO: 1683 - protein, 271 aa, Lactobacillus paracasei
VQRIVTVLSTKGGTGKTTQTYNFAKWLGSQGHQVLLIDHDHQMNLSTAFGIFNSPNTIAGVYDKEFKDPKILNVSKNVDLIPGSMHLGSIGETLINRTMREFILYNWLDKNYEAYDLGKYEYILLDSHPDVSIISKNAIMISNHVLSFVEPSQFGGFDAMDSLKARMQEFKSEAVVPRTQQSYVTADTLFVGNKVAYNTNASHEFRKSVSEMKDVVAVIPQKELFNRSTIEHRMIFEYEDGDQRNTKFFRDLRIEYGKIKQAIDKPEEEGN

SEQ ID NO: 1684 - protein, 99 aa, Lactobacillus paracasei
MAFQKNGPKIRETLESQLEKKRVQQPTSDKRKINRVADTQNIRVFNETHERIVFIAKTLKKGRPIYKLIDEMLEIYVEKGLSPKERKLYASLFGDNNDQ

SEQ ID NO: 1685 - protein, 117 aa, Lactobacillus paracasei
MDKETELRLGIKSMLSQYDHYFTRAPHTRYWLVVVDNHFEDCYSFFIYMQRFKAKLIKSYEIACFKRDKGQYEHFLSSLKQHSNLSIEYRDTNHLILPDTEVQQDLIHGHNFQTNTN

SEQ ID NO: 1686 - protein, 430 aa, Lactobacillus paracasei
MTTPLDDPTRLPVHDIMCIDCKSFYASVEAIRRGIHPLAADIAVLSKGDSPGGLVLAASPNCKKRYHVGLSTRRFQLRDDMQIELAEPRMADYIRKNYGINRIYRQFTDDAHWYPYSIDESFIDVTHSHNLFGSNQEIATQIQKKVFDQFGIITTVGIGQNPLLAKLALDNEAKKAAPWQATWTYDRVPETIWQLHDLADFWSIGSRTAKKLNAIGIHSLYDLAHTDRLLLHQRFGVLGDALYFHSWGIDYSDLTRRYLPRAENKGYGNSQVLMRDYTQAREIEVVLSEIADQVAGRLRHHQVQGEVVSVGIGYADAEEAGTSGFGAQMKIDPTNHTDDLIRAARYLFHSKWDGHAVRNVSVRVNRISQASSMQLSLFESAEKEEANVLLDQTIDKIRQLYGYKAIVRGYSKEKGATAIDRAGLVGGHHG

SEQ ID NO: 1687 - protein, 128 aa, Lactobacillus paracasei
MMENNVPREQWLYPDRCMKKWLGWILSDHSAYMEKASISERPVEPKPEQSQETISNILEDAWQNAKIVAVQIGTPYDDRLLPDIEGAVIGHWDDQVYLQLKNGDTQSINAVDIRNVALLNPDRWWALA

SEQ ID NO: 1688 - protein, 62 aa, Lactobacillus paracasei
LKLRDKIQALLDSDATSYAIAKETGISNSTIVELRHGKRKLSNITLKVAERLGEYYDTHQVR

SEQ ID NO: 1689 - protein, 127 aa, Lactobacillus paracasei
MADVVIYPVVLSKDGDYIFVRVPDIDGGYTQGNDEIDAMRMAQDLIGNLLEDANKYPKPSEPSAISLKDGEKLVYVAVDMTAFRKKFSRTVRKNITIPEYLNSLAKKKGVNVSAVATEALEAQLCVK

SEQ ID NO: 1690 - protein, 64 aa, Lactobacillus paracasei
MPMKPRQMIKLLKENGFHEKSQNGSSHLKMYNHKTNKTVMIPIHAKELGKGLEQAILSEANLKR

SEQ ID NO: 1691 - protein, 142 aa, Lactobacillus paracasei
VVRVTRYFSPIDHDKTIENAKEVLGNYWHHKRLAQRTKIALRSPVMDGMPKSPSYGNKAEDKVISHADELYYIACCEGAIESLDSANHRLILTSSYLTKRYSDQQIMDKLFLSKAQYYRTKREALIAFAEICPLVEIEMRPL

SEQ ID NO: 1692 - protein, 75 aa, Lactobacillus paracasei
MNDLDSKRALAENLRKNIYDLNMTQATYAKEIGIPITTLQYAISGRGSVSLNTLDKIAQGAGLDPWELIRPPEDK

SEQ ID NO: 1693 - protein, 72 aa, Lactobacillus paracasei
MSKSKDIDVYLQGELCAKAELATKLLHDIAWSKWTTDAMTARVDPIYKQAREISYWLLNSDDWYTENEDGDE

SEQ ID NO: 1694 - protein, 140 aa, Lactobacillus paracasei
MKREIKFRAWDKAHECYLYDVQGAYDMLSGCVKYENGENAAYDEECFAGFLDNDQYVVEQFTGLTDNNGREIYEGDVVRTGKDNIGDPEPMIGQVIMREGSWLIENEKKQEAIDLFSEITSREVIGNIFEDKQLLEGKHE

SEQ ID NO: 1695 - protein, 68 aa, Lactobacillus paracasei
MKREIKVIRMPSGEYLCNSGWGGKGQTLDLSGAIKWYGEKGETDPYKTAHYWGGKVVVLREVQDETRD

SEQ ID NO: 1696 - protein, 86 aa, Lactobacillus paracasei
MKYFDTKEPYYSLIVANNADEAKKIYRQMYGDQDDPDKFQELSREEALYHLTIAKTEDGDILTYEEVQKSLDEKVPSMLLVDHVIL

SEQ ID NO: 1697 - protein, 118 aa, Lactobacillus paracasei
MSNETKQDVFEAVWNRLAGYQVFFNGWPREAIDEYKKRYDAALPDDLPVIPQAVGEYIKANRGHMSLTSGIENASCISEWLWGKGFDYGNDSVFARAWVLGVWRVEETGEIVKLEEEK

SEQ ID NO: 1698 - protein, 68 aa, Lactobacillus paracasei
MNKQEVNLKSGGRACYFVAKVSDFGNAHRVSPIYFNRERAVLQLNYLKKKNADDSYAMFETTGWRCVL

SEQ ID NO: 1699 - protein, 71 aa, Lactobacillus paracasei
MMMIKLDSGKLLNLSAVSYISNTEMLAYFKQPVITNENNFETAKCFGVGVTEADIERIANNNANKEVTDDE

SEQ ID NO: 1700 - protein, 187 aa, Lactobacillus paracasei
MSEEKLYAVKNDEGKYWDFEDRDDFWELSYASCPTTDNELDAKDVIHDHGGHVVALVEVPEKVTVSPEEAKLVKNCLWTNLQDAFLNNINLLFRGRRPEDVTRLKSALTNGYTVAKEKKYLVYKELGGKQKNKQFAQAYRSSVYPGTVSWILTNEVTNRSFAQFTESEIEHFGLQDCEKKEVTDDDD

SEQ ID NO: 1701 - protein, 41 aa, Lactobacillus paracasei
MKTGDDTFDDIYISKETGKVVGVMYEGVDYKLVAIKQEDEK

SEQ ID NO: 1702 - protein, 202 aa, Lactobacillus paracasei
MKQGRVYKFWTQNEIDRVKNEVIMAADTNAILNYEEIAEMFGRTISSVEHVVNDLRKQGKLPKFCRNNQQEKYRSLYSKSEKKMIASLIEQKYTYEEIAIITGRTKYGIQEFWRNNGYARTRKWTHEEETALLQSVKFDSYGIVENYEELQRLFNRGYDAIKAKIYDLRKKGRLPKAKRTGMPEAKREEFKRYANRFFTKSV

SEQ ID NO: 1703 - protein, 307 aa, Lactobacillus paracasei
LKRNEQLFQTYFKKWIETYKHNYVTPVTYRKWENTERMLKLLAPQLKVTQLTRRSYQQLLSQYAETHEHQTCMDFHHQLKCVIQDILDEGLIKRDPTLRAVIGGTRHREHKIKFLQPEELEKLLQDLNLGKELDYDYMILLLAKTGLRFAEALGLTPADFDFDSLTLRINKTWDYKSTTGKFAPTKNKSSVRTIAIDYKTAAKFAMLIQNLPKDRPIFVPDGKRIYNETINDILKRHCENAGVPVISAHGLRHTHASLLIGKGINLQAVAKRLGHSSSLTTQKVYIHLLKDTETSADAKIGQLMAAL

SEQ ID NO: 1704 - protein, 236 aa, Lactobacillus paracasei
MTTKFTADVVHKLLGVREAQQAPAALMKIVMDQQKRNELFKQFLDVSTDVSHDWFSEYFMSVQADRKDKKQDFTPESISKLVNMLVGSNDSSEYYEVAAGTGSMMIQRWQQDRLKHKPWDYRPSMYFYHLEELGDSTLPFLIFNCAIRGMNATIVHGDSLTRAARQVYFIQNDEDDYLHFSTVNVMPHSKDVEQEFDIRQWLEPEQNHIESTEIPARYNEAIQKLTAGKEDKLEEK

SEQ ID NO: 1705 - protein, 111 aa, Lactobacillus paracasei
MNSIRIQNGKVFVNGIEVGQVEKIHFKAEANDPVEVEMKWLVPVRGLDVSVYQPEPRQQQPEADAKQQTINDLTSKLEAAKQANNDLSQAIKDAQSIKDYSDQAVKSVSAK

SEQ ID NO: 1706 - protein, 121 aa, Lactobacillus paracasei
VNRIIIPLPLMTLNQYIKVERGNMFGGAKVKKQATETVMLAVRKAMNQGVKFQWGKPLSFDWYWYDKRTDPDNIAFQHKFIFDGMQKAKFLENDNWDHIVELRDRFFIDKANPRVEVEEID

SEQ ID NO: 1707 - protein, 84 aa, Lactobacillus paracasei
MQAIKTKMMVGDLVVVPDRVFMGVRDLGGVARIIRIERYNARCASQDINKPVAFDGKAPKELITTVEMIDGKQRQYYLKDVKPA

SEQ ID NO: 1708 - protein, 95 aa, Lactobacillus paracasei
MIEHEDETNNAGQDWARERLRNFIDDHPSLPIYRFALIAGVSRITIASFLSGKEVMMITLTKIAKAMGISLEKLKQPISKEEYKELQEESSNASN

SEQ ID NO: 1709 - protein, 114 aa, Lactobacillus paracasei
MAYPTMTLKEFNEYMQEGHYQYSLFIILQLDEAMEYLKKAQQADADMKKFWYQWAYVTLVDALETAESEYYGETSAYLPTKETDPVTRAYCQNTYDIWRGYLKKLNVNLPKQKF

SEQ ID NO: 1710 - protein, 420 aa, Lactobacillus paracasei
LTKKLYDPSNPEPHVMYGLYTKPELIKSEWIDPKWFSSQQYAAVVAYMNKLPGDVDTLELQDGFDTAHPGVMSVTDWQYIMTSDFGTSRFDWWVGKLKRDYFRSQLIQTAQAYSEEPSEDNLTAMMVASQNATAASQTVTESSIADLAADMEDKMIHGATENGIKTYFTLNNILGGGLMPGRLLTIGARPGVGKSAFAVNLIIEALKQQPELTVDMFSLEMSNAENYNRLLACKTGISAGKFINPQKSLSDAEKVEVEKAGNVLKDYHLQLYDKQVELPQIVKTMRQRAADADKGYLAIVDYLGLIGVRSQADRRLQIEEITRQFKVLTNELGIPIVLLSQLSRGIENRQDKQPVLSDLRESGSIEQDSNAVGFLWNSDRQNERSDIRTVTLTIAKNREGALGSIDFRFFAPKLQFKVAY

SEQ ID NO: 1711 - protein, 270 aa, Lactobacillus paracasei
MNESPSYYAIIPAGVRYDKQIPQGAKLLYGEITALSNKNGYCWASDGYFSDVYKVSKVTIQNWLKALENGMYISRQVNYKHDSKEIDKRYIRILGTPTQENLGTPTQKNFRENNTSTNKNIRASSTLESDFEKLWKLYPKKIGKKPALAAYKRAMSRKKNPATNRQIQDGIVAYRQLINSKGTEKRFVKDGSTFFNQEAWNDYLEVVKEERDEQDARKPKFNPKKTAIAMYIDYNSPDRVLEEIQAQGIPINPEDAKRYIAEYDEGRQQA

SEQ ID NO: 1712 - protein, 185 aa, Lactobacillus paracasei
MAITMDYSQAAEGNGDIQDGVYECVINRFGFDNYKDREFIKFDLIVRNDVPQKYQNKHIFDNQYPKKDTGEYAMGYLFMIGKNAGIPDHKAWADLAAMLADFTGHAVKVTVKNEEYNGKTYPHIKKWEPTAFPQIQHRWKDSKDESSSNSNPSFGTPAQASQTNTADPFANNGKPIDISDDDLPF

SEQ ID NO: 1713 - protein, 235 aa, Lactobacillus paracasei
MQPIKHASAIDRTNNWRVLIYGKPGVGKTSAIRNLDGKTLVLDLDDSSKVLSGAPNIDVQPFDRSKPSEEWKEFLKNLAERVSGYDNLVIDNVSAFEKDWFVEMGRHSKNGIGNELQDYSRWTNYFARIMTMIFMDAPVNVLVTAWENTRDVTSETGQSFSQYAPAIRDSVRDGLLGLTDVVGRVVVNPKTDGRGVILEGTDAIFAKNRLDNRKLVPIKELFKFGNQEKSVKQED

SEQ ID NO: 1714 - protein, 163 aa, Lactobacillus paracasei
MSTLYDLQGKYASLLELAEDGTTDPEVLADTMDSIVDAINDKAEGYARVIRQIKADIEANKKERDRFEARIKAYQSNLGTISQRLVEAMNETNQRKIKTPLFTISVAKNGGKQQIYIDQDNLQADVFKVKREPDTDKIRERLEAGEKVLGAELKPRGEHLLIK

SEQ ID NO: 1715 - protein, 67 aa, Lactobacillus paracasei
MTNEEYERILAAANRQIAKYRKVAADYGPDNTDFHQTYAMGQEDGAHAILFIIKQAMKKAAGPHAND

SEQ ID NO: 1716 - protein, 50 aa, Lactobacillus paracasei
LNEAERTIGDLLKEHNKLTLDIMRGNHTPIAKMLLVENEKLRARLAKLRG

SEQ ID NO: 1717 - protein, 30 aa, Lactobacillus paracasei
MIGYLLIAGGFGVIVGHCLGHSGNWRQWIE

SEQ ID NO: 1718 - protein, 118 aa, Lactobacillus paracasei
MPLLQVVEDDQISNKKYLAVDEEELAKMIKENQELKRKLAARGMWTLTTATSYVEGHNNTWVVNNILNVPRFHKFLQDTVVSYPPPGKKGYLFHPKPWLDFLDKWFPEISRSLREKEK

SEQ ID NO: 1719 - protein, 81 aa, Lactobacillus paracasei
MDLPYKKVFAPTSGNIGAVFSSKDVAIKSAYSFKDGNEFFMIRNLIVNGKEEVLVERASNVLTVWSTLPLGDESKGSYSVG

SEQ ID NO: 1720 - protein, 58 aa, Lactobacillus paracasei
MNEENKKPRTDMGSTGVTLYTWRTSYPFPPAVKPGDLVTIVIEDEELTHTVGTFAFVS

SEQ ID NO: 1721 - protein, 257 aa, Lactobacillus paracasei
MNELQEFNFQGNQLRTVLIDSEPFFVGKDAATAIGYKNFRDALKTHVKAKYKRESRITTPFGTQTMTVISEPGLYQLAGESKLPSAGPFQDWVYEQVLPSIRKHGAYMTPETIEKAIYNPDFIINLATQLKDEQAKTAALKADNETMKPKALFADAVATSHTTILVGDLAKVIKQNGVDIGAKRLFAWLREQGYLIKRIGADYNSPTQRAMELGLFEVKETAISHSDGHVTVQKTPKVTGKGQQYFINKFLQKEITV

SEQ ID NO: 1722 - protein, 83 aa, Lactobacillus paracasei
MVNVNLDRLKGLMTERHVTQDSLALALGIARSTLFRKMQRGGKDFTAQEIFKMMQFIPLSDQEAIDIFLKKKVAITRHKEMSV

SEQ ID NO: 1723 - protein, 257 aa, Lactobacillus paracasei
MNVGERMKTIRKQKGISADSLAAKIGVSRSTVFRYEKGDIEKVPIEVVAKVANALDIKPEVLMGLKADTVVDKIHDTVVQLHPERQQKVYTYAEKQLNEQQNPDNVVSLDEAHAERNLDEPAFNVEVDGIVAAGYGAFNDDRYEPMDTVKIPDSAIPYHYDYCFKVVGDSMSPYYEDGEFVFVQKTQDVTNGMIAVVEIDDMTFIKKLILEQDRLCLRSLNDDVDEKTGERIYPDFYADDTDNIDVIGKVVGSYAFK

SEQ ID NO: 1724 - protein, 223 aa, Lactobacillus paracasei
MKKSLLVGLSILSVFLLSSCGSSSNSSANANSKTQNAETSKTSRSDTKRVSGKLTKVGTYSVRDGRKATLVKIFHPSQKLTFQENQKSVEVGFDDIKIIENDIQDSSIKKDLEDVYKTSIPGDKFYIVQIDFSLTNKTGNDAYLEGISTLTIGNRSLSDGQFYDPTPGVTVSNNAAYSNSIVAVIEKNEINFSRLGIAFENIDEPGQSNMLMKPTSSQYLSLN

SEQ ID NO: 1725 - protein, 375 aa, Lactobacillus paracasei
VASISKRGKKWQYRVSYKDNDGTRKYVNKGGFPSKKAADIAATEVERQHNRGANLDLNKITLIDYWDKWIELYKSGKHSRITEARYKTIRKQLLAYWGESRELKSISKSDWQGFINEFGKKRAKDTVSKLNGYVRSMADSAVDDQIIYTNFTHNVVLTGNEGQAGIIKYLQVKDLRKLVNYCLEFADYEHIAYYIIATGALTGARYSEVIGLTWDHVDLKKHVVHITRTWDHRYGSGFAATKNKSSVRDIDITRELADLLLRLKKEQQEVYVAQGYRDSKQLLFRSIRHNMLSSTAINKDLRTIQKTLDISPAITFHGLRHTHVSYLIANHVDINYISKRLGHANTMITQKVYAHLLEDQRKEQVSQTLQALSRL

SEQ ID NO: 1726 - protein, 122 aa, Lactobacillus paracasei
MNENHKERLWLTSFLAAIVATIAFSVYITEYQYGGDSYYMKIDSQPIISNVEVPVGISIQGYTYEGAAKNAQGKIKNLKLKTDEHDIGPFKSGQIIKITVNKTYGIVDYQRVTKKETPLRAQ

SEQ ID NO: 1727 - protein, 337 aa, Lactobacillus paracasei
MSFFNIKKQAVEPGQRQESDLAGFSFDDVKTDYLYLDMLPTEMPDEMWARIRSVMNLFKKEALSPSVITGDLELDATSRFMSYRDKKKLFLPQTSYHNFYDDLHHRGAANRTQAAFGTHLLEQFKVKPAAGSRTDRYLDDEGRIALKIAHDDRKRVTMMSYFHAGQLTREDSYDEDQRLFASELYAQLPDFQQISLLEPVLTNTTIQATIFNIGGVPIINALPLIKQYWLNNQAGEPVHMFTDMNAILVWWLTQNFLHTDRKLYIDASSELFVQLVNEPAMHDHLIPIINDEPDQLILPQLLKPLRYLVNEQFIERPEVLALPEDVQKIDSWHHFMS

SEQ ID NO: 1728 - protein, 267 aa, Lactobacillus paracasei
MGENEQLSATFELLHADAASPVVISFPHSGTWIPADMRKRLLPTAVLANSDWFLPALYDFLPQTGFTTLINRVNRYVADPNRAVTLDSDHDYRSATIYQRNTFNHPLYARPLPPETLQSRLRTYYWPYRHALTMILKQKQAKFGHAYLIDLHSFAQYPHYPGIKPKTIVLGNDHDRTTSKIFRQTLSAAFAAHDFTVENNFPFRGGDITRYYGHQPNITAIQIELRYDQYIDQRPFREEVLTQYQTDLFRKAQDRLRFLRDFLLKLT

SEQ ID NO: 1729 - protein, 104 aa, Lactobacillus paracasei
MFETNHSRFATFGVISNLPGEIIDSIWMIIDRNLQGVVPLNNLLRFDLQNNQGKLTVHFSENGAATEMSVDLPFPYDPSFPDTVMAYDDGESQTILLPEEGHQK

SEQ ID NO: 1730 - protein, 167 aa, Lactobacillus paracasei
MAKHHNKVEKTLVEKMLDKAGIAYVPYEFPTEEVGDVAQLTVDHLDVPEHQIYKTLVLTGNKTGPVVGVVPLDRHVDYKKLSKVSGNRKVGMVPLKDLMKTTGYEHGANTPIGIHERHKYPIFISQEAEGQATIIVSAGKVGRSVGIDPKILAQFVDAQFADIATQD

SEQ ID NO: 1731 - protein, 175 aa, Lactobacillus paracasei
MTINFKDYIASVQDYPEPGIIFRDISPLMADGKAYAAATDEIAAYAQDKGVEMIVGPEARGFIVGCPVAYKLGIGFAPARKKGKLPRPTVKASYDLEYGEATLYLHKDAIKPGQRVLVCDDLLATGGTIAATIRLVEQLGGIVVGTAFLIELSDLHGRDKIKDYDMFTLMSYTGA

SEQ ID NO: 1732 - protein, 764 aa, Lactobacillus paracasei
MTQYQWQLAPQPAAADEHALSETLGVPPFLATLLLQRGINDQADYDAFVHPDTSRLHDPFALHYMDKAVARILKAIEQNEKITIYGDYDVDGLTSSAIMLETLQSLGADPDVFIPDRFTDGYGPNAEVYAYLQKTGTQLVITVDNGVAGAEVIDPAQAAGMDVVVTDHHELPANLPHAVAVVHPRHPDGDYPFGDLSGAGVAFKVATALLGEPPIESVDLAALGTIADLVSLTDENRVIAQLGLKMIQTQPRVGLAAILKEAGVAPETVNETTVGFVIGPRLNALGRMGDANPGVTLLTTFEDDVAAELAEQVGKLNQERQGLVAKIAQEALTMAQAPENQAAKTLLLASKGWHEGVVGIVASKVVEATGKPTLIMNIADDGETAKGSGRSIEAYHLFKALEPAKEHMVHFGGHHMAVGLTAKTTDLPAIHAQMEAAAATMLKTVPKPTLPISTRLEDADLTLNHYQLIRQLAPFGQGNPEPVFSVRPQVIQNVKQIGKENNHLRFQIDQGINVIGFGYGDAAETLATAQAVKLAVQLDQNTWQGHTSLQLMLKDYEVKQPQVIDWRMPTIDGGQFKASRTYVFFDAKVKQQFERQFSFGGPTTIAAQVQAPLANAVLVDLPKDAAALHQVMQYVQPPVAVMFYGAPSRLVAIPTRAEFGAVLRFLKAHPGFDKHHIPAIAKAVHLTVHQVILAVQVFFELDFVTIEGAFISPVTAPAKKPLQTAKAYAARTAFLDLAQQLQTMPRAQLETMLLTEHSDSEVES

SEQ ID NO: 1733 - protein, 123 aa, Lactobacillus paracasei
MAKSQDQFNEKVGKEINVSDEAVDKAAAQIEKVGYVTEKDVPEMIDRDYTRALSKKVSAKLHKDNDDDYFYEEPFDYENGRIANIMWDMDKIKTREEAMKILADELGLTVPKIVMRKIDEQVF

SEQ ID NO: 1734 - protein, 173 aa, Lactobacillus paracasei
ASCHDMAINPRTEINMADQQELDDFFAHAKAALDLPADTYEDAYQLGGAKFADKLAALVKTGKKTATSSGFELYTIEQDPLPNAGVYNIILNRADKPVALTFTDNVFVTPFMKVTADIAKREGEDDQSLASWREVHQAFFSQEYQANGIQFDPESSMVVVEEFHTVYPVVQTR

SEQ ID NO: 1735 - protein, 77 aa, Lactobacillus paracasei
MNLKHRTAITEKKVTQKLDDIPHPTLDATLYLLVFSITAIGGLVSYGAYQLFKPERKLAHKAKTLVDEHEDDHQHEA

SEQ ID NO: 1736 - protein, 612 aa, Lactobacillus paracasei
MNQEEMLDRQKHIRNFSIIAHIDHGKSTLADRILELTDTIAKRDMQAQVLDDMALERERGITIKLNAVELHYKAKNGETYIFHLIDTPGHVDFSYEVSRSLAACEGALLVVDATQGVEAQTLANVYLAIDDDLEIIPVINKVDLPSAQPDVVKEEIEEMIGLDASDAILASGKTGLGVPEILERIVTDVPAPSGDLNAPLQALIFDSVYDDYRGVVLDVRVKEGQVKVGDTIQLMSNGKQFQVTEVGVMSPKAVKRDFLMVGDVGYITAAIKTIQDTRVGDTVTLADRPAEKALKGYRKITPMVYSGLFPVDNAKFNDLREALEKLQLNDAALEFEPETSQALGFGFRCGFLGLLHMDVVQERLERDYDLDLIMTAPSVDYEIIMTDGTEKTIDNPADMPEVSEIKEIREPYVKASIMVPNDYVGPVMELSQRKRGEFVTMDYLDKYRVNVIYNLPLSEIIYDFFDDLKSSTKGYASLDYEITGYRQSDLVKMDILLNGDPVDALSTIVHKDFAYERGKAIVARLKTTIPRQQFEIPIQAAIGNKVIARSTVKAYRKNVLAKCYGGDITRKRKLLEKQKAGKKRMKSVGSVEVPQEAFMSILKMNDEESQGK

SEQ ID NO: 1737 - protein, 302 aa, Lactobacillus paracasei
MQYGATFRSLRRSKGLTLKQVADDVNSISLISQFEHDQLHISTERFIHLLDRIAVSFDEFQVIRTGTAKSVSEQQIEAYLNLIRYSYDRLSHPYDHEAIDQRLTMLERQNEKRYSLQLDHFLQIRHGYAHFGHPPYLSGIAYYLQNVDQWGLHEMRLFKQSARLFPLAVNRQFIDNVKRKSALLAAIPGYQRELFYVYFTAITAYITQTHFAEAAQCLNLAQREAKKAELADISIFLPFMAGWLKLFEGAESEAATLFDQTLTLYHQLGMKHHETVWQDVRRSEIAHYKANEPSDFFVFDGI

SEQ ID NO: 1738 - protein, 533 aa, Lactobacillus paracasei
MTFFQELLRLKWRLVTYIGLYGLMTSALTATAILSGNAMTALTHFHRTMFIEAALLLVMVTITQLALATLTNIDQFVLQRHLNNNIRRQLVANIAKMSYLTYHRRTDAVYTSWLTNDMNTINQQGLRYFSYMIQAIWQVLLSAIVLVNYQISFLPTVTLAATALLIVPLLYRKRLARAAAEFSHQNERLNKKISDVLAGFDTLLMANRQTLLINRITHASDETGQANLHYMQFDMFTQFLINLVNLASQLALLIQAGLLAYQHQLAVGAVVTIYSLGGSTFSGLTLLSFSLTTLKSVKPIFKKFGAAAITLPSTGQKIGPLAHALKIKQLDFTYGNCREPILRQLNLTISALTKIAVVGASGRGKTTLVKLLTGLLQPTHGGIYWDQMPYPEIDGGSLRNQITYIDQSPYLFNASIRFNITLGDPFTDRQLNQVLTLCQLTTFVANQPHGLETILSQNGSNISGGQKQRLVLARGLIRNRRLVITDESTAALDEPTAIKIEQLLVTLPNITLIMITHHLHSQIAKQVDRIIKL

SEQ ID NO: 1739 - protein, 387 aa, Lactobacillus paracasei
MADQKDYYETLGVSRDADDDTIRKAFRKLSKKYHPDLNHAPGAEQKFKDINEAYQVLSDPQKRAAYDQYGSADGPQGFGGAGAGQGGFSDFGGGQGGFGGFDDIFSQFFGGAGGGAQANPSAPRQGADLQYRMDLTFEEAIFGKDTKISYDREAVCHTCNGSGAKPGTSPVTCHKCHGSGYIQVQRNTAFGAMMTRQVCDVCGGTGKEIKEKCPTCHGTGHEQERHTIDVKVPAGVEDGQQMRLQQAGEAGTNGGPYGDLYIVFRVAPSKKYQRDGSEIYLTIPLSFAQAALGDEIKVDTVHGAVELKIPAGTQSQTKFRLRGKGAPRLRGNGTGDQIVTVEVQTPKHLNEKQKSALMQFAAASGEDVTPHNGTLFDRVKEAFKGGK

SEQ ID NO: 1740 - protein, 624 aa, Lactobacillus paracasei
MSKVIGIDLGTTNSAVAVLEGNQPKIITNPEGNRTTPSVVAFKDGEIQVGEVAKRQAITNPDTIVSIKRHMGEANYKVKVGDKEYTPQEISAMILQYIKKFSEDYLGEPVKDAVITVPAYFNDSQRQATKDAGKIAGLNVQRIINEPTASALAYGLDKGDKDEKILVYDLGGGTFDVSILQLGDGVFEVLSTNGDTHLGGDDFDNKIIDWLVAEFKKDNNIDLSKDKMAMQRLKDAAEKAKKDLSGVTQTQISLPFISAGPNGPLHLERTLTRAQFDEMTADLVAKTKIPVENALKDAKLTNADIDKVILNGGSTRTPAVQEAVKQWTGKDPDHSINPDEAVALGAAIQGGVISGDVKDVVLLDVTPLSLGIETMGGVFTKLIDRNTTIPTSKSQVFSTAADSQPAVDIHVLQGERPMAADDKTLGRFELTDIPPAPRGVPQIEVKFDIDKNGIVQVSAKDLGTGKSQNITIKSSSGLSDEEIERMKKEAEENADADEKRKEEVDLKNDVDQLLFQTDKTLKDVDGKVPEEDIKKVKDAQEALKKAQQENNLDDMKQKRDDLNKLVQDMTVKLYENAQKNQQAQGGPASGAATDAGAAQGSDDKKSDDDTINGDYKDVSDDDKK

SEQ ID NO: 1741 - protein, 196 aa, Lactobacillus paracasei
MAEQKAKHAANAAKKAEKSADTKETSLKEDILQESIADLNEQLSNSKHDGEQLKQERDDFEDKYLRAAAEIQNMNARFEKEQQKLLKYDGQKLAKAILPVVDNLERALATEAKDDSAASLKKGVQMVYDHLERALKENGITAIDGAGDKFDPNTQQAVQTVAADDQHPADTVAQVLQKGYYLKDRVLRPAMVVVAK

SEQ ID NO: 1742 - protein, 348 aa, Lactobacillus paracasei
MLTKRQLLVLKEIIRLFTESGQPVGSKTLMQELPVHVSSATIRNDMAALEDAGLITKTHSSSGRVPSTQGYRYYLDHLVEPVRVSRHDLATIKQKLGQRYSKMDEIVAQSAQILSNLTSYTAISLGPEVNNIKLTGFRLVPLGNHQVMAILVTNNGNVENQVFTVPPSISSDELEKAIRIVNDQLVGLPLVQVAQRLRTDVPSMLMQYLTSPDGFLDIFGNVLKSAASERFYVGGRLNLMDYLGDSDIHELKKIMSLIDADHGDLTELLGGPIRQTPVQVRLGPELKPIDLANLSLITASYDVGGHGTGMIALLGPTQMPYSKMIGLLDVFREELAKRLTDYYANFDQ

SEQ ID NO: 1743 - protein, 381 aa, Lactobacillus paracasei
MAGAYLHIPFCEHICYYCDFNKVFIEGQPVDDYVAMLLKEMRMVMAEHPEEKIQTVYVGGGTPSTLTPTQLATLCQGIHDILHFDQGEFTFEANPNDLLTTEKLQVLHDYGVNRLSIGVQSFNDDVLRRIGRIHRAKDVYTAIANARQVGFDNISIDLIFRLPDQSRDDFLTSLQKALALDLPHYSTYSLILERKTIFYNLMRQGKLRLPTQDVEADMYQDAIDLMEAHGRHQYEISNFAKDGYQCEHNLLYWRNDKYFGFGAGAFGYLGRDRYHNYGPIKQYLTPLHADHLPVLEHHLVPQSEQIEEEMFLGLRTMQGVSEARFYDRYHMTVDAIYGETVPELVSQGLVVRQDGYIRLTNKGKFLGNEVFQRFLIDEPLV

SEQ ID NO: 1744 - protein, 315 aa, Lactobacillus paracasei
MKTIDIQPPLQVSAAPPQPIVLTLGFFDGVHRGHQAVIKTGKKIALAKKIPLAVMTFNIHPAVVYRGVSETDIRYLSTREEKIKIMQSLGVDYLYVVHFTPDFAALTPQAFVDQYLVGLKADTVVAGFDYTYGKRDVASMALLPKYACGRFDVISVPELAEDGQKVSSTRIRHALDSSDIDTANDFLGYTYTTAGKVVHGEARGRLLGFPTINLETLGQQRLPGIGIYAVKVKVGTTWYLGMASIGRNVTFGADRDVTLEINLLDFNQMIYGETVQVRWYHYLRGEVKFAGADALIDQLKKDETAVRDYFAAKKG

SEQ ID NO: 1745 - protein, 301 aa, Lactobacillus paracasei
MNGILPLYKPTGMTSADAVYHARKILGIKKIGHSGTLDPNVDGVLPLAIGAGTKAVPQLMASGKVYTGEITLGFATTTEDLDGEVVDNTPLTQPFTADQLDAALTAWTGNITQIPPMFSAVKVNGRRLYEYARAGETVKRPERQATVSQFTRTDEPVFSATDGTQRFRFEVHVSKGTYIRTLAVDVGKTLGVAAVMSQLTRVKSGGFTLKQAVSIEQLKAHAAAGTLADVIQPIDIAFADLPQVDLTVEQFEAISHGRFLSLDQQTPRVRLHFAGVLKAIYRREDDQYRPDLMFLANEKNV

SEQ ID NO: 1746 - protein, 263 aa, Lactobacillus paracasei
MHGIIIIIEKGRITIKLLGALYGPFFSAHNWQLAFSVSGLVTIFSLILLECMLSVDNAVVLAAQTEQLKVESERKKALMYGMGGAYIFRFIAIGLGTYLLQFWPIKAIGAAYLVWMSASYFYEVRHPKNQRGAHGKRPHGLWGTVIQIESLDIVFSVDSILAALAVSSNPVIVLIGGCLGIFAMRLVAQVITTFIDRVPELETAAYILVGLIAIKLGLSLPMIDVKTPDWLFSVLVVLVFIWAGWRHVEHEKHHHSMYKKSKP

SEQ ID NO: 1747 - protein, 117 aa, Lactobacillus paracasei
MKHRIGRVETQIQREVDDILLKDVNDPRVKGVTITGVKLTGDLQHATIFYSILDDAPDKVEAAQTGLDKASGLIRREVGQRIRLFKVPEIEFAQDKSVQYGARIDQLINEVRRKNLE

SEQ ID NO: 1748 - protein, 943 aa, Lactobacillus paracasei
MGKKRVYEFAKEMHVDNKDVIDIAKNLGIEVKNHMSSIDQDQEAKIKGMLSKQSAGKTPSSQAAKTPAKAAKTSSTAHKEAAKKPVAASAKSNDHADAAEHSQKNAKPAAKQENKPARSNKTSDGKIILSKSTILRPRSTQTAHTNTNHNRGGNTASANNTANGRNSNRSNNNNNNRSANNANRSGNNNRSNERNRNDRNRRFDNQRVTGPMPRAGRPTAANGNPRPVAGNGGKFVKPASERQQPKRQEAVKPANAASKRSEQPRTERPRTEQPAATTNQRFTKPAPVPAAAAPKPASAGSQDNRNSRRGGGNSNFGRSNSYGNRNGFNRNNRRNKKNKRRQQSAPKKEMPQRKERPLPETLIYEVGMNAQDLGKILHREPAELIKKLFMLGVMVNQNQSLDKDTIELLATDYGIDAQEKVHEDISDLDKVFEEENKNQDNLQPRPPVVTIMGHVDHGKTTLLDKLRHTHVTEGEAGGITQHIGAYQVKLRDRLITFLDTPGHAAFTNMRARGADITDIVVLVVAADDGVMPQTIEAIHHAQAAKAPIIVAVNKIDKPGANPDHVMEQLTEYGLIPEDWGGDTIFVKISAKFGKNIDELLEMILLEADVLELKANPDQKAVGTVIEARLDKGKGPVATVLVQQGTLHTGDPIVVGNTFGRVRAMTNDHGRRVKDALPSMPVEITGINDVPQSADKFVVFADERTARAAGEERAKRAQEEERKNTNHVTLDNLFETMKEGQLKEVDVIIKADVQGSVEALAGSLEKIEVKGVRVNIIHQAVGAINESDVTLAAASNAIIIGFNVRPTALAKAQAEQDDVDIRLHSVIYKAIEEVEAAMKGMLEPTYEEKVIGTVTVRETIPVSKVGTVVGGYVDSGYITRDAGVRLVRDGIVKYEGKLGSLRRFKDDVKEVRQGFELGLTIENYNDIKVDDQIEAFTMEQVPVK

SEQ ID NO: 1749 - protein, 101 aa, Lactobacillus paracasei
VTMQKQAVLNLLGLARRASRLVTGDNLVLGAIRSREAKLVYVANDASANTRKKFSDKSSYYEVPLVTEFSKMELSQAIGSDRSIIAVVDAGFAKKMQQLLT

SEQ ID NO: 1750 - protein, 97 aa, Lactobacillus paracasei
MKKRKIPMRKDLLSNQMMPKKELVRIVKNKENVVAIDPTGKAAGRGAYVALDPAAVKAAKGKKLIDAAFGITIEPTFYDDLFAYVDHQKARQELFGK

SEQ ID NO: 1751 - protein, 417 aa, Lactobacillus paracasei
MSKEMIQALDALEQEKGVKKEVVIEALEAALVSAYKRNYNQAQNVDVEFDPKQGDIHIYAVKEVTDEVFDSRLEVSLKEALAINKAYEIGDQIKFEVTPKDFGRIAAQTAKQVIMQRVREAERSIVYDEYSQYEDEILQGVVERRDNRFIYVNLGKIEAVLGRQDQMPNEKYEAHDRIKVYVTKVENTSKGPQVFVSRTHPGLVKRLFEQEVPEIFDGTVEIVNIAREAGDRTKIAVRSTNDAVDAVGTTVGPRGARVQAVVNELSGENMDVVQWEEDPADYIANALNPAQVIAVQFNDEANDRSATVIVPDYQLSLAIGKKGQNARLAAKLTGYKIDIKPESEVEFVDDDELPEAEAEAAAETNDNADAATDAETTPDSDAAAADDADDAKTASDAPDSADQAPVTPSATDHPAQA

SEQ ID NO: 1752 - protein, 159 aa, Lactobacillus paracasei
LSTQSVVETVTALVKPILDDHHFYLTDVEFVKEGGGWYLRVYIDKTGGITLDECVMVSEALSEKLDAMDPDPIPQQYFLEVSSPGAERPLKHETDYEQAVGDYIHVSLFKKLDGKKVFEGTLKELLPDQLTLTVKDKSRKFDQVIDRQLIASARLAIEF

SEQ ID NO: 1753 - protein, 1444 aa, Lactobacillus paracasei
LALSQHEMFEKLLDQLDLAADVRQDPSLTSGTVQNVTIHEQSRRYDFTLGFDAILPFQIFNAIATKLPLVFQQIAATDLSVEVTQPTITDELLAQYWQYVVTHAEIGTGIVRELCEKQVPTLENDRAVIKTENEQIRQYLIQQGLGKLEETYRQVGFSGLRMQAEVDEEQAAQSMAAFQAQRAEETAKMAKAAAEVVKQQAAKQKQVQTDGPVQMGRQMKMTDAPQQMVTITQEERSVTVEGYVFDVEVRELRSKRQLLIFKVTDYSSSFIAKKFSNGPEDEAMFARIQKGQWLRVRGSVQEDNYSRELTINAQDIQTVSHPDPTDDAEGEKRVELHLHTNMSQMDAMNPISDYVKRAKEWGHKAIAVTDHAGLQAYPEAHSAAVKAGLKMLYGVEINLVDDGTPVAYRADEPRDLASAEYVVFDVETTGLSAVYDKVIELAAVKMKDGKVIDQFEEMIDPGFPLSELTINLTHITDDMVHGSKSEVDVFKLFQQFCDGAIMVGHNVTFDVGFLDNGYERHGLADIDNPVIDTLELSRMLHPERKNHKLDTLAKQYKVSLEHHHRANADAEATGYLLYALEKEAAKMYGMTTLNQLNDRVGAGDAYKAARPSHAIVFAKTQAGLKNLFKLVSLSNVKYFYRVPRVPRSQLQKLREGLLVGSACSSGEVFTAMMQKGEAEARAKASFYDYLEVQPLPVYQPLIEAGLIKGEAHLKDIIQKVIKIGSELEKPVVATGDAHYLDQHDAIYRQILIHSQGGANPLNRHSLPDVHFRSTSEMLTDFSWLGEEKAHELVVDNSNLIANWVDDDITPVKDKLYTPEVPGVEENLKHDVMTTAHELYGDPLPDIVAQRLDKELKSIIGNGFSVIYNIAQRLVLKSNKDGYLVGSRGSVGSSLAATMAGITEVNPLPPHYRCPNCQYSEFFTHGEIGSGFDLPDKQCPKCGADLHKDGHDIPFETFLGFHGDKVPDIDLNFSGDYQPIAHNYIKVMFGEDHSFRAGTIGTVADKTAYGYVKAYERDTGQQLRGAEIDRLAQGDTGVKRTTGQHPAGILIVPADMDIYDFTPIQYPADDQNAAWMTTHFDFHSIHDNILKMDVLGHDDPTMIRMLQDLSGVEPKSIPTDDPGVMALFSGTKSLGVTPEQINSKMGTLGIPEFGTRFVRGMLEETKPTTFSELLQISGLSHGTDVWLGNAEELIKQGIVTLKEVIGCRDNIMMDLIHWGMEDSMAFNIMEHVRKGRGIPDDWQKAMRENENVPDWYIESCLKIKYMFPKAHATAYILMALRIAWFKVHYPLIYYTAYFSVRAEDFDLAAMSHGKEAVKAAMKEITDKGMDASTKEKQLLTVLEIANECLERGFKIKMIDVTKSDSHNFLIQDDHTILAPFRAVPGLGDNVAKQIVAAREEKPFLSKEDLANRGKVSKTLIDYMTTNHVLDDLPDENQLSLFDGLF

SEQ ID NO: 1754 - protein, 575 aa, Lactobacillus paracasei
MKQSRMFIPTEKEVPSSAEAKSHKMMLRSGFVRQIQAGVYAYLPLAERVLARIEAIIDDEMTKIDAVKMKMPVLLPAELWEESGRYETYGPNLFKLKNRQDRKMILGPTHEETFTDLVRNELKSYKRMPLVLYQIQDKFRDEDRPRYGVLRGREFIMQDAYSFTSNDQDLDTIYRQMEHAYTNIFDRLGLRYRSIIGDGGAMGGKDSKEFSAIADIGEDTIVYSDSSDYAANLEMATSMALPKQGVEEQAALEPVDTKDAKTIAEVAEFLKVPEKKLIKAVLFMADGAPVLALVRGDYEVNPTKLKNLLNADFLDMATPEQVQTVMHAEVGNIGPVNVDKDVRIIADNSLSDLTNLVAGANKAHTHLLNVNFDRDVTPETYADIRFVTEGEVSPDGQGVLKFTRGIEIGHIFKLGTRYTETMGANFLDENGRSQPIIMGSYGIGVSRLLSAIAEQQADEHGLVWPTTIAPFDIHLIPVNLKREEQKSLTASIETMLEDAGYSVLVDDRNERPGVKFADSDLIGVPLRVTVGKKAVDEIVELKLRKTGETIEVKKEELISSIKILMGQLNKQEQDN

SEQ ID NO: 1755 - protein, 413 aa, Lactobacillus paracasei
MTTIIAFIVIFCILVVVHEFGHFYFAKRSGILVREFSIGMGPKLWASHKNNTTYTLRLLPLGGYVRMAGWQDEEDEIKPGTMLSLILNDQGKVVRINASDKTTLAGGMPVQVSRVDLVKDLVIEGYPNGDETALQTWQVDHDATIIEEDGTEVQIAPEDVQFQNAPVWRRLLVNFAGPMNNFLLAILAFIIYGLFFGVQVLNTNQIGTVVPGYPAAEAGLKSNATVQTIDGQKMSSFTDLSKIVSKNAGKSVTFTVKENGKSKNIVIKPNKEGKIGVEVHVDKSPANAIPFGFSQTWNLAVRTWDVLKSMVTGGFSLNKLAGPVGIYTMTSQSAKGGIQGLLFFMGYLSLGLGITNLLPIPVLDGGKILLNLIEIIRRKPLKPETEGVVTMIGLGLMVLLMLAVTINDIMRYF

SEQ ID NO: 1756 - protein, 262 aa, Lactobacillus paracasei
MKQRVITAVVALAIFIPILIAGGGWIDIAGAVLAVIALSEVFIMRKRILVSADYLIAALGVLVVVLPNSFFRWLPAFLGRIDLIYIAVALLLFLTVTTKNKTTFDDIGVSVLSFFYIGTGFHYLISVRNDAGLDTLMFALLIVWLTDTGAYMIGRKLGRHKLWPAISPNKTIEGSLGGIALALITAAIYLMFFPQYYTFWPMMGIALFLSVIGQIGDLIESALKRFYGVKDSGKILPGHGGILDRFDSLLLVLPMLHLFGIV

SEQ ID NO: 1757 - protein, 250 aa, Lactobacillus paracasei
LATSKASKVKLDPARIPAHIAIIMDGNGRWAKRRFFPRVAGHKQGMHNVKTITKAASRLGVKVLTLYAFSTENWKRPGSEVNYLMRLPVDFFNDFMPDLIKENVKVEVMGELDDLPPQTRQASEKAMADTANNTGMILNFALNYGGRDELVHAAQKLAKQVQEGELSPDDIDDRHFANALMTGFLGDLADPDLLIRTSGELRISNFLLWQIAYSELVFVDDYWPDFSPAALEAAIAEYQARDRRFGGLKK

SEQ ID NO: 1758 - protein, 185 aa, Lactobacillus paracasei
MANQIIDQAKVNMGKTEESLQRELGNIRAGRANASLLNQITVEYYGAPTPLNQMAAITIPEPRVLQVSPYDKSSLKNIETALNASDLGINPANDGDVIRLVIPQLTGERRKEIAKEVGKYSESAKIAIRNIRREGLDKLKRQEKDGDITEDDLHRLEKDMQKATDDATKRIDEIAAAKEKEITEV

SEQ ID NO: 1759 - protein, 239 aa, Lactobacillus paracasei
MVKYNRIVLKISGEALAGEAGFGIKPPVIATIAKQIKEVHELGVQIAIVCGGGNIWRGETGAEMGMERAQADYMGMLATVMNALALQDNLESQGVPTRVQTSIEMRQIAEPYIRRKAIRHLEKGRVVIFAGGTGNPYFSTDTTAALRAAEIGADVILMAKNNVDGVYSADPNKDTHAVKYESLTHMDIINKDLKVMDSTASTLSMDNDIDLVVFNLNEPGNIKRVVEGQKIGTTIEGRS

SEQ ID NO: 1760 - protein, 293 aa, Lactobacillus paracasei
MAQITAAQVKELRDRTQVGMMDAKKALVAADGDMDKAIDVLREKGLAKAAKKSGNIAAEGLAEIAVNGNTAAIIEVNSETDFVASNDQFKDYVNNVAAAIAANKPADLEAAKATKMSDGQTVDEGAIALTTVIGEKISLRRFQVVEKTDNEHFGKYLHNGGQIAALTVIEGADDDTAKDVAMHVAAINPEYLDRTKVPAEELKHQTDIFTEETKNEGKPEKIVPRIVEGRVNKWLGEISLVDQEFVKDPDQTVAKYVAAKGGKVKGFVRYEVGEGIEKKQENFADEVMDQIKG

SEQ ID NO: 1761 - protein, 262 aa, Lactobacillus paracasei
MAVLSMKQLLEAGVHFGHQTRRWNPKMKPYIFTERNGIYIIDLQKTVKMIDDAYNFVKEEAQNGGVFLFVGTKKQAQDAIAEEATRAGQYYVNHRWLGGTLTNWNTIQTRIKRLKDIKKMATDGTFDVLPKKEVSLLKKQQDKLEKFLGGIEDMPRIPDVLFIVDPRKEKIAVQEAQKLNIPIVAMVDTNTDPDDIDVIIPSNDDAIRAVRLITSKMADAIIEGNQGEDQDDAQEQQVAADKKADSMEDIVEAVEGDNKSAK

SEQ ID NO: 1762 - protein, 89 aa, Lactobacillus paracasei
MATKTYYFYVLLCADGSFYGGFTDDVKARVATHNAGKGAKYTAQRLPVRLLYHQAFADKHDALSAEWHFKHQTRHRKEVFLEDHQVEWR

SEQ ID NO: 1763 - protein, 247 aa, Lactobacillus paracasei
VFVMSLLPGERVDVLASRNIKIIQSSAVFSFSLDAVLLANFAQVKRHSRVVDLAAGNGAVGLFLARDTDQQVTMVELQPRLADMAKRSVALNQLQNVTVQVGDLADATQMVAKDSVDIVTCNPPYFKVSSQSITSPNDHLALARHELTTDFATVARVSADLLKYQGKAFYVHRPERLAELLTTLTVVGLAPKRLQFIHPREDREANMVLIEAIKAGRPNGIRIMPPLIVHEADGTYSSSVRRLLNGD

SEQ ID NO: 1764 - protein, 216 aa, Lactobacillus paracasei
MFYSFLRYIIAGLIWLINGHAQTQNKQQLPEGPFVLVAPHRTWLDPVFLALASWPHHFSFMAKSELFKNPLMRWLLVKVGAFPVDRAHPGPSAIKVPVRALKDEHKALMIFPTGSRYSADMKGGAILIAKLAKAPIVPAVYQGPGSFWSLFKRKPAIVRFGAPVEPPKGKLTDEALAAFSDKLQENFNALDYAINPEYKYVPDKKKYLEEKEHGEV

SEQ ID NO: 1765 - protein, 464 aa, Lactobacillus paracasei
MNLWKQMTRKPDVQAALNADHLLTRSLTTRDLIALGIGAVIGTGIFILPGTVAATTSGPAITIAFILAAIVCSLAAMCYAEFASALPVAGSAYAYGNLVFGQVFGWIIGWALILEYMLAVAAVSTSFSAYFASLLQGFHITLPAAIAGPFSPSHGTYVNLIAVIVVLIIGVMLSRGMQSSMAINRLMVLVKLVIIAIFIVVGFFYVQPANWHPYLPFGAKGVLAGAAMVFFAYLGFDAVSASAPEVKNPQHTLPRGIIGTLVIATILYVLVAIVLTGMVPFTKLDVADPVAFALSAVHLRSVGGIISVGALAGMFTMMVTMIYSSSRLIYAIGRDGLLPRWFGHVKGHLPENALWTVVLIIAIMGGLVPLTQLVNLVNIGTLIAFALVSIGIIPLRRHQAFNNEGFKVPGYPVTPIISFLFCLLLMTQLSVETWIMSLIWFAFGLVIYFSYGIRHGHVAEKRIE

SEQ ID NO: 1766 - protein, 263 aa, Lactobacillus paracasei
LINPQTATCLVDGKVYAISDGLFLSDLEPKLANIIRNDYPKATKNSFICNPHLLTYRLERMRRQQRQDARAHDKINRKMSQALVKDNFQLTNVYDNMEATITFGERIADAVAKYAGSWPFIIIFSGFMIVWMILNTVGIFGAKFDPFPFILLNLFLSMIAALQAPLIMMSQNRAAEYDRLEAKNDYHVNLKSEEEIRLLHSKLDHIISDDNPNLFESQRLTVEVLGEMVNQLTETRQQLELLKATQDQANKDIAIDQKNKTNE

SEQ ID NO: 1767 - protein, 597 aa, Lactobacillus paracasei
LASKGYESAWSKSIPIRQQLKIMKRLMGYTRPYKRQFIGAIVAAALLAGMNVLLPFILQQFMDRYLANQSATVQILLLFAALYAFGTLVKAVFQFFQTFLFNMGAERGLEDARRQLFAKLHTLGMRYFDQTPAGSIVSRVTNDTMTFSDFWNVILAVIVGLFSVISSFAIMFAANPKIALMVAAFLPILLIVVWYYSTYSSKVYRHMREKLSELNTQLNESIEGIGIIQQFRQENRISQEFEATNEEYLDSRKAMIRVNSLLLSSVINLLYSFALIAVLWAFGLISMHSYVEAGLIYAFTTYTANFFNPMVNMMDNLSFLQDGVVAGSRIFRILDSQEYAPAQHPDAHALIQQGKIEFRHVSFAYDGKHDILHDISFVANPGETVALVGHTGSGKSSIINVMMRFYEFGEGQILIDDVDIRDYPMPELRKKLGLVLQDSFMFYGDISSNIRLFNDSITDEQVKQAAEFVQADRFIDKLPGTYHAKVIEGGTEFSSGERQLISFARTVVTDPKILVLDEATANIDTETESVIQEGLRRIRQGRTTIAIAHRLSTIQDANLILVLNAGRIVERGTHDELLAKRGRYYEMYHLQIGDHAE

SEQ ID NO: 1768 - protein, 585 aa, Lactobacillus paracasei
VGIFRKLGWYFKQEWRRYLLGVTFLLLVALVNLIPPKVIGDLVDAMSKSRLTSSHLAWMLGLLLFSGVAQYLFRFGWRNAIWGGAAKLERTLRTRLFWHFMKMDATFYQKHRTGDLMAHATNDLNAVQNVAGAGILTLFDSMITGGTTIIAMVLVVDWRLTIVAILPMPLLAVMARKLGTRLHAAFSESQAAFSRLNDKTQESVSGIKVIKTFGQEAEDTADFNQIVDHTVQINRRVNMIDALFDPTTSLIMGLTYVITIIYGGWQVVHGQITIGQLVSFVTYVSALVWPMFAIGRLFNILERGNASYDRVDELLQEKSTILEAKDAITTPAHGDIRYQINKFSYPDDQQVALSRVHFTLPEGHTLGIVGKVGAGKSTIFKLLLREFDNYDGVIEFGGHNIKDYSLDALLDSIGYVPQDNFLFSTTVADNIRFSAFEKGQQDVEQAAKESAVHEDIKKFAAGYDTLVGEKGVSLSGGQKQRLSIARAVINAPELLILDDALSAVDAKTEEEILANMKQDRAHKTTIIAAHRLSSVMHADEILVLENGQVIERGTHEQLITKHGWYAEMWAKQEMEAAEEGESLGK

SEQ ID NO: 1769 - protein, 73 aa, Lactobacillus paracasei
LLITVLVGIIALLVGLAGGFFGARAYMKKYFQDNPPVNEEMLRTMMMQMGQKPSAKKLNQMMAQMKQAQRNAK

SEQ ID NO: 1770 - protein, 81 aa, Lactobacillus paracasei
MAEQPKERLDRINELAKKDRSVGLTPEEKIERQQLREAYLKDFRAGLRDQIEHTQVFDKKGKELTSKKVQKIQREHGWRKD

SEQ ID NO: 1771 - protein, 58 aa, Lactobacillus paracasei
MDDQLVYIVYYADQSAPTELLKAFSSERRAAEYVAMLKNAPYPKHEAANYCYAAVQLN

SEQ ID NO: 1772 - protein, 115 aa, Lactobacillus paracasei
MNPLIQEITKKQLRDDIPDFRPGDNVRVHAKIVEGERERIQLFEGVVIKRHGVGISATYTVRKISNGVGVERTFPLHSPRVEKIEVTRHGQVRRAKLYYLRALRGKAARIREKRR

SEQ ID NO: 1773 - protein, 255 aa, Lactobacillus paracasei
MQIDVLSLFPNMFEPLRESMIGKAIERELLNFDVVDYRSYSHDKHHHVDDTPYGGGAGMLLKPEPLFEAMDGVNERHPGPKRVILMDPAGKKFNHQAARALSQEDHLVFICGHYEGYDERIRTLVTDEYSLGDYVLTGGELPAMVMIDAIVRLLPGVLGNDESAHTDSFENGLLEYPQYTRPPEYRGMKVPEVLQNGNHQLIARWRQKESLRRTYLRRPDLLKTITLDQTAQKLLREVKTEEATKAAEARLKNQS

SEQ ID NO: 1774 - protein, 172 aa, Lactobacillus paracasei
MPDYYDIGTIVNTHGIRGEVRVLVTTDFPADRFKVGNTVYVATSPKTALTIQSVREHKGLTLLTFKDYTDINQVLPFKGKKLQVTETALQPLDEGSYYYKDIIGLTVIDEQGQTLGKVNEILSPGPNDVWVIPRSGKSDILLPFLKSVVQSIDLDQKVAHVIVPEGLIDDAD

SEQ ID NO: 1775 - protein, 84 aa, Lactobacillus paracasei
MVDIGSLIQAIVTPLVTQPEAVKVTAHETGDYMAFDLAVAPEDVGRVIGKQGRVAQAIRTIVYSVKSPYNKRVRLNILGASHAE

SEQ ID NO: 1776 - protein, 91 aa, Lactobacillus paracasei
VAVKIRLKRMGSKRKPFYRIVVADSRSPRDGRFIEAVGYYNPLTNPVDLKLNEEDILNWLQKGAQPSDTVRNLLGSKGIMQKYHEARFAKK

SEQ ID NO: 1777 - protein, 478 aa, Lactobacillus paracasei
MAFEGLSERLQKAFSGLRRKGKVSESDIRDAMREIRLALLEADVNFDVVKTFIKNVRTKALGAEVLESLTPSQQIIKIVNDELVKTMGEAAVPLNKAPHIPTVIMMAGLQGAGKTTTVGKLSKYLMDNDSARPLLIAADVYRPAAIDQLQTIGKQLNVPVFEMGTDVDPVEIVRQGLATAKENKNDYVLIDTAGRLQIDEKLMNELKNIKELAHPNDILLVVDAMTGQAAVDVAKGFNEQLDITGVVLTKLDGDTRGGAALSIRAVTGKPIKFIGQGEKMDALDVFYPDRMANRILGMGDMLTLIDKAQKNYDEKQAMEMAEKIRENSFDFNDFLDQMDQISKMGPLEDIMKMIPGMANNKALANVKMDPKDIAHMKAIVYSMTPQEREDPDLLNPSRRRRLAAGSGRPVVEVNRMIKQFNQSKQMMNQMSKGNMKGLDGLMGGGVSGKLGKMAMNSMVRKQKKNKKRRLKNAKRFHS

SEQ ID NO: 1778 - protein, 114 aa, Lactobacillus paracasei
MMEIEKNYRMNSLFEFYGPLLTDKQHAYLALYYGDDYSLGEIATEFNVSRQAVYDNIRRTEASLEEYEKKLHLFANYQAQNEAVDTLVSYARTHYPDDKALSTLLERVADQTAK

SEQ ID NO: 1779 - protein, 58 aa, Lactobacillus paracasei
MVHPLGGSETREQAQKPAHKDLEAKWPKPSHLASRPLMLRFLTAPVRALPVSPSFVVH

SEQ ID NO: 1780 - protein, 104 aa, Lactobacillus paracasei
MVSTFIYWAVFAALAAWGLWSLVFSCVYLSNHENGNLWFFAIINAILGLLGWLFAWIMSNTAWQQYWFASKVQPSAWFTYLLIGYLVLIVLQVILGREKKVQAA

SEQ ID NO: 1781 - protein, 331 aa, Lactobacillus paracasei
MGLFDAIKKVFTGDEPETPEENKYDEGLEKSRSSFGEKLNALFANFRSVDEDFFDNLEEMLIESDVGFETAVKLSDDLREEVKLKNAKDPKAVSRVIVEKLVDMYGDAGKDEDNALHFAESGPSVFLFVGVNGAGKTTTVGKLAHQLKEEGKRVLLVAADTFRAGAIQQLQEWGRRVDVPVVATKEGGDPAAVVFDGVKRAKDEQFDVVLVDTAGRLQNKVNLMNELNKIKRVIVRELPDAPQEVLLVLDATTGQNALNQAKEFNQTTKITGIVLTKLDGSGKGGIVLAIRNELHVPVKLVGLGEKMDDLQAFDPTKFVAGLFKGLIQVEA

SEQ ID NO: 1782 - protein, 1184 aa, Lactobacillus paracasei
MQLKRLIINGFKSFADKTEIDFVSGLTGIVGPNGSGKSNITEAIRWALGEQSAKSLRGERMGDVIFAGTDTRPALNRASVTMTFDNHDGYLKNQPDEVSVTRRLYRDGTSEFLLNGQDVRLKDIVDLFMDSGLGRESFSFISQGRVEAIFNSKPEERRGIIEEAAGVYKYKQQKTKAERELANNDDNLARINDIIVELKHQVEPLREQASLAKDYQQQSGEYHQIHQTLLALEIEQLATEQEKTQGEAKVTKETIAALTAKVKDLEDQSERLSAVDRQFENQLNQLNDQVLSRSMKLENLSGEANLSSERSANAETTLADLKERLARAQQALTEANQRLKELKTKTTAAAEKEQAIKQELAQQKQANQDPAKLNQQVEVAQNHYIDLLKSQADNKNAQAALQKDQQLAASQNAAHDRRIYELSKHAQDQEAKVTALLTQQQQLQAEVDEQQTAVEQAKTDRDLLQQQRAAQQQAYQDELATYQRSRARYETLSELNDDYAGFYNGVRVVLKHKDQLPGVIGAVAELLEVPTAYQQAFDLALGSNLQAIVTRDEAAAQRAISLLKQQRAGRATFLPAAVMRPRELPSAVLQLVEGAEGFLGTGLQLAQYPADLAHVMANLLGSVLMVDTLPHAIAIANTTHHRYRIVTTAGDILNPGGSLTGGQVKQGRQASPLARSQEARHLKVQLQTLVETLKAKQADLTALTKKENVAQAAWQTASQQAQALTAKLTTITSQHTAQAETLRQAQRQLAAAQQADTAQADLSAKLTELQHQGKKLVQDIAEAQATIENAKAAVAAATASSTQHAATVNALKTKLAVTTNDLQTLNDQQRQWQTQARDAQAQATDLQQRIEHITATAEETAAKKASRTATIANLQTELKQLKADQTKLTQQKAENRGKLSQISARITTTYEQQHQAMATSEQQAVALNRVKLGLDARLNTLAEDYQLTYEAAKEAVTADHAPIPELKSKLKLLKRGIDELGPVNLNAIDQFKEVNERYEFLTKQQDDLLEAKQQLEETMHELDETVKTRFKDMFDQTNSAFEAIFPQMFGGGHAHLSLTNPDDLLATGIEISAQPPGKKLTRLSLLSGGERALTAIVLLFAILKVRPVPFSILDEVEASLDDVNVNRFGEFLRHYASATQFIVITHRHGTMVAANVLYGVTMQESGVSRIMAVSLDQSQKEAIN

SEQ ID NO: 1783 - protein, 231 aa, Lactobacillus paracasei
MVASEFVSELRQRYGIEFHDLSLLDEAFTHSSYVNEHKELGLKDNERLEFLGDAVLELTVSDYLYRKFPDKPEGDLTRIRAAAVQTAAFSAFSKEAHFDRYIKLGKGEEKAGARKRLTLLEDLFEAFNGALYLDQGRDANIRFAQQIIFPKIDAGEFSADQDHKTALQEVLQQNGDVAIVYHLLDEQGPAHERQFHVDVEVDGRVLGTGFGKNKKAAEQAAAKAALASLKR

SEQ ID NO: 1784 - protein, 597 aa, Lactobacillus paracasei
MKKRSVFGMITLATALSITLVACGSKSSNSSSSTANKAVKFPVSYNNSAKAIKGGNVNVAVVNDSPFKGVFNEELYTDNYDNQYMSPAAESLFAYNSKFKFNNTGAATLKQDNSAKTITVTVKPNVKWSDGQPVVARDLVYAYEIMANKATKSQRYTESLQNIEGLTEYHDGKADSISGLTMPKGDNGDTMVIHFKQMKPSFGTSGNGYFLENAAPYHYLHDVAFDKLESSDKVRKQPLFFGPYKMSKIVAGQSIEYTPNQYYWKGKPTLDKITFENVSTASITSALKNHKYDVVYNMPADSYNDWKSIGGYDNLGRQSLAYNYIGFKLGKWDHSKSENIYNPKAKMANKSLRQAMGYAMNNDQVAAKFYNGTRSRATTLIPPVFGKDVHADIDGYNLNIKKANSLLDKAGYKKGKDGYRTDPDGKKLTINFATMAGGSTAQPMAQNYIQQWKKIGLRVKLTTGRPIEFNSFYDKVQKDDKDVDVYAAAWSLSSDPSPMDLYSQKAPFNYSRFVSAKNTELLNDIDGQKALSASYRAKALKDWQKYANDEAFVIPTLYRQEIYPVNKRVKNASVDYASTANLNWAKMTVTSSSRASK

SEQ ID NO: 1785 - protein, 302 aa, Lactobacillus paracasei
MQNNANEVAATTKVEQSPSNFKVILNEFRKDKVAVVSLFLAVFIILAAFIGSLMFNVGGATQVNILDRYMAPGTGGYILGTDEGGRDMFKYLFFAARNSITIGISVALIIEFVGVVLGTISGYFGGLIDAVIMRLVDFWMIIPSLLVIIVLVTIIPQYNVITIILIMAAFYWMTTTRLMRSLVLSEARSEYVMASKTSGTSNFKIMFTGVLPNISSLIITDLTLTIASSIGIETALSFLGFGLPMETPSLGTLIGYASNPDLIFDRWWVWFPAVLVLLTLSLSINFVGQALRRAADSRQRRG

SEQ ID NO: 1786 - protein, 320 aa, Lactobacillus paracasei
MWKTILRRVLIMIPQLILLSVLVFMLSKMMPGDPLTGNFSQGQSAAQMAALRQQYGLNDPWYIQYFKWVGNMFHGDLGQSFVYKRSVTGLIGERAVNTFWLALMSTVILYVIAIPAGVIAGRYEGTKRDSAISVGSFILMAVPPFVFYLLGLIFFGFFLQWFPTGGSVSSTYNPGTLGYVWDRIYHMILPALVAGIITTPSTIQYLRTGVIDNTRQDFVRTARSKGVPDRVIFNKHILRNSLLPIAAFMGNQITMLLGGSVILETVFSYPGMGQLFVSSMTSRDYPVVISLVLLFGFLTLLGNLLSDIIMSIVDPRIRIE

SEQ ID NO: 1787 - protein, 317 aa, Lactobacillus paracasei
MAMIEVRNLKIHYPIRSGFFNRVTDHVLAVDGIDFDIEQGETYGLIGESGSGKSTAGKAIVGLEPVTSGSIMYQGQDITKRSVRKHMQYNKDVQMIFQDSLSSLNPRKRIEDIIAEPIRNFQNLTGDEERRRVQELLDIVGMPSDALYKYPHEFSGGQRQRIGVARAMATNPKLIIADEPVSALDLSVQAQVLNFMKRIQEEYNISYLFISHDLGVVKHMCKNMAIMHRGRFVEIGSREDIYNHPQHIYTQRLLSAIPDINPDDRKKNKEHRREVERVFKEEESKYYSKEGRVLDLQKISDTHFVALPDSTMKGVHD

SEQ ID NO: 1788 - protein, 340 aa, Lactobacillus paracasei
LDKPEDLLLDVQHLHTGFRLGDDYYDAVDDVSITLRKDEILAIVGESGSGKSTLATSIIGLHDPRNTKVTGDILYNNLNLVGLNEALFDRIRGKDIGMIFQDPLAALNPLMRIGEQIEETLVYHTKMNKEERESRVLELLNQVGIPNPERTARSYPHELSGGMRQRIVIAIAIACKPPIIIADEPTTALDVTIQAQILDLLEDIQREMHSGIILITHDLGVVAETADRVAVMYAGQIVESGSVMDVFKHPTHPYTRSLLRSMPQTDSDDDELHVIQGVVPSLKNMQIEGCRFAARIPWIPASAHEEHPIMHEVGPDHFVQCTCYKDFYFPDDEQAAEKGE

SEQ ID NO: 1789 - protein, 80 aa, Lactobacillus paracasei
MSEDEIYQKIAGLIQDHFQLSPDKISPTLNFQKDLDADSIDIVEFVLELEDAFGAEIPDDDAENIKTVQDAVDYINAHQK

SEQ ID NO: 1790 - protein, 341 aa, Lactobacillus paracasei
MKIAIDAMGGDNAPEVVIAGVEKARDANKELTFLLYGDEAKIKPLIHHDERLTIIHTPEKINSDDEPVRAIRRKKQASMVLAAQAVKQGEADAMVSLGSTGALLAAGLFIIGRIRAIERPGLLPTLPTVDGKGFVMLDVGANAENRPYHLLQYAIMGSYYAKDVRNVENPRVGLLNNGTEANKGDKMHQEAHDLLAAAPGINFVGNVESSDILNGPADVVVTDGFTGNATLKAIEGTVRTVMHMLKGAIYEGGLSGKLGGLFLKGNLKSMASTFDISSYGGAVLLGLKAPLIKAHGAADAETVYYTLLQTAKMVQNGTVTKVADYFDAHPEVAEAKTAEKA

SEQ ID NO: 1791 - protein, 679 aa, Lactobacillus paracasei
MALTDPVTVLPGVGPKREAGLASLGIHTIRDLLFYFPYRYDDLKVKDLAEAADQEKLTVKGIVVTDPVISRFGPHRSRVNVKLQIERSVILVTFFNQPWLKDRFQMGDEAAIFGKWDAKRRSLTGMKILATQSQDQPSMAAIYTVNKNVRMGTLLDLIKAAWERDQQNINDLVPASIREHYRLMSDAQLVHGMHFPDTPAEAKAARRTGVFREFFLFQLQIQALKQLNANSSNGLAIPYDNQALRALIATLPFALTNAQKRVVNEICADMRRPNHMNRLLQGDVGSGKTVVAAIVLYAAVTAGFQAALMVPTEVLAEQHFAKLTKLFKDFPVKLGLLTGSTSTKKRRELLSELRDGRLNLIIGTHALIQKGVDFHALGLVVIDEQHRFGVNQRKILQEKGQKPDLLSMTATPIPRTLAITAYGEMDVSTIDELPAGRKPIATMWLRKNQIDQVYRIIREQVQSGSQVFAITPLIAESEKIDLQNAEQLFVDMQKAVGNLGPVALLHGQMKPDEKDQIMRAFSDGKIAVLVSTTVVEVGVDIPNATVMAIFDADRFGLSQLHQLRGRVGRGQKAAQCLLIADPKNEQGIARMEIMTKTNDGFLLAQKDLEMRGSGDIFGDKQSGLPEFKVADPVGDFPTLEAAQKIVAQIFKTDPHLLQSDHQPLAAYLAESRQMLGSLD

SEQ ID NO: 1792 - protein, 558 aa, Lactobacillus paracasei
VAVTEITATKFQDMIRVAAHRINKNADFVNSLNVFPVPDGDTGTNMNLTFQTGAKAVLESNDESVGDLAKHLGKGLLMGARGNSGVISSQLFRGFAKSVAHKKSLTAQDLADAFAHGVETAYKAVMKPVEGTILTVAREAAKAGLKAANGSDDALVVMQAVVKGAKRALAKTPDLLAVLKEVGVVDSGGQGLVFIYEGFQEGLSGKISSDVHDVTDEEMNEMINAVHHQSAQVQLDPADIVYGYCTEMMVELGDGQNLKHFDYEPFRNYLNTLGDSTLVISDEEVVKVHVHTEHPGTVFRYGQQFGSLMKIKVDNMRLQQESIIEREGALDQQVAQKPLAEMGVVAIAAGQGLGELFKSLGVTHVLNGGQTMNPSTNDILDAVKAAHAKHVIVLPNNGNIFMAAEAAAKAATDVEVAVVKSKTINQGMTAMLGYSPDADLATNQSEMTAQLPNVISGSITRAIRDTTINGLAIRDHDWMGIIDGTITVTDKDREAAGIAMIDKMINDDSEIVTIIVGADANQTEAKAIADAVGKQYPDLEFEIHQGDQPVYPYFVSVE

SEQ ID NO: 1793 - protein, 120 aa, Lactobacillus paracasei
MAVKIKTKYGIIDISNSVIATVVGGAATSIYGIVGMASRNQIRDNLNDILKRENYSRGVVVRQTDNGVKIEVNIIVSYGTKISEVCRNVQDKVKYNLETMLGVTTDEVTVIVQGVKVLGD

SEQ ID NO: 1794 - protein, 61 aa, Lactobacillus paracasei
VAKDIITGRHTTFGNKRSHALNSSRRQWKANLHKVRILVDGKPKRVWVSARALKSGKLTRV

SEQ ID NO: 1795 - protein, 222 aa, Lactobacillus paracasei
MTHVNIMAGGPQACLPAAWEQLPGVWIGVDRGTLRLVRAGIHPELAVGDFDSLTLEELRLVRGHVQKLQQVPSEKDDTDTELAVKAALQASSSGDVTLVGGTGGRLDHFLSNLFLPLQPRFLADVERLHLFDVQNWVDYYSPGEHEIKPLPGYRYVAVVNLTPVADLTIVGAKYPLKPWRAGYPYVWASNEFLGKQPFTVSWTTGQVAIIYSRDRRGQKLDN

SEQ ID NO: 1796 - protein, 216 aa, Lactobacillus paracasei
MKIAPSILSADFAHLARDVEKVEKAGADLLHVDVMDGHFVSNLTFGPLVVQALRPVTSLPLEVHLMVSDPAAWVADFAEAGADTILVHEEATDHLYGVLQHVIEKGVRAGVVINPGTPLSSLEEVLPLVDQVLVMTVNPGFGGQKFLTPMVDKVDRLYQLRKARKLHFDIEVDGGINNQTVKAAADAGTDIFVAGSYVFGSKNVGDAMNSLCEAVK

SEQ ID NO: 1797 - protein, 301 aa, Lactobacillus paracasei
MSEDLTGRIIKQISGYYDIAVNGTTYRTRGRGSLRNDKITPLVGDIAAFQPGEGDDEGYLLKVLPRHNALVRPPVANVDQAVLITSAVEPDFSKNLLDRFLVYLEGHDIHAEIYLTKTDLTKPQRLTKIRQDLAGYTKIGYPVFAPDKPFDPTILAQVQASFADKLTIFTGQTGAGKSTLLNHLVPGLDLATAAISHALNRGRHTTRTTDLYPIHGGLVADTPGFSSLGLLDVTLDDLRDRFPEFAALAPNCKFRGCQHVSEPHCAVKAALAAGDIMQSRYDNYLQFREELSGKRPVYKKK

SEQ ID NO: 1798 - protein, 666 aa, Lactobacillus paracasei
MIEPGTILNERYKLIKTLGEGGMANVYLARDLILDRDVAVKVLRLDLQNDPDTVRRFQREAMATSELVHPNIVSIYDVGESQGQQFLVMEYVKGSDLKHYIVEHFPIPYQRVVDMMEQILSAVQTAHDHNIIHRDLKPQNILIDPDGNAKITDFGIAVALSENSMTMTNSLLGSVHYLSPEQARGSMPTRQSDIYALGIILFEMLTGSVPFEGDSAVTIALKHFQEEIPSVRAFDPHIPQALENVVFKATAKNPANRYTSADAMASDLKTALSPARAHEAKYVVPKDDLDETRIMPVIPNGPKPPHDEGGDADSPASQPSPKARPKKKSRRWWIIGIGILVAMLLMIGIGAVFANQKRDVDVPDLRGMTTTQAKTALTSAGLKVGSYKYTYSTKVSKDLVIDSDPKRQVSVKEGSTVKLILSRGQPQFTLENYVGQDYTDVKSDLQKRGVTVKEKQVSANDEPSGKIVSQSIKAGKKVIADKTTITFGVSVAIKPNTFALRDLTGYTEKSLRDYANEVGLKIVISQAHSDTVDTGMVISQTPAAGTQVKPGDTVNVSVSQGPDPEETKTWSKTISIPYQAPASSSTASASNSSGSTSSSSSAAPAPNGIQVFFADKTHNISTINRSFNITADDQITITLQVSTKYPGSYRIVRDGTVIAQEDNITQ

SEQ ID NO: 1799 - protein, 247 aa, Lactobacillus paracasei
MEFAYRTDIGRRRPNNQDYVGIFKNQSEATLALVADGMGGHRGGDVASEMAVSHLGYAFEKTDTAEIESIVRWLIFELQQENDVILQKAKQYTDLSGMGTTVVAVIISGTRFVVANIGDSRGYLYRNGHLVQITEDHSLVNELVKHGELTPEEAKRFPQRNVITRSLGVSSDVDADVTIYDMEYDDYLLLCSDGLTNMVDNEDIAAVLRQDMPIGSKAQELILKANAAGGPDNISALIIHQDRREPQ

SEQ ID NO: 1800 - protein, 446 aa, Lactobacillus paracasei
MTPNNPRLLAVETLSRVTGQGGYSNLTLDHVINSHKLTPRDAGLLTNIVYGVIQHQLTLDFYLAPFIKGRKLDNWIRCLLDTAVYQLQYLDKVPERAVFFDSTEIAKKLGHQGIAKFVTGVLRNAQRTGFPDPAAIADPVKRLSIESSTPVWLVEKLTAQLGEPKTRAILNVINVPAHASLRVNTTKITPAALLASLKPEFPDLKESPLTPIGLIAPSGHLAGTSAFVKGEYTMQDESSMLVAPSLDIQPGDVVLDACAAPGGKTTHIAQYLDPKQGGQVTALDLHANKVRLINKNAKRLGLTDRIHAQVLDARKVATTFPANSFDKILVDAPCSGLGLIRRKPEIKYTKTPEDPAHLQQIQLAILNSVAPTLKIGGRLTYSTCTMVKEENQDVVAQFLAAHPEFEQVSVPTLKPLHKAHNAPALQLFPDDYDTDGFFIASLIRRK

SEQ ID NO: 1801 - protein, 318 aa, Lactobacillus paracasei
MTSVIFLGTPEFAVPILEGLIAQHYDILAVMTQPDRKVGRKQRLAASPVKQAAQKHDIPVLQPEKLSGSPELAQAIAMAPDLIVTAAYGQFLPTKFLEAAKIIAVNVHGSLLPKYRGGAPIQYSIMNGDSETGVTIIEMVKKMDAGDMFAQAKLPLTRADDTGTVFAKLSLLGRDLLLETLPKIIAGTATRTPQDPDKVTFSPTITKEQEHLNIHLPAKALDQWIRALRPDVGGYVYLNGQRTKLWAITPLSAGSTLPAGSIVERDKHRLVMVAGQQTTFQVDELQPAGKAKQSIADFLNGPGQQLVSGQQVITDDPE

SEQ ID NO: 1802 - protein, 805 aa, Lactobacillus paracasei
LAIVAKVIVDVPTMQTDRPFDYLVPARLEDALQAGMRVWVQFGKGARKVSGMVVSVSDQSDYDGQLKPLLDVLDPAPVLDHELLKLSKWLAQTTYSFWIACMQTMLPTMLKIDAVKVAEPVKLTADEQQKYFGTADSLAIGSLNAEQQVAVMKLAQAGKVAISYLKKDRARVKKIFYLIPQLSLEQAAAEREHVRKNAAKQLKLLTLIGEWAANNQHPALMTVEHQYGLTKPVINQAVEKGWLKLEGHETYRDPYPELQHQPLTKPLPLTPEQQTIVTQINAAVAERDPKTFLLEGVTGSGKTEIYLQVIARVLAAGQTALMLVPEIALTPQMVNRVKGRFGTHVAVMHSGLSDGEKYDEWRRIARGEAQVVVGARSAAFAPLKNIGVFIMDEEHETSYKQDSAPRYHARDVLLKRAQIHHAPVVLGSATPSLESRARAEKGVYTLLRLPHRINDQPLPPVHIVDMREAFAHGAQEDFSGPLLDALRIRLQRQEQSVLLLNRRGYSSFVMCRDCGYVAKCPNCDISLTLHMDTHTLKCHYCGHEEPIPHRCPNCGSDKIRYYGTGTQKVEAKLQQLLPDARILRMDVDTTRRKGGHARILDAFGDHQADILLGTQMIAKGLDFPDVTLVGVINADTALGLPDFRASEKTFQLLTQVSGRAGRADKPGEVFVQTFNPDHYAIQYAKRQDYEGFFRQEMAIRHRGNYPPYFYSTKIAVSHVDETQAAKAIFSLAKELREHLSDQVIMLGPTPGPIARLKNRYIYQIVLKYKHEPALAATLQHILEETQQSSRHGFLVAIDPEPLAFV

SEQ ID NO: 1803 - protein, 399 aa, Lactobacillus paracasei
MKKQHIALFVTGGIAAYKVPLLVRALIKAGHDVRVEMTKSAERFVTPETLAIVSKAAVLTDGHEFDHPEHVAHVALAHWADLGVVVPATANTLAKLANGLADNVVTTTLLAMQAPKLLVPAMNDQMWQNPQTQKNIASLMTEQNYLVLPPETGLLAEGYAGIGRMPEPERIALFIESLDDPRLRGRRIIVSAGGTKERLDPVRYLTNDSSGKMGTAIANAAAGAGAEVTLVTTRQLPVVPGVTVKQVESAQSMADTIDAEFTEADAVIMAAAVADYRLPTVSDHKLKKTDATSGLTLNLVQNPDILASLGRKKTHQILIGFAAETNDLLKNAQLKLTKKNADMIVANHVDATHGFNTDTNAVTLLRPEQAPVTLPEMPKPKVAAALIEQLATMLAKQKG

SEQ ID NO: 1804 - protein, 82 aa, Lactobacillus paracasei
MIIYPSIDKLLEKVPSRYSLAVLAAKRAHELESGDLKMLSDYKSDKSVGKALEEIAAGDVIIDPKSKMLERDAEKLDRKDQE

SEQ ID NO: 1805 - protein, 208 aa, Lactobacillus paracasei
MHERGMLIVLSGPSGVGKGTVRQAMLDGNYRDFQYSISMTTRQMRPGEVDGVDYYFRTKAQFEHEIATGGMLEYAKYVENYYGTPLKYVNETLDAGRDVLLEIEVNGAMQVRKKCPNGVFIFLTPPDLSELRHRLKGRGTDDDVTIDKRIRKAASEITMMENYDYAVVNDKVDLAVKRIERIIESEHLRVPRVIDRYKGMLASADLAR

SEQ ID NO: 1806 - protein, 228 aa, Lactobacillus paracasei
MATIAVVFGGGAAHGAYQAGVWAVLGPRLRPTFVIGSSIGAINAAGTARMLPEQVPQWWQHFSEAKVNGPIFLRRHFVPVLDRMLQAPKLDSRAVLAVTTSVPDFQAHVTRLDVLTAPEAREWLLASSAMPGVFSPVERAGVSYVDGGVVNDLPVDIARQIGADYVIAISGEGIGRIGSDHGDLYLKPSERLPGLFNFRPEAIANMIALGRRDAQIALKRAHFSPFHR

SEQ ID NO: 1807 - protein, 100 aa, Lactobacillus paracasei
MENKSSALQTVTRHLVASYREFFDLAAPNAKMPSHQLDLFLDQAMHRQYQVALFFDQDRPPFIGRITRPLGEKRYLVKAYHSNVYRIITEAEVSYIKRFK

SEQ ID NO: 1808 - protein, 45 aa, Lactobacillus paracasei
MIGVGRLRSVARYHHAIHRRLLIIESEFLGLHEWHLIQMGFITTN

SEQ ID NO: 1809 - protein, 566 aa, Lactobacillus paracasei
MLQELAIHDFAIIDHLALSFQPGMTALTGETGAGKSIIIDAVGLLAGGRGSVDFIRTGTTKASLEGLFDAQENPATEAKLQAYGVMDPDQNDTVLLQREIFRTGRNVCRVNGHLVNTTTLKAIGETLVDIHGQNEHQQLMHPETHLGLLDSFAGDDLLKLRQQYADVYHDYQRTLRAVKQKQANEQEWAQRLDMLKFQVGEIQSANLQPHEDTDLTAERERLANFQKINSALQESYALLSDEEVNALDQIGQAMSSMQSIADLDTNFAAIADNLQSAYYSLQDVQNDLSKELDDQEFDEGRLDEVEKRLDLFNQLKRKYGESLDEVIAYGKRAATELNQMEQAETSVEDLDTTLKASQNQLQKLGTALSKRRHAAAKQLTKAIHEQLASLYMEKTVFSVHFAKAKDFRADGLDEVEFYIQTNPGESAKPLAKIASGGELSRLMLAMKTIFAKTEGVTAIIFDEVDTGVSGRVAQAIANKISLIAKSSQVLCITHLPQVAAMADHEYVISKAVHNGRTTTQVLKLTDQARVDEIARMLAGEKITKLTVEHAEELLKMADEFKHGRMS

SEQ ID NO: 1810 - protein, 150 aa, Lactobacillus paracasei
MRKRERQATIQRLIQDEPIERQEDLVARLNELHIPVTQATISRDIKDMQLIKVPAGEGHYRYSMPAEKQLPATDKLRRTLITAMKWGEAMDNFIHLALLPGTAAAVETLIEQLDDQRIFATISGDASILIICRSAKYATAVLAELEAMVG

SEQ ID NO: 1811 - protein, 276 aa, Lactobacillus paracasei
MTKIKKERVDVLLVEQGLFESREQAKRSVMAGEVYDQNNQRLDKPGVKIAGDAILHVKGKKMPYVSRGGLKLAKALKVFNIDLKDKTVLDIGASTGGFTDVALQNGAKMSYALDVGYNQLAWKLREDPRVKVMERVNFRYSKPEDFTDGPVEFAMTDVSFISLKLILPPLKAILIPGGHAVALIKPQFEAGPANVGKHGIVRDPQVHRDVLKMIVDFALEAGYDVLGLDYSPIKGGEGNIEFLIHLQNSAQTPGKMAPDVDIEETLTAAYGDLHRP

SEQ ID NO: 1812 - protein, 283 aa, Lactobacillus paracasei
MSPMLAGWRTAVEQTLDEQLAAVANPHLRAAMVYSVEAGGKRLRPLLLLSVVAMYDGVIADALPAAAALEYVHTYSLIHDDLPAMDDDDLRRGKPTNHKQFGEALAILAGDALLTDAFAILSREYPEKGAACVQILAEAAGSNGMVGGQVLDMDGENEQYHLETLKRMHEAKTGALIQAAIAMGGLFVTIPETDQTALADFSAAFGLGFQIKDDINDVTKTTAELGKTADKDVIEHKNTFPELLGLDGAIQALQVEIAKAETALNELTVDAAPLAEILAVLKA

SEQ ID NO: 1813 - protein, 75 aa, Lactobacillus paracasei
MAEPTFEEKLAQLENIVNQLEQGDVPLEKALDQFKAGVKLSQDLEKTLKTAEKTVTEMVSDDGTTQPFSPKDDQQ

SEQ ID NO: 1814 - protein, 449 aa, Lactobacillus paracasei
MVDASQYLSVTALTQYLKRKFDADPYLAKVYLTGEISNYRKRVGNQYFSLKDDHAKIGALMFRNAFSKVQFDLEEGMKVLVVGRVSLYEPSGEYRLIVEHLEPDGVGALYQAFEQLKKKLAAEGLFDRNQRPLPLFPKRVAVVTSPSGAVIQDIMTTVARRYPILQLTLFPAVVQGDQAADSLVKRLNQIKTIGGFDAVIIGRGGGSIEDLWPFNEEKVARALVDMPMPVVSSVGHETDTTITDFIADRRAATPTAAAEIVTPVTLIDALNRISEDRVRLVNAMHNRLKNAAIRVQRSAQSVVLTQPDRLYDQYVQRVDQFQQRLQQSMHNRLRDADHRLAMATSQLDGRQLFIRLVNLQRQVTGDRHRLDQAMRGLVKTKRQAFASAVSGLDHLSPLKILGRGFAYVTDKQGQMLKSLSDYELDQDIHIHVADGQVGAHVTTKEKTHG

SEQ ID NO: 1815 - protein, 283 aa, Lactobacillus paracasei
LATRLDGRAVSKKILADLKQTIAQLAQHDVTPTLAVVLVGSNPASEVYVRNKQRRAEDIGVRSLMFRMPEATTQADLLAKVAELNHDPDIDAILVQLPLPAGLDEQAVIDAIDPDKDVDGFSPVSVGRLWANEPTVVASTPYGIMALLDAYDIDVAGKRVVIIGRSNIVGRPLAGLMVNHDATVTIAHSKTRDLKQLAKEADILVVAVGVPHFIGADAVKPGAVVIDVGISRGADGKVLGDVDEAAVAPIASAITPVPGGVGPMTIASLMAQTVTLAKRRANG

SEQ ID NO: 1816 - protein, 135 aa, Lactobacillus paracasei
MESRHAIREAAFQALFALATNPEADKDAVYAEVLPQDTEVPAYLTTLVEGVLSKQADLDAALTPQLKKGWTLSRLTKPDLIILRLGLYEIRYEEAMPEAAAINEAINLAKRYSDDQSAKFVNGILANFIQATPQA

SEQ ID NO: 1817 - protein, 153 aa, Lactobacillus paracasei
MAEETNIILANRTDAQGTIEIVPEVLEVILGIAASQVDGVYQMRGSLGASINAWFGRANHGKGVSVTVTDDQIAADVYVYLDYGVSVPKVALTMQERLREQLLFMTDLTLSEVNVHVVGIIPEKAEKVDPDNLFNDDDTDTDDAESASGKDDE

SEQ ID NO: 1818 - protein, 187 aa, Lactobacillus paracasei
MISVNDFKNGLTIEVDGDLWRIVEFQHVKPGKGSAFVRSTLKNLRTGAVQEKTFRSTEKVEKAQIDSKNMQYLYADGDNYVFMDTDTYDQLTLPGDEIRDQLNYLKENMNVKIIMHGNETLGIELPKTVDLVVKETEPGIRGNTSSGGSKPATMETGLVVQVPFFINVDDVLTINTDDGTYISRANN

SEQ ID NO: 1819 - protein, 355 aa, Lactobacillus paracasei
MDRMTALQARIQDKKLDGFFVTDTKNVTYLTGFTGEESTLLVTPQKAYFVTDSRFTEQFKQQVHNAEMILHQDSMFKAVGKLANRLQLTRIGFEAVHLNYADYEAFDLLTQGTLVPTRDFVETQREIKDANELASITQAIAIAEKGYQHVIATIKPGMREIDVANDLDFFMRGLGASNVSFETIVASGTRSAMPHGAATEKKIEKGDIVTLDWGCIYHGYMSDLTRTFAVGEPDPRLKTIYQIVYQTNQKVQKALKPGVLGRVINDLAHNTINDAGYGKYFGHGTGHGIGLSIHEGPGAWGPYLDVPAAKGNVVTDEPGIYVPDLGGVRIEDDLLVTAAGSQSLSQPAPSELLVL

SEQ ID NO: 1820 - protein, 96 aa, Lactobacillus paracasei
MLKMNLQFFSHHKGGGSTSNGRNSAGRRLGSKRADGQFVKAGNILYRQRGTKIHPGENVGRGGDDTLFATADGVVKFERFGRDKKKVSVYPAAAAE

SEQ ID NO: 1821 - protein, 116 aa, Lactobacillus paracasei
MIKAIFHRDEHGDIVSFSLTGHADAGKTGKDIVCAAVSAVSIGAVNGIEGLAGFEPDVIADEVHGGHLQMAIKTAITGEQLHISQILLENLLLELQSIQDQYPDRLTITTKQLEQN

SEQ ID NO: 1822 - protein, 103 aa, Lactobacillus paracasei
VYAIIKTGGKQYKAEVGEAIYVEKLDADEGKQVTFDEVIMVAGEGDAKIGTPTVKGATVTGKVEKQGREKKVVTYKYKPKKHSHQKKGHRQPYTKVVIDAINA

SEQ ID NO: 1823 - protein, 40 aa, Lactobacillus paracasei
MSYRIQLNMKTQEFIAIDSSNAKHIGKGNTIEKALQQLKK

SEQ ID NO: 1824 - protein, 106 aa, Lactobacillus paracasei
VRVYLNFLPFVLPYYHKRKKEQRKVRNLKTAIKKLGAEVIAGDQDATKVLNIYLIVSFLSDTNADIEALVIQGRELLDQIRKLPAKTDGTYDEAMTKAKLLLNQIS

SEQ ID NO: 1825 - protein, 799 aa, Lactobacillus paracasei
MLMKLNQFARLTPDFKVQVAELKQIGLQADPDDAFSQSATDLFNAFFPEAYTLAAKEDKLAQVAVNMDQTLAAWLAKKPSKMTRRDFYNVALQLLGFEAFTDFDLNDPFKMMTATKLPSLDHDLTSTADLLKAVYLLLNTRTKHLVSYLDDLANRGFLKDFQKKQKKPTHLLFNGKVQQVFDARQAVREVVWIESDMDTDHDGQRDLLEATIYRPKATDQGLKVPVLFTANPYFHGTNDVTAVTHVPETTLAVKTHGASKAEVTANPEEPANLPHHPVNGEATQAEAYAEENSMYAFNDYFLARGFAVVYSAGVGTRYSDGFRTTGGPEETDGAVAVIEWLTGKRRAFTNRTDGITIKAWWSTGLVAMTGKSYLATLAMAAATTGVDGLKTIVADAGISSWYDYYRENGLVVAPGGFQGEDADVLAVDTFSRQKSGGDLINIKQAWEKHLATITHDQDRTTGAYNTWWDARNYRKNANKVKADVVLIHGLNDWNVKPTNAIKFWEAIADLPIQKKLVLHQGQHVYVHNVRSLDFLDMMNLWLTHELLGEANGAEDVLPNVVVQDNVAVQTWSAYQNFASPAAEHVTNTRNLKTDFEAATDQFTDHATATFNAQHDTSASFETAIITPNSAYANSRLWLTQPPLERDQTLEGIPHLELTLAIDAPTGILSVRLIDLGMAKRFGETAATMALNGLQLGFDYKTTDILEFKPTAKPTPSKLISLGHINLQNPKNAYEVQRITPGQPFHISLDLQPTHYHLPAGRQLALVIHGADMAQTIRPIKTTHYQIDLANSSITLPYRI

SEQ ID NO: 1826 - protein, 446 aa, Lactobacillus paracasei
MARKTITADEIRQTVKDENVLFLRLMFTDINGIVKNVEVPISQLEKVLNNKITFDGSSIDGFVRIEESDMLLFPDLDTWLLFPWENDHGKIARLICSVHRPDGSPFAGDPRNNLIRVVNEMKEAGFTSFNIGPEPEFFLFKMDENGNPTTQLNDKGSYFDFAPLDLGENCRRDIVLELEKMGFEVEASHHEVAPGQHEIDFKYADALEAADNIQTFKLVVKTIARKHGLYATFMPKPLHGINGSGMHINMSLFHDKGNAFFDANTDDQLSETAMHFLAGVLRHAYALTAINNPTVNSYKRLVPGFEAPVYVAWSGKNRSPLIRVPQSRGLSTRLELRSVDPTANPYLAIAGILQAGLDGVTKKLKPEEAVDRNIYRMQDDERKANHIQDLPSTLHNALKALAADDVVKAALGKHLYQSFMDSKNLEWSAYRQQVSEWERQQYLELY

SEQ ID NO: 1827 - protein, 120 aa, Lactobacillus paracasei
MAEIADLRTRSVLPIGTVMLLTDLTARQIRYYEAQGLVQPARNAGNHRTYSLNNVNELLEIRSQMADGFTLADVKRLKHPRHHEDSDAEVRQVLRDELLNQSRLNQSPDPGPAIGFRQSH

SEQ ID NO: 1828 - protein, 696 aa, Lactobacillus paracasei
MHLYIGYSEKVAARILPTNWRCLTAAPLAAFGAAIIDASDTATLTQLVASQLPLPTFIIGQIPISHTGQLTVTNIDTLNTATMAQITAAAQAYEQTMVPAFIRDLLDYAKADPTSFATPGHHSGHYDDLAPAGYLLHQAYGPTFFASDTSDVVTSLGDMLTHGGTPLAAEEATAQLYHADETYFVTNGTTGSNNIVASALLTPGDLVLFDRNNHKSFYNAALVQNDARPVYLDTLRTKRGLIGPIDLQNLTHESLRQMAVAVAPEKAHQSRPFRLTILELETFDGIVPNVRQLIDLFGPLTDYIAFDAAWGGYEPFIPAMTPMDPLQVPLAPTDPGIIVTQSVHKQQSGFGQASQIHKKDAHIKGQARYVGHEQFNHAYLKHVTTSYNYPLYASLVANTAINQGARGQKIWQDAIRAALGFRRSLNDSRLFSAYEPPELTTLPADQAIQTAEAWSMTPQAAWHQLAGLQPDQAFLDPGKVTVLLPDTAAFGISGWLVDRYLLDHGIIPEKADLNSLLFLVTPGTARTDWQRLRQVLAQFETDYFVNKTVAESLPKLVAETGEAYAHQTLRELSQTMSDFFREAHLTEQQRDLFTNTNAIPTAMTPQAADRYFVRGQIDTIPLEQATGRIAVDGALPYPPGIFVVVPGERWRPEAISYFQTLFEGIRHFPGFTPEIQGVIARAGGQPYVHVVHEQLS

SEQ ID NO: 1829 - protein, 418 aa, Lactobacillus paracasei
MSWMDKFDPKLQTMVKEVDAQIAPQLAKIDARILENQNKVLTSFQNHHVAESYLTGSTGYGHNDEGRDVLEAIYADVLGGEDALVRPQFVSGTHAIGVALLGLVRPGDDIVYITGKPYDTLQEVLGLAGNGIGAPQEYGIGVDYVDLLPNGAVDDDAVKARLNDKTKVVAIQRSRGYATRDSFTVDQIAAMIKVVRSVLPNVWIFVDNAYGEFSETKEPLEVGADVMAGSLFKNAGGGMAKTGGYIVGKKDLIDRISYRFTVPGLGGAEGATVGALADMYQGFFISPQTTGNAIKGAIFEAALFAKLGLDVSPAWDAPRTDLIQTVNFGNADDMVKFAKAVQANSPVDSFVTPIPEKMAGYEDQVIMAGGTFVAGSTIEFSGDGPLRPPYTLYLQGGLTYAHIKLATMGAAQSTFFDN

SEQ ID NO: 1830 - protein, 309 aa, Lactobacillus paracasei
MDKPAKRIVMIVGPTAVGKSDLGVYLAQQLHGEVINGDAYQIYRHMDIGTAKITPKEMQGVPHHLLDIADPTVAYSVAKFKKAATAMIDTLADRQQLPILVGGTGFYLNSLRLNLPLGGKAPPTAIRQRWQVALATNGQSWLWQQLAQRDPDAAQQIAPANTRRVIRALEVGELTGRRFSDQPQPEPLFSTLVIGLTTDRTVLYDRINARVDAMMQAGLLAEVEQLLKTMPADAQAMQAIGYKELVPYLHGQAELANCVALIKQHSRHFAKRQLTYFRNQMPTHWFDLVAHPEDKNAIVTLVQQWLKQR

SEQ ID NO: 1831 - protein, 59 aa, Lactobacillus paracasei
MKHKFARGFFVGTLMTLGAIAGSVFAFKKNYIEPVETKVDEINDNRRKANRKRFSAHQG

SEQ ID NO: 1832 - protein, 135 aa, Lactobacillus paracasei
VLTYLLIFVGLFLIYWGFNWLWSYYQKSRFKAIGGEITPDDFEHTMRKAQIIDLRERNEFKAGHILGARDIPYTQLRERMGEMRQDLPVYLYDKTGVLSLRAARRLRKNGFEKISWLKGGYDNWSGKTKKSPTNY

SEQ ID NO: 1833 - protein, 320 aa, Lactobacillus paracasei
MNDKKLIGVDLGGTTVKFAILTTDGEIQQRWSIDTNILDEGSHILPDIIDSINEHLKLYNMTPNDFVGIGMGSPGSVDIEAGTVIGAYNLNWKTLQQAKKDIEAGTGIPFSIDNDANVAALGERWKGAGENDANVTFVTLGTGVGGGIIADGNLLHGVAGSAGELGHVTVDPVNGYLCTCGKRGCLETVASATGVVRVARDMAEEFAGDSKLKQTLDDGDEISSKIVFDLAKTGDKLALMIVDRVSHFLGLALANVGNLLNPKFIVIGGGVSAAGDFLLKRVDKYFKENTFPNVRETTSLRLATLGNTAGVIGAASLALK

SEQ ID NO: 1834 - protein, 84 aa, Lactobacillus paracasei
MKTYYDVLQLLKGFGTFIHVGKREWDIELAALELDRLHKAQLIDDKVYLNAKVVLRHAHAQEEAHPLNHELPLPAEKRRNDKNE

SEQ ID NO: 1835 - protein, 227 aa, Lactobacillus paracasei
MNYSNWRSRLQNSAYVTNAILAVTILVFLLETFSGGSTNNSVLVFYGARLNPLILYGQWWRLMTPVFVHIGLMHILVNGFSLYYLGQMTEQLFGHWRFFLLYFISGFAGNVASFAFSPNTLAAGASTAIFGLLGACLMLGDSFKENPVIRQLARQFLLLVGLNLLFNLFSSGIDIFGHIGGLLGGFLAAGMLGAPALGRMGTPRRIASAVTLLFGLGALLFLGFNAG

SEQ ID NO: 1836 - protein, 708 aa, Lactobacillus paracasei
VKYIRTPQPKRNKSQIPFRLNLLFFIAFLLLAALVAQLAYLQILNGPRLAAEVDRTNKTVVTGNVPRGLIFDSKGRALVTNKANNAITYTKSVGAKSQQMYDIANQLAKLIDKPEDNLTKRDYIDYYLAPTKVSKQIVSKLPKKIQDLPTDKADELYKYEVAYVRQHMPTFTATQKEAAGLYKIMNGATQLSTVYLKNQDVTAHEVAVVGERLTQMPGVNLGTDWERSYPNGDSMTSIIGQVSNEKSGLPADQLQAYLANGYARNDRVGTSYLEKAYENVLKGSKSQTQVEIGNNNQIIQSVSKFKGQQGANLNLTIDSDYQKKVEKSLSDTFSSIRSAGAGSLSDGAYAVAMDPNTGRILAMAGQHQDVQTHKVEDDALGVINRAFVVGSAVKGATVLGALQDGVITVNSNTQADTPIYLPGTPVKKSVYPVGTFSSLDAASALEVSSNIYMMWLAMKEGHYAYSPNNYLKLNSDIFSKMRGYFNQFGLGLKTGIDLPGEIAGLEGNTHDSSGNLLVGSALDLSYGNYDNYTLIQMLQYISAIANNGYRMKPFLVNSISQTLSDGSSGPVLTSTQPSVTSKIDNTQDQINLVKQGMWQVVHGTNGWTTATSLNTLNPGVAGKTGTAQGFARESKDSALTETITESFVGYAPAKDPKIAIAVIIPNLKAETTTPYQLQIAKEMFTDFYQMNNIKEDKDYSIHQKTVNG

SEQ ID NO: 1837 - protein, 868 aa, Lactobacillus paracasei
VRQRWLKNYPLILSFLLPGLLVGLYFAIRGTFPFGSSSVLTVDLGQQYIDFFAYLRQTLLGHPGQLFYAFNKALGGDMYGVFAYYLLSPFNWLVVLFPADMLDVAAFLITVLKISTIGFTMGWYAKRHAIHGMMIPAFGLAYALSGWLLANSFNLMWLDAAMLLPLIIDSVEILFKGGRVMAYIGWLAAALIINFYTGYMIALFLILYAIYWLIAHTSTWQHFWRSGLRFIGASGLAGMISAVVLLPTWFQLSQSKGTYTVATIRWRFEYAPTRFLSKMLPGSFNFDQMPSGYPNYYIGALGFVLVVLFFLSKSHPWRQKLAAAGVTIVLILSCMLEPLDLLWHGFQFPVWYPYRFTFVLCFWFLILGIAVLPHLQIGIPLQWLGVLLLVFGAIYIDVAANLKHFSFLTVGHLLFGAGCLLLTFVWFSLDNRRPVWFGFAIVLIDLSGSLILTLNQLAYLNHSDYHDYTAALIRGTQTIQQHDPGLFRVGKTTIRTRNDPMTANYLGADQFNSMLEPAVPKFFGQLGQPEDDGSVAYTNGTLITDSLLGMKYYLTPTKRAAKKLPDAGQRPDLKWYRPIKTTPTWQILRSPFAQSLGFVADTDLLKQPLYSETPLANQSLILQSALGKSGNPYFTPTALEAPQLTGVRRVSTGSAPTYAKVGHGPHDVTYRFKPIPGKIYVLTLGSQFADHLVTLNQNGQTVTLPDSFNDTITVNVTPRNPKAEQVLRFRLNKKDAWFENFDLYQADAKQVIHDLKKLQTGSWHVIQHTATTVEATINVLHDHQMLQTTIPTAPGWHVKIDNRPVTVKKSLGIFMAVPLKPGQHMITMRYVPPLLGWGAVITVTGLCLTACWYVVDKRRFSRHLVSRR

SEQ ID NO: 1838 - protein, 106 aa, Lactobacillus paracasei
MIKEMMGLQLAITDEASRWFHRELSLPDKGAGIRFFGKAYGKTQVHDGFSVGMTRDDHPDQPIMAVEKDGVTYFVDPTDAWFFENLAMTVDYDAHLDEPKYEFKEE

SEQ ID NO: 1839 - protein, 221 aa, Lactobacillus paracasei
MIKVLIVDDHEMVRLGLATYIGVQPDLEVVDQAENGQEGVDMALKDRPDIILMDLVMPVKDGITATKEILKAWPQARIIILTSFIDDAKVYPAMEAGAASYILKTATAEEIAKAIRQTAKGERVLEPQVTTKMMNRMNHPQPQYDELTNREREVLQLIAQGKSNQEIATELFITLKTVKTHVSNILAKLDVEDRTQAAIYALKHGLVKNDQGDDGVATRDH

SEQ ID NO: 1840 - protein, 354 aa, Lactobacillus paracasei
MRRRMLVGFFMALLVWALLVEACLVFMLAKVTEHDFLQVLLTTVLSAPVLVYLVIGALLISTGATVIVMWRQRVMHSQLDSRLAQLNAGQYQAPIFSRSQQAVGALGKQPAALLEELRQKMIRLQREIERYSNTPVRFSGETKEAILTGERHRLARELHDSVSQQLFAAMMMLSALRSVADRDPAQAELSKQLDTIQKVINEAQAEMRALLLHLRPTNLEGKSLKQGIIQLLKELQTKITIEITWQLDDIKLNPAAEDNLFRIVQELLSNTLRHAKASSLEVYLKQLQDMVVLRMVDDGVGFDAKQASSNGNYGLANIKERAAAMGGTAKVVSVVGQGTSVEVRVPLSKDVAHD

SEQ ID NO: 1841 - protein, 234 aa, Lactobacillus paracasei
VRRWQLFLGIELALTLWLFFQIITNPMALTTILVGVFFLFLGARWHRLRSFNVAFGGILLVLGIFINPAIWLILMIAGVFIIMVVTKPGMGFSAWDRKQYVAPVTQEPSEKAGKRTINSWTDRHTISPTYDWDDINMVVPAGDTIIDLGDTFLPKGDSVIMIRKGFGKTRILVPIGVGVAVEHAAFYGTLHFENKDSMLHSQSVTAYSKDYDDAPRRIHIITSVGVGDLEVLAV

SEQ ID NO: 1842 - protein, 156 aa, Lactobacillus paracasei
MADKSYPMTAEGKKKLEDELEELKTKKRPEVIDRIKVARGFGDLSENSEYEAAKDEQSTLENRIVTIQTMLRYAEIIDSKAVAKNEVSLGKKVTFEEDGDEETYEIVGAAEADAFNGKISNESPIAQGLIGRKVGDKVTISTPGGEMKIKITKVEG

SEQ ID NO: 1843 - protein, 212 aa, Lactobacillus paracasei
VQQKKPIVIGVTGGSASGKTSVSRAIFDHFSGHSLLLLAQDAYYKKSDMPFSERKKINYDHPLAFDTPLLKDHLNRLIHRQAVDQPVYDYTIHNRSDRTVHLAPKDVIILEGILILDDAELRDMMDIKVFVDTDDDIRVIRRIKRDMVSRGRSLDSIINQYLKTVKPMYHQFVEPSKRYADLIVPEGGQNQVAIDLLVTKIKAILAERGLQE

SEQ ID NO: 1844 - protein, 383 aa, Lactobacillus paracasei
LDRRSSDRQDKRRQRSSEKKAANKIVAWVIGIVLAVLVIVGLMGYRYVRSALEPVDPNGKTSISVTVPAGSSTKQIAAQLEAKHVIKSATVFSYYVKFHNIADFQAGQYKLTQRANMSTVIQALRAGGSATTAAGQLLVKEGTTIEQIATSMDKLTKSNKNLTGKKFLALMKDQTFFNQLAKKYPQLLSSAANAKGVRYRLEGYLFPATYNVGAGETVKDLVDAMVAKTDSVMQSYYKSIKKQQYTVQEVMTLASLVEREGVTQDDRRKIAGVFLNRIDAGMPLQSDISVMYALNTHKTHLTNKDTSVDSPYNLYVHTGYGPGPFDSPSEQSITAVLSPDARDKDYLYFVANLKTGEVLYATTREQHDANTAKFASDNAAADK

SEQ ID NO: 1845 - protein, 803 aa, Lactobacillus paracasei
MDVSYEWLKELVDVPVSPEELADKVSRTGIEVDGVKHPDAGLKKIVVGKVVSATPHPNSDHLHLCQVDVGEETPRQIVCGAPNVAAGQTVIVALPGARIADNVKIKKGKMRGEESLGMICALQEIGFSENVVPKPYLNGIYVFNEPLEPGSDALAALGMHDAVLDFEITPNRADALGMRGVAWEVGATYAEKPHFEEKPLTEGDRPVGDFLSAEVKDAKDAPSYQLRVIDHVKVQESPLWLQKRLWLAGIRPINNIVDVTNLIMLAYGQPLHAFDYAKLGSQQIVVRRAKNGEPLTTLDGNEHELDDQDIVITNGQVPVALAGVMGGLNSEITPETTTVVIESASFNPVNVRKTALKYNLRSEASSRFEKGTNLADINRALDAAVAWMAELSEGQVAEGTVSPTSVSAEDVVVDISLDHINHVLGTDLTQQQVTQIFEQLGFDVTESDGLFAVAVPPRRWDIHIKADLVEEVARIYGFDNLPSTLPTTTMTIGEYTSQQKRIRRTRHLLEGLGLTQVITYALTSAEAAEQFKLQPGLPTKVDSPMTTDHAVLRMNMISGLLNVIKYNQARKETDVAIYEQGRIFTKTGDQVRPTEIEYLGGAITGNVVAKDWHQSAKAVDFFYAKGIVTHLLGDYSLADPIRFEATQAVAELHPGQAANIFVGDQLVGILGRLHPAFEHAEHLPATFVFELDLDALFAAPRQEKIAQPAPKFPAVTRDIALQVDEQVTNDQVMAIFHEHGGAFLQDVTLFDVYAGDHIAAGQKSLAYTLTYRRDDQTLTEDEVTQAFDKVKAALQTGIGAAIR

SEQ ID NO: 1846 - protein, 348 aa, Lactobacillus paracasei
MDLQTKLEQLFQQNNDTIKKVKSLDELNQIRVQLLGKKGPITGVLRGMKDLSAEERPKVGAFANKIRDDLSAVIEARKAQLEQAVINAKLASETVDVTLPGDPVEAGTPHIITQIMDDLEGFFMGMGYQVLTGPEVEEDHYNFEMMNIPKDHPARDMQETFYITNELLMRSQTSPMQARTMEKHDFTKGPLKMISPGVVYRRDDDDATHSHQFHQMEGLVIDKHITMADLKGTLLAMCQHVFGKDRTIRLRPSYFPFTEPSVEVDVSCFRCGGKGCPVCKYTGWIEVLGAGMVHPNVLRAANIDADVYGGFAFGLGPDRFAMLKYGIDDIRSFYTDDLRFLTQFSQEG

SEQ ID NO: 1847 - protein, 124 aa, Lactobacillus paracasei
VDATVTSTADCQSQQVALCPKFQHTFEILGKKWNGLILEVLLNNGNSRFKDIAQLIPRCSDRVLVERLKELEGEGLVDRLTHKDSALIEYALTDKGRGLNSVMAAAHAWGDAWVTDAECHANEK

SEQ ID NO: 1848 - protein, 167 aa, Lactobacillus paracasei
LSKKRDWQSDAEYVGYVADLLAKPEVQRLAEHPQHHYSNRLEHSISVSYQSYLIGKRLHLNVRAIARAGLLHDLFYYDWRKTKFDLGTHAFIHPRIALRNAEKLTELSPMEKDIIVKHMWGATVGLPKYKESFVVSLVDDYAAMDEVVVPWMHKLRHPIHTHLKALN

SEQ ID NO: 1849 - protein, 236 aa, Lactobacillus paracasei
  misc_feature (214)..(220): Xaa can be any naturally occurring amino acid
MEYISSPKNDRIKTAKKLTVKKHQKDAGRYLLEGRHLVQEALASGQTPYDIYATEKYVEDRALKPFYDKITQISESVSEHLSDTQTPQGIFAVMPRRAEQLPEPLSGQFLLLDAIQDPGNVGTLVRTADAAGIQTVVFGNGTADAFGPKVLRAMQGSQFHVRIVSAKLMPIIKALHRGGIPVYGSELNEKAKSYHSIQPSERFALIVGNEGNGXXXXXXXVTKYRYEPLHSDPGQS

SEQ ID NO: 1850 - protein, 110 aa, Lactobacillus paracasei
MSKCCLTASPIKKGSVFLVKLAKQIVVRGRVQGVGFRWATKMIADNLDISGTIENRSDGSVFIQAAGEPLNLAKFVAKVKAGPNPYANVSTYEEQPLEDVPNFRGFQVTG

SEQ ID NO: 1851 - protein, 332 aa, Lactobacillus paracasei
MHKSKKFVTLGLVSLLPLILAACAQTTKKGTTMKPPTDPFFGTFYKVIGLPLQHLMEWIASLVGTASSYGIAIIVITLLVRLIVLPLMLRQQRTMTAYQEKQKIIQPQLKIVQEATKRAKTPEQQMAMNGYMRKIYSANGTSMIPSMGCLPMLIQLPIFSGLYQAIAYSPEISEATFFGIQLGHSNFIVTILATLPYIVVSLIMLQGVPPEQRKAMQTTAFLNPIMTFVFCMMYNAGLGLYFGAGGIILIIQQAIVTYVVTPNIRKRMDAEMEENPPVIVVDEHTFDNWDTATAGATGAAGTTGSSKPADPDAIDHGKLRRRNAGKQQRPRK

SEQ ID NO: 1852 - protein, 528 aa, Lactobacillus paracasei
MIPKKQTLEQTRKSPRISLKVKWALTVGVGIFVTFVTFSMILYGAMRQILVNQERRTVTDTLNTVVQRLSPVSGDLTMAQVVPRLEGAMPSGQTSIPVPSESQNRIFSDSVIQKLAQADVSVSVFSPDRTNIFQSRDTPITLGKVHGVEVQEANIDDFHGLVGTAPIYSATSSDLIGYVQVTDKLTAFHATMHEITLLIMGLSFAAILISILIGYALATRFLKPIKLITNAIDVVNEEPQSTVRIPALKRNDELGDLVLEFNGMLDRIQRYIDQQGEFVQDVSHELRTPVAILEGHLQLLNRWGKDDPEVLAESLTASLQEVTRIKSLIQEMLDLTRADQVDIQFPNAVVDVHQTVQQVVGDFRMIHPEFTFTLDDDLEQKTFVRMYRNHLEQVMIILLDNAVKYSTDRKEIHVSMAENSVSGVAVAVQDFGEGIAEADRRRVFNRFYRVDKARSREKGGNGLGLSIAQQLVESYHGQIEVDSALGHGSIFRIDLPTITEAKAQALAAQETTKRAEAGKTDTHIKSNL

SEQ ID NO: 1853 - protein, 228 aa, Lactobacillus paracasei
MSKILIIEDEKNLARFVELELKHEGYETEVHFNGRTGLEAALAEDWDAILLDLMLPELNGLEVCRRVRQVKNTPIIMMTARDSVIDRVSGLDHGADDYIVKPFAIEELLARLRALLRRISIEGENNTAKQTTIKYRDLVIEKENRVVRRGDDIIELTKREYELLLTLMENVNVVLARDVLLSKVWGYNSDVETNVVDVYVRYIRNKIDRPGEPSYIQTVRGTGYVMRS

SEQ ID NO: 1854 - protein, 472 aa, Lactobacillus paracasei
MDKPQIGVVGMAVMGKNLALNIESRGNTVAIFNRTGSKTKAVVEEHPDKKLVPSYKIEDFVASLEKPRRIIMMVKAGAGTDAVIKELLPLLDKGDVLIDGGNTFFEDTMRRSAELDKSGINFIGMGVSGGELGALHGPSLMPGGQKEAYDLVAPILEAISAKAEDGAPCVTYIGPNGAGHYVKMVHNGIEYGDMELIAESYNLMRNLLGLDVKEMADIFSEWNKGELDSYLIDITADILTRKDDLGSDKPIVDMILDRAGNKGTGKWSSQSALELGVPQSVITESVYARYISAMKQERVEASKVLPKPVANVSVDKKEAIEMIRKALYFSKLMSYAQGFEQLRFASEKYDWKLQYGDLAKIWRAGCIIRARFLQNITDAYNKKPDLQNLLLDDYFLNIAKNYQESVRDLVGVAVKAGVPVPGFSAAISYYDSYRSAVLPANLTQAQRDYFGAHTYERTDRDGIYHYSWYTEA

SEQ ID NO: 1855 - protein, 104 aa, Lactobacillus paracasei
MTQKQLIRERTQKIKLAAVNIKMISDNQLLRNLDKLHTTKLGRIRIEHNLSLTNRDVIAFCKEKILNPEAIMNRKGKNWYVKIDHIIVTINANSFTVITAHTEG

SEQ ID NO: 1856 - protein, 182 aa, Lactobacillus paracasei
MLKWTVQELIKHDQEPLHFSTTLDVKTDLQDRDPEVLDVSPIQVSGDIVYDRGDFLVSVNLKGNLVVPSTRSLTPVTLPQDFTFSEIYLTDAGHADQYEDGEILMPLEDAELDLLPAIEDHLLLSIPMQVLTPEEVASGDMPSGDDWEVLAEEDFDKAVKKEKQADNPFTKLKGMFPDDDQS

SEQ ID NO: 1857 - protein, 378 aa, Lactobacillus paracasei
MQTVGMIAEFNPFHTGHAYALAQARKLAQADVVVVVMSGNYVQRGEPAIFDKWVRAQAALQHGADIVVELPVTGAVQAADQFAEAGVTALAAMGVNTLAFGTEHPEVAYADLAEKLATAALTEDGFRDYTQTYATQLNAVYAKAAGITQTDPNFMLGLSYAKANLALKRPMTLLPFARRGIGHDEVGIQANIASASTVREYLRADQSVEAIVPTELVDFYAKQQQYSWAQFFPWLKYRVQTAELNELRLVATMAEGLEYRFTQKIDDAQDMTAFLKQVKSKRYTYARLRRLALAITLNMTATAVNQARQHPQLHVLGFTPTGRQYLNSVKHDLDWPLLTKVSADMLAPDGVLAMTHRADRLITTIGGVEQNYGRRPLM

SEQ ID NO: 1858 - protein, 245 aa, Lactobacillus paracasei
MIYQTFAEVYDKLMDQSLYSQWRDYVTKRVAPAGQPILELAGGSGFLAVLLAQAGYQVTDFDLSDEMLSLAAEKAEEADAQLALIQGDMRDLSDLPPFPVVTCFDDSICYMANLEEVQQVFTQVASLLPPGGDFLFDAHSLYQMDQIFPGYMYNYQTDDFAFLWHSFVGEVPHSVEHDLTFFLYDEGLDAYKPLTETHKERTYPINDYLDALTASGFEKIEVTADFGRQPIQADSTRWFFHAKKK

SEQ ID NO: 1859 - protein, 119 aa, Lactobacillus paracasei
MIDSKTMLEVAVKAGDSKRAEDIVALDMRGVSLLADYFVIMSGTSDRQVQAIVDEIEDKEEEAGVTIRRIEGQKGSKWMLIDMNDVVVHVFMPEERQFYNLEKLWQEAPLVEVDQWVEA

SEQ ID NO: 1860 - protein, 199 aa, Lactobacillus paracasei
VSEHQYPASLTHGLSREEILNRLHNRLDEPRYEHCLRVEATAIELAKRFDQDVDRAGLAGLLHDYGKEIPVETYKRVIIEDGFDPDLLQYGRGVWHGVVGVHFIQTEVGITDKQVLTAIARHTTGDPEMTKLDEIIFVGDFIEPARSLPVEAKARKAAETNLEEASRIELENTLTYLIGARKLVFPKTLLTYNAFLTKE

SEQ ID NO: 1861 - protein, 216 aa, Lactobacillus paracasei
MEKTQSVTLTQPVISVEMREQILGQHRRKQIGLFGGTFNPIHNGHLIMAEAAGTELGLEKVYFMPDNQPPHVDTKTAISARHRVNMVQLAIADNPLFGLEGIEIRRGGVSYTYETMLELHRLHPDTDYYFIIGADMVDYLPKWSHIDELVKLVTFVGVKRRGYTPASRYPILWVDAPLIDISSTDVRDRVENGRSLKYLVPDSVIDYIQKEGLYRE

SEQ ID NO: 1862 - protein, 103 aa, Lactobacillus paracasei
MLTGKQKRYLRSLAMTTKPLINVGKNGLGDTFVAGVKDALEARELVKISLLPAADDTPQEVADTLQAAIQGVEIAQIIGHTVVVYKQAEKKDHRKISLEVNAR

SEQ ID NO: 1863 - protein, 374 aa, Lactobacillus paracasei
MDTTNTETERRCIGCGAILQTTDPKKPGYLPKATLSKADPDDEIYCQRCFRLRHYNEIAPVTLTDDDFLRLLNAIGESNALIVNVIDIFDFNGSVIPGLHRFVGDNPVILVGNKADVLPKSLNPNRLKNWLQQQAKAQGLRPVVTMLASAKKGFGVDELLDAIEKYRDHRDVYVVGVTNTGKSTLINRIIKELTGVEDLITTSRFPGTTLDRIMIPLDDGQSLIDTPGIIHRHQMAHFVGPKDLKLVSPTSVIKPATYQLNEGQTIFLGGLARFDYLRGGRNSFVIYTDNQLTLHRTKLENADDFYQKHVGGLLSPPQADEVPDFPPLVRFEFTPKEKADLVFAGLGWITVPAGVTVAGYAPKGVDVLLRRAFI

SEQ ID NO: 1864 - protein, 178 aa, Lactobacillus paracasei
VAVFEPTWLVTNIFSLTPASLKQQGIKAVLTDLDNTLMAWDHPEGTETLTRWLTDLRNSGIKVVVVSNNNANRIHKAMAKLGVAYVARALKPLPVGITKARKQLGLKRSEVVMVGDQLLTDIWAGNLAGVRTVLTQPLVQSDAWNTRINRYFEGYVFKALAKKRHLDYQEDIHGYHEH

SEQ ID NO: 1865 - protein, 299 aa, Lactobacillus paracasei
MTRLHHVSLLTGDAPATIQFYTKVLGLRLVKNTVNQENVHVRHLFFGDYQGTPGSVVTFFAIDRLGHRYDGQNQLGGIDLAIPTGSLAFWKQRLRMAGCVVTATLTSLTLVDPADTPVRLLVTDQTLPTQLVVPNDVPGENQITGLINVDLPVADHEAEKTFFQTMLGVTPENNQFKLEAGNTLTLKPSLTDSIKRFGRGSMDHFALTVDHEEALPRLGTIAAQHGYEVEEFADRGWFKSLYVRDPADNRIEFATKEPGFALDEPLAHLGEGLGLPPKFEAQRQAIETYFKTKGVDFHD

SEQ ID NO: 1866 - protein, 322 aa, Lactobacillus paracasei
MIEHTLLGMNHVTAMASDPQAIFDFMSKTLGLHLIKKTVNQDALDTYHFYFTDDQGTAGTDMTFFTFPNQPKGKKGTNMISRASFRVPSDAALDYWLKRFAEKGVANEGISNQFGTKIINFHDQDDQQYQLVSDENDHGVAGGTPWKHNDVPEEFAITGLGPVTVTIFNLGHMQYVLTEIMGYKQIAEDGNWSLYEVGEGGHGAQVILEHREDLPIAEEGFGNIHHAAFSTENRETLGTWIDRIKQYRLPQSGYVDRFYFKSEYFRAAPQILFELATTGPGFLQDETYDEAGIHLELPPFLESKREEIEKQLTPVKTDWRGR

SEQ ID NO: 1867 - protein, 53 aa, Lactobacillus paracasei
MAEDKVNYAFVKGDPTVSPLLLLHGQGGDENDLLPIGKYLSPNSPMLSIRGRV

SEQ ID NO: 1868 - protein, 156 aa, Lactobacillus paracasei
MNRYFKHTENGGFDLNDLEQETTWLFSVLNDLCRKFDIDYERFIVIGYSNGANVAARALLTRSDTFHTGIFFHPMALSTVDSKQDLSDVKVWMSHGDQDPIVPAQNFKVLDTYLEEQGADVTIFRHGQSHNLNEEELTNAKSWLAKSGRLADWRRR

SEQ ID NO: 1869 - protein, 322 aa, Lactobacillus paracasei
MQRFGFEQYGDPSVFETIEAPIPEPKTGQVQLQVLGFGLNPYDASLRRGEQAAFRKVKFPVVPGTDVLGRITKLGEGVTDFAIGDLVLNYRPIGGYSEYVTASTSKIYKKPTALSFLDAAALPQVGLAAFNILHYMLSLKPGQTLAVIGASGGVGAILVQLAKFEKLNVIAVAGAQHHDYLQQLGADQIYSYTDDLPDSRADAVVNAVFGAADHGASLKLVKAGGQYVTTAYADVDVSSKPGTTHLQLNPSKDYSVHDGFAYLVDVAQKWGLQVRVAQSFAFTVDGVIAAHEMLETHHAPGKLIVMQDRHVTHPVRKDINQL

SEQ ID NO: 1870 - protein, 188 aa, Lactobacillus paracasei
MKIAVYCGANSGADPAFLQAASKVGAWIAARGDTLIYGGGKLGLMGAVAQSALDHGGDVIGIMPQVLADRGLAMPALTHLEVVADMGTRKAKMIEMADADLALPGGPGTLEEITEAISFSRIGLNASPTILFDQNGYYQPLKQMYQTAVDQGFFDQDAFDNVLFSDDLTAISTFIANYQPLGVVRQYH

SEQ ID NO: 1871 - protein, 118 aa, Lactobacillus paracasei
MPHVKGGTVTRKRRKKVLKLAKGYRGAKHLLFKAANAQVMVSYRYAFRDRRAKKRDFRRLWIARINAAARMNDISYSKLMHGLKVANVDMNRKMLADLAVSDPDGFKAVADTAKKALA

SEQ ID NO: 1872 - protein, 66 aa, Lactobacillus paracasei
MPKFKTHRASAKRFKKTASGALKRGHAYTSHRFHGKTKKQRRQLRKSALVSHSDMKRIRQMLSQMK

SEQ ID NO: 1873 - protein, 154 aa, Lactobacillus paracasei
LISQTGEQLGVKSTRDALAIAEDANLDVVLVSPNAKPPVARIMDYGKFRFELQKKERDARKKQKTVTIKEIRLSPTIGEADFNTRLKNATKFLEKGDKVKVSVRFRGRAITHKDLGRKVLEQMADAVKEIAAVETHPKMDGRSMFLMLAPRAEK

SEQ ID NO: 1874 - protein, 231 aa, Lactobacillus paracasei
MTDEPIVQNPQLIHLIQLLRADQNDETQAAFYAALKTAKFMLPVGATRDGDPTIVMITDDQGQDFLPIFTDQANFGKSPDHDQYAVATINDCANFLYEDHDIQGVAINPYGENMLLSRANLFYVAKPDSAKNGEAVRIGEPPRETATLVKHLRDYLAKLRTVHAAYLTTMIRADDTQSLLLVVDADKGTDLHAIVAFAEAYLPETTQFHVSPNDNELGRYVSGEFAPFYQR

SEQ ID NO: 1875 - protein, 161 aa, Lactobacillus paracasei
LFSPNLAHPPFVFSMYDKLDTFTTHIKRKGDSVFIALWASWLVLFVVTKILAAVLYLVVLFAYMKLPWRTPNQRGYWLIAHRGRGLLVIMGIVMLLTVVGAYGIATWWFAKIEFQPQGVAVFGSVGIVLLSWLVGLPKKLRRFRGKVSADQKRDKGENDDD

SEQ ID NO: 1876 - protein, 189 aa, Lactobacillus paracasei
MATIDLVRHAEPDITIHDDFLRPLTSAGQRQTQQLVDSLHQYPYTAFFSSPLKRAVDTITPIADDHGLPVQKNELLVARKMPAWLPNFSEYVNQQWQDLTFFEKPGESIHQVQERYLSFLYGLPSSAFVAVGSHGTAISSLVEAAIPGIGYHFFSKLGYAAVTRIEMHAGNVVHLAVWEPKSKTFKVLK

SEQ ID NO: 1877 - protein, 657 aa, Lactobacillus paracasei
MALDITFPDGNVKQFPDGTTVKAITEGISNSLAKKAVAGKLDGDLIAYDEPIAHSGQLQIMTKDDAEGLTVLRQTAAFVLAAALKDLYPDIHFGQGQATEDGFYYDTDRADGQVSVDDLPTVQKKMEAIIKENAALEPVVLSRAEAFQAFKNDPFKKQLVEAAGDPIKGYKLGDFVDFDEKVLLPSLKDLKHLKLLSVAGAYWQGKSSNPMLQRIYGTAYWSEKGLEDDAKRRQEAAEHDHRVIGRDLDLFFVDPKVGAGLPYWMPNGATIRRVIERYIIDKEIADGYEHVYTPVLANLDLYKTSGHWDHYREDMFPPMDMGDGEMLELRPMNCPSHIQIYNHHIRSYRELPLRIAELGMMHRYEKSGALSGLQRVREMTLNDGHTFVALDQVQEEFKKILRLIMDVYEDFNITDYSFRLSYRDPKNTEKYFDDDEMWTRSQSMLKGAMDDLKLDYYEAEGEAAFYGPKLDIQTKTALGNDETMSTIQLDFMLPERFNLTYVGKDGEEHRPVMIHRGIVGTMERFIAYLTEIYKGAFPTWLAPTQAVLIPVNNDLHLDYVNRIKKQMLAAGLRVKVDDRNEKMGYKIREAQTKKIPYTVVVGDKELNDAAVSVRRYGDEHTEEEAGNMFIDALVAEVKNYSRDGKTKPGEATKVLGD

SEQ ID NO: 1878 - protein, 143 aa, Lactobacillus paracasei
MLFPELLVALRTELVHTVAETRSLAQKPAHKDLKPKMTKAQPFRLEATSVPVSKRARERSFSENLLHLTAQCVSMKLSKTEATKDHPIESKTMAESLARSDPNHFSRLPQGPVTQVTRQLSGQQPVLLANWVEPRSLIVPDVS

SEQ ID NO: 1879 - protein, 311 aa, Lactobacillus paracasei
MEDMRKRIAMLMDSRQWRDRYFKMVKEALQDPEVQAFLKQHTGELADDAIDRGTAKIYEFVSERNKIARGELPLAPGYKPTLVAANGLIDVAYEPTDAKIAADEEAKQASLVTSVNMPKDIRGASLTNYDPTDERMDALLAANQFVLAVVADPKAFHQGLYLSGPFGVGKTYLLGAIANDLAEKGGIASTLIHVPTFVVEMKNAIGNNTVLPKIDRIKRAQVLILDDIGAESISPWVRDDVLGIILQYRMQEKMPTLFSSNKSMEDLTASLAGTDRGNSEMLKAKRIMERIHFLAKEVQVGGENRRNPLAD

SEQ ID NO: 1880 - protein, 448 aa, Lactobacillus paracasei
MQRPDTFSPQAGFVLTKAGHLSDFDEKVAISLYQPLIGPIAMALYLSLWQEVKDRALVTDRRLQLWLLDLLDIDIDQLFNARVKLEAVGLLRTYTQVDSLGRYYAYELYAPVAPDAFFKDDLLGLLLYDKVGEKRYDELVGQFSLKPVRRPEWQEITASFLDVFRFDHDLSKEPPAVVAAKSDMTQKEATRPRLGTGGGYDWALVKAMLANSNIQAGQLATHQEALYQIAGFYGIQPPDFARLISRATDVMTGKINLSQLRRLAEQGYTRAQPHAQPTTTTAPPKVASADEALLQKAKSMPPRQFLTAAKQAKNVRMYPANNELRAVQQLSERNVFDAPTINILIDYILRTNDSINQALLDAIANSWLKANVNSPEAALKQISDFEKQKASGQKRRQGSAKGPRQEKLPDWAQEGYQPEKKKVSDADREKLAAQLAKLRELGDKGGAN

SEQ ID NO: 1881 - protein, 155 aa, Lactobacillus paracasei
VQCPHCHHNSSRVVDSRPTDGGRAIRRRRECENCGFRFTTFERVEQTPLLVIKKNGTREEFNREKILKGLIRAAEKRPVTMEQMQSIVDSVENQLRAIGENEVSSQAIGEFVMSKLADVDDVAYIRFASVYRQFKDMSVFMQELQDMMKKEKTKK

SEQ ID NO: 1882 - protein, 200 aa, Lactobacillus paracasei
VTYLLGLTGGIASGKSTVSRTFKAAGFPVVDADVIARQIVEPGQPVLARIAQAFGPEVLRADGSLDRAKLAEIVFSQPGRMAALNQINRPYLREAISQAVAQAKAGGAAIVVGDIPLLYEADYADDFDGVAVVSVDPNIQLSRLMARDGLSQADAEARIQSQMPLAQKAALADFVIDNNGTQEATIAQANALIQRLQRLS

SEQ ID NO: 1883 - protein, 282 aa, Lactobacillus paracasei
MPELPEVETVRRSLLPLVKNKVITAINTNWEKILINGLATFQKEIVGSEITTIDRRGKYLLMRLSNGETIISHLRMEGRYYVVKDANTPFDKHDHVTFTFQDGSQLRYRDLRKFGRMRLIKTGQEDQVPALAKLGPEPTPRTFDETEFARRLKRHHKPIKSVLLDQTVVAGVGNIYADEVLWLSRLNPLQPADTLKSKEIKTLHDAIIQELNAAIAAGGTSAHTYVDAEGNRGSFQNALHVYDREGTPCDRCGTTIVKIKVGQRGTHYCPHCQPLHQRRRPA

SEQ ID NO: 1884 - protein, 881 aa, Lactobacillus paracasei
MASKTKLLLVDGNSVAFRAFFALYNQLDRFTNQDGLHTNAIYAFNNMLEIVLKAVQPDAALVAFDAGKTTFRTAKYADYKSGRAKTPSELLEQLPYIKELLDDMGIAHYELKDYEADDIIGTMAKRADEAGWETTIVTGDRDLTQLTTDRTTVQLTVKGVNELEAYTPAHVKEKLGITPAQIIDLKGLMGDTSDNYPGVTKVGEKTALKLLNQYGSMENLYANVDDMKKSKLKENLINDKDNAFLSKQLATIDRDAPLTVDLADVTYAGPDLDKLRDFYTKMNMNSLLKKIGGSVAKPVQAVHFSVLDEQSILALTKLTEPLTFEIEMLEDNYHVAEQIGFFIGTKEETYVSTDVTLLTLPAVKRWLEDAKRDLTVFDGKRNIVAANRLGVKLPDIAFDVLLASYLINPDENSNDLGKIAEDHDYHDLPRDEDIYGKGAKRQVPEDDKLFGQFARKSDALFALRPDLTGDLEKQEQTDLFTDMEMPLSRVLAEMEIQGITLNAKTLKAMGTEFSQSIKILEEKIYAEAGVKFNLNSPKQLGEILFEKLNLPVIKKTKTGYSTSVDVLNELKSASPIVQDILDYRGWAKLNSTYVVGLLKAQLPDHKIHTRYLQTLTQTGRLSSVDPNMQNIPARDEGKIIRKAFVPSHEGWQIFSSDYSQIELRVLSHISGDENMQEAFKHGVDIHANTAMKIFGLSSPDQVTPDMRRQAKATNFGIVYGISDYGLSQNIGISRKQAKAFIDGYFDQYPKVHDYMDAMVKKAREDGYVETLFHRRRYLPQIHSRNFNLRKFAERTAMNTPIQGSAADIIKVAMIRMQKALDEAGLQAKMLLQVHDELIFEAPEEEIVQLSELVPKVMDSAVHLDVPLKVESHYGPTWFDAK

SEQ ID NO: 1885 - protein, 236 aa, Lactobacillus paracasei
MQERRVVNEAGLTQFFSRIYTLMGSGLVVTALVSYLLGFPFRAEYTSFVSGHPIVFWIMAFMPIILSFFVTGRRAQASPGYATVMFYLMSASFGFTFASVAMVADGTNLAVALATTAVVFLVMSMVGHFGKRDLSKAGSIAMVALFGIIIMSFVNMFLGSNGMQLLISYGVLIIFIVLTAWDTQRLKNLYLTTGNDGQAAVSEGSLAVLGALMLYLDFLNLFTAILQILGVGNNNN

SEQ ID NO: 1886 - protein, 436 aa, Lactobacillus paracasei
MTEATYYFIGIKGSGMSALALVLHDLGHQVLGSDITQYTFTQKGLAAAGIKMLPFDPANLKPGYTVIAGNSFTDDHPEIKRAKELGLTIYRYHEFLGKLIEGYTSIGVAGAHGKTSTTGLLAHTLSGVAKTSYLIGDGTGKGIPDSKFFVFEADEYRRHFLAYHPDYMIMTNIDFDHPDYYTGFEDVYDAFETEANQVKKAIVAWGDDPWLRKLKAKVPVYYYGISDRDDFQARNVDRDTKGSSFDAYFHDQLIGHFFVPLFGEHSVLNALAVVAVAHMEKLDAKLIARELGNFSGVKRRFAEKDLKDMIIVDDYAHHPNEIKATLDAARQKYPDKAIIAVFQPHTFSRTQAYEPQYVQVLSQADQTFLTPIFSSAREKTGKIRSEDITAQIKGAAVIHQEDMKPLLQYHNAVVVFMGAGDIQKYEKAYETILAEE

SEQ ID NO: 1887 - protein, 836 aa, Lactobacillus paracasei
MAHYDGPAFLHQNKVPEPQSELNTSDWTQAQHEEQYQLPPQLAHEPKPDVDPRKVAEAQADLRAFDYPQRPRGRDELSRLSTPNSTAHRRPVDRTDYAQIAEILRPDSQTVYLFAGHGIENKMAVNHDISLTPSDTNTAKSTTSFIEKQDENEADRRANASKAPQEDTLLAEKSDEAGTQNQKPLDETLPEATAPSVAAKPVTPTDTHQLSSSTPATSAVEPQAKSAETEKKTLLTAVTADEAEEAPASVNKPFVDSSSQSVINKPHAPNSRKAARIEALRRKHAAKKLRRELAAQKAKAKQAQAEMQTSPKPSGPPSTTAETPSANDADYSTSALTQSPSTGILPSSMAAAEDTGSAPTGPIPGVSTLPPLKLLASPVKVDQAAQEDWVVAQSDRLDKTLQAFNVDAHVVAHTVGPTVTQFQVRLASGVKVNKITNLNDDLKLALAAKDIRIEAPIPGKNTVGIEIPNLKPRPVMLREVLDTPAFQQAKSPLTIALGVDLFGQPVVTNLARMPHGLIAGATGSGKSVFINSLLVSLLYKATPEQVRLLLIDPKAVELAGYNGLPHLVSPVISDPKAASAALKWVVSTMNDRYKKLAAAGVRNLEQFNAKAERFHEYAQVLPYLVIIIDELADLMLAAGSEIQDDIARITAKARAAGIHLLVATQRPSVDVITGTIKNNIPTRIAFMTASQIDSRTIIDTAGAERLLGRGDMLYLGNGASQPIRLQGTFVDREIDAIVDYVKARRGPRYLFDPAGLVKSAEASVSHEDELMPEVLDYLSGERHISTSKLQRVFSIGYNRAANLIDALEAKHLVSPAKGAKPREVYYSQAKKEEQTS

SEQ ID NO: 1888 - protein, 213 aa, Lactobacillus paracasei
MLITSYNQPAFGDTLLAITGQDTATQTIQRRGDIVAILNDKGNVIGYNFFNVTQWLGQLTGQGRLVLTATQIAELNQAIQTAGLPGKLAVDETPKFVIGKIVDFKDHPDADHLHVTQVDIGNEQVQIVCGAPNAALGQTVVVALPGAMMPDGKIIWPGSLRGVDSYGMISSARELGIPGAPQRRGILVMPDSLPAGTPFDAKKAEAVVAVQAS

SEQ ID NO: 1889 - protein, 105 aa, Lactobacillus paracasei
MKELGSNAAILNEVKQPGKKMLFFSADWCSDCRFIKPAMPEIEKDFSDYEFIAVDRDKNLEVAQDMGVFGIPSFIAFNDGKETGRFVNKDRKTKQQVEDFINGLH

SEQ ID NO: 1890 - protein, 113 aa, Lactobacillus paracasei
LAIFKKKSNWRVWIAAAAVTAGMASIVYRRLYYRTIPNRILSIVKTNFTNRGTIENSWINMQPTERGTGRDRYRVYTGGLTVREGDRLNQFAFAVEPDGTLRQLKQLHEPINA

SEQ ID NO: 1891 - protein, 214 aa, Lactobacillus paracasei
MRLRNKQWAKPLILAHPEMILVRPEKMQGHWQSRFDQARPLYLEVGSGKGQFIVEMAKTHPDRNFIALELQEAAVAMILKKQVALKLPNLQLVLGDGADLTDYFSEGEIDGLFLNFSDPWPKTRHEKRRLTYRDFLRQYQAIMKPDALLQFKTDNQGLFEYSLVSMNHFGMTFDLVSLNLHHDKRVTDNVPTEYEEKFSADGGRIYELVAHFKH

SEQ ID NO: 1892 - protein, 257 aa, Lactobacillus paracasei
MEFELDSGWSLQPAGGSTGSAFLGVYANQKYFLKRNASPFLAALSVEHITPRLLWTRRVSTGDVLTAQEWLDGETLTRQQMMLPVVAKMLAQVHHSSLLKRLLRQVGGQVLDPEQLRIALLQDFPVDVAAQPKIKTALHDLKQWLPHTDVQTVCHGDLNHKNWLQAGGRLYLVDWEQVALGDPAYDLADVLAHYGSPATSHQFLDAYGARLDEDLKRRLYWYGDLHLLHDIKVAATHQRFEEVAQVLHQFECLQASR

SEQ ID NO: 1893 - protein, 32 aa, Lactobacillus paracasei
MAKDRPFRLKAAYVPVSKRASLRSALDVNFAS

SEQ ID NO: 1894 - protein, 404 aa, Lactobacillus paracasei
MVALWRTRLRQHVQEQQKYLRLVFNDHFVLVLLILFGGALYAYSLLVKTLQPSWWLALCLAVIFTALIALGQLATLAQAPDQVFLLPKAEAFSDYLLKARRYSMMLPATLLGFAALAMWPLFAQLGQDPISATVTLLLAVWLFKDLDLWLQLLQRYHLPINWRHPRLVLLVITFAALFLGFYLHPAVALLVALTLNLVFRWLRSSLLADGLLNFEALIDLEADRMGRLYRFYNLFTDVPGLANSVHRRRYLDPLLKLVKPSKTETWAYLYLRGFLRGGEYLGLYLRLLVIGAIIVAVLSQWWLLLGFTILFLYMVGFQLLPFFFQYDEIVFTHLYPVAPNQKLAAFERLLMTLLLLEVVVFTLVALIRLQWLAALTIFVGGTAFVWGFTRWYARVRLRVHDAMR

SEQ ID NO: 1895 - protein, 242 aa, Lactobacillus paracasei
MTLTIEGLTGGYGNLTVLKDINFTVPAGKIVGLIGLNGAGKSTTIKHIIGLLTPQSGTISLDGKTLHDDPTGFRADLAYVPETPVLYPELTLREHLEMTIMAYDLDATVAWQDADNMLKMFRLDNKLDWFPAKFSKGMQQKVMIVAAFMTHAQLFIIDEPFSGLDPLAVHDLLDLVTAKKEQGASILMSTHILATAQQYADEFVLIKAGKVRATGDLPSLKQQFDLQDGSLDDIYMKMTEEQ

SEQ ID NO: 1896 - protein, 142 aa, Lactobacillus paracasei
MNDCIFCKIVRNEIPNVTVYEDDVVKAFLDITQVTPGHTLLVPKVHIPDIFAYDTELAAAVFERLPKIARAIKASDPAIKGMNILNNNGKVAYQSVFHSHIHLIPRYSDQDDFGMHFGDHSAQYDTEKLEAVADKIRTQLEA

SEQ ID NO: 1897 - protein, 123 aa, Lactobacillus paracasei
MKFKHGFLLGALTGTVYALLTAKKTGPQLQQEIAAYFEGLSDGVGQVRESVAQFSQSLTHLSDELNNTLKPAMKDITDRVETFEFETAPRVDAIQKHVENINDAVSNLDAMPTADQREPLPKH

SEQ ID NO: 1898 - protein, 300 aa, Lactobacillus paracasei
MKKWILGVVGLFVAVTLAGCSSSTVANMKGAKVTKDEYYDAMKKTTTGQATLRNMIVLKALEQQYPNKVSDKKVNSQFSTLKKQYGSSFDTTLEQNGYTESSFKDQIRTTLYSEVALKALKKPTEKQIAAQWKKYQPKITVQHILVKTEDEAKQIISDYQKDPTEKNFEALAKKNSIDTGTKDKGGKLTAFDNTDTSLDSTFKKAAFKLTKAGDITTTPVKTQYGYHVIRVISVGKKGTMKEHKKDLENQLYTTWQSDQTVMNGIITKVLKKENVSIKDNDLKDVLSSYLSTSSSTSTSN

SEQ ID NO: 1899 - protein, 325 aa, Lactobacillus paracasei
VTTLVKRLFDYHNEEDVRLPVLIKSAEVRVAKNGKKFIAMIFQDNSGHISGKFWDASDNDIAQFKAGEVVQLSGKRELYQGNPQIKIFSLRLATQEEGNDPKAFVERAPEAPSDMEEELNSYIFEITNANWNRIVRKLINDHKKAFFSYPAAKSNHHAFAGGLAFHTLSILRLAKSVVQQYSSLNKSLLYAGAILHDLGKTIELSGPISTDYTVEGNLIGHIVLIDEQIVLAAQQLKIDINAEDMLLLRHVVLAHHGLLEYGSPVRPELLEAQVLHDLDELDASINMMTTAYQHVDPGTFTERLFGMDNRRFYRPKNGQTFPDPH

SEQ ID NO: 1900 - protein, 114 aa, Lactobacillus paracasei
MANVYDTANQMAADIKTTQEFQDLKKAFDLLKLDAVAYGLFQQFQQKQYEMQQKSMQGQDFTDDEVKSLQELGDKMRDIQPIQNLMAKEQGLSQMMDELNKIISQPIIDVYQGK

SEQ ID NO: 1901 - protein, 680 aa, Lactobacillus paracasei
MQFLSRIWQGTRWFFRRFQVIRWLILIGLTVMLGFSAWFTYKAKTADVENIKSTLQTKTVIYDANNEEAGTLYGQKGTYVELKAISPQVQNAVISTEDRTFYTNGGFSIKGILRSALNYVIHHGQIMGGGSTITQQLAKNTLLTQKQTVMRKAQELFMAIQLNKVYSKQDILAMYLNNAYFGNGVWGVQDAAKRYFGKDASQLDASEGAILAGMLRNPSYYNPADHMDNALSRRNVVLQLMVDNKKLTQAQANAAKAQSVQVVDTFSTANSQKYPSYFDSVIEEARSEGISVDDILNKGYKIYTNLDQTYQRNLQNSFAQDWAFPANAADGKQVQGASIVLDPKTGGVRAVVGNRGEHTFLGFNYATQLRNSPGSTIKPLMVYTPALENGYHYDSVLKDEKLSYGKNNYTPTNATGTYLGTVPMYKALADSINAPAVWLLNKIGVQKGVTSLDRFGIQLKESDQNLAAALGGLKNGVSPLMMARAYAVFANGGKLPTTHFIRKIVDASGQTVVDNSHPTMRQIISKKVAQEMTSMMIGTFNEGTGQTAKPAGYTIAGKTGSTEVPSSWGYGTKDQWVIGYTPDIVNATWIGYPTTDSQHFLQGTSTSGVAPLFKLEMTNLMPNTPQTAFDTKDAAQMASIQTPSSGDKTWQGIQDSIEKGIDSAKQTVGQWYDNIKGWFK

SEQ ID NO: 1902 - protein, 277 aa, Lactobacillus paracasei
LLFQTSARATLPTSLRDQLQAWLIPRKRQHQLRVAKTILVNGHYRNFNEKVQPSDVITMTYDEPTPLAYVPETPALTIHYEDDDLLIVDKPAGMKTHPNLPGETGTLMNQAAAYLAPFPALITHRLDMATSGLLVIAKNPLTQAIINRQLALKTMHRDYIALVPQGIAASGTITAPIGHDPDDQRKRMIRPDGASAITHFRRIAETSTTATVALRLETGRTHQIRVHLASIGYPILGDPLYAPDQTTYQRMYLHAFQVRFTKPLSDTTLTVTSPLPF

SEQ ID NO: 1903 - protein, 151 aa, Lactobacillus paracasei
MNKSERQAALTRIINQKPIATQEELLAALKAAGIDATQATISRDIREMKIVKSQDATGTLRYTIFRGSSESQLERLGRSIREVGLSITRVHFMNVIKTLPSNGNLLAAIIDDIGFEQVVGTIAGHDTIVVISPDEKQAKWFEAAYRQAFNS

SEQ ID NO: 1904 - protein, 560 aa, Lactobacillus paracasei
MDFKELVVKALEPALAGQLDAAAIKSLIETPKSSDLGDYAFPTFSLAKIMHRAPKMIASDLVGQIDVTPFEKVKAVGGYVNFYLDKISFAHDVLKVIAQAGEHYGDANIGSGNVPIDMSSPNIAKPMSMGHLRSTVIGNALANILSKIGYTPIKINHLGDWGTQFGKLIVAYKKWGSEDAVKADPIKNLLHYYVEFHEKAEANPELDDEARAWFKRLEDGDEEAIALWRWFRTVSLAEFNRIYKILGVDFDSYNGEAFYNDKMADVVKRLEDKHLLKTSQGAEIVDLSAYNLNPALIKKSDGATLYMTRDLAAAIFRKEHYHFVQSLYVVGNEQREHFQQLKAVLLEMGYDWANDIHHIPFGLITANGKKLSTRKGNIILLENVLRDAVGLAKQQIAEKHPDLPNADKVAHEVGVGAVIFHDLKNERLDNFDFNLEEVVRFEGETGPYVQYTNARANSILRKAAIDPAPEVALSDPAAWDVLRALGDYPSMVLRAAKEYEPSVIAKYALRLAKAFNKYYANVKVLVEDSELPARLAMVKATTQVLTNALQLLGVGAPEEM

SEQ ID NO: 1905 - protein, 128 aa, Lactobacillus paracasei
MAKTGRHYYFVARNEKTKTGYHISFPNIPNAEAVGTTYEETVYYSYRVLADFLSHLPKQEAEIRAYTLSDIPDTVSSNVFYSLVSVTPDFDPHKMETHFTLPQTPPADIRQKAAKLAGLVTPNDNLAL

SEQ ID NO: 1906 - protein, 60 aa, Lactobacillus paracasei
MQTFRMLLLVIFLVGVGLALIGLVSWLIALLRHRETKPMRRLTWLSGGVALAALIVNAFT

SEQ ID NO: 1907 - protein, 312 aa, Lactobacillus paracasei
MTDLQTSIGDFQFDNVFMNASGVRCYTEEDLDALAQSDAGTFVTKSATQAKRLGNPSPRYARLELGSINSMGLPNEGLDYYLNYALKFQEKHPGQWIFLSVAGLTMEENLAMAHTIEDSDFNGLVEFNLSCPNVPGKPQTGYDFDRTKEVLTNLFTFFTKPAGVKLPPYFDLAQFDQMAAILNQFPLQFVNSINSLGNGLMIDPETDTALIKPKGGFGGIGGAYAKPIALANVRAFSQRLDPKIQLIGTGGVTNGRDAYDLILAGASLVQVGTLLQEEGPAVFTRLSRELQAVMQTKGYTNLSDFKGQLKTQ

SEQ ID NO: 1908 - protein, 604 aa, Lactobacillus paracasei
MTNEKMKVWAYFKHNAGDFSRHWGAYIMLISVTNLFIGLAVIPFFNFAAQQTLRIGHVPYITLTNLGQILTHDPGVAAVLTLLGLLLLLFVYWQFTFLILGIQNIHRQTRLSFFQLAIATLKKTHRLTPTTIAVLIAYFVLIFPFSSVVFKTSLLAKLTIPDFIVDFIFARWYLGLLVIALYMMGTWLAVRLLPLLPALILSETPPRKAVAKTWRMTRGQTWRTLLAVLLIFIPVAVLTTLLTIGLYLLQSYLDSHWEHWALLGATINLGVLQVVMLLLTVFFTVMLYQLGTSQAETFQLIPNQDLIARVPKRRRNLLFRIGAVGLIALVIGGSSLFYYAYLTGALASQPLTISHRGVDDGNGVQNTIPALQATAKEKPDYVEMDLHETKDHQFVVMHDENLKDLTGVDAKPHQLTLSEMTKLTARENGHTTKVASFDQYLAAAERLHQKLLIEIKTTPEDSPQMMNHFIQLYGQRLLADHDQLHSLDYQVVTTMRKQVPKLKTFFILPYTLVFPETPASGYTLETTTLAMRVIDEAHNRDQKVYAWTVNDSDDMEKVAFMDADGIITDQLGELKTTLYQMNHHPSYADQILQYLTSFSDDAEN

SEQ ID NO: 1909 - protein, 228 aa, Lactobacillus paracasei
MEMERINANTIRVMLGNDDLAQRGITVLDLLGNHKQIESFFYSILDEVDKDHTFATNEAVTFQVMPSQSGLELLISKSGQKNDDSAADQTDDEGTDTQVPDYIRQQLQGLDASDQQDHQAVDEGGYIDADKAPQTELVLKLKDFEDFISLADTLRLEGGKSDLYRYKNAYYLVLTFYPNEISSDEAHDQMAVAMEFGDRSPLSSAVLSEYGKRLMETSALETARYYFK

SEQ ID NO: 1910 - protein, 132 aa, Lactobacillus paracasei
MVILYTSPSCTSCRKARAWLKENKIPFEERNIFSDPLNVDEIKRLLRMTEDGTEEIISTRSKIFQELGINIDDLSTGTLIKLVAKYPGLLRRPIMMDDKRLQVGYNEDEIRRFLPRSVRTMELQQAQLLAGF

SEQ ID NO: 1911 - protein, 70 aa, Lactobacillus paracasei
VNYEFSLNFQVKCNYDNEFLIVVDKANHKRQLIAIQLTSRGQKSRATIQATANKLAKANDVDAVIQFVQS

SEQ ID NO: 1912 - protein, 444 aa, Lactobacillus paracasei
MARSTHKQLNALSIFLLGIDGIIGSGIFLMPSRVYAKLGDLSMVVMPLAGIAILSIALCFANLASKIPGDGGAWLYTYTAFGRFAGFEIGIFTWLLGIITMATEISAFVTSLRSLFPVLNQHGPYLITALGILAALTGLNLMGSGFMDWVDNVSTIAKVGVLVAFVVIGLFFIHPANLGNLTGNPAATPLFSRFNQGFGMVFYMFTGFSFLPIAASKMKNPEKMLPRALISVLLTAAGLYLVVQLTAIGVAGSGLAAANVPIAVAFSHFAGTVGYDLALMGMLISILGVALSVSFSTPLIASSLASEHQLLPRTLGRQNKRGVPLQSLILSVVICALFLLSGNYLFLASCIVFTSFVQYVPTIFAAIKLRHHSKLPVGFKLPGGLTIPVLALLVTMYLTLSFSVTLVLTGLGIFLVSALWYLYDDRDRKANGLERDISAKDRPF

SEQ ID NO: 1913 - protein, 96 aa, Lactobacillus paracasei
MAKIGYARVSSKEQHLDRQLAALKDVDKLFTDKLSGANTNRPELQKMLAYIREGDIVLVTELDLGQLLRLINSQLKRPKHKRFNWCFGLDCVFMYS

SEQ ID NO: 1914 - protein, 186 aa, Lactobacillus paracasei
MRFIFKALIVVVIILAFPLSIVLVFKNWSTAIGTSTPMSLKLGWLEQYEPIYLFWSGVILAVLLIIFLLITLFWPRSQSLYLHQKSDGQVTISKRAIEHFALSALQHEPFIGNPKVSAKLSRKGITLKIWGDLLNSVNAKKQTANFLNQLKKDLRICLGISEQKKIKIRLVDFNELDANVHKSRVV

SEQ ID NO: 1915 - protein, 61 aa, Lactobacillus paracasei
VTELIKAYFWPLIGGIMGLLLAVLIITFGFFKTLFVLIFMAIGITAGYYIQKTGILTNVFK

SEQ ID NO: 1916 - protein, 180 aa, Lactobacillus paracasei
MQNGTPSEKTTTNEKSGVKGNLTFDDKVIQKIIGIALSEVDGLLTVDGGFFSNVAGKLVNTSDVTSGIDVEVGKKQVAVDLDIVAEYGIDISKLYDKIKNVIVREVKNMTELEVIEVNVNVVDIKTKEQYEKDSTSLQDRVSDATDKTKEAVIKGAKKSKETLGDSVDKVTSDNQSSRVN

SEQ ID NO: 1917 - protein, 82 aa, Lactobacillus paracasei
MGLIWSLIVGAIIGAIAGAITNRGAAMGWIANIVAGLIGAWIGQGLLGTWGPSLAGMAIIPSIIGAIVVVAVVSFFLSRSTR

SEQ ID NO: 1918 - protein, 91 aa, Lactobacillus paracasei
MQNRSGRKYGLLNYSVYVISLGGFLFGYDTGVINGALAFMSKTSQLNLTPSRQGIVSSSLVLGACLGAFLCGKYADKYGRKVTLRWVAVIS

SEQ ID NO: 1919 - protein, 421 aa, Lactobacillus paracasei
MKKIVKFALPMVLLALTLGACGSGSSSGSSAKKDVTFYLSGDTSEGGAYTKMAKKYEKETGTRVRITDVPYDDLKTKIDKSVQAKDEPDVARVAGVSSTWTKDLQNLGSIAKSAKTINSMTITDSKTKQVVAIPSDLTTNGLFINKTLFDKAGVKYPASDKDIWTWDDFLAAVKKVQASTGAKYGLVVDPSDQRLRTITYQYGGKDFRLNKAGTSYVTDANTKNALKKFISWNDNKLMPKTVWTSGEDPSSMFKSGQVAAYLSGSWQITDFSKNIKDFKWAATYMPYVKTRATNLGGNFVISFKNGKNPSGGMKFLKWLYKPANYKQLCEYAGYIPAVEDLDIDYGSNQKAYDIMLNEIANSSSIAGYQETKGVEAVMKGYKGLSGSYKDEIANVISGQESFNAALKKIEQDYNDGFLNQK

SEQ ID NO: 1920 - protein, 292 aa, Lactobacillus paracasei
VTLKQKFRRNKWPLIFVGVNVVLFIVWFVIPAILGLYYSFTNSDGNPGERFIGLANYQKLFVDPSFYKALFRTFTYVICEVPLLYIVSLLVAVLLSSDKVKGKIVGKIVVFLPWCVSGIVTGVMWKWLFGQDFGFINYVLQKMGQKPIPWFSNGNTAFMVIVIAGVWAATAFNVLLFMNAIKNVPTSLYEAAALDGASSFDKFWHITVPAIRPTSFMVILLATIGAMKEFVMVQALTDGGPGTDNMFIVQYIYTTGFDKSNVGYASAVSMVLFVILLILALIQMKVGGGTNE

SEQ ID NO: 1921 - protein, 276 aa, Lactobacillus paracasei
MSKLYDRTTKTLLTLALAIVCVLYLFPILWFLLSSLKPGNELFSYPLTIFPKHATFENFSNAWNTLDFFKYFKNTFISATITTVLTVLASATCGYALAKYDRKWLKIFFVCIIATTMLPTEVLMNPTFSVIKATGLYNRLAGIIIPSINTATGIFMFRSFFVTVPDSLIESARIDGASDGRIFASIMFPIARPIVMTLSIFSFQWRWNDYIWPLIVLNDPDKYTLQVALRSIIGAQNVNWSLLLASSVISILPLVLVFVVFQRYIMNSGSTSGMKD

SEQ ID NO: 1922 - protein, 70 aa, Lactobacillus paracasei
MPFFVIKKGLVLLEWKYFPTPKILDPFLFSARYELRPGSLFTPANCGFDIQLRSILTSISLSFHLLSQNS

SEQ ID NO: 1923 - protein, 110 aa, Lactobacillus paracasei
MRTFTHRYGSDITRDQFNLIRADLEDARKHTAPRQIDLYDVFCAMLYTMKNGCTWRDLPSDFPKWQTVYYYWVLWTKQENPIEMALLTRVLKKLSLSYDLAKAGQLELRS

SEQ ID NO: 1924 - protein, 2947 aa, Lactobacillus paracasei
MGKFSKEKPSAKTTNFKMYKAGKRWIFAFSTLTLLAGGAGLLSSEGQSVHADSKDDQQIINAATAASIHTAPAVPSTAASAATIAAPTAATTAAPATVAAQPKADNHEQTQPASASAATPSATPEAASSVTASVAPATSSSATPIVKQAAQSSAPEVTTQTASKTTESAASPISAAPSAAASSVTPASAAVNDVGKAIVSKTLAAMPVVDDAGTPSTIVYTQSNSRGSATVTAPNVSIFAGDTSIDQVVQSNFTAFGNGSLATFTLTSGLTIVASTAVNNIDYTHDLTPFGSSSIKGPFLTFQGTGTVGSILANQVGRPNDANIPIWIPSVSYKTPGVYAVQFNIDTNQSKPLIGPFNGVIMSYFLVTVKSALNPDTDSSTAASAASVASAASTKANSASSIASSASSAANSANTQTASIASANPENDSLASLAKVASSATAVASSYATDASSDAAAAKSIAAVVGTANNVAASAATAANAASAAGKIDDATSFATIASSAASVASQQAPIANAAADKALSKAYAASSAADNALNAGRSAAAITGSASSTASAGSIASSAGNTGSIALDKATIASTIANSASAIASTANSTAASAKAIVDNAASAFPTNDSLAKLSATASSATAATSSYAASAFASNSQASDLAAKVKAANDAVISAVAQTTAALASKNLPDASSYAAIAASAAGLASQLADQTSTAASAALSSALAASDAAKIVVSAASDASKIAGSLGTTTGSATADGSNASLANGVALSASAEANNASAIAKAASTTASSANSTASGLASAFPDNASIGSLAAKAAGANSLTSSYATAASAFASQASDLATQVSVANSQAQAAVGQVTSAANKGDSAAVALYSAQASTAASTAAALANQTKSAASSAMSNALKAKEQAGIAADAASAAGNIAAGLTTGAGDGAGSGSNVAQSASVVASTASVVANSASAIASTASSVALSAKNVTASAASSFPKDDSLAALSTTASSANDVASDFATKASSDASVASSYAGQTSSANDVAKTAASQANSAIAAGQSAAAVTFASQAVAAGKLASSLADKTSTAASFAQSEALKASSAADIAANAANSATGRLSSLTADTRKDTSAASDKASAAAVAAKSASTVANNASIIASTASSVASSANDVTTSLISSYPTNSSLTSLSNVASSANIATSGYAKSASSDAATASSLAAKVTAANKAASLAASQANSAIAVGDLPNASAFKAQASAVASTAADLASQANDAANQASIEADQANSTAAIGSSAAAAAIDVAANLAKTTSDTADHASSVASSASVVANSASVVANSASSIASAASSTAKSANDIASSIASRFPKDQSIGSLSAAASSAASLTSSYAAGASSDASLASSYAATVSSANDAASAAASAANSAYTTGSIAVASSFAADASSAASTAASAADKGKSAATKALSEAYQASSAAKDASSIAAVASTAASSLAASITSGNTSASDKASSASDQARSASVTASTASVTANNASAIASTASSVADSAYQDASSAASRYPDNGSLTSLSAVASSANTQTASLATLASSDADAASSFATVVSSANAKATSAAAKANSAIDAGDLTAASSFADQAAIAGSIASSIADKVSSAAGQALSEARAASSAAKIAVSAGSNARDIAGKVASSTTSYTADSASAVANNASDIASTASSVASSAYQNASSTANNYPDNLSLASLVKTASSANTVATSFATDASSDASAANSFADQVKSANAAAITAASQATAASSRGDNGTAQSYGNKAASAAAAASDYADKTSSAAAKALSEAYKASSAAKVAVDANDHAKAVAAVASSAGDQASVKASQASDSAQAAAVIARSASTTANNASAIASAASSTAKSANAIASSAASRFPNNDSLTSLAQVAADATAQTSSYAAQALSDVSSATSLATVTSSANTAASRAASQANSAIAAGNISQASSLADQASSFAKTASSAADAASSFADTALSEAVQAKAQAAIVSSAAADANRIATAVASQGDKYIGDAIKAASQAGSSADIAHSASSKYPTDASITSATSVAKKAADDASSAADTAKQAAQGGDIPTASSAAAVAKSAADRASVAADLASSLAIGHDGDAKSYANDAAKSASQASSSADIAGSAATKYPDDPTISRVTDIAKKAASDASSAASIAKDAAKLGDDTTASSAAADAKSAADLADSAARIASSTADSITAAKKAAATSYASDATKAASSASSSADVAGSAATKYPNDPTISSATDAAKSAASIASSAAIDAKSAAQAGDDSTASSAASVAKSASTVASSAASKASDAAKAKSTAATSYASDATKAASSASSSADVADSAATKYPNDPTISSATDAAKSAASIASSAAIDAKSAAQAGDDSTASSAASVAKSASTVASSAASKASDAAKAKSTAATSFASDATKAASSASSSADVADSAATKYPNDPTISSATDAAKSAASIASSAATDAKSAAQAGDDSTASSAASVAKSASTVASSAASKASDAAKAKSTAATSYASDATKAASSASSSADVADSAATKYPNDPTISSATDAAKSAASIASSAATDAKSAAQAGDDSTASSAASVAKSVSAVASSAASKASDAAKAKDEAKSKSDAASSYADAAGKSASQASSSADVAGSAGKKYPDDPAIKSSADLAKSAADDAAKSAAVAKEAAKSGDDSKASSAAAGAKSSADLASSAADTAKSLASSHAAGSETVNHPAQSDYTSAANSAVTAANLAASIAAKAASETANIAQANPNNTSLAYLKSDAASAALVAANAAKDAASYAAYAKAAQELAHDYVDPNKAAQALSFAAQYVASATAAADTAKSAATRAQADRDLAAQITSGKSNPTGDHGTTDHGNQGTGQGGQQGTGGKGTTDNNGSQTGNNTGNNNQNGDNAGTVHTVANETGAGAKTNTADITGSGTANGNDHTLPQTGETDAAGALALAGVALMGALALMGAKRRHEN

SEQ ID NO: 1925 - protein, 903 aa, Lactobacillus paracasei
LKKSQNIAFADTEKIKVKRANFRSWKKGKKWLFASSLIVTVIGAGALDSGKTVKADEVTPETIKIAASIDQAPTNKESAEAQQAKDSQSSQSAVNTQPSTRPASQALIAPQISAVAAQQFVAPNAIAQSTAALTQTNSAQSSEASSVVTASVAPAASLVAPSVNAIQATVTKDKQTLETRDVQVQTKSSFDPSIALIGGTDSKGNPLNPEDISLTGTVTTAYAGSYFLRYEYIDPYTKEKIGKTVRVNVSDREVQPPVVSSAGQASTSSLATLKNNSSATEVVTKPVALDSLNLTSVSASLASFAKTDQGRITLSEAADKINSGVNFFSAAVSLSNDPKVLAFQTQLSAATAASDVALQKSLVASFNATAEGQAMNSLAAIQSSTANDPAFQSMLGSLSSSTAAASVADASATSSFMATAAGKAFMTQASLVADKGSLASAAAVSAFAKTADGQQMIAAISSYAAIPEFAAYNKAMSSAVASSNESLAQSLTASFFATSLGSAFIQDMQKYESTNSYKAMQTAITEAQDSVAKQLQSTISVTAQSLVKADSGFSITGILSSITSFAWNAISWLASNINPVKLVPNLTGLGQVGELIESVIGGTLGSAFYGTITTAIGGFATWIVAGVPATVLNSIVGIIPIVGWITNGGNLAELGWTGGIVGWLSGLVGSSIGAYYGATMAAGLSKDGKVDNVVSGVALGATIGGLVGHTIANWAISYTLGMIVEGIAVVIAVAAGFIGLGPIVNPLEFFLLGWFTPLTDTIASLIGSPIGAAIGGVIGGVAGWLLQLVGIQVNLPDAGGVLKGISQLPGISDLIGTISQISSKAGKLVTKNVVIQAKSHFDPADAFVSATDGDGNAVALDQMSVDGAVTVSIPGTYILRYYFTNAANKNEIVTNDVYVTVTR

SEQ ID NO: 1926 - protein, 79 aa, Lactobacillus paracasei
MKAKIELRPLVLKNKESFQPEKLLVNANDSLGNPVPLELFGLSGEVNLTRPGVYQITIDFTDPVSNQHIEEKTSVTVLS

SEQ ID NO: 1927 - protein, 577 aa, Lactobacillus paracasei
MGKRQRQNKTKLKGNLPIVELTKVQRRCLDTSGLILVFASLIALNIGHSVNASSNGDGVIAGDATTNQSSANQMYPSGPSSINTTNSTASAISSAPARRVSEEGKIALEKQQSSEVSQTDVTDKAKKELNDSGESDQKKENIVSVSETNQVQTPKIQTAGVTISRNSSWSPAENLISARNTLGQEVGLDDIQTVGTVNSAVVGTYFIQYGFKDVSGGKDVTQFSSITVTDNNDPVHYKQAGENILPSVPVGALASIKAKDTFLLTKSSWMPNNNFISATNSDGESVNPDKISIDGTVNPTVVGNYFIRFSFTDTKLKTLVANMAKVTVVNTLPLESGDLSQGGYKESHLASFFPSTTNYPSTKTVYLPDDPNFKPDENEISKYFLQYVNELRTLNGQTTLTISASDTARAQQRARAIVDSFNHETVSSATENIGTNAGITDQMHSNQEIAYYMVMAWYDETDNPEPLGDGHYGHRANLLYGGPTMGLSFYRPSAGTAEFTDYYAFEAPIYTDFLLYLKAKSMANAMTNPVSVPLPNITFVYVNAATLATLRSYLNWSQVGHADPKVENNAKPSLSLA

SEQ ID NO: 1928 - protein, 449 aa, Lactobacillus paracasei
MGFFSKKSRSETANLLDSLAKQSSSSEQRQKLGGGKQAFSPADGVDQLAKALAPGSAASTQQLDQLSSVASLANEILKPTESKSDTWSMNITGGTELSFADDQLTVYVQNESEAAAPNDQAVPSKATVSQPQDAAAPIQPDQAEHHADDAGKQVPDPIVKSVDNTDAATASQAEVVTHHQVKAAGASATQQQSEAPAVVLQEAAPQLDNQSTIKSTGDQYHEALKQNSILITQIAVLQKINEQLTTQIEQWHTYRSKTTVYIKDLMAKHQATLADFESNRQAAEEAKTLRSQNEALLEKEQTLQDQVANLTQQLTTTKADLTKQLEAAKTDLANQLETAQSDRDKALNAKSDLQNELSKQIVAEQIAETDLKHAQEDLAAAKQAQQQLEAELTKLRAERANRAATSVSSQPAVAVPTAKALADSGVALNRLDVLPSSDVPVFESDFPEA

SEQ ID NO: 1929 - protein, 511 aa, Lactobacillus paracasei
LNYFVNENIFSMNSGTEFSAAKRLTLFKRNGVPAKVLTRNYNPLLIDDLKRVGLEQADVLNMYNYFQEAVAVVPQDIDIRYTEVIDKFDYHIVGIDANESQILHHGKVVGKALVAPATVGLVGSLEYYNDMNATVAKDVWDRRGFKSSTQYFHPDGQIGPQVFYNPAGEPKLEIVRMNVNGTLMNTMYQLLNYKGRAWRFNSESELFIFFMNEIAAAEPSVLINDRPSLINEVAAVTEATAKWQYLHSVHTHNPERVGGSKHYVDYLKPLFATHINDFDGVMVATEEQKAEIDKFFHFKEVVVVPDTFADAHDLVPIKKRDRNKIVYLGRISPEKEPQEAIKIFAKAKKQLPDLHLDFYGYVSDQDVENGMIAYSKELGVDTAIQYHGYQTDEELAKELGTAAALLSVSSSEAFGMNILQAMSYGVPVIAYNVKYGLNLLVEKDVSGYLAPLGESKAAADHLVRLLTDATPNAKWADMVNTTYQKSQTFDAKAAWQQWQDQLATVPNLFLR

SEQ ID NO: 1930 - protein, 538 aa, Lactobacillus paracasei
MIFFINSSFNQSNSGIEHAQLKRAGLFRDHGEPFKMIFREWNPRLHEYLNHNDVADSEILGMFDYFQDAEDVPTKILHAEDIDFGLDNLSYQKEPNQFRYLVLRGNQFVARVNYFSDDPTERVSSIEQFDAFGNLFRVDFYDFRGFMSLSQWYTPDNKIGTEVWHKVDGRPVLETFNKYDANHVFTKTGWRLTEDNGAVYVFSDIDELTLHFYNRLNEQYWDDKRPNIFIIDRSHLGDWQLVNLVRPAYTVMHLHNSHAGDAQDPMHSVMNNFYEYSLIHANDYDAVVSATEKQTHDVRERFHPESKLFTIPVGVIPDEQFARPRVAMADRQPAKVLVTARVAPEKRIDHIIEAIGIAKKDVPNISLDVYGYVDHRDNDEAMTKINAAIKKYHLEDDVKLHDYVKDVGAVQREAQVYALASVMEGFNLSLMEAISNGMVGVTYDVNYGPNELIVDGENGFVVPFEGIKAMAAKFVELFTHPDELQQMSTRSYELSDRYSEENVWQAWQALLDDAKKKKLPHIDEITEGIGDQRVKTKG

SEQ ID NO: 1931 - protein, 332 aa, Lactobacillus paracasei
VIRYGTIGTNKITNEFIEAATISRKWELTAVYADDAKDAQAFADQQSASTAFSDLNTFLQSDGLEAVFIASSPIRHFEQIKRAIQADKHVIVQPPAVTNPTEFAAIEQLLADHPDVRFFEAVYPLHMPNFENVAATLATMPAIQGATFVAMRDLPGYDQVLAGQQPDGFTLASAGGALQIVGLYPLYAALRLFGRPKKGSYFATAIQTGVDGLGAIFLEYPKFDVTLHIGITTDSFMPSEIYGLHEKIVIDNITELKLINHYDVDKQNNLLNTITYANRLTGEALAIGNVLENLNDPEQQKQYASWLQLARDVHTTLFHLRSMVGIKFPTDR

SEQ ID NO: 1932 - protein, 548 aa, Lactobacillus paracasei
MFAGRERGLLKYPKLNLNRRLVGQSLPFGANHNTGGDGDLFSGIIILACAMKEESALFYFVTNQFDVNDPVGVEQLKRLTLFSDNQQDAKILVLDDQPDLSQQKDLAQVAANQIQSVFTAIVPHTNATVRVPYTTGDIQTFTQYQARPNGEETAFFDGEQLVMKIRYFTATTGGQAVLHQIRTISYFSEHGDRLRTEEYDLTGNKISTHYFRADGNLRLTVYFQIDGSSLLTIDYDQQGTIHKISYLDRAGQTAEFANWMAFATFALGRTVQNTPGEVIVDHPATSLDELVKLTAITRLTPVVRNEHDAQAVKQVLEQPDLRSKIVQIVIDPKADYATLLADVGIQLLPIAAGDDSVDQPATAPEWDDRQAEQLALIIDDQHAPNFEQLIGALSLVRVKAEQVKLTFFFQRPDSPLKQQLQQQVNQLGLNQLIRIQDEVIQETSALEQSAAFIVPDIANLKDDNVLTALAHGTPIITFTGDPLGGADKGELGILKANQDTFELAGLIQRLITDKDWWTQISQNAQKTAKPLRRLTVWELWRMKLVTAG

SEQ ID NO: 1933 - protein, 89 aa, Lactobacillus paracasei
MFQATLIRRNKHTIRMRYKRIGKRDPTMKQIRIHDFRHSHVALLIDRETEYTIIKERLRHASIVTTIDTYGHLFPNKQRETAYALDKFF

SEQ ID NO: 1934 - protein, 124 aa, Lactobacillus paracasei
MEKPKFRPYKRPNGNIEFFEFLDSLPFKERAKLQLAIQMTQDLGLQEAAQRLLVKKLATNLYELRSRQGKTYQRGLYFHVSGNDYVITHGFSKKTNKTPQREIDHAIDLRAEFYQNYKEEDDHE

SEQ ID NO: 1935 - protein, 106 aa, Lactobacillus paracasei
MSKDLHEFTVEHTGDLDAYFAEMMKDSSYREVYNEEKNKMASAMALLEAREEAGLSQQKLADKSGVPKTTIVRIENGNNTSIDTLTKLANALGRPLNLTIGPASMA

SEQ ID NO: 1936 - protein, 410 aa, Lactobacillus paracasei
LKIELLGQVSDSIIHIISRKIGTDDFRSFMMNHSLPYSGSNVSRFYQFFNKTANRSTDERAQLQEELEEFVAHSLQFGQTRIIDEATFDLKPTPDSIEEIPAYRSTKNKSEFSFSKLLNFSVGKYFSLIYRVVDVDNVEKLSKITMCFARKFTPIDTNDKAELVWIIIDFKNRTWQMRRDARTGNRIDDKLASTSPQLFKYFRKILAGDYAISTEESSDQQTLFKMFEHFTRMNEEEFSDVITKYDKQIQSLCQGFLKEQSIDPHVTTLKLDSRVRNLLLRMLISSKFERYEETQHNMEASVRSFGFNASEDTSLSAKSGPVRGYRSVEQISEFSIEHTAAYFDNRETIEQSQRLFLISLLWMKNSTGLDNDVLVKYIAYSGFTETHFQLYALKEEEYNVVFPKLEDYRI

SEQ ID NO: 1937 - protein, 172 aa, Lactobacillus paracasei
LYFQNLKIIESEIKENPTDYSASYFIALCKLDQWLVYLNRRERLLVRPLTFCSENSVNFNVAIKLFCLASGQGTFKPVFYTIGDFGEIRLLADTKKTLIKLIQDPVDNDLYGAAKEDDIFLGYQLIETPTEVPKDFTERIESEAITVDLQINGDTPQSRQARHAILCAFMES

SEQ ID NO: 1938 - protein, 195 aa, Lactobacillus paracasei
MQKRINKDRVFQLLKTYTPIVLTGLFLLGQYLLVGTFLWREYLLKLKFDNLTPKVQVSFFSSISPYIGPSITVLTALTTIYIQQIIIKHKDRSERTRINRLIKIEFAENQNRLRTLNQVKSISPTDRFKGALSCINTRDWNNLRSKLTPKDLLALNEIRIAYCSFDDAKSFSDAIEGEDEDNRILWDKLKQKFGL

SEQ ID NO: 1939 - protein, 128 aa, Lactobacillus paracasei
LKISIKKVPALYDLLYGAFALVMLVAAIMATLPNGFSLTGVGSTLMQWANHLWWLTLPGIVLHLLSYFASQNQRLLLIGNLVGLCAFIAFILIPNYSVFAVIGLAVAMFLILSGAKRSRRVHNNSEVS

SEQ ID NO: 1940 - protein, 60 aa, Lactobacillus paracasei
MAWLKHKKEEPPEIGIGDHDFSQFVQDARRDPQRFKAVQSVFSRLKRKPRKDDSRRPKRH

SEQ ID NO: 1941 - protein, 128 aa, Lactobacillus paracasei
MKKAFGVVFLLVVIVLGFFGYQYWNSTYNGVESYAKVTQGTKHASKNNDGSPYKVNGKQYYYYDYEFTWVTKDGQKREVGYESGESANPTELQPGSYVKATVSEKRVIKGPEVVNKNAIPASVLSKLE

SEQ ID NO: 1942 - protein, 82 aa, Lactobacillus paracasei
MAENLALRALISQQTDALVSELYTDDKVNARLQTWLAKVPDPGVADTYSYLLSESRDFSEELLYRILTKLVEDGSLKLKEQA

SEQ ID NO: 1943 - protein, 204 aa, Lactobacillus paracasei
MLSMMIPWLVTQPTIQSAQQLLGMQLSLAGCSGLIVETEAYLGVEDKAAHAFGGRKTPRNHSLYLPAGNVYVYQMRQYCLLNIVTRTAEVPECILIRALEPQAGMAKMQQRRHQEGVGLTNGPGKLCQALAIDRALDGSRLNAGGLQLTATTFQPRHITIGPRIGIPNKEPWTSAPLRFSVQGNPFVSGTARRDQDLKTRGWQS

SEQ ID NO: 1944 - protein, 164 aa, Lactobacillus paracasei
MSQINMLDAIGDKMDALDFDGDLSLNWDKDAHVIELEITMTVQSESGIEVEDQSGETVDNGPVEYQDAILFYDETRLHGEDYADDYLAVFGFNGKKGIDKATVDALFIYLQDFLDDSESDLMDFVDGTSDDDTFVLNFDDAAFERILAEQPEEDNRVFLPYPKY

SEQ ID NO: 1945 - protein, 315 aa, Lactobacillus paracasei
MNDWTALTVTTTTEAIEAVSNILMEAGAVGIQIKDAADFKKETVDAHGAWFDPKTVPHLASGAQVIGYFDPATSLVEQRDHIATRVRGLAQFGLDPGAATVTLADVRQADWANVWKQYYHPLRVSRFLTIVPKWEHYTPQQAGELQLTLDPGMAFGTGTHPTTQLMLSLLESVIRGGETMIDVGTGSGILAIAAERLGVGDILATDVDEIAVRNAEANIKLNPVSHITVTANDLLKGITLSADLIVANILAEVLVPLIPQVRPRLKAHGHFLLAGIIADKATLIIRTLEDNGFSIAQRREAGGWVALDAVIKETA

SEQ ID NO: 1946 - protein, 246 aa, Lactobacillus paracasei
MQRYFTDQKLKTGDVVQLDATIAKHAIKVLRQDIGDRFELVDPMHHAYLAIIQQSSPLQVAIDEDITKKVELPLAVEVVCGVSKGDKSEWIVQKATELGADKIGFFNAQWGTARWPAERVVKKIARLQEIAKNAAEQSHRNQVPDVTMYAKLNQVGQTAEAKLVAYEESAKQGEHGALISALSPRPASLCVVFGPEGGLAPEELSVLTGQGFIAAGLGPRILRAETAPLYLLSAVSVLTELQATSI

SEQ ID NO: 1947 - protein, 107 aa, Lactobacillus paracasei
MSRILNWVKVPRNSVISWSILITLILPWLFPLFHISTAIRVGVLFILIDMFSAWWIGKMIHRHHLAWWWLFVLPVLFAAMVFLRYQWYGYFFVPVYILLSLLAMAKD

SEQ ID NO: 1948 - protein, 742 aa, Lactobacillus paracasei
MAEEVELTQPDVMKLCKAYMNPEHLAFVEKAYKFAAYVHKDQVRKSGEPYIIHPIQVAGILAELKMDPATVASGYLHDVVEDTNITLGDIEEVFGHDVAVIVDGVTKLSKVTYVAHKDELAENHRKMLLAMAKDLRVIMVKLADRLHNMRTLQHLRPDKQRRIANETLEIYAPLADRLGISTIKWELEDLSLRYLNPQQYYRIAHLMNSKRTEREAYIQEAIDEIEKALADLHIKYEIYGRPKHIYSIYKKMRDKHKQFDELYDLLAIRVITETIKDCYAVLGAIHTKWKPMPGRFKDYIAMPKANLYQSIHTTVIGPMGKPLEVQIRTEEMHHVAEYGVAAHWAYKEGQTSKVEYDKTGKKLDIFREILELQDETSDAADFMESVKGDIFTDRVYVFTPKGDVYELPKGSNPLDFGYLVHTEVGNHTVGAKVNGKIVPLNYVLKNGDIVEMLTASGSAPSRDWIKLVFTSRARNKIKRYFKQADKSENAEKGRDMLERELLDEGYVPKDFLTKENMTGLMQRLNFQTIDELMSSIGYGEYTPKVIANRLTEKFRHDKAEKDRKAKEAEILSKNQKVTTVSSDKHQQPQTHSEDGVVIEGVDNLLVHLAKCCMPVPGDAIVGYVTKGRGVTVHRADCPNVQSSGEMAGRLIDVRWENEEAQKQLFDTDLEIYGYNRSGLLSDVLQVLNAQTKALNNINGRVDHDKMADIHVTVGVRNLAHLDKLMDAVKNVPDIYEVKRANG

SEQ ID NO: 1949 - protein, 148 aa, Lactobacillus paracasei
MRAVVQRSLEAKVTIEGNTVGTIDHGFVVLLGVGPTDTQADSDYLAEKISKLRVFSDPVGKMNLALADVGGQVLSISQFTLYADTHRGNRPSFTGAADPALGDRLYQAFNAKLKALGVPVATGEFGGDMQVSLTNDGPVTILFDTEAK

SEQ ID NO: 1950 - protein, 208 aa, Lactobacillus paracasei
MLVNAIWDFDGTLYDSYPGMMKALGALVTDNGGHFDLAALYRTTKETSIKQFLTTFGAQIGRSVTDLEADYHHRAAAYLQDIKPYPTALAVLRAIKSQGGNNLLLTHRDHSAWKILAKDHAADLFLGGVDADLDLPRKPAPDSIQYLLKRFQLNPAVTAMIGDRSLDVDAGINAGVKTIYFNVDGLNAAPQADFQVDHLEEIPPLFRV

SEQ ID NO: 1951 - protein, 440 aa, Lactobacillus paracasei
MKKIGQLKKWPLVVLVALLFGVGVATTSVMANTQYMTVKADTVNVRLGPGLAYSIMGQVKSGNELSIIGAKNSWYQVRLAGNKIGWVASWLVDQSEAATSQAKVATVNQPVNVREYASQNAKQLGSLNAGDSVKVVYQEGAWTQIAYNTTAAWITSSSVQLTGQTTNLAQPAQTALATEKSAPALKVTTNTMTNLRNAAGINAPSVEKLDKGTELTVSKQQDDWYAVTAPDGKTGYVASWTVSAPNDGQTQKAATKLSEATIVLDPGHGGSDTGAIANDGTDYEKTYTLKTANLVANALRAAGANVIMTRTTDTFVDLAPRPNTANNAHADAFISFHFDSSPSKNSASGITTYYYDSKKDLALAKSVNSAFSGLPLENRGVAFGNFEVLRDNKQPAILNEMGYINNDKDFRQIKDPSYQSKIATDIVNGLNAYFKAGNHQ

SEQ ID NO: 1952 - protein, 146 aa, Lactobacillus paracasei
MWQDNRIQAAIDGTNPMVMAELPGGFAVFGDVQFLPGYCVLLPKQNITDLNHLEEPARTLFLQSMAQLGDAVLAACHPVRVNYDILGNTDNFLHAHVFPRYKTESAERLAKPVWLYTPDHWHDPQYQYNPAKHDAIRQKITQFLLP

SEQ ID NO: 1953 - protein, 291 aa, Lactobacillus paracasei
MSLFLKNVGQRFGDKQALTGITATLEANGVSGLIGPNGAGKSTLLKLLATLAKPSSGTILLDDVDIVRQPQKMRQVLGYLPQQVPYDAHVTALAYLRYIAALKGIAPREADRQIVQTLGLLHLNPSNSTLLGDYSGGMRQRVGLTASLLGDPQVVIVDEPTVGLDPVERIAVRNLLSSLAQTRIVIISTHIIEDVEAIASQLLLLTDGQLHFQGTPAQFLDKASGHVWEYTLPRNASLPTSERISGMQERSDGIHIRMIADEAPVANAVMVAPNLEDATLDFFESQAVRKG

SEQ ID NO: 1954 - protein, 501 aa, Lactobacillus paracasei
MMRLIAVDYRERTQQFSFRILAVIALFAAVILAPRPKGNFRVLVLDPQYFAQANNPTWLPIGVACVLSLFFPLVSLVIARQGIHADRENGVLTYLLTTKLRRFRYLASQFLVSCCLLFTILVLVMLGSGLMLLIQYPGQGLSLSQFLSPFFSLVPGIFLISGLGVLSETFPGLRGQLGTTVLVIALLTLYAMMTTMTWYSQLFNFSGITFLMAMIRQSAISAGHPLNTVLMLGGNDHLSRTGTHQLIFQPLALTQTEWLAIGGTVLMSIVLVLLAAFCLEHRPLHQKTNSGKSKLTVDLPRPKDDRFHSARTANFRWQQLLGQQAHRLFHSQNKWWWLVAIGLWLLAWVVPVGSLRGMILPIQYLWAMSFFSQIGWPDDLNGLSAWEGTVNHATRRAINSTLWLSVTFSLLLLLPTLLRQGIVAWPLLGWAIMLPVVSLMLGQLTKSGQWSQLLGTVILFLVVCGLTGPLPLATSLVGMVTGAVYSLIAVGCWIVIEVRAR

SEQ ID NO: 1955 - protein, 108 aa, Lactobacillus paracasei
MASKSVFVKVDRPIGFSDKSHAPYPINYGYVPTVTGGDGEKQDVYIVSDLINEPLQSFEGKLIAVVHRADDNEEKWVATTENETFSAAEIAARIHFMEQYFDSTVALV

SEQ ID NO: 1956 - protein, 427 aa, Lactobacillus paracasei
MNYQRPKGTADILPGQSERWQQVEAVARKIFAQYQYHEIRTPIFENVDVFSRSAGDTSDIVTKEMYTFKDKGDRMMALRPEGTAGVVRAYVENKLYGPEHAKPYKVYYLGPMFRYERPQSGRQRQFHQIGVEAFGSDSPVLDAETLALAKQLLEALGAKHLKFVINSLGDPATRKAFHAALVDYLTPFKDQLSEDSKVRLVKNPLRILDSKDKHDQEIVANAPSILDYLTPEAQQHFDRVKTLLQGLGIPFEVDATMVRGLDYYNHTIFEVMSDDKVFGGGYTTILAGGRYNGLVEELGGPETPGIGFAMGVERLMLLMQGELPTAQPDAYIVTIDQGADQEALQMLTAIRQQGFTGEMDYMGRKPKGQFKAANKANAKLVLTIGESERAAGTVQIKNMATGDQQAFPQADVLADFGKIYTQVMEAK

SEQ ID NO: 1957 - protein, 601 aa, Lactobacillus paracasei
MSKRTCYAGDVTAEYVDQEVTLKGWVQKRRSLGSLIFIDLRDREGIVQLVFSEEFDKDALAVANSVRSEYVIEVQGVVKKRKPQAVNKDMKTGDVEVEVHTITILNKAKTPPFYIEDGVAVTEETKLKYRYLDLRRPEMQKNIFTRAHIMRSVHHFLDDNGFIDVETPTLTASTPEGARDYLVPSRVYPGSFYALPQSPQLFKQLLMGAGFDRYYQIARCFRDEDLRGDRQPEFTQIDLETSFLTAEEIQDITEGLIAKVMHDVKGIDVKLPFDRITWQDAMDKYGSDKPDLRFDMQIQDVSELVKDSDFKVFAGAVQNGGQVRAIVLPGGADKYSRKMIDAQQDYIKRFGAKGLAWLKVTSDSISGPIAKFFGDGADLVKAVGANAGDLVLFVADKAKVVADALGYLRTHFGHDLGLIDEQAFRFCWVVDWPLFEYDEGIQRWVPAHHPFTMPNEEDVHLLDTDPHAAHAQSYDIVLNGYELGGGSIRIHNREIQEKMLKALGFTPERAQKSFGFLLNALDYGFPPHGGLAIGLDRFVMLLTGRDNIRDVIAFPKNSKASEPMTSAPYPVADAQLKDLGIEVRADVDPEKEHEGDENLTE

SEQ ID NO: 1958 - protein, 150 aa, Lactobacillus paracasei
LSDQFEKESKKDLKKRLSPEAYAVTQEAATERPFTGEYDDFYQDGIYVDIVSGEPLFSSQDKYDAGCGWPSFTKPISKLAEHRDQSFGMERVEVRSPSAESHLGHVFTDGPAAKGGLRYCINSAALRFIPVADLEKEGYGDYRQLFKSVH

SEQ ID NO: 1959 - protein, 306 aa, Lactobacillus paracasei
MEEIDKLIRRHQNWSRLSAAFFYSICVAVALNMFWEPGGVFASGVTGLAQLLATIVRKWFNFSIALPFVSLSTTDLFSTGTLLFFLNVPLFVLAWKAIGHRFTFFTFLAVIFSTIMIRVLGVLTPLTKDPIVCGIFGAVVNGLGTGFALRNNISTGGIDILGIVLRKRTGRTVGTINIMFNILIIFFAGFVNDWPHALYSALAIFINGRVMDSLYTRQQRLQVMIVTARPRQVVNEIQNSMRRGITIVHDAEGAFHHEEKTILFTIISRAEMYDLEQAMRHSDPYAFVSITDSVKILGHFYEPKTD

SEQ ID NO: 1960 - protein, 295 aa, Lactobacillus paracasei
MLIGANVSMKGSEMLLGAVEEAASYTANTLQFYTGAPQNTRRKPTSEMMIPEGLAAMTKDGISHTVIHAPYIVNLGNTKKPENFTFAVQFMREEVARADALHAYTMPFHPGAHVGAGPEAAIKQIIKGLNEIIDPNQKVTIALETMAGKGTEIGRSFDELAAIIDGVTHNEKLRVTFDTCHTNDAGYDIKNDFDGVLNEFDHIIGLDRLSVIHVNDSKNPQGSHKDRHANIGFGTIGFDALNKIAHHPALAELPKILETPYVGPDKKHQVPPYGAEIKWLKTGDFQPDELRHLMV

SEQ ID NO: 1961 - protein, 276 aa, Lactobacillus paracasei
MTQELNLYIMSDSVGETGLRLAQAVAAQFPNFEAHYVRFPFIHTEEKIYSALDEAKKENALAIMTFVTSGFAQLATHYAKDQGVIAIDVMSPILSGIKSITHEEPNHVPGAVHDLNERYFDRISAMEFAVLYDDGKDPKGFLEADIVLLGVSRTSKTPLSLFLANRNLKVANLPLVPNAHIPEEIWSVDPKKIVGLTTDASVLMEFRRQRMIAYGLNPDTAYSARDQVNQELKFAEDLYKKIGCMVINTAHRSIEETATLILEHMGLDEFDNTETH

SEQ ID NO: 1962 - protein, 58 aa, Lactobacillus paracasei
MAKTVVKKNESLDDALRRFKRTVSKSGTLAEYRKREFYEKPSVRRKLKSEAARKRKKF

SEQ ID NO: 1963 - protein, 147 aa, Lactobacillus paracasei
VALMDELNAQMKQSMLAKDKVTLSVVRMLKTALVNEKIKLGHDLSEEEEKSVLATELKQRKESVSEFTKGGRDDLVQQTEAEIKVVERFLPAQLNKAQVGDIVDATIKEVGAKGKQDFGKVMKTLMPKVKGQADGSLVSSVVKEKLS

SEQ ID NO: 1964 - protein, 54 aa, Lactobacillus paracasei
MAVLSAAWSKKNLVNDKAGAIAGFFIWVLWVNGVRGDQIRVLILLTNGFALNIV

SEQ ID NO: 1965 - protein, 328 aa, Lactobacillus paracasei
LAQETSEKIFRLSNPDMAINLVGINDANLTLIEEGLNVQISPFGDELRIHGDTEAVSLTLQLLEAASKLLAQGIKLSPQDIASAVAMAKRGTLEYFADMYSETLLRDAKGQPIRVKNFGQRQYVDAIKHNDITFGIGPAGTGKTFLAVVMAVAAMKAGQVERIILTRPAVEAGESLGFLPGDLKEKVDPYLRPVYDALYAVLGKEHTDRLMDRGVIEIAPLAYMRGRTLDNAFAILDEAQNTTQAQMKMFLTRLGFGSKMIVNGDITQIDLPNNAKSGLLQAEQLLKGISHIAFTQFSAQDVVRHPVVAKIIEAYGRHDLQLQKKTKE

SEQ ID NO: 1966 - protein, 152 aa, Lactobacillus paracasei
MDLELFDDDQLLDDKHHDLIKKLVAFCGKQLKLPENTEMSITLVGDDEIERINREYRETDRVTDVISFAIEEGEDDLPLLPGMAKNIGDLFIDPLTVRRHAEEYGHSFERELGYTVVHGFLHLNGYDHIKPEDEAVMIPLQKKILAAYGLTR

SEQ ID NO: 1967 - protein, 132 aa, Lactobacillus paracasei
MALPDKQVGKNKHFIQSARHALDGLKVFFVDENNFKREFLSATLVIVAGVVLQVSAFSWFVLVLAILLVFLGELLNTIVENVVDFIVGDQYDARAKKIKDMSAGAVLIVSLIAVVAGIYVFGPPLLALFRSW

SEQ ID NO: 1968 - protein, 129 aa, Lactobacillus paracasei
LSVLRTAALAARENAYVPYSHFAVGAAVRVGDRIFSGANVENASYGLSNCAERSAIFAAVSAGYSKLDELLVIADTKGPVAPCGACRQVISEFFGPNAVITLANVAGQSVQTTPQALLPGAFSKGDLNA

SEQ ID NO: 1969 - protein, 300 aa, Lactobacillus paracasei
LSEHHSGFVAIIGRPNVGKSTFMNRILGEKIAIMSPKAQTTRNKINGIYTTPDAQIVFVDTPGIHKPKNELDTYMDKAALSTLNQVDAILFMVEADEEKGPGDGYIMRQLAEVKKPVYLIINKIDLVKPDDLLPLIESYQHDYAFAQVFPISATMGNNVDELLTALTDALPVGPQYYPEDQLTDHPEYFVVGELIREKILELTRDEVPHAVAVQVERMKDREGGKLQIEAYIIVERDSQKGIIIGRGGQMLKQIGIRARRDIENLLGDKVNLKLWVRVQKNWRDNNAYLKSLGYNTKDLR

SEQ ID NO: 1970 - protein, 259 aa, Lactobacillus paracasei
MVRQTETFEGLVMSRQNYRESDMLVKILTDRFGKKMFLLNRARKPGFTLGAGILPFTHADYIGEVRESGLSYLSAIKNATQYRQISDDITLNAYAAYIFGLIDLAFPDGRPVGFWFNQIKQALYLIDSGLDPQIIANVIEVQMLKEYGVEPNWRGCVIDGRADLPLDFSESYGGLLCQNHWDKDPHRLHASPRAIFYLRRFSTLDLNKVERINVKLDTKAELRRILDVIYTDMVGVTPKAKRFLDQMHQWQDRLPDDSE

SEQ ID NO: 1971 - protein, 139 aa, Lactobacillus paracasei
MSFYGFKTHMLVTTDGYILNYVVTAASVHDTKVAVSLIDDCPCPIVLADVGYVGKRLGAEFKQLGYTLWTPYRSNMKGAKEYNKRALKALRRTIESRFSTLVSDFGIETNLTRSAFGFQLKIELAILVYNLGFFNFVTN

SEQ ID NO: 1972 - protein, 263 aa, Lactobacillus paracasei
MKFFTAHTTTASKIVTLIYIFYRLIVIFMLGNSIYMQEWSHVALLVLTLNLFMLPYLIETYLHINIPSLLELIVISFIFSSTVLGELNDFYGHIPVWDTALHALNGFLAAGVGFSLIYLLNENITILKLTPLFIAVTTFCFSMTVGVAWEFVEFSADRWLNMDMQKDRIVRQINSVDLGQHNNKVVQLKDIQRTTIESETADGKKVTTVIHNGYLDVGVIDTMKDLFVNFIGALFFSIFGYLYIDHEHKRFQFIRNFIPTKRK

SEQ ID NO: 1973 - protein, 579 aa, Lactobacillus paracasei
VQENFVDQGMVADVAIHRDHPDNPHAHVMLTNRPFNPDGSWGLKAKTQYIKDENGKQLLTKSGFPKQRKIWLVDWDKKEKINEWRKNWALSVNQFLAQKNIPDRISEKSFVDQWIQETPTQHEGINSQRKNRKAFNQQVRAQRNAQAKYHNLDEKIRNHEHFDALTDELSFSEKHTISHLSQQLKTYVDLEHLDDKQRMLFNWKNSLLIKHAVGEDVTKQLLTIDQQTTSLAQANQLLNKVVERATKKLYPELDFEQTTAAERRELIKETNSEQTIFKGSELAERLADIRNDLLTQQLLTFTKRPYTSWQLANQQAQTIEKQLTTVLAKHGHQLDDLKHTDRGMLAVYEPNELEFISKAVKDLRVMREVKAVVQTQYDSILTTAFPDSDLDKLETIDKEQIYTAVVYYDPELKPLSADDLSQLQQQPPVVFTSQQHQAGLNYLLGKMELKDIQHHRLQRVLKHDGTRQLFIGECGQDPKLDHKQIEMVQARLKQQTTRFDQYKQDQIKDYQAINYYPTSPKNYLTNILDEALITILYAKNTDYLRKQQLRGLKETEWAMTKKQRQHQTRNRHEDGDMHL

SEQ ID NO: 1974 - protein, 271 aa, Lactobacillus paracasei
LLDVSTSGYYAWRRALPKRNAKERQYRQRIKHFFDQGQGTYGPKRICGLLRKNGNKASYHRVARLMADAGLYSTLRCRHPKSLTDSRLARQGDYPNLVKHQSFKPFEALSSDITQTTTSEGKAYICQIRDLTSNLVLAHQISNHMDMDLVLATLKQAHQRWALPETCIFHSDRGSQYTAKAVTKLVNQYHWQRSFSALGKPGDNAWSESFFAIMKKELIYQIQFKDINDLRAQVFAYIETFYNRVRVQARLDYLAPVAWLSLYDQASQKVA

SEQ ID NO: 1975 - protein, 93 aa, Lactobacillus paracasei
MTYSRNRYDQDFKKNAVRLSFNSSKPVKIIASELGVPESALYRWRKLYTEDGKQTPFASLEAENRALKRENAELALERDMLKKAAAYFASLQK

SEQ ID NO: 1976 - protein, 69 aa, Lactobacillus paracasei
MSQSNLEKQEAKLKSLNQKIKDEKNKIEQRLGKQIISQANLDYANLSNDQIKLLAKQFSEFLKVKSVDH

SEQ ID NO: 1977 - protein, 92 aa, Lactobacillus paracasei
MSNQYEKLIEQQARLKQKIEREDFKLRQSKYYENRQARKARSRRLIQKGALLEKYFQANNLSVEQTEELLKTFADYVNAHKPDRLKNDQPNN

SEQ ID NO: 1978 - protein, 168 aa, Lactobacillus paracasei
MRTNDLVSLYVSFVETNGGKSRPVLIRRVSEQTVEAFKITSQYEKKSTYIKQQYYPIQDWQSAGLKKPSWVDLGNIYRFPKAGLNFKEIGHLSKLDQNKISDFTLDLKSKRRGKGQKIIQQRSSKRKHKESKAELTKRIQKQLKDFAKHNPEIKPKNNPENKNDRPSY

SEQ ID NO: 1979 - protein, 93 aa, Lactobacillus paracasei
MAVKEKKRVQVKIDKDLADDTEAVLSELGLNPTTAINMFYKRIVANGALPFNASLSEEERANLRFLKATEGTPVTEFKDAKEVADWLNDPDED

SEQ ID NO: 1980 - protein, 156 aa, Lactobacillus paracasei
VIVDAQSVKTTDLTKNSGYDGGKKISGIKRHMAVDINGLPQAILVTRANVSDRSGALAMLSLASQNLELVQHVMVDGGYTGNDFADQVKLILNTKTTVAKRNELHMFTVLPQRWIVERSWSWLDKFRRLWKNCERVLNSSLQMVVLAFLKIVLKRY

SEQ ID NO: 1981 - protein, 216 aa, Lactobacillus paracasei
LAKIGYARVSTRDQNLARQIEQLHDAGVNKIFQEKLSGKNADRPQLKAMLDYIRDDDEVVVLSLDRLGRNSHDLTDIIETIRHRGAQLNVLNLPSFASIEDPNLRNLITTIIVELYKYIAQEERETIKIRQQQGIEIAKRQGKYKGKIREYGPHSPNRQKRYIYKEACRLLNRKKDGDETLTKRQIARMLGIAPVTLYRIEKYQAEDLANVPPSER

SEQ ID NO: 1982 - protein, 94 aa, Lactobacillus paracasei
MIDLRGKRILFTGRLRSFRRFQAQQLATILGAKPVNRIDKNVDILVVGIISKPYDQLLTTQKLTYARTYGIPKIDELAFISWCQWRLDQLKATL

SEQ ID NO: 1983 - protein, 169 aa, Lactobacillus paracasei
MQKRIDLANQTFGRLTVISFFGSSSNGNALWLCQCQCGNKCIVDSQRLQKGFTRSCGCLRSEISRSNIKANNQTKKFMGNPKNFQLINRTNLVASTLKRSNNKSGVIGVSWDKTAQKWVARLYFQGHLVLNRVYVHMEDAIAARKAAEKRYIVPLQKKYNQTHQKNQLN

SEQ ID NO: 1984 - protein, 44 aa, Lactobacillus paracasei
MDKELLTYVLDQAVGVIIAVILLTRIERRLDTLITNMGTFMVKI

SEQ ID NO: 1985 - protein, 182 aa, Lactobacillus paracasei
MAVAQKGFLLFLEHQAVVYGVLAKLSIRPHHSYFQDWRDEGILVYLNYFDRYRDPLTDAAAITKFNKLAWRFVFLTLMQRMQKVRHRRALEEAPANAAVLQTTTVATAPTSLEQSVEVKLQLRQLEAILTPVERRVLQLRLAGLADTGIARQLQISRQRFLKVRKRIQVKYRQLELEGFLNG

SEQ ID NO: 1986 - protein, 699 aa, Lactobacillus paracasei
MKHVLKKIVVTTLGIAVLACLAGFGGQQSVEAATDSEKPTIRIDKVNNLSPNFIMGADTSTLISEENSGVKYSDFDGQQKDLLTILNNNGVNYVRVRVWNDPYNAKGQGYGAGNADLNNAIKIGQRATKLGMKVLIDFHYSDFWADPGRQIPPKSWQGYSVDQKAQAIYDFTSSSLKKLRDAGVDVGMVQVGNETTASGICGVTGQDEYKLFAKGTQAVRDFDKNILIALHFTNPDKTDTMLWYAKGMADNKIDYDVFATSYYPYWHGSLDNLTYVLKTIANTYDKKVMVAETSYPYTLDDTDGETNVIKTTDDIKPAGYPATPQGQAHALRDVINAVANVGPKALGVFYWEPAWTTVGSANRTANLPIWEKYGSGWASSAVIGYDPTVSATTYGGSQWDNQALFDAKGRALQSLHTFKAVYTGANEQLPDPMLPSDEPAVESLLKNPSFEDTDLSAYQLSGPIKLTQDTPKTGKNALNFYSDDNFSASVSQTIILEAGTYEFSPSIQGGDTDSTSDLEIYADIDGQNQSSKVPALTGWKKWVEPKLTFKLAKETQVKLGLNIKSNAKSWGSTDDWVLTKTENGDATDSGDGSQSSESKSSSSQNESESSQSSDESHPSQASQSSESKSSSSQNESESTQSSDESHPSQASQSTEASSTDQKKKKSLPKTGEEIALGTGVIGIVVFISSLIFYVKHRVD

SEQ ID NO: 1987 - protein, 112 aa, Lactobacillus paracasei
MATKEEISMSGFEIVAYAGDAKTAVMKALTAAQEGDFEEADKQLKDAQKSIDDAHNSQTKILAEEAGGADMDVTFIMVHGQDTLMTTMLLIDETKYFVNVFKRLKALESKRR

SEQ ID NO: 1988 - protein, 480 aa, Lactobacillus paracasei
VKFPENFYFGGATAAYQAEGATHEDGRGPILWDPFLEKKGTFSPDPACDFYHEYPKDLQLSKQFGLNAIRVSIAWSRIFPTGSGKTEPRGVAFYHRLFAECKKDGIEPFVTLHHFDSPLSINESGDWLNPDNIDKFVDYAKFCFQEFPEIHYWITINEPTSMAVQQWTTGTFPPGEKYNFHKTFQSEHNENLAHARAVNAYKAMNLPGEIGIIHALQTVYPFEEGNAADIHAAKKQDTLDNYLFLDGTLAGHYSDEVLSLMNEILDANQQEHITITDQDEETLAQAAKQLDFVGVNYYFSKFVKAYDGPSETVHNGTGKKGSSITRLRGIGEEQVRPGIPTTDWDWPIYPKGIYDQLMRIKNNYPLVPKMYITENGVGLKETLPADGSVIDDQQRIDYVALHLKAIQEAMADGANVCGYFLWSLQDMFSWTNGYSKRYGLFFVDFKTQERYPKKSAYWFEQLTKNHEIPSTDAVDRITSH

SEQ ID NO: 1989 - protein, 583 aa, Lactobacillus paracasei
EIICBCMPNENTMDSFTKRIEKLRPVFEKIAANAYVSAIRDGFIAAMPIILFSSVFLMIAYVPNAWGFVWPKGVENNLMLAYNYSMGLLALFVAGTTAKNLTDTKNIKLPKTNQINPISVIMASMISFFILAALPLKIGSDMTYMGTQGLIAAYLVGLIIPNIYYVCIKNNITIKLPPQVPGNISQTFKDVIPMAASVTVFWAVTIAFKTFTGTNLPKFIIQVLSPLFKASDSYLGLALIAGAMAFFWFCGVQGPSIVSPAVTPIMIANTAANLQLYQAGEHASHVLAYNTMDFVMNFGGTGSTFVLAYLMLIFARSKQLKATGKAAFIPGTFSVNEPVLFGTPIIMNPIFFIPFILTPIFNIWMYKFFVTALGMNSIMYTMPWTLPGPIGIPVATGFAPLSFVLVGLMLIVDIAMYLPFLKVYDSQLVEEESAAAASDAQPAAIAPTVEPGVAVAGAAAAKAGDPEVAVEEPKTEHLNKPTNVLVLCAGGGTSGILANALNKLAKERKLPLQATARAYGQDMDLIEDMDLVILAPQMDSQKGNLKKITDKYGVTMVTTTGREYIQLTQDGDKALKFVEEHAK

SEQ ID NO: 1990 - protein, 329 aa, Lactobacillus paracasei
MASLKEIAKRAKVSVSTVSRVLNYDDTLAVTEETRRRIFRAAEDVHYQKKTRKEPKGKIGVVTWYTQAQEVKNAYYLSLRVMVEDALEAENFNKVTLYYGQSWTELETCAGVIAIGHFSHKQRAVLKELNPKLVIIGENTLRDGISSVVTDNEFSIESVLANFIAHGHTNIGIMIGNGRTNDDQEKIYDPRLGAFRRFLKSKQLYRPQNVFQGRITPEKGYQMATKGFDKLQDEFPSALFIASDTLAVGVLRYLHEHHIQVPDRVSIVSFNDSVTAAATVPSLSSIRVYSDLMTQQGINMLKRMLVTNETVPAVCLTVGTSVAYRESSN

SEQ ID NO: 1991 - protein, 61 aa, Lactobacillus paracasei
MGTWKNLQKGFTAYECLSGTVADDCVRLISRNHSQRQKEVTKKAALCNFGRLQVGLIKLML

SEQ ID NO: 1992 - protein, 76 aa, Lactobacillus paracasei
MILNDLQQQIKTAIDNQSPSIARHLSKQLETEIDVVPDVFEGMVANQLYIELETVLLPEILRLSQKDTVQNTSDDK

SEQ ID NO: 1993 - protein, 223 aa, Lactobacillus paracasei
MQNRKNKYRWLRWTLLIMLLIVSLAMIFNEQLKNLTVQHISNSAYHASLKDPPKSTGNFDFKKVKSLDVTTVAKAMTNDSNAIARLAIPSVSMRLPVFYGLDNNNLARGAGTMKPNQVLGKGNYALAGHYMTDAGNLFSPLKRIQTASYVYLTDNQQVYTYQVTNKQTIDEHQVSVIDDVPGKKLLTLVTCDSATPDTPKRFIVQADLVKKVAAMQSTLRVFN

SEQ ID NO: 1994 - protein, 119 aa, Lactobacillus paracasei
MDRDSVRKMVQNYINKNNLSNPEFARQAKINDRTVRRLLNSEERISNSALKKLSAACVQPKFAVIGFTSGKVYFRGEHHADCTRWINTQVRTGDTLHTSRKTYLDIDEPMLIQRLSEAS

SEQ ID NO: 1995 - protein, 399 aa, Lactobacillus paracasei
MRKIIGIDVSKSTAKLSVAIDAKTVYEGDITLDMIGFTSLKAIIDSYGGAEVVFEATGVYSRRLERYLLDESITYHILNPLVAKKRLDDGSRTRKNDVRDARGLAITEFAKHPKPFKPSFYDPVYRELMDISRYYDQQTEDLKRTKNRIHRLIQLSFPGIEEELDLRKPSALHTLTLFSHPAELTGLSFENIKTQILDMHLKGVGAVRSSNLARALWRSRARSYPAVSGNSFVVQAVKHETQKALKLLSEREETVQAMVSLAERTPEYVILLSIPNIAENTAVRLVAELGDIRRFKTRAKLNSFIGLDLQEIQSGNYTAQRKITKHGNAHTRKLLYWTVINMIGSGAQPSHIRDFYAKRQATASRRKPLLVACMDRLLKTIHYLVNTNQLYSYELACSR

SEQ ID NO: 1996 - protein, 148 aa, Lactobacillus paracasei
MPELPFYLPMIEDDEESVFDSWPNGQRTHDKLSEGLRPYIQEIAVKSQTTSQIERDRYGNQRLAFYANGCDTPYYVTEDFLLTPNQTHDEKKLLVTALMLGDSKLTAVVSDQLLAQLSPKTRVFAKYQLINLPAQQFMDEHISIQVIK

SEQ ID NO: 1997 - protein, 96 aa, Lactobacillus paracasei
MIDIRNTYKPNVLEAWIKETREAGNYVSAELVQLHDDPQLGNALVLGFRFAKTPRALADEDIAFSFSHETTGPVFWRLVGVAEAYANDFNEELAFA

SEQ ID NO: 1998 - protein, 149 aa, Lactobacillus paracasei
MKKGKLYQVSIDEIEYQPHFIMVYASEDAKDKDLQRLATNFILSQNPELPESALVDSVIVEPRDPNEKPDVVAEGLHVPTPAWGVKMGLLYAQAVHHATYDDDEFDGVAYVRGETKAKRFETEAAAKAFAQWLNPNCEVVPLEEGDDHD

SEQ ID NO: 1999 - protein, 47 aa, Lactobacillus paracasei
MIDQQQAQVAWSEVIEELDSDTFNRLRHALELVDAYIRQGTEIERGL

SEQ ID NO: 2000 - protein, 84 aa, Lactobacillus paracasei
VKTAYDEVVKQPCDKLGQTMQDMTYCYNETVVPKKQYKKLLTKQLEEVVADSVAVNMVNAYYKTLAEFNKGNREGSYLLCCALN

SEQ ID NO: 2001 - protein, 212 aa, Lactobacillus paracasei
MTKFYFVRHGQTETNLARRFNGGRTDTPLTASGRDGAIAVGRFLATTGFAGIYASPMPRAQTTAELIVAQSRVVQPPIVTDRDLREVDLGKWDGQPLASVQDDPEINHYYHNLTAFDNQRIGAESFAHALKRGRRAINRIYDAHPDGKVLVVAHGLIGMLLLSTYLGADLDSARDAMRIPPNNSISELDTSDGEQFTRGSLWAFVPATAESK

SEQ ID NO: 2002 - protein, 325 aa, Lactobacillus paracasei
VVDKKDKKVLVSVKHLVQTFNAGKKDQVKAIQDISFDIYEGETLGLVGESGSGKTTTGRAIIRLYDPTSGEILYNGKDIAKLKNGSKQMLAFRRATQMIFQDPYASLNPRMKVKDIIAEGIDIHHLAKNNADRDHQVEQLLEEVGLNADHATRYPHEFSGGQRQRIGIARALAVQPKFIIADEPISALDVSIQAQVVNLLKDIQDRQGLTYLFIAHDLSMVKYISDRIAVMHYGRLVELATADEVYSHPLHPYTKSLLSAIPVPDPDVERRRVPLPYDASKVEGDNKKRKMVEVYPEHYIFAADDEVAAYKAEAEADHQGVKAAQ

SEQ ID NO: 2003 - protein, 350 aa, Lactobacillus paracasei
MSKILEVKDLQIDFATYAGPVHAIRNVNFDLNKGETLAIVGESGSGKSVTVRTVMGLLAPNAKITHGEVLFNGEDILKKSEKQLNAMRGNDVAMIFQDPMTSLDPTMTIGKQVAEPLLLHSKISKADALKEAERVLDLVGIKDAGGRLKDYPHQFSGGQRQRIVIAIAIINHPQILLADEPTTALDVTIQAQIIHLLKEIQSKIDTSIIFITHDLGVVAGIADRVAVMYAGKIVEYGTVDEIFYNAQHPYTWGLLEAMPTLETKSDRLYAIPGTPPDLLDPPKGDAFAPRNPYAMAIDLEQEPPFFKISPTHSAATWLLAPGAPKVELPPEIARRHALWASKHQDEKVVN

SEQ ID NO: 2004 - protein, 332 aa, Lactobacillus paracasei
MATSKLSPDAFKHVKVDAAEQERIATPALTFTQDAIRRLKKNKAAVISLWVLVFIAFISIISIWLSPSNPNKQSLNYANLPPKWPGIDLPGLNGYMNGQNKYAGMGKNVYFLLGTDYLGRDLLSRIMVGTRVSLFIGIVATFFDLTIGVFYGIISGWRGGMTDTLMQRVIEIISSIPNLVVVILMLLVFRPGLTSIILAIAFTGWVTMARLIRAQTLQLKDQEFVLAARTLGESSIKIAFKHLIPNLSSTIIIQTMFTIPTAIFFEAFLSYIGIGLPAPTASLGTLLSDGQKNLQVLPYQLLYPAIVIVILMLAFNLLADGLRDAFDPRSEH

SEQ ID NO: 2005 - protein, 307 aa, Lactobacillus paracasei
MVKYILKRIGFLLLTLFIVASATFFLMKLLPGTPFNNPKIPADQLLILKKQYGLDKPVWMQYLTYIVGISHGDFGMSYQFPGQTVSNLIASRIGPSLQIGAQAMVVGTLAGILLGAIAAIRKNTWVDATATIFAILGRSIPNFVFAALLQLFAFKTGAFPVALWGGFSYSILPTVALAIAPLAQTARFMRTEMVDVLSSDYIELARSKGESRWQVVAKHALRNSMIPIVTIIGPMAVDLMVGSLVVENIFAIPGIGEQFVKSITTNDYPVIMGLTILYSAMLTVVILVVDILYGFIDPRIRLSGEAN

SEQ ID NO: 2006 - protein, 540 aa, Lactobacillus paracasei
MKFRKTMVAGSALALAGVLAACGSNSSSSSKGTSITRMESDVISTMDPSTTTDAISGQALIDTMDGLYRYNGSKLENAMAKSQPTVTDGGKTYTFKLRNAKWSNGDPVTAQDFVFAWRRTVEPKTKSQYAYLYSGVKNADDITAGKKAASTLGVTAVNKTTLKVTLDHAIPYFKTMLVNPAFFPQNEKFVEKSGKKFGTTSKYILSNGPYQLKNWNGTGNTWKETKNTTYWNAKNVHIDTLNGQVVKDSQTAMNLYQSKKLDIAALQGEQAAQAKSMSDFKGLKQSATFYLELNEKKDPIFKNTKIRQAISMSIDREAYIKKVLNDASIAANNVTPEGLFEKNGQDFSKTASKAESSAVKYDPAKAKELWTEGLKEVGQSAPTLELLTDDTTNAKRSAEYFQSTLQQNLPGLKVTIATVPFKTRLSRSQNGQFDMVISAWSADFPDAISFLDLFTSDNSYNDGKWSNAEYDALIKQSKTTDATNAIARWNTLLKAQELLTKEQGVVPLYQRVQTTLQRKTITGLNYNPTNSYNFVNAKVK

SEQ ID NO: 2007 - protein, 476 aa, Lactobacillus paracasei
MVMTMPRAQRIKILIVLGMMSLLTALSGSSTNLAMPKISADLMISSSAATWIVSIGLITTSVLLVMFGHIGDLVSKNLVFLIGEMVFIVGSLLTGIAPTYLTILAGRVIQAVGSAMIMANSTGIVSQYFPDANRAEALAVISMFVSVGSISGPAFGGILITWASWRWIYLFNVPVGLLIVFAGMRLLPLRRPATGEIKQVWGNANWTGQNLFTGGMILTFASGYWLQQPTQHLLGFLILAGGAILTLLAFIQDQRAKSPWIAPALMHNPDYLISVSVLLIVMLVNSVSNILLPFYLQSYGGISAFESGLLMMLQSVVMLMITPFAGWLADHWNRYYLTILGLLVLIVSQVGYAFYPAKLSMAPIIWPIVLNGAGMALFLSPNNALTMGAVDASVSGVAGSLNSLARTIGMTIGISFGATLLFAQLPGVTRISPQSGAPFLHALAFVFWLATIVSVVGLIIVIFRTIRSRRTKASVQ

SEQ ID NO: 2008 - protein, 187 aa, Lactobacillus paracasei
MTEAIDLKSGMVFVKDGKLIKVLESNHHKPGKGNTVMQMKFYDIRSGANVTTTMRPSEKVEIAIMDRKKATYLYTQDDTAYFMDSDSYEQYELPTSSIEHELKFMLPNVPVEIEFYGDEVIGLELPGSVELKVTETQPAVKGGTVAGGGKPATLETGLVVTVPDFVKDGETIIVTTDTGTYKGRAQK

SEQ ID NO: 2009 - protein, 235 aa, Lactobacillus paracasei
MSDHTNREDFLNAIAEKAGRPRHQLKDHPFEPLNDLPETTLSGHSQDELETIAKKNSEGVHVTFKTTTKADLASALNAYIEQDAPKTMILPTTDKYADFGLTEWTNTVSPKPMYWTPGKGRDFNLKQAAAADVAIGFADYLLAESGTITVATTPGQGRGFHFLPTHYLAIIKKSNILPRSRQAMDHYDADIKAGKLQTSNINFITGPSNSGDIEMTLVVGVHGPLDMTYLVVEDM

SEQ ID NO: 2010 - protein, 494 aa, Lactobacillus paracasei
MSIVTSDKPFLERVKESEQDKFMQASVAKAQDAQWDKREASRHELGNWPQWRDLGEQIRQHVIKYLPDYLEEFSDNVEKRGGHVYFAKTDKEAAAYITNLAKKKQAKKIVKSKSMVTTEINLDKDLLKIPGTQLMETDLAEFILQEDDWAEPTHIVFPALAKNRDQVKTIFDKLGYKGDNDPEHLARFAREYLRRYFLQADFGITGCNFAIADSGLINLVTNEGNADLTMAIPKTQVVVMGMERIVPSLKEAETLDNMLSRSAVGQKLTSYCSFSGKQVDGEADGPEDFHVVIVDNGRSNALGTPFEPVLQCIRCGACLNVCPVYRHIGGHGYGSIYPGPIGAVLSPVLDGYEKFGDLPFASSLCAACTETCPVRIPLHELLIKHREVMMDKLKMDHSFNDKIMKMVGVGTSAPVLFNMALDMDHAMMGVLATKDQGSVENEYNSGRIKQTKMLPKLARGWTDVRDLPRPPKKNENFRHWFKEHKAALEAQKHE

SEQ ID NO: 2011 - protein, 260 aa, Lactobacillus paracasei
MKVVIFSTCIVDLFFPNVGAAMVEVLERFGCETFMPVKQICCGQPTYNSGYVKATQKVFRNEIDALLSVDADYIVGPAGSCVNMLREYRVLLKDDPEYAEKAKEVADKTFEFSQFLYRVLNVIDAGAELDAKATYHRSCHMTRLLGERTAPFVLLDHVKDLQMEPLPHIENCCGFGGMFSAKEPEISKQMVDEKVDDVLSTGAKVLISADPACLMNISGRFSRRQEKIKIMHIAEVLNHNVDPKRIKFHDPLPVEQEVRL

SEQ ID NO: 2012 - protein, 188 aa, Lactobacillus paracasei
MRKRYRATLQALNDDCIGRKAHGFANLEVTDDDALQIRIEMFNTPADMTHMAVLEGSVTKAPVAVATAAQDVNHDGVVDEEEAEKVSGKVFVPLDNAPEKLNLIGGKYPEADDNGFYIYQQRVVMSDLREQLLKRYGTDVFNLDNAVMYVDGVQSDVLLPKTVMSDLDKEKPYLTLPIAVGKLRKVMG

SEQ ID NO: 2013 - protein, 111 aa, Lactobacillus paracasei
MTQVNEQTIMGLIIAGGNAKSAAFTAIQAAKAGDFPEATVQLKEADDALVSAHNAQTELLTAEASGDHAEVSLLMVHAQDHLMNAITFRDLAGEVVAVYQRMAEMTTAPTV

SEQ ID NO: 2014 - protein, 292 aa, Lactobacillus paracasei
MGQIGISLYPEQTTVAKATAYLEMAHQLGYRRLFTSLLQLSGEKGRDQLAIFKAVVAKATQLGFKTIVDIAPPLFSELEIDYHDLSFFHELGVWGLRLDEGFTGQEEALMTHNQYGLKIEINMSAGTNYVDAIMPFGPRLDNLLGCHNFYPQQYTGLGDERFVAYSQKFRHYGIRTAAFVTAPSADHGPWPISEGLPTLESDRDRAIASQVHHLRLTEVIDDVLIGNAMASEADLHAAALAFFCPYPALRVHPTAAISELETKIAFSEAHLYRGDASDYLVRDTQPRIRYAG

SEQ ID NO: 2015 - protein, 136 aa, Lactobacillus paracasei
MKITMNLPVEPAVFFKQLQLSALADIRTHTGREPLPGSLRGFSYAKKWPNGRQARLQITDMEPNKVYAYTLATPQDDFRVSYRLVPLASEKSRLEYEESLVAKTARGTANNRVSGLLMGWFRKRRFKKMALKMCQS

SEQ ID NO: 2016 - protein, 68 aa, Lactobacillus paracasei
LKNVTANLILLNLSMAIVMFSPLLPAPWQIVGCGIGIGLTIVFVRRYVQLIKAQKQEGRDEDHHESAG

SEQ ID NO: 2017 - protein, 474 aa, Lactobacillus paracasei
MNAFIGWLNRHVVPIAAKIGSIRWLVALRDAFIAIMPAMMAGAVSTVLNVLIRDIPTQFKWMGIVDSMQWLIGINAMVWTGTLAILGLLFAFTFGYQLAVQYQVEPVTGGIVVLGAFIMSLPQNFTVALSSALGKGATKLITDAGGVVDGKNISMWGYFNFGKFFGSYGFFTVMIMGGIAMTLYIWLMKKNVTIKMPEAVPPAIAKAFTGIIPATAALYLAGVINYLISLNKTTVIEFIATLIQEPLLNMSQGFWAVLLMTLLVQIFWFFGLHGTNVLGPVLDSIWLTAQIANMNAFMKGEALPFVWTRNAFDLYAWIGGAGSTLLLLIAILLFSKRDDQRTVAKLSIAPGCFNVNEPVMFGLPIVLDPIYFIPFILAPVVMVSIAYGAHILGWVSPVKNQIVWSMPPFVNSLIATMDWRAPILQAVNMVIGFLIYVPFVKAANKLDPELTVDEPVMKKEKRLKETGKLEGDAV

SEQ ID NO: 2018 - protein, 740 aa, Lactobacillus paracasei
MANIEYDPERQLFHLHNNTFSYVIQVIRGYLVKRYCGPALDHFSGTAKLEDFSHAFNIQNDAAPYSLTTLPLEYSTLMGGDYRTPAYAVRNGHGQLIGNLKFDHYQILAGNESFNGTLPTARTPHGQTLIITMHDETQTLAVRLKYTIVGDLPVLLKQVEYRNLTDTTLTITHAASLQLDFDDHAYDLITLTGAHLNEAKVTRQPLTPGKKSIGSNYGASGPQGVPATILAAPATNEFAGEALGVTLLWSGNFNYTAQVDQFDNSRLVMGLNPELFAWQLKPGKPFVTPEAAVAYTNDGLNDLSRIFHRFFADHVMPLPRKNLIEYNTWETTYFDVSEAKILAEIPKAEELGVELLVIDDGWFKNRPNDAGQLGDWVPDPVKFPHGLRPVADAIHARGLAFGLWVEPEMISENSELYATHPDWAMQYVGQKPLRSRNQLILDLSQRIVQDHLITVLTNLVRDNHIDYLKWDYNRHFSQPGSPVLPPDQQGEVGYRYTRGLYRVLKTLRDTFPKLLIENCSSGGGRLDGGMIAYTDQTWTSDFTDPVYRMKIMNGFSLFFPLKIFVSHFTASPNLQDARLTPLHTRALLSLVGITGIECPPSQLSPAEAAAVKASFAFYKANRKELQNGLLFRLRPSHVNQDEVCWLITNAAKTKALVLTSVGVTSPIPHYQHVLLHYLDPRLSYQIDNTKNATGLELNHAGVTLPLAHGDFSATLMELTAVTNLPQPTAAPTLDQIATQS

SEQ ID NO: 2019 - protein, 247 aa, Lactobacillus paracasei
MKFIIAPAKKMIRAQDDFSVQSQPKYRAQAGELLLLMQQLTFSEAQALWHTSDKLTQTAYNQLQQCDLTRRQSPAIFSYSGIQYQYMAPDLLDDAGLVYIQQHLRILSGLYGILRPFDGVVPYRLEMQNHLPLPHHRNLYDFWGNRLYQALARMPGPIINLASDEYAKAIRPYLQAKDQFIDVRFAHRVNGQLKTRATYAKMARGEMIRFAASHRLTKAADLKHFDSPTYRFNAHLSTATQLVFIAK

SEQ ID NO: 2020 - protein, 248 aa, Lactobacillus paracasei
METSNNFVCENSELTHGYRLKNHHYQCRYCPVTFAADEVYPQDGHFFTAEAMIRQHVAQVHHGALAALVAQPAGQLGVSSSQQTVLQLFAQGLSDTVIAQRLKVSPSTIRNYRFKFREKAQQAQQFLAAMTLLAMPDALIIPHDGAKMVDDRYAITPEERTKTLKSFMDADGRVTNWPSKEKRKLIILSEIFKGFDPQKNYSETAVNEILKQHVEDYVTVRRNLIEYGFLDRTADGRTYWVKASGPRI

SEQ ID NO: 2021 - protein, 860 aa, Lactobacillus paracasei
MANQEQVYENVDLQVIKLLFNSDNGDYKVYAVRILNPNPALKMTLTQEATITGDMGYYNRRAIITADLVYDDAGSLRYNKPSYKLARLHFGLPKEPRRQWQLIDTLLVHQPTVRRRLHEHFADDTPILTIFSTDQVKPDSVPGIGPATIKKIATAIRGKLEIAVLANHWGKALSSMTYEKIWLAYKDANLAMQSIDANPYLLMSVAQLDFKKVDTFAKTRGIAANDPHRLTAGLQYIFRTAVLTQGLTYITITWFRQQAATLLAVREADLKMFANPQEALQYGFLLNEQYGLVTSCDMFATEGSVARIIKVAQKTAEPLMAPDELDDALDQFLDRFHLTINDQQRAAFQNVNRHGLSVLNGSAGTGKTWLTDLLVRFFNAQAKGKSVLLAPTGRAAKVLAKYTHEPAATIHAYLHLLPGEETGQFDADADWETFGDARLIVVDESSMLTTPLAYTVLKNVNFKKAHVLFVGDVFQLPPIGPGNFLKDCLDDEQVAATTLTRVYRQDSQSGVLALANRIRERLALPFGPDDDRYVSGNVALYNQRNAGRVFDAGVKAYQDALVKSGQQIDAQLLIVNKNIGATGRLRFNAELQALVNPAKNGEPEYISSYVDPVTNQKHHLRLNDRVMILKNDKHVPLVDPKTWERRAVLGENGLQQTDDFGTKRWRETIVANGDTGVVAHIDTKRHFVVVQIGKQYCYYSFGSVPRDLTLAYAITVHKAQGGQADTVIAIVNGADMMLNAQSFYTALTRTQQQFIFFGDFRVLLARTKIYPIDARHDLLGSFLSGQLTVDTFSRYTFDQVLAWLDKRHAERLSTRPALEAEEVIPSEQPFAVRYAEQLDILDQIVDEVAQLPARKPARDV

SEQ ID NO: 2022 - protein, 196 aa, Lactobacillus paracasei
MADTHATSSEAQHIIKLPNGGTAEGIMLHRGMANLQHEVDSADFAPQTKVYLAWLNDLNGNRFGLKITDAADKTLLRHTQFLDDAVKELAYADAPANAELTPDDFNPARKFYLPSAGLVALLAAIQWSVKHGREDVVVYSTHRPELQFYQARQQPTFIQQWAQHELQAVPEDFRFRIAPKLDKAATHETTKLRMQL

SEQ ID NO: 2023 - protein, 201 aa, Lactobacillus paracasei
MSKKLWLSGVAFAGLVVGSIATGSSLVAADNTVGTTNTTVAVTGGTIDLAVPDTLTFPSEPVEGIVRGNVNETVNSADNSLLTINDFRGTDAGYTVSAKASAITAANGDVLPGAAIELTPDAPAVTNADAPTWSKAVTLTDSDQPLFATTKSLNGAGISSYDLNKTTLAIPEDNAVKAESYSGVITFTLTPGQPAAPATAQ

SEQ ID NO: 2024 - protein, 270 aa, Lactobacillus paracasei
VKVIAIGDNVVDLYPADKQMYLGGHAANTAVFATELGLQAAYIGTFGNDARGDFARRMLVERGVDVQRSLQYAGRNAFTTITGKDGARRKVVGEPPQELRLDPEDIAYINSFDLVYLNSESHANAFLQAITARKVYDFSILDDDKLFKKIAPQIDLAYLSGKARSDDDVEALMRRVAAAGCDRIVCSRGLRGSAALVDGMMSWQQALGVKAVDSLGAGDAYITSFAETLYSSSKPTLDAKVSESLSHAAKFASAQVLLPGSFGHGAPLLS

SEQ ID NO: 2025 - protein, 206 aa, Lactobacillus paracasei
MSIGLGGGSIVRQQQDGSVTVGPDSVGYKITDEALTFGGNIITATDIAVRLGLSDVGDPQLTKQISLKFAQAALQTISDMIAVAIDKMKTSAEPATVILVGAGAIIAPHRLEGVGKLVRDPLGGVANAIGASISQVSGEYGRIYPYNQIPRDKAMADAKEKATAAAIESGADETTIEVVEVDEVPLAYHPENANRVKIKVVGNLTK

SEQ ID NO: 2026 - protein, 59 aa, Lactobacillus paracasei
MTKQAETHRVMFTLTDQAIAKLDQLVAKKQQEVNQNPDLAKYHVRVTKSNIVEDWLSKQ

SEQ ID NO: 2027 - protein, 279 aa, Lactobacillus paracasei
MRIIKKRLADNVLDISDSSLTCYLRGQNANLRAILNYPAIIICPGGGYTQLSDRESEIIALSFLAKGYHSFVLNYSLVSDSYLYPKPLVEMAKVFQFINENAEKYHINLDKIATIGFSAGGHVVSWYNSLPDDWITQYTNVSVIKPTKQILCYPLIDFSLTNGFPKGQISNILGTCLPGATQKMVSKKTPPTFIWTTNTDELVPSKNTTEYILALQKYSVDYEAHVFGWGPHGLSLSNEQTNYLPTDSKHSNRCFVNIHDSAWFPLAVEWLERKNYDIK

SEQ ID NO: 2028 - protein, 143 aa, Lactobacillus paracasei
MIKYVIASHSGFSLGLKSTLNFLTNNLKKIIAISAYDDNEKTDLNFSDISTLLNGIDKSDKIVFMTDINSGSVSQKIAQLVMENSNVYLISGINVPLGLSILLLDEEYLNEKSLLSLLSDKEALPKLITREYLLEHNNDSQDE

SEQ ID NO: 2029 - protein, 269 aa, Lactobacillus paracasei
MNENKTVLTKKDLRKSAWRWIRVGISSFNYQTQLAPSVAYALLPSLKKIYGDDKDALKRSLDNHYKYFNTNPWLAPILFGATLAMEDKDKADSLDEVQSTKVGLMGPLAGIGDTIIWAMIPTIFGSVGASMAKQGNPFGIYLWILFNICILFLRSRMFEFGYKQGMHFLTAYGDKLTAFTDAISVLGLTVIGALIPSTISFKTALSMTNAGVTLKFQSILNQILPSMLPVLLVGVFYWLIKKLNWKMANVIWLTILIAMVAAFFHILTV

SEQ ID NO: 2030 - protein, 268 aa, Lactobacillus paracasei
MQIQVWQIILITIIAYLKHFDFNSIQLFPFNSMVWGLLTGLIMGDLKTGIVIGATVQLMSLGVIAVGGASVPDYPVTAIITTAIAISTGKGMGAGIAIGLPVGMLGVQLDVIWKLFNGWTAVKSQAYADSGNYRGMQIMTLTSTYTAGFVSALPVFLSLFFGPQLVKLVLNFMPSWFSSGLQLTGAMLPAVGIAMLLIYMPTSAMFEYLLAGFVMSSYLKMPIIGVSLIGAALMIHVFRKKIKANNRDHETPISKSNDSSEIGADEDE

SEQ ID NO: 2031 - protein, 163 aa, Lactobacillus paracasei
MSIVSLRIDNRLLHGIVATQWAPLITPSRIMVIDNEVADDAMLKNSMRLGKPAGMALSIINESVALDHFSKHMYDSQKVFVIVRHPQIILNMLNSGLEIPSITLGGTVSPDDLNSAIKISSRAYITQAELPIYEAILESGTPIFSQYVPSDKSIDVSTVIKES

SEQ ID NO: 2032 - protein, 222 aa, Lactobacillus paracasei
VKETSKLNDFYTSDVNLLKLKKQMSYYGSHFEIPYSKQSVYAYYREFKGDSDENLKKINYFAGKLNPIYVFDLFKDKGQTNLCSVINQMRFHDILIVNSFDQLANSLPDLLSVVKGILNKDAILIITDFGRISCDSEGDRFIYNLEALTKSSKRMRSNSIKEGKSQKINSKIGRPKRVIDDRYYSIYKMMKKQRMSYQKASQVFNISKSTLYRIKKQIEDVD

SEQ ID NO: 2033 - protein, 37 aa, Lactobacillus paracasei
MVNSHWLQLARTLVIMIEKPFKAIFRDGFSNLSVAIK

SEQ ID NO: 2034 - protein, 173 aa, Lactobacillus paracasei
MSKTVKELADELGVSRQRVQQIISKQVASKRPKKVAGQYLISPADESLIEEKIVGTHHAKVQANSKQLSDKLQASLQEEVATLKEQIHTKDRQIQAKDNQLEKMQKLLDQSQQLQLMAENKLKKLEAPHNKPESSSDSESDQTQKREPEKPGVAENSPERSSSFWSRLFGTYK

SEQ ID NO: 2035 - protein, 29 aa, Lactobacillus paracasei
MSPFDIAIIAPLLVGVFLLLVEDKLNNRK

SEQ ID NO: 2036 - protein, 259 aa, Lactobacillus paracasei
MIDVRKLIWSSDRDFNQEEIHDKRYFLVAEHNDLITKARHDLNARELKIMDYVIARIKPDDDHFNLINTSMYELTKVLGLKRSGNAYSQLAGSLNAMRKKDVFIYNKQEKRLTMTGWFEVVDVWENGQVQLKINKQFAPFLLKLKDNGYYTQYLLADTVQLKSKYAILLYKLMREADKDHGQTISIVQGTPNEFKTWLGAPKSYTYGRLKDKILKPAIDEINLKINDLDLNLFQARRGRQVVQVEIHNNFLRRHPRTDQ

SEQ ID NO: 2037 - protein, 148 aa, Lactobacillus paracasei
MNNWTELLVSLAVAAVPIIGAWISKQLLANKQALTLVKVLGPLANAAVTAAEQLGVTKAIDGAVKKSTAIQAVKDGLKSLGFTSTDGQTIANAVEKAYADLKDSLAETYPQKTVDQEASNQDKVAAAAQAAAEAVKAQLAPSSVAPQQ

SEQ ID NO: 2038 - protein, 69 aa, Lactobacillus paracasei
VTATITKIIVDSTPYIATIISTLIAYLTYHEGKRKNRHDELEDMNDRLRADNDRLRRENERLRKENNHE

SEQ ID NO: 2039 - protein, 128 aa, Lactobacillus paracasei
MLNKIRDHPTHTALTIGMVAIGLFLIINDHYFIWPPHYSDWLNDDIVGFLFVIDGFGIGGWVLWETQLAVTNRLLLTTTSFLMSFLTILQFLTSISTGIYSSWISNAIITAFVLILARRSDSRDSNDN

SEQ ID NO: 2040 - protein, 733 aa, Lactobacillus paracasei
MAIRTYKVTLDTKNAIAPEPVLLRQGDKTGAVVIDATLLDNGSPVQLGGLSLSFKANTADGKAFIDDSSGFGIVSAADGEFTYQVPSQLGQVPGKIELAYFSLSDANGLESTFNVVFAVSPAADMTQDSAKDWLSNLDDIINQYNQWVNDAHSSWEEFVNTNKEIIESIDPGGTLLTEVINARTPSGANAYPALGDRLDAGVDARSKNAKAFGVKGDGSTDDLAAINNMIVNAADGDTLFFPSGNYALSNSIVISKKINLAGVKPIYDSGDLTEGTVLRGGGIYFKTGSSGSKVSGIGVVTGANIANGFDIHGTIDSITIENCLTIARDHGYLIESYNGLVQNVKVLNCEAHDGIHGFISKASRTTFENCLASGLQYWGYGTITDNILAADEVGAAIDNKVINCRAVNCGVGFSTYKRNYFGTGEDAVPCFGNQYVGCSAESCTNSLLVGDTPGSTGNSKYVTYPVDNMAVSAFTELDPSGSTRFLFSRNLNINGISLGIKADISNDDSHNNIGLTVSGVSGAKLGTWYDLQKLALGDSPSINYGQTFITQNTSSTAITNIVGFIDGQTYTILIYDKYTRINNSSIIRLQGPPLSGIGNSIVFRAQDGLLFEINRKKFAMPGIQVRYTASSGFDLGPQNFVELIANSSENLSNLIKVNNPDACDALITIFVRSTSGSIQPAGFDPSQFVIPSGNQLITFSSALNFGVGLMSQWAYVSAIGKYVLISCQLQPYV

SEQ ID NO: 2041 - protein, 696 aa, Lactobacillus paracasei
LITFTDVENNEYQAQCEIEKTDAVNGEKSLSGTIYFGQDVKANIAKGWTLSFLDEDYVVVTYKKNDKENTVAFSAVQALFYKMSKTGFYETWNGSHPFATYLDALFTGTGYTYDNTASVAAFEKQDWGMGDRLSLFNDIIDQASVEFYVEGTVVHIVPAMGSDLSTIVRKKFNLDTAEIQTDNTSFATYGRGYGAYSKPDDTTSPRLEVEYKSPLYDYYYPKFGAIEASPVADERYTIADNLLAAVKKKVDKSWNISLTLNLVDLQSVGYKYAMANPGDYITVIDENLNFSDKVRIIKVTSDYDISGTRTKTEVECGSLSFAEQQKTSQSTLSNVAAGKILVPNEWLTSQVQLATNSLLAARTQLSFTDQGIIAVDKSDSNKVVILNSSGLGVSTDGGQTFKSAVTADGVVAERIVGNLISGVAFKTASTNGFGMELHNGEIKFSKDDFEFGTLTATTDGATGQPNGFAIWNQPGSIFSINQGGSTGGSLPVFQLPATATAENRQYNLYGSLMSPLVSEQPGGMWIYHDSKFNVSADGGHNAQFQVTVGKTSVWGDFYVYSGSKNAAQVTRDGIRATPAYELAENYVGDIGEGKTGEDKTVRVDIDPLVFDLINTDKPYQVFLTAYSDAHFWVSERGKDYFVVSSDSPDSAFGWELKGKRRGFEDQRLVDTKDTYEDLEKMEGLIPNGNKNVQSNS

SEQ ID NO: 2042 - protein, 272 aa, Lactobacillus paracasei
MDLLVEKLDGSRYYLSQYKVLITEFEESAPSVTRNNMQLDQRNGNIDFGGWHTDKTINVTGYYRAGDIDEEEIIREKLYALLSDPDGYYITQLKTTPSVAMERPGETSGGYYDKRKDYPSHKRFLVYTEAPEMELVGNVNGTLLYKLTAEFKTMKLPYGETPPKDIDVISNVPYRGTVPCNQLEQGFTVQLTATGYASSLSLKIDYTELTSSNPVAAGDVLLLNGFSYTQNGLSIVSKTNKAYFVLQPDKPNRITCNVLGKVRIIGFQNLYA

SEQ ID NO: 2043 - protein, 915 aa, Lactobacillus paracasei
MANVVASFTADIGGYQSAMKQLKGETASATDSASSSVLGGGKSFLKMGALAGIGAGVVTKALQTMGSMTTSIVSRFDTLNNANRTFKNMGFATTDTKKAMSGLNDSIMGLPTSLDQAVQGMELMAASTGDVQKGQKVFSAVNDAVLGFGGSSAQASSAVQQLSQDLSSGTITAATWNSMINDGMGPALKALAKSMGMTSGQLKDALSNGKVSADQFSEALINMDKNGGGGMQSLHKIALDSTAGISSSFANLKTAVVRGSANMLTVVDNFIKSVTGTNISGWIKQAASAVTAGMAIASQAIKSFTPVAKSIFNTLKSIVAWVGQNKDWLLPLVASVSAFKSVITVVGIAKNAFSAFGNALEVGGLLARIVSGSKDAAAGLSLMAQNSKLAAAAQKVLQAVSAANPWVLLVAAIAAVVAGLAYFFTKTKTGQKIWSEFVSGLKDLWNGLASFFSGLWSGITQTFNSAAKGVQNGWNSVTTFFSNLWTGIVNGATSAWNGLTSFLSGIWNGIVNIATSVWGGISSFFSGLWNGIVSVATNIWNTFGPALTSIWNGIVNIAKGVWNLLKSVIMGPILIILDFISGGWNNLSSDLQLIWNNIVSAAGQIWTGLVQFFSGIWNGIVTYAQTAWNLFTSVIEAVWNGIVSGASAIWSALGSFFSGLWNGIVSTAESIWNSIVSFLSGLWNGTVSTAKNIWNALPGFFSGLWNGITSFFSSAWNNIKSTVINAATNIVNGARNIWNGFTNIVSNVVNGIKNGFNALMHFNLLDAGRAIMDSFFSGLKAAWSKVQDFVGGIASWIRKHKGPISYDAKLLIPAGNAIMGGLNQGLQKSFGAVQKTVSGMASDISDNMSANISNLSNTGAQFSSGDVTQSIDASERITPNIYVQNNVDKNGINSMVKEADANDAAVSSYFRPIGG

SEQ ID NO: 2044 - protein, 77 aa, Lactobacillus paracasei
LEGSFLRDVDMRRDLMELAVNIANVQNAKNPKRSVKTGYKNIDKAEQKIINRNGNGTVRKPDVEMIRKLNAAFGGGS

SEQ ID NO: 2045 - protein, 143 aa, Lactobacillus paracasei
MLEIQVKNEKVELKFNFKALFRANKLFSSQPNANDGASSIWLGFVTGDVTALFNAIKAMLPEKYTDADIISAIDEQPDPDAFYDEVVEELHKSAFFRREMKQWLKLNEKYGISLMEKKDMTAEEKGKKALLKDTLEEVKKSLS

SEQ ID NO: 2046 - protein, 209 aa, Lactobacillus paracasei
MAIPVNNGIEFVKDTPYRGKDVWYFIQSTDPKVAPIGSPAILPAHQESGDTSIEGDSLDEQTKMGRIIAASTNEDSIELTTYMVPGDKAYEIIIDAKHEGRQVKVWRVIVDERLAVVEGDHKAYPAMFGYGVVDSADISDEDSFSEIDFTLNIIGKLADKNEDGTPGTFPLSDEQVAMLDQLYAFERPGEKAGEFADGSVTTTTTTSHA

SEQ ID NO: 2047 - protein, 121 aa, Lactobacillus paracasei
MTLSQWYEDVQIQLTADGLNPVFIQPDAKSTLPLVFVNVHVDADMSSKTGTLSSVGQQIDIYDSIDTPPAEWEGFVRKVKWSLSKVARWQSLTASNSIDTSMGDSTPLRRCMLLITLEGDY

SEQ ID NO: 2048 - protein, 124 aa, Lactobacillus paracasei
MAEINVKWSGLDKLMEELGATAEATIDAAASAMKTTTGQVQAKAKQIAPKRTGVMAGNINVKPVKKTSTSVTGTIEAEKDYSSFVEFGTYKMHAEPFMRPAVDWGQSIFIKATMDKLKEAATFK

SEQ ID NO: 2049 - protein, 98 aa, Lactobacillus paracasei
MRYNNRITLIRKSPPADPLHDRPTETRETVTCLTIPITSAQELSVYGLVNTMAYEIHVKNPALPVNEIELDGVKWTINKTFVNRKSTVFIVSGGAANG

SEQ ID NO: 2050 - protein, 119 aa, Lactobacillus paracasei
MADSDTNTDVLKSVKLRIGLTDTLQDDLLNDLISDVNARVLAYINQDGVVNQTVPDAVTWVIKDVVVKMYNRIGDEGKQSGTEGNVSNTWETIDLSKYADGLDVYRESSQSRRPGMRFV

SEQ ID NO: 2051 - protein, 292 aa, Lactobacillus paracasei
MKLILCQPAIERFEWELEVCLTNLQSVGFDMRDVVLLFTVHDSKVTETLASKYGVEVHTYTDKRSDKQYIPSVKPWLWWQYLAEDPEREDEDYFYFDSDVIFRKRPDFRKLKSRPDRWLCSNTLSYISVDYIKQCEHGEEILKRMADIVGVTLASLETINRNSGGAQWIISHPSAEYWRKVYADSNRLWQYLQTVDSNIQKWTAEMWSQLWNMMYFNIGPFISDELDFCWATDPVKRWNETKIMHNAGVTVNDKRLFFKGKYVNHTPFEDDLSFVDKSKCSYKYVQAVKAVK

SEQ ID NO: 2052 - protein, 305 aa, Lactobacillus paracasei
MATENNNLPVRLYQKQFIAMMQTVFGVQSTFTPTFGDLQALDGIQNNAIAFSVKANDVPVAVGNYNTNPNVAFGSGTSNSNRFGPMKEIVYSDIDVPYDFNWSFNEGIDQFTVNTDLNSAVADRLNLQAQAKTRLFNGKLGAYLVDRAAADLGDVNDVNKVFEAASERYTDLEVVVPVRAYVTAEVYNAIIDHQLVTSYKGSAVNIDENGIVRFRDIVVTKTPTRYMAGKAIIFSPDNIGRAFTGINVVRTIQSENFAGVALQGAGKAGQWISDDNRQAIFTAGTSATTTTSTVAPSTTTTTSHA

SEQ ID NO: 2053 - protein, 183 aa, Lactobacillus paracasei
MAEEAQTQEETESTQTTETTTQAPTTYTQAQLDSEADKRAAKALETAKAKWQAEQAKALEDAKSEGARLAKMTEDEKAKELEKQRQAELDKREAELNQRELSTSTKSLLVDKGLPTDFAGSLVALGDADKIKTAVENIQKTIQETVNKQVEAKLQTDPPKNGASALDGADDPFKKIMSQYKKK

SEQ ID NO: 2054 - protein, 113 aa, Lactobacillus paracasei
MENFKVDVLGIEYKVLVNQNRKDYPLLEEADGFTDFTTKKIIIEELKKGPRNWEDMDTYFRQVLRHEIVHAFLHESGLDSNTDWARNEEIVDWIAIQFPKLKKAFKEAKDEIS

SEQ ID NO: 2055 - protein, 236 aa, Lactobacillus paracasei
MAFWYAFNEKHEDYTHADDSRYYDPELKEQLDRDAQSAGVKQKSVANNDELLSYAAYVYATAVAIKVAAYIGTNLGHLANQTAKLGSSIYGKHIKADLSVINKMFDGATWSDRIWSNQDALRNDLAKMMKNALLTHSNPITQSPALRKKFGVMKYQSDRIIRTESDRVMAHQSIVNAREAGYKKVVWVINSGACDICRQHSGEVYTLKQAEGMIPAHPNCLCSWAAYDTGDEVDDD

SEQ ID NO: 2056 - protein, 506 aa, Lactobacillus paracasei
MMDPFEESNLLYQEDITNLTPDRIMKFIFHHHEYQLPRLKKLDRYYKGKNEGILTPDSRRIETGKSDHRAVHSFGKYIADFQTAYSVGNPVNVKLDEDDKRLDQITRVNDLDALNYDLFLDMTRYGRAYEYVYYGSDSIEHCIRLDPLDTFVIYSLDVDPQPIMAVRYHSVELVDDNNKTIIDIIPETWTATEHDVYKPTTVGGAMYLNHSEIIRAFPVVEYDNNRFRTGDFEHVISLIDLYDSAQSDTANYMTDLNDALLVITGDIDALFNGSTLLSGVDPNDPEAMKTLAKDKLELIKEQKDANMLLLKSRMTANGQQTSIDAKYINKEYDVSGTEAYKKRVADDIHKFSHTPDLTDSNFAANVSGVAMKYKLLGTVELAAIKRRMFEKSLYQRYSIIYALDQSVSGGMKTDPNTIQFTFRDNLPTDDITQITDLVAAGATLPQEYLYRFAPGVTDPQEITDMIAKQRADSEYSEDLTNNDEDTEGTNQGVRGQTRQATPPDSK

SEQ ID NO: 2057 - protein, 431 aa, Lactobacillus paracasei
MSDITIDIPKIVSPAYYPMFTSHARYLSYKGSRGSGKSVATARKVIVDILAHSYVNWLVIRQYFGTHKDSTFAALKKAASDLGVYDLFKFTVSPLEATYKPTGQKIFFRGMDDALKITSITTDVGVICREWIEEAYELKSKSAFETVEESLRGILPDPQGFYQTVITFNPWSDRSWLKSEFFDEDTRRPHTRSFTTTYTDNPWLNDDYIASLKDMIKRNPNRARVAVYGDWGIAEGLVFDGLFEQRDFSMEDIAALPKAVGLDFGFKHDPTAGEFMAIDQQNRVVYIYDEFYQQGMLTQQIAEAIGQHKGYGLQITADSAEQRLISELSGVYGVPNIIGAGKGKDSVSQGIQYMQSYHFVVHPRVKGLLEEFNTYVYSKDKFDNWTNTPVDANNHAIDALRYAMEPFMFRTAGHYMSNQERIQTIKNLGLG

SEQ ID NO: 2058 - protein, 196 aa, Lactobacillus paracasei
VMKLSPKQRAFADNFIKSGNKYQSAINAGYSKSYARSHAEKLSENVGIKAYIAKRLEELKSAAVADQQEVLEFLTRLVRRQEMEQVVVTLKKPVSIPMHDKEGKTYSKFAYEDVDDVVDVKTKNSDALKAADILSKLQGMGDNANNTLTENQSRKASAEADIMEAKAKREANGDGADNVNVNIVMPDSNEEQKDNE

SEQ ID NO: 2059 - protein, 45 aa, Lactobacillus paracasei
MAQMVMTKFGYMSKAEASIIGKIAKEEALKKAKEDKKKRGRCGDM

SEQ ID NO: 2060 - protein, 382 aa, Lactobacillus paracasei
MQWTDEQISGIRKLASEGFTRRETADKLGISYDALQGKARRLGIEFQKPLKNEYDSDGTQSSETILKVVRGHKMTPREVLEAHGYDYTKWELVRATSNFWKQTPEATLYQSKIQIRPLVEAEQYESLMNDIITHKEPYQAKAPIFVESDRYLVIPAFDTHFNGDTLDVYAESLKRQLEIIERGHYAKILLILGGDLAHVDNINSTTAKGTQLETTDLGETVNEMEQYFETLIEAIIKNANECEVMYCAGNHDPSVGYMFARLLKRAYSNQTNITWDISLKHYKGTKLGHNFIGATHGDKGKNNYLAKYLDEFGFMLGTAQNRELFTGHLHSEMSKDLGGFVQRQVSTRKPTDKWTNDIGVVAHKTFELVEYSDHDTRAIYYV

SEQ ID NO: 2061 - protein, 142 aa, Lactobacillus paracasei
MSTYEKHVNGTVSELLAEAFFVSKGHIVSKPINDFNEYDLIIDCEDGLKRVQVKTVYWDNTKMRNMVSCVTSHIRGNNQRYNKKYNARSFDILCAVHKDTKTFYLIPFEDIKGRRSITFYPEGKPKTVNSRYVDFESYRETL

SEQ ID NO: 2062 - protein, 142 aa, Lactobacillus paracasei
MELLSISDEKDREAVEDILNKYRAERGFIKAPVNPKITSAWGDGTSASTVQRPLYAQQRLERQASARKFCDWCDNCIASMPKQSHQRLLRVRYCDGPETDTPDGDAMNILDISSATYTRRKKNALLAAAWYFGVTPRKSSEQ

SEQ ID NO: 2063 - protein, 89 aa, Lactobacillus paracasei
MNIHEQFKGGFTRGSGIRTEEILHDDRVTNEHVLQFLMYDANLYPCPNLSTWKPKARQGVIDFVKERVSKVNADVWVDDVQIKTYEAEK

SEQ ID NO: 2064 - protein, 118 aa, Lactobacillus paracasei
MSNETKQDVFEAVWNRLAGYQVFFNGWPREAIDEYKKRYDAALPDDLPVIPQAVGEYIKANRGHMSLTSGIENASCISEWLWGKGFDYGNDSVFARAWVLGVWRVEETGEIVKLEAEK

SEQ ID NO: 2065 - protein, 61 aa, Lactobacillus paracasei
MAFVELEDGDFVNLNLILRIFKENPREKKWVVAMSTGKIAEITDADRILILKHAGFVRARK

SEQ ID NO: 2066 - protein, 108 aa, Lactobacillus paracasei
MSSKIIRLESLSLMDHDETLNDGSIFQTTRFIAVGHPYDENWAELAPEGDGYVERHSDRDVVSIDSIRSLCDSDGCCYLVKLKGGNELHLPIHAFIAETKEVTDDGVR

SEQ ID NO: 2067 - protein, 176 aa, Lactobacillus paracasei
MSEEKLYAVRNDGGQWADPGYTFGSGAWVTPDKAEREEDAKHHGGHVVAFVEEPEKVEVSKSVGDAIDSLISAETYVQAAEAFKYLFASRKKEDIKRIMKAVRNGYTVKEKKYRVLTPKSWWASENEPEYMHMNVLNGIENYKGADDDTLFTQKQLDLYGLSGSPFTKEEVTDDEQ

SEQ ID NO: 2068 - protein, 80 aa, Lactobacillus paracasei
MKTEDNTFDDIYVSKDTGKVVGVMLDGRDYKLVPISKTNEPISYERAKAFYRATVIGNGPGAIAYALDILHFIYGKEDEK

SEQ ID NO: 2069 - protein, 127 aa, Lactobacillus paracasei
MVVRKRRRGKYNAQPVVIDGIRFASKAEGAYYMLIRNKPQKVTIQESFEILSAFKINGKRYSARIYTPDYCFYDGDELTKVVDVKGGDATLTTDARLRMLLFMIRYKIPITIARYDYHTGLFTEEQL

SEQ ID NO: 2070 - protein, 149 aa, Lactobacillus paracasei
MTQVTVRFYKQGDKVWRDFKAELLKRYENSAMLDISKSKAFSKIEKQEFNNRIIVSKKSIVEKRAVSGVDDSDTLKTSVNNGLEKISKKRKEARAKYARGIAEAASQCDTLIDVAKRIGKSTTFVKRVASEFEIKLPRRNNGHEEIVSR

SEQ ID NO: 2071 - protein, 110 aa, Lactobacillus paracasei
VTAEEMTNRYLQRLDKRLRDYEMDLNQTIADIENDYDLGCIGVTEAQWQDIIVLVGGIVQANTRMIHEASECIRTDGEVSGSLLNLLDLAKHFATLDFSEAPLIKQEAKA

SEQ ID NO: 2072 - protein, 260 aa, Lactobacillus paracasei
MESTKGLFTHADVQKIIEKRGMDVSKLPTQEEIEKRFYERSMAALNRKKARAIYRYSVFPGNVPAKFTFDKWRPEMQMDLQKSRDLGNRAYKLAKQMQKAPEIVILFGPRGTGKTSLALAMLTSLRDEGQSGLFISTAELTNLMGLQYDAPDIRQRLAGIERAMKEADVLLLDDFGTEGGMKLDIKPVRRDMQELMYRVANARLDFESNMPRLSTIITTNNEMSELEHMYNSKLISRIIPKSKDCTLNFEKLTDVRGKRS

SEQ ID NO: 2073 - protein, 261 aa, Lactobacillus paracasei
MDYFKQRREYRKLKRDQIDISTGQNNLYRELLDYANDEGKLEVAFTLKNSALVDLTGLSESGMKKARNELVQLGLIKYTVGKRNKAKPTYQIVQLYDTSWATKNKKSSSTSNPTCSSTSVPTVAQSVAHKNLLVPDSNQTIKSNSQQSRKREYADGSPEMAEAVYLWSKIKGNNPEHRKPNLQAWADDVRKMHELDHRPFEKIHKMIDWCQLDTFWQTNILSASKLRSKYDTMVVQANRKFSSGRQVEHTETKENWGYGVD

SEQ ID NO: 2074 - protein, 146 aa, Lactobacillus paracasei
VINSVALNGRLTRDVDLRYTTSGIAVGQFTLAVDRRFKSKSGNRETDFIGCQIWRKSAENLANYAHKGSLIGIEGRIQTRTYDNNQGQKVYVTEVIADNFSLLEPKPVQRTDNVGPSNNQTAQSTASQPSGNNGKPIDVNDDDLPF

SEQ ID NO: 2075 - protein, 115 aa, Lactobacillus paracasei
MQKQGASITYAKRISLSLAFGIVADEDDDGQSASLLDEYKSEQEAKRVRVIAYLKDNMPLIDKSKSERVYAVLGKKRPKGNGLDVLSYAQALILSGAVQLELSDDLSGIGEEGAK

SEQ ID NO: 2076 - protein, 121 aa, Lactobacillus paracasei
MMDQQLDQASTPELNKALYDVQLVLKQPSKNKKATTEVTPISVPLITQLEPLSKKPATESATFKALRTKWTVTGKQFTKSIPKSLTAAEKKRSYGEPLFQMMQTCKSRGQASHMLSALACP

SEQ ID NO: 2077 - protein, 135 aa, Lactobacillus paracasei
MLDYNTAVLNDYQRREALEDKAIADWESYHGTVLPKDMDIEQAEEFLATADEYEVDTKKPWFYQSCATSRYEGAFNKDKAKEYLKDWINIHGPERFLKDAASSTYPKAELVEIFFGDDSLDVIDFMKNQGFQEWK

SEQ ID NO: 2078 - protein, 39 aa, Lactobacillus paracasei
MDTIKRAQKNPVAPTTGNKKLGKYYYDLILSRKAVDDHA

SEQ ID NO: 2079 - protein, 42 aa, Lactobacillus paracasei; identical to SEQ ID NO: 1447

SEQ ID NO: 2080 - protein, 108 aa, Lactobacillus paracasei
MDVAVKVNEDEKLAELIAVHLADNLKPVVQAMVNKAVEDALPGHGMNKGELSAKLKLSLGTDAFERIAYQSGMPRYESGNDGRKKSDKSRDRWYSKAVDKFMETYTED

SEQ ID NO: 2081 - protein, 157 aa, Lactobacillus paracasei
MAINIFQEFSRSLQEEGLTRKSLAARVHVTQAAISNWEARGIPNDKLIPVALAIGNDRFLNAVIEHQTGLRVFADDLDTDDPLVVYLHEKMAQKKFEESAERAESVLSKGSDHFTATDVNKIRSYIDSGESLVESLESLIGSLKSQIRPVEKVKAWM

SEQ ID NO: 2082 - protein, 52 aa, Lactobacillus paracasei
MDREQMIEALMSYRDDKPKAFWETMDNDMLEMAISAERERARNEMIDYLATA

SEQ ID NO: 2083 - protein, 59 aa, Lactobacillus paracasei
MHFVIYRSENNQYFFVIKSANHETVATSETYVYKESAQRTIDAIKNGIDQSSFVIDMTE

SEQ ID NO: 2084 - protein, 40 aa, Lactobacillus paracasei
MNENERKQIAQTAQKLLEEAAQLIALSNKLDELLGHVNDK

SEQ ID NO: 2085 - protein, 79 aa, Lactobacillus paracasei
MSLKDERKKKKLSQIELAHAVGLSQSMIQQMESGEKHGSVSTNIKIANYLGVSMEAILSGLENTESNKRNPAQREEAVK

SEQ ID NO: 2086 - protein, 214 aa, Lactobacillus paracasei
MTTGKRIADLRKKRSWTQPMLADKMSVSQSTITMWENDKRAVSSEDVKKLAKLFGTTTDYILGIDDNLPINAIPVSSEVADQPVMVYGEIQAGVAKWAEQDIIGHINVTKSFAKRYGAKNLFALQVNGESMNREIPNGYTAVFSKDLEPESGDIVAVMIDSESATIKRFRETSLAVMFEPSSWDPSFKPYVFPKDGIQDFKIIGKFLYATSECI

SEQ ID NO: 2087 - protein, 264 aa, Lactobacillus paracasei
LDNLLGCLGIVLILFLFIYYWYVAIPISLVLAIISIWLVKRKKAKQKETSDDFVYTTPPPAFRPVKPKASKDDLNEEISNLEEKIKKLKNEQQDLIRTNKDAISIIVNKEIKIIDRLNGREFEKYCGRMLEKLEFEDVNVTISSGDQGIDVLAKMGKTSYGFQCKHYSSPVGNKAIQEAISGKEFYKVDKAVVITNNYFTPSAIALAQEAGIDTWNRDTLIDFVHDQVVPEIANKEQHESQSPVSNNDSQVGATEPPKNEWEDF

SEQ ID NO: 2088 - protein, 196 aa, Lactobacillus paracasei
MKKTILIGLSLLTVTTLAGCGNSNSASKGSSPTKTEKAVNKATPTKKKTDASSVPTDANHEWFFKDPVFYAGNETMTLTKSEVRDSDEDGQKVLVIYNTIRNNSKKEQDPSNFYMVIHAKQKTDTSNVQLDTGMVKMNDDGNSPLQAQEDNLQNSLLPGKTVETVLIYSLKNTNPVTVEFSNADFKTIGTKTYSVN

SEQ ID NO: 2089 - protein, 401 aa, Lactobacillus paracasei
VRKWKEVPHHPNVYRYETRRGTRYGIRRGFKNSVGKRDEYTRSGFTNWHDAEGELKRFEASLVTGGINPLTHRGVTLNAYFASLVKNREELGVWRPATVIQKKTYYRKHLQERFGNRPMSKISRSEYQQFIDEKIKSGLAQTTMRTLNSVMQIIMNDAEHNDIIRKNMLRGILINGAKPPKDVSITDEDYAKFMATAKKLLNKYQLTMLYLLTLGERREELAGLQFRSFKRGTTEGKPYYEITYYVGRTPQQPLGGPLKTPSSYRTNYVTGPIIDYIDYSLQYAKNILTRTHREIEPETFIYLNEKTGMPVHPSNINRNLFQRVKDATGIELRPHMLRHYFATQALQDGLPQMSVMHWLGHKNIDMTNDYTRPTREGSLKVINGMGPILFKNGTTGPDGTK

SEQ ID NO: 2090 - protein, 122 aa, Lactobacillus paracasei
MALDVDGIIAQLKDASILELNDLVKSIEDEFGVKAAAPVAAGAAAGADAAAAKDTYDVELTEAGQEKVKVIKAVREITGLGLKDAKGMVDAAPKVIKEGLSEDDANKLKEQLEGVGATVTLK

SEQ ID NO: 2091 - protein, 168 aa, Lactobacillus paracasei
MSEQAIAKKAEIVKSISEQFKSATSAVVVDYLGLTVEQVTALRKELREAGVKMEVLKNTYLRRAADANGYEALDDVFKGPTAVAFSNDDPVAPARIMAKYADQFDALKIKGGIIENKVASLDTIMEMSKMPDREGLLSQLASVLQAPVRDFALVVKAVAEAKDEEPAA

SEQ ID NO: 2092 - protein, 410 aa, Lactobacillus paracasei
LPSKLKSLEPWQQNLAVLWLGTFIAGMGFSEVSPFISLYVDQLGDFTKGQLSIYSGITFGVTFMVVAIVSPLWGRLADRRGRKLMLLRSSFGMAIIIGACGFVHNVYALIALRFLQGLAAGYIPNASALIATETPKAKSGTAIGILTTGYVSGNLIGPILGGFLAQTFSIRLTFIITGVLLLIVFVLSLTMVHEHYTPDPRLLNKEKRPSLLSQVNNPKAIMVLLVSTAVIQLGNMSIYPIISLYVKELMHNVGPITVVAGVIAALPGISNLIAAPRLGQLGDRIGSGKILVSGLIFAVIMYIPQGIVGSIWALGFLRLMIGVSDGALFPTIQTLLSKLTPVSYTGTVFSWNQSAQAFGSMAGSLAGGFISNIFNYNGVFIFTALCLALNLVMVLVFIPHIWSSRPKQQA

SEQ ID NO: 2093 - protein, 277 aa, Lactobacillus paracasei
MREDRTLTGRKVTLTMLQPFLASADTFTQQHFANRHAILLKYPQSSAVTFAAAVWENSFHANALYFDVVGDVAWLPQLLEDLRQLADHHDRLQYSSYAAQSAVITQLQAKHFRVFRRTAMSDYRKVVATPEADVRSRSQLTSAQWHDVVQMSFANYVAAHADNPVTFNHATFEQQLAEAEDTQPSFLVENQQVQAYVFWFEDEPGALTSAWLGGQQFADIRRLLQTALFQVQARYSVVNGEFDDTDIHAWTVYQQLALPDPKPLISWQLLLDATRMQ

SEQ ID NO: 2094 - protein, 172 aa, Lactobacillus paracasei
MKKITEWYYGISLKDRFKQRTYDAIMGRNMLTAELMLLIATIIAIFIDANSLKMISAGTWILLIVTIVINLMNEITLRHYRLHVIEADTPEEYRRYEWLAVVRGVLSAVLMGVFIFAFEMAYEAAMDMNPLPQYYFANHLWIGFIFPIVYGASRYAYSLTRLHGTWQGKKDA

SEQ ID NO: 2095 - protein, 401 aa, Lactobacillus paracasei
MSKKPSGHTRLIIGIGVAWLFDAMDVGMLSFVIAALHSEWQLSTVQMGWIGSVSSIGMAVGAILFGMMADRFGRKAILILTLLVFSIGSGISAFATSYGIFLGLRFIIGAGLGGELPVASTLVSESVPVEKRGRSVVLLESFWAAGWLLAAIISYFIMPIWGWRVAVFATGLAGLYAFYFREGINESHVFKKVARPGLLKTLRTLWRPPYVRATLMLWIVWFMVVFSYYGMFLWLPSVMVLKGFSLINSFGYVLIMTLAQLPGYFVAAWLIEKWGRKMVLSLFLLGTAASALGFGLATGLPMLLTAGMLLSFFNLGAWGALYAYSPEQYPTVVRSSGSGMAAGIGRIGGVVGPLLVGHLLGSHWSVGGIFSIFTAAILIAVLAIVFLGQETMGVKLADTLE

SEQ ID NO: 2096 - protein, 461 aa, Lactobacillus paracasei
NADPMAYQTIDPNTNTLEKTYSNTTPTQISEMLATGHAFYKQERNVNPATRAATLHAVAAYFRNNADEMAAIITREMGKRTEEALFEVELCAEIADMYADRAPALLQPQPINSTAGAVVINHLASGIVFGVEPWNFPYYQLMRVFAPNFMVGNAVIIKPSSNVPASGLEFEKAVLGGGADKGAFQIALIGHADSETFIKDPRVAGVCLTGSERAGSQVAALAGKYLKKSLLELGGMDAFLVLDGADLDTVIPEAIKTRLMNCGQVCTSSKRFIVLDKYYDDFVAGLKKGFENLKIGDPSDPTVNVGPMTSQKAKDKLQKQVDEAIAHGAKVVYGNTPVDLPGAFFQPTILTDIDQDNPAYRTELFGPVACVYKVHSEDEAVELANDVPYGLGGAVFAGDTNHAAEVAARIETGMVGANQSQNYNAELPFGGVKNSGYGRELGDLGLFTFVNEQTVTRALRR

SEQ ID NO: 2097 - protein, 229 aa, Lactobacillus paracasei
MAKKGKKYLEAAKAVDPTKQYTPEEAVDLLKKIDFAKFDETVEVAYRLNVDPKQADQQIRGAVVLPNGTGKTAKVIVFAQGDQAKAAEDAGADIVGAEDLVQKIQDGWLDFDVAVATPPMMAQVGRLGRVLGPKGLMPNPKTGTVTMDTAKAVKDIKAGQVAYRVDKAGIIHAPIGKKSFDADKLLENFKAMNDIVLKARPASTKGIYIKSLALTATMAPGIKVNPSDF

SEQ ID NO: 2098 - protein, 141 aa, Lactobacillus paracasei
VAKKVANIVKLQIPAGKATPAPPVGPALGQAGINIMGFTKDFNARTADQAGMIIPVVITVYEDRSFDFVTKTPPAAVLLKKAAGVEHGSGEPNTKKVAKVTKDQVKEIAETKMQDLNAADVEAAMRMVEGTARSMGFEVEG

SEQ ID NO: 2099 - protein, 876 aa, Lactobacillus paracasei
MLKKTMSGHGASTQEKTAALTRYSQMSDQAVYQALKTNPDGLSSTEAADRLEAVGANTVVTQHPRPWYLILLSAFNEPFVWVLVFLVAVSTATADYDGAMMMSLMIVLSVTIHFWQEYRSQKASHALAALIANTTAVTRDGQTQERPMDDVVPGDVVQLATGDMIPADAYLVATHDLFINQSSFTGEAMPVEKRAEVYEQDADISVFDYPNLVFMGTDVISGSGTAVILKTGDATYFGDMASQISGKTDPTSFERGMRAISRLLIGMMLVLVPVVFVINGVTKQDWSQAFYFAIAVAVGLTPEMLPMIVNSNLAKGALAMSKRKVIVKRLHAIQNLGAIDTLFTDKTGTITEDRVVVMRYVDATGKTDPAVLRLAYMNANYQTGWHNLMDTAVVDYVKEHHDEIVDLPAGLEKIDEIPFDFERRRLTVVVANHDHQWMITKGAFEEMLAVCDQVQLHGEILPLTDERKRQLEQTNAMMSGQGMRMIVVAYRTDVHEQRIYTTDDEQHMVMAGFLGFLDPAKPDAKEAVSLLHAHGVRVKVLTGDNAIITQHVAEEVGIPEQAVISGNEVDAMTDNDLLEAVETTDLFVKLSPMQKARIIKTTQGAGHTVGYMGDGINDTAALREADVGISVDTAADITKDVSGIILLEKSLLVLEDGIVEGRRVYANAMKYIKMTIASNFGNAFSVLIASIFLPFLPMLSIQLLLQNLIYDTSQMTIPWDNVDDDTLAKPTPWRADGLLRYALTFGPLSSIFDITTFLFLWFGLGVGAHAASLPAEHMFQAGWFVVGLCTQSLVIHVLRTRKVPFWRAPASAIVILSTMMALLVGLFLILSPLHKAFDFGILPAAYWPGAVIIVLVYLGMVEWTKAGYLKRGRPWL

SEQ ID NO: 2100 - protein, 487 aa, Lactobacillus paracasei
MQKSALDQAAAIRAGVLSPEELIDSTREKRTALNPALNAITWTRFEAAKQDANQLEDHGQPFFGVPLILKGLGQDFAGAPATFGSRFFAKAKSEHTNNFVKALQRLGFIIVGQSNVPEFGFKNITDAELYGPARNPWNRDYSPGGSSGGAAAVVASGISPLATGSDGGGSIRIPASFSGLIGLKPTRGRVPTGPGEWRGWQGASINFALTKTMADTAALLRGLATTQLAAPFIAPPLRLDLVGDTRPLKIAYTTTSPVGTPVSDTAVKAVETAADALRAAGHQVVAAAPDVDGTALMKAYYMMNGGETAAMFQAFAAQTGKQATAADMELITWVIYQAGLHTSAADYSLSLGAWDRAAEAYNHFHESYDLLLSPTTAKTAPRIDAVLQSPAIVAKMQHAAELAPQEQQALIWDLFEPSLEYSPFTQQANLTGAPAISLPTAISPEGLPLGIQFTAAKGREDQLLRIGYWFEQQGLLKLLPASLKEKI

SEQ ID NO: 2101 - protein, 122 aa, Lactobacillus paracasei
MGSLAEWYQRIPTPDDLTRVESLFANIQAQFPQLKLEFKWNQPMFTDHGTFIMGFNPSKKHLAVAIEPQTMTRFIPQIDKAGYDHSQIIRFPWHKPLDEQLIRDLIAYTIDQKKDATTFWQR

SEQ ID NO: 2102 - protein, 178 aa, Lactobacillus paracasei
LKLYTKVGDHGATKQINGKKVPKFSPQIVALGDLDELDSWLGYVASQAKATPGFDWLAEDLEARQRELYELLADVAVPRHQTITADHVQGLEAAIDKMMAVVPKITAFVLPGGHPLAAALQYGRAVARRAERSLDQLDAESQPLDSVILQYSNRLSDYLFALARYVNYRAGVDEVKSK

SEQ ID NO: 2103 - protein, 190 aa, Lactobacillus paracasei
MKPQPSVTKPSPVRAVALLGLLTALCTVLRIVKVPIPNVQPVTDILMIVTLLLGFRWGFSLTMSTLIVSNLFLGFGLWTLPQIVAYACCMVIVIVMVTILPVIRRRIWLQIGLAGLLGYLYGFIVSLGMAVIGSLNGLGFWAYYVSGLPFDTYHAIGNLVFYPIVLAILRQGLQRFDRGGAHFETLHKSR

SEQ ID NO: 2104 - protein, 128 aa, Lactobacillus paracasei
LKKVLRSLVVFFVAMFVLAGCSSSGNAAKSSSKSNQIVVTYQLKQNGKAFAKKTIDQPKRSVVMTGLKKGWTVKASKGFITEIAGKKQNVAKKTYWLYTINGKMAQKGATEQPVKNHDKVVFDLSVTK

SEQ ID NO: 2105 - protein, 748 aa, Lactobacillus paracasei
MQVMTKPITLAPAFIAEVKKEIKPHWGELGWVTYKRTYARWLPDVQRTENWDETVKRVVEGNINLDPRLHTANPDPKVVETLQKEARNLFKLIYGLAGTPSGRNLWISGTDYQKRNGDALNNCWFIAIRPQPYGQSHIVPEDYPASQPAVSMPYSFMFDELMKGGGVGFSVTKDNIAKLPPVATKLELTVVIGRNSASYADSLKMGAVDRDEWEKAHAGEQADHCALPDTREGWVLANAKVIDHHFAATNPSGQTKLVLDITNIRPKGARIHGFGGTASGPMPLIEMLLDINKLLNARVGQHLTAVDATDIGNLIGKTVVAGNVRRSAEMSLGSADDDDFITMKQDQKQLYHHRWASNNSVAINTQFDAYSPIAHAIAKNGEPGIVNLELSRRFGRIADGENVENDPDVEGTNPCGEISLANGEPCNLFEVFPVVAVEQGWKLKQAFTLAARFAKRVTFSHYDWQVSRDIIKKNRRIGVSMSGIQDWFLNDFGRRVVSGFESVVDPQTGKMVQKPIYDPEIKQAVDGLYHTVVDADQAYSDALGCEPSRKHTTVKPSGTVAKLAGVSEGMHFHYAGYLIQRIRFQGNDPLLPALQACGYHIEPDVYTKGTMVVEFPIRAAHADDPAFASAGTVSIAEQIATQAFLQTYWSDNAVSCTVTFQPKEADQIAGLLSQYRHVIKSTSMLPYVGAGFKQAPKEPIDVKTYKQKCAAIHGSVAAVFAVQNADHDQKDLELVDQTDCAGGACPIK

SEQ ID NO: 2106 - protein, 147 aa, Lactobacillus paracasei
MAQIYVAAPFFDAAQTKRLDQVLAALQVNKSVTGVFSPRDDTNKAKLEENSPGWQRQVFGEDIQGLHQATTMVAILDYVGDTPDPGTAFEIGYAYAHHMPIVAVQVGKMPMNLMLAGSITCFVQEIAELKTLDLAHVLVRPYVGPVF

SEQ ID NO: 2107 - protein, 281 aa, Lactobacillus paracasei
MSGWFWIVAAIGLVVVVGGLADYLLLARPGYQPVPLVMDPVPTLFIPGHLGTRYSFGHMLWRLQRRYGLSKDVVAIVAPDGKVHLRGQLNLNHHAAVQVLFTDKAVRPAAQLHGLEKVIAALQTQQAFAEVNIVGHSMGGVTAVLYLLSKPTVPVANLVTIAAPMNDLEVAQRSPILNWRLTRTGPEHAAPIYQQFQKTIGNLPANLRWLNIAGDLLIGGRHDGEVAINSSFAIRYLVKDRIKDYTEVVIRGPRAAHSLLHENRLVDHDIVEYLWQRQRDF

SEQ ID NO: 2108 - protein, 184 aa, Lactobacillus paracasei
MAETVTSAEKRWYVLHTYSGYENKVKTNLEQRTSSMNMDDYIFRVVVPEEEEHEQKNGKEKIEMKKTFPGYVLVEMVMTDQSWFVVRNTPGVTGFVGSHGAGSKPAPLLPEEVANVLHSMGMSTRHNDVEFDVGEPVTIIDGAFTGMHGKVTAVDKEKMKLKVVTEMFDREVTAELDFDQVDKL

SEQ ID NO: 2109 - protein, 56 aa, Lactobacillus paracasei
MKFIKSVFAEMKAVTWPTARQTRRDTFTVIMTSIIFAIYFAAVDWVINMIFQAFLY

SEQ ID NO: 2110 - protein, 49 aa, Lactobacillus paracasei
MTAKKVALACSVCGQRNYFVPENPKRTERLTLKKFCKHCGRVTVHQETK

SEQ ID NO: 2111 - protein, 319 aa, Lactobacillus paracasei
MSEPYHRLTWPLFLEFIRLPAKAASMLPFVLGISYAGWAFQQFSWVNSLIYGLAQLAIALFVTGFNNVQDYFKAKDQSYQQRQNIIGREHLSPWGMLALTIVILLVSVILGIILVMRTNLSLLVIGAIGVGVAILYTFGPVPLSRLPLGELLAGFVEGYGTFIIAVLINMPAPSPLNLMLGRRTFTFSFDLGWLLQLLLAALPVIILNAAVMFADNIADMDQDIKNQRFTLPYFLGRKRALQWYRLIPFITFAALILGVLTRALPLWSLLVLATWPLVRNNTRRYTSKPSKDKTFIFTIQSLLTVGGTLLLTLWLGILF

SEQ ID NO: 2112 - protein, 312 aa, Lactobacillus paracasei
MPLSVFFELVEIRTKLASILPFAIGTLFAVTYFHTFNAVNTILFFMAMLLFDMMTTALNNLMDYRKAKDTHYQTTTNIIGRANLAPKLVKKMIIGMLIVASLIGLVLVWRTDWLLLLMGMACFAIGILYTWGPLPLSRLPLGEIFSGIVMGLGIPVIATYVNIAPGRLLALDLGWPNVVLRGDFIAIIALGLACVTPMATIANIMLANNMSDLDEDQRNHRHTLPMYLGSWWSPRVYALLAYVGFLAIIFGVIFGALPAWTLVIELAWPLVIKNVHRFIRDPSKQRTFHTAVINLVIENGLLVLGLGMGAIL

SEQ ID NO: 2113 - protein, 355 aa, Lactobacillus paracasei
MKKRFVVVLLMLLALVATACAGKTAAKRTLVEGDPYSDTQFLMGTVVTVKIYDKDKQSALDAAFARVQQLADELTVNQKGSEVDAVNKNAGIKPVHVTPSVYRVIAAAKHYSENSEGAFDLAIGPITSLWHIGFADARKPAQSEIDERLPLVHYPDVVLNAKKQTVYLKKKGMAIDLGGIAKGFITDEVVKTLKAKKVTTAIIDLGGNIYVMGKSPKNVKKDWNVGIQDPKKPRGTAIGTLPASNMTVVTSGIYERYLKVDGKIYMHLMNPKTGYPFDNNLMGVSIVTKKSVDGDALSTATFDKGLAGGMAYIEKLKYADAIFITKDKKVYVSSGLKDKFKLLKDSGYTLATLKK

SEQ ID NO: 2114 - protein, 304 aa, Lactobacillus paracasei
MKLSKVVTGTAVVALSALVLSACGSSSSSSKNSTSSKASSSKVVKKSSSQKQVAGGALKDGTYKLDETGYDHGYKVQMAMTVKDGKITSTKYDYVDKDGKSKTKDAAYEKAMKAKVKVGPKEYIPELNKSFQKNGTNVGAIDVISGATDSSMTFKNYAQQLIQAAQAGDTKTIEVNNTGKMQDGTYTLEEKNYFNGYRVTFSITVKDGKITESNYDNINKDGKSKTLDTKYEANMKKVNKVGPKEYIPELNKSLVAKQSPAKVDVVSGATHSSDTFILYADQLVNAAQNGNTNKIEVDNIVYNN

SEQ ID NO: 2115 - protein, 661 aa, Lactobacillus paracasei
NADHDEHYDRGENASELIKEPRTEINYLDMAKTNIVVVGAGFAGVYATKHLAKHYKRNKDVTITLIDRHSYFTYVTELHEIAADRVPEDAIQYDLQRLFNRRKNVKVVTDNVTGIDRDKKEVVTENGSFPYDYVILGIGSQPNDFGTPGVAEHGFTLGKWEDAIRLKRHIEDVVRRGSEEHDPAKRKALLSIVIVGSGFTGTETIGELRDWRDTLAKQYKLDPNEIQFSLMEMAPTIMNMLDRSDADKAERYMEKRGIKVMKNTGVVGVHEDHVDLKDGSTFPTCTLVWTAGVKATDQAKDFGLKQGRAGRILVKNNMESQDDPSIYVVGDVSLVDQDGTGKGQPQIVQGAEATALTALTNIEAKLENKQQVEYKANYSGFMVSLGSKYGVANIMGWLHLSGFFAMLMKHLVNMLYFIQVYSGYYLFQYFMHEFFRTRNGRNMFRGHLSRQGNVLWTLPARLTLGAMWLIDCWPKIQGKESWFIDKLRLPFTWLQPAATSGASAAGADATSAATGAAAGAAKATKTVFSLSYQYGNDPMMVFEKMPNWYYSITKALIPNQQVAFFMQKAMTIMEILIGLALVAGLFTWLTSAATIAFVGVFCLSGMFYWVNIWMIPMAFACMNGSGRAFGLDKWVVPYLQKVFGKWRYGTPRSLYGTDTLK

SEQ ID NO: 2116 - protein, 147 aa, Lactobacillus paracasei
MKQPSTFKRYLKMIRPFDWIIVGGLFLAAFIPYVIFAVHENQQQQAEPQRVLTAIVTHDGHEVYRKRLTGHTGTSRFTYRAKDGDWNKIEVKDAGVAITEANCQDQVCVRRGRITKPGQTIVCLPHKLLIEIKANKGGGSTGGMVTE

SEQ ID NO: 2117 - protein, 195 aa, Lactobacillus paracasei
MSTYKADRTRQYIYIALLCAQGVIIGLLERMIPFPFAFAPGAKLGLANLITIISLFTMSIPDSFILMCLRLLLTTLLGGTLSTFLYSGAGAVLSWFGMLLIKQLGEKRVSMIGISAAGGILHNVGQLLVASLIAQSWTVMLYLPVLAFMGILAGIAVGIAANFLFEHIDILRRLRYDRTKRRKKGATHENSSHVA

SEQ ID NO: 2118 - protein, 325 aa, Lactobacillus paracasei
MKIHPMWHEYPTLAPELASALAMIEKQITTNNTPVAKAIMEMINGGGKLLRPAYCLLFSRFQDVDREKMIALAAAIETLHTATLIHDDIIDKSPTRRNQVTIQKQFGPDTAVYAGDYLFVVCFKLLSHYASSLRSIQQDSGSMEKILKGELDQMATRYQTKITIDDYLKQVSGKTGQLFALSCFIGAYESGSSPTFAKNAEKIGMNIGIAFQLLDDILDYTSDDDTLGKPVCEDVRSGVYSAPLILAMQRNRQAFLPLLAKKDQITDAEMNELRQLVIHHQGVEQAYAMAQKRTEQAIAGLQKLPAGAAQDDLIRLTQSLLNRKA

SEQ ID NO: 2119 - protein, 58 aa, Lactobacillus paracasei
MKKILRWFWQHKLISLGVTSVYLFKLYDTHFTSFDLVVYVIALPATVWISDQWPRALS

SEQ ID NO: 2120 - protein, 80 aa, Lactobacillus paracasei
VENKNKDRGFNYLAMSYRGKLRRTLWMFPFGVLAIALIAWTSGSVFITVILAVFLTIIWALQVAYTYFMAQREKHDGDNQ

SEQ ID NO: 2121 - protein, 259 aa, Lactobacillus paracasei
  misc_feature (5)..(5): Xaa can be any naturally occurring amino acid
NADPXIDREDCTASECENZYMEFDEPENDENTMMAIQRVGVIGAGKVGIVLAGLALDAGYTVRISGSGSVKKIALTIKTLVPGAIPSENADVVANSDIILLAIPLSRYKNIDADLLKGKLVIDAMNYWWETDGIREEVLDPSTTSSEQVQTYFKDAKIVKAFNHMGYHNLQEEARPKGDPKRKALFVTGNDPEAVATVAAFVDHMGFDTVVHNNLADGIMTEPGSPLFGASLRYAELKDIIDHFDQTEFGKEVAAQTHK

SEQ ID NO: 2122 - protein, 351 aa, Lactobacillus paracasei
MVDIEHLQFGLETFGDIVANEDGSLQTAAASIRQIVREGKLADDLGIDVFGVGEHHRPDYSVSSPETVLAAISAVTKQVKLATAVTVLSSDDPVRVYERFATLDALSNGRAQVMLGRGSFTESFPLFGYDLTDYDDLFNEKLGLYDALRNEKAVTWSGKFRAALKNQEVYPKTENGKLETYIGIGGSPESVIRAVNFGYKVIIAIIGGQASRFKPYIELYHAAAKELGKPEFPIAVHSHGFIADDEDEAVEVAFKNIKANFDRIGLMRGWAPMSREQFEGETKVGSFYVGDPETVARRMAATIDLLDLGRFDLVYGAGNQTAAQRERMIELYGTKVIPRVKEILAEKAAVK

SEQ ID NO: 2123 - protein, 291 aa, Lactobacillus paracasei
MLKLKDIELSFPNKKHVLNDITLTLDQKEVVGLVAPNGTGKTTLLNVIMNNLTPSHGYVEIDGLRYDNNRLTKKIHQKICAFPLENELFGELSGYEHLKLYKNMWQSRRAIDELIDALKMQTYISQKVGTYSLGMKQRLCFAMVVVSDASMMLLDEAMNGLDPENVALISSQIQQLRESGKLVIMVSHLLDNLQMLADRVLFLRAGKVVKDLNMHEQQNNFLKMRLEPHLVASINKDAVLDAYQNQALIDLTKLDYATRKSLVLELMTNDIPYSIAPLSLVDEFRLTFQRQ

SEQ ID NO: 2124 - protein, 410 aa, Lactobacillus paracasei
MTRNTSYLTFQLKQNLLSKKNWGVCLIFFAWSLWFCYQYLPENGTLENFSRQEVTDKLLKNEKFMKTFKPAFPNYPTIANAGIYIPQFITAERAQLAAAAKGDYKKVAASMNDELLLTDHLVLQGQPWLSYPLQYYNDPNVVRDAGSGNQSRNGHYWNLEARTRLQQYAHMKDNDINAAVINQQTALQQLERAFFYGLALALLIATAIISTDLVTRDRKKTSILRNLPLTAWGMINYKSLSALLMSGGLVLGFLVILLPCNMLRFGIGSLTLPIPVYQSISFTTISLGRFMLEAFVLLLLGMWLIIRLQIVLQLVLKSEFASLAMTSLLLVSETFYFVPGLVSINNWSLYLLPSYFNIGQLVVGFQNFRYETTKMTFMFGMMLFMSILIVVEVVIYCLTHKRHTRKARLS

SEQ ID NO: 2125 - protein, 370 aa, Lactobacillus paracasei
MKQLSAFFQRQVTFNQKNLVVELFMIFLVIGLFFVIKFQKVADLKIDTFRIQQSVQSSYLRYDARAYSKTSKKGRMQQVLNEQLSGAGKIDSGLLIQDASMILNGQVELAQAQLKSYSLNFAGAEGLLIPAKESVIGNLVVAQRLQKSHDSPRHNIQNAADYGAILFQVIAICAPFLIAYLVGDSWLVELEHKSILKNMPVNFFEKFTAHIKANLQLSAGLFLVFPAVALLLMGLVTGFGDWNYPTAFNLMNSVITMPSWLAGLLIALYSLAITIFMSVVAIWLNKLTKNFYATVLSIMTILVIVTFSQTLPLVLYLTPIPYLNIAYVYSGRFLLNDHLPVGWLTGMVMILIWSVAIFFILSRQGGARND

SEQ ID NO: 2126 - protein, 472 aa, Lactobacillus paracasei
MAYRHRATQLSFQSFNNGLGVPLSSDNEWVQLADMLPWQQLDEAYQLLFTEMGGRAAKPFRLLYGASLIKQAEHLTDRSVVTAIRDTPAYQYFIGLDTYTTDLPFNHSTLVYFRRRMGQITELVRNIISDTLREQIQSLLPDDELRVLITDATAVPIEIRFPQDTSLLNQARLNLEEMLLDMAHQLQIKPPRTYKREAKAKWTAFARKPRRWAKETRKQIKVQLQYVRRDLRYIDVLLAHGASLNERQTKRLAVIRKLFDQQMFMYENRTHRVPGRIVSLAQPWIRPINRGKAKQRTEFGPKIDASIADGMIDIERFDFKAFNESQDLATTIDHYFDVHGYYPDEILADTLYRTRENRQLCQRLGIRLSGPRLGRKPKKMDAKQRQVDRDAEKRRGKIERGFAFMKGPLGLSLVRTKTVASIAVTIDIAINLANLKMLLRLFNGPILIFVKYKQESILIHYQIHVSGSRNVA

SEQ ID NO: 2127 - protein, 297 aa, Lactobacillus paracasei
MTEPILIDPRNLYHTSQFEKQDQETPALQKKMSPKPDCGEGSYIGNHKLENRRVLITGGDSGIGRAAAIAFAREGADIALQFYPGEEPDANEVAEYIQEAGRKVVLLPCDLRDRNAPEEMVKQTVAELGGLDTILLNAAQQISQPSIEELTMKQVEDTYMVNIISQFALVKAALPHLKAGSSIVATTSIQAFDPSAHLLDYATTKAAIANFVVGLAKQLADKGIRVNGVAPGPIWTPLQLDQGQPENALPKFGQDTLMKRAGQPAELAPVYVFLASNDASYVTAQIYGATGGGAINL

SEQ ID NO: 2128 - protein, 185 aa, Lactobacillus paracasei
MKRIVKTLLIIVGLLLITALVPLIIIGAPYVGLDQIRFLDGLFLNIYSWQYLFWVASTFAILILIGIVFVIFYPQLRRQFKLDSKGGHLVLEQEAIEGFVRSKLSARDFINKPKIKVHATKRKIRVIIDGQLKRTSSLIDQTEAFRSELQQELQRLLGTKEQVIVNVEFNDYQTNKQTTGSTRVV

SEQ ID NO: 2129 - protein, 66 aa, Lactobacillus paracasei
MKAFWRHFMFPIIGGGLGLFLAILFVSIGFFKTLLLIILTIIGTLIGFYVKRLGILDGLLKQSDDY

SEQ ID NO: 2130 - protein, 202 aa, Lactobacillus paracasei
MTQNNQNGLDTRKESLSTTNQKAAHLRSDSDKTTDQIRGKLTYDDKVVQKIIGNAIEKIDGLLDVNGGFFANIADKLVNTDNVTSGIKTEVGEKQVAVDMDVVIEYGRDIPEIADKVKQVIHDEVAKMTHLEVIEVNINVVDIKTESEYEEDSETIQDKVTNAAKSTGRFASKQTDKAKEAISQGTNKAQEKVKENTEPRVQ

SEQ ID NO: 2131 - protein, 82 aa, Lactobacillus paracasei
MAWLWSLIVGAIIGVIAGAITGRGNSMGWIANIIAGLIGSAIGQALLGTWGPSLAGMALIPSILGAVILVIIVSLILGRKKA

SEQ ID NO: 2132 - protein, 134 aa, Lactobacillus paracasei
MNKVRVKDRKAVISDFKQVHRAANREAAELKLNEFANNRHQTYPKLIKDLLKMPNLLTFMDFPPAIRQSLYSTNLIENFNKHLKRTTHHKEQFPTEDSLDRFLVSQFNVYNEKSLKRIHRGFKGLQDTLEASFI

SEQ ID NO: 2133 - protein, 65 aa, Lactobacillus paracasei
MTTQEAANRDAQSINERIDQYGSYAVIIAQTIFVRNYSIGATLPGSCWAESDEQSSRKRPQGRDQ

SEQ ID NO: 2134 - protein, 365 aa, Lactobacillus paracasei
MLAIIKLHMCKCVNLLASLEVEIMKCPLTNATSCAEKYSKAEKFKISNRNMKFIESKSRGGRPNRHRPFTINKVEDPAEVEKRLIQQRDKAAKAVRQLSHLDDKTLQATLKQLRQAQSEDEIKAAIDQAKSLDQKAAIQSQARQHQQNLSQLQTSLDRTHATLKAWKKPHGQCTVKALGEANIVIRYFATADGITPKQYRWLVPEDLEIPEHVAGHLMLVPGCDDDEQVAVIAYVRHDKIREYSNGKIVPAVKMLKFLDDHATTEQQSAIAAHERKITATYATKPKSGPKRRPKIRRLLKFSIESKIEFLKNRNNSSNCQMPRSHHAELVPLESLELYTNTLKGQPKLAVGLLALWICWQKTLGM

SEQ ID NO: 2135 - protein, 128 aa, Lactobacillus paracasei
MADTKKNTIGFFNKEKKHSPDMAYKEDIPVKETYKGSGLKAFDPSAEKKTTPVTHKVKDARRTIRIPRQQYYELLALLELSPNKYVYELIAELVDRAVKEISADRPDELRLYQQAIERIKATDERRSR

SEQ ID NO: 2136 - protein, 293 aa, Lactobacillus paracasei
MQSKLNLKRPLTITVANAKGGVGKTTITRYLPYDLAERGYKVLVIDADPQANLTKSMGITKQQHDPDNIFTIDKSMMAAVRDGSFKGAVLEIVPNLYELPSQIDFRGFETFLSKKYGVAEKGDPEYLSVESKKVSLLKGLIEPIKADYDFVFIDTPPTAGQYVRNATFASDYVIIAFQTQSDSLDGAIQFISDDLTELVETFGARTDVLGILPNQVSKSGAIDQVVIKDAIARFGQQNLFDHIIPFARRIQAAPRMGLSRQGYWNQKLFDDIVDPLTDDFLQRLKIVGEVTNG

SEQ ID NO: 2137 - protein, 491 aa, Lactobacillus paracasei
MDVLGAANLSEAAIVAILHHGLARSKYKHSQLRPEDRQGARPTGAIFLTRTKDDLREAIGFVATSQEAVLDNETCSHWTPNIFRFGTYADRRCHVLKGHSEDNLKQINTFVVDADFGSGKPSYDTALLNKFIVNQNDQQELWPTLVLETPHGYQAYYVLDRPVFVRRTGDQLPAVTAAKRVSEALRAAVAKDLPQVDVGANHFGFFRKPSEENVCFFEPALTHDFGDLQDWTKLQHLTFHHDNKAHYPVKQTDQPWFIALTHAQVPRGDGMLGRNNTLLTLCLAGYSSGWSAEDAYDFADQWNTDQREPLSDQEVRRIIRSAFSGKYQGASAAYIAELTATYTPDAPKTTGPQVWHKHAKPRTERKYSHLQEWAGDLVAYVVERAGQAVDQIKVTTRELRDQLGISSQVLTKVLAYVADYGLLKVVKQYGRHGGLYLTTRQMLGRQLQLDRRAQAISWHDFVTGQLRGRAQKEVVKGQVSLLPETLTRSGP

SEQ ID NO: 2138 - protein, 106 aa, Lactobacillus paracasei
MPDYPSNISRAQFALIQPDLENFRKHTRPRRYDLYDVFNAILYSLTTGCQWRELPHDFPEWHTVYRYYDMWRDKPDPTADSLLERLLKKLSLPIVLHRADRPERRL

SEQ ID NO: 2139 - protein, 80 aa, Lactobacillus paracasei
MDNHGFVERFWYVYKICEHTANTSKPDLNLTFVKRLALANKKTIIVKENKPIIAVEKPIAPYVYPIVVKNYQTWPSSLYR

SEQ ID NO: 2140 - protein, 125 aa, Lactobacillus paracasei
MRKLSSKVKLTFTSPLFWIVIVCFGITYLEFFTSSISFFLTRYCWNSPVEVFSGQYYRLFTALFLHLDIFHLSGNMLFLALLTWIISANITRFQYLMVLLFSGVFGNLLADTFITYLYKLDGHVW

SEQ ID NO: 2141 - protein, 549 aa, Lactobacillus paracasei
LLTVNNVSMTFSDRKLYEDVNLKFTPGNCYGIIGANGAGKSTFLKIIQGELTPTTGTVSLSPNERMSSLRQDHFAFDNQTVMNTVLQGWERLYQVMTEKDALYAKPDFSEADGNKAAELEGEFAEMDGWNAESDASQLLQSLGIAESEHQKLMADLPEGEKVKVLLAQALFGKPDVLLLDEPTNGLDPQAINWLENFLADYEHTVLVVSHDRHFLNAVCTMMCDVDFGKIELYVGNYDFWKQSSELALQLQSQANAKKEEQIKQLQEFVARFSANASKSKQATSRKKQLEKITLDDIRPSTRKYPYIKFEPEREIGNDLLRVENVSKTIDGHEVLKNVSFILRPGDKTGIISRNDVTATVLMQLLAGELKPDTGTITWGVTTSRAAMPKDLNPEFDHDDLNILDWLRQFAPQDEQDNTFLRGFLGRMLFSGDEVLKQLNVLSGGEKVRSYLAKMMLSKANVLIMDDSTNHLDLESITSLNDALIDFKGSLIFTSHDHQFIQTIADHIIEVGPLGVVDRADTSYDEFTQHETAQAQVADIYPADKKKSKA

SEQ ID NO: 2142 - protein, 558 aa, Lactobacillus paracasei
MSQPITILLSVTGFIVAMIVLNGLLTWQRQQKLKRQLLADWGTFPEKRPKGERYLKAAYLDHEAQVNHDCQVDDLTWQDLDMLDVFEQLNVTQSSVGAERVYAQLRAYDLGKPAVDEALIAFFQDHPDSRLKVQMAFAGLGIEPANNSQLYLRTTTKKALPNAWRFKVMGGFPFIGVLLTLLWPAIGVTLMVVSLLVNVFYYILKREGLDAEITSMGYLVRTIIKAERLAKISQPTQAALRQAVKPMRGITRFAFVFRTKTGSMGDILTEYLSIMFMLSFIAYNTVLDRLSSHHAEALALWQRLGDLELAIAIANFRAAEATTTQPVFAKGGMNATDLAHPLLKHPVANPVDWQKNALITGANASGKSTYVKSIAINAILAQTINTVTATSFTMEPGEVITAMAVRDDLSEGDSYFVAEIKAIRRLLNAVAKKKRVYGFIDEILKGTNTVERIAASASVINWLKQYPSLVVVATHDNELTDIMGDQCVNWHFQEKVTKEDGVVFDYLLYQGPATSHNAIALLATMDYPTSLIHDARQLAADFERSKAWPKFVKGGIQA

SEQ ID NO: 2143 - protein, 193 aa, Lactobacillus paracasei
VTDADKIFEAIRQDPDNADFTAQGWDPLYHIEPEATILIASQAPGRKAQTTKTYWNDPSGDRLRTWMGVTKDQFYHSGKIAVLPLDFYYPGKGKSGDLPPRKDFAAKWHPSLLALMPKIQLTIVIGAYAQKYYLGKHREKTLTATVKNFRAYLPDYFPIVHPSPLNYGWVNRNPWFMTDVVPALQAQVADLMK

SEQ ID NO: 2144 - protein, 235 aa, Lactobacillus paracasei
MWTQTLGEFIGTFILILLGDGVVAGVSLNQSKAKDAGWVAITLGWGLAVTMGVYTAAFLGPAHLNPAVTIAFAAIGQFSWPWVLPFVAAQMLGAFLGAAIVWLHYYPHWAKTNDQATTLGVFATGPAIRNYTANFLSEFIGTAVLIFGLLAFAQGKWTAGLAPMGVGILITAIGLSLGGTTGYAINPARDLGPRLAHAILPIAHKGGSDWGYSWVPVLGPLAGGVVGALIFVTLP

SEQ ID NO: 2145 - protein, 617 aa, Lactobacillus paracasei
MVFSNETRKQTIHQLKHTELDLLIVGGGITGAGVAIQAAASGIKTGLIEMQDFAEGTSSRSTKLVHGGIRYLKSFDVGVVADTVKERAVVQGIAPHIPRPFPMLLPIYQESGSTFDMFSVKIAMDLYDRLAGVEGSQYANYTVTKDEVLQREPQLSADNLQGGGVYLDFVNNDARLVIENIKEADELGGLMASHVKAVGVLHNDAGQVVGLHVKDLLDDTEFDIHAKLVINTTGPWADKFNALDDHEKHAPTLRPTKGVHLVVDGSRLPVPQPTYMDTGLNDGRMFFVVPREGKTYFGTTDTDYTGDYEHPRVEQEDVDYLLKVVNKRFPESHMTIDDIEASWAGLRPLINDNGSSDYNGGGANSGKVSDDSFTALIEVVNAYEDDQATRADVEHAISKLETAHAEAGLSPSQVSRGSSLHQATDGLITLSGGKITDYRKMAAGALALIRRILVDRFNVDAPAVDSKKLQVSGGHFDPTNVEETMAFYIRIGVDAGLSEKEAQDLANRFGSNTSRVLTYAVDGPAPGLSLKETMSLRYSLNEEMTLTPVDYLLRRTNALLFHAETLAELKQPVVDEMAQTLGWDDSVKAQQLAALNAAIADSQLAYLKTAPAPVHPE

SEQ ID NO: 2146 - protein, 505 aa, Lactobacillus paracasei
VTSDQKYILAIDEGTTSTRTIIIDHNGQKVVDAQREFPQYFPHPGWVEHNANEIWNAALSTIATAFIESQIQPRQIVGIGITNQRETTVVWDKQTGLPIYNAIVWQSRQTSEIADKLKADGHSDMIHDSTGLLIDSYFSATKIRWILDHVPGAQERAEKGELLFGTIDTWLSWKLSGGAIHVTDYTNASRTMLFNIHKLAWDDEILQLLNIPKQMLPEVRSNSEIYGNAAAYHFFGSTVPIAGMVGDQQAALFGQLALEPGMVKNTYGTGAFIVMNTGEKPTLSNNNLLTTIGYGLDGKVTYALEGSVFVAGSAIQWLRDAMKLVERSSDSEAAARASKSQNEVYVVPAFTGLGAPYWDSDARGAIFGITRGTTREDFIKATLQSLAYQSRDVVDTMNKDTGIPIQALRVDGGAANNDYLMQFQADILGIPIERAANLETTAMGAAFLAGLATGFWNNTDELQSIVKLGKRFEPTMGAPDRDHLYEGWQQAVAATQMYKHKAKKA

SEQ ID NO: 2147 - protein, 240 aa, Lactobacillus paracasei
MSNLDLTIVVPTYNLGHYLPETLKSIQQQTIDFELWLIDDASTDGTAQTVADFVKGIPNFHATGFNHHRGIGAARNFGIDRATGQAVAFVDGDDLIAPTFAGTLSHGFTSGVVATAVGYDWWHRSRGGPNRFQLLSQREMFDQVSRHGSEVGGYIWNKAFSRDALTTGNIRYDEQLRIAEDYYFTADFVAHTPGKYAYNPTILYTKVNRPNSTMHNFSWADRRQEDQIFERIHRMRQLIQ

SEQ ID NO: 2148 - protein, 388 aa, Lactobacillus paracasei
VNSTDVTKGFTEQFGKQAEHTFFAPGRINLIGEHTDYNGGHVFPCAISLGTYAAVGTNEDNAFRLYSANFPKVGIIDIPFSDLFQDKRGLWTDYFQGMARVMKTAGANFTHGLNVYINGNLPDGAGLSSSASLEMLVGTILNNLFDGGFEPLELVQFGVKVENDYIGVNSGVMDQFAIEMGRANQATLLDTNTMKYEYLPVEMGDNVIVIMNTNKRRELADSKYNERRSECEKALAMLQKGIEVKSLGQLSEDEFDENTYLIYDPILIKRARHAVFENQRTLKASKALQDGDLKTFGKLVSASGVSLAFDYEVTGIELDTLVTNALKQRGVLGARMTGAGFGGCAIAIVNSADVEDFIDNVGKTYREKIGYDAHFYVADIADGAKQLN

SEQ ID NO: 2149 - protein, 331 aa, Lactobacillus paracasei
MTIAVLGGAGYIGSHTVKQLLAAGEDVVVLDNLITGHRKAVDPRARFYQGDIRDYHFLSQVFSQEKIDGIVHFAAFSIVPESMKDPLKYFDNNTGGMITLLEAMNQFGIKKIVFSSTAATYGEPKQVPIKETDPQVPTNPYGESKLAMEKIMHWADVAYGLKFVALRYFNVAGAMPDGSIGEDHHPETHIVPIILQVAAGTRTGLQIYGDDYPTKDGTNVRDYVHVVDLADAHILALKYLDAGNKSSAFNIGSAHGFSNLEILNAARKVTGQEIPATMGPRRAGDPSTLIASSEKARDILGWKPNYDDIDKIIETAWNWHENHPEGFGDRN

SEQ ID NO: 2150 - protein, 486 aa, Lactobacillus paracasei
LTAISNHVGTIVKLNPDYTQMDAVYLTNKLLNLIGDAALDLPGDADPLTNLDLMVKAAQENGKIPDSQAARQILEAQLMDLATPTPSRINQLFWDKYQAGPRVATDWFFALSRANNYIQTRAIAKNVVFPAKTEYGDLEITINLSKPEKDPKDIAAAAHAAQSGYPACALCLQTEGYAGRTDFAARTNHRIIRFLLGGKTWGFQYSPYAYFNEHAIFLDAIHEPMVIDQSTFSNLLAIVSMFPAYFVGSNADLPIVGGSMLTHEHYQGGRHTFPMAKAPIETQVEISGHPHVFAGIVKWPMSVIRLVSADSDELINAAEHVRQVWNQYTDETVDVRAFVDGKPHHTVTPIARRVGSEFQLDLVLRDNQTSAEYPDGIFHPHQDVQHIKKENIGLIEVMGRAILPARLKSELAEVQKYLLGEANTMKPMHKTWADQLKAKYDWTPENVEAQMQAAVGRVFAQVLEDAGVFKRDEVGQKAFARFCRAL

SEQ ID NO: 2151 - protein, 336 aa, Lactobacillus paracasei
MDVSVEPYGQYQGHNLYELTLTNDQGMVVKLLNYGATLEKVLLPEADGLHNMILSLPSREDYAKERNFLGGTVGRVVGRIRGHVWQHGDVKIDLPMNEGKNHIHGGDDGLDRQVYNFRIDQTATTASASFTFVDPAGHNGYPGNVKLQVTYTLENTNTLHYRLDAVSDEETLFNPTNHTYFAIDQPNKIDATTLTIPADDYKPLDADHLPDQGWQPVAGTVFDFRQGQKLGDVIHTRAAQITAERGINHPFLLKHGQTLAAKLQTDKHTMTLATTAPSVVVYTANHFDGTGIPHNIDQFDGVALECQFAPVSGDDLSAMTLLPGEPFTLVNSWAFE

SEQ ID NO: 2152 - protein, 236 aa, Lactobacillus paracasei
MKTKFLKLPVYQQGLFLTLIWLMVGIGVMLYRWPTSDQDFQTTAYWLAPNLIHMQGEVTAQWFPFACAVTAGVSLYVVKHIKSRNCDTREGLYVLQNLWPIWLVTIVVFFLLNLWLPQTGMTRFSSFDRQVLTIAILFLDITLFSSYMLWLNFWVPVGRVHNVIKVLFWAVLFLGAGFIMSHIQFTFASSSFSLDDLGRRTWLTLPFWPSWFLGLLLTAVIWWHTFRRLRMTDDSH

SEQ ID NO: 2153 - protein, 243 aa, Lactobacillus paracasei
MKMKLQRLPIALQGIVLGAIWFLLAIAFMLYNTPTAKNEVPIPFPPLVPQMFRVDGVVKADWLQFIFWFILFLTWYAIYRVVRLNDQTHTLQPVLRAVVPIWVFAITIVFIATFWTPIIGLNGLSVVERSLVTLGLLVFTVLFVGAFRLYGEILRYSSRQGKVFRIICWFTLLCASFYVIWHLQFTVQGAPILKNTFLFGGLSQDAWVVPFWPSWLIGMALVSLSLLIIRKKAINIQYREKTM

SEQ ID NO: 2154 - protein, 164 aa, Lactobacillus paracasei
MAKTVENDLFDAALAFVEDGDDQDTVFKQVSDQLLVAGAVKPDFYEHLSEREKNYPTGIDMSVVNAEYPNVAIPHTEGEFVNVRKIIPIRLKKPIEFANMIAPDQKLKVSFLFMILNNDPEGQANVLAQIMDFLTTSSAETLAKLFGADDAATIYNVLATSFKK

SEQ ID NO: 2155 - protein, 102 aa, Lactobacillus paracasei
MTVKILAACGAGVNSSHQIKDAIEKEFKKRGYSVQADAVMVKDVNEDMMKNYDIFTPIAKTDLGFTPAIPVINAGPILYRMPAMAKPVYDKIEGVIKKENLK

SEQ ID NO: 2156 - protein, 483 aa, Lactobacillus paracasei
MQTIIDLANAVFKPVIDLGAAPIMLIVLTLIAWAVGVNFFHALEGGIKLAIAITAIGSVIGLLTTTYQPALNAFVKSTGINLSITDLGWAPLATITWGSPYTLFFLAILVIVNLILLFLNRTNTLDVDIFDIWHLSFTGLLAIYFGANLFIATILVIFIGILKIINSDLMKPTFNDLLDDWENPMTTTHLNYMMNPVIMVFDKLFDKLFPWLDKYDFDAAKLNEKIGFWGSRFAIGIYLGIFIGLISHQSVKSIATLAFMAATCLELFSIIGSWFIAAVEPLSQGVTDFANKRLGGRMLNIGLDWPFLAGRAEIWAAANVLAPIMLLEALILPGNRILPLGGIIAMGVTPALLVVTRGKIIRMIVIGAIELPLFLWAGTLSAPFITHTARALHAPGIPATGLFSSSTKEGPIEQFIAVLVGKASKGEMMMVLYAALALIAYTALFFWYRHEMMKRNQKYSDEGKEVADDVKFVATHGAAGSAD

SEQ ID NO: 2157 - protein, 64 aa, Lactobacillus paracasei
MTARRKTYLLWLALVTFVAIMNGIFKNSLTQVLVMVTACYALYQLLKMDHVFDRKKRRENRASR

SEQ ID NO: 2158 - protein, 226 aa, Lactobacillus paracasei
MSTIDQLRTLNPDKTIHSLDEAAFADYGVTYAQYDVSELKAFMDQHVTIPAPSEANLYVPSNSDMEKIPVVQQIGRDVYAGLPIEAGECAGHAEALTAVEFHQGSEVNVFFTDVVMVIGKRGQMHDDQFNAEKDAKLFFVPAGTVVEFFSDTLHYSPCEAHASGFKFIVMLVRGSNQPLPADYHTDNKLIVKQNKFQVVHASRTDKIKQGIQVGVTGELVRVKHLN

SEQ ID NO: 2159 - protein, 312 aa, Lactobacillus paracasei
MILTVTLNPSIDVSYPLEHLKIDTVNRVKTVRKTAGGKGLNVSRVIHMLNHEITATGFIGGYFGKWLENQLDRDGIDHDFFPIDAETRSSIAMLHDGGEQTEILEAGPTIAAEDAEKFLSHFDSLLDKSDLITISGSMPQGLPADYYTQMIAHAGQKNVKVLLDTSGATLKSALEAPVKPLLIKPNEEELGGLLNRDVDKTDYTALKHDLMDPIFDGVDWIVVSLGAAGAFVKHLDKFYHAAIPKIKVVNPVGSGDSTLAGLAMGIHDGKSDEDIMKTAMTTGMLNTMEAETGFVNPGKFDEYFAKVTIESY

SEQ ID NO: 2160 - protein, 333 aa, Lactobacillus paracasei
MTVNLTAGQYKHLQQLSDDNNVISALAIDQRGSLKKMLAAAANKPADETTIVDFKKAVSEELTKYASSILLDPEYGLPAAKVRAPQAGLLLSYEKTGYDATEPGRFPDLIDDQSALRIKNEGGDAVKFLLYIDPDEPEAINDRKYAFVERVGAEAKANDLPLFLELVSYDGTLNETGTAAWAKVKPDKVIKITKEFSKPQYNVSVLKVEVPVDQKFVEGFTDEGVTPVYTKEEAAKYYKAQSDATDLPFIFLSAGVSNELFLEELKFAKQAGSTFNGVLCGRATWKPGVKPFAAEGEAAGKAWLETEGKANIDRLNKVLAETATPWTDKVEHA

SEQ ID NO: 2161 - protein, 172 aa, Lactobacillus paracasei
MIIAIGNDHIVTMQKIEISNMLKDMGYTVIDEGTYDTHRTHYPIYGKKVAEDVADGRADLGIVMCGTGIGISTAADKNDGIRAAMCDDVTSAVYAREQLNANVLGIGGATVGIHMIQDIVKAYLDATYKETPENKKIIDKIDNIAKPNPEQKDNPHFFDTELEKWAEGVYHD

SEQ ID NO: 2162 - protein, 142 aa, Lactobacillus paracasei
MDVIIGADKDGFAMKEQVKKYLEDHQYRVKDMTPEPAEDFVDSSLAVTKELLSGDAHKAIMFDRYGVGSAMASNKVKGMVTAVVEEENTAHMTAEHNGAKAIAIGTGITGYDRALVIIQRYLDTEYAGGRHQIRLDMLEKMI

SEQ ID NO: 2163 - protein, 258 aa, Lactobacillus paracasei
MLKDERLLTIRNLVDRKGIVTVNEIGESLGVSTMTVRRDLEELADQKELVRIHGGAQSTNFKPLTELSRNEKRSIHVNEKRKIAATIAALIIPGDTIYIGPGTTNEMIAQYLKKPDVRIITNSLPVFQSFQDRADFFSLQLIGGRLRARSGAFIGSLANEMLAHLTTTKAFISVNGIADNHISNASPEEGQTQRIALDNAGMKLVVADHFKLNRQDFYSFYDLDQTDGLITDPGISRDDLQHYNTFTHVITDKTNKGE

SEQ ID NO: 2164 - protein, 208 aa, Lactobacillus paracasei
MNTFIFDIDGTLLDNVEAYLYGLQKTLRRHGREVPIHELTWTNGRAGVDSLAELGFSAAEIPEVHEQWREDSKEFLTDIAWFPGMQHALNQLKQTYKLGLVTSKDKTQFIEEDKKFHFSPYFDAIVVAGEAKRNKPFGDPITLARERLGSEPASTIYIGDTPTDAQAAADAKVAFALAGWTTPPSNEVMPRVAVLQQASDLLTLPTLA

SEQ ID NO: 2165 - protein, 373 aa, Lactobacillus paracasei
MRFLHTADWHIGKKLNDFDLLEDQQAVFEQLVETAETHKVDAIVIAGDLYDRALPSEAAVSVLDNMLIKLNRDHGYPLLVISGNHDSAVRLRTGRAWYSATKMFVNTQVAEAFTPIELDGVQFFLLPYFEPFAVRDYFQDKTITNVAQAIRPIVAKMKTLFKPDMRHILVSHFFAAGSDHSASETKVNVGGLDAVPLDDLAAFDYVALGHLHNHHALHGEPKIQYSGALLKYTVSEAHQEKGVYIVDTETMDREFVPLKPKHDLIELKASYADLTAPAYYQQQDRDAYIGIDLTDTQVIPNVMAQLRQIYPRIISLRRENGVNAVKPLQERQRDLDPMSLLQTFFKDMTQDDLSAAQIKWAKAGLTTAKKEQK

SEQ ID NO: 2166 - protein, 1041 aa, Lactobacillus paracasei
MQLKQLHMQFFGPYADAVVDFDDFRTSPLFLISGPTGSGKTTIFDALIYALYGETSGERDGGQMRSNFAGNSDLTKVTLTFDHDGKHYLIERQPPQLQSKKRGDGLTEVKAKVLLAISSDEKQVAEYRKKNQVQEQLDAVLHLDASQFRQIVLLPQGDFRRFLDADSNAKEDLLRDLFGTQLIQRWQTAMLAQMKAKGAAIQDQERMLDVLMSQFDFETAPDEHATMADKLSLMRATVASQAKVVTARQATAAQSHQRYQEAQTALQQGQQLAQAFTEREQAATALAKLAEQKQTHQKQLKQIEQLTWVQQHENAAQRVQKAGQDLKAAIVQSEQTQAALTTTKQKFSLDKQALARLQAKSDQIEAQKKQLNSLQAVQQQLTAIAEQNKQVIKQAAIVNEAELALTHAQQQLTDAQTVKTQQQTSLDNLGLDELITTVNTQRNLLAALVPQAANYQEAQADVAQLSMAIKKTQVTLEQAETQVAATTSHLNKLQQTQIRQQIAHLAAKLEPDSPCPVCGSTSHPHPALVVDEPLVSEAALKQADQERQKAAARKTMVETQLANLETQLKTAKAKTAQARQAFTEHWQEQAKLIAGVADKTGILQQLTALKTLAATNEHQLTEAQTKHAALQVALKKSDKAITTGTTKVQQCEASLNTARIDAAEAQSALKTMQKNLPAEATDLATVAAQATTLQTTITTYQAQLQEAQARVNALDRQLAGLQADEKHAAAQVTALTKEQAEAKATFTIAVTQYFGADGKQRFAELQLRVSQLPLLNEQVQTYEHTQLKQQTLLDAANKTIGTQAQPQLDQLEAEATAAETTATNDQTALIKISQAHDAAEKLAKQAATIFTANQTALAAYADLQTLATVMNGNGPKKLSLERYVLQAYLQEILNVANSRLQVLSNNRYQFVLHTSLGTQKIHSGLEIDVYDDQVGEKRAVQTLSGGESFIAALSLALALGEVIQQESGGINIDALFVDEGFGSLDANSLDVAMNALESLEGESRLIGIISHVTELRYNIPDQLQVEPAGTGRSRLKILHSA

SEQ ID NO: 2167 - protein, 47 aa, Lactobacillus paracasei
MASLSKEQKKALIAKVEKERQDHPEKKSKKSGFETIDEEAERLESEN

SEQ ID NO: 2168 - protein, 158 aa, Lactobacillus paracasei
MANEVLNRRNNELMNNVNDPFFDNLARRFFGPVSDWMDWATPAITSTAVNGLLTDVKETKDAYEVHVDVPGIDKNNIKMNYHDGVLSINVHKDDITDHADKNGNVMMSERNYGTMSRSYQLPNVDASNIKAAYQDGVLNITMPKLTESKESGHNIEIQ

SEQ ID NO: 2169 - protein, 77 aa, Lactobacillus paracasei
MLRFLNGSVYALQKNHPNDHTYRWDDFNDSMITATAAILIDFCLLTHGFCPLTAEVPLLFMLAMQSVNLGSADDEHY

SEQ ID NO: 2170 - protein, 368 aa, Lactobacillus paracasei
MMTNKLMNWPPEKVAAFQKALLNWYDQHARQLPWREDHDPYHVMVSELMLQQTQVQTVIPYYERFMNQFPTVGALAKAPEAEVLKAWEGLGYYSRARRLQQAAKQIVADYGGVWPQTSETLQTLSGIGPYTAGAIASISFGEPVPAIDGNAFRVFARLFKVDADIARPQTRQLFFDLIQPLMPKDRPGDFNQAVMDLGSSYMSANHPDPAHSPVRDFDASYRDGVVSAYPVKTKKPRPVLHRYFALVIRSEKGYLLEQRPSTGLLADLWMFPLVDMADLESTMMSAQLDEVSTLFAASSGMQLTFADLGAKTVKHTFTHQQWQLTLIGVETAASDLSFLPARWVKADHFSELALPTVQKKLNAALGMN

SEQ ID NO: 2171 - protein, 261 aa, Lactobacillus paracasei
LTVNVTRDIAYGDAALQKLDFYEPEKSNGAAILDIHGGGWFRGEKNKEGEMAERFAALGYTVAVSNYRLAPEAFFPAARDDVLAAFSWLREHTKGLQLGVFGSSAGGSLSVDVGLAEGVPTVSWSGIFDIRQWFADHPAVVAQPDTKTDFVKTASAKIDQGGRNDPFYKWFILNYVDSDETKFPEVEPFDRLTAQAGPLYLANSQEEIIPISGIYQLAHAAEKLGLPVTLQSIPGGQHAEGYLDEAWQGTVAFFAQYLLKG

SEQ ID NO: 2172 - protein, 222 aa, Lactobacillus paracasei
VETLVVVSHPEIEKSDTQQFLKASAASLSQVVWHHLESRLPFDVTAEQQAITSADRLIFQFPLYWYMAPASLHQWLTDVWLKQFVYDARGGLLHGKSLGFVVTFSQPATAYQLGGSVGFSISQFLTPYAALAAKTGLTLLPPLTIAQFANQTDLEHQQLLVRYQQYLTLDHPDRPDEQAQWFIDRLSGNADTQLLADQLAAQTDDIDRLRLTLHELKAGESE

SEQ ID NO: 2173 - protein, 59 aa, Lactobacillus paracasei
MTTDEQWLVNAAAVQEKQATSYENAAFFRALQAFVTQQAKRRESLEGEIDGRSWNHEQW

SEQ ID NO: 2174 - protein, 174 aa, Lactobacillus paracasei
MQTMFDRLQRWSWLRGLLMILIGAWILIAPRQVYRSFLWIVAAVLIIAAIPKLIDGFSARKASGTYGTSLFTGGFYLLLALMVPVIVRPLMSLGPLLLGIVLMIYGVNKILSARNRQQFVNVSVWPTVIYGVVLLIMGFIMALNPFRTVMMVFSFFGGLLVAMGILQLFTRPRA

SEQ ID NO: 2175 - protein, 210 aa, Lactobacillus paracasei
MHKFDWREVERDEYSRSEEPSFVKLTTRSYITAMGVAPDRVTDQAFTSLAAAVTQIAERISEGPDAGIDIPNFKAYHPYPLQAVWSGGDKISKRHIFRLWLKQPLFIHEDQFEAALTQLHFEPAIAQQLHLEQLAEGFEIQSFNSTPLTDEAPAIARIQTVINRDHLVPKFDDRHREVYLEGYQGEVPVLYRVPLDENFGEVGDEQVAYN

SEQ ID NO: 2176 - protein, 273 aa, Lactobacillus paracasei
VANEFPQVMTIGGTDSDGSAGVQADLHSFFMRGVYGATILTAAVAGNSYGIQDSMVMPLPFIDAQFKSLAADLHIRAAKTGMLADRALVQNIIKNWQQYDFGALVVDPVIITKHGAMLLEQDAYDAVKNELIPLATVVTPNHYEAEHLTGMKLDTDAQTEAAAHQLQDSGAKNIVLKGAHDDPTQPTVRDFVLLESGKSFWLSEPYHATDRVNGTGDTLSAVITAEIGKGNSVEEAIRIAKRFTNQAIGHPIAVGHQYGPINHWANKIVYPQF

SEQ ID NO: 2177 - protein, 353 aa, Lactobacillus paracasei
MLNLNDAHLAALITKPLTVAQARQQIGTAYQQEADHLANSPLWESNDEALTALLASYTNLLGNKLYQALQNLTSIPTPFLQTLWLQDTTADAHHSEIAVIQTTQDDNNTLLTIVDPLSDDAKLKAVNLPTLLQITAADSNAMTYDAETVKALSALAKALNQGGYRFTTVDETVLQPVNGLSFKTRFDNLKPLVAKKAVIKAGDFSIGTSLDQDAKVLGYQVLDEDGHDWQDLGSEEVKNDRFEWASTTVPQELVNHRLKLIIRVSAGSNSPALDELFVIASNNAILMRQGAKAGVYELPLPNQKIFTVMINPANNMVYLKYPDPETQIIELNHQYPFIGEWLKAVLPQKRAFN

SEQ ID NO: 2178 - protein, 276 aa, Lactobacillus paracasei
MSIEASLTYQKKFFNDFTDAWHKKSRYRLYQGLDATAENLRLDIEETPGYILAYDKNAQAELHDFLQIGLIDFLRQHIPFFEVNDQGTVYFGNWYHRREFGHINVILRAITQSADEQRRILPQLEAFSDDPDHYLDRQLDAMRKEVYRDVDSLHTQIDNLEAENAPERGQATQGNSGFRGLLKNFIDPSDDDQASPSQPSGDASRLKAQFDKEKLTADDIFDKRKRELEVSAAITRYEFQAVMGTYSSVAEFENILANLKDDFMQSLKLEGGRTHA

SEQ ID NO: 2179 - protein, 216 aa, Lactobacillus paracasei
MKIAVLGATGRAGSAIVAEARRRGHEVLAVVRDPQKAADRLGATVATLVKEPLVLTEDDLDSVDAVVDALSVPWGSGRGYLHLDFATHLVSLLRNSDTLAVFILGSASLAMPGADHPMILDFPESAASQPWYDGALYQYYEYQFLQMNANVNWIGISPSEAFPSGPATSYVAGKDTLLVGEDGQSHITTGNMALAILDQLEHPTAIRDRIVVRDAD

SEQ ID NO: 2180 - protein, 795 aa, Lactobacillus paracasei
MGVVVSNFHLAKITAEEKVKLTSGKDFWTSEHLADKGIPSFRMSDGPHGLRYQALAADHLGINDSVPSTSFPTASASAAAWDPDLIQAMGKAIGLEAQSLGVDMVLGPGVNMKRNPLCGRNFEYFSEDPFLAGKLGAAWINGIQSQGIAACLKHFAANNQENDRLSSDSLVDPTALHEIYLEAFRIAVTESHPEAVMCSYNKINGTYASDNLYLMTQVLRQQFGFGGAVITDWGALNDKVAALNAGTDLEMPGDDHLFDGEALQAYQQGTLKLASLDRAVTKIAEIARKQRPKFQGSREQLLQANGQLAQKIAESAIVLLKNEAAMLPLQATDTVAVIGELAKATRFQGAGSSHINASEIVSVLDGLKQKKVSFDYAAGYRLDDQDDSQATAEALALARNHDKVVFVAGLPDNYESEGFDRQNMALPKVQNDLLQAVTAVNPNVIVLLVAGAPVELPWVDQVKAVVNLSLGGERIGAAAANVLTGAVNPSGKLAESYPLKYQDVPSADVYDKNPRSVPYVESTYVGYRYYDKAKVQVAFPFGFGLSYTSFALKNIQLSSDHVTDDQPLTISLQVTNTGKVDGAEVVQVYVQEQQPRPLRPEKSLKAFKKVFVKAGQTVNVALELKAQAFKEWREQTQTWVLPEAQKAIAVGTSVTNIDAVLPVSFTGETFNNFATIPNWYTTLSGKPSVQDFEQLTDQKVPAPHEFVPGEFTRLNTPREMKKHSLLLRLVAWITVKIRTKDYIDKQGPEAKFQQAIVLDTPLIRLAQQASGALKLSMVDRLVAAANHQYVKMIFR

SEQ ID NO: 2181 - protein, 318 aa, Lactobacillus paracasei
MKKHRLLVIATAALVGLTLIGCGKKSNAASSKTVKIGILQLIDQSALTEARKGFVAELAKAGYSGDRVKIDYVNAQGDQANLKTMSDRLASDKNDVNLAIATPAAQALQQADKKTPMLFTAITDPKSAGLVTNPTKPDKNATGVTDLVAVAKQIDLLHQTFPEAKTVGLMYNAGEPNSVYQIKQAKARLKQLGLRYQVRTAATTNDVQQAAESLAKSVDALYLPADNVMAAAMPTIGKVAKAQQIPVVPAASTMVQDGGTITKGINYRDLGKQTAKMAIKLLKGKTVKTLPVEKPAKVETVRNEAMLKAVKQTVKLPE

SEQ ID NO: 2182 - protein, 322 aa, Lactobacillus paracasei
MKIKRMAAIAAAALTIMVLAGCGKSTSAAADKSQVKIGILQLIDQQALTAARKGFTEELAKAGYKGKKIKLDYVNAQGDQSNLQTMSQRLQRDKNDLNLAIATPAAQALQKADSKTPLLFTAITDPKAAGLVTTTAKPDKNATGVTDMVDVAGQIDFLHKAFPKAKKVGLLFNAAEENSQVQIKLAKAAIKKLGLTAVEKTAATTNDVEQSATALMKQSDVVYIPTDNTMAASMPTIGKISTKENIPVVTADATMVKLAGVATVGINYEDLGRQTGKLAVQILKGKKVSDLPVEKPAKTRLVTDSTRMKQFGLTEAALKQAE

SEQ ID NO: 2183 - protein, 323 aa, Lactobacillus paracasei
MDIVTSSIAQGLLWSVMAIGVYLTFRILDIADMTAEGSFPLGAAITAHAIVTGVGPIAATLMGFAGGAAAGAVSGFLTTKLHIPDLLTGILTMTGLYSVNLFIMGKANISLIGTVKTVFNLVDSGDATTTGIIIGAIVVAIVIGILVFFFHTEMGLAAAAVGNNQNMAAANGINNDAMKIIIYMLSNGLIALSGSLMAQTNGYADLSMGIGTIVIALAAIIISEILLRGVPLWARLLMIIVGAVIYRLIIAVVLDLGVDPNYLRFFYALMLTIFLSLPLLKKKLQLMTIRHGNRRQARIVQAQMQAAKTDSMSTHAGDQQKEV

SEQ ID NO: 2184 - protein, 267 aa, Lactobacillus paracasei
MAVLEVHGLHQYFEQGTVNENHALKGIDLSLERGEFVAIIGGNGAGKSTLLNSIAGTLPVSQGQILINGKDVTYQNVAKRAKVIARVFQDPRSGTASLLTIEQNLALAEKRGSWRNFWASGVKRSDRQHFKEKLATLGLGLENRLGAEMGLLSGGQRQAVTLLMATLKEPALLLLDEHTAALDPQTSATVMALTDKMVRAQHTTTLMITHNMASALKYGDRLIMLDHGEIAVDVRGEEKQHLTVEDLLTMFKERSGQEFADDAVLLS

SEQ ID NO: 2185 - protein, 319 aa, Lactobacillus paracasei
MQTFQALVHDGQKATFQTLHEDDLPAGDLLIKVAYSDINYKDALAYQPQNQIIRDYPQILGIDLSGTVVASQDANFKVGDQVLASGHGLGVSQGGGYAEYARIPASWAISLPSAMTLASAMSFGTAGLTAALCVAALTAHGMTPEHAPQILVGGVTGGVGSVAMRLLEQAGFTNRIGIVRTPDQQKQVMSLGATATLALDELPKGKTLSKQRFDFAIDPLGGSFTTSLLPSMRYGGAIALCGNAAGTALPLTVFPFILRNVSLLGVDSVNAPAAARAAAWQTLGKLAPMPVDTVKLADLPQTLTKHFNHHTTRTIVDMG

SEQ ID NO: 2186 - protein, 887 aa, Lactobacillus paracasei
MTTTTKHLTRLTPSDLAAELTTNTKTGLTAKEAAARLQQNGRNQLTAAKKPSLLRQIGHHLSDITSLILLFAVGLSAYLALTTDSDWTKTIVIGAIVILNVVIALYQEHSAEKALAALKAMTIQTVTVVREGKTQTIQAAELVPGDLILLKAGDAVPADARIIQSQELEADEAILTGESLGVTKTAEALATAPDDLGDAANYIFSGTAITSGKATAIVTATGMDTELGKIAALLNQTKKQTTPLAKRLNTLGKRLSFVAILGGIITILLATLLHQEGFTDSLMLGVSLAIAAVPETLPVIVTLSLAHGVQKMAKRHAIIRQVTAVETIGNVNVIASDKTGTLTQNRMTITHFWPYGKEIHKVAKTKLSANDTRFFKYLGLATNAHLTADDEPDIGDATELAIVRLLDHYDLSRTEAEQTYPRVAEAPFSSDKKTMATLHRTPDGHYLAIIKGAVDRINFAPENWEQTATAIHDQMTAQALRVLAAGYQQFETDPGENWETQLTAVQPLGLIGIIDPPRPEVPAAIRAAKQAGITTVMITGDHLGTAKAIAKDIGILESGQQAITGHDLSQMSDEDLAANIADIRVFARTTPSDKIRIVKAWQKQDAVVAMTGDGVNDAPALKAADVGIAMGITGTDVAKNAADMVLTDDNFATIIDAVAQGRTVYQNILKAVEFLISVNFAQIFTMLLAVLVGWGAVMTPEQLLIVNVLADGIPGFFLSRELAEPGMMHLKPIPKAASIFSNGLGKRVAVRTTTYVGLILGIYFVGRFVVSPDVPSIGMTMLFLTLAIGSMLDIFPIKTRGRLNWSAMTVNPILTGSLLLTMTVIVALATIAPLQQIFQLAPLTVGQWAIVLGAIWLPMLVVETYKRRQHRHELAPWRQATLSDSAE

SEQ ID NO: 2187 - protein, 325 aa, Lactobacillus paracasei
MRQEKNPFISIVLPVYNESAGIGETLTVLANYVRARPERYELIFVNDGSTDDSADQIRAAMAKNPAIRLVDFSRNFGHQLAITAGIRYASGDAVVVMDADLQDPPRVIPEMLARWREGYDVVYGKRRKRSGETWFKKLTAEMFYRLLKAVTSINIPVDTGDFRLMDRRVVNVLKQMNEQDPYVRGMVTWVGYKQIAVEYDRQEREAGETHYPLRKMLHLAMDGITSFSTVPLTLASWLSGFFLIIAVALFGLSLALGHLTSLTWVMIITLLVGAGITFTIGMLGTYIARMFAESRHRPLYIVADTYGFKTQTTQQTSYPYHALQN

SEQ ID NO: 2188 - protein, 716 aa, Lactobacillus paracasei
MKKIKQWTVDWWFIGILILAAFLYAWNIWEAGNANDYYTAAITSMIQSWHNFWYGAFDPAGFITVDKPPVALWFMAISAKIFGVHGWSVVLPSILFGIGSVALIYNMIKPRFNIWAARLTALALTLTPIVVADSRTNNMDATLQFFLLLASWCLMKAISNRKPWLVVVSFALIGVSFNIKMLQAFMILPALLLFFWLASNQKLWRRLGTLAIAMVAMAVTTLAWPIQVDSTATSQRPYVGSSETNSELELAFGYNGTERLLGQTTGTGAAFPGMGTKSKTGSTGTAGTPPTGAKGTAPGGTTARKPTGTPGAGNTGKTPPAGTKMPGTKTGAAGKQPAVTTERGAGTGRKMPANFKKGTFKGGTRGRQGSQRGGAGGAFSIGTVGPLRLLQSDLGPQISWLLPAAIIGFISAFAYYLDRKRKWYQTTIQQNHLLFWLGWLIPVAGFFSIASFFHPYYMIMLAPPIAALFGIGTVTMFKQFKTDLKHWQAWLLPIAIVVTTGLQAWYVSLYYQWQPFLVIAGGLLGLILLFIGRTKAWRKTALGVAIAAIMAAPAFWSLTPTIAGSSAGIPSAGPSLLSSSGNGGLGNGTADSGLLKYVEKHQGNAKYLFATGNASTAAPYIIKSGKAVMAIGGFNGTDPAITLKQFKALVKKGDMKYYLSSGRSGNSKIEAWVTKVGKKVAASQYGGTSSSSTQGFGSRGGMGGGTLYELDASMVK

SEQ ID NO: 2189 - protein, 135 aa, Lactobacillus paracasei
MRQKLKQFIGFGLVGGVNTILTYLIYLTLYQLINPTAAMGVGYGLTSIFGLFLNDTWVFKARDRRQLKTVAPRYYLSYGLTFILSLVLTSFWNDFLRLPKPLAPMFALMITVPTNFLLSKFWVFREKGVAAHEKN

SEQ ID NO: 2190 - protein, 231 aa, Lactobacillus paracasei
MTVKPRILVIEDDPDLNESITDFIRAFADPEAALNGADGLYLAEEGIFDAIILDIMLPELNGFDVLKKLRAKQIKTPVLILTAKDALTDKLHGFELGGDDYLTKPFHREELIMRLKALLKRTGHFFDDDGLTAGPFVVHVTSHEVLINDQPVALNGKEFDLLVYLLQNQKTIITKDQIFDRLWGFDSETAVSVVEVYMSNLRKKLKPLKVEHWIKTIRNVGYIFQEPEGSE

SEQ ID NO: 2191 - protein, 431 aa, Lactobacillus paracasei
MNAEKGIKHQQRRLFIGQLLSFAGLFVVLGIIVFFLYERSIYQDIDHTLEQQQAMILNPNEETTKLGPQQPGTRVTHPAPFRTNMVVFNQKGRIINQAMLGERFYAYFKNLKLDRSAQNKLQTLTTSTGTFRTLLIKAPKYSADPQYAGHYVLILQNTDAQEAAIRSFRHVLIVTIILFWALALGLSYWLSTRAMRPIVRSWQRQQDFVADAAHELRAPLAVIRSKQEALLTKPQATIIDESEAIATSLGETKRLRQLTDDLLTIAKADSNTIEIELVDQPFEKAFEPQLSSYQDIAVSQQKSFTTTLPKAGHALFDTARMKQLLVILLDNAFKYTQAGDSIWVEVTQTPRDWQLQVGNSGPSIADADKARVFERFYREDASRSRQTGGSGLGLAIARWIVTMHHGHIEVKDVHPHGALFIATFPNKPRMR

SEQ ID NO: 2192 - protein, 126 aa, Lactobacillus paracasei
MQIHFDEGATEKIQPHLGDDKKLLLTFEDGVGPYSQHAMIHMQVQFSLNVVKASDPATDYDTEIDSNLGPILIKGYSQEDLNAHMNVHFNKTLNTLVLSGDGGDIDTNMGFIDFTEANGVRNNPAR

SEQ ID NO: 2193 - protein, 494 aa, Lactobacillus paracasei
MKLNTLLQRLDQTVPLAFDTSLQNPEITSLQFDDDTTFSPHPTSLYLAVSADQTITLKGSVGKTAQLSLCAQTQLKNESQLAQLFDRAGCLLTSETSLQAQVNQLAIKAITEDFDTILNQASRTLGNPLIVLDLVGQPVAQSTQAPAISDLTAPAITSVQVQQALKKFRPAKDLIPQVILIQQSQLPLLLLCLPLAYRNNALGYLVMPACVRPLTAEQTAFFKAEAKIITSSLIKNRMMPTAASKRDQLLTMLLTEQQSGTFAAQFAKEHATLPTSMVLIKGEPRAGQSLAALKERLKYLLTPLFSQTLITLYHHQCLALVSVDLPTYNNPEFKADLATIADRANCRLIVSNQYTRPEDTIAAYAVCSRTAKLKSQPTHVTMCEDAFFDLMRAQVDHAEILPFFINPAVKALMDHDAENKTELLPTLDAYLESGENLTHTARQLFIHLNTLRYRLKHISDITGIDLKDAETCFKLGASFKVRRYLNHNKLTFTR

SEQ ID NO: 2194 - protein, 286 aa, Lactobacillus paracasei
MKDFKDKVMFITGAAHGFGRVIAEEGAKRGMKLALVDIDKPALNETYQIVVATGADAVMIPTDVTKEDEVNAAIDQTLQTFKQIDLLINDAGIALPGRMWELPTRDWEWIMHVNVMSQVYAMKRIIPIMMAQKTHGAILNVASIAGLVDTPGMPAYHASKFASVGMSEATAYDLQRAGADIEMHVMCPGFVQTDLYHTEEHRPKQYSDPSDPYYQSEAFLKGQQFAKYVITNGMPLDTIAATVFKALEEDQFYILTHPQFNPLILDRVNRIVKNGAPDVHVMDGIM

SEQ ID NO: 2195 - protein, 108 aa, Lactobacillus paracasei
MSSYVVSQEDVKNFLNLPSMNDQEGISFAYATDPDALAKLIPAPLKLVAPVVCGYVVHMGKPSFGGPYLEQTLFALVSYKDKMMGSYPLTLLLHGPGAEAGLVAGRYS

SEQ ID NO: 2196 - protein, 184 aa, Lactobacillus paracasei
MALVLKPAWWQAGIPKKLADHIELRRNDNSASATVERHGKTLLSVDWEAGDVNDPSILQTFGSQFALNKESEMNSFFFPHDLVQDKQGANHFENVELVATQMKSLADRVEPGKLSIQLASTEDDPFGELLVLKPLGAMWYHFATSTMFNTLHLEQVDADKTAPYLITGRYDRSMMNPLATTYII

SEQ ID NO: 2197 - protein, 219 aa, Lactobacillus paracasei
MTETVATKKLTNNDFADVMFDRHSVRVFDPSVKISRDELQEMIKEATTAPSACNLQSWHFVIIDTPEGKEKLKKSAMKFNYPQINSSSAIIFIAGDTQSHEVYRDVWTKVYEDGKISKEKLDQIFNTFLPLYENASPEFLTLDATIDGAMVGMQLLLTARAHGFDANPWSGYDFKTIIPTLGLDPKRFVPVMAVAIGKAAEKPIHTDRYDVKQLIDYLD

SEQ ID NO: 2198 - protein, 368 aa, Lactobacillus paracasei
MVDAVETDPFGKVDAIDVLDLASLEARAEKILGRGEFGYISEGSDDGYTMRRNTTAFTDVQMLPRVLQGVEKPDQSTTFMGARLASPLLTAPIAGNTLAHPSGELGLAKGAKEAGIMMSQSTFASKTIAETAAVSDGAPYMFQLYMPKDWSYCQYLLDQAKQAGALAIILTADSTLGGYREKDVMNHYHLKGRLANLEGYNTGQQGVGAGGLFKESMQKLDLATIDKLASYSGLPIIVKGIQHPDDAVAAITAGAAGIYVSNHGGRQLDGAPGAIEALPAIAAAVDHRVPIIFDGGVQRGTHVLKALALGADLVGIGRPFSYGLALGGWEGVKAVADHMKMEINIAMQLTGCQTMADVKQMQIKTTFA

SEQ ID NO: 2199 - protein, 345 aa, Lactobacillus paracasei
MDTITTYLDSLFASLPDNDKTRQAKADMLANMRDYYRDLLREGKSEEAAIGAVISAFGSIDELRADLGMPAQATATTTQSDPTDAEEEADEDAITETELRSFWHMADQFATQIALAVLLCAVSIALPAYTGGGRWEGFGVIGMFLLAALAVGLFIWGGTVFSQQKKQLNDRPITASAKQLANKTTGEYTRQFAAGLIAGIMICIGSLIPPIISAYIPGFISENAGGALFLAIAGLGSYLIIYVSINYSQLKRYAYATTAANSTAWYNVTADDATHWSQPHKHHQNSRARQDIALLHQVYWPAIFVIYLLASFVLGGWAYSWLIFIIGGFFENIFTALISRRDYSK

SEQ ID NO: 2200 - protein, 112 aa, Lactobacillus paracasei
VISSDAMRGYNDALILAILQQGDSYGYKIGKEIRERTDGQYLIRETTLYAVFNRLSKNGYIDDYPGDVTNGKPRTYYRITPSGRNFLAVKAAEWERVKTVVDPFLKQPLTNL

SEQ ID NO: 2201 - protein, 101 aa, Lactobacillus paracasei
MRVDTGKYPEGVDPVRVKRLKLLSKVATFTCILMYVSYIPEIIANFSGNPVNPIQPLVAMINATLWTFYGWTKTYKDWPIIISNMPGILFGLVTFITVFIH

SEQ ID NO: 2202 - protein, 99 aa, Lactobacillus paracasei
MAEQSENTVTRTQKQEGADAIMDKGYVTERDIPEMMSKTWSEQLLDAVNDELRLRTVTNRTVLQQFHYYMGNGTIIYDPGQLNSEGAKIALQHALGFRK

SEQ ID NO: 2203 - protein, 340 aa, Lactobacillus paracasei
MTQNLAIGFTEGLPITAPNSLQQFTLPMPQPQSGEVIVAVAGVSVNPVDTKRRQVAGKHQTPQIQGYDAVGTITQIGANVTGFKPGDRVIYAGTTHRPGSNQQYQAVDARLLAAAPADAPDADLAALPLVGLTAWELLFEKMGFIPEFNANKGQHLLVINGAGGVGSMLCQLARWSGLTVLATSSPKNHPWLLDHGVATPLDYHQDLIAQVQHAGLQTVDGIALLYQPEPYLAAASQLIRAFGHIGCIVGPQTGLDLAVVKDKAASFDYEYMFAKTDFDYHVASQGAILSRLVSLYQDHQIKASVTKHFDTISVDTLKNATALVEGGHEVGKVVLTGPFA

SEQ ID NO: 2204 - protein, 41 aa, Lactobacillus paracasei
MVLAQLAVDKSAGYEPLIVILPVTIMKTACDAAAFLSRRSH

SEQ ID NO: 2205 - protein, 120 aa, Lactobacillus paracasei
VKKLGTKRELIGVVIVLLLAAVGFALFAWYTMRPTDTIGTIATISFGLVLSALIGIVLILDTAATTRWRRFWVDLLFAALMLTLIDYFFLDSTAPWQMLVAGAGVALAIVALLAIRKIDE

SEQ ID NO: 2206 - protein, 159 aa, Lactobacillus paracasei
MNNFNVFLIGLDVILMALAGYYLYWQSKIQVASRYAVTQLMWAVFLGFWFMTTRVDNLPYIVFISIFLVLSIMAGTGGLAPTRLIANGILARVIPYANMSSITLTPVSLPNGQEWVVAVFALSKRRMVRLTFQASLQNFMTELTKVLPKTVPVTVQRMN

SEQ ID NO: 2207 - protein, 388 aa, Lactobacillus paracasei
LKHTDSWLYRRFLNSKFMILLVDLLLALLVIFVFTKIAWVFQPVLDFLGIIAPPFIFAGILFYLTVPIINRLEKFGLHRGWAIGLLFIVLIGLLAWGLLRFIPAVSNQITSIVHSAPQIFDEIGKWLDNLNDQQNILSQHDLNEIAAEVQSFFTGKQGAFVTGTISQLQNLIGIVGNVVITISTAPIILFFMLKDGDKFTPMVLHIVPTKLRRSVKQMLHEMNEKVGSYVQGQITVALCVAVMFMVGYSVIGLRYGLIFGLLACPLNLIPYFGSALAMIPPLIMGALTSPRMILAVIIVFFIEWLIETQVISPLVMGSKLELHPITIVVVLLTAGNLFGLVGVILGIPGFAVLKIVVTRFFSWYQQVSGLYEAEHATDDTKQKGVPHE

SEQ ID NO: 2208 - protein, 64 aa, Lactobacillus paracasei
MTILRGAKWTLITLTLVATLLLFSNFATAGILLIALDIFLSFFYAVIKSRCDRRQMHKMPLLHN

SEQ ID NO: 2209 - protein, 208 aa, Lactobacillus paracasei
MPTQASQKRWKQILQSIYDAIEDHGYPPTVREIGKSVGLSSSSTVAAYLEKLLAAGLIAKDPAKPRTLEVTSAGRDFIGVQDHGIPIVGTVAAGVPITAIENIDDYFPVPDDLPYAADELFMLRVQGNSMIKIGILDGDQIIVKKQNDAENGQIVVAMTEEDEATVKRFYKEKNGIRLHPENDSMDDMFFPDVTILGIVVSLYRPALV

SEQ ID NO: 2210 - protein, 157 aa, Lactobacillus paracasei
MKKRYLLLAAILILSGCSQTTSTPKKTTSSSSATSQSHTVKKAVPKATLGTLVGHAFVQTKDATKAIRVTSSTSGYYLETLANRDGVFESTDSGIFAADLTLKGRIFTFTGKAQPQASANTIQFQLTKTGNLKQLPDGPVYKKVPQDDLDRLAQQNQ

SEQ ID NO: 2211 - protein, 315 aa, Lactobacillus paracasei
LTAFISSVFGVLEILILIAIGYFLTARGWFNDHSSKIIAKVVTQVALPAYMIVTIASKFTAPMLLRLLPDLFFPVLSMMILFALSFLVCYLLKVPHARKGTFKSMFFNSNTVFIGLPVNLALFGPSSLPYVLVYYMANTTIFWTIGVYLIQGDGPRPAKFDLKKALGKVFSPPLLGFMLGIVLVLLKIKLPTFLMADLTYIGALTVPGSMFFIGIALHQAGWGKLRISKEALGIFSGRFLFAPLLMTALVAFAPVPTLMKQIFILQSCMPVMTNAPVVAKLYDADSDYAAIMVTETTLLSMIVIPIVMTCIQFIH

SEQ ID NO: 2212 - protein, 205 aa, Lactobacillus paracasei
MFNLAAADLSARDQYKLLAGSIIPRPIAWITTQNTTGLINLAPFSFTTGISNQLPLLSVAVLRDRGQAKDTAANLLARHEAVVHIVSADLTKAMNQTAARLAPDQSELSLINLPLVASTDIQVPGLQAARVRFETKLYQYVPIRNADGAILTDLFILEVQRFHFADTVLDPTTLHIDPTALAPIARLAGPTYAELGRTFTLRRPK

SEQ ID NO: 2213 - protein, 302 aa, Lactobacillus paracasei
MRRERIRKNRRTLYLTLTGIGTAVIFVAVFMWLVLRGAKVQGPVASSSSSVSSSVTVTHPFNSGTYKASGTVIDLDRDQHDLTVYVKLTDDQTYTRLLILDPHGHPFVVNDTGSFKRKNGKLTLTSDHANVYEYASATTYKNNKPTAVRQYSVDGATGTVRSYTKTLTSELNNTITLKNKTPHSYRYVETNLPLSKSKKKLTSLAKFKTTQETASTQSSTVSSAPVIVSQPSEPPSSAAPAPSVQPSVESQQSTVDNSGSNHNGNNNNGQNESQTDGNSNASSEQPSPSPDSSSAVSSSSPS

SEQ ID NO: 2214 - protein, 186 aa, Lactobacillus paracasei
MPSKAEFRPLQLKRLKAAKKATQAASAALLAALVQTPMWQRPHSIGVTVSGPFEVPTEPIIQAAHDANKAVYLPRVMPKRQMVFLPDPGKDKLITSAFGIPEPPYQADQIHAAPDLILVPGIGFSLADKYRIGFGGGYYDRFLTTYRGTTITLVPPVMAFPQVAWPVEPFDVPIQTLILANGDVIV

SEQ ID NO: 2215 - protein, 116 aa, Lactobacillus paracasei
LKVTLERIYQKPQASGFRVLVDRVWPRGISKVNAALDLWAKTIAPSTELRKWFGHDPEKYPEFKKRYLAELAANPDLPDFIKTLKQHEQEPVIMLYGAKDETHNQAVVLSELLKTK

SEQ ID NO: 2216 - protein, 311 aa, Lactobacillus paracasei
MITRYQIQPRGNMQVTTDDQANWIRVSAPLPQELQTLATTYGLPATYLAAATDQHENARVEGLNPADQVPGLIVLRYPVETTSETGFDQYNTVPMTMILLNDRVITITHDSLQAFDDLAQQKLSPKPEEFALEVLWLVLHQFVIAMDKLNDETKQIERSLGKAAKNTQLYQLMAMQKGLVFFDAALDHSGTLLKALRDGERFFNTNGYLRRLHDVEVEVVEAQTMVRITEKLLTQYSTAVSAIVSNNLNLIMKVLTSITIILTIPTIVGGIYGMNVRLPFANAYWAFWWLIGGTAILCGLAAWWLWRQDYF

SEQ ID NO: 2217 - protein, 291 aa, Lactobacillus paracasei
LNTRDFEYFLALTQTRNFSQAAEQFAVSQPTITTAIKRLEDSFQAQLIIRDRRHHDIGVTSAGKQLAAHAQVILQQLTLAQQEIARDQTNKIRFGLPPIIGNYFFPKIAPQLIAAGLMPQLQTVEAGSAALLNQIKQGDLDFALLGASGPLQEPDLTISQIGTAPFVIITPESDPLAQKDKVRFAELAMQKFVTLSEAFVHTRAFTWFQQQSAFIPNVVYQTGDVQLLKQMVAQNVGIGFLTNLAINPDDHLAAVKLTDPKQPVFTISIVRRKDRVLTPAMQHFNQILAAN

SEQ ID NO: 2218 - protein, 555 aa, Lactobacillus paracasei
LKYTPEQIINDPFLNKGTAFTQAERNQYGLNGLLPPAVQTLDQQVKQAYAQLKTKPTDLAKRQFLMTLFNENHVLFYKLFSEHINEFMPIVYDPTIADTIENYSALFVNPQNATYLSIDDPDHIESALKHSANGRDIRLLVVSDAEGILGIGDWGTQGVDISVGKLMVYTAAAGIDPSQVLPVVLDVGTNNEALLNDDLYLGNRHKRVYGPKYRSFVDQFVTTAEKLFPNLYLHFEDFGRSNAADILNEYKDRITTFNDDIQGTGIIVLAGLLGAMNISKQKLTDQVYLSFGAGTAGAGITSRVYEAFIEEGLSPEEAKKHFYLVDKQGLLFDDMSDLTPEQKPFARKRSEFANADALTNLEAVVKAVHPTVLVGTSTVPGTFTESIVKEMAAHTERPIIFPLSNPTKLAEAKADDLIKWTDGRGLIATGVPAANVDYQGVSYAIGQANNALVYPGLGLGTIASTAKLLTDSMISAAAHSLGGIVDPDQPGAAVLPPVSKLDQFSQTVAIAVAEDAVKHGLNQKPIKDAKQAVANMTWQPEYRPLPDSLEMDLGE

SEQ ID NO: 2219 - protein, 328 aa, Lactobacillus paracasei
LTALSTSIQSVLTIVLLIVVGYVLRRQGRFDDQFGKTISDLLMKIALPASIFISVLQRLTLDKLVSLSSGLVYGFGAVILGYLIAFLLVWLLKVRPGRRGTFINMFVNANTIFIGLPLNLALFGDKAVPYFLMYYVVNTVSTWTVGAFIMAWDDPTQKKSEKSSTGFNWKKLLPAPLVGFLVALVFLLLKIPFIHVGWLSFAVNALDYVGSLVTPLSLIYIGIILADAGLKAIRFDRDTIVALIGRFVIAPALIAGLILLGMHAGFNVPGLEAQTLIIQAAAPGLAVLPILATEAHADVEYATNVVTTSTVLFVVVVPILMMLVQGLA

SEQ ID NO: 2220 - protein, 165 aa, Lactobacillus paracasei
LEITRHGEALTTNGTPIELGEQLPTFTVTNAQAKPVTTQDLSKRLTLISVVPDINTRVCSISTKHFNEDMDAFDHTDFYTISTNTPQEQQSWCAAEGVKKMQLLSDQNGDFGKAMGLFVADNHTDARSVWIVDGTGTVKYRELITEQTHEPDYTSALAYLEAHQH

SEQ ID NO: 2221 - protein, 163 aa, Lactobacillus paracasei
MEQALVVYASETGFTQRFALGIAQALHCELIDVQFVTTADLQKRKLIIYGGHLVGEKVLGLKAFYREFHQSLPDQLIVFGSGIIRREQVAIKQIKLQYQNRCVMPIDFYYLQGQPKLSQMNLFRRIQTSLALKQLGASHCPAIHETIQPLLRAVVRLLDQANL

SEQ ID NO: 2222 - protein, 603 aa, Lactobacillus paracasei
MSETALPKRQEVDPKLTWDLTPIFADEFAYTEAIKQVRALTKDFVHLYQGKLTEPAIIVDALGDYGSIIELDSKIGHWAFMPYSTDTTDPKLRDRQIKATALDGEIGGQLSFFQAELTQLPEEVLDAVVAKAPDYAGFFRQIKIAKKGALAPAAEKVLAELSPVFQAPSNIRDQTIFGDMDFGTFTAHGKTYPLSFVMYEENYQKHPDTEVRRAAYAKFNQTLRRYQNTMAAGYLAQVTREKITATMRGYDSVIDYLLADQEVSRAMFDRQIDVIMHDLAPIMRKYITHVKELWGLDHIGYTDLQIDIDPAYSPTITLDQAKQDIEKATAIMGHDYQAQMMQAFTDHWIDFPANQGKDSGAYTAGPYGVHPYVEMTWSNSLPAVYTLIHELGHTAQMVRSEKAHNILDADFNDYLVESPSTFNELLLTHYLDQTAKDPQMKRFALSRLLNDTYFHNFVTHLLEAAFQRKVYQRIDAGDSFDAAALNAIKRQVLTDFWGPAVELEEGAELTWMRQSHYYMGLYSYSYSAGLTVATQAFQAIEQQGQPAVDRWLRYLSLGDSLNPVAAARVAGVDVTTDAALKQTIAFLGRTVDEIISLSHEING

SEQ ID NO: 2223 - protein, 116 aa, Lactobacillus paracasei
MGIDNNQLVARYFDRKADHAAFFKALEAYLDDQINELYTTLNDTFADTVTLSLDVAIAKAHQAGAKIDDPAAEEIAATNYLFKELSSRGLWLQSPDQTEPNTIIAKLNFGNRRTYY

SEQ ID NO: 2224 - protein, 244 aa, Lactobacillus paracasei
MIKRQTLTLITGADKGIGFETAMALGKRGQHLLVGARNQARGEQAINKLHTAGVSAELVILDVTQAGTIATAAKQIEASHGYLNVLINNAGIALDAHQPPSQLPVMTMRQDFDVNFFGLVSVTQAMIPLLKKGAPAKIINVSSNMGSLGLASDPDSRFFQVNSLGYQASKAAVNFATIDFAKELQPDHISVNSVNPGWTRTDFGGNRSGEQTVAEGAAQIVKLAADDSPDLNMTFTETAGKLPW

SEQ ID NO: 2225 - protein, 149 aa, Lactobacillus paracasei
MAEEQTLVLVKPDGVANGHIGDVITRIEHRGFTIDALKVTHATADQLHQHYAALVGEPFFPRIERFMTGGPMVAMIVSGFNVIEAVRKMTGATNPAEAAPGTIRGDFGREWADKTIRNVIHSSDSETSARREIPIWFPDRQYAPHQPEK

SEQ ID NO: 2226 - protein, 782 aa, Lactobacillus paracasei
MAEQNILPDQGLSTKQVEERFAAGQHNLPLKPLTRSISQIIKVNTFTLFNLVNVVLGALIVTTGSYKNLLFLGVAVINTAIGTIQEIQAKHQIDKMSILAAARATVIRDGKTQKIELEQLVMDDMVHLKRGDQIPVDGVVVATNGLESDESPLTGESRPITKKVGDKLLSGAFIVSGQATMQVTAVGAATFAAKLALAAKAEKGSKSQLLATINRIIRVLTYVLIPIGAILFTVSMIRRGNYNRAILTTSAAMIGMIPEGLVLLTNVALAVSARNLAVKRVLVRALPAIEALARVDTICLDKTGTITSGKLKVAETLPMIGQTEATVTKAAAAIVYALNDDNETAMAIKAAFQNDTNQQVTQTMPFSSARKWSGAVVDGQVLFMGAPQFTFGDQLPTPIANQIKDAAAKGYRVLAIGTATKLVHPLVNPQLLGLILITDELRPTAINTFDFFKTQGVALKVISGDDPITVANIAKQARLEGADQSVDMSTIADNATAKDYQTLVKRYNVFGRVTPEQKKSLIMAYQALGHTVAMTGDGVNDVLALRQSDCSIAMASGADAASSIADFVLLDSNFDAMTGVLNEGRRVINNIERVASMYLVKTMYSVILATIFVFLPLDYPIVPINLTPVSAIGVAIPSFFLTLEPNFERVTGQFMQKVMTIAAPAAISVVIYTLLLTWMESFFHLSFESTSSMVAMLIGTISLNVLLVVARPFNRLKVGLLGGLSIALFLVFFVFSSIFSLVNLWQWQLALIYLPLMISTVPFYLLIQEFLGRRVLSKINWR

SEQ ID NO: 2227 - protein, 307 aa, Lactobacillus paracasei
MPKLNPDGTQFITLSSGYHLWTQTQGKGDIHLMTLHGGPGGTNEVFENFAERLAPYGVRVTRYDQLGSFYSDQPDFSDPANRQQFLNIDYYLSEVEQVRQQLGIDHFYLLGQSWGGVLAIEYALKYPEHLNGVILSSMIDNLDEYIVNINRIRETMFSKEDVAYMQQIEQQHAFDDAKYQALVSELGEHYLHHAKDPQPRHLISTLATPVYNYFQGDNEFVMVGALKDWDRRADIHRIAVPTYLTFGGHETMPLAAAERMAKTIPDATLHVTPNAGHGQMLDNPTDYFSHLGDWLVKTDTKTAFHSK

SEQ ID NO: 2228 - protein, 115 aa, Lactobacillus paracasei
MSEYDELKTSLFEPVRAFDRALEQQPDLIIPLAVVHLIPIALTLGGGIAIIRGHQKLRAEKERTKQLSLKLEMHKHHHGRRNWRLAPEHRGEQDVFAPEYLEKPAGKNRHAHRRH

SEQ ID NO: 2229 - protein, 173 aa, Lactobacillus paracasei
MPVMLMRTATREDIPAMMKIIASARQFLGEQGISQWQGTYPDQAAVEQDVATGIGRVLVVDGQVAGIAALVEGPDPHYLKIDGAGWLADVPYLAVHRFALDGSIRGHQLSKVFFSNIMSEAYRRGVYDLRVDTHAQNVIMQHAITGMGFEYRGIVYMDEPVPERNAYEVRLAH

SEQ ID NO: 2230 - protein, 384 aa, Lactobacillus paracasei
MQDIGNLALILVTTLVLAHLSRLLNMPAVIGELLAGILIGPALLGWLAPSHTISLFAEIGVIILMFLAGLESDLDLLKKYFKPGMLVAMIGVIVPVAVVFVFGRSWGFNMTSSLFLGITFAATSVSISVEVLKELHALEGRNGATILGAAVVDDILTVLILSFTVAVLGEQKTASLPFWVQIIEQLLYFAGIYLVVRWAAPYLMGLAEKMFPSSAVTIMSLLICLGMAYLADLVGMSAVIGAFFAGVAVGQTRHRHEVDGSLSAIGYAVFIPVFFVSVGLNMRFDTFGRDLGFIAILTLLALVTKWVGCGVGDRLAGASWLQSNVVGAGMVSRGEMALIVAQIGFEAKLMDAEYYSAVIVVIVLTTLIAPIILKDALRREQEPV

SEQ ID NO: 2231 - protein, 222 aa, Lactobacillus paracasei
MANLFFDFDGTVADSEVGIVAGLKYMVQDRGLRPLDNSAYTQFIGPALIDMLPKVWPELDDIEVKRAIDAFHHYYEEEGLYQVELYPNFLDTMAKLKQQDNQLYIASAKPETMLHRLVKHFSLDQYFAGAYGASDDEETRVTKTDILTYALKDSQVALDQSVMIGDRANDMIGGKANHVQLLGVTYGFGSAKELKEAGAKVLVDQPADIPAGLAKLAKINAK

SEQ ID NO: 2232 - protein, 152 aa, Lactobacillus paracasei
MTDESLLQAYVDAYFSTFKSINELISAPMAKYHLSFEQFRILSDIAHDPDISLTAIVAKRGVTKPAVARQLRVLRNLNYVTQTKFAADRRRNTLRLTPLGKQVEAEITKTATDRFDQWVTALGEDKAKQFVDLLNEIGEKLIHPQQTSEDDQ

SEQ ID NO: 2233 - protein, 310 aa, Lactobacillus paracasei
VRKHKKAWLIGLLSIFGVLLMGLVGASLYFYQYAFVPSKKSFLSGGESRIVKDGKAWLKTVHKETWTEKAAGADLKLVADYVPAAKPTNKTVVVAHGYMNTKEFMAPQIKMFHDAGFNVLAPDDRGHGQSQGNYIGYGWPDRLDYLKWINQIIKKQGQQSQIALYGVSMGGATVMYLSGEKLPSQVKSIVEDCGYTSIIDELTYQAKAMFNLPKWPLIPSVALTATIKAGYNVFDASAITALHKNTRPILFIHGSKDKFVPTSMVYQNYRAATKSKKALWVVKGAGHAKSFPDHQQAYSKRVVGWFNANW

SEQ ID NO: 2234 - protein, 157 aa, Lactobacillus paracasei
MTEPIHVLFISISGNTRAFAHRLAVYAQTQHDQNAANPTIVLKEISDATQSDGETKPFFVMVPTYLDGGNGIDNGVKELMTTAMGDYLAEGENADQCIGIIGSGNRNFNEQYCLTAKRYAKEFDAPFLADYELRGTPSDAEKIYAILKRVAATNAAQ

SEQ ID NO: 2235 - protein, 274 aa, Lactobacillus paracasei
MNYTLNDGNVLPAIGFGTYKLNGANGVRAMVGAVNVGYRMLDAAFNYENEGAVGEAVRQSGIPRSQLTIASKLPGRHHRYQEAIDTIEESLYRAGLDYYDLYLIHWPNPKEDLYVEAWQALIQAQRFGLVRSIGVSNFLPEHIDRLIKETDVTPAVNQIELHPYFNQQAQREYDAAHNIQTVAWSPLGRGAVLQEPSIKKIAAAHGKNVGQVILRWDLQHQILPIPKSAHLARQRTNLDVFDFTLTNEEMAAIDSLTKPDGRLKDQDPAVYQEF

SEQ ID NO: 2236 - protein, 325 aa, Lactobacillus paracasei
MHTSIDKPSCIIKPKDSAQTSLVSVLVGVLRVYKEGIITKTQQWRAVSRSWFALFTMIFWVLLFVEAFSTGMMLTIGSPARTEAVIVKSKGLDQLTQTLNQQLLTTAAKSGASLDKRTVLVTTDDTQRLAKNMVAASSLHQPHVSLTTIEESVTSRLQTAATVQHQNFDQKKVLASLKTTLEREINLHVMAQGWGLVYPLLVLMTQTAVIVAAILMAFVLLIMIKTAHSWRRFLAVTGRSTYVMGYVGGFMAMFVTANPFLGAVVSRIAINQQLTRDLILAYSPLWQRVAGWTIIIGLLVAGVSHFFPRAQAEDDDLLTAERSAL

SEQ ID NO: 2237 - protein, 281 aa, Lactobacillus paracasei
MKLKRWVVIVFAAVVVIAGAGWYWYQEQPTDTPTTEKTTIGQTATLYLHGYSGGAGSTNTLIRHAEQSGATKVLTATVAKNGKVSWQGNARHVSKPIVQVIFQDNVNPDYAKLAGWLTTINRELYQRYGVRQVNFVAHSMGNMAVMFYATQNSDHPKLPKMRAYVAIAGHFDGIIGMGDEPHRIKLAPNGYPTPPDENYATLARMRDRFPKNVKVLNIYGDVDDGSDSDGRVANNSSRSLQYLVEGRAASYQEKEFVGKKAQHSALHENPQVAKAVDNFIW

SEQ ID NO: 2238 - protein, 217 aa, Lactobacillus paracasei
MQLFRDPYFITAMKLLLGFIVFVAQIKLTGKGNLAPATIVDQMQNYVLGGIIGGVIYNTDIGLLQFVNVLLIWTLIVFSSKYLTNHNRWIKRLIDGEPLLVVQHGKIRVETATQVGLSANDLAYKLRTAGVNDLRDVRQAYLEQNGQLNVILKGDETIKYPLILDGQIDPAALDAIDHDEDWLKAQLQEQGYETGDVYMANYLSGKVVVTPYDPNKN

SEQ ID NO: 2239 - protein, 153 aa, Lactobacillus paracasei
MGTTFYAYSVLTRQTTWQSTFRYIIIMAGAVVIVAYLIYFLRHKHTNKYRDLLILVALIELLTIGIQIRDLQASRTATADSQAVATLLRSVAKQKQVGVQQVYANSNTVHTGMLVTIGKSTKTMFTVTINADNNSYQLDKTTLIVPQANFVTK

SEQ ID NO: 2240 - protein, 377 aa, Lactobacillus paracasei
MTEKVQIKAPFRADLVGSLLRPERLKAAHQQLAIGEIKQDQELNIQHAAIERIVKRQVELGFKAVTDGEFSRRYWHLDFLWGLNGFEKDDSWQYEHDFKGGINAAANVHLAGKVSFNPDHPFFAAFKYLQSIVPEGVLPKQTIPSPALLFRDHRSDNWAKYYDRFDDYLADVVQAYVDTIQHFYDLGARYLQIDDTNWAYLIQNLKDTENDPKAHQRFIDLAKLAHRVIKAVLVKLPEDLTVTSHICRGNFQSTFLFSGGYQYVADYIGDLPYDGLFLEYDNQRSGSFEPLTKLWHGDTNKRIVLGLITSKFPELEDEDAVIKRINAATEYVPLTNLALSTQCGFASTEEGNKVTEDDQWAKLALVQKIAKRVWADA

SEQ ID NO: 2241 - protein, 157 aa, Lactobacillus paracasei
MAKVESFTLDHTAVKAPYVRLITTEHGAKGDVISNYDLRLVQPNTAAIDTAGLHTIEHLLASLLRDRMDGVIDCSPFGCRTGFHLITWGEHSTTEVAKALKSSLEAIANDITWDDVPGVDIKSCGNYKDHSLFSAKEWAKLILSRGISNDPYTRQVV

SEQ ID NO: 2242 - protein, 230 aa, Lactobacillus paracasei
TMEMFAMILYINNERMEMBRANEPRTEINYDZMNPKNVRRLINFATIVVVILLAAVAIYWYDLGILSNINALQAYIARLGIAGALFFMLIQVIQVVIPIIPGGVSTAAGVILFGPWTGFFYNYIGIAIGSFINFHLARRFGKPLLTYLISEKTYNKYIGYTKNQQRFDRFFTLAIILPVAPDDVLCLLAGLTKMTFKKFFWIIILGKPITILAYSMSLIYGGQWLIHLFQ

SEQ ID NO: 2243 - protein, 198 aa, Lactobacillus paracasei
MYEYFEGIIQAVTPAYIVIDVHGIGFRLLVANPYHFEAGEQKRVYVQLIIRDNDQTLYGFEGAADKRTFNQLLTVTGIGPKSALAILANVSSGGLATAIAQDDVKFLTKFPGIGKKTAAQIILDLKGKITTDGQPAAAAIAPVASDVDSELADALAALVALGYPQRTVDGLTDTLKAFSAKTTDAYLREGLRLLSGKA

SEQ ID NO: 2244 - protein, 338 aa, Lactobacillus paracasei
LADADKDRLVSGDVDDSNEAQIEKSLRPRMLAQYIGQDRVKHQLEVYITAAKQREESLDHVLLYGPPGLGKTTLALVIANELGVNIRTTSGPAIEKPGDLVALLNELHPGDVLFIDEIHRLPKIVEEMLYSAMEDFYIDIVVGQGPTAHPVHFPLPPFTLIGATTRAGMLSAPLRDRFGISEHMAYYSADDLSEIVKRSATIFDMAIDAEGAHEIARRSRGTPRVANRLLKRIRDFAEVAGQSPVDIQMVDHALDQLQVDQQGLDQIDRKLLMFMIRDYEGGPVGLSTIAANIGEEMATIEEMYEPYLLQIGYLKRTPRGRMVTPAGFAHMGLSAEQH

SEQ ID NO: 2245 - protein, 357 aa, Lactobacillus paracasei
MVQENKRYHKVEDKHYQLSDFDYDLPHELIAQTPLKERDASRLLVLNSETGEMQDKHFYDILDYFKPGDALVMNDTRVMPARLYGVKPETGAHMEVLLLNNTSGDDWETLMKPARKAPVGTVIDFGDGLLKATVTKELEHGGRMIHFDYDGIFMEILDKLGETPLPPYIKEKLEDPEMYQTVYSKELGSAAAPTAGLHWTKDLLKKVQEKGVKLVYLTLHVGLGTFRPVVEENIEAHKMHSEFYRLTPEAAATLNDVRDNGGRIIATGTTSIRTLEAIGTKFDGAIKADSGWTDIFIKPGYQWKVVDAFITNFHLPKSTLVMLVAAFTGRDTILNAYKHAIDEKYRFFSFGDAMFIY

SEQ ID NO: 2246 - protein, 380 aa, Lactobacillus paracasei
MEPAVKYRLIHQDKHSGARLGELITPHGTFPTPMFMPVGTQASVKTMAPEELDTMGATVILANTYHLWLRPGPELIEEAGGLHNFMNWHKGILTDSGGFQVFSLADTRHITEEGVTFKNHLNGAKMFLSPEKAIAIENALGPDIMMSLDECPPFFESYDYVKKSVARTSRWAERGLQAHKNPDWQALFGIVQGAGFKDLREQSAKDLVSMDFPGYSIGGLSVGESKDEMNHVLDFTTPLLPENKPRYLMGVGSADALIDGALRGIDMFDCVLPTRIARNGTCMTSRGRLVIKNAKYAHDFGPLDPNCDCYTCRNYSRAYIRHLIHVGEAFGIRLTTYHNLYFLLHLMQQVREAIANDDLLAFREDFFEAYGYNKEKAKNF

SEQ ID NO: 2247 - protein, 139 aa, Lactobacillus paracasei
LNGNMTMIIMLLIFVGFMYFGMVRPQKKQQQKRQEMLNQLKKGDPIITIGGLHGVIDSIDQQAGTVVIDSDGIYLTFNLSAVRGTATRPAAPAPAATVTKAEEAHNTDEQREAKPVEEAAPKADDQTDAKSDSKAEDDK

SEQ ID NO: 2248 - protein, 868 aa, Lactobacillus paracasei
MLKNTAKTATEVDVKSMVDELVANAHAALKIMKTFDQEKIDHIVHRMAIAGLDHHMELAKLAVDETGRGVWEDKAIKNMFATEEIWHSIKNNKTVGVINEDKQRGLVSIAEPIGVIAGVTPVTNPTSTTMFKSEIAIKTRNPIIFAFHPGAQKSSARALEVIRDEAEKAGLPKGALQYIPVPSMDATKALMDHPGIATILATGGPGMVKSAYSSGKPALGVGAGNAPAYIEASANIKQAVNDLVLSKSFDNGMICASEQGVIIDSSIYDDVKKEFEAQGAYFVKQKDMKKFESTVINLEKQSVNPRIVGQSPKQIAEWAGITIPDNTTILIAELKGVGEKYPLSREKLSPVLAMVKADGHEDAFKKCETMLDIGGLGHTAVIHTADDELALKYADAMQACRILINTPSSVGGIGDLYNEMIPSLTLGCGSYGGNSISHNVGTVDLLNIKTMAKRRNNMQWMKLPPKIYFEKNSVRYLEHMEGIKRAFIVADRSMEKLGFVKIVEDVLARRENPVQVQTFVDVEPDPSTDTVFKGTDIMRSFGPDTVIAIGGGSVMDAAKGMCLFNDAGDADFFGAKQKFLDIRKRTYTFPNLNKTKLVCIPTTSGTGSEVTPFAVITDSKAGIKYPLADYALTPDIAIVDSQFIESVPPVVVADSGLDVLCHATESYVSTMATHYTKGLSLEAIKLVFENLEKSYHGDVEAKSKMHDASTIAGMAFANALLGINHSIAHKIGQAFHLPHGRCIAITMPHVIRFNASQPKKRAIWAKYSYFRANEDYAEIARYLGLPGKTTDELVESYVQAFIKLAHSVGVKLSLKEQGVKKADLDKQVDRLAELAYEDNCTVTNPQEPLIGDLKHIILDEYEGTESTF

SEQ ID NO: 2249 - protein, 214 aa, Lactobacillus paracasei
MTPNKEDYLKLIFEIGGDTQLVSNKQIVAGMHVSAASVSEMINKLGEEKLVAHTPYQGIQLTSAGRKKAAILVRNHRLWEVFLVQCLKYPADAVHQEAEKLEHALTPEMAKRLSAMLGEPRYCPHGGVISDANGHYLQQSRVTLGTLDVGQSGHIERVIDEVSLIDYTVKIDLRLDDEFTVTAKTLDAVIIKLARTGKELAVDADRADHIFVEL

SEQ ID NO: 2250 - protein, 495 aa, Lactobacillus paracasei
MPEESRAVIIIFGGSGDLASRKLYPALFNLYRRGVLAEHFAVIGTARRPWTDDHYHEVVENAVAGDDVDRDQAKAFAQHFFYQSHDVTDADHYITLKNLAAKLDDQYVTGGNRIFYMAMAPDFFETIASHLKSEHLLTERGFNRLIIEKPFGHDYASAKELNDSLTATFDDDQIFRIDHYLGKEMIQNLLAFRFDNAIFEGVWNKDYIDNIQITLSEAVGVEERAGYYEKAGALRDMVQNHVMQVLSYLTMPKPKTFTANDILTAKDQVFAALKPYDLATAKENFVRAQYASAEVDGDQVLGYRQEEGVAADSQTATFVAGKIMLDMPQWEGVPVYIRTGKRLTRKSTQLTLTFKPVASPLFNRETGSQPDSLTIYIEPSEGYSLQLNGKALGTGFNIEPDELRYRHDPEAAAAAPEAYERLINNVLEGDQTNFTHWSELSASWRFIDAIQAAWSQETEMPTYPAATMGPQAAFDLLARDGRQWFWQPRRIKLAD

SEQ ID NO: 2251 - protein, 367 aa, Lactobacillus paracasei
MALFELPLQNDTSRKIIHLDMDAFYASIEMRDNPQLRSKALVIARDPRTTGGKGVVTTANYVARRYGVHSAMPANEALQLVPRSKLVFKTPDFPKYKAVSAQIHALFHQVTDLIEPVAFDEAYLDVTANKMFPSTIALALWLQDQISQATQLTSSIGISYNKFIAKQASDYNKPVGRTLVLPEQALLFLDRLPIKQFRGVGKKTLPKLTDLGVTDGKSLRALSQDDLLRMFGKMGFVLYQHARGVDNRPVAVRTAKSIGKERTYGTPLTDAEAVQTQLHNLAGMVVTSLNQKAMHGKTVVLKVRDVDFITQTKRLTQDHYFEGEQAIFDAAWQLWGSVAMSNLAIRLLGITVTGLDPKQYENLDLPL

SEQ ID NO: 2252 - protein, 437 aa, Lactobacillus paracasei
MATKHEQILDYIANLAVGKKISVRSIAKHLKVSEGTAYRAIKEAENTGFVSTIARVGTIRIEQKPLNPIESVTFKTLVDLIDAKVLGGQAGMDKKLDKFVIGAMTPAAMRPYITRNSLMIVGNREDAQRLALEDGAAVLITGGFETSAAIIALADDQQLPVLQTAYDTFTVATMINRALSDQAIKQDILTVAAIYTPLAQIQTIGVEATVGDYLLLPDPRYPLPVVTRNGRLVGVMRPSLVGGKKPTVPIERLMQKDPQTVKPYLSVTAVGHTMQDNGLTAMPVVDDSWNLLGIVTRNAVFSSLTGIAHSRELSNTIADQVSAQLTAITPQPPYVGGYELKTVPAMTNSLGTMSFGVLAEAINGCTTRYLHDTGRRNVLVEGLNLTTFRPIQLESVVTVLLRELEMTRHDATLDVDVLSDGVQVAKAIVTCQLLERN

SEQ ID NO: 2253 - protein, 318 aa, Lactobacillus paracasei
MIQTDIINAIKANDPIIIHRHVNPDPDALGSQVGLAETIRASFPDKKVYQVGSDTGNLSWLAQEQTITDDVYKYALVIVTDTADTPRVSDERFNKGKMLIKIDHHPNDDAYGDLVWVDNNASSASELIYDLIAASNGVLKLSDKAARLMYAGIVGDTGRFLFNNTTPHTLQVAAELIKKDFDPTAINNRMNTVTLAQARLQGYVVDHLKITPAGAASVTVPRTAINELKLADDQVSAVVGTPGRLDTVIAWAEFIEQAEGGYRVHLRSKGPIINTLAKAHNGGGHPLASGAKAANFDELIQIETQLDQLVKEYSTSGK

SEQ ID NO: 2254 - protein, 481 aa, Lactobacillus paracasei
  misc_feature (6)..(6): Xaa can be any naturally occurring amino acid
DEADBXATPDEPENDENTRNAHELICASECSHBMENQFKQFQLKPFVIDGLNAMAITAPTPIQQKVIPALLRGENIVGQSQTGSGKTHAFLVPLLSMVDPTEDATQVVITAPSRELANQIYAVAQQLIQTEPAIRINRLVGGMDKQKQIDKLQNHQPHVAIGTPGRILDMIKSYDLVPSSVRHFVVDEADMTLDMGFLETVDAIASSFPDHLQMAVFSATIPQKLEPFLRKYMDNPTTIELKPQSVIADTVENILIAAKGRDKNELIYQLVTMGHPFLVLIFANTKTSVDAIHDFLKHQGLKVAKIHGGIQPRERRRVMKDVADLKYQYVVATDLAARGIDIKGVSMVINAEIPRDNEFFIHRVGRTGRNGMAGTAVTLYEPGQEDQIAELEHMGIKFAPKMIKNGELVDTYDRNRRVHRKPKQEDTSLAIRGLVKKAKQKHMPNYRKKIRTAVLLERKRNTKIARRQALLAEKRKNRKRG

SEQ ID NO: 2255 - protein, 311 aa, Lactobacillus paracasei
MAVNDLTLPTWNTLDEARQKFIFQQLTRYFLSPLLSVDDIRPLTVTFFGQTLHTFEAMIGGEWLRLVPGMPNVSLGFAADQQGRLADYLGQSGLTMQDLSHQLSPERQVDIPAMLVATRATPASEEILGRVSLTTRIFKGNHMAYAAVRAQVLALLDRHGSLDPFSQSGWPATLTSGSVILRLASAHHYQVSISKNWQKSELQKALSYFGFRLPTQDQYEYLQGGGVTSLFSFGNTLPADMPRYLPNRFGLTVPVTRSGSELIQEAMQKSTPLSAQPTAKEALALSPFYQLAGEGNMGTALYRRVATITMD

SEQ ID NO: 2256 - protein, 881 aa, Lactobacillus paracasei
MKKMSSGEIRQMFLDFFKSKGHAVEPSASLIPVDDPTLLWINSGVATLKKYFDGSVVPDNPRITNAQKSIRTNDIENVGKTARHLTFFEMLGNFSVGDYFKKEVIPWAWELLTSPKWFGFDPKRLYVTVYPKDKVTKELWQKTGVPDDHIVKAEDNFWDIGEGPSGPDSEIFYDRGQQFNNVAEDDPENYPGGENSRYVEIWNIVFSELNHLPDGRFVEQPHKNIDTGMGLERLVAVIQGTPTIFETDLFMPIIKATEKMSAGKRYGVSAQDDVSFKIIADHARTVTFAIGDGALPSNEGRGYVLRRLIRRAVLNGKKLGIDHDFLYQLVPVVGEIMKSYYPQILANQQFIQKVIESEEARFRQTLDAGVTLLNQIIADLKQDGKKEIPGADAFKLFDTYGFPVEMTNEYAQDEGLQVDMAGFKKNMAAQRDRARKARGDRQSMGSQDKVLMSITTPSKFTGWTELDHKHASLQTIVVNDQLQDSVSEGTAQLIFDETPFYAEMGGQVADHGEIKAQDGTVLADVSDVQHAPNGQNLHTVTVKGKLETGQQYWLSVDPLRRKKVSLNHTATHLLDQALRDVLGEHTHQAGSLVEPDYLRFDFTNFGQVTPKQLRQVETIVNQKIWDALPITWKEMPIEEAKKLGAIAMFGDKYGSVVRIVKIGDYNTEFDGGTHPTNSNALGLFKITSESGIGAGIRRVEAVTSKEAYEYLTQQQDWLSETAENLKIDQVKNVPSKVTQLQADLKAEQKTVAGLQAKLAAQAAAGIFDHPEEVGGLKLIAKQVQVAGMNELRQLADKWKAKQASDILVLGTEVSGKANLLVAVNDTANQAGFKAGDLIKAIAPKVGGGGGGRPDMAQAGGKNPAGIPAALSEAKTVISQKA

SEQ ID NO: 2257 - protein, 53 aa, Lactobacillus paracasei
MNRLRLSLTGFFGPNEHYLVAEQHGGIKIIYSVDPRVSTPIFLRTIAQNQIGH

SEQ ID NO: 2258 - protein, 86 aa, Lactobacillus paracasei
MSTLDQTVHFDFRDNNPKNVHETLETVYKALEEKGYNPINQIVGYLISGDPAYIPRYNDARNLIRKHERDEIIEELVRNYLGKEQA

SEQ ID NO: 2259 - protein, 144 aa, Lactobacillus paracasei
MRLMGLDVGSRTVGVAVSDPLGWTAQGLEIIRINEDKEQFGIARLKELVKQYEVTAFVLGLPKNMNNSIGPRAEKSQAYGELLKTTFGLPVDFIDERLTTVEASRMLIEEADASRKRQKQVIDKLAAQMILQNYLDAKGPLTKQ

SEQ ID NO: 2260 - protein, 106 aa, Lactobacillus paracasei
MANNEHVTPGEDDQQITLIDEKGNEELYQVLFTFDSEDYGKSYVLLYPASESDDQEVEIQAFSFTPDENGDASSGDLFPIEDDAEWDMVEEVLNTFLADDDSNLKD

SEQ ID NO: 2261 - protein, 81 aa, Lactobacillus paracasei
MSEEKRRFKAVIGDKTYTIIGPGSEQHFITVTKLLNERLEQVKTLAPDLSAEEQAILVAFNSVSDQVKLLAAQQDDHEQEE

SEQ ID NO: 2262 - protein, 177 aa, Lactobacillus paracasei
LISLSIILILAYFYYSGARRGAALQWLHVAGYGLSFLAATALARPLGAHFTLVVPYPSATNAGQFAFYSDKVGLTLDTAFYRGFAFLVVLTFGWLLTRVGALWFHDLTYAAMGHRRSAIIGGCANLVIGYIFLFLILALLALIPIAGIQHGLDHAIVAKVMIKYSPGLTQFVNALWL

SEQ ID NO: 2263 - protein, 786 aa, Lactobacillus paracasei
MNEKILKTLEYDKIQQALLGQVVTANGRQLVQAMQPLTDPVAVQQALDETADGASALRLKGGIPVPQLENIDPALKRVDIGAVLNGQELASISRVLQTVSAIDKFLTDLQDQIDFRQLYTLQESLTVLPQLSRRLKTAVDPDGTLTDEASPQLHGVREQIKSIEGEIRGKMTNYTRGAQSKYLSDPIVTIRDDRYVIPVKAEYRAKFGGVVHDQSATGQTLFIEPQAIVALNNRLREAQLAEVAEINRILAELSNELAPYTGQIKANAAVLGHFDFINAKARLAKAEKATEPLVSADNDVLLRDARHPLIDPHKVVGNDIPLGDKYQAMVITGPNTGGKTITLKTLGLLQLMGQSGLFIPADDESRIGIFDEVFADIGDEQSIEQNLSTFSAHMDNIVHILKQLSQNSLVLFDELGAGTDPQEGAALAIAILDAVGEVGAYVVATTHYPELKLYGYNTAKTINASMEFDSKTLQPTYRLLVGVPGRSNAFDISARLGLPSVIVERAKSMISSDSHELNNMISDLEKQRKAAETAYEAARRQLADAQSVHDELAAAYKKFTTERDAQLQQAKDKANSLVDKAQTKADKIINQLRQMQLTNPGTVKENQLIAAKTALKQLHQDEPLQKNRILRREREKQALHVGDEVKVASYDQTGTLLEQFDKKHWQVQLGILKMKVPTDELEKIKPSKQSAAQRPVVKVSGGGMSGPSTTLDLRGERYDQAMADLDQYIDAALLAGYPSVTIIHGLGTGAIRNGVTQYLKRNRQVKTYGFAPQNAGGSGATIVNFK

SEQ ID NO: 2264 - protein, 103 aa, Lactobacillus paracasei
MVQAVTDSNYKTETDTGVTLTDFWATWCGPCRMQSPVIDKLAESRDDVKFVKMDVDANPETPKSFGIMAIPTLVIKKDGEVVEKLVGYQTKDQLESTLNKYTA

SEQ ID NO: 2265 - protein, 49 aa, Lactobacillus paracasei
MFAKLKAMWENPTFRFIFWTITYFLILLVLIYLYGYSGINNSKFIYNEF

SEQ ID NO: 2266 - protein, 506 aa, Lactobacillus paracasei
MIDNVITAIDRVAAEHPTRVAYDYEGTQYTYAQLKEGSDRLAGFFAETLPEHEPIIVYGGQTFDMVEVFLGLSKSGHAYIPIDTHSPNERITQVQDVAHTPAIIEVAPLPIAVPDVQIIRAPELHEAEKTHAPISSLQHAVVGDDNYYIIFTSGTTGKPKGVQISHDNLLSYVNWNISDFGLKEGVVAMSQPPYSFDLSVMDLYPTLVLGGTLKALPKEVTDNFKTLFATLPKLGLNEWVSTPSFAEIALLDPNFNQDNYPDLTHFLFCGEELVNKTAQELITRFPKATVYNTYGPTETTVAVTGMAITQDIVDQYPRLPIGFAKPDTEIFVVDEQGNQVSAGTEGELMIVGPSVSKGYLNNPEKTAKAFFNVGSQRGYRSGDLATMTEDGMIFYRGRTDFQVKLHGYRIELEDVDHNLNQVSYIKQASTVPRYNKDHKVAQLIAFAVAKPNDFESDMKLTQAVKAELGKMVMEYMIPQRIIYRDKLPLTANGKVDRKALIAEVNH

SEQ ID NO: 2267 - protein, 405 aa, Lactobacillus paracasei
MLNLQPYENPQYFVYLIIALLPVIIGMFKGFRMHWYESLFSIVFLVMIFDADKWPQGKALLGYVVFNLLLVYAYFKYRTREGSKNSTAVFYLSVILGIAQLVVVKFTPLFQHHGSILGFLGISYLTFRVVGTIMEIRDGSIKDLNMWKFIQFLLFFPTISSGPIDRYRRFIKDYDRVPDPEHYAQLVTKAMHYLMLGFLYKFILGYIFGTLWLPSVEHMAMVSRTGAFLGLSWPVVGVMYAYSFYLFFDFAGYSLFAVAISYLMGIETPMNFNKPWMSYNIKDFWNRWHMSLSFWFRDYIYMRFVFFMMKHKLIKSRIWTAFVGYLVLFLIMGIWHGETWYYITYGLFHAMLINLTDAWLRFKKKHKDFFPHNKATHYFAIFMTANAVCFSFLIFSGFLDTLWFH

SEQ ID NO: 2268 - protein, 81 aa, Lactobacillus paracasei
MADEAIKNGVLDILADLTGSDDVKTNLDLNLFETGLLDSMGTVQLLLELQSQFGVEAPVSEFDRSQWDTPNKIIAKVEQAQ

SEQ ID NO: 2269 - protein, 423 aa, Lactobacillus paracasei
MKKPIGKILWRGLGPLLIAVILVAALMLVPFKFGRSSQATIRQAASSMSANVLKGENIKNEAMAENYVPFIGSSELSRMDAFHPSVLAQKYHRNYRPFLMGMAGTQDLTHFLSINALQHVNGKKAVMVLSPQWFVPGGVRKAQFDYFFSPAQMTTFLLSANPNSEADRYAASRLLQFPSADSDRIANDALKNIAAGQKLSDSQYWYLKKIKEPMSDHQDILFSQLFLDNNQPKLTKAAKTLPGTYDADVLDGLATQDGMNETTNNAFELKNDFYTKRVKRNLPKLKGSQATWSYVKSPEYSDLQLVLNTYAKKHMEVLFVIPPINAKWAAYTGLDLGMIQNTVTKLKYQLKTQGFNHVLDLSQDGAQPYFMEDTIHIGWRGWLKMDQTVRPFLKTTKAAPVHYKLNDDFYTTRWQQRSANGLN

SEQ ID NO: 2270 - protein, 164 aa, Lactobacillus paracasei
MAKSDYTTLLNLPGSVSFFALTAMRDLMLPNMLGEEQHNILYWAGRDLAAKLPVDETAIPQLFTQVGFGALTPLKQKRQERQYLLAGDVVATRIRTYEDPDFQLEVGFLAQALQQVLGFAVEGGSAIQRREQNVVLTVVMDNQDTQPRAEHLIDLETDHQPTKK

SEQ ID NO: 2271 - protein, 484 aa, Lactobacillus paracasei
MNKQPIGFIDSGVGGLTVVKEALHQLPAESSVYLGDQARLPYGPRPAEQVQAFTWQMVNFLLKKHIKMLVIACNTATAAALPLIKANLDIPVIGVIKPGSRAALKATQTGHIGIIATEGTVKSGAYVKALRAKAPKIRLTSLAAPKFVSLVESNEAHSPIAKRVVADTLQPLLHEDIDTLILGCTHYPILRPLIQNVMGDQVTLIDSGAETVNDVSMLLDYFDLANNSGDTPTHEYYTTGAPSMFDELGEAWLELTAPMHAKHVNIEGEADHAMATVPEAKGKTIVVASKNQGKIKEFKTMFEPAGITVKSLADFSSVPTVDETGTTFEENARQKADQYAKDLQLPVIADDSGLMVDALDGQPGIRSARYAGDGHNDAANNAKLLAALADVPEDDRTATFHTTLVLAKPDHPEADLVVHGDVSGLITAIPRGTDGFGYDPFFFVPALGKTMAEMTAEEKNQISHRGNAMRALEDVWQTWLEANG

SEQ ID NO: 2272 - protein, 174 aa, Lactobacillus paracasei
MKILAVSDTHGDREILTALLKQQPHLDGYFYAGDSELAADDGLFQQYEAVEGNMDYDPNFPMQITTTIQGVTVFMAHGHRFGVNFGLDKLIAAGEGVHADLIIFGHTHQLGVEEHAGIVILNPGSISQPRGQFANLGGTYATVEFTADNVHVDFLKRDGAIVPELSRDFSRKHD

SEQ ID NO: 2273 - protein, 245 aa, Lactobacillus paracasei
MTYDLGVRLAAEFIGTAIMVLLGNGSVANVDLKGTKGNGSDWLLIAVGYGAGVMIPAMMFGAISGNHINPAFTLGLAASGMFPWSEVLPYIAVQMAGAMFGQLLVVAAYKPHYDLTTNTQHVLGTFSTISATKSKLNGFVNEFIGSYILFIGALGITKAPFFQNNLGTAHMGLGFLVATLVASLGGPTGPALNPARDLGPRILHALLPLKHKGSSDWGYSWVPVVAPILAAILAVFTYKVLFIKG

SEQ ID NO: 2274 - protein, 161 aa, Lactobacillus paracasei
MLNPVIANMLIENRHHFMISADMVATVSENNPLSHAFLVLTKVRYAKIPVLDHDSKFKGLISLPMITETMLGLDHMSFNSLDTMTVKDVMQTEVATIDDPYDLENVLHLLVDNPFIPVVQDGYFTGIVTRREVMKGINNIGHNIDKNFQLEPLTVTVPKES

SEQ ID NO: 2275 - protein, 300 aa, Lactobacillus paracasei
MLNFVKGAIIGIALVIPGLSGSIFAVVVGLYDRLLNAVNHFRDDPKKNMRFLTPIGLGAVIGILLSTKAVLVITTRWPLPSYGFFIGLVLGIGPFIYRKLTTKKFSWWYLLLVVFGFVAIYGLAKLGGTDPENLIAIKRLTSVSDAGVMAFAGVFAVSLMAIPGISGSVMLMVIDQYGTVYNAVGQLGDAARAAASGNWSAFQTAMGSVALLLPFMIGAAAGLIAVAKLMAYLLAHFEAQVYYAVCGIVLAAVVILIEAGIAPYWPATGHLGAIAMVVISLVIGVLATIFLDKPDADEKK

SEQ ID NO: 2276 - protein, 294 aa, Lactobacillus paracasei
VIHMIVTATTVNEQTNVWLKYFTTIDWDKIVGTFIDKVLSLLFFTVLFLILYRLGRFALNRTFKSYQRRAHLTGTRVKTIHALSVNVFFYLVLFFYLYAILSILGVPVGTLLAGAGVVGLAVGFGAQGFVNDVVTGFFILLEAQFDVGDVVKLGTISGTVTNVGLRTTVVKSSDGTVNFIPNRNITIVSNLSRSNMQVLIKLPLAPSADLDLVRKTIERVNQDLVPKFTTITEEPDILGLTEEKNGAFTYQVLFYAENGEQVSLQRTFLGAYVAALNSAGIKVVTPPLNLQSGS

SEQ ID NO: 2277 - protein, 142 aa, Lactobacillus paracasei
MSGGEIAWIIAAVAFLIIALAIAIIAVRVSGVTKEVKGTVAETNKTLNTINGELGILTKEVEGLLAKSNTLLEDVNGKVAAIDPVFTAIGELGESVSDLNQSTRNLTERVAHGAKNGAKATVAARMSAKAFSMLTKKKHNDQ

SEQ ID NO: 2278 - protein, 175 aa, Lactobacillus paracasei
MAKKGHFLLGFVFGAASALATTYLLTPQTSDELKRRVKHASEDLADRAVDYFDYAKEASADWKQSATDFVDELKRKGDDADGSKALANYDAATEQLRDQLNTATDTDSSADFDDIVLDGKSAFAQAKDDDEGSDTRTDEVPEPVEPEAVAPASTDTAPASSVAPDEPQASATNDK

SEQ ID NO: 2279 - protein, 173 aa, Lactobacillus paracasei
MLNSERQAQIKAALSTAAEPLSASSFARQFAVSRQTIVGDIALLRAQGEPIIATPRGYMFSRPAAHEFLLPCKHTPAQTAEELQLILENGGWIEDVLIEHPLYGQLRGQLNIRTVADMKLFMSRLSRYHGRLLSELTGGIHLHTISVKSERDMPKIKAALRQAGMLYEQVEQR

SEQ ID NO: 2280 - protein, 367 aa, Lactobacillus paracasei
MNEHLAALQAWVAKEGLDLAYISDPININYYTGFFQDPEERITALIVTPDNDPFLFTPQLTIEEVKKAGWPYQVFGYLDHEDPFAIMANHIKAVTANPTKWAIEKDNLAVFKFEALMKQFPDATFPVDASRFIENQRLIKTPSEIKQMEAAGAQADRAFQAGFNAIKAGATEQEVAAEIDYAMMKEGVMHMSFGTIVQAGVDAANPHGEPMGTKLQPNELVLFDLGTDNHGYMSDATRTVAFGQVTGKPREIFDVCLEANLTAMAAVRPGLKASELDKIARDIITKAGYGDYFNHRLGHGIGMSTHEFPSIMEGNDLLLQPGMCFSIEPGIYVPGVAGVRIEDCVHVTETGCEPFTHTSKEFTVING

SEQ ID NO: 2281 - protein, 333 aa, Lactobacillus paracasei
LEKQTITIYDVAREANVSMATVSRVVNGNPNVKPATRKKVLEVIERLDYRPNAVARGLASKKTTTVGVIIPDVTNMFFSSLARGIDDVATMYKYNIILANSDENNQKEVTVLNTLLAKQVDGLIFMGHELTDSIRAEFSRSKTPVVLAGSIDPDEQVGSVNIDYVAALEEATRQLLESGNKRVALATGSLTHPINGQFRLKGYKQALEKAGVAYDESLIFENEPSYQAGLALFDKLQKVGATAVIAGDDELAVGLLDGAIDKGVKVPDDFEIITSNNTKLTEMTRPQLTSIDQPLYDIGAVAMRLLTKMMNKEEIEEKTVMLGFDILKRGSTK

SEQ ID NO: 2282 - protein, 927 aa, Lactobacillus paracasei
LKKFFDRVKTLGTRFRHWFTAFVTRRPDSEAETTNLTGKEAVVFYGNVTLQSIKTIVYYLLGVLGIATVFGLGLFGGYFVSIIDATPIPTEAAMKATLSNTSRTSSMYFAHNVKLSNVKSDLVSTKVDLNEMSPWLTKAIVATEDEDFYRHDGVVPKAVIRAFFSDLTGMGNQTGGSTLTQQVVKMMFLSSETTFKRKAAEIMLARRLNNHFSKDQILATYLNVATLGRNNKGQNIAGVEAAAQGLFGVSAKDINLPEAAFIAGLPQSPFIYTPYTASGALKSNLKDGVDRQQTVLFRMYRAGVISHKQYVDAKAFDIKGAFLQHENAEEDDNQYGYVYNMVLSEAESLLAEQLAKNDGHSAAELAKDNALNNDYLRQAANLFSSKNYQIKSTINKDVYDRMQFVMKATRSTFGQTYTSTQINPKTGETETIKHPVQNGSVVLDNQTGAVLGFVGGVSGELNHIYTLRSPGSTIKPLLVYAPAVDQKIIGSQTALADFKTDLGNNYSVTDYGGQIQNRFIPATEALAQSYNIPAVNLYKHIKPTVNVKDYMDKMGIDTLTKNDYSQLGLALGGTDYGVDVKEQASAFSTFANQGEHVPAYVISEIVDPSGHPIYQHKVKKTKVFSKGTTYIMNQMLKNVIDSGTAESLNYQLHFNTDNLIGKTGTSNDFRDIWFIGSTPGVTIASWMGYDNNDGTTYSLDETGSMTNEAYWAKLTNAVYQTIPKQFKVNQKLARPDTVKSVTVDKQTGQPAGTLTFDGNTYRTGGSTVTSLYNDWQPTTKNDFAIGGSKANYQLFFDHLDGKQNGYGQVSDANGNSTEAKKEHQETPITPTEDTQTTPSSAPSVTVPSSQQNQQGTSENQPSEPQTTGTGGTNGATGTGGTGGTGTTTETGTTTGTGTTTGGGTNTGGTNNTNQQQTPPATTTGGGQ

SEQ ID NO: 2283 - protein, 227 aa, Lactobacillus paracasei
MYRIILFDVDDTLLDFKAGELKSLAKMFARLNLTYSPRIEASYLKINASLWRDYEAGRITRPELFDVRFAKLFRHHHIEADPHLAERTYHHFLDQEAILLPRVLYTLDALQDYRLFIVSNGIEPVQRERLASSGLIDYFEDIFVSDSVGSPKPTVAFFDYVAKRIPRFDRRETLIMGDSLTSDIQGGINGKIDSIWFNPHFQPNRDHITPTYQLNEFSDLTKLLTLN

SEQ ID NO: 2284 - protein, 250 aa, Lactobacillus paracasei
MFEPDALNPWLDDPRLRAAVTTAGTVTSTNVILKKSVQNGGPLPQILIADQQTAGVGRHGKHFASPADAGLYISYAFHPQINRALITPAAGVALQQAIADQFGISTQIKWVNDLQKAGKKVAGILAEALLEQNAVILGTGVDLFPAASDPLPNDQPMTTILREVPANDPRPELAGRYLTHLMRLFANPETIMPAYRKRAAWVGRRITVSGTQNPLTGTISGFDDNGALLLKTDLGTLVVSSGTIRLVETV

SEQ ID NO: 2285 - protein, 467 aa, Lactobacillus paracasei
MTINWQQEAEKLEPQLLSDLTTLLKINSERDTDHQTKAYPLGPGPAKALEAFLTIAERDGFKTLNVDNVAGRIELGSGDEIFGLFGHVDVVPAGPGWQTDPFVPVIKDGKIYGRGTSDDKGPSIAAYYALKLIRDLGLPINKKIHFIIGTDEESEWVGIHRYLETQPAPDFGFSPDAEFPIINGEKGIASFKIDQKPIAAAPAELTLTNFSAGIRPNMVPQVATATITGNLPETFATQATAWADEAGVKLTLTLGNPTTIEVVGKGAHAQEPKDGKNAGTYLANLLADLPFDPAGKAYLLMVAKYLHNDSRGKLLGINYTDKLMGELTASPDIFTFTQDGEQSVLVNVRYPQGTDADTIRDQIETTLGADKVTVSISGHAQGPHYVPGDDPLVKTLLQTFTDHTGIPGHEQVIGGGTYGRIIKRGVAFGAQMPGQENVMHQANEYMPIKDIITAVAIYADAISRLVK

SEQ ID NO: 2286 - protein, 446 aa, Lactobacillus paracasei
MGKRLTLAVLLLPLFLLLSGFTLIGHRGDPLNYPEETYQSFDSAFNNGADYVELDVHESADGVVVIQHDSTIQRMTGANLAIATTNFAQLQQYHTKNGEPIHSLEDLFIHEQQTNHKFLIETKIVKGEPHPHLEDKIAALIQKYHMENRVMFHSFSAASLKRLQAVLPNVPRILIVGSLKRINFDVLTYVDGINLSSDLVTPQLVTQLHDLGKKVYIWDEMNENRSLWTWLVNLNIDGIVTNYTALGHEFQALKAAAVTTDINDLGANSSTTPLPIYENPYQPTLRHEQLAPETPVMISSMVTIAGNTYYQIGDNAFVPATTVNLAPQAGWASLFINQNAVVTGKKFRVPVYADPLHQQDVIAHIANHTRHHITAARYEGNHLYVKIKTGWLNAQDLQLLPDAENMTTWMSQYRSIPAAQKPLVHWALGDTAFDTPLLNASVVGIG

SEQ ID NO: 2287 - protein, 104 aa, Lactobacillus paracasei
MADKFQVFDLIQEITRNDGSRYFELGNVMMNGRAEKAAMKGLIKRVRIVQLNIPHSTAVTAYEQYINDHYEFPSADLTSWEEWDKPEGPVRQAYHEILKQNHVG

SEQ ID NO: 2288 - protein, 355 aa, Lactobacillus paracasei
VKYFGKWLIPFVAAIAVFIGMQFDSSLYAKPVGRVESVQVIKTTSHDDEDQNHDRLTKQQVKVRLLNTAKRGQSVTIHNTYSFSGGLDNQLRPGEQIFLDVDKGVYTLNNIKRDAILAALLVLTFGLIFLVMGRHAWLTSISILLNTVIFFIAVTWEIGSKQWQAWWLFVGLAVVFTILTAVFIVGFKPIAVTISLGSLLATGLAVALGYGVLTLTNYNGVHLEEVKYATQMPQLLFFAQIVIGSLGAVLDEASDISVAIFQLHDSAKERFQAGMAIGRNVMGPLISVLFMIFIADTFVESVLWIRNNNSIAQTVIWVMGLGFAQSLISAFGIVLAVPMTSGLAAFMAKIKKVAA

SEQ ID NO: 2289 - protein, 245 aa, Lactobacillus paracasei
MNAILALALLLLVMMLLIGGKQGLANFFALTVNALLMILVVILMASGFNPIILAVVFGLIILASTIFLSTSHVAVAGPAFVSALLIMTLLVGLIILTMTLSQTAGFGPEDSESLEGFSVYIGVSFPHILIATTLLGTLGAIAEAAIAVAAGMDEIKDQASDAGIKQMGHEIIGTALNTLFFGFFGGFSSLFIWFASLRYPFSQIINNKIFVGELLQVLISVIAVVLTVPMTTWVVTTRHAHRRKE

SEQ ID NO: 2290 - protein, 200 aa, Lactobacillus paracasei
MQYFIADTHFFHADLLGQNDFAPRLFPSVEAMDTAMINAWNARVGDRDIVYHLGDIAMNPEHFPQPPEVLGILKQLNGRIVFIKGNHDYESLFKFLHRNDPGVNGQPKFTFHDVGTIIKDDHTQFIMTHYPLMMGIVKQTLNLHGHIHHNSVNLAENINVGVDAPERDLLMPHLPFGTPLSAAEVHEIYRLKAQALAQNR

SEQ ID NO: 2291 - protein, 458 aa, Lactobacillus paracasei
VEKLVILHTNDLHSHFENWPKIRRFMLGTRAAEQAEGASVLAFDDGDAMDRSAPLTEATQGQINVQLLNEIGYDAATIGNNEGVGNPHDVLEHLYDHANFPVALANLFEVDGSRPTWAKPFVRTQTRAGTRIAIVGFTAPFFLTYRPNGWQVKTVADVFPDILKQLSGTYDVLIVLSHLGIEADRHLAKQYPEIDVVIGGHTHHLLADGELHGTTLLTAAEKYGHYVGKVTLTLDDQHQIITRQAETFKTELMQAAAADPREIQGYESKGIALLKQHQVARLPKQLSIKYDGPSPLLDLGLEALADGAQVDAAILNAGLFLMPLGPGVVTQADLLTCLPHPMHLLKVTLSGKELWRLIMEMEKNRMFLRHFHMIGMSFRGKIFGDIGYRGISVNREKRVVLWHGKPLVPEQQYTFVTVDNFLFIPFFPTIEIMGSNELLFPKLLRNVVGEYLAQKYPL

SEQ ID NO: 2292 - protein, 214 aa, Lactobacillus paracasei
MGEHEPLMQQIDAALTPEADKDSRVVIVNGDLLTIDGRRYRLVKDHRNAFDVARLNERYNEILDKYDYIVGDWGYDQLRLRGFYKDDRRGVSKDQLIGTLEDYLYEYCNFGCAYFVLACLDKSVTKGQPHRRQGHREAGQRSETIKPVHRQTPPTNRRNSQNNKHKPRSAKAEKPYTEKTTRPTKIRGDQAKTINQTQPRKRHFTIRRRETNKK

SEQ ID NO: 2293 - protein, 258 aa, Lactobacillus paracasei
LKYKGYMIDLDGTIYRGKERIPAAKDFVERLQAAQIPFLFLTNNTTKSPEDVVKNLAENHDIHVQPAQVYTPALATAAYLTDLNHGDVTGKSIYIIGELGLKQALLDTGLRLNEVDPDYVVVGLDYDVTYHKFELATLAIKRGAKFIGTNADTNLPNERGLVPGAGSLIALVERSTQQRAFYIGKPEPTIMEKALKKMGLPKEAVAMVGDNYNTDIKAGLNAGIDTILVYTGVSTRDYVSKQVHQPTHQIDALTDWEV

SEQ ID NO: 2294 - protein, 207 aa, Lactobacillus paracasei
MKRIAQWVALWLAIISVLVFMTILSTLITFPVYAHMDDLPQIAVMSLGRLYQNYLQLMAYLNLPWVGTLHMNDFPTSVHGAIHFADVRHLFLFDIGVAVVTVPFAVRWLHQLRITRKRYLLVRPFMIGAVVPVVLTAILAVNFDQFFITFHEVLFRNSDWLFDPATDPIINVLPEGFFMLCFLTAFALFEAVMIWGIWRGRQDAKVA

SEQ ID NO: 2295 - protein, 217 aa, Lactobacillus paracasei
MTQLFDFIMHIDEHLITIVNSFGPWTYAILFAMVFIETGVVIFPFLPGDSLLFAASALAANAAYNLNVWILFAVFLAAAVIGDTVNYEIGKRVGSAASTGNGWFGRLINRDKLKQAEAFFDKHGGKTIAIARFMPLIRTFAPFVSGGSRMHYGKFIHYNLLGGFLWVTMCVFGGFYFGNVTFVKEHFSLVAIGIVIISLLPMVIAAIKTRTAKATER

SEQ ID NO: 2296 - protein, 167 aa, Lactobacillus paracasei
MTNEEKLYDRTIQLLHERGVRISDIGELVMFLQERFIPKLTLEEATQNVRIVLRKREVQNAVMTGIALDKAAEANSLEEPLQKIIAEDEGLYGVDEVLAFSIVNVYGSIGFTNYGYIDRIKPGILAKLNAHEPGIIHTFLDDIVGATAAAAASRLAHSHPEIEDDIY

SEQ ID NO: 2297 - protein, 340 aa, Lactobacillus paracasei
NADPREDCTASEMSVQHVYEITVIGGGPVGMFAAFYAGLRQADVLLLESLDELGGQTGNLYPAKILYDIGGFPHVSGKDLVTQLKTQLVHFHPEVKTATEVQTIDQDPDGFFTLHTSQGDFRSKTVIVATGGGAFTPRKLAVDYDPALEGKKLFYFVQDLETFRDQEVAVAGGGDSAIDWALALEPVAKHVSLIHRRAKFRGLEASVAALEKSSVTIQTPYLIESVTPQDDQLAIQLKEVRGEAQPTLTVDKLLINYGFVTDKHHLQAWQLDTDRNGILVDTQMQTSRPGIFAIGDAVSYAGKLPLIASGFGEAPTAINEALSRLYPDRRQALHSTQLYH

SEQ ID NO: 2298 - protein, 194 aa, Lactobacillus paracasei
MDYPQLELKDFKGPKAIFETSEGRFEIALFPEQAPKTVENFVGLAKKHYYDGLIFHRIIDDFMIQGGDPTGTGMGGESLWGKPFNDEFSNQLFNLKGALSMANAGPNTNGSQFFIVTNAHLDPSMQAQLSEAGFPEPIIEAYKQGGTPWLDHRHTVFGQVLSGLSVVEKISKVKTGANDKPVEPVTIDQVTIED

SEQ ID NO: 2299 - protein, 119 aa, Lactobacillus paracasei
LTGKVTGVQPYGAFVMLDEHTQGLVHISECQHGYVKDTSDIFTVGQRVEVVILDIDEYTQKISLSLRALQASPRMSKKRRRKHYWTSRKFHTGFAPIAARLDGWVAEALDHLDEEPAHK

SEQ ID NO: 2300 - protein, 94 aa, Lactobacillus paracasei
MIDLRGKRILFTGRLRSFRRLQAQQLATILGAKPVNGIDKNVDILVVGIISKPYDQLLTTQKLTYARTYGIPKIDELAFISWCQWRLDQLKATL

SEQ ID NO: 2301 - protein, 216 aa, Lactobacillus paracasei
LAKIGYARVSTRDQNLARQIEQLHDAGVNKIFQEKLSGKNADRPQLKAMLDYIRDDDEVVVLSLDRLGRNSHDLTDIIETIRRRGAQLNVLNLPSFASIEDPNLRNLITTIIVELYKYIAQEERETIKIRQQQGIEIAKRQGKYKGKIREYGPHSPNRQKRYIYKEACRLLNRKKDGDETLTKRQIARMLGIAPVTLYRIEKYQAEDLANVPPSKR

SEQ ID NO: 2302 - protein, 377 aa, Lactobacillus paracasei
MAEIDLKHLYKSYDDGNDYAVEDFVLHIKDREFIVFVGPSGCGKSTTLRMIAGLEDITKGELVIDGHLMNDIAPKDRDIAMVFQNYALYPHMTVADNMAFGLKLRHYSKDNIQKRIDNAADILGLNEFLQRKPADLSGGQRQRVALGRAIVRDAPIFLMDEPLSNLDAKLRVSMRAEIAKLHRRLNTTTIYVTHDQTEAMTLADRVVVMSVGKIQQIGTPEEVYKNPRNIFVAGFMGSPAMNFFHVAYRNGIVSDGNKIRMEVPEGRAKTLNEQGYNGKEIVFGVRPEDIHSEQAFIDTWPDAIVEAEVSVSELLGATEQLYLKTDNEEYIANVNARDFHSPGDRIRVGFDINKAHFFDKETQMAIVDNPIPIESMN

SEQ ID NO: 2303 - protein, 246 aa, Lactobacillus paracasei
MTEDQAFWNAFAPDYAAAEQASRLPIAHDVIAWLRSTQLLPAHSAVDLAAGTGHYAVQMMPWVQELTLIDWSSAMLAFAKERMHQQADTKAQFIVADWRKLHKPLNADMLFVSQLPTLKPQDLKLLMNWASQTVVLNFQTAQSDALLEQAASLLGLQLPPVYQADPARMTSFKVWLTAQRIPFQSHSLTYEIEEQTTLSDLLPDLATPIGLKTAASLAKTITGHENTHVQVTDQLTYTYTQLVWHV

SEQ ID NO: 2304 - protein, 515 aa, Lactobacillus paracasei
MSVLTVTGLSQRFLDKVLYQDASFQVNIEDHLGVIGQNGVGKSTLIKILTGALTPDAGKIVWQKHLHVGYLDQYANLVPGQTVIEFLRTAFSDLYRKEAKMNQIYADYANHPDDDLLAKAGELQQELEAGDFYDLETTIQTVAEGLGITAMGMDHPVEALSGGQRSKLILAKLLLEKPDMLLLDEPTNYLDVSHIAWLTDWLQNFEGAFIVISHDFDFLENVTNAVLDIEFGQITKYTGTLKQAMRQKEADHETYLKAFAKQQETIKKTEAFIRKFKAGTRATMAKSREKQLARMDKLTPPGTRSKAHLAFPYAPVNRQILVDVNDLVVGYDKPLLQPMNFSVAKDQIIAFEGFNGVGKSTLLKTLLGLLPAISGNVEIADNVVFGYYEQELHWDQPKQSPVQYLEQRFPALTQKTVRQVLSRTALTSEEANNPLTMLSGGEQAKVKLADLMLQTTNILVMDEPTNHLDDDTKNALREGLQQYPGAVLLVSHEAGFYDSSWVDTVVNVEQLQVKA

SEQ ID NO: 2305 - protein, 312 aa, Lactobacillus paracasei
MGIMESRLIHGTVGFAIGDALGLPVKGQNAAELTAAPVTTMKGYGTFNQPAGTYSDETGLALAGLDALQHGFDEQALIKAYQAWFTAGKYAPYGKRSPDIWPSIETALKTGQSVAAPKEPGALIRILPFAFFAYQTFDTSLFQKAEGVKVLETFVHITNQDAENLVAAGIYMQIAVELLGATPDLPSAIATGIDKAGSYFGTTQPYQPIFEAFQAALADDKWPDGSATDPISLLARTLKALQSKPDYHDAVLQTVNQGGATDTTGALVSGLAGLAYGYTSLPHRWCLMLAEYAQIVDLCRQAENSGFFPKYD

SEQ ID NO: 2306 - protein, 199 aa, Lactobacillus paracasei
VKNNSHSTLKTVLEFLVLFAVIFFASQLLMRYVLSKDVVQGTSMQPTLENGDRLYSIRVKKPKRNDIVVINAPDRPGSLYIKRVIGMPGDTVSSKDNQLSVNGKKIAEPYLNKKFATDEINKWASQQGLDASTIKFTNDFNIKTLSSTKSAKVPAGKYFVMGDNRLVSHDSRDFGFVDKSKIQSVVVWRYWPLNQMKLY

SEQ ID NO: 2307 - protein, 110 aa, Lactobacillus paracasei
METEAYMTLAEVKARQAALKDKVPLDQAIAENIQNWAQWLLDEGFEGSYFTAKIDGDTINITGLDGHPAASISTDAPSYVEAFKDSDRMTMMAIQTKLRRLIDRQVLKSQ

SEQ ID NO: 2308 - protein, 247 aa, Lactobacillus paracasei
LTEHLMTYRQLKQKAKGQLKEGTNRRDLMLAYLLPSLIQAAVAIITYLMVFALIQKFGIDKALTDPDGFQNYLQSGNRTGSMNTIQSLVNTMLIQGVNFGVLDLVRRKERVQPLHALLGLFNGQWFWGAISLWIFMYFLTLMGLSFFLIPGILLALGWRQAFWVFKDGHETNQRFSSISALIGSWRLMRGFKGDLLGLYVSMIGWYLLENITFHLFDWVINPYLQLVHANYYENRRAYKIAAQAAQS

SEQ ID NO: 2309 - protein, 260 aa, Lactobacillus paracasei
MVKPLVTIIVPVYNLEAYVAHGLKSLIEQTYSHLQIIVIDDASKDHSPQIIAHFAELDSRIQPILKQVNHGVSAARNSGLALAKGDLVAFMDGDDWYEPDFIAHAVDMMARGWDLIAMPFYRDDPDPRPVHEALRKPKQLTREGLIRQMLHPIGYIRGYLWNKVFRRDVIEQVRLRFDESMTIMEDELFTATYVMATHRFLYTGHPAYHHVVRRDSATQSLGIIGAVPQQLYALWRIHQVLRVARRTEKVTKKEAIKIEH

SEQ ID NO: 2310 - protein, 252 aa, Lactobacillus paracasei
VAMYREKRFEEIKKLLAARSELSIEDIMKAVGVSRDTARRDIVALDAQGVARRTRGGLVSLSFGHTIPSYSARLKRFSTQKTKMAKSALSLIKPGGVYFIDDSTTLLKLSQSIRQPVTVYTHSLDNAIALSVEERVNLHLFGGKLDHHARFFFEPTMLETLRRIAFDAAFIGATAIAEDGVYFSYMEDAQVKQAAALSARRVVVVSETEKFQIEAPYRGLELGQITTLITDKKLSRTHKQWFAPQTQFLLGD

SEQ ID NO: 2311 - protein, 228 aa, Lactobacillus paracasei
MASNHSQKVEAIADHADADNDSSHVNAKSIVLSNEAKVEQANAHSLINPKKEITFTVGTNDIAEAAHQIADQKAAAAKAAEEQAAAEQAAAEQAAAEQAAAEKAQQEAQQAAQNAAAASAASAASASSSAATTASTETTTNKGTFKLSFYDPSVLGSGLGYGGVAANLSVFPKGTRLKITLSDGTVWYRTVNDTGSFAAGNPNQLDVAMPNSQIPSAGVLTATVEVVG

SEQ ID NO: 2312 - protein, 459 aa, Lactobacillus paracasei
MSPQPTLTKRQYLTLGSLLFGMFFGAGNLIFPIHMGQLAGSAWLPAAIGFLLSAVLLPLLSIMAISLTRASSMYDLARPAGHSFALFFLLATHASLGLLIASPRTATVTYSIGIAPFLGKGQQQIGLLIFSFIFFLTTFLLARNESKITTYIGKLLNPLLLILLAVIFFWALVIKGDIRAISFTSSPKLMSSNLINGFLQGYNTMDALAGLGFGVTIITALKLMGLHQASTRAKAVAKVGSLAMGLEALIYMLLILLGAISLGFSKLTANGGTAFNQIMTHYTGLIGTALLGAMTLLACLTTAIGLVTSFSQDLGHRFPKLGYHFFLPMTTIGAFLIANFGLDQIIAYSTPILMLLYPLAIALIMLGLMHPWIGKNTRIYKTTVAFTMIPALLDAIHALPAGLAQLPIFSSIQQFATTYIPWFGIGMDFVPFLLIGFLTGFIAAKLSGHKLAPDLPDPD

SEQ ID NO: 2313 - protein, 364 aa, Lactobacillus paracasei
MDKQPDLDQRTLKRKPKRRHPILRALAIIALVALFLAGGYAARFYSQAKKAVAKTYDPVSTKAVSSDLDGKKPISILLLGTDTGAFGRKDTGRSDTMMLVTINPKEKKTTMTSIPRDTLAEMVGTGSDSPTYEKINAAYAYGQSDAAIKTVEKLLDVPINYYVTVNMAGLSKIVDAVGGVDVNVPFSWTDWNTGGQTFKKGKAHLDGGMALAYARMRDEDPEGDYGRQKRQQEVINQIVKHLLSVKSLTNYQKVMDSLSSSMRTNLTFDDMMAIAQNYRASATTIDRQQLKGIGVYIDEAAYQVMTTETLQKMSNELRGQLGLESKTLSNFNTQQNEINNANGFDWTANNPVYTVSLDGATTGP

SEQ ID NO: 2314 - protein, 599 aa, Lactobacillus paracasei
MQHLPARAEVPTELTWDLTTIYPDDKAWQVDFEAVRQQAKEAAALKGTLGKSPEALVAGIKAVLAVFRRFEKVYVYSSLKSDQDTGNAAYQAMNAKAESLAADLASQLAFMDPEILAIPADQLTAWRDTESLKPYGHFIDAITVNRQHVLTTAAESLIASAGDALNASHATFNVLNNSDLQFGFVENEDGETVQLSNGLYGQLIRSTNRKLRKDAFEALLRAYESLKNTFAQTLSGQIKAHNFNALAHHYPDARAAAMASNHIPESVYTTLLDQVNAHLPLLHRYIALRKKILNVDQLHMYDIYTPLTGRPPLSFTLDQAKDEALKALAPLGNDYLDHMREIFNNRYIDVVENKGKRSGAYSGGAYDTNPFILLNWHDAVDELYTLVHETGHSVHSWYTRHHQPYVYGDYPIFVAEIASTTNENLLTDYFLKNTNDPKVRAYILNYYLDGFKGTVFRQAQFADFEHWIHQQDQHGEPLTATSMSSYYADLNARYYGPDVARDPEIAFEWARIPHFYYNYYVYQYATGFAAASTLAAGISGGEPEAVSRYIGYLKSGSSKYAIDTMKAAGVDMTKPDYLEAAFSLFEQRLAELEEILQKG

SEQ ID NO: 2315 - protein, 293 aa, Lactobacillus paracasei
MSSVKLGFIGTGVMGTGIIKNFLKNGQEVVVFNRTQAHAQPVIEAGATWAESPHAVAAQCDIVLSMVGFPQDVETIYFGSDGILAGARKGALLIDMTTSTPTLAKKIAAKAAEKGLQAVDAPVSGGDIGAKNGTLTIMVGGDKTLLSRLQQLFTPIAASVNYFGPAGSGQHAKMANQIMIAGTMTGLTEMLVYAKAAGLDLDETLKVVGGGAGANWSLSNYGPRILQGDYTPGFFAKHFLKDLRIALDEADNMHLQLPATQLAKQLYEQMVNTGKGNLGTQGLITMNDRWDQA

SEQ ID NO: 2316 - protein, 282 aa, Lactobacillus paracasei
MTTIAILSDIHGNMTAFSAVIQDAKAHQADEYWFLGDLFLPGPGSDKLWATLHGLKPTHIVKGNWDDDLFWVLDGPVDLSQPTDVYFSRLVAYLWPHLTAENLATIRSWPLHEVFEQDGLIVSLAHNLPDKNHGHALYPDQPQLNFDQIAPDSQIDLAVYGHTHQQLLRYTSNGQVILNPGSIGQAYSPRPHLQTTTYADYALLQLNDGAITDLDLRQVPYDVSAELSLAKQQQLPYPEVYTKLRHTGATSTHNAAYLKQFEQRHDYQQEVAEFLHKYRHQH

SEQ ID NO: 2317 - protein, 265 aa, Lactobacillus paracasei
MNLFAYAFMQNAFMASTFIAITTGIVGVFVVARNMSFLAHTLSEVGFAGAAFAVFAGIRPLDGMLLFTAISSISVGRMSVQASRREASISAVSSLFIGLGILFLSLSSANASYATTILFGSIIGISRADVWQLVALAAGVLVTLYFGYRRLAFDSFDPVGSAAQGLKSKYISIYFLLILAVSVSIGAQIVGSLLVFILLTLPPNVAKYLGRTLPQMIVISVITALIGVWSGLYLGFLTNWPVTFFIAAIEFLFYFLALWYHHRTN

SEQ ID NO: 2318 - protein, 239 aa, Lactobacillus paracasei
MSEPILTVDHLSFGFRDQQLYQDLSFQLNVGSMTSLVGPNGVGKTTLIRLLMAQLKPQAGTIRFRQQPPVRLGYVPQFRNVDTEFPLSIRSFIQLRQLDHLFFWHTGKEKAALDAVIKATHLGKIADTRLGMASGGEKQKAYLAQALLDDPNFLILDESTASLDVNTKQELMDLVQELNQTRQLTVLFVTHDLSLAKKYTQQYLLLTGSSYEMKPTAQMDLKAMPEELRNDAENRGVIA

SEQ ID NO: 2319 - protein, 114 aa, Lactobacillus paracasei
MYEPTKKRRVAEDVAKVFPKEVTNQIFDVIAVMNKAKQIVTAPVAIAFSDDYTDDEMYAMIIQGNLAPAQEFPLTYAGEKPFLGHGYILVVKDKPKTIRLDFSTANPFKAEESK

SEQ ID NO: 2320 - protein, 450 aa, Lactobacillus paracasei
MDILVLVLGILLLLVLIIKFKFNTYVSLIITAVVVALGLGMAPAKIATSIQNGIGAQLGELALVFGFGAMLGRLVADAGGAYRIAHTLINAFGRRGLQLAVVLASFIIGIALFFEVGIVLLVPIVFAIAAEAGVPILTLGIPMAAALSVTHGFLPPHPAPTAISTALGASAGLVLAYGVIIAIPTVYIAGPLFSKLAHRFVPDAFERRGNLKALGPQKTFKLEETPSFGISVLTSLFPVILMAIATVYELVFHGGKLPKTPNGLDNVIAFIGSPSIAMLISLLFAMWAMGYARKLPAKAIMTTLEDAVKSIAMLLLVIGGGGAFKQVLIDGGVGDSVKNLFVGSGISPLILGWLIAVVLRIALGSATVAAMTASGLVLPLMQSAGIQPALMVLAIGAGSLAASHVNDAGFWMFREYFDLTIKQTLLTWTLLETIISVVGLGGVLLLSLVV

SEQ ID NO: 2321 - protein, 522 aa, Lactobacillus paracasei
MAIKYMIGVDLGTTSTKVVLFDLKGHAIATANNPYPLYQDTPDMAEEDPEEIFAATVGGLTEVMHRGNVQPDELGGVSFSAAMHSLILMDENDKPLTRVITWADNRAAAYATKLKQSDLGMTLFKNTGVPTHPMSPLVKLLWLSAEHPELVAQTSHFIGIKDFILFRFFGRYVQDYSLANATGLFNIHTMDWDDRALDVANVRRDQLPELVDTSYQLTGLNANYAAVTGIDAKTPFILGASDGTLSNLGVGAIDPGVLAVTIGTSGAVRVVTDKPVVDPQGRLFTYYLSPNHWVVGGPVNNGGIVFRWVRDQLFAPEKLTAEQLQVDSYEILTEIASKIPAGADGLLFHPYLGGERAPIWDANARGSFFGLTRQHTRAHMVRAALEGIVYNLYMVMLMIEGITGKPKAIQATGGFARSALWSQMLADVFEQEVNIPESFESSALGAVVLGMKSLGLIDDLNVVKDMIGVTNTHEPNADNFQAYRELLPIWIRLTRKLGSEYQAIADYQRAHPDPNAHIAAED

SEQ ID NO: 2322 - protein, 328 aa, Lactobacillus paracasei
  misc_feature (20)..(20): Xaa can be any naturally occurring amino acid
NADPDEPENDENTDECARBXYLATINGMHIGMVGLGKMGMNLVANMRDHDIEVTAFDLNDKAREEVGQYGAKAVASLDALVMSLASPRIIWSMVPAGKPTEATISQLAKPLRPDDIVIDGGNSYYQDSIAHGKLLAAEGIHFFDVGTSGGMAGARADGNFMIGGDKAIFNKIEPLFKAIAAKGGYLYTGPAGSGHYLKMVHNGIEYGMMQAIGEGFDVLAHSPYDYDNAAVANMWNNGSVIRSWLMDLAANAFTEDANLEKIQGIMHSSGEGAWTVEEALRLHVATPVIASSLMMRYRSEEADTMTGKVVAALRNQFGGHAVDPIKSK

SEQ ID NO: 2323 - protein, 280 aa, Lactobacillus paracasei
MHDFLVQLQIYKPNLSGQEKKLAAYLQAHPDHASQANISELSQLTGVSTATISRFAKALGYTNFQALRMALAQTSPEDDHALFAELSPKDSVDTLAQKIFTSNIDALRTTLANLDTDALTKAVKWITHAEHLGLFGLGASNLVALDGYHKFLRTAIPVAYAADYHMQLMAATHLGPRDAMILTSHSGEDKDAIALAELAKKQQVPLIVITGSPTSRLVKMADAAFVAVAEESRYRTEALHALIAEISIMDTLFMISAIKTDSQTAPLFRQVRATIDATRH

SEQ ID NO: 2324 - protein, 286 aa, Lactobacillus paracasei
LAHLTKLTDTYTLSNGVKIPIVGFGTWQTPDGDVAKHSVEAALAAGYRHIDTAAAYGNEESVGAGLRASGVPRDQIFLTTKLWNGDHGYEATKAALDKSLKKLGVDYVDLYLIHWPNPIKFRDNWEETNAGSWKAMEEAYKAGKVRAIGVSNFRAKHIDALLKTATVKPMVNQIFLNPSDLQPEVVAYNDAHDILSEAYSPLGTGKIFQVDALKKIAARYHKSVAQIVLRWSLQHGFLPLPKSVHDDRIKENTELFDFELSHHDMTLIDALHGEAGLATDPDTTDF

SEQ ID NO: 2325 - protein, 250 aa, Lactobacillus paracasei
MRQFFTVIGGMGTPATESYVRLLNQRTHAHSDQEYLNYILVNDATVPDRTDYILDHSKPSFYPDLLEDIQDQSLLNPEFMVIVCNTAHYFYDQLAAATPIPLLHMPHLAISDMCERFPDEKRVGLIATQGTIQDGIYSHEIETSEREVVLGDQALQDMVTELIYKYVKEKGEVNAALYHRILQRMHDDFNVNVIVLGCTELSFAQEKAGDHPYHVIDAQSIIVDKTIALGKAFRQSEAAGKALLNQMMAR

SEQ ID NO: 2326 - protein, 517 aa, Lactobacillus paracasei
MALSLRACILLLKEHHLLKSAAIQNTEDVDMTGIAYDSRKVSGPTLFFCKGDKFRPIYLSMAKDNGARTYVAEKPYVEGNGLNALIVRNITKAMAILSAAFFDYPQDDLFVIAYTGTKGKTTASYFTEAILNEARPRHIALFSTIDTVVGPEPDQRFKSNLTTPESLDLFRDMREAVENGMTHLVMEVSSQAYLRNRVFGLTYDVGFFLNITPDHIGPNEHPTFANYLHNKLQLLVNARKVVINAETEHFDQVYAAATTTTYPESIYLFASAGFRPKRDDIDIDFRFDSQEADVAESRFTLVPVTEKAAALNIGGHYSLALIGDFNESNATAAIIGAGLAGVDASAAVPGIAKVKIPGRMEHTKVAGHGAVYVDYAHNYASMKALLSFLKHAYKDPRLLVVVGSPGDKGVSRRPGFAKVLTEFATEAFLTTDDPGYEDPANIIEEIDSKIDHSKVKVHKVLDRQKAIAEAISDSGPNDIVVVAGKGADPYQKVRGVNTPWPTDMAVVKQVAKSLQEG

SEQ ID NO: 2327 - protein, 155 aa, Lactobacillus paracasei
MVTYHEITPTGLANLKQEVEDLKTIRPAKIKNLADAAALGDRSENAEYSAAKRELRQLEGRLRYLDKLIRYAKVTHPAASDIADIGNRITLKFDDDEDQATYELVGPAEAGMGQDKLAINSPLGAAIRHHHAGDTVTVTAPSGSYQVTLMNIASA

SEQ ID NO: 2328 - protein, 436 aa, Lactobacillus paracasei
MKKLMRGLIAAVVAVLMIGGAAPAMSVSAAESSDTNLVDAKAAVAIEPTTGKILYAKNASSVLPIASMTKMLSIELVLDAIKSGKINWDDKVTLNNAIWELSQNRDLSNVPLRRDGSYSVRELYDASLIYSANAAMMLLAEKVAGSQEKFVSQMTAKLNSWGITDAKIVNVTGLNNSQLKDAKVPGTDDNAENEMSAKDMAQVAQHLLKDHPEVLKTTSIAKQTFRKGTSDAIDMENWNWMLKGLVSYDKNLPVDGLKTGTSDAAGDCFTGTVEKNGMRIITVILHANGDAKTRRFDQTKKLMTNVLENWKTMTLAEAGQGIKGYDSVKVNRGQSRTTPIAPSTKAVAVVPSNSSKQSLQYTYTPAKGVKKNTVEAPVKKGTTIAQLEVSAKGDNLGFVGSSASEGITLKTTKTDNKANFFVLIFRGIGDFFSNIF

SEQ ID NO: 2329 - protein, 396 aa, Lactobacillus paracasei
MSEKVKLTGKEKSELWIEGIVTVILLLMLNFALLVLINQMIAHNPGLENAIWGVKTNLTFGSRGFHLWSWSNLFLALMAIADVIVVYWRLARRYRQMQMRHVIAELHFIADGHLDHRIKFEVNTELQKVVSSINALVDSTVNSMAEERRIEQSKDELITNVSHDIRTPLTSIIGYLGLIEDHQYRSEEELLKYTHTAYLKAKQMKVLVEDLFEYTKVKSTTTKLNPVRFNMIAMLEQLAASFELEAHKKHMRILVSGEPDPLMMEADTEKLGRVFNNLIVNALKYGQGGRHIFLDAQRIGSEVVVKVSNDGAQIPNDALSQLFDRFYRVEESRSQETGGTGLGLAIAQSIIALHGGYIYADSSPEITSFVIHLPLKVGASLTDNKNKSNEEAGKSK

SEQ ID NO: 2330 - protein, 228 aa, Lactobacillus paracasei
MKILIVDDDKEIVELLSIYVKNEGYEPIQAYSGKEAITKLVTNPDIALMILDIMMPNMSGMDVVKEVRKDSQIPIIIVSAKTADMDKIQGLITGADDYVTKPFNPLEVMARVKSLLRRSQNEVTNTEPDVLEVGPLTIKKDSHEVTTLTGKQIQLTALEFGILYLLASHPNRVFSADEIFERVWQQESIVSAKTVMVHVSHLRDKIEEATDGEKVIETVWGVGYKVEA

SEQ ID NO: 2331 - protein, 226 aa, Lactobacillus paracasei
LKDLTKIVTASLPSTMHIAGINIARSSGSTYWLLRQSSQWLTLRLATHPHWLRGVRQLQVVLPASSARHDSITMLTKALASPAAAKNTYTFTAIDTALANMLLWTASRKLVFMLRLTPEMATTHKMTPFCLQQDFAPLPLFLGDRNNSNDLLLPVHDAKLQQSLIDFYSANLLFTQFSSHQLVKLLPTAQWLQTILTTVPTNPAWPLTLATTFGTELLDVIHRARM

SEQ ID NO: 2332 - protein, 495 aa, Lactobacillus paracasei
MSLWDTKFARRGFTFDDVLLIPAESHVLPHDVDLSVQLADNLKLNIPIISAGMDTVTESAMAIAMARQGGLGVIHKNMSIEAQADEVLKVKRSENGVIVDPFFLTADKPVSDAEDLMKKYRISGVPIVNNTTDRKLTGIITNRDLRYVDDKSVLIDTVMTKEGLVTAPAGTSIEDAEAILQSRKIEKLPLIDKEGRLSGLITIKDIEKVVEFPHAAKDAHGRLLVAAAVGVTSDTFDRAQALLDAGADAIVIDTAHGHSAGVIRKIKEIREQFPLATLIAGNVATAEATEALYDAGVDVVKVGIGPGSICTTRIVAGVGVPQLTAIYDAASVARKRGKTIIADGGIKYSGDIVKALAAGGNAVMLGSLLAGTDEAPGQFEIYQGRRFKTYRGMGSLGAMAQAHGSSDRYFQSGVNEANKLVPEGIEGRVAYKGSLGDVIFQMLGGIESGMGYVGAPNLQELQDNAQFIQITGAGLRESHPHDVQITREAPNYSVQ

SEQ ID NO: 2333 - protein, 273 aa, Lactobacillus paracasei
MAEKHEAETKQTATDAAVTGKNTATTEQTASKVQSAATDESSADQATAAKNAHVKQEKPATTVPELIARLTNKNDEYIFKLRRELKDGGMNAADEEELLKTMLPEIITAQRQGKPANQLYGPVTVKADEILHTPKPEPKKPMWLMVIDQSLFFMSILAVMYGALAYFDTKSQNAASSSFVYLVMLSLMAGLFFVYYADWMQQDKKKRRSAWLVLGGGVVLVVSITFIGSALAMLDTPFTRPMPWFVNIIIGAIAYGIHWVLQHRYHLKSFFQR

SEQ ID NO: 2334 - protein, 340 aa, Lactobacillus paracasei
MANYPFATIDPNVGMVEVPDKRLARIDELIPAKKIIHTTFEFTDIAGIVKGASKGEGLGNKFLENIRQVDAIVHVVRAFDDDNITSVTGKVDPLEDMATINMELAIADLDAVNKRYAKVEKVARTQTNDKEAQAEFKVLKKIKPVLEDGGMVRSIDFDKDELKIVKGLFLLTSKPVLYVANIAEEAMADPDSVDYVKQIKAEAAKEGAEVIAISAKTEEEIAELDDDEKADFLAAEGVDESGLDKLIKASYHLLGLATFFTAGGKETRAWTFRQGMKAPEVAGIIHSDFERGFIRAETMSFTDLDKYGSVQAVKEAGRYRSEGKEYEVQDGDIIEFRFNV

SEQ ID NO: 2335 - protein, 60 aa, Lactobacillus paracasei
MYDLHDLVQMKKPHACGTNKWEIIRLGADIKIKCTGCGHIVMMSRRDFEKRLKKVLGHVE

SEQ ID NO: 2336 - protein, 290 aa, Lactobacillus paracasei
MANKNNKGLGRGIDAIFKDFESPDLSANNTVEELPLIDIRPNPYQPRKTFDEEGLKELAGSIKQTGVFQPIIVRKSVSGYEIITGERRFRASKLAGKETIPSIVRDFNDPEMMEIAVLENLQREDLTPLDEAQAYDTLIKRLNLTQAEVSARLGKSRPYIANYLRLLTLPQQVKQMLSANQLSMGQARTLLSLKDKSKMVSVAKKTINENLTVRQLERLINQMNAGNTRPATKEKPKSPYVRATENQLGERFGTKVNINEGNKGKGKIEIDFTSEKDLNRILAMLDVNID

SEQ ID NO: 2337 - protein, 255 aa, Lactobacillus paracasei
MAHIIAVANQKGGVGKTTTTVNLGACLANLGKKILIVDADAQGNATSGVGVQKAQVEKDIYDVLVNEEPITEAILPTKHKNMSIVPATIQLAGAEIELTSQMAREMRLKLGLHPVEDQYDYILIDCPPSLGQLSINAFTASDSILIPVQSEYYALEGLSQLLNTVRLVQKHFNPSLAIEGVLLTMYDARTNLGAQVIDEVRKYFGDKVYATVIPRITRLAEAPSYGLPIVDFDPKSRGSEVYEALAKEVLAAHGE

SEQ ID NO: 2338 - protein, 276 aa, Lactobacillus paracasei
VPLSSIFGHKKPDDETVVQQLPMTAIVPNQFQPRKVFTPESIRELATTIKDHGLLQPIIVREYKPEKYEIIAGERRYRAMQTLGWEKAPAIVQKMDDDESASMALVENLQREGLSAIEEGQAYVALMKLNHLTQAALAEQLGKSQAFVANKIRLLKLSEPVQEALMKSRISERHGRELLKLDEKQQVAALHQIFADDLTVKETSALINEMLRPKKPTPKPKPKVRRSAVSHDTRIAWNTLKRSVKMIRETGMTVTAKEEDTDDAYRMIIEIPKEKR

SEQ ID NO: 2339 - protein, 243 aa, Lactobacillus paracasei
MDPAAFVQALADHGIVLNDHQQDQFAAYYQYLISENEKMNLTGITAEGDVYLKHFYDSLTLALVLPELQTQVMSVCDVGAGAGFPSIPLKIAFPQLKITIVDSLQKRIGFLERLTARLELTDVQLFHDRAETFGAKKSPHRASFDLVTARAVAALDVLAELCLPLVKPQGRFVAMKAAATPAELIAAKSAIGLLGGKLAQDAALTLPETGDPRHLLVIDKVKPTPNKYPRKPGIPNKQPLGGA

SEQ ID NO: 2340 - protein, 126 aa, Lactobacillus paracasei
MELDGKEIKENEQLTDAQLADLHKQYEALWDKLKKDNYRTEHQFMEVLYEEPDNSQNYEAAFFTYQIRKDTGDNQFDQLTITLNNKPTFHDQPDEFVFEISDYADMDALHKAIEEKAQPWIKAHKR

SEQ ID NO: 2341 - protein, 223 aa, Lactobacillus paracasei
MADKIKIAYLYEDLMNTYGDSGDVKILRYLLNQQGYQVDVDNVSLGDHFNADDYDFIFFGGGQDYEQTVVAKDLLRHAQTLGQYIENGKPMLAICGGYQLLGDYYKTSEGSVIKGLGILPLHTVFKPDSRMIGDTKYETEFGTVTAFENHSGRTYFDDKQKLKPLGKMIEGYGNNPEDGVEGMRYKNTIGSYSHGPILKNQNIAKAIANMIVKNHKARMGQPA

SEQ ID NO: 2342 - protein, 238 aa, Lactobacillus paracasei
  misc_feature (5)..(5): Xaa can be any naturally occurring amino acid
NADPXIDREDCTASECENZYMEFDEPENDENTMTIGIIGSGNVGRALGQLFSHVGEQVIISHRHGVASLAPVIAEMRSTVEAGTVADAAKQDIVVLAVPFNALPELPTSVDPKTIIIDATNYYPSRDGDQPALAAHQVTSSELVAKHFGTKKVVKAFNTIAMTKIRSLAKPSQPAGRIAIPIAGDDNAAKQTVTTLIKRIGFDVVDLGSLSDSYPAQADGPLFLFAGDADQVRAQVQH

SEQ ID NO: 2343 - protein, 215 aa, Lactobacillus paracasei
MKILVTGFDPFGDDKINPAIEAVKCLPDEIAGAQIVKLEIPTKFNVSADVVKDAIAKEKPDYVLSIGQAGGRFELTPERVAINLDDGRIQDNAGYQPLNHTIHGDGENAYFTQLPIKAMAKAIREAGVPAAVSNTAGTYVCNHIFYQVQYMRDKMFPDIKAGFMHIPFLPEQVVTRPETPALSLDDDVLGITAAIKAIVARDGKGDIETIEGKNH

SEQ ID NO: 2344 - protein, 304 aa, Lactobacillus paracasei
MVNTLLLILYALIGVVMAIAGIEAFRAKDNPARIGTGLFWEIMAVIFAFGTLMPAMVVGVLVVIIGILALFKQIQIGKIKPVDGAHAATAAKRLGGWVFVPSVVLAVVSIGVAQFTKLGGQVGIGIGAAVSLIVAIIMTKAPGKMVYNDTQRMVRSVGAAGILPQLLATLGAVFTAAGVGSLTAKLIAGLFPTGSHLGGVILYCVAMALFTIIMGNAFAAFAVITAAVGIPFVIAQGANPAIVAAIGMTSGYCGTLLTPMAANFNSLPVALLEMKDPLGVIKQQAPIAILLLIIQIGLMYFLAF

SEQ ID NO: 2345 - protein, 225 aa, Lactobacillus paracasei
MEYLKLLGIVIIVVGFALKWDTTAVVVLAAVVTAVFSGMSIPALLTTLGQSFVDNRMVSLFFLTLPMIGLVESHGLKEVAVNGIQKLKKLTPSRILNIYLVIRELGGVFGISLSGQVQFVRPLITPMVTAAAETKRKLTDKDIDLIKARSAATDNFGNFFAQNLFVATAGVLLIASTMKSLNHPVEPMQVVLASIPVALITLVIVAIYNRWFDRQFEQQSHKGGK

SEQ ID NO: 2346 - protein, 141 aa, Lactobacillus paracasei
MDNTKNAGINKELKFDDAVIAKIVGITCNEVEGVYSLEGGMMANMTDLFRKDEDPTKGVDVDLSDDQNVSVSLDATVRYGENAPEIFNKVTMAIVKNVRQMTGLNVTEVKMTVKDMLTKDEIARNEAKNKDADKEKDLQPA

SEQ ID NO: 2347 - protein, 137 aa, Lactobacillus paracasei
MDAVATPPVAASPAVTRETLMANSRLTFEDKVIEKIAALCAREIDGLLGMDGTMMDNLTETFSSGENITKGISAEVGEKQVAIDMDVFLAFDSDAQAIFKQLCEKISAQITRMTGLQLVELNLHVKDVLTKREWQKK

SEQ ID NO: 2348 - protein, 65 aa, Lactobacillus paracasei
MQRGMIGAVIGIVLAFAWMRFGFMGMLLVLIFGAAGWLIERYLVPNWHAFTSWLTAGKDAFSKGK

SEQ ID NO: 2349 - protein, 179 aa, Lactobacillus paracasei
MRPITKIMLGIIAVGGLLQSVGFGLLLWPSREFTRFYLQQVVWLRPTMIGLTGLVALVFLIMLLVAIFRRSTAQSLILAGEDGDLTLDKSAIENTVAKAVVAQHFAKSVAVAVSIRKKQVARMRIEAFSGNSKDLKAEAKQIEETARQKLQACLGIPVKHVRVHLLPATKVKAKTARVI

SEQ ID NO: 2350 - protein, 85 aa, Lactobacillus paracasei
MMHFIWTLIIGAVIGCIGQLIVGRDMPLGWLGNIIGGLVGAWLGTALLGDWGPSLAGMALIPAIIGAIIVVFLVSLLLGTTRRKA

SEQ ID NO: 2351 - protein, 133 aa, Lactobacillus paracasei
MATLTQDMKDMIGAQLNYLATADENGNPQVGPKGTMRVFDDHHLIYNEETGKQAWHNLQYSKKAAVATVDYKALKGFRFEGTVEFHHDDKIFEDAQAFAKAHHLPAAISAVLINVDRIYKLDAGPNAGDLIEG

SEQ ID NO: 2352 - protein, 320 aa, Lactobacillus paracasei
MAKVYISAALPKSANAALQKAGVDFEAYTGSGLITESDLQTHLAHTEVLITALSTPVTAATLAKAPHLKLIANYGAGFNNIDVTAAKAQGVLVTNTPKVSTTSTAEVTVALILAVLHRVTEGDRLMRGAGFAGWAPTFFLGHELAGKTVGIIGMGQIGQAVAKRVHAFDAKILYTQRHQLTSATEQTLGATFTDQATLLRESDIVTLHLPLVPATHHLLDAQAMATMKPTAYLINAARGPLIDETALLQQLQAHKLAGAALDVYEAEPHVSSGLKALDNVVLTPHIGNATVEARDAMAKIVTDNTLAILAGKQPEYIVNA

SEQ ID NO: 2353 - protein, 64 aa, Lactobacillus paracasei
MTKTAWYRIVLVLIAVGLIGVLDLVMTQNQIANPFLVGGLGLTLGIVLALLVASIWQPRNSRKP

SEQ ID NO: 2354 - protein, 80 aa, Lactobacillus paracasei
MSEEIVFFNPGDAVANDFDFAAARRSAQIYKAEHVVDEGLVVAKDKDGKYSVFYEAAGTPDSKAKGDYKAVGKYTILAHL

SEQ ID NO: 2355 - protein, 155 aa, Lactobacillus paracasei
MKAIILYASITGNAKGMARIEQQFFEHYGWDVTLGEMIQTDPTTIKDYDVLVLATYTWTGGVIPEETEDFYEDLSKLDFSAKPLVFGVLGTGDPYYGKDYNTAPELFEAVLAASGAVQGADPVKIALNVKQEEMPQFAAFTKSLIAKAEALQADK

SEQ ID NO: 2356 - protein, 101 aa, Lactobacillus paracasei
MEHYAYLQDLAADQNDRQLRVRIWDNKNIIIRRNLGQQQGLATQVWDAWLRQELRRFNGFEPIIEIDDFSGHQEIRFFKENELADAVHFILQGEGTVETAS

SEQ ID NO: 2357 - protein, 168 aa, Lactobacillus paracasei
MTNSETKQYSWPKFRRSLRFGRPSAIIHFIYLLAIAPYVFWAIYFIGLTALLLVSKPSMLLALLSYIGKLLLLDPILQTWQLLTSLNFAETGWMLLIVISYWCVIAGIVMHIVHRIRKRQLFHQLISGQAQIITKADQTFVMDKHQHHYPLLKHPVRWWQASPDRRWY

SEQ ID NO: 2358 - protein, 56 aa, Lactobacillus paracasei
MVLTFGTTSLYKHTFVNAIALFTVALKLAIRSLFYRFNQATQSDNVTIECHTCADW

SEQ ID NO: 2359 - protein, 68 aa, Lactobacillus paracasei
LAEKDQISAFSREIIDFQRKNHLTDTEMALNSHVSVEHIHNIKSMREMPDSSVVATLKDYMEHKPSGK

SEQ ID NO: 2360 - protein, 124 aa, Lactobacillus paracasei
MDKKLKTEIDDVEIMIGKVMQIGVVLSALVIILGLLLLLVTGSTGYATGVHPTRVGDILSGTLALKPYAVLMTGIFLLILTPVLRVVVSIYAFAVEHDRLYVWITTIVLIILLGAMTIGYLGNR

SEQ ID NO: 2361 - protein, 280 aa, Lactobacillus paracasei
MEQMIMLMVTGLLGGILGAVLGIGGGMIITPILTMLMGLPIQYAIGASIVSVIATSSGATIAYLKDEMLNLRVAMFLEIATTVGAVIGAVVTGLVDGKVLYVLFGALLIFSAFNMIRKMRMKEPEERQSKPDEIATKLRLNGAYFDKATGKEINYTVTNVPGGFAMMFGAGIASGLLGIGSGAFKVIAMDTIMHMPLKPSSATSNLMMGVTAAASATVYYFGGQLQPQIAAPLAIGILIGATVGSRIMPMLPTKVLRLIFIPVIGYMGIQMALKGFGVNI

SEQ ID NO: 2362 - protein, 437 aa, Lactobacillus paracasei
MHKYLWWLIPLVLLLGIGAATQQSVQAASGTWYRDDGDMMGAKSQAAVNRLNNETFAKVKGHPQIAVITVKSLDDDEIEDYANDQFAKLGIGKKGWDNGLLLVLSREDRKYWLEVGYGLEDVVPDGSADEIVTSNVKTQLKAQNYDEAIALFLDHIGQRVTANQSAIATPAQITAKRARDAAIQQAILIAALILMALLVLFFVVHMAMAARLRDAMRDTVALEAMPLYAAVMAAGIPVRRQTASLPLFKFAWSHAKLREIGLANLARRGFESWTRVLRLTAPYPYWYYYQTSKPLRQLADQDVVAAPSVSALAALLTPALADRFAKGRPYEASYAQWLGQQKNVAGQAAVTTWSKFLENVKETDRFSAEMLAATFGVILFHIRHPEKNQDLSQYDLPLWVVSDFGSSASSGSSGGSDNFGSGFGGGSSGGGGFGGSW

SEQ ID NO: 2363 - protein, 210 aa, Lactobacillus paracasei
MNSWNLIGLLAWVILIAYLIFIVWHIRQRHIKAIVKSGKQVRGSVVLIDIAEVLVFAIAAIGMVWVSWLRPIDYRDSRAVAISHSAEHLILQTGEDHSFYVRVQTGNGKNPTLYYTYWTNGAKYENTSHNAEVSAGTQPLTPRAAGYPWSKKDLKKLDQTADQAYVATVTARYKPGFLNGLGMHVGNIADRFSILRVPNDTFVEIDPVKD

SEQ ID NO: 2364 - protein, 463 aa, Lactobacillus paracasei
  misc_feature (5)..(5): Xaa can be any naturally occurring amino acid
NADHXIDASEMLMKVVVVGCTHAGTAAVRELLMKHPETEVDVFERREDISFLSCGIALYLEGTVGRLEDMFYATPASLEALGPHVHVHLKHDVLSIDASDHRILAENLKTGNQQHYQYDKLVMATGSYPVVPPISGVSIPRVLMCKNYDDARRIKESAKDAEHIAIVGGGYIGVELAEAYSRNHKQVTLINGVSPLLSHYVDLPLSHEISEALTTRGVELKPNTVAKHFDSDEQHVFIQTDKGEIQADLAVVCVGFRPMTELLIGQVDMNPDGSIHVNDYMQTSNSDIFAAGDAVAVHFNPTGKDAYAPLATNAVRQGMMVGANLFKPTIKYMGTQATSALKLYDHNLGVTGLTLAHAKRNHLSAASVTMTDDFRPPFMPDTVKITMVLVYDTDDRRILGAQFYSQYDIVNAANLISVMIQNRNTIDQLAYVDMLFNPNYDKPWHYLNLLGQLAVTQADNTTA

SEQ ID NO: 2365 - protein, 616 aa, Lactobacillus paracasei
MHITLIGAGPRGLLILERLLSWQQNRFPKRQLTIVLTDPYPIGGRVWKIDQDPNLIMNTAASQITLFTDQTVTNVGPFLTGPDLSTWALTTASGYLDAHPEFNNRAILLRQAAALGPNNYASRALYGVYQHWFFDMLVARAGNNSITFKQQTVVSLAKNVANFTITTDQESWHTDQVVMALGNLKNSLTRDQKALDDYAHAHDLFYLAPGFPEEGDLSTIEPQAPVIIRGLGLSFFDLMSRLTEGRGGRFQKTADGLLAYHPSGREPHIFTGSRRGFPYRAKGRNQKGPGEEWEPQFLTTEQINTWQAHGEVSGQTFWEALQHEVELVYYRLLLVQRYPDLDVTAFEHDFVADPVTTLGTLPIAAKDRLDWDALADPTKWHPSGQPYQDFMRHYLRRDAREAMRGTKTGPLTSALEVLRDMRDPIRQLVERGLLSQDQYLDFFLRWFNSLNDFLSIGPPALRIDQLQALLGAGIVTILPPGMQIKGIDGQFLLKTPSDPSFSVQAKSLLEARVPAVNAPTAQNALIQQLLHDGYAHTYELQLNADKRFQSGAIAVDRQTQQLLDTNEHPQPGLFFWGVPTEGVHWLTTASPRPLVNDTSLKTAEQIVQTIWTMPKP

SEQ ID NO: 2366 - protein, 207 aa, Lactobacillus paracasei
MNNFFNMIDFEFLQKLLTHIYISFTAIILGVIVAVPLGILLSSFKKRSNFIMAVVGMLQTIPALALLTLMIPIFGIGRTPTIIALFLYSLLPILRNTYAGLETVGENYIDSAKGMGMSWGQRLIFIRLPMSMSAIIAGIRTSSVYVISWATLAAYIGAGGLGDYVFSGLNLYRMDLVMLGTIPITILALTVDSLLRIVENHFSLQKG

SEQ ID NO: 2367 - protein, 303 aa, Lactobacillus paracasei
VKRIVAVILMLLILIISFVSNIQSAGNTITVSGGVTSESQILGSLVSEMIEHYTDNKVEFLNNLGTATIDQQAMQRGDLDISATRYTGTDLVTTLGEKTEKDPTKTLRTVQTQFERRFGYYWSDGYGFSNQFTFLVTKETAKKYHLKTVSDLRRVASRLSLGTDQAWYKRAGDGYLAFSKYYGMKFRDVYPMQVGILYDALVNKELDVILGYSTDGRIGSYDLVMLKDDKKFFPPYAASFVLSKDTLQRYPKLKGILNKLSGTIDTKTMQKLNFQADDEMLEPQKVAKEFLEKHKYFEEGEKK

SEQ ID NO: 2368 - protein, 209 aa, Lactobacillus paracasei
MIQESLDYLSTNFSYILNQIGIHLYISTLGVVITFFIGFPLGIFLSNHQKSEFFVTNLINIFQTVPSIALLTILLMFMGLGQRTVLAAVVVYSLLPIVKNTTVGLKNVDPIYIENARSIGMSKFQTLWIVMIPLAAPIILAGVRTALVMAVGVTAIGSFVGAGGLGDIILRGVNITNGSPVIIIGSGLCVLIAIGVDVLFKWIIGTSEE

SEQ ID NO: 2369 - protein, 304 aa, Lactobacillus paracasei
MQAYQYQKKGLALIFLAKKFFVLKVGDRVPTVTEMINESELSRGTIQAGLELMKADGAISTISKGHLGSFLVAQDQDKLLSYLDYRNVVCAMPLPYTKHYEGLGTGLYKAFKNQKLGLNVAYVNGSVNRLEGLQRNRYDFIIVSALTADYLAEHHDVDVVGIMPEGSYVSQHVIVYKGDQDFKMRDGLRIGIDSHSLDYKLMTNKILEKHKVELVESPYNQIVQRIVAGEIDAAIWNLDEVKSKNYPLSYQMIKDPMVKRASRAAILCAKGNGFVKRVIGDYVDFKEVTAIQKQVISGEVLPEY

SEQ ID NO: 2370 - protein, 116 aa, Lactobacillus paracasei
VSDETAKKLQILYDVGKLSDEDLAFIRLVDQYLVRTVGERDSEMFLIHLSVALERSHKQEPVDALPDNLWAEVTADPAYQKALSIWQHVAASRPVEFSDFETRYIIMHLVNILRRG

SEQ ID NO: 2371 - protein, 120 aa, Lactobacillus paracasei
MTRIVIGGQMGKDELRQSLEKLTAGKDVEISVKSDLDAAMAVKDNKADFYIGACETGAGGALAMATALLGSSKTLTVASPSKVLSEADIKEGIDNGKIAFGFTINTKDTILPILAKYLTK

SEQ ID NO: 2372 - protein, 431 aa, Lactobacillus paracasei
MNISVLVDYVLIALVGGVGSILANRGIAVFNDGLRPIMPEYLEGKIDRKELAATSFAVSFGLIIGFGIPVSIGSTILVAHSILLAADIIGTWTPANKWGTALAGVVGAVYGVGLLFGLSFIVSAFKMLPVNFLGALSLLGGPILLAFCAFPALAVASQHGAKKGMITFGATFVAYLLATKFGVFSVGNGIKITLNPIGMSLLVAMLFMLYFAAQIKGEGTSNASLVNVFSARVSRIKKNWIWLSIMGGLITAASSVLIIAVDVLPQQLLVKGQVMEAAIATLARAIGFIPLVFSTAIVTGVYGMAGTTIIFAIGLLLKGNPIVAFIAGFVWMWIEVQALAGTAKGLDKFPGLRDMGEHIRTSLTDTIAIALLIGAALACNKMAPNLGYFWVIGVWLLNKKLKKPLVDMAVGPIAAIALGILLNLLRIVHLF

SEQ ID NO: 2373 - protein, 294 aa, Lactobacillus paracasei
MLLPGKVYAHEHIPIDLSEVKQNEDCHLDAIDQVIAEFKDLYQKGVRNVISMTNKGMGRNIPYANKVAKESGINIVQCTGFYQDAFLPIEVFRLSVSQLAEQMIKDIQVGIKGTDIKAGVIGEIATSKGQWTAAEEKVFQAAVIAQQETGCPISTHTSIGTLGREQVDFFKRQHADLKHIVIGHVDLTGSADYVLDMLKTGINVEFDTIGKNNYMPDATRVEMLKAIEAAGFTDQVVLSMDITRKSHLKANGGNGYAYLLDSFIPQLQDAGISETFINKMIEANPQRIYGDINA

SEQ ID NO: 2374 - protein, 365 aa, Lactobacillus paracasei
MPSFKTYPLESIGYDEALRKQFLLVDEITRHFKGSEFLSRGDLGVVPGLNQPRYTKRVEEILAAYFHAEAAMLVRGAGTVAIRMALHSYLRAGQTLLVHDAPIYPTTQTSIEMMSLRTIRADFNDLNHQQLPESPDGILVQYTRQKPDDSYDMAKVLAFFKQRYPSVPIVTDDNYAVMKVHKIGVELGANLSCFSTFKLLGPEGIGCIVGAKSAIQKLRSENYSGGSQVQGHEAIDVLRGLTYAPVALAAQANVVTELVERLNGNEIPGISEAYVANAQSKVLLVEFNQPIAEKVLKYTNDLGAAPNPVGAESKYEIVPMFYRVSGTFKKFDPNLLKTTIRINPYRCGADTIMRILAESVEKVMA

SEQ ID NO: 2375 - protein, 390 aa, Lactobacillus paracasei
MFLKQLEKLNPELIQYAFELHHSGKILPDTYVIDLDMIHQNTTHMVAEAKKNHVELLYMTKQVGRNPVIAQEVVNAGIPEAVVVDFREAETFMENGLALGNVGHLVQPPKHFLTRLLKYGTKYVTMYSLENTQALNEAAKEVGIKQKVLLKVMGNGDDIYPGQTGGFTLAELDKQLEQLKTLSNIALVGITTFPAILYNESQEDFAATANVKTIDEAKSIFSKHGLKAQVVSLPSATSTTSLPLIKQLGGNEGEPGHALTGTTPLHAVKEQPEKPAYCYVSEVSHTFGPHSYIFGGGWYRRGHLKNALIQDGDQYTHAHVLPLENSNIDYYLELDQQFKSGLPVIMAFRTQIFVTRSTVALVRGLHTAGKTPELVGLYDSQGKKLPEGMQ

SEQ ID NO: 2376 - protein, 409 aa, Lactobacillus paracasei
MGKYGVIVLDSFGVGAMDDVPKVRPDDIGANTALNIIKAVPQIKIPNLEKLGLMNAIGQERGDHKFSPTANWGTSLLMHHGADSYLAHQEIMGTKPKMPLLQPFNEVIDTVEAQVKKDGFNVERYGDPGYQLLLVNHCATIGDNLEADPGQVYNVTAALDEMPFDEITRLGESVRSVVKVSRVIAFGGRGVDLKNILAARKIEHEKYVGVSAPESGVYNTDYHVIHLGYGINPKVQLPSILHANGIDVALVGKTADIMNVDTPRKFPGVDTDYLFDKFVEQSKDMKDGLLFMNIQETDLAGHAEDPVRYAEVLETADKRLADVLPLYTGDDILIVMADHGDDPTIGFSLHTRERTPLLIYKEGTHNKYVGERSTLSDVGATGSDFFKVPFPENGKSFLHRIIDGTDLDA

SEQ ID NO: 2377 - protein, 253 aa, Lactobacillus paracasei
MGLIEKEFAEHLSNLSETEKYAFYFIDAHPYIIRQLTLTQLAERLATSNTTIIRMAKKLDLAGYSEFKYRAMAAVKENTLPDQKDLIGQYRHLFTSLLDNVNFERLRYMATKIHEAKTLYIAGVGLTKPIAEYVAKRFIQLNKPTIYSYESHIIDLIPKLTRPQDVILFLSMSGETQSIIQAVKKFRYVDHNLLFSITNNGDSSLAKMMDANLSSSVPTNHFENYDITSRASLMVQADILIEIYMNMFDQPEN

SEQ ID NO: 2378 - protein, 561 aa, Lactobacillus paracasei
MFADKIETHLRQIYQDDRQYRQATQIFSDLLKSEQLADFRPVMPLSQKSAYLITYGDAFTEQHERGLSVLKQVVDLYLSETITDVHLLPMFPYTSDDGFSVTDYMAINPDLGDWQDVYALRQSKRLMFDFVANHMSANSLWFKRFLNHDAGFEKAYIEFDPTFDTSKVIRPRVSPLFHTYQNDRGETKTVWTTFSEDQVDINFGDPLMLARQTKVLLEYAKRGAASIRLDAIGFIWKESGTTCMHRPETHEIVRLWRTLLDHFAPNTQIITETNVPNKENIVYFGQGDDEAHQVYQFPLPPLVLYSFISGDADHLQEWAKTVQAPSSKATFFNFLASHDGIGLRPVEGILSADERQRIIDRVLTNHGQVSYKDNPDGTKSVYELNINYGDALRISTDTDAEAANKMIAAHNILVSMVGVPAIYYHSMFGSKGDLKAVKETGMNRRINRERIDYDRLKNELRTDQYRQKVYAGISHLLKVRQKNIAFNPFGKQEVLDLGKQIFAVKRFSDDGSAIISFTNVSSQPAIIHNIEGRELLSEKLVRNDLRLKPYGIAWLKMEASK

SEQ ID NO: 2379 - protein, 381 aa, Lactobacillus paracasei
VKVVVGIDSFKGSASSAELNQAVASSIKEVAGVTAVWPVSVSDGGEGAVASLQQRLDGQMKTVTTIDLLGRRIQAPYFTFAFENENYAAIESASVVGLDKVVPSPETIRQASSYGLGIALRKLDQQHFDHILIFLGGTGVSDGGLGVLRAFDGAIKDNKGQLLEEGNLLLQAASINLSKLSRLHSDLMIATDVTNPYSGESGAAKVYARQKGATVEQVNQLDTNAHQIASHVHESGGPDLDKSAGAGAAGGLGGALQLIGGQICQGFPTMAKFLRLDDLFEKTDLVITGEGKLDRQSTFGKVPFGMAKLAEKYAVPTVVLCGSKQIATCPKIFAGIFSIQPGPISLTDAMNKENTLANIGNTAYNILSTIQHVFAQRTQEG

SEQ ID NO: 2380 - protein, 662 aa, Lactobacillus paracasei
MDMTLITDPSLIFLHQDWQSKEEVLDHLINAFASEGVVNDKAVYKQAVLDREKISETGFENGFAIPHGKSVAVTKPAVAIVTLKKPLASAAWASTDPTNQVELIFLLAIPESQKGDAYLKILSDLAVRLMDEKLVDQLKHANTADQVIQLLGKKNQEATTTIKETKKRPKQILAITACATGIAHTYMAAEALQKAAAAKGVQIHVEKQGANGIEDGITPEMLKDADGVIFATDIAAKGKERFKGIPFVQTKVAEPLKHGEAMIDQVLNHPDGVVQGEAAASEVATTGKKQSWQSTLMQSVMTGISYMIPILVAAGVMIGLSQIGASFFGLNKVIGDPKMATNANQMIVLLYYMGQCGNMAMKFMYPIFTAFMAYSIADRPAIAPGFVGGAFAAGFQFILLGNAKGIPSGFFGALFLGALVGFLVKYMNEHIHLNKNFSAMKPMLILPGVSILVVFLANFFIVDPVFGGLNAWLQQMVLTYKDSSEVLLSSIIACLTAFDLGGPVNKAAGAVAIGMAADKVFPLTPRVLSIVIPPIGIGLATLIDKYVVGRHVFDEDLRVSGKTSLLLGFLAIGEGAIPFALANPLITIPINMLGATLGSVTAVLLGAVQWYPLPAVWGWPLVQNFPAYAVGILVGVLFIALTNIFIRFHIIRKKEKTTTAVK

SEQ ID NO: 2381 - protein, 885 aa, Lactobacillus paracasei
MTKSVFAVAHSHWDHEWYFTQEDADMILIENLDYLIETLEENPEFPSYTFDGQSSVIDKYLKIRPENKKRIEKLIADRRLFVGPWYTQTDALLGKTESVIRNLLYGVKQTQALGHTMAIGYAPDIFGMHAYFPSIYKRFGLKWAIFQRGVYNDQVSSNLNFNWQAPNGEVIPANNIFFGYGPGKFLSADDAYIKTRLKPILDELSRRNQHTDNLLLPAGGDQVLINRHFPKTIAELNRLLPDYDIKLTDYETFMQATWQHHHFPKTIEGELVAGQKSRIHNTCRSTRYDIKNLNFQVEDLLLNELEPLCTIGSQFGIKFPQNWLDQIWRKVFESQAHNGIGASNSDDANHDIVVRLTSALRQIKDLINMVKRQLTAAISKQTQLEDIVVLFNTNIREEHYQRSIVLFTHHKDFTLKTMNDEPLAYSILHQDELDGGKVIVVTAGGEQEKSVPPYYRTEILVEDIKLPAMGFTTLQVQDGVAGQCDHQSAIKAQVIENEFYKVSFDDDQHLRLQNKQTRQAIDDPFYFDDQADGGDSFDYSPISGDQAKLINEPVLIDVTKSARRQVMRLEFKAQLPASLNQTADARSEAVKDFVIKTTLVLDQGERHLKVEHDVDNHIKDHRVRVHWHTGVKNMSENYADQGFSLLTRKSTNSHEATWQTEGFVEKPKSIFVFESMIALSDDESHFSLHSGMLKEYQPYPDTHTLALTLFRSNGLLGRDDLAWRPGRASGINNMVVPTPDGQMLQQMHFAYTVEFGLKSIDSQQAFKQSDAIYTKTDFYQNQSLNSYLNRIDRFQIPKLKADVPAHFSLLHSQNENLFFAALKQGWNGGVVLRLFNPTNDAQPINLKTSEAIQRTRVVDLKEDPVGEFKEGQLLAAKDYITLKFN

SEQ ID NO: 2382 - protein, 575 aa, Lactobacillus paracasei
MTYELRPKIEAKDYQIAAQNDEIGNFIRQQLSQADPETQTVLVFEAYPGVDQDKLLALAKSLQPKLIINALDQTLPQSEVNAKLKTTLTDDRVLGLMTHANMADFFDSEKMNRVRDRIAHAEGLVIVYGVGASLVAGEWDHLAYFDLTRWEIQLRFRKGMNNWLAAPEPDILKQFKRGYFFEWRIADRRKEALSSMMDFVVDTTTNDHWTMITGDTFQHIQQLAVRRPFRLVPYFDASVWGGQWMKETFQLDPGKENYGWAFDGVPEENSVLFQLGNGEFEMPAINLVHNFPLQLLGERVTALFGPQFPIRFDYLDTMGGGNLSLQVHPKVEYIQQQFGMNYTQNESYYILQATSRSTIYLGVKNGTNKKELFDALKEAQTGQANFDDDKFINVFPVNKHDHYSIPAGTIHCGGPDTVVLEISATPYIFTFKLWDWGRIGLDGKPRPIHLDHGEPSADMRFDTDYVKDNLFSKNKVIQQTEQELIEETGLCDLEFIATYRYTFTDTIEVQDHDSVNMLNLVEGDAIELSSQTDAFPPVTIHYGETFIIPESCHHVQVTNLTPSKPVKLLQAFIKD

SEQ ID NO: 2383 - protein, 280 aa, Lactobacillus paracasei
MAKLVLQTDFGLVDGAVAAMYGVAYGVDGELSIHDLTHEIPPYDIFAASYRLYQTTKYWPEGTVFVSVVDPGVGSDRRSIIAETVDHHFIITPDNGTLTHLAKFVGLKRVSVIDEASHALPGSQESHTFHGRDIYAYNGAKLASGQITFEDLGKEIEPEQVVMLPLGEVKEGVDQIAGTIDILDIRFGSLWTNIPLATFKKLGVAAGEFVQVSIYYHDQLRYQNQMPFTRTFAAVRVGEPLVYVNSLLNLGVAINQDSFSKLYHIGTGVDWHITVKRLSV

SEQ ID NO: 2384 - protein, 186 aa, Lactobacillus paracasei
MRDQKALSVRTVVAIGIGTAILFILKRFAVIPTGIANTNIDISYGFLGFIATLFGPIAGFFIGFLGHALNDFTQYGTPWWTWVFTTGLVGMVIGLFWRRFNVEAGNFGMKKIVSFNLLQIITNVVSWSLIAPTLDIWIYSEPANKVYVQGIVSAISNSIATGVIGTILLVTYAATRTRSGSLKKES

SEQ ID NO: 2385 - protein, 566 aa, Lactobacillus paracasei
MAAPAIQLDHVTFQYDSQAEPTLHDINLTIQPGEKVLIVGPSGSGKSTLGNLINGLIPHAFPGKLSGTVTVNGTVVQDASLATLSLQVGTVLQDPDAQFVALTAGEDIAFALENSAVAPSEMHTRVKKWADRLKIGDLLAQAPQSLSGGQKQRVAMAGVLIDEGDILLFDEPLASLDPATGEASVDLIDELHQTYHVTEVIIEHRLEDVLRRPVDRLVVMKDGRIIADDAPETLLHGQLLQQIGLREPLYLEAAEFAGVDLDQADHLADLSRFEAPQLRPKLAAFTAEAATVKPEQLQAPLLSIDGLQFGYPNGRQIFTDLSFTLHHGEMVALVGRNGVGKSTLSHLIAGFLKPGAGRMTLDGEDLADWSVKERADKIGYILQDPNQMISKHLIFDEVALGPRLRGWDETRVKTAVIEALKVCGLYPFRSWPINALSYGQKKRVTIAAILVLEPALMILDEPTAGQDWRHFTDMMRFLTTLNERGITMMLITHDMHLMLEYAQRAIVLGDGGILMDDSPAAVLTNPAIIEHASLAQPSLYRLAKREGLDPLAFTQAVIDQERRVRQ

SEQ ID NO: 2386 - protein, 275 aa, Lactobacillus paracasei
MNSLFGYDPQDTWLHRLTGATKMLAFIGISVIVMASYDTRFVCAVMLASIILFAQAKIHWRQISLVVKIITIFAVVNLLLVFVFSPQYGVGLYGSKHVLLNAGYFTITQEQLFYEMNLALKYIVTVPLALIFLITTNPSEFAASLNKLHVSYRISYSVALALRYIPDVQTNFRQISLAQQARGYELSRKAKLFQRLKGMGQILLPLIFTSLDRIDQISQAMELRRFGTGKRQTWYMDQPLRTPDWIVLAGVAVIIVIGLFLFHVNGGRFYNPFRG

SEQ ID NO: 2387 - protein, 71 aa, Lactobacillus paracasei
MAISSGIARVPVNQAIELLRNTNDAIGDIAIKVGFSNYVQFAKAFQKARQMSPSVFRKAISNGDLSPRKID

SEQ ID NO: 2388 - protein, 844 aa, Lactobacillus paracasei
LNAVEKLYATIVQHFPTERITTNQAADAVGLTRGVTSSYLSKLEKQGKLLKTGSRPVYWQVKRDHSAFDDLIGVHGSLSTNIQLAIEAIVYPTHGLPIFITGPAGSGKLPFAQAIYHEAIRREVLKKTAVFKIIDCANYKDHPGTLKKKLQSENNATTADGTAESGYLYIKNVQMLGSSDQHYLFTHTNQQQTTAFRYIYSGTTEIFKAARVWFKSAAVQIKLSAFSDRPLNERITFAAMYLQQQADQINKEILIAPNELIKLANFDHVNNITALNNRVQLLCAGAYAKAPDHTQLRLGQTDTSAILVTPKQQTLQARITSLITSALQLGPTTDALFKKLSDSLNNGESITEQNFLLAKVLNQVDTIASEKLLSVFAQAIQKDAKTYITHVYGVTFPSDNIFWQNVALAFAFAGLCRDNLPDTQSALKIQKAIKHRYPRSYYLFKHFLTRLKAQYVQSPYYYLPFFMMMIHCESKIESVQYNAILLAHGEHTASSIQQVVNSLCGNYFFEAFDMPIDVTLDQINGYVQEYLTDQSPSAKGNIVLFDMGSLRQMFREIKKVSDQELIVVNNVTTAMALDIGLRVQRNDAFQSIAEASEQYGATTEAQYYEGLSNKKNIIVSCMSGVGLSEEVKKLIDATLSPALEVIAVDYKELHTLLTNHDRKFFSNTQLILTTTDVAGDIGADIGIDIVNVYNVFDKASSQKMQTVLRNCGESPQSINELIDRLVRFLSIEGIRGRLQILNPDIVIQESQRIVSHYEDFYNVKFGSRLKLNLFMHLSLMIERMMTSKRSTTSIDRATLTPPEQEFFSLSSGIFQPVEQKFNIKVQDYEIALLYQLLKDFIFVA

SEQ ID NO: 2389 - protein, 157 aa, Lactobacillus paracasei
EIIABCMPNENTMKYLLLVSHGDFSSGLKQTLGMFAGDDAIGSVIAVGLKPDEAASTFGTRFEALLKTLPENASFVVLADIVGGSPLTTVCNILNDHGKLQDTLVLGGMNFPMALTTLMSKDSLDNSALKEKAFSEATAAIKEFQTTSSEASDDDDI

SEQ ID NO: 2390 - protein, 164 aa, Lactobacillus paracasei
MAISFVRIDDRMIHGLITVRWGKEYPMDGIIAVNDKAANNPILKEAYMAASDKKTFVWTLDHFDKVKDKVLNSATKYFLITKSPQDMKKILVDMNFKPGDIKTVVVGPGNDRDNAVKLGDNQSFTQEEGDAFEAIEKAGYKVEFALLPDQRIGSWDKFKSRFGY

SEQ ID NO: 2391 - protein, 358 aa, Lactobacillus paracasei
MTKERSSRPRPLTLRFHPRWLALTITRSQSQKPAHKDLGRNGQSATITSKATYAPVSKRSCSRSQKRKVRKMTISWFQAAILGVFACLCSNSCMAGQAVGNYTIGRPLVGGLVCGIILGNLQLGIACGVAMQLVYIALVTPGGTVSADVRAISYIGIPLAMVAISSQGLNPLGGGAANLAKSVGTLVGTVGTVLYYAVATMNLVWQSFGWKDVHNGKLDKLTAVNFGWPWISHALFSFLPTMLLTYYGATAVTALRSALPMDGIAMKTLFTVGGMLPCVGIAILLRQIVGKAADFIPFLVGFTLAASLHLNLVSVTVVSLLFAVIIYEIEMSGSNNTPSKGSAAPADGPSDDDDEEDI

SEQ ID NO: 2392 - protein, 281 aa, Lactobacillus paracasei
METTNDMKKLDHKTLTKSFHRWFWGALTCFSQEHMQTFGYMASMLPILRKLYPKHDDQVKAIHAYTAFFNTNPMLGTVIVGITASMEQARANGKEIDGETINDMRAGLMGPIAGIGDSLIDGTLIPILLGISLGMSTGGSPVGAIFYIVAWVLMAYFGQRFLYFRGYRFGDQAVSFLVGKQGAAVRHAIGIVGSMVVGGVLASWVNVTTSLKLRGADGKVFLNLQDKLNSIYPGLLTVLVTLFCWWLMAKKHVSAIWTMLLLVVVSLVGVLVGFFNPGLSY

SEQ ID NO: 2393 - protein, 110 aa, Lactobacillus paracasei
MTIDEMTKGYEKEVAYQKHMLKNLGYWFQLCTILSGVGIVLIYFFHGKTLWLNIVGIVLLVLGALGMLMFGYSGWKGQQNVRAVVDDYDKKIKYFQKKVRQQTGITPKAK

SEQ ID NO: 2394 - protein, 1136 aa, Lactobacillus paracasei
LEMDEKKHYKMYKSKSVWVFACLSTCLIVSFFNDGQNVSAATSASSTQISQTNTGSQPNNETTGETAQSSVNSTATASSSSVADLPSSSDSKSSIGSTISQPAVDKKETSKSDTADNDLTKSVTTSDSDKALPTSKTTLPTSNEQVQSSVGQSQTDQPASSATIATNAVTSDVSQNDQYNEPYRNQYHYSSSQNWINDPNGLFYDSKTGLYNLYYQYNPEGNQWGNMSWGHAVSKDLINWTQEDVAIPMLQNQGWEDFTYTNTTGSLKDKGEVRYVGVPTTNWGDADGKKAIFSGSIVVDTNNVSGLGKDAILAFYTADYQIATRKNDGAEDGWGTWIGLTEIQEQHLAYSLDGGKTFIQYSKDGNAANPQAIIPTSMNQGGDAANFRDPSVVYDAVNKQYYLTVVSGQQALIYKSSNLLDWTYASKIERENDVGNGVWECPSLVPMKVAGTNETKWVFCISVQQGAHATGSGMQYYVGNMTADGTWVPESSKTLQNPMTMDSGEDFYAGIPFSNMPDGRTVMLAWQSNWSYVDEAKTSPWSGNMTLPRELSLKKNADTTDGYLLTNTVVKEIANNEEANVINKAESNFTVSRSDEQVQYEGKQYKISATFSWDEADKPKSVGFKLRVSDDQKYDMIVGYDLTTGLLYVQRLNTGEPNMGAPRDKMNATVNADGSITITVYVDETSIEAFANDGQKSITQNFFMRPENIGDQATTGVYVYSNDGTTKISDLTINPITSIWNSTGQLTEKFVDENGNTIASDKIQTGRVGQSYTSESATIPGYVFVKENTDHINSNQLYTTQNQTITYTYRASQASVVTKDTTLVAGPSAAWNAADNLVGATDADGNALAVSNLTVTGAVDPKTPGTYTVTYSYTDVAGNRISKEATVTVIASKADIVTKDTTMVAGPSATWNAADNLVIATDAKGNVLALSDLTVNGAVDPKTPGTYTVTYSYTNAAGNKISKEATVTVIASKADIVTKDTTMVAGPSAAWNAANNLVSATDADGNALAMSNLTVTGTVDLKTQGTYTVTYTYTDVAGNKISKEATVTVLTEKETNIEDNTGSSISNDRENPPASITGKGGDDIHQNAKTTMTKKKTETLPQAGNHVNELAIVLGQMILAICVGGILWLKRRVKRV

SEQ ID NO: 2395 - protein, 86 aa, Lactobacillus paracasei
MGLVPITHTFKRKVSCFAGDRYHHNDHSLCRFIGSADHRVHTIDQSNDHAASSSSRTYAGARSISRKIGKLKAAPTFTGMSRLLVA

SEQ ID NO: 2396 - protein, 82 aa, Lactobacillus paracasei
MVKKHPAELANLLATYEPNGTAMDMTIATLKRHKVAVLAAVTSPYSNGPIEGVNRLIKSLKRSCFGFKNQLNFFKRIYQITA

SEQ ID NO: 2397 - protein, 623 aa, Lactobacillus paracasei
MSLSNRQRQIVLQLINAEGAVTAKQLAESAAVSVRTVKYDLTDIRDWLAAKDSVLKSAPRKGIWIEASEAARTALREKIDDQLADNYLAPNERILRMILILSQTGDYTTQQQLQARVNVSQTTVNNDLKKLAVYLEQFNVKLISKNYYGYKLNGTELAIRRLLEQLITQQLNRKTLMAELVDSLNTKTEPKRALVLTGEATFDHAFNAILKEAIRIGKQEGDMPDPSALIATIIRLTIGVIRQGFNQLVNSYHRVEQSQTDQQYSDKLIMKTLAFYNLPALTDDYDYYLGQSVNEKVAPQDHNLVAMTHRIILAVGALVDHDFSHDSQLQENLYLHLSQSLGKKSQLLEYSPFTQDIKQEYPALFEAIEKTVNKELAGDQAVLSEAFVSFIALHFMVSLNRDSQMRTVRVAYVCATGIGITNLIQQRIASAIPNIELVGFASIDDARALIAREHPELVISVFPLKNLEVQVIEVRPLPNDADIAAIRRAVAKKLQVPLAQIKSQHPVVPIRPKPNLEQQTQQTILTMFSIYSELKQQLPTKIDPYYSDAFMMHVFLAVQRIMFDKQYQGKPNQDDPKLVGTVEHVFSDHGLAINRAEVHAILEYLSLSHEVSEEGDDTTGSER

SEQ ID NO: 2398 - protein, 118 aa, Lactobacillus paracasei
MTPLEANVELPTEVKAMIEQSSDAQAATALVNYVIKLAAEAEIHFTDLQLQVLTNHLIEMLGRSKSGEQLPAVDPTMFAEVSQKSLDLADQVVQHIGHLEVAEKYVLSIHFEAAQDKI

SEQ ID NO: 2399 - protein, 119 aa, Lactobacillus paracasei
MVKVVIADRMGKGQNVAKGVEAAGGTAVVVPGMGADMRLGQVMDKEKADMGISFCGSGGAGAITAHTQFGWPERHGMRSVQEGITAIEDGNKVLGFGFMDQEALGKALVEAWNKKYPEA

SEQ ID NO: 2400 - protein, 122 aa, Lactobacillus paracasei
MTVVNETKRQVLTVSGKGETKQQAFAAAFSDIQKQLIDNGDEAILRIVPEKVEPLKLIKSSYTEKFLFFFFKRTRPTYAVTLVVTVAITAIDLGALTFEDVTTPSPDALSLPNLKNMLKDVK

SEQ ID NO: 2401 - protein, 259 aa, Lactobacillus paracasei
LPILTILFQSIIIGGLVGFAAGVGAARMFTAPKTQALGAFRTLGEMNAAEGDPASHFSFGLGFFFNAWASTVGAGAFTQDITHRVIPNWAAAGLLMKNRNVEQTVHNPKKMGIAGAIIGVVVVAFLNVTSSSIPESLQVTAVKVLVPAANQLINLVMPILFWLAAIDAGRRSGLFGTVFGGLSAMIMGNAVPGVVLGILIGKGVDELGWTRITKSILAAAILLFVLSGFFRGFDLSLLKSFNLNAPDWLSNVHQMLGGK

SEQ ID NO: 2402 - protein, 94 aa, Lactobacillus paracasei
MTPIMSPNTPPVKRASPKLETKDLAPTESKIAGIPMPTPVKIEPPRSRIPTSEPSKIRANRKLAPKAAAAPYEPPVIPAFNIATIATSLKAPTP

SEQ ID NO: 2403 - protein, 396 aa, Lactobacillus paracasei
MAEKEHYERTKPHVNIGTIGHVDHGKTTLTAAITKVLSEKGLAKAQDYASIDAAPEEKERGITINTAHVEYETEKRHYAHIDAPGHADYVKNMITGAAQMDGAILVVAATDGPMPQTREHILLARQVGVDYIVVFLNKTDLVDDPELIDLVEMEVRELLSEYDYPGDDIPVIRGSALKALEGDPEQEKVIMELMDTIDEYIPTPVRETDKPFLMPVEDVFTITGRGTVASGRIDRGTVKIGDEVEIIGLKPDVIKSTVTGLEMFRKTLDLGEAGDNVGVLLRGVNREQVERGQVLAKPGSIQLHNKFKGEVYILTKEEGGRHTPFFSNYRPQFYFHTTDVTGVIELPDGVEMVMPGDNVTFEVDLIAPVAIEKGTKFTVREGGRTVGAGVVSEILD

SEQ ID NO: 2404 - protein, 303 aa, Lactobacillus paracasei
MAKMVSLPDNEKRHFDIGEQALQKGNYASAAAHFEKAYEADQSYAIAQPLAASLNGLKQFHESLNVMLPHYQAFMQTDADVQLMLDAWLGTLNFVMARGMLRHFDAVRRATFDRQIDAAEALALSSHGEQIASLVRKISHLGGFSRQEQQDLFSQIGILPKAALVEAAVPNLADQTVPVAMRVSLLDLLTSISYNQPVRYQAYDRIETLVPNELPGMAEEKSGPAILTQLQAALGDDDQELGTALVQMARVQIAFLYPDIDRLIPDPAAFVQAYLDHHQGKSTVFDQLFAWQTAETAKLSEQA

SEQ ID NO: 2405 - protein, 560 aa, Lactobacillus paracasei
MTKINLVALGGVRENGKNMYAVEVDDQIFVCDFGLKYPDNELLGIDVVIPDFSYLTENADRIAGIFLSHGHADAVGALPYFLVEHPVPVFGSELTIAMAKVFMQHDAQAKKFKDFHVIDEKSVIDFGDVSVSFFRTTHSIPGSLGIDIETSEGQIVYTGDFKFDPSATPMYQTDWARLAQIGNKKVLALLSDSANAESPYPNANEHEIYDHIKETFEYQDGRIIVAGVASNIQRIQQVINAAASLGRRVVLTGRDVEKVVKTAIRMDYIKLPNEDVLAKTKELKALAPEKTVILETGRMGEPMKSLQRMATSRHRLIHIHEGDLVFITTTIAHAMETMAARTKDMIYRAGGDVKVLGDDIHSSGHAYKNDLQLMIDLLKPQYLVPVQGEYRLMAAHAEIAHEAGIPTANIFIVGMGDILRYEKGKMTASGHVNAGNTMIDGIGVGDIGNIVLRDRKMLAEDGIFIAVVTIDRKKKRVVSKPKVTSRGFVYLKTSRDLLAESGTLVTDTVQKNLDNKEFDWTHLKQDVRDKLSRFLFEQTKRRPVILPVIMEVNQNSAKRQ

SEQ ID NO: 2406 - protein, 231 aa, Lactobacillus paracasei
MGAEYRQRYEDHLLRITVLAATHQITVVFAAMAADQWAAAGITKKGAVQTAAEGIALPLQQLVQAIAIGLIGKTPTLSLLPSELQKTVTTILQNRELLMTATPTGLTIMPQVAGTTVDFWLAGDAAFLTVPDDRLQPIDLKAWVQNILPQAHGMGFGPVTGQAALAILANDRGKHLAAGCSSELAVVLMADHEVAAYHLDAAQTSDAGYQTAVAAAKQNHHVVQRFFENHV

SEQ ID NO: 2407 - protein, 89 aa, Lactobacillus paracasei
MAIEQTQKDEIIKQYARHDGDTGSPEVQIAVLTAEILALNDHLSVHKKDHHSYVGLMKKIGHRRNLLAYLRNKDITRYRDLIKALGLRR

SEQ ID NO: 2408 - protein, 37 aa, Lactobacillus paracasei
MIASLFAYQAFSLYNFLLHCPQAFCIIATVETYAVLS

SEQ ID NO: 2409 - protein, 84 aa, Lactobacillus paracasei
MPQIKSAIKRVKTQEAARVRNIAQMNAMRTAVKKFKTATEQNADNSQDLYKAAARAIDMANSKGLIKKNKAGRDKSRLSALLNK

SEQ ID NO: 2410 - protein, 347 aa, Lactobacillus paracasei
MQVRDFIKHLKNGERPPLTLILGEESALRQQAQHAIASMIPEDQQAMNFGRYDMQQTPVGAALNDATSMPFFGDYREVVIDDPYFLTGEKNADKIDHDLAGLQAYFENPVPSTMMVIIAPYKKLDERKRLTKALKKAALIVNAAPLDEREARAALAQTFKKHQVTIDAPALDTLVQRTNGQYSIMMGEVRKLLTYASDGSPLTVAAVEALVPKQLNDRVFDLVTDVLRKNAAAALALYRDLLAQREEPIRLNALMLGQFRLLLQVKLLAKKGYSQGDIAGTLKAHPYRVKLAMRQVDRLPYQQLATAYSGLVDTETAMKTGTIDKALAFELFMLKYTGQQSGKHVRG

SEQ ID NO: 2411 - protein, 734 aa, Lactobacillus paracasei
MSGRFILMAAGLLAGILIGIGGWLPACLLLLWLLVKTTRNLVIVVSLAILVGLGRGLIDAQQWRQPPVPQGSIVIPATALKLKEGYASFTGRAANGVIVSGRGSVNQAVAARLKSNNQPLVLHGQHQIKRLGPARNQFEFDYATYVWQTQQLAYELVKPQLNFESRSPQNIAELVDGWRVHLFDYFEQLPTKVRQYAKGLFLGQLDEDFLTQRQAFVDLGIFHVFSVSGMHLFAIIAGLYWFAARLRVPQGLVDLSLIVLLPLLLLLLPLGAGLWRAVWMRLAGIVNDHLQLGFSGLDLFSFVLMFNLFWQPRVLLTMGGQLTYLLTGLLVALPAMRSWQLNWRLVLASMPVIAWHTFSFNILTVLFNWLLMPIFELGVMPGLAIALLLPHATLTATFDDGLQLLENGLVSLSRVPSQIVTGAFPSWLALIGVVVMLTVIVAKRWLAAACWFVTVFGWCWYQPNYRVVMFDVGQGDAILIETPFHQGALLIDTGGRIFGKTTNPPVRRAIVPYLHARGYARLDTLLLTHPDMDHVGDAPLLSQLMPVGRLITTATSVQHQMIQKVAKQVQHVQLVAADDWLRIGPAKFQVVSPKAQTSGDPTKTNADSIVLYGKIGNSSWLLTGDAEKEAEEKNIMPRQLTADYLKVGHHGSKTSSTPALINSLHLKAALISAGVDNRYGHPHPETLATLAAANVPWASTSERGMLWVEPGQNKQEDQLFGWLPTKEQSSNAGP

SEQ ID NO: 2412 - protein, 227 aa, Lactobacillus paracasei
MTTLMFWLKTYWYVPLVLLVGGFFFWQQTKAAPAQSQLAVSVHTTRSHASNVHGQSTTIASSRQTRSSTSRPTRGFVHIKGAVQKPGLYPVRADTRWDAVVKAAGGLTDKADISQVNLAKLAVDQESLQIPEKGGAVATAPASGTASTGGTAGQTNEAAVSRAVVNLNTADVSQLQTISGIGPKKAADIISYRDSHGGFKDVAELKEVHGIGDKTFETLAPQLTVGP

SEQ ID NO: 2413 - protein, 334 aa, Lactobacillus paracasei
LAVFFLIPTNYYLEVPGSAESLKPYVKVSGNKDDAKGAYMLTTVGVVGPASPALLLLSKVQAHTDIVSKQDLMGNDSSAEYDQLQAYYMKSAANNAVAAAFKAAKMPVKTEHLGIYVMSVLPQSPFKGKLALGDTITELNGQHYTTADAYVNAIKSKKVGSSLTLTYQHKGKTKQATGKLMRLPQTKRAGIGITLTENTAVTSEPKVTIDAGNIGGPSAGTMFALQIYTQITHQNLRRGAVIAGTGTIDSDGNVGQIGGIDKKVVAADAKGAKLFFAPNQPATKKLKHYDPNYVNNYAEAVETAKQIKTKMKIVPVKTLQDVIRYMETYAKSAS

SEQ ID NO: 2414 - protein, 167 aa, Lactobacillus paracasei
MTKKIAVFPGSFDPFTNGHLDTVKRASRLFDEVVVAAMTNTSKKPLFSSEEKLALISESTAGLPNVKAMAAPKRLTVEFARSIGAQFMIRGIRNVADFGYEADIATVNHDLDPEIETVFLLADKQYDALSSTIIKEVAAFGGDVHRFVPAPVEAALYAKLGDAHQTK

SEQ ID NO: 2415 - protein, 188 aa, Lactobacillus paracasei
MRVISGAFRGLRLTAVAGNQTRPTADKVKESMFNMLGPYFDGGQALDLYAGTGALGIEAVSRGMAHATLVDRQYAAIKTIKTNLALTKQPEHFTVLKQPVNKAIRQFAEAGQQFDLIMMDPPYAQQQVLAQLAAFISTNLLRPGARVLVETGMDVTYPDEIPGYIKLRRQTYGVAQVLILERSEENND

SEQ ID NO: 2416 - protein, 125 aa, Lactobacillus paracasei
VSLEGEKMFAIKQRQGLVVWVYSLKQLKTLRRYGTIMYVSRRMKYVYLYLDQDELAQTSAKLSKLRFVKRVEPSHRPELATEFGSNIGQFKPTEEDLEVKAKPKRRLRPSSAGDETSVGDHDARH

SEQ ID NO: 2417 - protein, 1145 aa, Lactobacillus paracasei
MHKVLVANRGEIAIRIFRACEELGLKTVGIFAKEDALSIHRFKAQESYQVGAGKAPIAAYLDMDDIIRIAKQSGADAIHPGYGLLSENAEFARKVRTAGLIFVGPRSELLDIFGDKVAAKEAAHKAGLATIPGTPEPTRDFSEIQDFTATHGFPVMLKAASGGGGKGMRIVHSEAELEAVYQNAVNEAKASFGDDRMYVEKYIASAKHIEVQVLGDEYGHLLHLFERDCSVQRRQQKVVEIAPAVALPTALRARICQSAVDLMQGLHYENAGTVEFLVDGDQYYFIEVNPRVQVEHTITELITDVDIVQSQLKIAAGADLFADLHLPKQADLHENGAAIQCRITTEDPENNFMPDTGTINTYRSPGGFGIRLDVGNAYAGAVVSPYFDSLLVKASVHAPNFTAAVAKMQRALHEFQITGVKTNVAFLEHLLATETFRTGEAETAFIDAHPELLQVQAKPDTASRLLWYISDVTVNGFKGVERQAQKYYPELHYDVHFPAAKPQKDLVALLHADGAQGVTDWIKAQNQLLLTDTTFRDAHQSLFATRMRTRDMLTVAQDMGNGLPNLFSMEVWGGATFDVAYRFLNEDPWTRLKKLRAALPHTLLQMLFRGSNAVGYQNYPDNVIKAFIQKAADDGVDVFRIFDSLNWLPQMTLSIDTVKQTGKLAEATMCYTGDILSHAHPKYQLAYYVDLAKQLVAAGADMLAIKDMAGLLKPQAATELVTALKDAVSVPIHLHTHDTTGNGIATYVAAANAGVDIVDVAQSSFSGTTSQPSLESLYYALSGNQRQPDVAIEKAQKLNRYFQAIRPYYADFSNGVTGPLTDIYTVQMPGGQYSNLQQQARSMGITDFEAVKTMYAQVNTLFGDIIKVTPSSKVVGDMALFMLQNHLTPDEVLAHGEQYDFPASVVAFFKGDLGQPVGGFPKALQAKILKGQKPLTVRPGQLAKPADLKAVRAALVQAGMNEPSTEDVLSAILYPDVFNAYARKQRQIGPVTKLDSPSYFQGMRIGETVSVPIKAGKTMIIQLNAIGEADASGMKTLYFTVDGQKQEVQIRDAHQKSAGLRHQLAEPTDRNQIGAPMAGKIVSVAVKSGQEVAQGDALFVIEAMKMETTVHAPFAGTVTHLYVEAGALIKSQELLAKLQPGVTKQ

SEQ ID NO: 2418 - protein, 51 aa, Lactobacillus paracasei
VTGVLPVTGVTLPFISYGGSSMIVLSMAIGIMLNISYHSERTQRKVEKTHA

SEQ ID NO: 2419 - protein, 340 aa, Lactobacillus paracasei
  misc_feature (330)..(332): Xaa can be any naturally occurring amino acid
MNKLRHVDYFILVPYLVLCAIGIVMVYSASAYWVQRQYGVAETKYLIQQALFVLLGIATVFFFYNMSLKVVHNRWVLLTLMAGLVVMLIYLIVHGRAVNGAAAWITIGGFRLQPSEFAKMILIFYLAHMLTSREDRFQQEDFRLRQMWQPLFVAGMIMLLVFVEPDTGGFAILFLITLVVVMSSGIPMRYGFLWVLMLIAITALGYYIVSHYHFPGLEKNYGYQRLVAAIHPFAKANTVGNQVVNSLYAINHGGLFGVGLGMGSQKLGYLPEPYTDFILAVIAEELGLVGTFVVLSLLFFLIMRFYLIGIRSKNTYHTLIAYGIATMMLXXXKPFSTLVL

SEQ ID NO: 2420 - protein, 614 aa, Lactobacillus paracasei
VKTRDDIRNIAIIAHVDHGKTTLVNEMLKQSDTLDQHIQLQDRAMDTNAIEKERGITILSKNTAVKFGDTTINILDTPGHADFGGEVERVMKMVDGVLLVVDAFEGPMPQTRFVLKKALEQHLTPIVVINKVDRPGARPEEVVDEVLELFIELGADDAQLEFPVVYASAVNGTSSMDSDLSTQKHTMTPLFETIVKTIPAPIDNSDEPLQFQVAMLDYNDYVGRIGIGRIFRGKIKIGDNVTVMKLDGSQKNFRVTKLFGFFGLTRTEINSAKAGDLIAVSGMDDIFVGETVTAADTPEALPILRIDEPTLQMMFVANDSPFAGREGKNVTARKLEERLKSQLQTDVSLRVDDTDQAGAWMVSGRGELHLSILVEEMRREGFELQLGRPEVIYRDIDGVMMEPFESVQIDTPEQYTGTVIDAMSQRKGEMQNMENEGNGQTRLTFLAPSRGLIGYSTEFLSATGGYGIMNHTFEKYAPVIKNWEPGRTQGALVSINAGSATTYSLQSVEDRGQLFINAGTEVYEGMIVGQNSRENDIAVNVTKGKNLTNTRAAGKDHAAAIKTPKDMTLEESIEFLNDDEYCEVTPKNIRLRKKILNTGERQKAAKRKKIAASK

SEQ ID NO: 2421 - protein, 263 aa, Lactobacillus paracasei
MTQDPEMLRQTIISWFAASRKQILTAMAAPLDVATKSNRNDLVTNVDKANQQFLIGKIREAYPEAGIIGEEGHEHDDTDLAGLVFFVDPIDGTMNFVKQQAHFAIMIGVYQDGEPVVGAIMDVMRNEVLSGGPMIPVTHAGQQVKVLPDLPLKDGLLGVNGPMTIKNRLHLGDIALTSSGARMSGSAGMEFIEIALGRQIGYVSYLQPWDVAAGMAITKGLGVVFSREDGAPINLQQPGVVVAATPKAHQTILTMMADGGKEA

SEQ ID NO: 2422 - protein, 93 aa, Lactobacillus paracasei
MKPNYAYPLDIDWTTAEKVKVTTFYTLVEDAYEHGVDRDNLLAAYRGFKEVVPDKGTERKLDREFEALSGYSMYTVIQMARKGVSQKIRVRVS

SEQ ID NO: 2423 - protein, 296 aa, Lactobacillus paracasei
MQRVVVSGASIGTQGLLETLIASQLLLTVGCYEPDESLIDMVGLTALSQICQNTFAKVTPKVLKAADILILTDTGSPDADDFIETNIAAIRKVLNSAMAAGFTGRIIVAMTRDELFTYFAQRFSGVNKSQVVGLGTFGATWRFEQFLAARLAVPAKHVTAYVVGTRQAPVLIWSRAYVGATPVLRLLNDQTIFTDGLDAVRSFLRSPLTVLLGRLVIPIIAAYSGDSLIGTLTHLMDVEDDTGQVYSSPVLLNDSGVVTLATVAGSDDEEAALSQTKQTVQDQIKAIEQGASKHET

SEQ ID NO: 2424 - protein, 467 aa, Lactobacillus paracasei
MVVGDFAIDLDTVVIGSGPGGYVAAIRAAEMGQKVTVIESTFIGGVCLNVGCIPSKALINAGHRYQDALEASTFGINAKGADLDFTKTQEWKQNKVVHTLTSGVSMLFKKHKIDTIMGTAFLKDDHSLRVMQKDSAQTYTFKNLIIATGSRPIEIKGFKFGKRILDSTGGLNLPEVPKEFVVIGGGYIGSELASAYANLGAHVTILEGTSSILPNFEKDMVQLVLNSFKKRGVTVITNAMAKEAEDTGKGVKVTYTADGKEQTIAADYVMVTVGRRPNTDDLGLDIVGVETTDRGLIKVDAQGRTNKPNIYAIGDIVPGAALAHKASYEGKVAAEAISGKASAVDYKAMPAVCFTDPELATTGMTVAEAKDKGIKAKASKFPFAANGRALSLAQTEGFVRLVTNENGTVIGGQVAGAGASDLISELTVAVEGGLNVEDLALTIHPHPTLSEVIMDDAEVALGLPINI

SEQ ID NO: 2425 - protein, 554 aa, Lactobacillus paracasei
MAFEFKLPELGEGLAEGEIVKWDVKPGDDIKEDDTLLEVQSDKSVEEIPSPVSGKILKILVPEGETASVGDLLVEIDDGSGPAAAPAAPATATAAPATPAPATPAVQPAPAQSVYQFKLPELGEGLAEGEIVKWSVKPGDQIKEDDTLLEVQSDKSVEEIPSPVAGTVVKILVPEGETATVGEALVDIDAPGHNDTSVATEAGTAPQPVAATPAATPAAPAAGGVPAITDPNREILAMPSVRQYAREQGIDISQVPATGKHGRITKADVEAFKTGAPAASAQPAAPAAQAQPQPATAKPAAPAAPKPQAVAPYVSSGNEAELETREKMTPTRKAIAKAMLASKQRSPHVTSFDDVEVSKLMAHRKKYKQYAADKGIKLTFLPYIVKALVTVLREYPEFNASIDDTTDEIVYKHYFNIGIATNTDHGLYVPVIKNADAKSMFEIAKEISENAQKAYDSKLKPDEMRGGSMTISNVGSIGGGWFTPVINQPEVAILGVGKIAKEPYVNEDNEIVVGNMLKLSLSYDHRLIDGALAQTALNLMDKLLADPDLLLMEG

SEQ ID NO: 2426 - protein, 325 aa, Lactobacillus paracasei
MAQKTMIQAITDALDVELANDPKTLVFGEDVGKNGGVFRATDGLQAKYGEDRVFDTPLAESGIGGLSIGLALTGWRPIPEIQFFGFVFETMDSIGGQMSRMRYRMGGTRSMPITIRAPFGGGVHTPEMHSDNFEGLIAQFPGMRVVIPSNPYDAKGLLISSIRSNDPVLFLEHMKLYRSFRQDVPEGTYTVPLDKAAVTREGSDVSIITYGAMVREALKAADNLAKDGIQAEIVDLRTIAPLDVETIINSVKKTHKVVVVQEAQRMAGVASTVISEISERAILSLEAPIGRVAAPDTPFPFGQAENIWLPNAKDIEAKVRETVNF

SEQ ID NO: 2427 - protein, 370 aa, Lactobacillus paracasei
MAKQHAAVDFKKLLENQDADFKPTIQILDEAGKVVNPDIMPDLSDDQLVDLMSKMVWQRVLDQRATALNRQGRLGFYAPSAGEEASMIGSHSAMKTTDWLLPAYRDLPQLIQHGLPLDKAFLWSRGHVAGNEYPEDFHALPPQIIIGAQYVQTAGVALGLKKNGSDEVAFTYTGDGGTSQGDFYEGVNFAGHFKAPAIFIVQDNGFAISVPRASQTAAKTLAQKAVAAGIPGVQVDGMDALAVYEVTKEARAWTAAGNGPVLIETLTYRYGPHTLSGDDPTRYRSKETDELWQKRDPLIRMRNYLTDKGLWNKDKEDALIDQVKDEIKDAINKADKAPQQTVSRFLKDTYETAPQNVAEQLAEFQGKESK

SEQ ID NO: 2428 - protein, 271 aa, Lactobacillus paracasei
MLMMVSSGLSRYEAQKAQQTVTPRPNTINKASLFLPLLIMTAGVSGLISVITRNWLLTVVIGVLLSMMMAVIVYLLTAATRHQGDPKQTVLVVREGLVRQVSANDLVVGDVLMLTTGEKLPVDVALAPDAHVSLPSDLAGLLALIGRQVPAGVGIAGAVMATDAQATVTAVLRDGLVDHAFAQLNGKTENHAPASLVTSAAVGFVLALKQIFRVSGIAVSLLASELLRSKQVNRAQQVRLHADLAQHATLVGAMKHHSKTSDFRHNQDPVS

SEQ ID NO: 2429 - protein, 184 aa, Lactobacillus paracasei
VYLMKDITRDGAKVLRETAKPVTFPLSDEDKQLAHDMMAYLVISQDEEQNEKYHLRPGVGLAAPQVGQSKAMAAVLVPGDDNEILFKEVLINPRIISNSVQHAALAEGEGCLSVDKDVPGYVVRADRITISYQNEAGEHKKIRLKNYPAIVCQHEIDHLNGVLFYDHINKEHPFTIDPDAVIIK

SEQ ID NO: 2430 - protein, 97 aa, Lactobacillus paracasei
VNDDQDLLMRQIKSFAQGLGAAMSKKDRRPDDPVVVFHDAEVSLASYQAKLITEVKENGFSAAKALLTTWRDTRLSRRQYEDLTAWLQGQRFVYKES

SEQ ID NO: 2431 - protein, 149 aa, Lactobacillus paracasei
VVWLIVVLVLIVLIVLWVLRKRWRRNKAIQILLHHSQRLSDQVMDAALTSLKIPVQEPLTSKPITDIWGHGVMAFSYIFPKSFSTIDQHQLADALQKAAEELDIASSDPALPPFVITDYFELEGQQHVDLAFIANEATIEYVRDVNRVA

SEQ ID NO: 2432 - protein, 70 aa, Lactobacillus paracasei
MIYKVLYQKDKIQNPRRETTQTLYLEAPSAVEARALVEKNTPYNIEFIQELSGNFLEYEEKSANFKLTTF

SEQ ID NO: 2433 - protein, 560 aa, Lactobacillus paracasei
MKLNIKNNETAVFAVGGLGEIGKNMYGVQFQDEIIVIDAGIKFPEDDLLGIDYVISDYSYLVQNKDKIKALVITHGHEDHIGGIPYFLQQVPNVPIYAGPLAAALIRGKLEEHGLLRTTKLTEINEDTVLKFKKLSVEFFRTTHSIPDTLGIAVHTPQGIVIQTGDFKFDLTPVGDQPSPNFQKMCRFAEEGVLVLMSDSTNAEVPTFTKSERFVGKSIRHIFDRIDGRIIFATFASNISRIAQAADAAMAHGRKIAVFGRSMETAMVNGRELGYLNIPDDVLIDAHQLNSMPADKVMILCTGSQGEPMAALSRIANGTHRQISIQPGDTVIFSSNPIPGNTVSVNHVINQLSEAGAEVIHGKVNNVHTSGHGGQEDQKLMLRLIKPKFFMACHGEYRMQKIHCELAQQCGVPEKNCYIMENGDVLALTQDSARIAGHFPAGDVYIDGNGVGDIGNAVIRDRRMLSEEGLVVVVATINMQKQAVLAGPDLLSRGFIYMRESGELINQAQRRVYRTIKSTFSSSEKVMEASLKDAITSNLQEFLFDKTERHPVILPMLILL

SEQ ID NO: 2434 - protein, 316 aa, Lactobacillus paracasei
MTAVFYYIIYNPAAGGGSSIPIYKQVKAVLDQRHLAYAIKTSRYPGHTNVITKQIGDFNRREHPVLLVIGGDGTLNQAINGLAGTRQSEIPVAYVPAGSGNDFARGIGMSEDPMHALEQVLQATEAVTIDIGRFHERTRGESGYFVNNIGIGFDAAVVNAANRSDSKQLLNRLHLGKLTYLFHVVGMLMTRRPFPVAVYEKGVRHFFHRAYICTTTNIPYFGGGIRLYKPANPTDGKLDLVIVEWFNIVSWALAMIQLMRGKKPTSRATHLFHADKLTVETSSLEFGQMDGEEMGTRPFEIDFSMAKQKFWIDRSI

SEQ ID NO: 2435 - protein, 405 aa, Lactobacillus paracasei
MEDNIRKSLVIKPVTPQDLEQFNDLLTYVFQVTQKDLEQSGYEEGELERAKRPVLEKSDVLGWFHKDELVSSLAIYPCTVNIHGTLYKMAGLTGVGTYPEYAGHGLMHDLVRLGLQHMRDHKQWISYLYPYSIPFYRKKGWEIMSDHLTFDVKDTQLPKQVNVPGHVERLEIDDPDVIETYNRFAMKNHGAMIRNQLNWDEYWRWENEEERTAGVYYDANDEPQGYVLYWIADEVFHVKEMIYTNQEARVGLWNFISAHFSMVTHVKGNIYKNEPLHFLLDDGDIYQTIKPYFMARIVDVKAFLKQYPFAAETPESFHFVVTDPLAPWNNGTFGVYWDEKNQVQITDRPVGEEIKTDIQTLTTMLMSYRRPSYLAQIERLFASKHAIKLLENAIPMEEPYFSDYF

SEQ ID NO: 2436 - protein, 822 aa, Lactobacillus paracasei
MDTREETVTGRVKSIFFQNPTNFFKILLIEISATTITWTESDIVVTGTFGDIKEDATYTFTGHVVDHPKYGQQFQADNYHADQPTNKSGLVDYLSSDKFPGIGPKTATKIIDHLGMDAIDKILDDPKVLAGLGMTAAKRDMLATNLKSNQGMERVIIGLNDYGFTSNMAGRIYQQYQNDALDVIKHNPYQLINDIDGIGFTRADQIAAKLAIAPTSQLRLGGAVMDTLQRLTDGEGDTYVTLKSLVTQTLDLLERARNVAVSPDAVGQAIVTLAKDNALIAEGDRIFPKRLYDAEWQIGRQLKGLAEADATATEPELAEIEKTLAAVEADTGIAYDVTQRKAIVTALQSPIFLLTGGPGTGKTTVTDGIVRTYARLHDLSLDLDQYTTDEPFPIMLAAPTGRAAKRISETTQLPASTIHRLLGLGVDTQEFAPNELPNGLLIIDEMSMVDTYLFRTLLTALHPGMKIVLVGDKDQLPSVGPGQVFADLLRSGVLPQTALTHIHRQDADSSIIPLAHAVNAGKLPDDFTKPQVDRSFLACAPSQVPEVVGQVVQRAAVKQFSIADIQVLAPMYRGTAGIDRLNPLLQNILNPKRSARTKAIQFGATEYRIGDKVLQLVNDPNQNVFNGEIGQIVGITLGKEAESKTDELTIDFDGNEITCKRSDFNKITLAYATSIHKAQGSEFPMVILPLTLQSRRMLRRNLLYTAITRAKSFLILVGELAAFQEAVSEVAVNRHTGLVDRLMTVFGKTVAPQVADASATKDISASPSEPQIDTTALDLDNEVKQQPPAVHQLTPALVASQRIDPMIGMDGITPQMFMTKEN

SEQ ID NO: 2437 - protein, 222 aa, Lactobacillus paracasei
MDSKILTMFNQGKHEEAIQAAVKAIDAAPDDPKRYAMLATMLISIKALDQAGELLAKARQLFPEDLELQYTAGLFAYAQADFAAAVSWFAKVRTDQTLKNDATYMLALSYQQAGQPTKALAFALTAHDLAPKQLDAALLAADLLMANDVFDAAARVLKTLLATEQPQVLFTYGMALSAAGKDGSHYLNKAKALDPKGYDQKANIVADINRFLRLQEGQDGHA

SEQ ID NO: 2438 - protein, 220 aa, Lactobacillus paracasei
VTKLYFVRHGKTEWNNQGRYQGANGDSPLLPESYAQIKALAGYLQGIPFMHAYVSPLKRARTTAQTLIKDLDESIPLTIMPALREFNLGKMEGMTFTDVGKHFPQELHAFRHEPAAYDPRKIHGESFSQLINRAIPAIVATVAMDRTGEANSLYVSHGAALAAVIQSLLGTPLADIRKDGGLTNSSVTILHADGPTLPFTLLDWNETSFLPEPPKATDTI

SEQ ID NO: 2439 - protein, 50 aa, Lactobacillus paracasei
MAKPGPSRSRPLMLRFLTAPAHALLEIFLQNLDNERVKMRKDSTVIDWDF

SEQ ID NO: 2440 - protein, 471 aa, Lactobacillus paracasei
MAKPGPSHPRPLTLRFLTGVGHALAETRSQAQKPAHKDLKPKWPKTSHLGLRPLMLRFLTAPAHALAVAISSFTVIMVFTGIRPSNRISPESDEMMVIVLDNSNIRVVVGMSGGVDSSVTALLLKQQGYDVVGVFMKNWDDTDENGVCTATTDYEDVAKVASEIGIPYYSINFEKEYWDRVFQYFLDEYKAGRTPNPDVMCNKEIKFKAFLDYADQLNADYIAMGHYAQVKTDENGIVHMLRGADGNKDQTYFLSQLSQDQLKKSLFPIGHLQKPEVRKIAEAAGLATAKKKDSTGICFIGERNFKQFLSTYLPAQPGKMMTVDGVEMGTHDGLMYYTIGQRQGLGIGGNSDNSEPWFVVGKDLDKNILYVGQGFDNPALMATSLSASNLNWTTGQAPAEGTHMTAKFRYRQRDTGVTLHYHDDGTATVDFDVPVRAITPGQAVVFYDDDECLGGGTIDAAYAHTNELQYV

SEQ ID NO: 2441 - protein, 760 aa, Lactobacillus paracasei
MFDHGFIEVHDANQNNLQHVNVKIPKDAISVFVGRSGSGKSSLVFDTIAAESRRELNETFPSFTQQYLPKYGQPDVGQIDHLPVAIVVEQKRIGKNARSTLATYTGIYSLLRLLFSRAGKPFIGYSDTFSFNLPQGMCKTCQGLGYVDDIDVKKLIDPNKSLNQGAITFVSFGPDTWRWKRYAYSGLFDNDKRLGDYTKQEMDTLLYAPQQTLDHAPTKWPKTALYEGVVPRIRRSIIGKKEAEHHKTALAEIVTRMPCPTCHGTRLRPEVLTCLINQTNIAQVLQMDLVKVRHFLNGIQEPLVQDVIRELLRKIDSLIDIGLGYLSLDRPTETLSGGETQRIKIAKFLTSALVDMVYILDEPSVGLHPHDIELIKRAILRLKEKGNTILIVEHNPALIAIGDNIVEVGPGAGATGGHITFTGTYQALLDSDTLTGKLLKQPLTFRQPRPATSTISLQHIHRHNLKDVSVAVPLGIETVISGVAGSGKSTLVSALRDQLTAPYIDLAQADIGANIRSTPATYLSILDPIRKVFADANHVASSWFSYNGRGACPRCKGKGVTITNMAFMDPVVQTCEQCHGRRYNDQALSYTYHDKNISDVLRMPITKAQSFFADVPAIAAPLRNMARVGLDYLTLGQPLTTLSGGEKQRLKLAVELNRTGTLYLLDEPTAGLHLQDVKKLIQLFDELVADGNSLIIVEHNLEVISQADWLIDMGPDAGIYGGQVRYTGTPENSMTVKQSRTGQAMKQYNQAPERQQNNRH

SEQ ID NO: 2442 - protein, 113 aa, Lactobacillus paracasei
MALAATGSAQGDPKTYQIGSALKRFTLIDLGFVQTKNGNFQLQRSLDPNSPYTTANKLKMTVAKNLDKFQLDVTTGNGLKAINIFKTDATKENVEQYQYWINNLIERGVIEAK

SEQ ID NO: 2443 - protein, 387 aa, Lactobacillus paracasei
MQHVYLDNAATTPMAPEVIQTMMDQMEHDFGNASSTHWFGRTAHTVMDKSRKVLADAIHAQPGNMVITSGATESNNTAITQTAHTRASLGKHIITTAIEHPSVLQPLKALEKEGFRVTYLPVDENGRISLADFDAALDDDTILVTIMMGNNEVGSRMPISEIGARLVDHQAWFHTDATQAFGLLDIDVQAQHIDMLSVSAHKINGPKGIGFLYRDPKVQFPSLLKGGEQELKRRAGTENIAGIAGFATAVSLITSDEKAKRQSKYLGFKQQIMGALDDAEIPYAVNGDIRPDNVNHVFNIWLKGISTYALQTNLDLAGIAVSGGSACTAGSLEPSHVLTAMFGADSPRLGESIRLSFGAQTTKADIQAFIDALLPIVQRLQAKQSAR

SEQ ID NO: 2444 - protein, 236 aa, Lactobacillus paracasei
LIKVGVICAMEEEIRTLLAKQTQQHETVIASQHYFEGQIDGIDVILVQSGIGKVQAAMTAALLLGTFKPDVVINTGSAGGIGQGLAIGDVVISSGVAYHDVDATAFGYLPGQLPQQPQIFEAGLDYVAKIQAAASTTGLTSKVGLIVTGDKFVNGQDAIAAILKIYPQALASEMEGAAIGQVAKEFHTPFVVIRAMSDVADEQSGVDFDKFVIKAGEQSAAMLLSFFAHLQASPQS

SEQ ID NO: 2445 - protein, 86 aa, Lactobacillus paracasei
MAEVNTRKAYREAQEKEQHAARAREAKRVEVEKDYARKSKGKPEIKNARFDEVTFRKVNSLKKRLNWAIGIVFGLLVIVFLVLYFG

SEQ ID NO: 2446 - protein, 178 aa, Lactobacillus paracasei
VDEEPIAQQRVFTGQLIAVDELTVKLPNNTTAQREIVRAQPAAGVLALKDDKALFVSQFRSTIGQMTLEIPAGKINQGEAPLTAARRELNEETGMTAMKWQPLASYFQSLGFSDATMALFLASELHLATNQLHQDPDEFVKGEWLTLPEAWRAVDDGRICDSKTLLALLYWQQQGIGA

SEQ ID NO: 2447 - protein, 220 aa, Lactobacillus paracasei
VATSKRIRIWRIILWAAMGAAIGALSGRWVIALSIGVVFAFACYIGELSRPKPKSTSLPSLDPKMAEHYAASGLSDEEIKLFRKTMADLAEQIRTIEALTKEVPKLRALTLNTDLVDLLHAYFEALVQAPQRLTDAGTFVYQQVPNLLDLMQKYAQITHHEVKTADTYETLDKAFSTMTSMAGKIKSDYQAFIKDDLDDLDSDVRLAKKHLDPDKVHETE

SEQ ID NO: 2448 - protein, 400 aa, Lactobacillus paracasei
VNDDKQTNLTDDLLADPFSTSEASMTNNNSAEAVQAAATARPKLSAEQEAKAQELASKIDVTKGETVLNYGADAQKQLGVFSQNMLTKVQSQDTGAVGDALTSLMTRLNEANPDELKAENNNIFRKLFGRVKRSIYEITAKYQKIGAQIDTIANRLETSQRGLLNDNKLLDELYDQNKAYFDALNIYIEAANLKLRELNDKTIPEAVKAAEAANDQMAIQQVNDLKQFASRLDKRAYDLQLARQITIQQAPQIRLIQNTNQALAEKIQASINTAIPLWKNQVAIALTLLRQKDAVTAQRQVSQTTNDLLKKNSDMLKISSIETAKENERGVVDIETLTQTQNDLIDTLKQTLQIQQDGRVKRQNAEKQLVQMEGELKEQLLNYTHGDMSHQGPKDVTPDN

SEQ ID NO: 2449 - protein, 478 aa, Lactobacillus paracasei
VKNYIEDKNVQKNRWWILTAIGMFTIMSTLDGSIVNIALPVMSRDLHIPMNQAEWVVSIYLMMICGLLLFFGRLGDSIGKIKVFRVGMVLFLIGSLFAGFNNSLALLLAARIVQATGASMTMANNNGIVTEIFPMNERGRALGLIGSFVSIGAIAGPGIGGLILGQLPWGYIFWINIPIGIVALILGTIVLPKDLPSRRVPIDWAGFVTFLVLILSLFMGIFLGQERGFTDPFILGLFALAIVAFAAFVHIENHKTDPLVSFKIFQNSAFTLSLLSAFFIFVTNFFFNVISPFYLQNARGLSPEKAGYLLMIFPIVQVIVAPVAGSIADRIGPYRITMVGLLIIVVSQIGYAFFNLQTSFMFVALMIGLVGFGNGLFQAPNNTVVMSSVPTRDLGIAGGMNALARNLGMVVGISTATTVLFSSMSHTAGKKVTTYLTGQPDIFISGMHVSFWVATGLCILAVALTGYRMWQVRHETAV

SEQ ID NO: 2450 - protein, 301 aa, Lactobacillus paracasei
MKHSKLFVGLTVALAATLVLAGCGSKSASSSSKSSSAPIKQSKILAVGSTALQPLVEQAAKQYQTDNPKAEITVQGGGSGAGLSQVAAGSVTIGNSDIFAQEKSDLKADDLVDHQVAVVAIAPVVNKDAGVKNISTQQLVDIFQGKITNWKEVGGKDQAIVLINRAQGSGTRATFEQFGIKTNKVKTSQEQDSSGTVYQMVSTTPGAISYLAFSAIKDGVQKLALNHVQPTDKNVTTNTWKIWAYEHMYTKGKPNASTAAFINYIQSKNVQKTLVPKLGYIPVTQMTVARTHDGKIEEINK

SEQ ID NO: 2451 - protein, 73 aa, Lactobacillus paracasei
MQGRVKNFNVDKGYGFIEAEGQPDIFVHFSAINEPGFKSLTPGETVDFVIVEGPRGPQAANVTVHRSEDGAPQ

SEQ ID NO: 2452 - protein, 928 aa, Lactobacillus paracasei
VKIKDTLNMGKTSFPMRAGLPKNEPIWQKKWDEDHVYEQRQKLNEGKPTFMLHDGPPFANGNIHMGHALNKISKDIIVRYKSMNGFRAPYVPGWDTHGLPIEQQLAKQGVKRKEMSMTDYRELCRQFAMQEIDKQRTDFKRLGVMGDWEHPYITLQHHYEASEIRVFGAMAKKGYIYHGLKPVYWSWSSESTLAEAEIEYHDDKSPSIYVAFKVVDGKGLLDTDTYLVIWTTTPWTIPANYGITVNPRFDYVQVQVGDKKYVVAAELLDRVAEEIGWENPKILKTFKGTDMDKMTAQHPLYDRTSLVMNADHVTLDAGTGLVHTAPGHGEDDYKVGVKYGLPVVSVVDAKGYMNEYAPGFEGVFYDDANKQITQALADKGALLKLDFFTHSYPHDWRTKKPVIFRATTQWFASIDAFRDQILKAIDTVDFKPSWGKTRLYNMIRDRGDWVISRQRAWGVPLPIFYAEDGEPIIEEETINHVADLFGKYGSNVWFEREAKDLLPEGYTNPHSPNGQFTKEKDIMDVWFDSGSSHQAVLAARPELSFPADLYLEGSDQYRGWFNSSLITSVAATGVAPYRGILSQGFTLDGKGRKMSKSLGNTIVPATIEKQFGAEIIRLWVATVDSSSDVRVSVDNFAQTSEAYRKIRNTMRFMVANTGDFDPEKDTVAYDELGSVDRYMMVRLNQIIKQVKTAYDAYDFATVEKTISSFLVNDLSAFYLDVAKDVVYIEAKDDPKRRGMQTVMFAALLALTKLITPILPHTAEEVWPYLKQPEAYAALADMPEAEQFDDESQLLDIWSGFMDFRSEVQKALELARDNKVIGKSLEAAVTVYPSEPVRDMLDDVDANVMQLLITSHFEIASATTKAPANAEQFDDMAIVVKHADGEVCPRCRMVRTDIGTDPKLPQLCSRCAAIVEANFPDAVTNGFDK

SEQ ID NO: 2453 - protein, 261 aa, Lactobacillus paracasei
MALSPLDIHNKEFSSKMRGYDKDEVNDFLAQIVKDYSSLIKDNEGLKKELADAKEKVQYFTDMKEALNQSIIVAQESAEKVKNSAHQEADLIKQQAQQDGQAILSKAKADADQKLHQAQAQTEQTLHDAALKRQNISVQTEDLKRQSRVFRQRLQVMLESQLEVVKSPEWKELLSSSPEAADTTDPSQDSLDNAHEGFVNSEGAVSGADGTYTEIIFPDDQSGAPASQAAADTPASSAAAESESTNDSTNDSESATDHDAQ

SEQ ID NO: 2454 - protein, 259 aa, Lactobacillus paracasei
MDAIYQHFRKDEAALIDHFAELIETARTEYRPVLTDFTDPRQRLIATSLVSADDDIKLVHFGGYPHAERQRIIFAPSYFSATAADFDIRLLQIIYPEKFAELHHSTVQGTLLNAGLDRDVFGDIITDGDIWQFFVAAHMQDWVTSNVDKIGRVGVHFTEHPLVDYVTPENDWEPLNFSVSALRLDTVVAHGFNISRQRAKTLIQGGKVRLNFGESDAPDAEIATSDIISVRGFGRLRLDEILGESKKGKLRVSAAVIHK

SEQ ID NO: 2455 - protein, 113 aa, Lactobacillus paracasei
YGGTFAMILYPRTEINVFNLLNAIYQVGSWAIYLYIIMVFIYILISWFPNAQGSALDRFLSRFVDPFLSIFQRFIPPLAGIDFSPILAFFVLSLIKMAWTKLFIMLVQKLVIG

SEQ ID NO: 2456 - protein, 151 aa, Lactobacillus paracasei
MAFEKLGEKFSNFFAMDNEDDYQDQEDEQAQQPAPEQPVDNHYRSNKVVSMATPAGKTAKIVVYEPRVYSDAKEIGSHLLNNRAVVINFDRIGSDDATRIVDFLTGTVFAINGEIKRVGESIFLVTPANFEIDGSLASTIDSDGLNLSSQH

SEQ ID NO: 2457 - protein, 419 aa, Lactobacillus paracasei
MDFQMDAQNEKGANIKVIGVGGAGGNAINRMIAEDVKGVEFIAANTDLQALNASNAETKIQLGPKLTRGLGAGSNPEIGQKAAEESEEAIGAALQGADMIFVTAGMGGGSGTGAAPIVAKIAKDQGALTVGVVTRPFTFEGPKRAKNATEGIAQLKEHVDTLVIIANNRLLEIVDKKTPMLEAFHAADNVLRQGVQGISDLITSPGYVNLDFADVKTVMANQGSALMGIGSATGENRTVEATKKAISSPLLEVNISGAKQVLLNITGGPDLSLFEAQDASQIVADSAKDDVNIIFGTSINEELGDEVVVTVIATGIEEDPRQEPSRRNVAKNRTTDQDNQGGGYRPAYADSDANENRQAKSDDPFGNWDLRREPSKRQAPSGDDMSNAKKKDFDIFENQTNADDAGGDDQPPFFKRRRQ

SEQ ID NO: 2458 - protein, 448 aa, Lactobacillus paracasei
MDNQGIYVGLDIGTTSIKVIVAETVKGQMNVIGVGSQRSEGVSRGVIVDIDKAVAVIRAAVAQAEDKANIKIDRVVAGIPANMLQIEQVSGMIAVGEENKEISDNDVRSVAAAALVRNLPPERETLSLVPTEFIVDGFDDIKDPRGMLGVRLEMRGIMLTVPKTVIHNTKKAIEKAGLRVGGLVISPLAIGRLALTDGEQDFGTVLIDMGGGQSTAAVIHDRKLKFTSVDQEGGEYITKDISVVLNTSFTDAEKLKREYGNADSLATSEEETFPVTVVGKHEPAMISEKYLSEIIEARVAQIFKRLNKALDAVNALDLPGGIVITGGTTALPGVTELAQDIFGRPVKRFIPDDMGLRHPSFTEGLALIKYAAQMTDIEMLVSSVLPTPFMVDGADVRPQPQSKQPEQPAAAVDQGNQRLLKRKQEKQPDKPKSKEPSALRRFFGNFFE

SEQ ID NO: 2459 - protein, 287 aa, Lactobacillus paracasei
VITLAWPRKKKPQPDPLTPWQQYQARQQQTPRHDRRQKPKLNVDLPKVQNLRRRKLVRNLTLILLPLLILLGVFGYFASPLSKVGLVSVQGVRTVPDQQVINATKLSDDDLMLSVILHKKAIAQRVQDSLPEIKQASLTFTGLNHIVIKTSEYETIGYVYQKRTYHKILITGKVLKNGTQTPVDTYPVFSGFTAKELPQMISLLQQFPKAIQRDISEIDASRGDANPYQISMNMNDGYRVIADSRTIANKIKYYPAIVSQVKKKGVIDLEVGAFWRAYSSAEKSSND

SEQ ID NO: 2460 - protein, 363 aa, Lactobacillus paracasei
MRLVISGGGTGGHIYPALALIEALKAEGKLDDVLYVGTKRGLESRIVPATGLKFATLDLQGFKRSLSLSNFTTVRKFLGSLGEAKKLLQDFQPDIVVGTGGYVSGAILFAATRLHIPTVIHESNSVAGVTNKFLSHFVDRVAIVFPEVAKAFPANKVVVTGNPRAQQVAGLKPNDRLRDFGLDPHIRTLLAFGGSRGAPRINDAVVAALPIWAKADFQVLFATGRTHYDQIKAKLPDLPATIKVVPYIDDMPSILPDIGLLISRAGATTLAEITALGIPAVLIPSPNVTHHHQFLNAQSLTKQGAAITITEDELDNHFPRRVVTLMEDDEKRAAMAKASKKLGVPDASDQLIAVMTTLLSKRR

SEQ ID NO: 2461 - protein, 459 aa, Lactobacillus paracasei
VKNISDCRNKKVLVLGLAKSGVNAARLLHKLGALVTVNDKQQFDDNKDAQELLADGMRVITGRHPVELLDEHFELMVKNPGIPYSNPMVKRAEALHMPIITEPELAYQVSEAQWIGITGTNGKTTTTTLIGLMLNQQRPHHAFDAGNIGIPVSQVAQKVGKDDTIVAELSSFQLCGIKTLHPHIAVLTNIYEAHLDWHGNRANYVAAKMRITMNQTPDDYFIMNWDLPEMHELAKQSKAQIVPFSRKNAEGARAQLIDGWLTFDGDRIMKASEMQIPGLHNIENALAAIAAVKLEGVGDDAIREVLRTFSGVKHRIQYLETIDGRRVYNDSKATNVEAATVALNAFDQPIVWLAGGLDRGLPMDALTPLVKKHVKSMVVFGQTAPLMAKIAKDAGVPVQTTENVMTAVPLAYEVSRPGDVILLSPAAASWDQYPNFEVRGDDFIKAVNQLKATVESGDK

SEQ ID NO: 2462 - protein, 321 aa, Lactobacillus paracasei
MQLAQMLIPMVSAFAITIMFMPLFIGYMRYKKEGQVIREEGPSWHEKKSGTPTMGGLIFIAAIIVSAIWVGIWQHQLTLSVWVSLFILVLYGLLGFYDDFEKLVHHRNEGLKAWQKLAGQILGAIIFLIAYFHEGFDHTLWVPIIGNVSATWFYVLFVIVWLVGFSNAVNLTDGLDGLVAGQTTISFGTYAIIAAHDGRTDVLIVCLVTIGAMLGFLMFNHKPAQIFMGDLGSLALGGMLAVVAILLHREWSLLLIGIIYVTETASVILQVGSFKLTGKRIFLMSPIHHHFEMKGWSEWQIDLTFWLVGLIGSGIYLAFFL

SEQ ID NO: 2463 - protein, 715 aa, Lactobacillus paracasei
MKIFKSKRSTNAHPARNRKIFGIWMIGVTLLILGGFVLRFSFVATVGEVDSNNLAKQRQKQYQTDTVLQAKRGAILDKTGNVIAEDSNTYTIFAILDKQSKDSNNKPDYVVDKAKTAKILSRYLAMSEAKILARLTPGKNMYQVEFGTPGTKLSLAIKKQIDAEKLPGIHFRETPSRLYPNGVFASHVIGLAQAQGKSTSLTGVMGLEKQFNTVLAGTNGYRRSQTDAYGYKLPNAKTNLKTPVNGGTVYTTLDSGLQAYLETLMTDVQNKYEPKGMTAVLMSAKTGQILAATQRPTFDASTGEGLGDMWRDSLVEDNYEPGSVMKIVTLAAAIQSGKYHPNDYYQSGSIKLDGGTVNDWRTGGWGSIPLSKAFPLSSNVGMVKIEQAMGAGIWKQYLDKFRFGQKTGITLPGETSGHISFERPLDQAITSFGQGIEVNVMQMLQAISAVSNGGKMLKPQIVSKVISQNGKTKVYKPEVVGQPISKETAAQVIDAMRHVVNDEDGTGVAYKMPGVDLAVKTGTGQIASPQGGYLTGDSNYTFSVAGVAPASDPQYVLYLAMKQPQKMTEPAESILASIFKPMMQRALDTTANGAVTDDTNTATIPAVTNAALTTAQDSLKQANFDVAAVGTGNKVVQQLPTSGTKALHGSRVLLLTNGAMTMPDLTGWSKSDVLKFVQLTGKKFKLVGDGFVTQQSIAAGTLLGDTSGTIKFKQQ

SEQ ID NO: 2464 - protein, 121 aa, Lactobacillus paracasei
MLESTARPLVQQPETPPIHKPVTTPAPNTHIAFSGFERTLMFACGVLATVVCVVCLFMQNRLSNTQRQYEDLQTQIAKQSQTTANLKQEIGELSNSERLDAFAKAHGFKVINGNIKRVDNK

SEQ ID NO: 2465 - protein, 313 aa, Lactobacillus paracasei
MTEFKHETVLLKEATAALAVKPAGTYVDATLGRGGHTRQILNQLTTGRLIAFDQDEAAIATVTADFGTLPKQLTLVHRNFRDLTDALTTLGITEVDGILYDLGVSSPQFDDSKRGFSYRFDAPLDMRMDQRQTLDAKTIVNEWPYADLVRIFSRYGEEHFSKQIARRIEQARTVQPITTTFQLVELIKAGIPAKARRTGGHPAKKVFQAIRIAVNDELSALESSLEQALKLINVGGRISVITFQSLEDRLVKTMFKEVSSVQDVPRGLPVIPASAQPNYRLVNRKPILPSEEELAVNHRAHSAKLRVIEKIHD

SEQ ID NO: 2466 - protein, 143 aa, Lactobacillus paracasei
MLMGEFERSIDAKGRLIIPAKFRDQLGASFVLTRGMDGCLFGYPIAEWDKLQTKLATLPLAKKDARTFTRFLFSAATECDIDKQGRINIPKPLFKHAGLQKDCVLVGVNTRIEVWDAERWEQFAETAEENFDDISENLTDFGL

SEQ ID NO: 2467 - protein, 110 aa, Lactobacillus paracasei
MVLLAMGLPILVWLVVVAAVVQFDFHGGSWFCLLAIVNFWAIFKLTFTKTPNFIWVILFTTMVIALILVIWQVVREYDLIVRRYWRMLTRVLALATTCWWMAGVLIFFLG

SEQ ID NO: 2468 - protein, 477 aa, Lactobacillus paracasei
MWIWLVLGFLYIINALTAIITVFRSHRDISAVWAWLLVLLLLPVVGFLIYFVFGRKLRANRMQDLMTQRLLGIDDLVDQQQQALAAGQPLIGTPGSGGVSELVRTLLRADDALVTTHNDVQVLALREAFFKQLFEDIAVATEHIHIEAYTIRPDAIGHQLRDLLIEKAHAGVTVRVLYDTFGSHDLPNNFWKKLTAAGGQVERFVATKLGRWNPRINFRNHRKLIIIDGQLAYLGGFNLGKEHHGLPMLRDTQLRIQGKAVAVAQARFLMDWNGTSKQQKVKNVDVLFREPVVTGNTTMQIVSGGPEQQVEAIKLGYLGLINQAKRSIWIESPYFVPDDSLLDALTIAANAGVDVRVMIPKKANQILMAKASLFYLNQVVANGGQAFLYEEGFLHAKTIVVDGKYVSTGTANFDIRSFKLNFEIAAFIYDHRIGKTFQKLFLADMERAMPYTQKVIKAKTRPKQLSEELSRLLAPIL

SEQ ID NO: 2469 - protein, 270 aa, Lactobacillus paracasei
MKRRIVLALMLLVTLLGTVISGCARETVGNSWPRIERTKKVVIGLDDTFVPMGFRQKNGQLAGYDIDLAKAVFKRYGINVDFQTIDWSMKETELKNQTIDLIWNGYSVTPERKEKVAFSDNYLINHQILVTKTKSNIKTIRDMAGKTLGVQTGSSGAFDLDAQPKLLKNFIANKTPILYDTFNDAFIDLDAGRIQGILMDEVYARYYIAHKPDPSSYRIASDDFPPENFAVGMRKSDNVLRSKINAGLKALKADGTVAKLQKKWFGKVEE

SEQ ID NO: 2470 - protein, 212 aa, Lactobacillus paracasei
MLELKQINKSFNGQPVLVDINVTIEDGKTLAIVGPSGAGKTTLLRIISGLETADSGTMIWNGQPTTAQALRKEGVIGVVFQNFELFPNLSVMRNITLAPTLQGVDQKKADETAKKLLDRLELVAQENAYPYSLSGGQKQRVAIARALALNPQILLYDEPTSALDPLLRENVAALVNQFKASGMTQVVVTHDMDFAESVADTTYHVGKGGDGQ

SEQ ID NO: 2471 - protein, 218 aa, Lactobacillus paracasei
MSYIFQILPALLSGVKMTLGIFAITLIGSIPLGLILSVGLIPKPKSILGKAGKGLLEGYVWVFRGTPLLLQLMFIFYGLPIIGLVFDRFSAALVAFILNYAAYFAEIFRGGFGAIDEGQFEASTVLNMTRWQALRYVVIPQVVKIVLPSIGNEVINLVKDSSLVYVIGLGDLLRAGNIASARDVTLVPLVLVGIIYLLLTLILTFLQKRIESAFSYYR

SEQ ID NO: 2472 - protein, 265 aa, Lactobacillus paracasei
MGTALVVTSGKGGVGKTTSSANIGTALALQGKRVVLLDLDIGLRNLDVVMGLSNRIIYDIVDVATGRAKLHQALIKDKRFDDLLYLLPAAQNAEKDALEPEQVVEIVEQLRPDFDFIILDSPAGIEQGFRNATGAADGAIVVTTPEISAVSDADRVVGLLEQREMPIKPRLVINRIRQNMLADGRSMDIDEITSHLGLDLLGIIVDDDGVIASSNKGEAIVMNPDDLASKGYRNIARRLLGDSVPLMDIRIKKQGFWSKLFHRHD

SEQ ID NO: 2473 - protein, 218 aa, Lactobacillus paracasei
VDSVVLKGRNDGLALQLQDTADFEQIMRTLKTLLGKLYEETPTGDVSYRLETGNRLLTEEQLADIQKIFADFPRFSINGVVSAVIDKTVVNEMIAAKTTHRIGGVIRSGQTIDLMGDVLFLGDLHSGATLCASGNIFVMGQVGGVVQAGSQGDARAVVVGDLKGAGQIRIADVVEIVADHYDPDRPVAYLNELHTMTHAGLADLASIRPRLFKQMEAM

SEQ ID NO: 2474 - protein, 176 aa, Lactobacillus paracasei
MLNEKHFTGHWWVVLLLLLLMLIDGSLASVLAQWIMRPNFMGTPQLTLLGLIMITLFVPEEKYITWIAAIIGLLFDTFYTGILGVNALLFPLVIYTIRQIRPYIPRTPVFVGMVYIIGLLLYGIANYIMNRFIGFGTGNVVMLIANHLGPGLTVNLALFVIVYGPLHRLLDNLAEE

SEQ ID NO: 2475 - protein, 286 aa, Lactobacillus paracasei
MQKFFSNKKLIALMIALLVSLGLIAGSMYASNNRNTPPFIQRIANDVVGIGGRLVAIPGDFARNGLDDINNLLDTFQENQRLKSQLDNLAQTKVQVQTLKRENKQLKTQLKLNGTLTDYSQISAAVILRTPSDWRNMVVINQGSAAGVKKGMPVMAGSGLIGRVVEVNRTNAKVEMLSTANKSSDRIAAAVETKGDKEVNGIITGYDEKSGDLILGELNTDTDIKKGDDVVTSGLGGMTPKGLLIGKVASVKKDDYGLANSVYLTPAASLNDVTVVTVISRTIAGD

SEQ ID NO: 2476 - protein, 333 aa, Lactobacillus paracasei
LFGFGSKNIGIDLGTANTLVYVDGKGIVLNEPSVVAKNTQTEEVIAVGEEARDMIGRTPTNIVAIRPMKDGVIADYDTTAAMLKYFMQKALGNGSHPQVMICVPSGVTEVEKRAVIDAAKVAGARDAFVIEEPYAAAIGAGLPVMDPTGSMVVDIGGGTTDVATISLGGIVSSRSIRVAGDKFDEAIINHLRQNFNLLIGERTAEAMKIQIGSASVEKAKDIDGMTVRGRDLLSGLPKTIEISATDIASAIHENVLDIITAIKETLEETSPEIAADVIDHGIVLTGGGALLKHLPDVISDETKVPVFIAQDPLDCVAIGTGESLKNIDVLKKR

SEQ ID NO: 2477 - protein, 222 aa, Lactobacillus paracasei
MADAAELPRERLLAHGPQALTDAELLQLVVRAGNQHYPVKQIVSEVLATYPKLQGLAEGDQGLLEHIRGLGAAKRASILAGVELGRRAMQRQTVRYGQIKNSEQLGKTMISRFAGVNQESMLILFLDVKNQIITEQIAAIGTVDSAMADPRIVFREALKLSATNLIMVHNHPSGDPSPSQADRDTTTRFQLAAALLGMHLIDHLIVGGERYYSFARDDPEFN

SEQ ID NO: 2478 - protein, 214 aa, Lactobacillus paracasei
MTTTIIFDLDGTLVNTEALYLKSNVKAAAQLGLHRTEADFRPLVGAAGPSEAKVIADMIGAEHAAWFQKFSTADVLDQIQGGADFVLPNVQPTLAALTTAGYPLALATSSPRHYVDVVLAATGWQRQFHPILTGSDVQAHKPDPEMYEAMKVKLGNVPAVVVEDTHVGVEAAVGAGLPVVMIPGIAQKLDSKATAILSSISELPAWLKNQPAFA

SEQ ID NO: 2479 - protein, 425 aa, Lactobacillus paracasei
MDYTESVAYIHSFPRLAKTGDHQRILTLLHALGDPQKRGHYIHVTGTNGKGSAANAIAHILEASGLSVGLYTSPFIMRFNERMMIDHQPIPDAELVKAVAVGQQALTQLRQATPDFGVTEFEFITALAFWYFDQKQVDLAVIEVGIGGDTDSTNVITPVVSVLTEVALDHQKLLGDTITAIATHKAGIIKPHVPVVTGNLVPDADAVVAARVAATASTWLRFDRDFSVPKARLHGWGQRLTYADKDGELTDIDIPLVGDYQQRNMAIAIQTAKVYASATNWLLKPQEIRQGLAASRWPARLEKLSDEPLIVIDGAHNPDGIKGLIAALHQLFKQPVTVIAGILADKDYHTMADALTKAFHTVYLVPVPGNARALPEAGYAALHEGQLKDSWQEAMAASLADDPDQPIILTGSLYLAADVRQTLRA

SEQ ID NO: 2480 - protein, 880 aa, Lactobacillus paracasei
MKEQALAPKYDHKAVEAGRYQEWLDEDVFKPSGDQKAKPYSIVIPPPNVTGKLHMGHAWDTTLQDIVIREKRMQGFDTLWLPGMDHAGIATQAKVEAKLRKEGISRYDLGRDKFVQKVWEWKDEFAKTIHSQWAKMGLSLDYSRERFTLDKGLNEAVRKVFVELYKQGLIYRGEYIVNWDPQARTALSDIEVIHEDDKGAFYHVKYPFADGSGYIEIATTRPETMMGDTAVAVHPGDKRYQDLVGKELILPLANRKIPIIEDAYVDPAFGTGAVKITPAHDPNDFQVGNRHDLKRINTMNEDGTMNENAGKYNGMDRFEARKAMVADLDKEGLLLKVEPIVHSVGHSERTGVQVEARLSTQWFVKMKPLADAAIKAQQEADKKVTFVPDRFEHTYLQWMENIHDWVISRQLWWGHQIPAWYNKQTGETYVGMEAPKDIENWQQDPDVLDTWFSSALWPFSTMGWPDTDSPDYKRYYPTDTLVTGYDIIPFWVARMIFQGLHFTGERPFKYTLIHGLMRDEQGRKMSKSLGNGIDPMDVIEKYGADALRWFLITGNKPGQDTRFSYKQVEAAWNFINKIWNISRFVMMNLGDLEKPQQPDPSTFDLSDKWLFAQLNETIKQVTDLSERFEFGEMGRTLYNFTWNVFADWYVEMSKEVLYGDDEKAKAAKRVNLAYALDQILRLLHPVMPFVTEKLWLALPHAGQSIVTASYPVANDAFENSAAVDAMDSIIALIRGVRSIRKDAGAPLKTKVDIIVKLTDPALKPIFEDNFDFIDRFVNSKAFTVGTDVAEPKMAGSTVITGATIFVPLNELVDLDEERAKLTKDAKKLQKEIDRIDKKLNNQGFLAKAPEAVVEEQRTKRSNFADQLNSTQQRLAQLQQA

SEQ ID NO: 2481 - protein, 217 aa, Lactobacillus paracasei
VVVSKQALSQATIKRIPVYYRTVKDLQQTGEKRVRSDRLSKLVHIAPATIRRDFSNFGDLGRSGYGYSVDLLAQVFGELLEVHSEEQMALVGCGNLGRALLTNNFRRNPDLSITMGFDTDPQLIGTTIAGVPIYDLAALSEKLRPSMHTAIVCVPSSAQAAVVRQLEAQNVTAILTFAPKPVPAKPTTTIRYIDLTSELQALLFVDHQKQVKRVSQG

SEQ ID NO: 2482 - protein, 405 aa, Lactobacillus paracasei
MQYSEIMVRYGELSTKGKNRQAFIGRLNGNVTRALHEFPKLTIRPKRDRMHIELNGEPSDQVMARLSQVFGIQNFSPSIAVEKDMDKVHAVALQLMNETAPKGISYKVNTRRSDHDFALDTNAMNLDLGDYLTDKRPDLVVKMHQPDMILRVEVRREAIYLSTKTIQGAGGLPVGTAGKAALMLSGGIDSPVAGYYALKRGVDIEMVHFFSPPYTSQQALNKAKQLTAKLTPYVGRIYFIEVPFTEIQEEIKAKVPEGYLMTVQRRLMLRLTEAIAQQRGDLAIFNGESVGQVASQTLESMAAINDVTTMPIIRPVATMDKNEIIAEAEKIDTYDLSIMPFEDCCTIFAPPSPKTKPKTDRARYYESKIDVAGLMDRALAGVKIQEIKSSDQFMNQDQDVIAELL

SEQ ID NO: 2483 - protein, 429 aa, Lactobacillus paracasei
MVKVRPSRPRPLTLRFLPDWLALLKLTNFLSIIQRSHNNGRGRQMIYFDNSATTKISPEALATYNKVSTDFFGNPSSLHALGTRANEVLQSSRAQIAQLIGAKPNEIYFTSGGTESDNWVIKGTAMAKREFGRHLITTSIEHPAVINTMKQLEKLGFDVTYLPVDHRGFINIDDLKAAIRKDTILVSIMAVNNEIGSMQPIVEAARVLDAYPNIHFHVDAVQAVGKGLDAALQDPRIDFMSFSGHKFHAPRGTGFIYAKEGRMIAPLLTGGGQENDWRSGTENVPAIAAMAKSLRLLLANEADNVARQQAVRKRIYDHVSQKPKVTMFSQLTPDFAPHVLCFAIAGVRGETIVHAFEAQAIYISTTSACSSKKGTESSTLAAMHTDSRIATSAIRVSLDEANTLAEADAFNKAFDTIYAKFAKLDKATV

SEQ ID NO: 2484 - protein, 567 aa, Lactobacillus paracasei
MIWFFVIVVIIVVAAGGVWWLQHYFQTRIKNLDAQVEAIDVGALSSQIRSIEQLKLTGDSLATFSKWERAFDQLNDDDLADLQKILLDLEDQAKRFRFDHAQKIAKVLEAKIDTARQQYDLISQALQDIRHDEADNRSKMLQLRDDYQVSRKTILAKSFVFGDAQPALEQQLQQLAELFQKIDQINNDGDHQAAKSEIKQLSDEMAALRRQVKELPPLVNEQVNEFPAQINEIEHGYRQLTTAHYVFTDDIPGMVEDVNEKMADANTALKSLDVDAIEAANSEIEAEIDKMYAIMEKEMQARKRVDAAAPDLRQFIDHALRQNRELQTELDHLNQSYTLNHNEIKIAKDLKTQLDSIDANYIKDTDAIEAGKAVYSDVIERFDATKDELTAIEKQQVQINQAVAGLKKGEIVANKQAENFELDMRNIKHEILRHHLPGLPQDYVSQVKHVTAEIEQLNHDLDQVKINMDAIAKFLIKIASDIDALKKATSALIDAAGLTEELMQYANRYKTTVKPVAEAVHQATESYMQFDYKQAADTLATALEQTEAGSYKKVEDAYLARKKASLY

SEQ ID NO: 2485 - protein, 160 aa, Lactobacillus paracasei
MTTLDPIIVDQLDGLLTGETNPITVLANASALLNDLMTDLNWAGFYLYNDKTGQLDLGPFQGKVACMHIQPGNGVVGTSYAQNAVLRVPNVHEFAGHIACDSASNAEIVVPITVDNRVVAIMDIDSPTLDRFSENDEAILTKFGETLAAHLDTAALNTVY

SEQ ID NO: 2486 - protein, 203 aa, Lactobacillus paracasei
MSRYTGPRWKQSRRLGLSLSGTGKELARRPYAPGDHGANNRRKISEYGQQLREKQKLRWMYGLNERQFQNLFLRAGKIKEGTHGDNFMILLETRLDNLVFRLGLASSRPQARQLVNHGHITVDGKRVDIPSYEVEPGQVIALRERSQNLAIVNEAIENTVSRPAYVTFDDTKKTGSLVRLPERGELEPEVDESLVVEYYNQKL

SEQ ID NO: 2487 - protein, 509 aa, Lactobacillus paracasei
MIEDEAEHQITCVEDYLNFLQQFDAYRNQGKLFYRAQLASFQTVIPSIAHGKYSKLYEVKRLEKSNLVSGTDRFYNIAYGQHQGVPTRFLDFTVDPLVALFFAVSPTVREDSVIFIFIKPSLRREDLHIDLLTKLAFWGSTDFSSFVKSFNEQLSEPLSEHNALTLATKPVFVDRHSIVDAGNLRMCAQSGTFAICSNVIEDGRIKEISGIESTESFLTIAIPFEYKAKLRRELSDRNYTPDKMFADDRSREFPRFEKAKGSLQSISEIVDSNINRKGLYSKYGAHIALNGLFTVGEITEYARRFAYSRAEDRVWLWFARDRVNALQHRNNLVLTADIMKKSFPSLDLLADESFLYHDGYVPISNYYSNPNNIRSGQKIPVSKKARYIKMSVTMTSSRITIKTNLFNDAKLFFSSDQIKALYSDEFVVHQGRADLDIRVPLELSKGNFLIVLTYPSTQTRAFLAKSGIQYENIDSPAFKRTGLFSPTAEWHFSYAVLAGEFQVGAESIT

SEQ ID NO: 2488 - protein, 262 aa, Lactobacillus paracasei
MKIVYFDEGSAMDYLTIINDGYRKSEKETTTKTTTAANGDVTVKAKLGQWLSIIPGISVDGQVGVYGKAASDRLVTSSITSAVLSDFLQSAESAQKEVMKLSEYRLSLHKGSIEYIQSISPYLMMTNGKFNVGDGVAIEASKIYDALKLGKGYYEMVGQKFGETKPSAIFRFNNAAFLHNYSISDLPAMKLTSYGMHSGNKPLHSLDFSKSIQESTSVEVVTALNHSLRTDSKWGSDTNDKPTTFDTKLPMYDIVLTGVDND

SEQ ID NO: 2489 - protein, 186 aa, Lactobacillus paracasei
MRQQLSMFQNQASFDYLFGASHSQLNFARDLSNRESNVILLDEFDKVNPALYSAFYQLFDEGIFEDKNYQIRTNNLIIICTSNFADVTQIRETLGDAMYYRFSALVPFKHLDVDAFLKIINDVVNELWSELDDQERTLFVAKANLIEAFTRDVPYFQNFRQAKSLMRQFVYRKIVDLSLKKGSFHP

SEQ ID NO: 2490 - protein, 244 aa, Lactobacillus paracasei
LTKTRIAGFILKFTEPNFLQSTKSNVFHFTNINYFRKMESEEKRGVKDPHEIMQVHALNPETDKVRLTFKGHPGSTEIDQPHGTFTLNYGMTNHLSICSFVFLNIQTDFIKNSKNEFRIKSSVITDLIDQFGNRPAILWGGGDFKKLTSNLNVKENTILEVYSGLVNYYSGSNFSLFDKKITPKNIFKIAFKKEEYFKSQREFRLVAYTEKENFDFDLKSTVTAENDSLKVSNSRELADFYAKL

SEQ ID NO: 2491 - protein, 81 aa, Lactobacillus paracasei
MAMVMMSYDLFTLCQREDTDERMLGDLFFYYGEALPDIRIVQALNWLIRQLIGTASTYQEVWVVINQIMSEFMKKLPKSHA

SEQ ID NO: 2492 - protein, 151 aa, Lactobacillus paracasei
MNLVALELVDQAIKAGVKTQYTLFDSWFAYRKMFHELLKCGINDIGMIKQTEKVYFRYRGREMDVKHLLATLKQSKWPKHEHYLYSPIVQYDMDGTKMAMKLVFVTKKGAKNRFLVLVTTKNDLRPERIIQMYGRRWQIVGYFKVAKQYLR

SEQ ID NO: 2493 - protein, 101 aa, Lactobacillus paracasei
VAVSLIRYLHQFAATGRDQALVIDDSLFKREFSKKTKLLSKVFDHDHERYCTGFRALTLSWSDGNTFLPLNFALMVSSKAENQIDPQKLCDGRSLAAKCRH

SEQ ID NO: 2494 - protein, 33 aa, Lactobacillus paracasei
MATIQQSTHDIQLKTKHFSKLAHLSRALRQANA

SEQ ID NO: 2495 - protein, 725 aa, Lactobacillus paracasei
LIEEQTVQLVQQSLTGITDRQINTVLHLMQEGNTVPFIARYRKEMTGSLDEVQIQAIEEAYKRATALQDRKAAVIKSIAEQGALTAKLEQQIQASTKLQDVEDIYLPYKQKRQTKAMVAKSRGLEPFAKWLLAFPNGSLEQEAQKYVDPAKEIATVQDVLDGAHEILAETFSEMAPIRNWVRNFTMRTGTISATVKTKGKELDEKGVYQQYYDFEETVKKMSSTRTLAINRGEKEKILTVKVKVDTDAVLHYFHFKIIDNRPSTEATAFIEDAYEDAYKRFVGPAIEREVRNALTTDAEEKSIKVFGQNLYNLLMQAPIKGKVVLGFDPAYRTGCKLAVVDENGKFLAKAVIYPHKPAPEKKRQEAAPELIALLERYQVTMIAIGNGTASRESEQFVAETLKQIKRDVFYVIVNEAGASVYSASQEARDEFPDLHVEQRSAISIARRLQDPLAELVKIDPESVGVGQYQHDLPSKDLSNEVDVVVERAVNQVGVNLNTASYQLLTHISGLSKSIATNIVHYRDENGRYNSRAELKKVPRLGPKAFEQSVGFLRIIGGKNPLDNTDIHPESYPVAKKVLTAAGVTAADLGDAAAVAKIREVPIAPLVSEGVGAETAKDIITSLQNPGRDLRDNMAAPILRQDVLTMEDLKVGMKLEGTVRNVVDFGAFVDIGVKHDGLVHVSKMARKFVRDPKTVVAIGDIVEVWIESVDLARERIQLTMVDPAAR

SEQ ID NO: 2496 - protein, 108 aa, Lactobacillus paracasei
MIKTTADGIRFLLEIATVVLLIIAGFNSSDLVVKLTVGVIVPVLGILFWGRFMAPMSLHRLPTIGRVITEILIFGGTSLATYLLTTHKAALIYGGIALIDTLIEHLIP

SEQ ID NO: 2497 - protein, 134 aa, Lactobacillus paracasei
MNIRTCAQQSGVSKDTLRFYEKIGLIVPSRGENHYRDYTPDDVVKLQITRNLKAVGLSLNEISMILRMYDAPVTKACREDTLAILQSYREVFKRRAKLDLALSNIALDTTTAIKMQAGDDAMMTLFKKIGALND

SEQ ID NO: 2498 - protein, 451 aa, Lactobacillus paracasei
MIDKLFLDLIIMMSVNNFFNRYTASVKTVIAICLSRYAAKENPMIFYFILSLFMIAVLVVIALQHLNTNRIVDIQLEQHKMMFPSQVRGARIVYVRGIYRSHPSKRNWRLVAIVLDILAAIGLVTAIVMHYQDAFSADLMTSPFGLRLAEMLAASNNEIQNIFLFGGMTLALISRMIWFYLTQWLFQLLEKADQDHDSDATDLYWTPKHLLKRQYQLRISLQGILMVGAIFLALTGAFNWLPVASEMASQTRLPRTVSSSSASAASASSEITNESATSSSWTQNTDTTYPIDAMKTAPLAPASELAGLTDADRAALFFTAYWTLNGLQQSEVADYANSTSETYSYHLVPGSSSKLIVFSEFIPSVNQTDYMFYALIDGEQVAFYNMYQSKTPITSLASQYSLTVSGTTLRPSMPEIRDSDMNMRQLIGAFKSDKSFDQTKKGLHRGADIPL

SEQ ID NO: 2499 - protein, 295 aa, Lactobacillus paracasei
MTTVIQAEHLKFSYGDKAVLKDINLTVQPGEIVGLIGVNGAGKTTLLNILLGLLSGTGTVKVFDQQPGTTAIKGRLGSMLQGDMIIPSITVGDILALAAAETPDALDPAALLEELQLQQLKSQRLGSLSGGQLRRVTFAVALIGQPDLLFLDEPTVGMDATARKEFWNKIEQLRQQGKTIIITSHYLEEIQQVADRLLILQDGRFTFDGSLQQLQKKHLGATITFETDLQPAIFKGLAAVDQVHSIGSKLAIHSNNGDQTLKSLVPMLDRLHQINLSRESLEDIFLQLTKQEAEK

SEQ ID NO: 2500 - protein, 254 aa, Lactobacillus paracasei
MKTLLAQLAFDGKRLVVRNSSFIFFSLLMPAGFYLLYTKMMISGSATEIKYFNISYMDQMIVYSILINAFFSIASILKRDRDKGFTTFLRLSPHGTLPYYVSITFWMLMMSLLSVIVLGSIAVGVNNVSLGTDQWLGLLGVVLIGQLPVLMIGIALSYIHREEMLSLASNLLTFPMAIISGLWWPITMLPNWLQVIGKQMPTYFVNKLLNQLTSRATVDLTNLVGIVVWFVLGSLLVVAMTKHEQRKGVALGEA

SEQ ID NO: 2501 - protein, 371 aa, Lactobacillus paracasei
VRHSLRSWLRNLEWTSYIWLVYLPYIMSEFVPVKSINDWLWIGLGILFLIVYILVNEVDHWLPVTIPLELAIAGIFSIFALNNYMIIYPGWQVPFILARFPRKYFRWFAAAFYLIIFVSLWRVNQLHPGIININNPDMFNLIFPLVSPIISYTVSRSVIHQRQLRQTNRRLQAIVRRGERERIARDLHDTLGQSFSMITLKTELAKKLLVKAPDRVAQELDDIAQTSRDDLQLVRSIVNDLHQQSLSEMMLMQGKNLAEANVVLLTSGESEAAEWPTKVQIRLSAVISEAITNVIRHAHAHQVEMIFEQNPNGYLVEIQDDGHSKSYKRTGSNGISGMQQRMKEVNGTFTINHNRQGTQVSLTLPKEQLSQ

SEQ ID NO: 2502 - protein, 202 aa, Lactobacillus paracasei
MITLYLAEDQSMLNSALTQLLDLEDDLHVLGSAGDGAKAWQDIQQLKPDVAVLDIEMPKLTGLDVADKIHGSQLATKIIILTTFAQKAYFERAIAAQVNGYLLKDSPSDDLIDVIRKVMTGQTVYAPELVTNMVTAESNPLTDRELAVLAEVASGLSSKQIAASLFLSEGTVRNYLSAIFSKLGVHNRIEAVQMAKKNKWLE

SEQ ID NO: 2503 - protein, 285 aa, Lactobacillus paracasei
MTKKIAIVVDSGSDVPQSVLDENKNIAVVPLNITMNGHNYLDAVDITPDEFYSALATAETLPQTSSPSPQAAKEAMDRLFAAGYQQILGITISSALSVTNNVFQLAAQDFPVDTVTILDTKSIGIGSGIQAAYAASLINAGESFQDVIAKVRASIVKSRIYFYVPTLKYLSAGGRIGRVAGLVGSVLHIKPVISCDPEGVYYPLFKARSEDKAIRKLVEQVKTDCLNSAHYRLGVAHGQNPALVKKLAEKLREVTGRPVDFIGEISPSLGVHTGPGLIGATIQSY

SEQ ID NO: 2504 - protein, 173 aa, Lactobacillus paracasei
GNATFAMILYPRTEINMPTNKGITVAREEDPDLKQAIVRAVLADLPEWFGLPDATNTYVEEAAKLSLWVACYEGQAIGFIDYRQTSKASGEISCMGIKKHFHHQGIGHQLVKALEADAKQHAHYLQVKTVDEGHYPEYDQTIRFYESVGFERLEVFPTLWDAWNPCLVLVKKL

SEQ ID NO: 2505 - protein, 268 aa, Lactobacillus paracasei
MQIKAGTADQGWALEEKLDEFNRHQHPFNGAGADVSFAYVIKKGDQVVGGVAASSDDNAIGYIELLWVDETMRRQGLGRALLATVEQGLQAAGCKRVRLETFDYQAPAFYLENGYHEFAKRDYDYARVIEYFLVKPLSLPIVFTVPATFSIEAAEDLAMEAIENKLHAYNVKMKPLLQQKMGVTFTFLAEEDGQCIGGIFVYSTMYKIGYIESLWVAETNRHAGVGTALVDALLNALKDFGCPIVHLDTMSYQGGRFIRHLVLSNLAS

SEQ ID NO: 2506 - protein, 212 aa, Lactobacillus paracasei
LDLNEDFFKHYHYKTELMAICRQHRLPAGGTKAVLNQRLQALVAGQPLDTPTSKVKRLAKPVKELSVTTPLANSGFSFNAAARQFFAAYFHVSKFAFTKPMAVLKRQADAQPQLALTVADLIDVYQATRNSKARQQFLAENAEEKTYEWNRFVHDFFADPATRQFRPRLKVAAILWQQLKQSTAPKQYVHSLLQAYHEAIAGYVQTSSEIDQ

SEQ ID NO: 2507 - protein, 209 aa, Lactobacillus paracasei
MLKLFYASGTSAMAPHILLTDAGLNFELEKVNLDQKTWRGGDYDQINAKSYVPTLQIAPEQYLTECAVILEYIDFQARQNDGSNYATDEYWQERVWLNYIATELHKNFISPFRKGNWLPNTDDSKRLVWQRVAPRLAYVEARFQGPWLMGQHFSMTDPYLFVMTNWMHRLDFSFDHLPKLKAFDERMRQRPSVQEVLRVEGKPHSVTDG

SEQ ID NO: 2508 - protein, 85 aa, Lactobacillus paracasei
MANIFKVLGEPHRIEILRILYHAGRELTCSEVSAQLNLSKSTVSYHFRAMRLAGLTNTRQVAQIKYLSINTTAFDRFLPGFLATL

SEQ ID NO: 2509 - protein, 211 aa, Lactobacillus paracasei
MINVLILGAASQISRFLIPDLLADKTVNLTLFARQAPQRLGQYAGESRVTLVDGDWNQEADIEQVMPNQDIVFLASSSLVGNQNVVTAMKHTGVQRLIVAGGLGIDDEVAGKFGNWNARMMGDYTPYKQAAKVILNSGLNTTYLRMTWLYDENGNEKYQIVPEGQPLRGTQVTRQAVAKLVTAIVRHPSLYQYANIGVVEPGTEWDKPSFY

SEQ ID NO: 2510 - protein, 105 aa, Lactobacillus paracasei
MAKQTAGRKQLGKFAPQFAALNDDVLFGEVWAKENELSAHDRSMITIACLMTSGDFPQLKAHLQLGKEHGLTKEEVVAEITHLAFYAGWPKAWSAFNLAKEVYGE

SEQ ID NO: 2511 - protein, 138 aa, Lactobacillus paracasei
MNDKNQNAGLFGLGEANTAYQQYFTGNSYLNGLVAAADEIDVTVANVTFEPGCRNNWHIHHNGFQILLVTSGEGWYQEAGKPAQLLHPGDVVTIHEGVKHWHGATKDSWFSHVAITKGTSEWLEPVSDQAYAQLTEAK

SEQ ID NO: 2512 - protein, 68 aa, Lactobacillus paracasei
MADFIVSMIAEIFTLIICAFALYASIISFSLFDYAFRWFVAFGIVFSSACILISIAAMIFSCYEFFSQ

SEQ ID NO: 2513 - protein, 32 aa, Lactobacillus paracasei
MNELTTEIIAALAQKQDLDEVFRHHLKLESPE

SEQ ID NO: 2514 - protein, 458 aa, Lactobacillus paracasei
MSIIEHHQEKLDLSQTIHGFSQLVGFSKLSTHVFGRHQGEFSLLQIIEWLLTTKFLGRSLYRAQPNPRFTTRTVRNYLNDGRTNWQRLTCLIAQALIKYLRPFIHTHRRLAFILDDTLLTRDTAKKTELLARIFDHDDQVYKKGFRALTLAWSDGDTLVPVDYALMSSKDAKNRIGGASTNQDLRTLGGRRRAQAVRKMTDVSVELIKQALANGLKVGYVLFDSWFSSPRMFLALKRLGLDTIAMVKKSSKVHYLYRKRHYSIPALYKRLASSKYHTKANYRYACVVQAEVEQPDGSVEIFPVKLVFVSNRGQSDRFLVLATTKQSLHPEEIIQMYGRRWQIEGYFKIAKQYLRLDRSQVQSYDGLCAHIAVAMMAYDILAWRQRQEADVRTLGDLFYNMNEAMPDLALTQALAWLLEELNLIQATGTTEMSSALNNVMGQFEAHLPQALETQLGIAA

SEQ ID NO: 2515 - protein, 412 aa, Lactobacillus paracasei
MSNQITINDVPVTALPAHKTNPDYHTDKQQVFIVGSKGIPAAYGGFETFVEMLTRFQTDDSIRYHVSRLGKDTQRYMHNGAKCFNVNVPDIGPAKAIYYDIAALKRCIDYCKARPQIKHPIFYVLACRIGPFIGHLAKEIHALGGKLYVNPDGHEWKRAKWSAPVRRYWKYSEQLMVKHADLLICDSKNIEAYIRTDYRQYTPKTTFIAYGADTKRSKLTDDDPQLLDWYAEKGLKSKEYYLVVGRFVPENNFETMIKEFMKSKSKKNFAIITTSNDEFLKKLEGKLHFKDDSRIKFVGTVYDTELLKKIREQAYGYFHGHEVGGTNPSLLEALGSTDLNLLLNVGFNREVAEDAALYWTKEDGSLATLIDKSDTLSKTEIITISVKAKERIQDFYSWSKIVRDYETQFVLD

SEQ ID NO: 2516 - protein, 440 aa, Lactobacillus paracasei
MKILHYTIGFQPDRTGGLVKYATDLIEAESRQGNDVVVLFPGTLGISQKFGIHHERKTSLRIGVECFSITASLPLPLASGIRNPERFMRKVDEQVYHEFLTRNHIQIIHVHSLMGIHLELFRVANKLGIPIVFTTHDYFGLSTEPNLYLHGKSYDDQNNIAFWEKVAVQAPSVRRDLIYQLPGYHILRNIIKKMPKSKTEQDAKVTNSDQDLNTRLSEELKNLKRYYETMFKYIDYFIFNSEVTRNVFEKNLPFPLTGKVVQVTSKDAVKREIRIPAISTKTSLTIGYIGPSADYKGFFDFVKFANNSQSVNRQFKTYGYAPSLNLNGIEECGRFSRDEVKAVYSSLDVLVVPSRWKETFGLVVTEALTNGVRVFASDNVGAGELLPDFYRFESIEDLQNKFRSETLPKIEVVVPTFSDHVQKIETLYGIMIDGKIGPGF

SEQ ID NO: 2517 - protein, 225 aa, Lactobacillus paracasei
MKSVSQQVSHYARIQIYARTAIKIIRGFIRKIFLRKSSGLLFIGKHVSIQNSQYISVGRNVKFEDYSEIQGLSTEYLTFGDNVTIGRGVMIRPSSYYGVGHIGVGVSIGANSSIGPGGFVGCAGMVKIGTNVMIGPNVMIIAENHVFSGQATSIKSQGVVQKGIHIEDDVWIGSNVTILDGVTIGKGSVIGAGTLVSKNVAPGTVNIDHRDRIARDRSGKEGMQK

SEQ ID NO: 2518 - protein, 316 aa, Lactobacillus paracasei
MSEHSVSVVIVTYGNRMNFVSKVATQVLSMSSVRHLIIVNNGNKERVQSDDSRLVSINLPENTGSANGFFAGLKRAREIQDDFVWILDDDNLPQRGALDVLLEDYDQSDGKQIYCSLRLDRTELVKRGEMHYLKNSFFGFSLLNKLKRHGASVIDKENRFLVCDTVPYGGLMLPLDVLNSIGLPNRDYYLYNDDNDFTYRITKKGLMINCDPESKIQDLESSWYRRENVPMFQGFFRTKMIASGLYTIRNRTYFEKNNIATNKAEYVFNIIIYMIYVFIFYMPKNGDGLRRYHQIASMINLGYRGKLGRMTETKGK

SEQ ID NO: 2519 - protein, 387 aa, Lactobacillus paracasei
LELYNRITKLKYIPALLAGFVIALPSNVMSKLFHSKSKLFLVGENGGVGFQDNGKFIFEELLKRNTGKTYWMTFALNCNTDLKNQCRIGTVRGYYLYFRSAAVFYTHSLSTDIAPLANHIVFFNPLHIEISHGVEGFKKKIQTNLVTNYPADLYTCSNSFEMQIKHDYWKIPNDKLSITGVARYDGLPIQKASHFTPRRILYMPTWREWDYQESSADFKLTNTFKQINNLCTDSNLSNLLQQYNMHLVLRLHPFFQKYSECFDSTKFAKNISVTDGDVSALIRDSDILITDYSSVSWDFLYSLKPVLFFQFDRDEYLNVRGSYLQIPEDLFGPSTTDWRKIPEILQNQILKFDSSRLIKQRDKYFDYSDRKNSARIVEACTDLLDEE

SEQ ID NO: 2520 - protein, 446 aa, Lactobacillus paracasei
MKNNREINKGELIRVHQRVGYVNMKKILSIIFTLLLLIKVSKKMWTIVGLLFPHLGILKQNATISIAVFILCLILLGCSHWRMRKNDFLLFIVLIFTLLISAVTNSTSTQSFFSQFYILFDSYSLVLVAILLNNQSMRMLNWRSVEATILVFVTLQALLGISQFISKSPIVPIMDASGDPVVNSIYYVNGASSNKAYFMFQAGAKLRAFGMTDSGFTFGLLMLLGLVVILKRREIKPWLRGLLAILYSVGIYCSYTRIIMFALFGFLILKVVSKKHLIFIKFTYFFGVVSQLGIMLLAYTLTSMQVMSSSTFWGSIVSRIQGIMFYTEHYSLNLIHFLFGFNNVVNSSNINTIYSIDNDTLNIYFDIGILGLLVIEVFFASMLLTTLRERVTFYQISSFMAVLALIGIVNSPYYFIAFLMILFEVERYSDGTSIIGSEIDAGISIY

SEQ ID NO: 2521 - protein, 294 aa, Lactobacillus paracasei
MLSVIVPVYNVKHYLTKCIQSIQNSSYTSLELLLIDDGSNDGSSEICDYFSNQDARIRVFHKPNGGQSSARNLGMQEASGDLIAFVDADDTVSPDYFGKMISVLNQTNADIVSSPFEKHSDRIREGIIPLESFICDVMAGELGTVVWNKLFTSRLLAGVTFPSNSIHEEIDFNRQYLKRIGTAAVVSDSGYRYTQDRSGNTNSSFDPSRVETYRQIDNFISEYRRLFSRKVVCSLEMFGAIHFYSMMNLVAHFSVPKTINTEINAKFRRYYWMSVKDGALFLHPKAMIKMLVHH

SEQ ID NO: 2522 - protein, 475 aa, Lactobacillus paracasei
LKNVRNYFYNLSYQLFLLIVPLITVPYISRTIGPSGVGINSLTLASTQYFIYFATLGLTTYGQREIAYVRDDKNKLTKTFWEIELLSVFTTLFAMLFFAVFIGIQAKYQKLYCIEALLVVSCALDVSWVIMGTENFKVTVLRNFFVKITSIILIFVFVRTSADLWKYVLITSLSTLLGNISLWPYLLKVINHAFPRKINIFKHLKPTFALFIPQIAITVYVYFNKIMLGNMSSVLQVGFFDSSDKLVRIALTVVTAISTVMLPSAAKYFSDGNVNKLNDSIKTSLNFALMLALPMAAGLMIISPRLVPIFFGLKFAPTSQVMIVEAISIIPISISQIIGVQYLISTKKTRIYTVSIVCGAVINLIANWFLIPSLGAVGTAWATVIAEFLIAGMELAFLSTKISLFWIFQDLPKLLLATLGMSFVCYFESMIGIEGIVGVLLPTLAGILSYFGLLLLLRVDFFVNAVGTISDKFSH

SEQ ID NO: 2523 - protein, 103 aa, Lactobacillus paracasei
MTDHFKGRQFNQSVITFAVGYYLRYNISYRDLVEMMRDRGIFVHHTTLMRWVQHYSPIMRALWRKRHRRTSKSWRMDETYIKIKGQWNYLYRAIDDQGLTLDF

SEQ ID NO: 2524 - protein, 307 aa, Lactobacillus paracasei
LSKDKTQKNGWFKKKPAAPKPPKIMHPGLRRPVTLLCWAVLIGSTSFGVYKNMTAIDTHTVHEVQVIKTKVIDTHALATFATDFAKLYYSWQPSHEALDQRQKALQPYLVEQLQSLNADTVRSDIPTTATVSEVKVWDVSETAKNTFRVLFTVTQELAKGKDKKAVTSTYTINVMQNDNGDMVVTKNPTIAAEPATARIKLPDTQSDNSVDSSTADNVTKFLKTFFALYPQSDRNELKYYVKDGTRPIERNLKFVELLDPVFKQTKRGLTVTLSVKYLDTDNDMSQVSQYTLTLSKQSNNWIITDGI

SEQ ID NO: 2525 - protein, 168 aa, Lactobacillus paracasei
MATLTGWNSSPTPSMMRHVDLKFGDNRALRNKELDFASSKWERIKFFKQRKPNTDDLCNVIDRFVDRMPEMESGHRREYRLAVAHEVAVEHWLVGKVFAPEDRKYILDRERFLAEEYFDNDRELGQYIETDYESCKRISLQRLFVHFLDIYDDFYRCYEIRKDKVNEP

SEQ ID NO: 2526 - protein, 331 aa, Lactobacillus paracasei
MKLWRWLALAAIPILLIGGLFFAVIASDDDEDQPASAITADAMNLSAEVYKHKLTVEKYCKEFGISDQVMVILAIMQVESGGKGGDVMQASESMGLPVNTLDTEASIKQGVKYFASLLKSKKAAGVDLNTAIQSYNYGGGFIDYVAKHGKKYTLELAVSFAKEKSGGQKVTYTNPVAKDSWCYAYGNMFYVSVISQYLVTGGAKFDDKTVQAIMDEALKYQGTRYVFGGSTPATGFDCSGLTSWCYGKAGIKLPRTAQAQYDATAHLNIKDAKPGDLVFFHSTYNTADYVTHVGIYVGGMKMYNAGDPLGYADLNSSYWQAHLIGAGRVRK

SEQ ID NO: 2527 - protein, 714 aa, Lactobacillus paracasei
MTKANRRRLLLFLGVVVAFMLVLVLAGGQPVHAAGLVDDQSGGSNEYSKYPLSHYQLDYFVDTSWDWLPWNWGDGIGKSVSYGLYAITNFLWTLSVYLSNAAGYLIQQAYSLDFIKDTSDAIGKNMQLLAGVSKDGFTTDGFYPGLLLMITLVVGIYVAYTGIIKRETSKAISAIVNFVVIFITSASFIAYAPDYVSKINEFSSDISTSALNTGSKMIMGTDTATDKSGVDAIRDTLFEIQVKQPWTLLQFGDSDADNVGKDRVNTLMKTDPFGDKGKTRTDVVKAEIEDNDNENLSPTMTINRLGTTTFVVLFNIAITLFVFFLTAMMLFSQILFIIYATFLPVSFLLAMLPSFNGLMKQNIMKLFNTIMTRVGVTLVITMAFSLSAMVYGLSATSPFFLVAFLQVTIFAGIWMKLGDLMGMMQLHSSDAQQGAQRFSRRGNRMFRQFVGSAMGGAMAGRFLSRGYGKGRGMPQTPQLPAGTQREQTADATKPQQPKKPRSQRLGEKLADVSDVGNRFKDKTKRGLNQVKDAPTNVLYGLHRGKQLTKEAAETAKDSFKGRREANQQERDKQLEQRRKQMQERRLAIKPKSDSEKPKPTAAKPPVEPKRKPTATKPPVESTRKPPTVTPAKPKSEQTAASGKPKRTTTQPTSTRPPRPATKPQADPAIKTHQEPATPPATKLKKPLNLVSEKTAKPRNPKPQRIQPAKGHKKR

SEQ ID NO: 2528 - protein, 821 aa, Lactobacillus paracasei
MKFPIKYIEDNLVWNADGECFAYFELIPYNYSFLSPEQKQQVHENFRQLISQNRDGKLHLLQLATEASVRDTLDRSKKLVKGSLKDIAFQHIDGQAEALTENVGDNQVDYRFFIGFKLLLNDAEVTAKSIFKDMSLGIRDFFAEFNTTFAGDFFTMNNAEVERYAKSAKFLAEKIGRRFKVRPLDKNDFGYLLEHLYGMTGQDYDDYEYHLPRKKSKRDTIIKRYDLIKPTRSLIEQHQRSIKITHGLDASYVTYLTLSDIVGELEFPGSEIFYFQQSQFDFPIDTSLNVEIVTNKKALTKVRNKKKELKDLDEHAYQSGNETTRGVSDALDSVDELESNLDQTKDAMYKISYVIRVAGRSEDEMKRRADQILDFYDSLNIKLVRPFGDMLGLHGEFIPASKRYINDYIQYVTSDFIASLGFGATQSLGEKEGIYIGYNVDTGRNVYLQPDIAAQGIKGTVTNALSAAFLGSLGGGKSFSNNLLVYYAVLYGAQALILDPKSERTGWAENLDFMGDEINIVNLTSEEQNRGLLDPYIILSNLKDSESLAVDTLTFLTGISSRDADRFPTLRKAIRAVTQAPEPGLLKVIDELRREDTPIARNIADHIESFTDYDFAALLFSDGTARRTIALDRKINIVQIADLVLPDADKTQEEYITAEMLSVAMLMIISTFAIDFIHQDRAQFKIVDLDEAWAFLNVAQGKALSMKLIREGRSMNAGVYLVTQNADDLLDEKMKNNIAQKFAFRSTDITEIKNTLNFFGLDAEDEGNQNRLRSLDNGECLFQDIWGHVGVLHFDYIFEHLHHAFDTRPPKPVEVIADDES

SEQ ID NO: 2529 - protein, 130 aa, Lactobacillus paracasei
MKKVRSYTSIWSVEKVLYAINDLQLPFPITFTQMTWFIVSLFAVMLLGDLPPLSFIDGAFLKYVGIPAGLTWFMSQKTFDNKKPMGFLRSVINYAITPKLTYAGKPVKSQKEKQTAAVIYVWRYNNEISN

SEQ ID NO: 2530 - protein, 167 aa, Lactobacillus paracasei
MATEMRVWIANLGKYNEGESVGAWFEPPIAWDDVAEQIGLNEEYEEYAIHDYEAPFPISEHETIAHLNEMWAALEKLNNSDLADAVEELVEKRFDDVIELAAHIDDFIHYDVETMEDLAIKLVQDGDFCGEVPKQIQSYINYERLASDLEADGDYITTYDGIYEYLN

SEQ ID NO: 2531 - protein, 73 aa, Lactobacillus paracasei
MNFGQNLFNWFTSNAQSLVLMAIAIIGVYLGFKREFSKLIGFLVIAIIAVGLVFNTAGVKDVLLNLFNRVMGA

SEQ ID NO: 2532 - protein, 108 aa, Lactobacillus paracasei
LVNDVLTSHQLRGKAFKDCVLNVYVYTAALVGVVEHKQYRRICDMNSFGFTAQDYIAWRHQQQEHPAALIGRDGRALNYSELRRLLYQTADESGWPVFRSPVEALFLY

SEQ ID NO: 2533 - protein, 396 aa, Lactobacillus paracasei
MCSWHEKIKTKRKQLKLTQVQLARRLGVTRMHYVQVENGKTNPSPALQAEIDRLLKNWNDEPELTLMFDYMRVRFPTTDAKAVITKILGLTPEHLIFEEHGFYGYSAMYIFSNIQVMVAPIDSNLGTLVEMKGQGCREFEGILLSHGETWYDYFLRVDEAGGIFKRVDIAINDMVGLLNIPELVDKCLNNECISVMRSFQGLQSGKLVDLDEAGRGNTLYVGTMKSDVYFCIYEKAAEQAAKRGIAIADTPIINRFEIRLKNERAIKVIESMLITRDAEKVAFGIITRYMRFVDEVPDKSRLKWPLNDRWAYFLGKGRQPIRLTTAPQPFDMNKTKAWLQKQVMPTLKVIKEIDNYFGTTDLQLMIKDAELNDKHLKLIEQQTVGSEELGGDMFGQ

SEQ ID NO: 2534 - protein, 60 aa, Lactobacillus paracasei
MTIQSVQQGCPLLPPRAACNAKAASVSGSGRRQPTAYPQYSNRGVLNTTSVPEHGVERLL

SEQ ID NO: 2535 - protein, 86 aa, Lactobacillus paracasei
MRIPIINNQSRFQEDYADTIIAGTPEDAEDALLEMCDYIEPYEDGDHWLELVGDRTISGKPIYFWFTATMTQTGMQLTYHSWAHHY

SEQ ID NO: 2536 - protein, 195 aa, Lactobacillus paracasei
MSDLIESFMKQNNGQVTTADAKKLGVNPHLLIDLANRGKLERVGRGVYIDPAIFEDDMYILQYRFSKGVYYKDTALFLHRMIDRTPDRYQMNFPRGYYPSSIGEFPVRMYHQKSEWHELGVEEVLSPGQHKVRVYNIERTLCDILRTRDSSDSETIRQAMISYSQLKQKDIGRLVRYADLFKVREKINNYMEVLL

SEQ ID NO: 2537 - protein, 276 aa, Lactobacillus paracasei
MKLGFSNGQQFKAKVRNLAKEKQIDPQILMQKVALDEIVDRISRSPYRDNLILKGGFLIVSMLGVDTRATRDVDTSVKGLPVTKEEILKVFTDIANMNEPDSDVTIRIAKIDDIRVAAEYAGFRIHIEAKIYNSVVDTKIDVSTGDTITPREISWHHRTIFNDQDILVMAYNMETILAEKLESMVVRQELNSRMKDFYDLYLFDKVQRQNIDFKVLKDALRATAELCGSEALLPRYAEIITSLRGSGLLKQRWEKSTEWPTYTVRTSLMKLPAMLR

SEQ ID NO: 2538 - protein, 91 aa, Lactobacillus paracasei
MSTDVKIKNRTQFLNDFHENVPFQSDEDAEDQLQWMAMHAHEYPDSRIWMGAPGGLTADRFPKRFWFNVTTGDNGGLIMTYTNVADEGDEE

SEQ ID NO: 2539 - protein, 462 aa, Lactobacillus paracasei
MKLTYRGTRVYPRQRNLLYNTAMTVVVSLWVTGVTIAYWPLLKQINWKFFSWSDVAALPWSWLPLIINSLCTALLFGAGLWVHRTWFADSYKQMEHRQKLARMIMENNWYQTDQSNSESFFKDLGSTRTKEKISHFPKIYYRLKDGLIHVSVEIVMSSYQDQLLHLEKKLEAGLYCELIDKILHDSYVEYTLLYDTIGKRITIADVTCEHGAMQLMETVAWHYDALPHMLIAGGTGGGKTYFILTLIEALLKDGAQLTILDPKNADLADLADVMPGVYSKKEAMLGALETFYQDMMVRNDKMKQMDGYKTGENYAYLGLPAHFLIFDEYVAFMDMLGRDAMQVMSKLKQIVMLGRQAGFFLVLACQRPDAKYLGDGIRDQFMFRVALGRMSELGYSMMFGETNKDFFQKPIKGRGYVDTGGSVISEFYTPLVPRDYDFLTKIGAAANTVPATPTKQEVPNEH

SEQ ID NO: 2540 - protein, 95 aa, Lactobacillus paracasei
MNDQTTLINLDDFMLHYEHISDFDNGASPTGDVIINLIDAANHAVQAGMNACDLILASEQCAKPEAYLHGARFSFNVSSSPLGLVIGYDGVNIDE

SEQ ID NO: 2541 - protein, 83 aa, Lactobacillus paracasei
MAQALSIDGFLEDYPALVDPDFHDPSPDALIDMVLMAAEQSNPDEPFSIWVDGECTRDHESKEFSFNIDTEDRQPAIKYIGVK

SEQ ID NO: 2542 - protein, 87 aa, Lactobacillus paracasei
MMTSTLTVVGREVFIDDYNEEIDNDYRLDPDEILQDMVELMEESPKSYQHLHFDSEQTNDGMNKLFSFTSYEREDGLRLSYLGVSDE

SEQ ID NO: 2543 - protein, 123 aa, Lactobacillus paracasei
MRLAEGIVIDLEETFGVLKFSGQRRERFVQDEDGNRTDNVKERTYDLKSMKQGMMIQVSIPAEAGVKDFKYNQIVTLVDPVIDTLANANFNRVETSWYMKAKDLVIATAPVKSQEKPNNNDKK

SEQ ID NO: 2544 - protein, 107 aa, Lactobacillus paracasei
MELKFVAPNIEKTFGHLYFGSLKREQAEGTRDERKIVSRTYELFSDLQRTDNIEITIPAKKGDKAESIEVDAPVIIIKPRIATIGYRIGEQAFVRYICNADDIVPVK

SEQ ID NO: 2545 - protein, 80 aa, Lactobacillus paracasei
MRISSINMYPDPGGDVLLQGDIVLDHVLILKNVKLIEGSYRWYIQFPRYADGRTVHPISKSFYQYLLQQLSEYYNQATAE

SEQ ID NO: 2546 - protein, 1269 aa, Lactobacillus paracasei
MKTARRTSIFAALVVIFIQLFIPASLAIAASMTNTKVADWRNTWHLHLFNGLHWTDTGMWMKKLDGKVAFCVEHGVDLDMSGSGYNPSTYADSKKDQLAKIAYYGYYQNPTNRNYAVTQMVIWETLGDTLLTTPNKTYQTEKKAILDKVAAHDRKPSFNGKQITLAVGDSITLTDTNGRLAAFAQQTANTANLKITKSGNKLTLTATAQSKASGKVAYAIAKAADVGTSFVYTKGSQQKLVNFKLSSNGEFSLPIKVNLNGNLKAKKVDADTNKALPGAKLKFAYNGTSKEVTTGADGYAALNDLKAGTKVTVSEVTAPNGYVNKGELKEATIEPNKTVEVVLGNKEQLGNVTLAKIGKEFGSDMFNAYYSLNGAVYGIYTSTGTRVGAITTDGNGKGTLQNLKLGSYYALEEKAPAGYVLNTTKLPFELKYAGQTVAVTTAHVDTTDQEQRGTATIIKEDAATGKQPQGAASLNGAVYELHRATDDKLVKSVTIANNTASVSGLELDDYYWQEVKAPTGYVLDPQKHAFKLAYAGQNVTTATATTTVKEQVITGDLELLKYGNYDWTTQGKGTKPVMLKDTQFTVTSKTTGKVVRTGLTDAQGYVKFADLPYDTYTVTETKTPTGYKGIKPFTVVVDGTQKSQHYSIENKVIEEKLRVVKVDTETGKTVLRAGAIFRVKNLQTNKYEVQPTADKSGTTDKFVTDNSGKLITAEALGYGKYLLEEVQAPEGYVLAKEPAKFTIDGSHKDGIVVIKFADLSQKGVATLTKTWATPVAVEKVETEYGDQYKFKYDYTALAGAKFEFKAAEDITTADGTVRAHKGDVVATGTTDAQGQIQTPELYLGKYTATEVSAPNGFILNTDPIAFELKYAGQEVTVTSTSLEAKNDFQQLDITLNKQEESLTGWKNNLPEIKNVAGNGQVFGLFSMAATKIGDTEVPAQSLLATTTVKDGKAAFDAIQLPVGYYYVKELDAGHSHDLSTTMYGFHFNTTDNEKIKHIKINDGKQIENKLHENELSFKKINEVATLVSGKGYSYAMTGNAAGAVFELLDADKKVIQTITVGRDSTGSIKHLPVGTFYLRESTPSATNLVLSKETLKLVSTKDGVTVFDGKDKQIGEAKADAKEPTIAFELNNNLIKGTGELTKTDVSTGKRLPNTGIRILDEDGKTVVSGRTDKNGVFSFGNLPAGKYSFQEYDAPKGYEISEALVPFEITKDGEIVKAIMKDKQTPKPGLPQTGNAKAGWLMVIGVVLLLGILAAMVVIGGTKKKDGK

SEQ ID NO: 2547 - protein, 107 aa, Lactobacillus paracasei
MKATYKDQSAEVWEISKNNEFPDWVKEAFEKNYLVWLDDRLRILMAGLFPPMIESLQHEKASVFRVQGVQFGVVTIGYLGDYLDVTNHRVVSKQQFARQYRIEKTGN

SEQ ID NO: 2548 - protein, 319 aa, Lactobacillus paracasei
MKRRKLVLISLAVVVVIAALIFGVARHNKTQAEQAIQARNAKVDQTLTAIRAQHKKNVALKDDAKRLQALANLETRSEAYSLRADRKQPVIALYKELINKEKAYFTDKNQKSLKKNKLTDDQLKDIKKKDLQAKLAGLNALTDVLNTQRDIVYNDKNFKTLSTEIQHLSERYAERLRQMTQDEGQASQPAESSNTASESQGQQDQTDQSASGQSADTSQSGNVDNGQTDTGTSTGGYGYNNPWNSWYAPNTGSGSSGSVTDNSGAGTTTTPNADNSGAGTGATDQGASTGADDGNQSSSATGNTGIDGQASSGADGTNP

SEQ ID NO: 2549 - protein, 146 aa, Lactobacillus paracasei
MENELKKLLSMPDPLQFNQHQCEWLLDHISDPNAEIRDNLVYSLLARGFLTEGFTTAQRKAIATRTTQQAQLFTGLNNSDNDKVFTRTFTALLGAILLETDSSKPFLTDKQIQTWIDWALKYLQIETDWRGYVSIKRLGAWHCPWQ

SEQ ID NO: 2550 - protein, 84 aa, Lactobacillus paracasei
VRIGKPISHTLMRKVHSLVCGRCINDDHGLRGFVHDTGGRPNTVDQSQYQTATSSGRIPQGARTTPRKIGKLKAAFPLSGSRGF

SEQ ID NO: 2551 - protein, 63 aa, Lactobacillus paracasei
MALIEVDHVTKQYVKVAKIGVVKKKRTLFTAVDDVSFAVEPGEKVGIVGLNGSGLDCNNKVTT

SEQ ID NO: 2552 - protein, 87 aa, Lactobacillus paracasei
LGERLPYKQRVTGSSPVSSIEPLAQLVEQLTFNQWVDSSSLSRLRELLVLNGGSSRFFADLAQLVEHLSCKQGVEGSNPLVGMVPII

SEQ ID NO: 2553 - protein, 182 aa, Lactobacillus paracasei
MKATELTLISEAITNSTAFSQLFKQYRPLVLTVLRPYHLRDFSHEDWLQEARTAMLKAITRYDGSSGSQFGPYYRMVLQSHLRSVLRKHFAHKRRIDATAIPVEDSALESLQERLALRSYEDGLLMRIEFAQFLARLSPLEYEAFEAAVISQTDSSEDPLLQRHRRALERSRIKILKFSREE

SEQ ID NO: 2554 - protein, 572 aa, Lactobacillus paracasei
MRYHRENSEFIKNNQFYIDHDTRYIKQVTFLGRYSIISSNRENNKIGLFQLVMLALGSLIGSGWLFGSWEAAAVAGPAAILSWVIGGLIIGIIAYNYIELGTMFPESGGMSKYAQYSHGSLVGFIASWANWISLVTLLPIEAVAAVQYMASWPWQWASFTHGFLANGRITSQGLLVVFAFIIIFTLLNYWSVSLLTRFTSFISIFKIGVPLLTITLLALSSFHPGNYGHSLATFMPYGSAPIFAATSVSGIIFSFNAFQTVINMGSDVKKPQKNIGRGIAISLLISAVIYILLQSVFITTISPKLLAAHGWQGLNLNSPFADLAILLGIHWLSVLLYMDAFVSPFGTGVSFVASSGRALQAMVSNNHIPKFLGKLDEKYGTPRVAMVVNALLSMVMVSIFPSWGTLASVISTATLIAYLTGPITVISLRDMAPDFKRPVKSSLLRVMAPLSFVLTSLAAYWAKWPTTVEVIGVIFLGIPFYLFYEWRSGWASTLKQLKAAAWMLVYLLFLSLISLIGSSEFNGLNWIHYPLDFVVIIIGALGFYAWGINSHIFSKYFRRAARVNDKVKMPRQ

SEQ ID NO: 2555 - protein, 99 aa, Lactobacillus paracasei
MQFSLKPLKLSYLVAITPSSGKSRKLCHLAFYQTSLHHRRLKASAAMAKNQNVFHHTKKHVDDHVSDQRRVFSNKSCYCRGILTLSFTLAARRKYLEKM

SEQ ID NO: 2556 - protein, 402 aa, Lactobacillus paracasei
VNIGIFTDSYFPQVSGVATSIKTLKDDLERKGHQVYIFTTTDPHVPDDAVEPNLFRFTSVPFVSFTDRRIAVRGLFHAYAVAKELNLDIVHTQTEFSMGYIGKFVAKQLKIPTIHTYHTMYEDYLHYVLNGHLLKPYHVKQFTRAFLYHVSGVVAPSERVYDTLRRYGVKTEIKIIPTGVDLTQFAQQKDPHLRDKLGLAHVPVLVSLSRVAYEKRIDKVIRAMPKILEQVPQAVLLIVGDGPAREDLEAQVAELGLKEHVRFTGEIDHDDVGDYYRVGDVFVSASDSESQGLTYIEAMAADRKVVALTGDYTDQLLDDPALGTTFSTETEMVHQVVNYLKHPNAYDDAKPRQEKLAAISADRFGDRVLDFYQDILSHYSPNEADEAAPWTDEDSSKRTMKG

SEQ ID NO: 2557 - protein, 342 aa, Lactobacillus paracasei
MIVINMFSSANKVAGQGVGAVYTELMGLLKHDFSNEFEVNVNRYTRSDISHYHTIDPKFYLSTFSKKRGRKIGFVHFVPSTLDASLKLPRVARWTLDKYTLAFYKRMDQLVVVNPNFIPKLEAYGISRDKVTYIPNFVSQRTFHPVSTEKRQALRHANGFKPNDFVIFGAGQVQDRKGVSDFIKLAKQNPEFRFVWAGGFSFGRITEGYDHLKKAVAEAPTNLDFTGIMPRETMIDYYNMADVFLLPSYEELFPMSVLEAFATGTPVMVRDLELYHQIITPYAITAVDVDDMQSRLRALADDHDLLATYATKSRQAAEVYDESRLEKVWHDFYLHQAALGKH

SEQ ID NO: 2558 - protein, 337 aa, Lactobacillus paracasei
MTRKNKLAVLIMILIGAGIFIYEARDLNGAQLIHELLTLDLKWLLVAFLLMFGSWIIETFVVQIFIRSEADDLDFKTALRVPLVEQLFNAITPMASGGQPAQLFALMQSGVEAGRASSVLLMKFVVYQFMVLINFVLTLFIGFDQVSKHFGALALFIVFGFVIHVVVIVGLLMVMYYYKFTKKLVNLVMIPIGWFVKPEKKLAMQSNLDHKIDTFYAESLHLKREKKRVIKACLLTLVQLLLYYAVPYFVLLSLGVSHVSIVEVIVLHVMIVMIVSLFPIPGGAGGAEYSFKTLFATYVASPSKLILGMLLWRFLTYYLGMICGIIAMAFPPKSKRT

SEQ ID NO: 2559 - protein, 117 aa, Lactobacillus paracasei
MSSASEELNQYWPAFRQSKRYAPLLGIGDAEIKHILTGIVELVMAQNQHHIKAWQINEIAAALRPALETSWATPKQEQRILARYASWVNIFLTWLAEAGKVAFTSADVAAVMAILYP

SEQ ID NO: 2560 - protein, 391 aa, Lactobacillus paracasei
MKLQPLNKQLADIDVSEIRQFDESVSKIPGILKLTLGEPDFNTPEHVKQAGIEAIQENYSHYTGMVGDPELREAAQHFFKTKYDTDYAADDEILVTVGATEALATAITTISDPGDAMLVPSPIYPGYIPLLTLNHVTPIYMDTSKTNFVLTPALIEATIAAHPDAKIKGIILNYPSNPTGVTYRASEVKAIAATAAEHDLYIICDEIYSELTYGDSHVSMGSYAYDRTFVVNGLSKSHAMTGWRIGFLMGPRVLIAEAKKVHQYLVTAATTIAQRAGIEALTNGQDDAQVMKAAYAKRRDFVYQALLDMGFDVARPDGAFYLFAKIPIELGLDSRQFTQSLATEQKLALISGTAFGPGGEGYIRISYAASMADLKEAVKRLQAFIAAHKAA

SEQ ID NO: 2561 - protein, 92 aa, Lactobacillus paracasei
MKQSQLVAIIKRLEAMQAGDGETQSRRFEKNGDEKGLVTYDPKTETYELEELGTHQTFQFDNIDLAAMEIYDLMDFDEDDGTSDSTSDQAPA

SEQ ID NO: 2562 - protein, 697 aa, Lactobacillus paracasei
MNQLGSKLREFFNTRLGFFVLAIVLFWAKTYWAYQSKFNLGVTGSFQHLILAINPIPTTLFLFGIALYMSGRKSYITMLIIDALTSVWLFANVLYYREFSDFLTFALIKGSGAVSNNLNKGIMGIVQPTDFIVFADVLILILLLVFKVIRMDIRPIKKRFALGVSVLAVAMFAANLSMAYSDRSGLLTRTFDNNYIVKYLGLNAYTVVDGVKTAQNSATKANADSSDVKSVLNYLNKNRVTPNAQYTGVAKGKNVFVIHLESLQQFMIDFKWDGQEVTPNLNKLYHESDTLSFDNFFNQVGQGKTADAEMMMENSLFGLPEGAAMVTDGTTNTFQAAPAILDQQGYTTASFHGDVPSFWNRDNTYKSWGYDYFFSKNYFSSGKNYDVGYGLKDKIFLKDSAQYIEQLPQPFYAKMITVTNHYPYTLDKANQTIEKTDTGDDTVDGYVQTARYLDEALGEFFNWLKETGLYDKSMIVLYGDHYGISNNHKKAMAKLTNISGFNDYNNAMYQRVPFMIHMSGLKGGINHTYGGEIDALPTILNLLGVKDNDTVQFGSDLLSADHPQTVAFRNGDFVTPDFTKVGSQYFNTTTGKKIDKLSESQKESVDASTNRVTTELSLSDRVINGDLLRFYTPAGFKKVDRSDFSYKLTDTKKKLKAAQKKGTSLKAENKGKSVADEYKTDAPELKDDSDSSSSESK

SEQ ID NO: 2563 - protein, 146 aa, Lactobacillus paracasei
MNQAVYNKTINLLKAKQIRVTPQREAIISYMIDSTAHPTAEMIYAKLSPQFPHMSVATVYNNLRLLVDLNLVEEMSSNDAATHFDFPIEPHYHAICTNCGRIFDFSYPGVTDVEAVAAKKTGFKVSGHHLEVYGICPDCQVKLGMK

SEQ ID NO: 2564 - protein, 225 aa, Lactobacillus paracasei
VLAEVLPKELIQGIVVISGPSHAEDVATHDITTLTAASDDLKLAEKVQKLFMNDYFRLYTNTDVIGVEIGAALKNVIAIGAGALHGLGYGDNTKAALMTRGLAEISRVGVKLGAEPLTFIGLSGVGDLIVTCTSVHSRNWRAGNALGQGEKLPDVLKNMGMVVEGVSTTKVAHQMARELDVDMPITDAIYQVLYENAPIRTVITDLMKRSGKPEFDFDNASLQKP

SEQ ID NO: 2565 - protein, 315 aa, Lactobacillus paracasei
MAKKYDVIVIGAGPGGMTAALYASRANLSVLMLDRGVYGGQMNNTAEVENYPGFKSILGPDLGQKMYDGATQFGAEYAYGNVVSVQNRGAVKLVKTDEDEYEAKAIVIATGAEHKKLGVPGEEAYSGRGVSYCAVCDGAFFKDRELAVIGGGDSAIEEGLYLTQMAKKVTVIHRRDQLRAQQIIQKRAFANDKMHFVWNAQVQEIQGDDMKVTGVKYRDKETGEEHVLPVAGVFIYVGIMPMTEAFQDLGVLDEHGWIPTDEHMRTKVPGVFAIGDVRAKDLRQITTAVGEGGTAGQGVFNYIQSLNDTNIEIKA

SEQ ID NO: 2566 - protein, 575 aa, Lactobacillus paracasei
VSYRDTYQQWVDEPTLDPELKADLKNMADDETTKEEAFAAPMAFGTAGMRGVLGAGIGRMNIYTVRQATEGLARFMDTLSDETKARGVAISYDSRYMSQEFAYESAGVLGAHGIKSYVFDQLRPTPELSFAVRHLKTYAGIMITASHNPKQYNGYKIYGPDGGQMPPEESDKITKYARSAADLFAIKSLNVHVLRAKKLMQPIGEDVDEAYYAEVATVTINHDLINKVGKNMSLVYSPLHGTGRIPAQMVLRNAGFENFRLVPEQSIADPEFATTPFPNPEFAQVFDLPIALGKKIGADVLIATDPDADRLGTAVKVGDHYQLLTGNQIASVLLHYILEARKQAGTLPKNGAVVKSIVSTELATAIAKDYGVDMINVLTGFKFIGDQIKHFQATGEHEFLFGFEESYGYLIKPFVRDKDAIQSTVLLAEVAAYYQSQGKTLWDGVQELYKKYGYYAEKTVGVDFEGVDGQKQMANLMTKFREEQPADFAGVKITKVEDFLSQEAKSADGTVEKLTMPSSNVLKYILADGTWIAIRPSGTEPKVKFYVGTKADTEAKAQEKLDAFEKALNDFREEA

SEQ ID NO: 2567 - protein, 215 aa, Lactobacillus paracasei
MNYLIVEDEPALAETLRAYLAKDGQALLATSLAQANERVAQISPDVIILDLNMPDGDGLTWLAQWRKHLTAKVIVLTANDEELTMLKGLRLADDYVVKPVSLRVLKARIAKQLPMTVQQFGAVSLNLATGQVTKNETAVVLTAAEYRLLAYFFANPNQILARDQLLAALWDTREQFVADNTLTVTIKRLREKLEDDPAHPTLIRTVRGMGYFIDG

SEQ ID NO: 2568 - protein, 336 aa, Lactobacillus paracasei
MVKHDYWAMPETKSVLRLTVWLIVILWAALLTVMVLVPVTRLWLVVIGLGSTLTSSWVVLRWAVKFSQRFDLALRQLDLTKAGASNYAIDRNDEGLFSDLNNRLYQYARQMQAERTAVKRDRDQLSVAITDIAHQLRTPLAANNNLLEMMTAANWEVTRQELLAQHTRQAELVEQLILLAKVDTHTLSQTRQDVSVAALGKEALKPLLRMVADNQLTIDWQVSPDLMLHVNPALVKEALVNVLKNAVEHTAFGGQIQIIGIADPIRVRLKIINTGSPIAEADMPHLFERFFRGQYATANNVGIGLAIAAGITRENDGRLSAENTAEGVQFTFEFFR

SEQ ID NO: 2569 - protein, 221 aa, Lactobacillus paracasei
VAILTARQLTKQYAGESRPALDHADFSIEKGEFVAIVGPSGSGKSTLLHLLGGIDQPTSGRVQLYDTDIYALDQTQLAIFRRRQVGLIYQFYNLIPDLTVVENMTLPADLDGRTVATSELTELLATLGLTEKQDALPNQLSGGQQQRVAIGRALINHPAIILADEPTGNLDRRNSQDIMTLLRQANIKQGQTLIVITHDPDIAKQADRVVTINDGVLREGR

SEQ ID NO: 2570 - protein, 788 aa, Lactobacillus paracasei
MGTMTHLVWRQLIKEKARTFTTILAMAVAATLTVATLIGINSARHSMYQDNIQNTGGLQFVLSKVNQETALAIQKKADISESVRYQQQGQISFADQVPNQPDSPLLMLPKPALQRLIQPILLEGRLPQNEQEVMLAQDLISDVYAVGKTVAAQRNGQHVVLKIVGSYRGYAGLMASDGAVTTGHFDGTKNYAVAAAFGNYGNFYAKLKKLTAQYHVGSDQQRMNELALERAGESRDVKVRAMFVLLVIVVLSVIGLVSLALIYTGINLSVQAQTQRYGLLRSIGATPRQIRQSVYLQALTLALPAILLGLLAGIGGLSLAFHELNRIFKASGNTFQLLLTISWWPILVSGFFMLLVTLLAARRPAKRAAQVSPIAAVRAQSASRKVSQRMLRQGMLGRFLPTPIAKLAYKHYRRLGWSKVTMMTTLALSLMIFIGFTSFFRGMLTFSDETISRQADVTITKTQSLASANFSFNPRRLPGVKRGTVTGTTQVGLKNAPQAFHDRLNVIVVSDQTFGTVFKDQPTIITGSRLVTNSKTGKRQQQWDTPKDFAGTLELANEQSSQKTLTQPMKVVTKTAAEMTDWLVSDQSGLVLSASRFRQISQALQIKNDDVTYAIQVLLIKPSFHETVASALRHEVPHAALFDQIENDARGTSFQLAIQVMVYGFLTLLTLVSLANIVNHIFANLLQRRRSLAMLQSVGTTPGQIVRMLALENGFLFGTSMVIGSLLGTLLGWILHQAVNTGITMAFQVPWLEMGMAGLALLVIWGIFAGISFQIMRHQDIDQLIRVG

SEQ ID NO: 2571 - protein, 215 aa, Lactobacillus paracasei
MGMHQFIQGLSNLETLRRAPGFFKYQEHSVAAHSFKVAEIAQMLGDVEELAGNKVNWQMLYEKSLNHDYTERFIGDIKTPVKYATPTLRHMLADVEATMTENFIKNEIPRDFQDRYRRRLSEGKDETLEGQILSVADKIDLLYEGFGEIEKGNPEQVFLDIYSESLSTILQFRNRPSVRYFLEEVLPDMLDEKFASRDQLAKLTKETMAEHEPNK

SEQ ID NO: 2572 - protein, 671 aa, Lactobacillus paracasei
MIERIADRKFDLVSPYQPAGDQPQAIAKLTKGFEEGKKEQILLGATGTGKTFTMSNIIANLNKPTLILSHNKTLAGQLYGEFKEFFPHNAVEYFVSYYDYYQPEAYVPSTDTYIEKDSAINDEIDKLRHSATSALLERNDVIVVASVSSIFGLGDPHEYKNHVLSLRTGMTIDRNTLLRQLVDIQFDRNDIDFQRGRFRVRGDVVEIFPASRDDHAIRVEFFGDEIDRITEVDALTGEVIGTRDHVAIFPATHFMTSDEQMQRAIKSIAAELEAQLKVLRSENKLLEAQRLEQRTNYDIEMMREMGFTSGIENYSRHMDGRKPGEPPYTLLDFFPKDFNIMVDESHVTMPQIRGMYNGDRARKQMLVNYGFRLPSALDNRPLKINEFEQHVHRILYVSATPGPYELDRVPKDDIAEQIIRPTGLLDPKIEVRPVMGQIDDLVGEINKRVDAHERVFITTLTKKMAEDLTDYLKDMGIKVRYLHSDIKTLERTQIIRDLRLGKFDVLIGINLLREGIDVPEVSLIAILDADKEGFLRAERSLIQTIGRASRNEHGKVIMYADKVTDSMKAAIDETQRRRTIQEKFNEEHHITPKTIIKPIRAAISSYEQSDDDKAEAKKTFAEVDYEDMSKADKKELVANLRSQMQAAAKKLDFEQAASLRDTILELQADMS

SEQ ID NO: 2573 - protein, 963 aa, Lactobacillus paracasei
MANDKIVIHGARAHNLKNIDVTIPRNKLVVMTGLSGSGKSSLAFDTLYAEGQRRYVESLSAYARQFLGQMEKPDVDSIDGLSPAISIDQKTTSKNPRSTVGTVTEINDYLRLLWARVGHPICPNDGTPITSQSVEQMVDRVLALPDKTRIQILSPVVRRKKGSHKKVFAKIMREGYVRMRVDGEVVDATADYELDKNKSHDIDIVIDRIVVKPEARSRLFDSFEAALRLSEGYANVDVIGGEPLRFSEHFACPICGFTIGEMEPRLFSFNAPFGACPECDGLGVKLTVDMDLVLPEPSMTLAEGAIAPWNPISSQYYPELLAQAAKTFKVRMDVPFKKLTHRERNVVLNGSEGKLFHFHYENDFGGVRDVDVPFEGVLNNISRRYAETNSDFTRQQMRSYMTALPCPVCHGKRLNRQALAVKIEGRDIAEVSDLAIKDALPFFKTVHLSEAESVIAQPIVKEVVDRLTFLVNVGLGYLTLSRSAGTLSGGEAQRIRLATQIGSNLSGVMYVLDEPSIGLHQRDNDRLIASLKKMRDLGNTLIVVEHDEDTMRAADYLIDVGPGAGEHGGRIMASGTPKQVARVRKSITGQYLSGRKFIPVPLKRRQGSGKVIRLEGATDHNLKNIDVDFPLGKFIVVSGVSGSGKSTLVNSILRRALAQKLNHNSEKPGPYKKILGYKNIEKLINIDQSPIGRTPRSNPATYTSVFDDIRGLFAETNEAKLRGYKKGRFSFNIKGGRCENCKGDGIIKIEMNFLPDVYVPCEVCHGKRYNSETLEVTYKGKNIAEVLDMTVEEATDFFKNIPKIRRKLQTIVDVGLGYVKLGQSATTLSGGEAQRMKLASELQKLSTGKNFYILDEPTTGLHTDDIKRLLEVLERLVDEGNTVLVIEHNLDVVKTADWVIDLGPEGGDGGGQIIATGTPEQVANVADSYTGQYLKPILVRDTQRTKEAAQTSTKNEAQAVSKK

SEQ ID NO: 2574 - protein, 179 aa, Lactobacillus paracasei
MLNRKSFGFDWGQFITGILFLIAAFVVMRYPLATLKTVTFIFAVVAIIRGIAILAGYSTLRQLTGKLAWVSLLMGIFDLVIGVIFLVNSNFGVATITMMFAIWFLVDSVGSLFNVGHLRIAGTGWFVLYLVLDILAVIVSLMLFMQPVVAAITLVTLLSMFFVLFGIECIVLAFARRNI

SEQ ID NO: 2575 - protein, 295 aa, Lactobacillus paracasei
MTESLDLVIITGMSGAGKTVAMQAFEDLGYFCVDNMPPALLPKFWELVKESGKITKVALVVDLRSRAFYDQIIDMLANLDNNAYVHSRILFLDATDEELVSRYKETRRSHPLAMEGRLMDGIKKERALLTELRNRAQVVIDTTTLSPRQLREKIFLNFKESGSQPAFHIEVMSFGFKYGLPIDADIVMDVRFLPNPFYIKDYRPKTGLDPEVYNYVMDNEDAESFYNKFYDLLSEIMPKYKAEGKTSVTIAIGCTGGQHRSVAFAERIGKAFSDAYAVDITHRDIKKHKETVNRS

SEQ ID NO: 2576 - protein, 342 aa, Lactobacillus paracasei
MSRETKFIRVIRGRRPKVVVIGGGTGLPVILHSLHEQDADVTAIVTVADDGGSSGTIRNYINVVPPGDIRNVLVALSELPSLYLDIFQYRFNTTDAFFAGHAIGNLIIAALSEMKGGIFPAVQQLSEMMQVDGHVYPASNTPLTLNAEFTDGTKLSGEAEITAAGKNIKHISVSETDPANGKPEAVKEVIDAIMDADVVVLGPGSLFTSILPNLMIENLGDAVKKTQAEVIYIVNIMTQKGETQHFTDADHVRVLNEQMGENFVDTVLVNIEPVPDNYLDHQKYNEILTPVKHNYQGLRDMGCRVISEDFLKLRDHGVFHDGDKVAKEILNLAFQVSGKTRR

SEQ ID NO: 2577 - protein, 315 aa, Lactobacillus paracasei
MASFASLVKKELTQLEVHPEHAKAELSALIRMNGSLTLMAHRFVLNIQTENPAIARRIYSLIRQVYHHEANLVVHRKMKLKKNYQYIVRLTEGVNDILSDLSILDPDTMAISTTVPASVLKEPQRMRSYLRGAFLASGSVNNPETSRYHLEIYSLYDNHNAGILKMMNHFNLNARTVERRSGYIVYLKEAEKIADFLQVIGATNAMLKFEDVRIMRDMRNSVNRLVNCENANMNKTIDAAQKQIENINYLKNHVGLDNLPAKLREIAVLRLAHPDVSLQELGAMMPSGQISKSGVNHRLRKLNQIAEGYQQPEDA

SEQ ID NO: 2578 - protein, 151 aa, Lactobacillus paracasei
MVKPITLNEQLCFAIYKAQKQYNHFYSQALAPFKLTYPQYITLLSLYEHGTMSVKQVGQTLELDSGTLTPLMKRLEKDGWISRKRSTEDERRVDVSLTQKALDARDQIFEHVGSCMELMNLPKPEYDHIKSEVSRVDEHLSAIPDGAFPEA

SEQ ID NO: 2579 - protein, 196 aa, Lactobacillus paracasei
MLVPTVVEQTSRGERAYDIYSRLLKDRIIMLSGEVNDQMANSVIAQLLFLDAQDSEKDIYLYINSPGGVITSGLAMLDTMNFIKSDVQTIAIGMAASMASVLLAGGTKGKRFALPNSTILIHQPSGGAQGQQTEIEIAAEEILKTRRKMNQILADATGQTIEQIKKDTERDHYMSAQEAKDYGLIDDILVNKNTQK

SEQ ID NO: 2580 - protein, 220 aa, Lactobacillus paracasei
MKKKKPIYKRIWFWIIVVLFIIVGVNMTGSKTNNSNTTAESSSSSAADKSHQQSSVASEATSESKTADVPAEYQSALNKGTTYASAMNMSKAGVYDQLVSQSGEKFSAEAAQYAIDHLKADWNKNALNKAKSYADSMHMSKAGIYDQLTSQSGEKFTAEEANYAIENVKADWNKNALAKAKTYQKDMDMSPDAVREQLTSENGEKFTADEANYAIQNLNK

SEQ ID NO: 2581 - protein, 345 aa, Lactobacillus paracasei
MHTELAWLKAIAPDLMGVVTKRYQVLQFINWMAPVGRRTLAEQMKISERALRTETDFLRSQGLLESSKSGMVLTAKGLETFHGLDHLMNQLLGIKDDEKRLAAQLKIDHCLVVSGDADQSGRVLDELGKTLNSTLQLLLPPGRLTVAVMGGTTMAHLARQLTFQLSAGRELTFVPARGGLGEAVTIQANSIAAAMAEATDSNYRALYVPENLSSESYESLIKEPSVKEVLGLIDKAQVVIHSVGDALVMARRRGMSSDTISMLKAKHAVAEAFGVFYDASGKVVYKIPQIGLQLADLDHIPYVFAVAAGKSKSKAIAAYMQHAPSRTWLLTDVGATNSILTGATR

SEQ ID NO: 2582 - protein, 340 aa, Lactobacillus paracasei
MTVKIGINGFGRIGRLAFRRIYELGAKSNDIQVVAINDLTSPTMLAHLLKYDSTHGTFPGEVSATDNGIVVDGKEYRVYAEPQAQNIPWVKNDGVDYVLECTGFYTSAEKSQAHLDAGAKRVLISAPAGKMKTIVYNVNDDTLNADDKIVSAGSCTTNCLAPMAYFLNKEFGIEVGTMTTVHAYTSTQMLLDGPVRGGNLRAARSAAANTIPHSTGAAKAIGLVIPELNGKLQGHAQRVSVVDGSLTELVSILKTKNVTADQVNEAIKKHTENNPSFGWNEDEIVSSDVIGTTQGSIFDPTQTEVTTAGDYQLVKTVAWYDNEYGFTCQMIRTLLKFATL

SEQ ID NO: 2583 - protein, 396 aa, Lactobacillus paracasei
LAKLIVSDLDVKDKKVLIRVDFNVPIKDGVIGDDNRIVAALPTIQYVIDHGGKAILLSHLGRVKTEEDKAKLTLKPVAERLSELLKKPVTFVPATRGKELEDAINKMNDGDVLVMENTRFEDLDGKKESGNDPELGKYWASLGDLFVNDAFGTAHRSHASNVGIASNMKQTAAGFLMEKEIKFLGDAVDNPKHPFIAILGGAKVSDKIGVIENLVPKADKILIGGGMTYTFYAAKGMSIGKSLVEKDKIELAKKIMDQAGDKLLLPVDSVVATEFSNDAPHKVVDGDIPDGYMALDIGPKTIKEFKDALQGAKTVVWNGPMGVFEMSNYAEGTLEVGRALGDLKDATTIIGGGDSTAAAKQLGIAPKITHISTGGGASLEYLEGKTLPGIAAISDK

SEQ ID NO: 2584 - protein, 251 aa, Lactobacillus paracasei
MRTPFIAGNWKMNKNPKETQEFLDGVKGKLPDASKVETVIGAPAIDLTTLVAGAEGTPLKTAAENCYFEDEGAFTGETSPKALKEMNVDYVIIGHSERRGYFHETDEDINKKAKAIFKNNLLPIICCGESLAQREAGQTEDWVASQIEAALAGLSADQVKVSVLAYEPIWAIGTGKTATADQAQEVVAHIRATVEKLYNKDTADAVRILYGGSVKPANVKELMAKPDIDGGLVGGASMDPESFIALANYQD

SEQ ID NO: 2585 - protein, 434 aa, Lactobacillus paracasei
MSIITDVLAREVLDSRGNPTVEVELYTEDGGFGRALVPSGASTGEHEAVELRDGDKDRFGGKGVLKAVGHVNNEIAKAVIGLDVTEQRLIDQTMIDLDGTPNKGKFGANAILGVSLAAARAAADEVGLPLYQYLGGPNAHVLPTPMMNVLNGGAHSTNTVDFQEFMIMPVGAKSVREAVRMGSETFHALQALLKSKGDITAVGDEGGFAPNLKDNEEAFELLVEAIKKAGYKPGDDIALAFDVAASEMYDAESKTYTTKWSNPDKKYTTEEWTDMIDGYINKYPIVSVEDPIDENDWEGWQTFTKKMGDKVQIVGDDLFVTNTDYLKKGIDMGVANSILIKLNQIGTLTETFEAIEMAKEAGYTAVVSHRSGETEDTTIADLVVATNAGQIKTGSMSRTDRIAKYNQLMRIEDQLGAQSQYKGRKSFYNVKAID

SEQ ID NO: 2586 - protein, 420 aa, Lactobacillus paracasei
MQTTPPHWQRNIALFLLGQFLSGITSMTVQYAIIWYLTAKTGSATILSIATLLGMLPTILLSPFVGPYIDRLNKKMLLIVPDIIAAMVALILSAVGEFGGFFPVWLIFVSLLVRALAQTFQMPTIQAILPTMVPGDQLTRVNGQLGVVNSANMIIAPALGAVLFGLMPMPLLILLDVLGAILGVSLLLFVSIPENRLVGTTVHVAQDAKVGWQLLRGNRGLWYMTLIGMLTTFAFMPAASMYPLMTMRYFHGTVGQAGLIEAVYFAGSLLGGLLISVFGHFRDRIHPIVWGMVVIGVTFGLSGVLPRTENGFLWFLILNGVAGLAWPFFNTPLIAMYQQSYAPETLGRVMGILNALMSLPGPVGLIFAGPIADRFGIATLFVVAGIGVLLAAGVMFGLKITREYDRQLQADGSSDLTKRG

SEQ ID NO: 2587 - protein, 100 aa, Lactobacillus paracasei
MLWMTWDVGLRASGQIFGALVVLIGIVLLYGLIIYALIGWFMDPTHRYWYVLTLVLTLLYNVLVWTFPSVMIQTWATYPFPLITLLIGAMLVWVARQEKQ

SEQ ID NO: 2588 - protein, 523 aa, Lactobacillus paracasei
LARPVKEKFDVTRLRFVLLGLLVGLMSGTVVSAFRYCIEVGLRYSRLVYGHLRIAPFVWWQWALLIGVNLGLALIVAWLLKKEPYISGSGIPQVEGQLAGELEMHWWSILWRKFVGGVLALGPGLFLGREGPSIQLGASVGQGLAAGFKLSGTDRRLLIASGSAAGLAAAFNAPIAGTLFVLEEVYHNFSPLVWLTALAGAIGSDFVSLNVFGLVPVLHLSYSRSLPVSSYWHLILLGILLGLFGYLYQRILLVMPRWYRNLTHLPRPLQGIVPFLLVILVGYFAPNLLGGGNGLIVGFGQYVPSLLVLIAIFVVRFVFSMISYGSGLPGGIFLPILSLGAVIGAIYGVFMNQLGLLPHVYIMNLIIFSMAGYFAGIGKAPFTAILLVTEMVGNLTHLMPLAVLSLTAYLVVDLLGGAPIYEALLEQMTMPKTVQQLHRPDRLEIPVFFGSPLNGKMVRDMPWPKEALLIGIRRGEQEVIPHGDSLIREGDTLVLLTDATQRARVKRRIDALSAALGKTHQNS

SEQ ID NO: 2589 - protein, 78 aa, Lactobacillus paracasei
LQSLLTTFLVIDSILIVIATLMQPSKQQDALSALSGGATDLFGKTKSRGFEAFMEKVTVVLGVIFFGLAIALVYLEAH

SEQ ID NO: 2590 - protein, 244 aa, Lactobacillus paracasei
MIFREPQPFEYEGTDTGVVLLHAYTGSPNDMNFMGRALQRAGYGVYAPLFTGHGTIEPMDILTKGNPDIWWAEASAAVSHMTAKYDRVFVFGLSLGGIFAMKALEILPGVTAGGVFSSPILPGKHHLVPGFLKYAQYMNRLAGVPDESTQILAYLPGQLAAIDNFATGVAADLYLVNKPIFIGQAGADELVDGQLAYQLRDALINAPQVDFHWYDNAKHVITVNSAHHALQQDVIAFMQQENEG

SEQ ID NO: 2591 - protein, 789 aa, Lactobacillus paracasei
MTTVGHIRNELLATFRKSPKIDYSVQTLSRALKLNEGTDFKTLVQALTGMENDNLIHPISEGRYAWGGTPKVLTGIFHGNEKGFGFVAIEDQDNDVYVPSTSTDFALDGDTVEVRIVREARPNDTRGPEGEITKVVERSLTTLVGEFKPFSDKDRAKSGFIGMVVSHEKKLKNFPVYVKDTGTMPQLGDMTVTEITEFPNEHHPKLMYGMVVETLGNKNDPGVDIMSLVMQNHIKTEFPDEVMTQTNDIPDHVTPEERVNRKDITDQAVVTIDGDDSKDFDDAVVVWKLPNGNFHLGVHIADVSHYVTEGSALDKEAFDRGTSTYLVDRVIPMLPFRLSNGICSLNPGVDRLAMSCDMEIDQDGHVVNHEIYQSIIKSHARMTYNNVNKIVTDHDPEVMAEYQELVPMFEDMVQLHQILYKMRHARGAIDFEENEAKIIVDDMGHPTDIVLRERGVSERMIESFMLAANETVAEHYNKQHLPFLYRVHETPDADRIKEFMEFIASFGITVPMKKGKEITPKQLQDVVTDVTGTPEEAMVSVKMLRSLKQARYSPDPLGHFGLAAKYYCHFTSPIRRYPDLVAHRLIRDYAVEGTGDDIKASWNKKLPDIAAQASMAERRSIDAERAVDDLKKAEFMADKVGEEFDAVVSGVTSFGMFVALPNTVEGLVHITRMTDDYYSFIDSQMALVGERTKRTYRIGQSLRVKLDNVDIDQRQVDFSLIPDENTPTSDLGKFVKKEDRRERRPNGNKPGFGNNNHGGPNRNQHNNRPRKPAGAPHQGKHYNAKRGTK

SEQ ID NO: 2592 - protein, 157 aa, Lactobacillus paracasei
MAKKHRQKPDNLLAQNKKAGHDYNILDTYEAGIALTGTEIKSVRDGKLNLRDGFARIRNNEAWLENVHISPYKEGNLFNVDPMRNRKLLLHKREIRKLGQMTARQGVTLVPLRMYLKHGYAKVLIGVAEGKHNYDKRETLKRKDQEREVQRALKARY

SEQ ID NO: 2593 - protein, 246 aa, Lactobacillus paracasei
MMQDRYVGDIGDFGKLGFLRALEIAGLSLGVNWYYTTPSGSEKTQGDGRHLIDQKYFDCDQDLASTLYKLSKSQTSRNLDTLGNSHVLQTGIFFRAQVLDKKSRVNWHQNALDALQQADLVFLDPDNGLSVKSVSKNSKKAVKYVFDDEIRDYLVRGQSVAFYQHRPHKLEHLYLSEAKSRIDNICNSLKLSIWVLTLPRHSVREIFVISPDERQDRLISKAVLSITNGSWNKYGIIKLQSTQPRT

SEQ ID NO: 2594 - protein, 139 aa, Lactobacillus paracasei
MSETFKMMNWQLDQFTDQVLVALDPLISIVLSPFVWFFQHPLADFCKWLFGPQSIAQGETALAVILVALGAYAIFFVFHTAALVAIATFVIPALLSLLGHIFHFGFKVLIIYLAIRFCIALVKFSGKWIDKMLGLAPNR

SEQ ID NO: 2595 - protein, 287 aa, Lactobacillus paracasei
LIHSGRKAALFMIQDQLSRGHRITVILRALRIPSSTYYDWLKWHPKSRNRRRIKLKELVQVLWQRRKFYGYVRIAKRIRKLLKCRLSDRTIWKVMRELGIQSTMYRKRSKKPTTTTDMPQKPNLMRHLADLSEVVTTDITYIQLINQKWVYLATAYDPKARKVLAWQVGQQMTQDLAVAPIQALIHQGYTFKMVHSDMGSQYTSRLFETTLTDAHLRHSYSRKGKPADNGRIEAYHSLLKREWVRLEQINYESILDVTESIARYNTFYNHDRETNGRGACKRKSAAA

SEQ ID NO: 2596 - protein, 401 aa, Lactobacillus paracasei
MECIFGIDISKHTANVAVLIDRQVIKEFKLSSNREGFERLEDELNSFREPKIIFESTGIYSRPWRAFFHRNGWLYTEINPLKAKKVMDSFRIVKTDSVDAVGLAEAMSRNNFAPSFQEKPEYTELRDLHRIYQEHNDDVVRNKNRLHHELQLTFPEIEHFLSRTEGALYWHIVQIFPHPYLVLQHSSTELTSIILKATSKNMGPKRAQHLAEHLLELAKSSGPAVDIDSYALKRVTELAYEVERIDRSKKSLIEEMAKIGTNLPEVAILTTIPGIALKSALCIIAELGDIRRFHSANAINAYIGIDLTTYQSGDYTAEQRIRKRGNPLARKVLYRTVINIISASSYRPTRFNDFYQMKKQSSQSKGTKKIAVAVMSRLNRMIFHLVLHNEVYEPTVSQPRQ

SEQ ID NO: 2597 - protein, 223 aa, Lactobacillus paracasei
MERPRIRDYFQQDLSQNETITPKQRAILQASLDLFAEKGFDQTSTSDIAQRAGVAEGTVYRRYKTKAALRDAILAPIVAHIVPILASDFSEDELRQRYPSLQAFVTAIFTDRVAFAKANVKELKVIFEMAAFDAERREQILSQIAPKMVKQMGSVINQLKADHLIVEWPNDLILQSLLSQLFGYLARLMLELPGTEIEREQAYLITVMTKILTPGEHDQITGQ

SEQ ID NO: 2598 - protein, 415 aa, Lactobacillus paracasei
MRTMAIVRRVFKQMLRDKRTLALMFLAPLLIMTLMYFLFQNNTTQVASLGVHHVDQSVVNVIDTKNVTIHHYDSSQARKMIKQHDLDGYLTQKNGQLTITYSNSNPTNTSLIKASLQSGLVKLKMKTLVTVTKKQRAALESQQAALKKLTAAQTQATVTKLKTAIAQAQARGDQATAEKLQKQLKQATATTSSSTQSAKATSYTTKSHYIYGSSDSTFFENFLPAFLGFFVFFFVFLISGVSLLNERTTGTLSRLLATPIRRSEIIMGYLIGYGGFAIIQTVLTVVFTITVFKIHLVGSIWLVFLTNLLLALVALTLGIFISTFANSEFQMIQFIPLIVVPQIFFAGLVPVDGMASWLQAIAHIMPLYYGANALTAVVTKGAGLGDIGVNLLILVGFMVVLTMLNIVGMKRYRKV

SEQ ID NO: 2599 - protein, 247 aa, Lactobacillus paracasei
MATDYVIAKQVSKHFGHQQVLNQIDLTLPAGMIYGLIGPSGAGKTTLIKSILGMEAVDSGTVKVMDTVMPNRAVMAQVGYMAQSDALYETLTARENLTLFGQLMSVPKIKLAQMIDYAAGLVDLTSQLDKRVSGYSGGMKRRLSLAIALIQDPQLLILDEPTVGIDPELRQQIWTELNKLKDTGKSMLVTTHVMDEAERCDYLMLIRHGIALAEGTPAALKQQYAVDTIEQVFLKAGRMQDANDGNR

SEQ ID NO: 2600 - protein, 109 aa, Lactobacillus paracasei
MVYRHSPLQLPFESFGAGLSTPLSSNNEWVQLAEAMPWKALDEAYQLEFTKNAGRAAKPFRLLYGAILIQQRMGLTDRGVVAAIRDRGQWNIHTKSSGRIPNKKSETLI

SEQ ID NO: 2601 - protein, 112 aa, Lactobacillus paracasei
MTRANVSDRDGASAMIALHAMHLRQVQNVLVDGGYSGVNFQLDVASNLNATVQVAKRNELHRFEVMPQRWVVERSFSWLENCRRLWKNCERQLTTSLQMVVLAFLALLLKRF

SEQ ID NO: 2602 - protein, 102 aa, Lactobacillus paracasei
MKNYPSNITRQQFELIRPALENFRKRTKPRKYDLYEVFCAVLYVLKTGCQWRQVPGDFPEWRSVYNYYKIWSTKAEPTADSLLEQVLKKLSLLGELTKDVQL

SEQ ID NO: 2603 - protein, 97 aa, Lactobacillus paracasei
LTGGVLGLIIGVIIYLVRKFTINQSNATFGADVMMGAGNQTGRFLGPLIILSAVTASIPIGIGSTVGAALFYAWKKPIPGGAIIGAMVMGFFFPVKL

SEQ ID NO: 2604 - protein, 373 aa, Lactobacillus paracasei
VFDVLIKNGKTEREQPIEIGINGSQIAALAPKLEGASGKQEIDLHHEAYVSAGWIDDHAHCYEKLTLYYDDPDEDGYKTGVTTVIDAGSTGADNIRDFYNITRDKKTNVYALINIGRTGILAQDELGDISKVNKEALFDAVHDLPDFIVGIKARESHSVVIDNGIKPLLAAKSYAALLGNLPVMVHVGANPPELKDIMQAMGKGDVLTHAYNGKPNGMVDEHGEIKEFIYDAYDRGVIFDVGHGTDSFNFKTMRIARDHGLDPKSLSTDIYHRNRENGPVYDMATTMEKMLQVGYTLPEVIRMVTFAPADNFHLLNKGRLRPGKDADITIYNVTDGEKTLTDSNGNTETGHQLITPIRTIVGGTVYDLEGQHA

SEQ ID NO: 2605 - protein, 366 aa, Lactobacillus paracasei
MSDYYKTYDLKHVINASGKMTILGVSKVPEVAIAAQQFGDTHFFEIKDLVDKTGAYIAEKLGTEGAVVVNSASAGIAEAVAGIIGQGSKYHAYHPFSPRFTKREIILPKGQNVDYGTPEEVMIELGGGQVVEAGYANMCTPEHIEMMITEQTAAIFYVKSHHAVQKSMLTIPEALEVAHKHDLPLILDAAAEEDLKKYVDLGVDVVLFSGAKAIEGPASGLVFGKEPYIGWTKLQSLGIGRAMKIGKENILGFTTALIHYLDNGPESGDAMKARLHPFVAALNEVPHLNVKEVQDGAGRPIFRAAVTVEATSPKNAKQVTAALKAGDPAIYTREYRANEGIIEFDIRAVDQAEMDLIVTRLKEILA

SEQ ID NO: 2606 - protein, 254 aa, Lactobacillus paracasei
MNLTPNYYKNRVALNVLAGSIQNAEDIYQAAEGHVVVGVLTKNYDTDEAAIEDMKKYQAVTQNGLSVGLGAGDPNQSAMVSRVSKVLQPQHVNQVFTGVGTSRALLGQNDTVINGLVSPTGKVGIVNVATGPKSSQKATAEVPVATAIALLQDMGGTSFKFFPMGGLKHEEEFRAVAKACAAEGFNLEPTGGIDLDNFEAILQIALDAGVKQIIPHIYSSIIDKATGLTRPEDVAKLWAITKRLVDATDLVTAE

SEQ ID NO: 2607 - protein, 293 aa, Lactobacillus paracasei
MVTATDFVKIPSGSFQLGTNDNYGFATDLEGPVTDIIVPSFLISRTTITNYEFQTFVNATGYRTESERIGWSFVFHLQASDYVKRNAKVVMQEPWWLAVDGADWRHPTGPDSDVVTDNQLENPVVQVSRNDALAFYKWNKVRLPTEAEWEVAAKGGTDNKVLPWGDSFFLDGKPTCNTFQGDFPMNDNGQDGFAGLAPAKWYKPNDYGLYQVIGNVWEWCLNPSKIPLSQFQKYSTQYFQSRYAKPLDGNFATRGGSFLCHKSYCHRYRIAARNSNHSATAANNLGFRCVKDI

SEQ ID NO: 2608 - protein, 387 aa, Lactobacillus paracasei
MKKSISILIKPASSLCNLRCKYCFYANISSMREVKNYGRMKPAIVDALIKNVYADLENGDDLSITFQGGEPTLAGLRYFEYFTSIIDAQIKQVKVHYALQTNGTMINDTWCAFLKSYEFLVGLSIDGTPLYHDLNRIDLHGNGTFHHVMETKRRFDRYQINYNVLCVLTNPLAKHAKKVFDFLSQNNINYVQFIPCLDDFGVNHRSNFALTPNRFFNFYQTYFTYWFKQLQNGEYQSVKLFDDIINQFAHKRRTACGLDGQCQIQYIIEADGSVYPCDFYALDQYRLGYIQEKTLRQLFSEHIALDFMHTKRMLPTMCATCPFKQYCCGGCKRMKDAMYVNSDGDFCGYRSVLEIILPHTEEILYWTQLSHFKYTSLNSALPGKDFP

SEQ ID NO: 2609 - protein, 260 aa, Lactobacillus paracasei
MPSQLLIYPIVILIANTIGAISGMGGGVIIKPALQIFDLDSVLIINFYSSVAVFTMSITSTLKQLHAEQHINMKYAIWLGIGSVIGGALGDFTFKQIYDALGDDLSVVVQMVLVIISLILSLYGSSGHIQPLYLAGTSVMFMSGLGLGWLATVLGIGGGPINIACFLVLLGLEIRPATIYSIITIFFSQGAKIIQALASKSIMNVDPLMIIVIIITALLGGWLGAIISNRITEKRILMLFNLVVVFVLILDAGNLIGYLV

SEQ ID NO: 2610 - protein, 84 aa, Lactobacillus paracasei
MALAIFNLLSIILIFIIIWLTRKEKVATRAGRYNRAFLIIIAVIEIVLIISETFIFKDSISLQSASFSCSLLLLINLLLSYRMH

SEQ ID NO: 2611 - protein, 39 aa, Lactobacillus paracasei
MALFKWRTNDGKENNQRYPLDVTLEEKRQLKSLCRIVKE

SEQ ID NO: 2612 - protein, 64 aa, Lactobacillus paracasei
MINLFFNISRRRAKIRSMSVAYKKYNKVTCKRMLNEMKWCLYQVELLKIFPLNWLNLVWDTYAI

SEQ ID NO: 2613 - protein, 132 aa, Lactobacillus paracasei
MVNLTEEMKNMLKNQLPFLATTGKDGKPQVGPKGSLHVLDDSHLIYFEHTFRQAYNNLSNNHLAAVAVADRGAQKGFRFEGTAHIHEADDFANQILDKTNIFDRFPRAGVVVIDVERIYKLDNTLEAGIQIA

SEQ ID NO: 2614 - protein, 123 aa, Lactobacillus paracasei
VRLWHQDLIQQLPRQQLLGQHREIAALRGNGWGRKHATVNYVFAHSPYKLFQFHCIVLREMEKRGYHPNQKWYDPLYRGQHCPAYKQLNPVALTIPIYPEHDQRYKHVCLTNLQNKGIFLNLP

SEQ ID NO: 2615 - protein, 127 aa, Lactobacillus paracasei
LAGRNSHDFTNIIEAIRYREVQLKVLSLPSCDSIEGLNFHNLITAIIVDLYKYIAQENREPIKMPQQQNIEIAKQENIRTTFSNMGLIQLIFKKPIFIKRPVAILNKKKANCLYRTYDLVVVCRHIN

SEQ ID NO: 2616 - protein, 869 aa, Lactobacillus paracasei
MAKKKVMRKIELPLVDLLENKRKIDLLSNEKPFIIPEYIKGNLKHQLRPYQNQALVNLDWTQRQPLADYQYNQLLFNMATGSGKTDVLAALILYLYTEFTYHNFIFVVNTNAVVAKTYDNLLNTASPKYLFSQPLTIHGQRIELRSVSRSPSTPEDGVIYLRLTTIQTLANELNTPRENGLTYGDLEKQKLIILADEAHHFSAGTKSKDDQKERSWEYVLDRIRQANKHNRQFEFTATLDLQNEAIYQKYRQKIVYRYDLSRFIHQGYSKRVYRLQANNDDENKMLNAVLLSQYRKRIANELKIPDFKPVILFKSNKIAVSKDARTTFLSMISQLNITDLTDFLKHQQNTSHSQALKQAYDYWLSQDLGTAIVELKRDFRAMNTINVNDSAKEGILGDLNDLHNLNTLESSDNPFRVIFAVAKLSEGWDVLNLYDIVRIGEQSTTLNQTNSEAQLIGRGARYNPFVYQGENSYTRRFDNQNPKYQLLESLYYHTINDPKYLDNLKKSLDKMDLPVEDDSDFDVFETNVKPSFKHSKVYQQGNLYYNEVEPVPDKEFNCLDRYGVNTTTMAEVNLVESTWETNYNAVAIEKDPLTETRFLFKFRDAVILVKKAFSRNKFYRFNSLKQYIPTLDSLNEFMTADNWLGNIRLYARVSNGSPALNRKQQLKAVEQYLTFVQKQIINNYQRQHGTKRFIPVPIKSLIRDYQKKVAKHFNKSVSEMILPYSMKNKPWFVFEEAIVDKLEKSLVDLIGAFVDRLSQKYSQIYLFRNDERNTNFKLHQFKGQTTHYAGFMPDFILYLQNKDFCYQIYIEPKGPQLLDQDQWKQELLESIRPENIELVGENDQVKLYGVKFFTYNDGRNVEQEIENLP

SEQ ID NO: 2617 - protein, 593 aa, Lactobacillus paracasei
MEIEPKIMSQVKSILGEFGNKYLTSKGSLKRNNVINDLDKFDHVLMTKLFKDPLIHKNYVEKIADAEVFKLNQFVEMFEYKNFWEDSYTKFTNKIGLTANGKFIDESADVVLDFPFKDTVLKAGMTKEDLDKDESADEPFLNEIIAKPEIDELLEPKIFVNAKKYDQNGEHNAFSFSDQDNLIIKGNNLIALYSLKRLYGRRIKLIYLDPPFNTGSDSFKYNDRFNESAWLTFMKNRLEVAKDLLAETGNIFIHIDINENHKLKVLADNIFGKSNFVEEIIWSYGSASGGRAAGAKPVNIHDYILHYAKNYPVRKQNKSYTPYSKEYINNWFKYKDEDGRVYQRRQRGKDEQGNPIWHKQYLDESNGVPLTTVWTDIKQVYANPQAYKEANRSSSEIEFNFGNSGQKPEKLLKRILEMSSDPGDVVLDFFGGSGTTAAVSLKLRRKFITVEQIDSQVEIEIKRLSDAINGKNSGISKEVNWQGGGSFVYAELMEKNQGYLKDLLAAKDINELDAVYKRMKVGADFDFRVDLDKYENDAERKALSFEEQKQLLVKLLDKNQLYYNFNNIDDADVRDLISDKDYQFNQSFYGKRD

SEQ ID NO: 2618 - protein, 174 aa, Lactobacillus paracasei
LQSRFKALWRQHQTSHTKSWRIDETYINVKGHWTYLYRAIDSNGLTLDFELRKHRDYAAAYHFLKRLLTTNGRPDRLVTDQYRATLKAVKHLMKQDYLSKSAHQCSKYRNNLIEQDHRFIKRHRVRSASFQSIRTASATLSGIEVIHALRKKTRRELSLIGFSAVDELKAMVPA

SEQ ID NO: 2619 - protein, 464 aa, Lactobacillus paracasei
MAIFTAYDNSEILAALQDAAPHAEIHIDDKIAREHSANGNAQREIAGKILAYVAVSDVADIQGVLKIARQYHMPVVPQSADTSTVIGSDGINGSLILSTARMNRIKEISKGDLLAVVEPGVINGDLDKAARAQGLFYAPDPGSKPISSIGGNAATNAGGMSTVKYGATTDNVLGLKVVLADGREIKLGGRTYKHAFSYDLTHLFVGSEGTLGIITEVTVKLNPIPIGTPVVGIAYFDNMTALAKGVEDLRLSGIYPVMLEALDGLTVAALDRYEGTHYAEGAEAMLLFRLDAGGEASLKMAEQILNDDHAKNIKVTSDPKEAAAIIKLRQDMLPAVFANGQHIMEDMAVPLSKLPEMMDYIASVAQDLNVEIYTAGHAGDGNVHPTVIWPADEEEPPKEALHAIRLMFRKALALGGTISGEHAVGMSKNQWNNEELGFDVDEIQHQIKGLFDPLGILNPKRKID

SEQ ID NO: 2620 - protein, 195 aa, Lactobacillus paracasei
MRDNRNNDKEPSDTLTTKPTFALQYLPGSAAAGCFGGKVGLHLLSKEPVALASPIFYYILPRFASFDGFDPRTQVLGRPEVAVLSGFDTHGRHVVRLDYRGNCEPLVVPQEQTINLVRFRHLADAGVDTDVLTICVATPTPITGSGQPRQPYRLAAMAPETTWLGEAVITVHPKETIAGETKAGQSISSQGQSAS

SEQ ID NO: 2621 - protein, 35 aa, Lactobacillus paracasei
MKGKRQHLLLYFVLGMMTGLVTAAIFHIIYAWLFH

SEQ ID NO: 2622 - protein, 497 aa, Lactobacillus paracasei
LADRPIRVRYAPSPTGHLHIGNARTALFNYLFARHNNGTLVLRIEDTDTKRNVADGEKSQMENLHWLGIDWDEGPDKGGDFGPYRQSERKDIYDKLIKQLVDKGFAYESYRTEEELKADREAQKARHEMPHYEYEYEGMTDAEKADAIAAAKAKGLEPVIRFHIPMDKTYEWDDIVKGKISIDANTLGGDFVIQKRDGMPTYNFAVVVDDHMMQISHVLRGDDHIANTPKQLAIYDAFGWEPPIFGHMTLIINGATGKKLSKRDETVLQFIEQYRELGYLPDAMFNFITLLGWSPVGEDEIFTKKEFIKQFDPKRLSKSPARFDQKKLEWVNNQYIKAKQKTNPNELMSLSLANLIEDGKIHSDPDPKTIEWARQLISLYTDQMSYTAQISKLADIFFDKATDLTDDERKELADDNAKPVIKAFAKKIRALDTFDAYSIGGIVNEVKQETKVKGRKLYMPIRIAATLRMHGPQLAETIELMGRDQVLKNVDLVTGQL

SEQ ID NO: 2623 - protein, 326 aa, Lactobacillus paracasei
MINYNWGMIGTGWIAHEMADALNRENGSIYAVADVNADMLKKFALEKHIAKTYTDPDALIADPNVDVIYIATPHTYHYPYIKKALNAGKHVLAEKAITVNAKQFDDVQQLAKHKGLILSEGLTLYHMPVYQQVKQLIASVKLGDIHLVQVNFGSLKDFDPKNRFFNKDLAGGALLDIGGYATAFARTFLDAQPNVTLTTVKYFETGVDEQSGIILKNADQQLAVMALSLRAKQPKRGVISGTKGYVEIDDYPRATTAKVTYTPDAHTTTSEVLSAGDQADALVYEVRDFQRYIDEGHDDGQLLLSHDVSHIMDSVRNAWGMRFPFD

SEQ ID NO: 2624 - protein, 223 aa, Lactobacillus paracasei
MTDQIAAALALIQPHQVVSLGGGRHMQTLADGIVARALPGIQICSPSEVTLAYCQTLGLPTTTQIVSDIAFDGCDSADKDLNLLKSNGGIHFYEKLHAQASHAYVILTAQKNVNAQLNAAVPLTLEVVSAASEQVMASAKLLGLQAKRRMATTYMGYTRTRDGNELIDCTMAEWTDIAKVDHLLASLPGVVATSYFAHLATLLLIETPDGQAHEIKQCVNRPG

SEQ ID NO: 2625 - protein, 276 aa, Lactobacillus paracasei
MSIIDRLYSMLPTLTATDRKIAQVVLTNPGAVVNTTIAALAKESNVSEASISRFCRTIGVEGFHQLKIELAKVAENRSAYYQEINADNLQQALSNISANKVAEIEGTLKNASSHDIRKILDLLKQASVILVAAAGDTQPVADDAVYKFNQLGLLAITDSSWETALAQTMNAPADALLLVISNSGETRNLITQIKAAQQRGIAVVAITNRKDSPIGLAADYQLLTAVRQQIFESEYFFSRVAAMTAVEALFLLLLAEDKTFMAHIKAHEALIAETKI

SEQ ID NO: 2626 - protein, 279 aa, Lactobacillus paracasei
MDKVVNNSPVSQFTVNMMGVEMLLCFALPIILLIWVILRCSKPKKGAVKVFFIGMGVFFLFAGVLEGPFRGIAKDFQHVPFLYALYGALLAGVFEEVGRYLGLKFINKRIPTKAATPETPFLYGLGHGGLEMILIGSLTMFSNFMFAMLINGGKVNEMLEKVPASSRSVLNTQVKQLMATTGWTISLSLMERLLALAVQIALSVVVWIIIMKRMRWFWLLLPIGLHAFIDFPAALTQVGALNGAVEEVLLVVQTILVLAFTYWFWRQNRQVMTRTAKTA

SEQ ID NO: 2627 - protein, 338 aa, Lactobacillus paracasei
MQAEMVILVVTWLILVAIQVVTPWLSRRNVLFGVVYARNSIWTTPAAKKLRRRYLAFSLTGAAILSVIGIGIAAAMHFAATALAWIQIAAFLLSICLNYALIVAAHRKSLQLLKEMGNQQELTQSKVTVDLNKLKPQTLVPAAYGLVLVPQFFLALVLGFQQTSADSWVIILALAVETLTVLGAFYLSRRARGAVRGNPDAEPRAGKVRNSVLYYLLFTGFLSQSLLVLQLMLPNMSAEGQWWFVIITLTLTLLSVSFLPLVYILGTRRLAAKGSVLNDNQHWVWGMFYYNPTDPALFVEKRLGIGFTLNMAKTMSWVILVGFLLIVAGIVIISFILD

SEQ ID NO: 2628 - protein, 124 aa, Lactobacillus paracasei
VQLTIDFDSKIPLYTQIRDAIVSGIATGDLTNGTILPSIRALGNELGVNLHTVNKAYKELQREGFVEIQRGRGVVVHAHGSPNQAVAEVLRPALEKVVAEAVARHLDRDALHTMIDELYDDLKE

SEQ ID NO: 2629 - protein, 423 aa, Lactobacillus paracasei
LQAFSNEKSQHKMYKAGTLWVAALIGVGICVGGSQIQSVTASTSHIHSVVTNATGTTPTNQATVLKQQETGMNDQIIAGHQTGQYSTKGVTDAGDDTTSAVPDTDVYQNRSLPITGNAVVVRCVDIEGNMLAPDKVITGKVGDPYMMTAPAFDYYENPQLATDSAPANGTFTNDVQTVTFVYTKTPIPRGSVNVKFVDVDGKRLASDKILTGQAGDPYEARPIDMTNYQFARLATGSAPEDGSFTDGTQTVTFIYTKNPVAQGTVDVKYVDDNGKQIAPDKILTGHVGDPYAVTPTMIANYHYLRLASGSIAENGAFATGSLTVTFVYAKQASPVTPSTPVTPSTPTTPSTQVLPSMSDTPTESAPLSDNDTAPIEVIIPTKQISRYLPNTGDNQRTSLIAIGVALLLALISFGSFGLRRREK

SEQ ID NO: 2630 - protein, 258 aa, Lactobacillus paracasei
LVTLVKHESYKLVKRPSLFVFWFGLTLFQVAIAVYLLTHPNASNPSSLFINSFYAPVLIVFYMLALTSTQLSSEIQYGTLKSLLYRRYSSSKILASKWVTLLLCTLVLYASSLIMSLCLAITVFNGKIDLVAKGIKGQQVWQIWLMNNISSFLTLIFILSFVCLLATLFENSTPAIIIGLSTYFIVSIFNQLMFMMIKQHEWIKWNPVNMMNLGNQLQNAELSKLTRLPLSQISLGYLIYAAAFLALSLVVFKYRNER

SEQ ID NO: 2631 - protein, 295 aa, Lactobacillus paracasei
MLKINQLDKFFGKKQVLHQISFEIKRGHIVGLIGANGAGKTTIMKAILGITAFDGDIQLDDQKITVDNHSALEHVGALIEYPGLYPYLTGREQLLLFANGPQRHERVNQTIEELHLAAYADVKTKKYSLGMRQKLGIALAFVNRPELVILDEPMNGLDPKATMALRQLIIRKRDEGTTFLISSHILSELQKVADDVIIIDQGRLIIDATMSELLKKSQTYFWIATDQDELAQKLLAEQGYVVSNEEQGLKISRSSISSINDLLKLLWRKDIVIKDIKETQGDLEKSLLDVLASTK

SEQ ID NO: 2632 - protein, 298 aa, Lactobacillus paracasei
MSEMTTGYLYKKIRLERGLRIADVAGEISVSTVSKFENGHSEISADKLIKLLNKLGMDTSEFFEILDQAHTSNAISTNTSQRRFVQTLRQLGLEQDIDGLKRFRSQFTNQFQKTHRKLNKLREIIISSIIMDTQDAHKLLSLSDSKYVSDYLLERDIWYKLEYVLYSDCVPFLQPQDFQRLYTKFLTIHFSFRQRGNYLPLFFQSFYNTAVALYYRKEYSQAIQTLDRLKEQQIPDNLFSVRLHLRLLRGLCLYQLTKSPETAEELASLVKVISKVSPVFGRRWKAEFHFHEPIGDNA

SEQ ID NO: 2633 - protein, 402 aa, Lactobacillus paracasei
TRAMDMAINCNTAININGPRTEINPRECRSRMKKRIIYIIFGLIGIGVGMGTLPPLWDLIGWADNHFLNNLLIDGLIGGVVFLLLASLSVGWILGRLKVLEKTLNTKSPSYLLFGSLSTIIGLILAAIISIPFYGFVAPLNIFLPLIIMLLFGYLGFRVGTTRSEEWRRLLSFRNRRTADTENDQVLERKVGDHFRKYKLLDTSVIIDGRVQAIAKTGFIEGTMLVPNFVLHELQLISDSADSMKRMRGRRGLDILNAMQKDKDIHIEMYEGDFEDMTEVDSKLLKLAKLLDGIVMTNDFNLNKVAQFQNVPVLNINALANALKPDVIPGEGMTVTVIKSGSERQQGVAYLEDGTMVVVEDGKFYMNKPLEVIVTSALQTAAGRMIFAKPAHQQKAIRDKER

SEQ ID NO: 2634 - protein, 454 aa, Lactobacillus paracasei
MAKAKTQYVCQNCGYISATYLGRCPNCGGWNTLVEETVSSSKSVPRQTAAGSKVKPTRMNDVTITKETRVKTGLDELNRVLGGGVVPGSLVLIGGDPGIGKSTLLLQVSGQLANTGGTVLYVSGEESASQIKMRAGRLGVANSGMYLYPETDMPSIEDVINQMQPDYVVIDSVQTMNVPEMNSAVGSVAQIREVTAELMRIAKSKGVTIFIVGHVTKEGAIAGPKILEHMVDTVLYFEGDMHHTYRILRSVKNRFGSTNEIGIFEMHQDGLQEVANPSEIFLEERLAGATGSAVVVSMEGTRPILVEIQALISPTMYGNAKRTSSGLDHNRVSLIMAVLEKRANLMLQNQDAYLKATGGVKLDEPAIDLAMAVAIASSYRDKEISPTDCFVGEIGLTGEVRRVNRIEERVKEAAKLGFKRIFVPRNNLQGWHAPKDIQVIGVTSIAEALHKVFN

SEQ ID NO: 2635 - protein, 180 aa, Lactobacillus paracasei
MKTRGFEIVSKYQDEDLTLPTRQTKQAAGYDFYAREDFVLRSIWRYDFIRLFRLIKNEHPLTNKDFERAKKVLKPYLVPTGIKAYMQPNEVLVLANRSSSPLKHGLVLPNGIGVIDADYYNNPANEGEIFIQLLNFFPRDVVIKKGDRIGQGIFMPFLLADGDEGGLAKRQSGFGSTDKA

SEQ ID NO: 2636 - protein, 112 aa, Lactobacillus paracasei
GNATFAMILYPRTEINMEFQREPGRFFNTDWDGRLMAEVTFQDIDDGHAWAVDHTFVDESLRGQGIAGQLIETVVAAARKEDKTIEPLCSYAVHAFHNHPEYADVLRPTKEA

SEQ ID NO: 2637 - protein, 125 aa, Lactobacillus paracasei
MVKAYQNYFKHLGNFSGTASRREFWWPWLLNVIVGYVIMTILFNIFGMNVTRVLNFQPGKETFLASLINFIIFIANWSLSVRRLHDTDRRGWWVLLWYVPIIGQIWLLIYFLLPTKKNRWNDRLA

SEQ ID NO: 2638 - protein, 439 aa, Lactobacillus paracasei
MSEITFDQIKDFQAQLAKQPAAGATARAVQNVGPQAASREPIDGEDMKPVFSLDLDTGTVANQKKSGRCWLFATLNTVRHGIADEFGIKDFEFSQNYNAFFDRLEKANLFYENILATADKPLDDREVADYLSGPDQDGGHYDQAEALIEKYGLVPKSIMPETYNSEKTVELNSVLNEKLRKDAKVLRELKQANAGDDAIAAKKREFLSVVYRILAYTFGNPPTQFDFEYRDDKKQYHRDTNLTPQSFFKKYVKWHFDDYVVVASDPEPNKKYHQLYTIASANTVVGGHPLTILNLPPDQLKKLALTQLQAGEAVWFGNDVLADMDRKSGTLKGGLYNYSDLFDLDLHFDKTDRIVTTEAEMSHAMTLTGADVVDGEVTKWKVENSWGKDNGHDGYFVADASWFDQYVYEVVVRKDLLDPADQAALKATPINVPVWDFLN

SEQ ID NO: 2639 - protein, 448 aa, Lactobacillus paracasei
MSAEITTGDLAQFKQDLQATPGASALQKAVMNNGINATAENTDSKVAMTPTFSIELDTGSVANQKQSGRCWMFAALNTMRHGIQAQFKIKDFELSQNYTFFWDKFEKSNYFYENVLKTADQPLDSRKVAFLMTTPQQDGGQWDMLSALIEKYGIVPKSVMPETYSSSKSSELNGLLNLKLRKDAVALRKLVADKASDADIEAAKQKMLADDYRILAYTLGNPPTKFDFEYRDDDKQYHIDRELTPQTFFKKYVAWNLDDYQSIINAPTDDKPYNHLYTVEMLGNVVGGREVRHLNLDIDTFKALAVKQLKAGESVWFGSDVGQSSDRQLGIMDTNIYKKDDLFNTDFTMTKAERLDYGESLMTHAMVLTGVDIVDGKPTKWKVENSWGDKVGDKGYFVASDSWFDEFVYQVVISKKYLSADLQDVIKNEYDKPTVLAPWDPMGALASK

SEQ ID NO: 2640 - protein, 366 aa, Lactobacillus paracasei
MGTQFAFDWRQIIHSRKNMAVLGLFMAAFIVAFFALSWTKRLDVTQTSQATANAALANYAEYNLDTLSQAQKPLLANLDAQNSATGVIGLGLQLDEPDTTRNGLLSLRTAQLAMRQHHYKALNTMPLPPLHQLTGDVRSLNVLKSEGRPAATSVSTSASYIVLVLPYLGWITGAAAILLSFDSWIERRRHRTLITARPLTAGLAGSSRLLMLTGFYILTLLAGFALMVATPALTAGLGDFNYPIAVMGTAILPLWQYILLFGGLTILAGIWLISFSMLVNTWITNVYLTAFIVMAAGLLPVMLPQLFHFLWFLPMPYLDSYATLSGTLVDRLNQPLASVVIGTGLLFLWTFVNLFIFGIRVKKEAA

SEQ ID NO: 2641 - protein, 397 aa, Lactobacillus paracasei
MAYFRFQFHQLLTNRKNLAVIGIALVALICQFVFFPPNTTPVELPTATVLTRDRDKNIAFVNESHGPNTAVWVPSTREFAKLETQMLTAQKQGKNKAYVRATINYLGFLRRYAANPDAQSSPFHYPLTYYYENRQYPDADAAYANVVLTQSLIPLAKQAHPDVSTIHQQTFWQTLFRGALGGWLTALLLITILLANDLLTSEQRHRSIARSLPLSPWHAINTKTLTVLGTLAGAVTLLIGVTAVCVIPFHGLGSLTTAISNFAKNGSYAYVQPLALGSALLMMLGLTVLLMWLFIRLNLLCQLLFHNELIGLVLSALLLFGEPLYFMQGLAFSVPQTAYYLPSYMNPAAIVNGLQNFRYDTGQMTPLSGVIVIGSVIVLLEIMLFIVTHRRHAATVK

SEQ ID NO: 2642 - protein, 292 aa, Lactobacillus paracasei
MELQLQNLALSFKNKPNIIHDISLTMNGGSIVGIVAPNGTGKTTLLRLILNDLKPQAGKVLVDGKSYGSQKQSLALHRQMCLFPVQDDLYPDLSGKAHLEYYAKLWHNRSKSVKQIINVLDMRDYINQPVRTYSMGMKQRLCFGMVMAANTPIMLLDEFMNGLDTINVARMSRILRGLRAEGKLIITVSHLLNNLQGYADLIYFMRDGKIIKTIDQHEQQPLYVQVAEENASRLPRMPWEHYPNGMLVLPIQKLPGEHFNQLLLGLAAHHIPFKLGPLDLDTYFNEFYETDQ

SEQ ID NO: 2643 - protein, 684 aa, Lactobacillus paracasei
MASGLTANKKLRHKITAAALLVTLGVVYGDIGTSPLYVMKSIVAGNGGMGHFDTDFLVGSVSLIFWTLLIITTVKYVLIALRADNNGEGGIFALYTLVRQRARWLVLPAMVGGAALLADGMLTPAVTVTTAIEGLKGVHINGNILIDNQQQVIWVTILIITFLFFIQRFGTDLIGKAFGPIMFVWFTFLGVAGFIALSKDWSMLRALNPYYALHLLVSPDNKMGLFILGSIFLATTGAEALYSDMGHVGRGNIYLSWPYVNICLVLNYFGQAVWLDQNSKVTAFNKITDFNPFFQMLPESIRLGAIILATLAAIIASQALISGSYTLVSEAIKLRFLPRLHIIYPTRLKGQLYIPVVNTILWLACLAIIGYFKTSAEMEGAYGLAITITMLMTTLLLYQYLRSRHAPAVIAIGTLIFFSAIETVFFISSAVKFLHGGYVTAMIAFIILAVMYVWQYGGRIRDDNTYRAEMASLFAYKNQLSELRNDPDYPTYTTNLVYMTQIANDHYIKKEILYSILDKRPKRARVYWFVTVNVTDEPYTAEYTTDTYGTDYMVNVQLYLGFRMEQQVNVFLRQIVNDMMREGELPTQPQKYTTIPDRQVGDWTFVLLHEELSPQTQIKGFQKAIIQARLRLQHIAVSPAQWFGLEYADTIDETVPLVLGKIPITKLNRLTRSQAEAQPEDEDD

SEQ ID NO: 2644 - protein, 877 aa, Lactobacillus paracasei
MMKQIYAFAEGNMEMRALLGGKGANLAEMTNLGLPVPPGFTITTAACHSYQTNHGLSDDLLQELDTHLTALEQATGKQFDDQTFPLLVSVRSGAPISMPGMMDTILNIGLNDQTVVALAKLTNDPRFAYDSYRRLLAMFGNVVYGLSEKAFDDVLTTMKRDKGYASDLDLTTTDLQAIIASFKQLYEQAGKTFPQAPKDQMLAAIAAVFESWNNHRAVIYRRENQIPEDLGTAVNIQTMVFGNAGEDSGTGVAFTRDPATGERALFGEYLLNAQGEDVVSGVRTPQPVAVLQAQMPAVYDQLATIATKLEQHYRDMQDLEFTIEHGHFYLLQARNGKRTPAAAVKIAVDLVNEGLINQHEAILRVAPKSISDMLHPEFDPEVLAAHTVLATGLPASPGAASGEVYFTAADAKTAHDAGHQVILMRQDTSPEDIEGMIVSQAIVTARGGMTSHAAVVARGMGATGVVGMHALSVDEHAKTATVGSTVLHEGDWVSVDGTTGNLYRGQITTTAAMVKESLATLLTWAKDASRMAVFTNADTPKDLEQALAFGADGIGLTRTEHMFFQPERLLQMRRLILAKDAAGRKTPLQALEKMQEQDFYELYRLANGKAVTIRLLDPPLHEFLPHDSREVSEVAQDLGLEQNQLRERMAALKEVNPMLGHRGDRLAVTFPDIYEMQVRALMHAVFRLVDEGMKVTPHIMIPLTNSETELIWVRKLVTDQIKQLVATKGIKVDYEVGTMIETPRACITADKIANAADFFSFGTNDLTQLTFGYSRDDVGSFLPDYLSKGILPADPFQTVDTEGVGAFMQMAVEKGRATKPQLTIGVCGEVGGDPDSVTFFNQIGVSYVSCSPYRVPVARLAAAQATLRAEKQTKQPS

SEQ ID NO: 2645 - protein, 185 aa, Lactobacillus paracasei
MTGETLATKLNISLATIRADLRLLTTIGILDARPKVGYAYQGENLLQMDSQKFFQTTIAAILLPPTEIKLTTSMEEAVTKLFLADVGSLYVLDDDGALVGLISRKDLLRASFTNRDTTLPASIVMTRMPNVITVTADTSIIAASKLLLKHNVDSLPVVQNVGDTHVIGKITKNRIFKYLIETLVP

SEQ ID NO: 2646 - protein, 223 aa, Lactobacillus paracasei
VVKLVLLRHGESIANQKNTYTGWSDVGLTAEGKAQAETAGEKIASTGILFDHVHTSVLSRAIMTAYIVQDKIGQNYLPITKSWRLNERHYGALRGINKDLTRKLFGPDQVASWRRSFSAHPPLLANPSRTRRYHCYPATIIPRGESLADASQRLLPYWTAELAPRLLSGKNQLIVAHGSTLRALVKFMEDISDAGINKVEIGNAQPIVYTLDDKLIILDKQTL

SEQ ID NO: 2647 - protein, 373 aa, Lactobacillus paracasei
MTQSHKSVTMVELFYDLIFAYAVGRMAQALALPTHGFIAPRMLGEFLMMLLVFWVIWTYQTVLANRYFNNQLAQSLFTLFNMFWVIVLSTAINVDFVKTKWSFQLSTAILFLSVAIQYGLIWRQKHAALPKIFGLTLTIAGALALVSPFLTPYSLSFTVFFLGVVGASFVPLLFWRTINAAPVDFSHLSERYSLLVLLIFGEAVIGVADTVYSGLSLQAGLFFFVVILLFVAYQLVYDNGLNRQIKTGGLAAIHLHYPLLAAILSISTFIHLWLTQELDPRWFAAAITLALAVYYFSLIGYLRAYPTSKIDIGFKRWFYLGFSLMIFGVYSFMTAAMPLPFMLGLTAYLLANTLYLWQFILHPNDPLYNESDQ

SEQ ID NO: 2648 - protein, 94 aa, Lactobacillus paracasei
MTTYDVTFNTVDGKSLIKRNVESDHENARVWEDAVERFDADHLYIKMNDKTMVSLLRRAVVRIDMTELPSDVEKKANRRDEFRNAMYTLSQIGL

SEQ ID NO: 2649 - protein, 371 aa, Lactobacillus paracasei
MTVVNGYEQSDAEKKLNILNLPSLADEAKKIIPTGGYGYIVGGSEDEWTLAENTKAFNHAQIVPKALSNIDSPDLSTNFLGIDLKTPIMMAPTAAQGLAHSQGEKDTARGVAAVGGLMAQSTYSSTSIADTAAASNGAPQLFQLYMSKDWDFNKSLLDEAKKAGVKGIILTVDATVDGYREEDIINNFQFPIPMPNLEKYSAGDGKGKGIGEIYASAAQKISEDDVRRIAEYTDLPVIVKGVQSPEDALRAIGAGAAAIYVSNHGGRQLNGGPASFDVLPAIAKAVNKRVPIIFDSGVRRGSHAFKALAAGADLVAFGRPVIYGLALGGAEGVQSVFEQIDHELEIIMQLAGTKTIADVKHAPLTHFNYAD

SEQ ID NO: 2650 - protein, 68 aa, Lactobacillus paracasei
MTDYDAAKDKVSGKVKETAGKLTGDESTEAKGKAQQIAGDVKEKLGEAKDKVAEKFNDVVDKTKKKED

SEQ ID NO: 2651 - protein, 85 aa, Lactobacillus paracasei
VSQEIVIGDKVSVRKAKDVPLSFKGTVEKLYANAAMLTIDSFSPDDASLVEDMKNKTVVNYKHIKKGGKAVIPPAPEEKRPGARH

SEQ ID NO: 2652 - protein, 68 aa, Lactobacillus paracasei
MLFAAHLRDYEVVGQYTDKWGHRHDSSRVCHQMTKREARDAMQRYLLQHFSDSVDLDAPIKVKVQATK

SEQ ID NO: 2653 - protein, 83 aa, Lactobacillus paracasei
MKQAKEGMVVLCRANGNMEHDFVGRIQKCYENSALVEILDYAPQDQVNVQDLIGRTVIAFNRMKRSQTTQLATTQNQVKESVG

SEQ ID NO: 2654 - protein, 410 aa, Lactobacillus paracasei
MDRHIFGATFSSLRSTNFRRFWIGQCISVMGTWIQRTTQTWLVYQMTKSAFLVGLLAAAQFVPIMALTLIAGTLIDRYPKRRILLMTQFGFLVLGAAMTIITFLKIVQYWQILVIALGYGILQSFDTPTRQSYVIELVGKKDLMNGISLNSSIFNLAKIAGPSLAGVLMVTIGVAPCFLVDTLSYIAIIIGLLMIHQQHPVASHTPRHIIADVKEGLAYIVHHDNVKLSAELMMIICTLNFNNNVIIPIYAQEVLGRGAQGYANLLSATGIGSLIAAFLMSYLARFGLRRDLYLLVALGTALVQSLMIFVHVYWLAMIFMVVIGFCNMVFLNQSNAAFQFSIPNELRGRIMSVYVLLNQGSTPIGSLYVGGLMDMAGGLWGFPSCGLLALLLTIPILLSHQTTVKHWLHA

SEQ ID NO: 2655 - protein, 418 aa, Lactobacillus paracasei
MDATTIDLEQMGRAAKTAAMTLGQLTTLQKNTGLLAMAAALETHADTILAANKADLAAASALPEKFVDRLALTKARIADMAAGVRQVATLDDPTAQTDRAWVNEAGLTIAQKRVPLGVVGMIYEARPNVTVDAAALTFKSGNAVILRGGKEALHSNLALAKVLQDALAAKGLPRDAVQLITDPSRAVATQMMHLNGYIDVLIPRGGKGLIKAVVEQAAVPVIETGAGNCHIYVDAHAQLQMAVAIVVNAKVQRPSVCNAAEKLLIHADVANEQLPVIAKALQDHGVELRGDERARAIVPSMHAATAEDWDTEFNDLIMAVKVVDSEEEAIQHINAHNTKHSEAIITDNYQNSQQFLQQVDAAVVYVNASTRFTDGYEFGFGAEIGISTQKLHARGPMGLAALTTIKYQVLGNGQIRKN

SEQ ID NO: 2656 - protein, 277 aa, Lactobacillus paracasei
MAKRAMQCKRLVVKIGTSSLIHPNGKVNLQTIDRLAYSLTALNNQGYELVLVTSGAIGVGMAELGMSKRPAVIAEQQALAAIGQSELMTLYTQRFSDYGAKIGQLLLTHDVFDYPMNRQHVLDTIDALLAQQVIPVINENDSVAVDELDHRTTFGDNDQLSALVAKQIGADLLVVLSDIDGLYDRDPNRHPDAALMPTITQLSAKVLAAAGGSSTRFGTGGMVTKLKAAKTMMLAGKQMVLASGRDPRIVLQILAGDPVGTWFGQPKQAASVSQSFQ

SEQ ID NO: 2657 - protein, 64 aa, Lactobacillus paracasei
MRAKKKQNKMANALLLTVSFIVVACYLLFFKGVSQPFQFILVCGSLSGFLVLLGAHLRQLFARS

SEQ ID NO: 2658 - protein, 178 aa, Lactobacillus paracasei
MRQYGIKGLAALGMLLVMLGMPSGSAESEPTPLKANHVAAVYEAKKVRPLFQQLAVFPDGTQQPLAGGIFAFYRFDSSGRRRYRTTDGHWRSVGNPLTSKEAYKVKADRHGIVAIAKNLPVGTFYSERLLLPRPYATKMPLPVKIHVKRTGITANGQAIHTGEELPRIYAFRVAVTRQ

SEQ ID NO: 2659 - protein, 407 aa, Lactobacillus paracasei
MFKKWVWVTVLSVIGIVALGFGGWALIDHYQYSQLVDQPSDVKKWEADPRPLQSKSAAIKQIKAIGQSDPLEKRAATDAKLVVIPGLRGAWSINAKTKKAGFGNNWVPQGVTQSKDAIYMSLYDGNHKLNSIIVQVNKHNAKYNKTLILRSKSHVGGITYDIDHQRLLWSDDAAQTTGAGISYVSQREIDAYSAKATQQPIKSTRIELHLARRTSAIALYNNQLVFVKYGQNKKNRSILALPLNANGLPAPITMKQMKAWALELAPKFAGKTLDQEVNMVFKSLIQKKVINSYNNGWDRLQGIAIAKSGLTLLSQSNGSAPGKIWIRVPGNKSWTKLDFTAPKSGSKIINVPNSVEEISLDPSEKHISMIFESGAKAYREAGSFMHRPSYMDRVIILPVLVKKGQVQ

SEQ ID NO: 2660 - protein, 275 aa, Lactobacillus paracasei
MAKQAKGSNRLLRWLVIILFTAGAACFCYPFAATAINEVIMTSRRAEADREAAKNAAAQDAQRASENRALAETGLRPGQDPFNSEQKVKQAYVKKHLIGRIAIPKIEVDLPLFDTTNNTLLDQGAVVLPGTSYPRGGKNTHTVISAHGGLPTKRYFTGLKKLKKGQQFLIEVNGKKLAYKVFRIQTVKPDQTESLQIESGQDLATLMTCTPYMINSHRLLVTGKRVPYTESLGQAAKAANQWRFWKSAAIIGGVLLLAVLIVWLARHYLRRQRRS

SEQ ID NO: 2661 - protein, 519 aa, Lactobacillus paracasei
MNATIKKIGHGLLAALMLMSVLLPLLGAGRTVQAAESQVAFTLHKIEQTADEQIQNTGHDLGLTGRTPVVGAKFKVFNVTDAFYQLLETHDKETAAAMMSQNLGNYANLQDPNAPEITTGQDGLAVFNQLPAKTGGRLSVYAFSETWTPQPYQKAADMIVSLPVRDKNGNDLTNIHLYPKDSVVTKHLDAINGGAVAAKDLHDVAVGDVLTYNIQFQIPHDIGAMADNQSGVFKYNQFEVLDYMTKAGLTFKELTAVTVDGQNILNDLTGKIALMTSNDAAWQTAHGNYPFGFKLDFLGGSDANAVRNLLTKYAGKRVTVGYTGIVNEKMVPDQKIGNTAVVSFDPDTKITVNGPEIQTGGMKFFKYETGSDDKSLAGAKFIIQRQTGNATEYAVLEGVTGMTGAYAPSKITWTTTKADATELTTSAGKPFNLSIQGMLPGTYTLIETDAPDGYEITDPTTDFEIVAGTWGEKIVRITNTPVRTLLPMTGGMGLLAFLLIGIVLMSGGYYVKKQTGKKA

SEQ ID NO: 2662 - protein, 440 aa, Lactobacillus paracasei
MRLRLLWWVIPLLLLVGTLLGLQPVSAAENTAEIVLHKRIYRDVRQPEDVWYDNDGQIIDPENPDKAGYKLLSKTSGLNGANFEVYDASSLLKSDMTPDDVQALIEKYQNMTRKQALKFARANLQLAGQGNKGLGLINTTTDKNLGEDGIGRVTVDTGQGSFEKAYLLIETALDFSTDLNVDMERKSSPMLIVFPVKDPTSGDPMSTVHLYPKNVGYVRDPYFFKFGVHPDGTSRRLAGAIFAIYRIVDGQKLYLDLSPATDLKNKWVASTDALHDDRVNKFVSDKDGLVNTGERFLSAGTYYFEELQSVPGYELDEKSRAIKIEIPDSWLDDDDNYRYVLIDGQPMKENIGGIVTPEMISIGNPRVYNYTDRSSTSSESDPTPPTGQSDQSDKPTGTGATGYLPAMSDWQSLSLVLIGVGLLTLATYFLIKHKKARNHP

SEQ ID NO: 2663 - protein, 1001 aa, Lactobacillus paracasei
MPKKLIHIVMLAMLMLTQVGSAVVPVADNGETNITEHDRAAPKSDPSSHQNDASGQAAISQDTIESDKKQTSAAMSSSENQTVKTEMPELTNRLDRQDVVLDDGGQWTAAVGQHVVTYTYDMQQAEIKVKLKLVKPWSENRTQKVVVTPFTDMVSQPAHTNGEINHVFDSNNWAAHEYEMTKKLSSEEQKQKSFKLNLDGFNGTDHVVSLNLDLKLPGPIVNDHVSEPGTDSLDAHSLILPRAALGETKIQVTKADGSDFPIGSAQIYRKPNGSSRSKYGSQTAMKENVSTDYVPSSSATAVIFKDVITQEDGLSNVLDAKLKVDINHVGSASDLNDQHFEIGAYVEMTNIHVRRVEWAPTPTDVGIDFSNNFFSGMSFANVLHYDWRVVFYEKETGKRLNFIPQSDLNQNSTLTFTSLNPGEFVWTEQSDINATYNADYVTDWQFQEGNWITANKDVFDQENLGERGTGQKGYTSKTWGNWVDPIDHDNLSEWEDRLGAPTFGRGAVAYTLNGTSHTFKRGTFSSGGSTWVANGSGQIELIDPNVTNNKSVSAQAIAGGGAKADKKGPIWTSNDLNDQVVNEHYQGDPFYYYINQEVYNMGDYVVKPTTITVTDLLPKNIELIPDQNNGPPTYEQAFQLFNATDPDAPNKDRAMTLTSGVSSFEVTEEKGRQRITLTIGRADVQKIYFHSGYFSLRLKVRPTLDPDTIDQRVTMTNSAVVKFFDTKERYSKETNEVDVHLDPLNRFHASITKKNQHGALLEGTKFTLKQAGQPLQEAVTNAQGQATFTGLRPGKYTVAEVMSPGHLLQPEFDLIVAENGDVTIGRQGEIWDDNTVVNQLKPTELELLKVNKSNKPLAKATFALYRDGQTEPVASDNTNDEGRLLFDHQLTPGSYRLVETKAPEGFDKLAGAFTFTINQTGTMVDLKYSGSDLTTDDYEFKFQPDASDKVNRISFTVVNHSLESLLPKTGGNGIVLFLLMALVAGASGLLLAIVLKRKEAR

SEQ ID NO: 2664 - protein, 185 aa, Lactobacillus paracasei
MAEKYTAEIVPLNAEKIGTAPHGAATFTIDGAQMKIHIDMFDTPANVQHWEHFHGFPDGKPAEIATAAQDANGDGFVDLPETEPVSGTTMVPFDAEPAKMHVPNDSYPVADAEGHYAYDKLVDLKELQTAFKAAFGSDDLQLDKRVIYIHGVPDTLKLPATVQGTVMNYDAHVTLPIAVGKIIKA

SEQ ID NO: 2665 - protein, 398 aa, Lactobacillus paracasei
MPDLAQSTFILPQDATLTSEQSALEQRIWTFINDNHNTTSTHLLIISGDAGAGKSVVLDAAFAQLQKAACATSGELAGTDNKLLVNHNEMLKIYKEIAGTKSYFRKKDFMKPTPFINAYRKAGKRADVVLIDEGHLLLTTPDPYNKFRGHNQLADILQLARVVVLVFDFHQLVKLKSFWTPALLKRVTRDYAVTHYHLTEQMRVGDAAVNDWIDHFVRGKVLPLPHPQHFDFQVFSDGQPMYDLIQRRNAETGLSRMIATADYPFTVLDGKTWYVQAGSLRLPWDKINFTDRPWAQRPETLHEVGSIYTIQGFDLNYAGVILGPSLGYDPSKDRLTVDLAQYQDKEAFKKRPDLADTTDAKAAIIMNAINILLKRAKHGLYLYAADPALRQRLLQLAK

SEQ ID NO: 2666 - protein, 351 aa, Lactobacillus paracasei
MPSIADYPQRHSLASFQQTPLTELDAGLFAQLGYLNFNYLIGQPYARFADLNDSTRLNRATLTTWAIPTHQIMLDAMRHSERFARVTWDNWLETCSHRNEEDFAAITFTLAPGVYCVSFRGTTNKLVGWKEDLNMSFMPTIPAQRRALSYLIKQISQHPGTYYLTGHSKGGSIATYAFDHLPQPLASQVAHVYSFDGPSGVPLDPSHRDRVTKLVPQSSLIGVSLDPAMNFEVVKSRVKLFGQHDVLTWNIADTTFAHLPTTTWASRYFQKTFALWLAGLDAKATAVTVDALYRILRSGNAITLDDLAKTKNHWRHYLGAFRRLDKHHRQQLGRSFRCLLGAMAGSLVQTH

SEQ ID NO: 2667 - protein, 148 aa, Lactobacillus paracasei
MQFSDKLKLARQQQQLTQTQIAEQLHVSPKTISSWENARSFPDIGTLVRISDFYDISLDQLLREDQTMTDHYDAIDKHAQRDQKYFQVTYYLNVTLFLVLWGLQAVSNNFRSVVGWLTLAFVINLIVLATHYPDYHAWITGLPHRILL

SEQ ID NO: 2668 - protein, 109 aa, Lactobacillus paracasei
MQPSSQMLKGILEGAILQIIQQGDIYGYGLHEQLGALGFGDIPEGTIYPLLLKLQKNKSIVGVRRASESGPDRKYYHLTEAGQQTLADFQQQWHQLSQAMAKLNQGGTT

SEQ ID NO: 2669 - protein, 262 aa, Lactobacillus paracasei
MKKLNQMRMANDQQLKQIHGTDYAYTETVVIYLRGALRKNPYAVEHAISDLLTTLIDAQTAGRKVSTFFGDDPETAADNILKELPPAPLDYFVSLFWPFAMFPLIDGILMMVVDHETRLLLTDFFPILIVSLGLFGISFGRGISFNRLSRKTIRRVLISLFLIVGLPLLIGYVSNHVFNLSFSSTTLIPICGGFVFLNLGLAACFRKNALLFLGWSAIWAFTAATLFLPISELSVGLAFVGLGACLLLLFYRPESQSHLEVS

SEQ ID NO: 2670 - protein, 262 aa, Lactobacillus paracasei
MKKLKQLRTANDQQLKAIHGTDYTYTETVIGYLRTDLRKDPYAIEQAINDLLTTLTDAQTAGHRVAAFFSDDPQTAADNILKELPRVPAWYLFDQYWPIVMFLFASIIFTMLVGQEHRLSLSSIAAPVAVVFAFIGVPFARGISFNKVSSKTIFGLLIAFALFIIVPLLIGYFSAKTNAFSFSRPLLISLCVGIGLVNLCLAGYFRTIALLLISWTGIWLLALLGLLLPASSLTVGLAIAGVLCATLLLFYHPEPKSVIAAN

SEQ ID NO: 2671 - protein, 92 aa, Lactobacillus paracasei
MKKQETQLFEAIDVAYADPEIAKQDDLRKLLFTSLQHLQNGDPYQMVAVKLKNSISRYVALHQLDAPDALNKLYMKIGPMDDRDWGLTQIFR

SEQ ID NO: 2672 - protein, 94 aa, Lactobacillus paracasei
LGGKETRLFQAIDGAYNDAAVQSDDEIKRFLFESARQLARGDRFSYVAARLDGFITSYSQVHHFQYPSALEPVYKLVAGASMRARGGGGLSVWL

SEQ ID NO: 2673 - protein, 98 aa, Lactobacillus paracasei
MSILKWYAGGQDRAEQAISILTELVADLNHSQQKMPLQQVLSDYIEAFRKKELAVPFILSRMNLDISSALKNNQIVLTASESDKLDALMALANIRYGY

SEQ ID NO: 2674 - protein, 451 aa, Lactobacillus paracasei
MTAKSNQTARGTRPLSEKHHMQIPWYDVIVSEERQADHATLEERASLVGRVGIMLLACGTGAWRVREAMNTVARALRMSCSADIGLISLSYTCFSNNHAYSEVLSLSQSGVNTDKLDALERFVRNFEKQYTTETVREIHHRLDQIQKMSGNYDPLRAGLAAALACCAFVFLLGGGPVEMVCCFVGAGIGNWLRGIMIRRSWTLLACIGVSVAVACLAYFLVFRGLEMSLGIAARHEAGYIGAMLFVIPGFPFITSMLDISKQDMRSGMERLLYALMITIVASLVGWLVAMIVHLRPENFVDLGLNPMLLLLFRLIASFSGVFGFSVMFNSPKRMAVQAGLIGAVANTLRLELVDLSTIPPAAAAFIGALVAGLLASAINRIDGYPRISLTVPSIVIMVPGLYIYRAIYNIGLNNIGVGAEWMTRAALIIMFLPLGLFTARLIMDSRWRKSD

SEQ ID NO: 2675 - protein, 86 aa, Lactobacillus paracasei
MGGVICYAVPVFWKRILRRHLIHEIKTLNQGLQLSSKAMSQLIDPENPYMVFADENGELDFSFLWLGNLRQLRRELRLIKEQKARV

SEQ ID NO: 2676 - protein, 116 aa, Lactobacillus paracasei
MEYQLEMEARKLIMILRHEIHQLHPLNRSPEMAYVVDRVAGDMDNELPHGPEFDRQLFRFAQKIDFILSTQSIQLSQLGRDAIDDIRRLANGEPLGKPEPERRGIQRFFAHLFGCN

SEQ ID NO: 2677 - protein, 459 aa, Lactobacillus paracasei
MIDLKKLETTEFYNHRYRNFSTVIIVPTAILFVLLLLFLIFAKREVTVLTAAEIAPVKTAVTVQGTAANRIVTNHMKEGKHVKRGDTLLVYHDVAHPAQLKVLEQQLATLKDQKAQLEVLNQSIAANKNLFASPDKFGYQQQVRDYLSQRRVYELESEALHATQGVVDGKSKEIDQLLQTSMQASEAKMTAIREAQTAIRTDRPLSDNHAYNYLYLQYKAEAKNADAANLNSLKGQYQSQLQNLLTTEKETLASLRTQRINQKQADLSAQQTGQNEAKLASLQSHMQQTMTAEQVKVQQGTQEGEAKLAALKDESKNYQVKASASGVLHLEASLSGNKYIPAGTVLAQILPDLATQKEAELKLAVSPAEIMSLKRGQSVRLRIAENVPSPMTLTGRIDAIDVAPTVNAKVGNYFKVQARVPLSKQQRQTLHYGIAGQAAVITGTKTYWQYFVDKMFNHQ

SEQ ID NO: 2678 - protein, 730 aa, Lactobacillus paracasei
MIKYNLKLGQAQYYKRYYTPQVDERDCGVAALNMLLQFNGSDYSLAHLRQLAKTDQEGTTALGIVRAAQALHFETKAVKADMTLFDLDDVPYPFLVHVLKRGELLHYYVVFKATKDHILIGDPDSSVAMTWLPKERFAKEWSGVAIFIAPEPQYQPRKEDKGSLFAFVPMLARQKGIIANIIVAAVLITLISIVGSYFLQSIIDTYIPNGMRTTLGMIASGLILAYVLQSVLTYGQNFLMAVLGQRLSIDVILGYVRHLYELPMSFFSTRRTGEIVSRFSDANKIIDALANTIMTLFLDIWIVLILGIVLGIQNTTLFLVSLIAVPCYLVIVFAFQRPFNRLNQETMESNAILSSSIIEDLNGIETIKSLTGEKVSYERVDREFVTYLKKSFNYTKADQLQQAIKGLLKLVLNVVVLWIGASLVMANKMSLGQMLTFNALLAYFTNPLESIINLQPKLQMAKVANNRLNEVYLVESEFKEQRSLNDRHLIDGAINVTDVSFKYGFGQDVLKQINLEIPANAKYTIVGMSGSGKSTLAKLLVGFYPVDTGKGKITFNGVPISDVDLTTLRQYIEYVPQDPFIFSGSVIENLTLGSRSNITEADIEAACSVAEIAGDISNLPQIWQTKLSESGSILSGGQKQRLAIARALLSPAKVLIFDESTSSLDTITERKIVDRLLAMTDRTIIFVAHRLTIAAKTEQIVVMDHGAIVEQGNHTELLAKQGYYARLVSE

SEQ ID NO: 2679 - protein, 45 aa, Lactobacillus paracasei
MKQFDEQKMVNMSDEELLGFIGGDSIRDVSPTFNKIRRWFDGLFK

SEQ ID NO: 2680 - protein, 432 aa, Lactobacillus paracasei
METYSDLAYIFLTSPVFILGITFLSYIFFHRINLIHVFFWSILAIVFSTTLSLLGEIFFGLIYAFYMSKTHSQSDIFWVFLFLEINLIIVNFQTLLGNFFALSIPNNFFLIHIASKLIINIALLILAIWLFGTRKKIVNNMRYLVQEKDGIWISAIFYLGASCTVMYFLEFTFILLKLDNVLTLLILAAFIFFMIVNLCSLFFILRSYRYYLELLVVKHTNESRRAYYASLNQQRENTSKLLHDYKNLLATLQLSLQQTSASQSSDTSNIIAQAQRSIQQAESGKDSLAAIESDPLRNLLYLKWSEATNSGIRLHIHTEGTIQPLSNNAGFAVIRALGILIDNALEESIRINKTHFSVLLVASDRGLEASVVNDINDDFNLAKFAEPGFTTKGRGHGNGLTIINELIQQNKNIIIKKTVINKQLKITLFIGR

SEQ ID NO: 2681 - protein, 268 aa, Lactobacillus paracasei
MTNHQTMLKIFILEDNADFLNFLESTLRNYIMIEALHAEIKFTTQSATDLLDAVDLEEINDCLFLLDIDIPGSSVSGIDIATILRKKSLYADIMFITSHTEEALSILAHKIAPLDLIDKSVLFEVEARLRSNIVYAIKRLKARQLQSPRLFNYSIDSNLFTVILDELLYIQTTPGISGTLELHAEREIATFPGNLKEVSLQYPTLFRCHRSILLNPTHISKLDTHGRFVYMDNQDKLEVSIRRVSALRQVMMTANKPQSATNDLSNDA

SEQ ID NO: 2682 - protein, 65 aa, Lactobacillus paracasei
MIITGDKMARFIRWLGIVFLPVYMLAFALKVIPKVDVIVPLLILTTSSLTFASSKSGKRQGKLKK

SEQ ID NO: 2683 - protein, 79 aa, Lactobacillus paracasei
LKMELIAASKMNFGKHPMSRHFNKRSKIVFHVCRSTTRVTINKLKLKHLFETPSYLWSLLIEVKMIEVTKAMAQIPTIL

SEQ ID NO: 2684 - protein, 60 aa, Lactobacillus paracasei
MYTMTNLKDKELSQITGGFAFVIPVAAILGFLASDAWSHADEIAGGATSGWSLADKSHSL

SEQ ID NO: 2685 - protein, 62 aa, Lactobacillus paracasei
MQQFMTLDNSSLEKIAGGENGGLWSIIGFGLGFSARSVLTGSLFVPSRGPVIDLVKQLTPKN

SEQ ID NO: 2686 - protein, 74 aa, Lactobacillus paracasei
MNAYKQLKQPLSMWIINCCLVALLFLVPDDSSIFVYIVIDLAIVANGFDLLKKLFGLSKHADWHHNTWNRDESK

SEQ ID NO: 2687 - protein, 61 aa, Lactobacillus paracasei
MSFRKVSSFIVGGGFLFAIVWLILSDLDLLPHISFIDRYYLIFLVIFIVVCEKSQKNKPTN

SEQ ID NO: 2688 - protein, 319 aa, Lactobacillus paracasei
  misc_feature (4)..(4): Xaa can be any naturally occurring amino acid
CAAXAMINTERMINALPRTEASESELFIMMNITYMSEKAGFVNLDEGDGMKKKRQRLFTPGLRVLYIFILDEFIEAFVFTPFLSFLQLDFWADIVLYKVLSLVIILGLNLLLLRQKIIFRTSFGWPSWQKFVFWDIVGCLVAWQIFTNRNFLDILQASVIGTIAAVPEEYLYRGVIFGGLLRAFYLANRGGTKRNFLYCMLLSSLAFSLAHLSNLPSQGAVATVGQMIQVSGMGMLLAALYVRYGTLLMPIFVHFMIDCLVTLIHGPYPSKLNGVSDEATLITVSLIWATIYLAISMWVLWHCHDEEGFMARLAGQAIK

SEQ ID NO: 2689 - protein, 110 aa, Lactobacillus paracasei
MNMIQRNKVYFIMTGLNESFQKTATVSVMNTDAQEVIDDALHILKKENVLQNRAIDYALARLYSRFVRLIGLQGMKLSPEADQWWQQLKDFMENDIHEELSQVGGPHFIT

SEQ ID NO: 2690 - protein, 63 aa, Lactobacillus paracasei
LAMTLNKAIHFLLLIGISGVFLFTLAAAMGWVNQGDFALPLLLLAAGLTLLRETDAGYEKARH

SEQ ID NO: 2691 - protein, 111 aa, Lactobacillus paracasei
MTDKRETLMSMLSKAYSSPTIKAEPELRALIETNAKKVDEGDDDKAYVTAVTQLSHDISKYYLIHHAVPEELVAVFNYIKKDVPAADIDAARYRAQALAAGLVAIPIVWGH

SEQ ID NO: 2692 - protein, 198 aa, Lactobacillus paracasei
MNLEEKFAFMATGKPYDDMDPLLLAVRDEATAKTDALNNEHDPAKRNALFRKLVGQTGVKPFVNPNFHCEFGRNIRVGDHFYANYDCTILDGAPVTIGDHVLFGPKVGLYTSNHLFDPLERQLGGCIAKPIVVGDGCWLAANVTVLPGVTIGAGTIIGAGSVVTHDIPARVIAAGNPCEVLREITAADKTGFAGHDMI

SEQ ID NO: 2693 - protein, 102 aa, Lactobacillus paracasei
MDKIISIIIVILILLATIAFYLAPFVGGLWQGAARSKVIAKILLLNRDLKLSSKGLSRLINPQNPYIVLTTLDGRLDFTFISMSNLKKLKSELMSLEIKSMD

SEQ ID NO: 2694 - protein, 71 aa, Lactobacillus paracasei
MISKEVGITLKQHDLVLIQGGAKRRNKPSGCIVSTIGGAVAGAAGLNPFTTVAGAAIGLSLCLSTNYIHPA

SEQ ID NO: 2695 - protein, 77 aa, Lactobacillus paracasei
MSYNYRQLDDFQLSGVSGGKKKFDCAATFVTGITAGIGSGTITGLAGGPFGIIGGAVVGGNLGAVGSAIKCLGDGMQ

SEQ ID NO: 2696 - protein, 74 aa, Lactobacillus paracasei
MIDRGSVGHVGVHPRIDHASMGNGELNLVNQQRLPNAAFKQRNLFRVKVGDAKMPNLATLFQCIKGRRNVIDFH

SEQ ID NO: 2697 - protein, 244 aa, Lactobacillus paracasei
LTVKDKVVVITGASSGIGAATVQVLAKAGAKLVIGARRTERLAELAASFTDGQVLYQQTDVTDQQQVKALIDLALDKFGHVDVLYNNAGLMPLSEMAELKVNEWERMIDVNIKGVLYGIAAVLPPMIAQHSGQIITTDSVAGHIVHPGTAVYSGTKWAIQAIMDGLRQEQAANHIKTTMISPGAVNTELFSTITDPKRREAVEADEKNNGLSASDVAKAVLYAIDQPANVAINEVLLRPVTQER

SEQ ID NO: 2698 - protein, 397 aa, Lactobacillus paracasei
  misc_feature (5)..(5): Xaa can be any naturally occurring amino acid
NADHXIDASEMSGYHFLKPFTFKHQTITLKNRIVIPPMTTRLSFEDGTVTRDKIRYYQQRAGGVGMFITGTANVNALGKGFEGELSVADDRFIPGLSKLAAAMKTGGTKAILQIFSAGRMSNSKILRGEQPVSASAVAAPRAGYETPRALTSAEIEATIHDFGQAVRRAILAGFDGIELHGANTYLIQQFYSPNSNRRTDEWGGDRDKRMRFPLAVVHEAEKVIATIADRPFLLGYRISPEELEQPGITLDDTLALIDALKQTKIDYLHVSQSDVWRTSLRNPEDTAIMNEQIRDHVAGAFPVIVVGGLKTPADAEKAADSFDLVAIGHEMIREPHWVQKVLDHDEKAIRYQIAPADLEELGIAPTFLDFIESISGGAKGVPLTTAQSMTSSNVPQD

SEQ ID NO: 2699 - protein, 458 aa, Lactobacillus paracasei
MSKYRTETDTLGPVEIPANALWGPQTERSRHNFQAGPLMPMPVIRALLQLKKAAARANVAADVLPAPKGQLITRAVDALLALPDEKLQKDFPLHVYQTGSGTQTNMNVNEVISHQAAKLNPDLPILPNDDVNHSQSSNDTFPTVMNITAAIAVNQLLHAVNQLCSVLYSKAVTYARVVKIGRTHLQDATPLTFGQEISGWVAMMEHDQIALKQLQPNLFYLAIGGTAVGTGLNADPNFGKIVAGRLSDVYQLPLSAKTNKFAALAAHSEISVVHGAIKTLAADLLKIANDIRFLASGPRAGYGELRIPANEPGSSIMPGKVNPTQAEALTMAAVRVMGNDTTITVAASQGNFELNVYKPVIISTFLESADLLTKTVTSFTEKLAAGLTIHAPHMRALVDHSLMLVTALAPHIGYEKSAAIAQLAEQENLDLKAAAIKSGDVTAAQFDKWVDPLRMTRA

SEQ ID NO: 2700 - protein, 252 aa, Lactobacillus paracasei
MAQGEETSTSTQLLETPAMLSQHATDLLISLMYADRLGSQASGSKKRLSFRGGRQFFEDFGQLAGIGSRTIMKRARLELQVSGALLADRHRTHKHYQLANDPWTLFKQYNGLMTSPILATRTYTADEFEQLLKISGDFSENFPLEAAGTVLIKAAIFGSNQPLIYAVSQAAYDRLLKAELTLKIANSKHRVDDSRAVIIQTWSVDPATVSRRLHGGISTPQADPIHLYLSLLTTGSIKAQTEAAQLVETILH

SEQ ID NO: 2701 - protein, 47 aa, Lactobacillus paracasei
MLTNNDLFESLAMSCDGIEESVGYDPWLFAILGLDHMQSKTATHSTK

SEQ ID NO: 2702 - protein, 535 aa, Lactobacillus paracasei
VSDDHKKRHPIKLIQYANGPSLEEINGTVEVPHGKGFWRTLFAYSGPGALVAVGYMDPGNWSTSITGGQNFQYLLISVILMSSLIAMLLQYMAAKLGIVSQMDLAQAIRARTSKKLGIVLWILTELAIMATDIAEVIGAAIALYLLFHIPLVIAVLVTVLDVLVLLLLTKIGFRKIEAIVVALILVILLVFVYQVALSDPNMGALLKGFIPTGETFASSPSINGMSPIQGALGIIGATVMPHNLYLHSAISQTRKIDHKNPDDVAQAVKFSAWDSNIQLSFAFVVNCLLLVMGVAVFKSGAVKDPSFFGLFQALSDSSTLSNGVLIAVAKSGILSILFAVALLASGQNSTITGTLTGQVIMEGFVHMKMPLWARRLVTRIISVIPVIVCVMLTARDTPIQQHEALNTLMNNSQVFLAFALPFSMLPLLMFTNSKVEMGDRFKNTGWVKVLGWISVLGLTGLNLKGLPDSIAGFFGDHPTATQTNMANIIAIVLIVAILALLAWTIWDLYKGNQRYEAHLAAVADEKEAKADVDEQ

SEQ ID NO: 2703 - protein, 905 aa, Lactobacillus paracasei
MEEVPDSQPPASAHSIKDLQQSLQVPSLNHGLSNEEAAKRLKANGPNSIESHPTPKWLIFLRQFNNLIIYILIIAAILTTVIGDVTDTSVIVLVIIINAAIGYYQESNASDSLEKIKKMLAPEATVYRDGERLDIPSANLVVGDVVFLEAGDNVPADLRLVDIDNLTIQEAVLTGEANSVIKTTATLPADTPLADQSNIAFASTAVAGGSGIGIVVATGHHTEFGKISQAVSDVRKGRSPMMREIDGIGKGISYAIIAAAILLFIFGLVIGKYSLPVLALAIVTMVVGSMPEGLPATTSVILAMGVSNMAKKQHVIVKTLPAAETLGSVDVICTDKTGTLTKNEMTITTIVTPQATYDVSGTGYAPTGDFSMAGKVIDPAEHADLSALLTAGFEANDTELHQEDGRYVINGEPTDGSFLTAYYKAFKQEPANTERDLMPFDSNNRYMAKLAKCVDGQTRLFVKGSPDKILPLVATAHPDFDQDRYLKLTSQFSVQGKRVIAVAEKVVPNATTEITPELLSEGLDFLGITAIIDPPRESVITAIKQMRRAGVKVKMITGDHPETAIAIAKKLGLADSPEAVTGAQLAGLSDEKRRQLILNADVFARTTPKDKLTIVSVLQEAGNVTAMVGDGVNDAPALKKADVGVAMGQSGTDVAKDAADMVLTDDRFARMETAIAQGRRIYQNIKKSILFLLPTSFAEGLVIVFTILTQQEMPLRASQLLWINMVSAITIQFAFIFEPAEAGTMDRPPRKKNAAMMHKHDVFQIAYVAMLIAGIGLWAFDWLIANHLTDRTTASTMMVNMIVLGKIFYLFNIRTNTLALSKNLFSNPMAFAIIGIMLALQCFLTYVPFMQDIFQTAPMSWREWGLAILAGSIILIVTEIDKIIRIRRQRMRGHGAFRSVTKTQG

SEQ ID NO: 2704 - protein, 121 aa, Lactobacillus paracasei
LKLYQSLTQVQINEQFAGQASGYKLTTTLDKPLNYDPTILYQYLDTVLKPGSRHDENNLRYVTDPGYIGENFNYQSVPFTSHMTEFDEKMAFARKLVADLNRHLSVNIKPEDETIELVFVD

SEQ ID NO: 2705 - protein, 258 aa, Lactobacillus paracasei
MHLKIDTGFNRLGLKSGINVTKEFIDDVVALYSLPNVHFTGIYTHFPVAGSDQPSDICFQYRQYQQFNEVCILLQNRGLRLGLRHCSNSKAMLYNPEMNLDMVRVGIYLYGLGSKIDNSKLNVKPAASLNALVILEKELLPGDTVSYGRLFKARSSQKIGIVALGFADGYFRSLGNNSGTKVYWEARGFEIIGKICMDYLMILLPEDLRIVGQMVEVISDDSPAYLLGKKVNSTAGEILTSITDRVPRRYVEGDVDNA

SEQ ID NO: 2706 - protein, 235 aa, Lactobacillus paracasei
KDPGALDLASEMLRKIQTLNHIYQTGLMAIVRVEAERRAIEIAEGCLNGGVDVMEISFTNNSAGETIRFLKKTYRNRLLVGAGTVLDSETARYAILCGADFVIAPNISEKVAETCNRYQVPYAPGCTSYTEAIRALEIGASLVKAFPISNFYGPKLGKIFTTPVPEMPILVSGGVSFDNLSEWIDSGVCAVGVGGLLTQGSQNEITQNATRLSEILITSRNESKSDTSEGQELNQ

SEQ ID NO: 2707 - protein, 287 aa, Lactobacillus paracasei
MQKYIWRGKIVDKTEVNIDLQDRGYQFGDGLYEVVHMYNGNFFTIDEHINRLFRGATQILLNIKMSKKSLKNLLNTLAKANNLNNGYIYMQITRGDKGIRNHGFKMYQDQEPVLSAFTVSTVRSPSKYDTGVTGTTVPDRRWEMCDVKSLNLIPNVLAKHEAQMLKVSKAIFVRDGVVTEEKSGNVLMIKSGKVYSHPDGSHILSGITKEVIKNICLENSIPYLERPFSEIELLGADEVLVTDTNSECMPVVEINGMRIGTGEPGVVSKHIQRLYEQKIIEQCGALQ

SEQ ID NO: 2708 - protein, 415 aa, Lactobacillus paracasei
MNRAFIKKWGTLLLLATGAGIIFQLPYIRETFYVPIQKAMNLTNAQMGTLSSGYATVATFSYFVGGIIADKFSARKLLTFSFLITGVLGLWFSFFPGYQISRIIFILMGVSTIITYWSAAIKATRMLGDSSEQGRLFGWQEGLRGLTNALLVFLMTWVYTQFADTVLGTAWAIRTCAITVIIIGILNWFIIKDTKTESQNEPIGKNIMGLLSSLKMPRVWILVGIVFFAYSMYGLLGYINTYAINVYGLSVAGGATLGGTRYLVQACGGIIGGIVADKIGSRLKVIIGGSALLTISWALFLILPASKSLLLAVVINFLFGLFFIYVIRSQYFAVIDDAGIPVDKTGRVSGIVSAIGYLPDVFMYTMVGGWFDTHPGKAGFDMMFIYAIIMGLMCIVFSLLLAFVIRRKKITNLEK

SEQ ID NO: 2709 - protein, 232 aa, Lactobacillus paracasei
MVSQTEIIKSMQSIVGTAGVVTDLKDLQESSVDRFRKYEAYNNVFTQPIPTAIVYAENTDQVKRVLLYANKNGVNVIPRSGNSALEQMLESEKENHIILDASRMNKIIKIDKLNMQVTAQAGVPLGDLEDEVRKLGLTTGHSPQSKPLAQMGGLVAVRSIGQFSTLYGGIEDMIVGMEAVFPNGEITRIKNVPRRAAGPDIRHVIVGNEGTLCFITEVTVKLFPYYPPRLHN

SEQ ID NO: 2710 - protein, 317 aa, Lactobacillus paracasei
VVTLSDVAKEANFSKMTVSRVINHPEQVTPELKQLVEQAMAILHYRPNSAAKALANNRTNVIKFLILEDVDTTEPYYMTLLFGIARGLDRQQYALQLVTDREHLDLDHADGYIITGARSTDCQWIDQLAKPVVLFGENRHGYDFIDTDNKLGEQQATEYALAKNYQSIIFLGIDVREPFEYSREAGYINTLQRHQKVPQIHRMGNHSHESQHFISENWRKFARNTVFICASDRLALGAVRAIQQNGGRIPTDFGVIGFDGVFLDQVSNPKLTTVKQPVVQLGELLARMLLQKIAQSGAQQGELLVPPKLVLRGTIRT

SEQ ID NO: 2711 - protein, 558 aa, Lactobacillus paracasei
MSTWYNQAIIYQIYPKSFQDSDGDGIGDLNGIRQRIPYLQDLGINAVWLNPVFVSPQVDNGYDVANYYAIDERMGTMADMQALIHELHEAGIRIILDFVLNHTSDQHPWFQDASRNVKSIYRDYYIFSGHHHKRPNNWGSFFGGSVWSPDPAGTGQSYFHLFDQHMPDLNWDNAEVRRAMGDVAEFWLNKGIDGLRLDAFIHIAKVDLAQNYPTSESQQEPVIAEPFFANLPNVQRWLRPFCAQIKADFPNTFILGEAASANVNLAVDYTSQHNKLMDSVITFRYFTEDTTQLDTSIPAQYQPKPLDFAKFKQTQVVWQQTLAGVSLPTLYWGNHDMARLATRVAHSAIQARSLAVLMYLQRGIPIIYYGEELGLENLTLPDAKAFSDPSVPRFIAAAVDAGYTQEAALAMVNATHKLPARGPMTWDATTNSGFTSGTPWLVGKRSSRTHVVEQQHDPHSSLAFYKQLIALKKRSVFQTGSFRLLSTGPDSYVYLRQTDKAIAVVAVALSDKTVNLRLPAGDYQAVLIVGDATLSEETLTLSADSAAVFIQEKERAKP

SEQ ID NO: 2712 - protein, 581 aa, Lactobacillus paracasei
MNLAAMSHRPESEDCFLYTNKKLRLRFHTAQNDVAKVVVLYGDPYWQELDQHQQYRLSYQRKPMSQIGTGQVADHWGVTLEAPYQRLQYLFEVTGQDGSKWLFGDRGLRKDTESARIDTGNYFRVPYFHEIDRVKTPDWVKETVWYQIFPERFANGDSTNDPVGTKPWRPSDHPGRDDYYGGDLQGVLDHLDDLQALGVNGLYFCPIFTASSNHKYDTIDYLTIDPDFGDKTLFAKLVNEAHKRGMRVMLDAVFNHMGFASMQWQDVLANGKKSRFASWFHIHDYPLTPFHNPLKGEGAPQYDTFAFESRMPKLDTANPAVQDYLLQVATYWIQAFDIDAWRLDVANEVDHHFWKRFYSAVTAIKPDFYILGEVWHSSQPWLNGDEFSGVMNYAFTQQIEDHFLTGKQTAAGMTALLTDQLMLYRDQTNQVMLNMLDSHDTPRLLTVAGDDIELALQALTFAFLQTGTPCLYYGTEMGMDGENDPDDRKPMDWTKLGQPIWQRVAKLIGFRREHAATLGRGTTKLEVTPSGLIKVVRHGRETLTAYFNTTASSVPLTAAPVLHQGFAQNELAPKGFVVAVN

SEQ ID NO: 2713 - protein, 753 aa, Lactobacillus paracasei
MKRTFAVDPWMIATHQFHPEDKRLQESLTAIGNGYMGMRGNFEEQYSGDQLSGTYLGGVWFPDKTRVGWWKNGYPAYFGKAINAPSFLPIRIKVNEQPVDLAKNSFRDFYLALDLHQGLLTRQFIYEGDQVEVRFEFQRFLSNVVKEAALINVKATVLSGKATITFDAGLEGRVANEDSNYDERFWEPQAEDPTQKTIQLQTKPNPYDVPQFTVLLKQQLRVNHQPVTGVVTTGNGWLNEQIVADVATGETYQLEKDVIVVTSRDVAPSDQQQTAAALMTTLQTHSFSEQLAAHTQLWAQRWEQSDVVIEGDPAAQQGIRFNIAQLFMTYYGEDKRLNIGPKGFTGEKYGGATYWDTEAYIVPMYLAVTPPDVTRALLQYRHDQLPGAYHNAQQQGLAGALFPMVTFNGIECHNEWEITFEEIHRNGAVAFAIYQYTAYTGDESYVNRDGIEVLVGIARFWADRVHFSKRTNQYMIHGVTGPNEYENNVNNNWYTNTMASWTLSYTLARLAKANADVVAKLAVTAEEKAKWQDIIDRMYYPVDDELGIFVQHDTFLDKDLRPASSIPADQRPINQHWSWDRILRSPFIKQADVLQGIYFLNDRFTQAQKERNFDFYEPMTVHESSLSASIHAILAAELGKTEKAVALYARTARLDLDNYNNDTDDGLHITSMSGSWLSIVQGFAGMRYDHDRLRFKPFLPKEWHRFSFKINYRGRLLAVDVSEEVNVILLAGPSIDIEVNGELQHLEKGDDHA

SEQ ID NO: 2714 - protein, 230 aa, Lactobacillus paracasei
MLKGFIFDLDGVVTDSAKYHLAAWGELAKQLGITLPATANEALRGRSRMDSLAIILGYGDQQKQYTEVEKENLADEKNRRYLQLIANMTPADILPGISQLLSDAKARHLKLAIASASKNAPTILRQLKLFNQFDAIVDPASLHRGKPDPEIFIKAQNLLQLQADEVVSFEDASAGIAAINAAGQFSVGIGDAKALAAADYFVANTGLLRFKSITTAFTKWQNALNKKGDG

SEQ ID NO: 2715 - protein, 43 aa, Lactobacillus paracasei
MVEIDLNHLYKKYPNAAQDSVKDFDLHIKNKEFIVFVGLSGCG

SEQ ID NO: 2716 - protein, 100 aa, Lactobacillus paracasei
MKKMDEMELKFRDQSIRYSWAFMIFTLFIYEFFHVMHYGKFDFISVVVNVAVGVQIASFLWLKHRADKTDKEPRRVLIGTIVIVAVVLTLGMIGLMFHGK

SEQ ID NO: 2717 - protein, 62 aa, Lactobacillus paracasei
MENNIHVLRMRQQLTQQELADAVNVTRQTINAIENNKYDPTLSLAFALAERLETTVDQLFQH

SEQ ID NO: 2718 - protein, 413 aa, Lactobacillus paracasei
VTTIRFLNGLNTIGGNIVEFATKTSRVIMDFGVAADLSNETVSSAIDNGKLPHVPELFFDQPDVYTHEAIFISHLHIDHMGALQYLKKPIPIYLSEPSYKLYQLLIKLGIEKPVANLHPLAYEQPITIGDLTVTGFHSDHDEPGVMALLVNDGSRRYAHSGDVRLNGPHAERVHAWAKRFNQEKLSLFMLEGTSFSFDTAAPVEDQDHPSIPLTEMSLQKQFQTVLAESPTLVVINPYIRNYERLAGFQASAHTAGRQLVWEPDDAAVLTTMTDQKPDAILGQTISLTDIARDPQHYVLQNSFDHLERLTDMPITTYIHSNGEPLGDYDPRFAQLKDWLEAHHIPLQFMNASGHASREDLITLAKEVNPRTIVPWHSFHPEREAEALDTQTNAAVVLPERDLYYDFDELNEEE

SEQ ID NO: 2719 - protein, 437 aa, Lactobacillus paracasei
MKKQTWVKALLAMFTVVLVAVLTACGSNSSSKLSSSTKSDSGKRVTITFWHGMNGPYQKALDQIINDFNKSQKQYKVVGTAQGNYTALQQKIMAAAKSRNLPTIAQTTYTTVPDYVKNGFISPLDQYMLKGDDKMSSSDLKDIYPAFLSSSKYQGKYYSVPFSKSTRILFYNEALMKKYNIAKPTSWEDIKKDADKLKADGIAAIGFDKSFDMEFEGLARQAGNPLVSADPLKANLDSKKTLTAANFIMDMVNSGEAKTAGEDIYGDKNFTAGKTLFYAGSSAGITNMKQNAPKDFKWGTMPLPSYKGKKATELAGNDIVLFKSASSDKQKGAWAFMKYLLSEKETSKWAQLTGYVPLRKSAVKSADFKKYLSANPTSQAAVDSLGFGFQSTAFIGFSEYRNDLLNAVDAMLTKHEKPDQALKTLQGQTETIIKTNK

SEQ ID NO: 2720 - protein, 273 aa, Lactobacillus paracasei
MAKKISKILLYLIVILGAITMLIPFLWMISTSLKTAPETIAVPPIWIPKVLQWGNYVKAWNEAPFGQYFINSTIVTVITTVGQLFTSILAAFAFARLKFYGKNLLFIIFLGTMMIPGEMLIIPNFVTLSHLGQIDHYGALILPWLASFFTVFTLRQTFQSTPNQIYYAAKIDGASDWKYLWQVLVPMSKSTITAVTVLQVIGSWNAFMWPLIVTNSDKMRTLPVGLQAFTTDAGTQYQLLMAASTFVIIPMVVLYIFLQKYIIAGISKAGLKG

SEQ ID NO: 2721 - protein, 297 aa, Lactobacillus paracasei
MLNEKASLKSTAKAALYLLPMLVITITFNIWPIINSFLMSLYTKYDFYTDKVSAWGFDNFVYLWNDPDFHLAVRNTLVFVVGVVPITVILSLIIALLLNQVKIISGFFRTVYFLPFVTSTVAIAMVWNWMFHSNYGLINYFMGWFGIHPINWLTDPHYALLALIIMSIWKSLGFNIILFLVGLNNIDHGYYEAAEIDGANARQRFWNITIPMLSPITFLVSVNGIIGSFKVFDEIFALFQGTPGPGKADLTIVYYLYQKFYTEYKYPIAAASGVVLFFLILLVTLVQLWYSRKHVHY

SEQ ID NO: 2722 - protein, 353 aa, Lactobacillus paracasei
LKVTFKDVTMSYDGKTDTLKDLNFTIPDGTLVSLLGPSGGGKTTTLNLISGLLSPTAGQIFFGDTDVTKKDALARKVGMVFQNYSLYPHLSVLDNIAFPLKMAKVSKAERHAKAKDLAKLVHVEDQLDKKPGALSGGQQQRVAIARALAKSPSLLLLDEPLSNLDARLRIEMREEIRRIQRETGVTTIFVTHDQDEALHISDNIMVLANGSIQQFSSPQKLYERPNNLFVAKFIGEPVINTLPAQALTTDLASAVSEDILKQAVTAGIRSEAIIPYDAGDNVLAKLHGKITQSSKYGREATADITYNGEHLLSTEMAGVAANQPDLDFYLTKSGFFLFDQSGALIFGGESHAE

SEQ ID NO: 2723 - protein, 193 aa, Lactobacillus paracasei
LIIRPSKPDDAPQVAPLIDIVFTEMEIPQLMKVPKKTLYSVLEQAFLLPTYRYGYPQMLVADHDGQIEGIAVGYLHEQEAHIDDALKPLLPKLGLTPNSSLFSDTETYAGEWYLDTLAVAETAQGHGIGTKLLNAVDTVARARHAKVVSLNVDQQNPRAKKLYERNGFLKHGELMIGSHRYDHMLRPVVGEEV

SEQ ID NO: 2724 - protein, 168 aa, Lactobacillus paracasei
MALYLDINALSTSSLSVVKTDNGKPAYILTGRHGLINGGFDLNTLSGEPLGSIRQKTVSVFPRYDLYIANRKVASVKKMFGVWHQFIFISDLNWVAMGNLLNNHYQVFHGVKTIFSAEEIAPAIVKLTIPNNRDIPAAILLAAILDRFRHVGVADPLKRYEYGLDFPD

SEQ ID NO: 2725 - protein, 297 aa, Lactobacillus paracasei
MIKLIASDMDGTLLNDKMEVSDENAQAIRDAQAAGIEFMVATGRGVTEATPLLAAQDLKPAFITLNGAMVFDEAGELVVTIPIASDLSDFIVETLQKDDIYFEIITNKGVFSDSRVKRIQNVADLLVDLNPDTTYKLAVALAAARLEIMNINYVSDYKELLADPTIQVMKIIAFTGEQRDILKAPAKVFEATGKLSVTSSSANNIEVNNIKAQKGYAVEAFAKQRGITMDEVMTIGDNLNDASMIKMAKYGMAMGNAIPEITKLAWGSTATNSENGVAQAIRKAIRINKAEKSNAQF

SEQ ID NO: 2726 - protein, 228 aa, Lactobacillus paracasei
LKTLIHNDWQTVLEPVFESPEYAQLHAFLKEEYATKTIYPEMHHIFQAFEWTPFHDVKVVILGQDPYHNPRQAVGASFAVAPGVALPPSLQNIYKELQSDLGYPPVHHGYLKAWADQGVLLLNAVLTVQAGEAYSHQNHGWEELTDAAIAALSARGGVVFILWGNAAKKKAAVIDTSKNAIIASAHPSPLSASRGFFGSRPFSRTNAALEKMGEAPINWQLPETVKAN

SEQ ID NO: 2727 - protein, 325 aa, Lactobacillus paracasei
LDLFESLKDKINGKNLRIVFPEGEDPRVLGAAVRLAADGLIQAIVLGNPDKIQTLAAAKSWDLSKLTVRDPANDDIHAKMVASFVERRKGKATPEQAEKIVQDANYFGTMLVYMKEADGMVSGAVHSTADTVRPALQIIKTRPGVHLVSGAFIMQRGRDERYLFADNAINIDPDADQLAEIAVESAKTAALFDIEPPRVALLSFSTKGSAKGPQVDKVVEATKKAHELAPDLALDGELQFDAAFVPTVAKQKAPDSKVAGEANVFIFPELQSGNIGYKIAQRFGGFEAIGPILQGLNQPVSDLSRGANEEDVYKLAIITAAQTLL

SEQ ID NO: 2728 - protein, 153 aa, Lactobacillus paracasei
MTSLKRDFTSEAALQSFAASLGPQLQAGDVLLLDGDLGAGKTSFTKGLAKGLGITDYVKSPTFTIVREYRHGRLPLYHMDLYRLEDGGAEDLGLEEYFEGDGVSVVEWPDFLGLSEPETYLMIHFQKDDNEDTTRHLEFVPFGQHYENLLESL

SEQ ID NO: 2729 - protein, 34 aa, Lactobacillus paracasei
MKFGEQLAALFVGLFVGEVTIWAVIHTFRRQWRA

SEQ ID NO: 2730 - protein, 298 aa, Lactobacillus paracasei
MLEVKDLVKTFGTMTAVDQESFTVKPGEIMGLIGQNGAGKTTTFRMILNFLTPDSGAITWNGHPLTAKDYDTIGYLPEERGLYPKMRVQDQIIYFARLRGMRTSEIKAKIPEWMDRFQVKGKPTDKIKDLSKGNQQKVQVIATMIHMPKLVILDEPFSGLDPVNSSLLMAGIQMLKDNGAAIIYSSHDMANVEAVSDHLVMLKQGRMVLNGAVGEIRESFGRTKLFIESGLTADDLREFDGVTKIKQHGQEFELTLADPAVGHQIFAKATENGYIPEFRQQPPTLDEIFRLKAGEADA

SEQ ID NO: 2731 - protein, 340 aa, Lactobacillus paracasei
  misc_feature (327)..(337): Xaa can be any naturally occurring amino acid
MHKFWVVMSQVYKKNARSGSWIFLVLSPLFFLAIAFGIVFYISKTQAPAQVAVVSDVGVVRQALSKQSTSDLRFKPYTSAKKANDALNKEDLDGILTVNAKDDFKSHYVARDNGQTVETSTLVAALSGLKLSSTAAAMKLTPAQVKALTAPPTVTSKTVAIEDGKQVAKSNTAQLMNHGLALVSMVLILMVTMVYGSILAQEIATEKGSRIMEILLSSVSATTQFFGKLAGIFALLLTQLVIYVIAGVIGWQFLKNQTMVAGLLKQVDLSILASGTTAMIALFFIIGTLTYSVLAALTGSLVSNQEQVQQAVMPITMLGMIGYFITXXXXXXXXXXXPSQ

SEQ ID NO: 2732 - protein, 180 aa, Lactobacillus paracasei
MDFIAMDFETANRKRASACSLALVVVQQNKVVDSFYTLINPQMQFDAQNIHIHGIIPEMVQDQPTFDQVWPHIQMFYTPGRIVTAHNAPFDVSVMRLTLDRYGIAAPRYQVIDTVKTSRQFLPKLPNHRLDTVSAALHIPLEHHHNALADSYACARILIAENEHFGEARIKSMMKLSKAG

SEQ ID NO: 2733 - protein, 252 aa, Lactobacillus paracasei
MKLISWNVNGLRAVLKKDFMTIFNELDADWFCLQETKMQAGQVELDLPGYHQYFNYAERKGYSGTAIFTKHEPLNVTYGMGVPEHDTEGRIITLEYPNFYLMTVYTPNSGGELKRLDYRQQWDKDFLAYTNQLAPKKPLVYCGDLNVAHQEIDLKNDKTNHHNAGFTDEERADFTKQLDSGFIDTFRNLYPDTVTYSWWSYRFHARANNAGWRIDYFVSSRNFKPYIQDAKILTDIMGSDHCPVELVTKDLI

SEQ ID NO: 2734 - protein, 301 aa, Lactobacillus paracasei
VVDAPRTLEGITMMHDEPLSHYTFTKTGGPADLLAFPKNVAEVRALVDDARDQGLPLTVIGNASNLIVRDGGIRGLVLILTEMKTITASGNQVTAEAGARLIDTTEAAYRAGLTGLEFAAGIPGSVGGAVFMNAGAYDGEVCNVISSVDVLTREGELKTYDHRELKFRYRHSFVQDTGDVVLSATFTLKAGDKPVIRAKMDELNARRAAKQPLEYPSCGSVFKRPKGHFVGPMIQKAGLQGHIIGGAQVSKKHAGFIINLGDATATDYLDMIHLIQKTVKAKFDVDLETEVRIIGEPGQPK

SEQ ID NO: 2735 - protein, 702 aa, Lactobacillus paracasei
MHLVEAVLFLMALVIVSNVLSHYIVAVPVSLIQVALGLGAALFFHLEINLATDWFMLLFIAPLLFYDGRNFPRRELWELRGPIIGNAIFLVFVTMLVGGYLIHFLIPPMPLPASFALAAILSPTDPIAVQSLAKRVHLPKGVLHLVSGESLINDASGLIGFKYGIAATMTGTFVLGNAVRDFFYVAIVGALAGLVLISLINLSRKWLLQQGINDVILHTILQVLTPFFIYLVVDEFMHASGVIAVVVAGLLSNTRYNRYIAALPELRIVSERTWDIIVYTLNGIIFLILGIELPVAMTDTIADHEVSTFQALGFVVVVYLGILIVRTLWIYGYMLLAKRSKEGKASWRAALLSGISGVRGAITLVGVLAVPAALSNGDAFPERSLMLFIAAGVVVLSLIVAIIALPLVTRSVAPLQTRGSTIVTDDSGDQDDDDSNDIRIISLSQAQTFVFQMAVRRVESERRETNQKAALDLIAEYQYLIRRLELAEDTGAAIPPLIQDELDLRKVGVQGELYALDDLWRDNKIMSKSYAKARKQLQHRLNDLDSMAKRSGRPTFRMLFERSALRLSHWWYTVASEQNRSHRFFNERLFIEKETAKGGLKYLSQFLRQKENKAHNYNRQVIYALIVQYRNRIASVKALNTHKSTQYEQELGRLRAIAFAAERAAIHDLTEKGYITMTMAQKLNQNVNFTENAATLTSLEEV

SEQ ID NO: 2736 - protein, 179 aa, Lactobacillus paracasei
MEIGSRIRDLRIRKNLTQEELGERTDLTKGYISQVEHDQSSPSLETFFDILSVLGESPADFFREEPKDSLVYHEDDQVTYLDEEKGYRLKWLVPESNENEMEPVMIDFAAHGIFKTFEPSPAETFVYVVSGRVKLLLGEQTYVAKKGETIYFHATKQHQLVNAATGRSKCLLVATASYL

SEQ ID NO: 2737 - protein, 362 aa, Lactobacillus paracasei
LSNIIVELKHVGKRYGDTQVLKDINIEIEQGKFYTLLGPSGSGKTTILRAIAGFLDVSEGEVLFDGKRINDVPANQRKVNTVFQDYALFPHLNVFDNVAFGLRLHRMSKQDIQTKVEDALKMVRLQGYADREISELSGGQQQRVAIARAIVLEPQVLLLDEPLSALDAKLRKDMQYELRELQERLGITFLFVTHDQEEALALSDEIFVMNDGEVQQSGTPVDIYDEPVNHFVADFIGESNIIQGHMIKDFLVEFNGKRFECADAGMRPNEPVEVVLRPEDLDITPANSGKVNVEVDTQLFRGDYYEIVGYDDLKNEWLIHSTNPAKDGETVGLTFDPEDIHVMRLNESEEDFDARLETYEGE

SEQ ID NO: 2738 - protein, 274 aa, Lactobacillus paracasei
VKKSTTNAAFYTPYVMWLALFVIAPMVLIVYQSFFNISGHFTLANYQTYFQSGTYIMMTINSVWYAFLITLATLLISYPTAYLLHYAKHKQLWLLLIILPTWINLLLKAYAFIGIFSQDGGINSFLGMFGIAPQQFLFTDFSFIFVAAYIEIPFMILPIFNAIEELPENLVNAAQDLGAKSWQTFTKVIWPLTISGVKSGVQAVFIPSLSLFMLTRLIGGNRVITLGTAIEEHFLTTMNWGMGSTIGVVLIVAMFIIMFLTGERKKKGARRHEA

SEQ ID NO: 2739 - protein, 279 aa, Lactobacillus paracasei
MKRKFKWSNLYLIFVFICLYVPIFYLVIYSFSTGDRMSNYSGFTWKHYAELFADTRMIQIVLDTLLVALLSSLIATIIGALGALAIDRTSRPVVKNTVLSLNNILMVSPDVIIGASFLIFYTALKVPLGFWSVLMSHIAFSIPIVVLMILPRLQEMSHSLLDAARDLGASNYQVLTRVIVPYITPGIFSGFFMAFTYSLDDFAVTFFVTGNGFETLAVEIYARARQGISLEINALSGVMFIFALLLVVGYYFIQQAGQNRRAKQKHKRESEALINETTH

SEQ ID NO: 2740 - protein, 357 aa, Lactobacillus paracasei
MKRLISIAIAILAVCLGLAVWSEGLQKSQGDTGENTLNLFNWGDYIDPALISKFEKQTGYHVNQETFDSNEAMFTKIQQGGTSYDLTVPSDYMIEKMKKANLLLPLDKSKLRGMQNMDPRLIDKDFDRNNKYSIPYFWGTLGIIYNDKFVKASEVQHWDQLWNPKFKDSIMLIDSARDVFAPALISMGKSVNETNPQTLALAKAKLDQLSPNVKAVVADEIKMYMAENEAKIAVDWSGEASEMLANNKHLHYVVPREGSNLWFDNLVIPKTAKHFKAIYAFLNFMMEPKNAAQNAEYVGYATPNAAAKKLLPKSVQNDRQFYPDDETMKHLEIYSDLPPAKVGLYNDLFLEFKMYRR

SEQ ID NO: 2741 - protein, 64 aa, Lactobacillus paracasei
MQTNKVVGLSFVGGWCVMFVSAVVWFAIRNGFIASILLDALGIATLGTVFFVVGYWLISHKNNH

SEQ ID NO: 2742 - protein, 930 aa, Lactobacillus paracasei
MKNEKETRRKFATDPVPDLMTDLHTTSTGLTQKEATDRLEKYGENVITREKQQSQLLIFLKNFTSVMAILLWVSGFVAILSGTLELGIAIWLVNIINGVFSYWQEHEAQKATDSLMKMLPAYTQVYRDGKLQQINATKMVPGDVFNLQAGNAVPVDARLIKATSVQVDQSALTGESVPESKKVAFDAGQGEFAESNLVYAGTTVGAGTATAVAFATGMNTEFGRIAALTQQQKPSLSPLQLELNRLTKQISLIAIGLGLVFFVSAIFFVHYPVAQSFIFALGMIVAFIPEGLLPTVTLSLAQGVQRMAKKHALLKDLNSVETLGETTVICSDKTGTLTQNQMTVDHIWTPAHSFTVTGQGFVNNGQIQLDGKPIKYGTDADLDLLIRLVAFNNDTEVEPSKGSARPKILGTPTEASLVILAQKSGIDTKAYSIKYPRLKELPFDSDRKRMTTIHQHDDHTLSICTKGSLSDLLPHCDTIQENGKVRPLTEDDKKAIDDANRKYASLGLRSIATAYREVPQETDKEKQLDGLTIDTAETNLTFVGLAIMSDPPRPEIYEAIKKCHRASIKIIMVTGDSSLTAKSVAVKIGLTSDKARVVTGGELDSMSKEDLKKALAGEIIFARVAPEQKYKIVSTLQEMGEIVASTGDGVNDAPALKKADIGVAMGVTGTDVAKDAADMILTDDNFASIVAAIEEGRTVYSNIQKFLIYILNSNLPEAVPSALFLFSRGAIPLPLTVMQILTVDLGTDMMPALGLGSEKAEPGIMDKPPRARDAHLMSKTVLWKAFAWYGLIASIISSGAYFFVNHLNGWPLKGLATSGNTYVMATTMTLAAIIFCQIAAAMNCRTENASVFKAGLFANKLVWFGIVFEIFLLALLSYTPFLQELFHTGPLAPTDWIFLAIIPIPLFLIEEGRKWLNRRRLAAKKVDVVD

SEQ ID NO: 2743 - protein, 214 aa, Lactobacillus paracasei
MHTRNITDLFSASLAKSNLSAKQQAVLKASLALFASQGFDRTSTKEIAETAQVSEGTVYKQFKTKDGILQALLAPMIRQVMPNVLTEFVNEVGEQDLPDLHTFLTFIVHDRMQFAIANQAQLRVLAATVLRDAALGQELAEQFNRELSGKAARLYATYQANGQLVDWPFNRVLRAIFGTVLSYLLPLIIGEQSAFDLETAVHEAVEFLERGLRA

SEQ ID NO: 2744 - protein, 62 aa, Lactobacillus paracasei
MLGWLQPIAHIMPLYYGANALTGIIAKGQSLAVFYPDVVALLGFFLLFLGLNLLTMRKYRQV

SEQ ID NO: 2745 - protein, 103 aa, Lactobacillus paracasei
MVDFPGPVRSVTVDHGKEFSCDQALTKRYRIPAYFCHAYHPNERGTNERFNRELRYYFPKGTQFDQVSETDIQQATALINNKPRKCLRWQTPVQAVSKPLSRW

SEQ ID NO: 2746 - protein, 66 aa, Lactobacillus paracasei
MQKGTVKWFNADKGYGFITGEDGQDVFVHFSAINGEGYKSLDEGQAVSYDVEQSDRGPQAANVTKL

SEQ ID NO: 2747 - protein, 145 aa, Lactobacillus paracasei
MSKSSLWVRKHHLVLALSLLLGSVVFLAIGLWATILLLLTVQPTVSLILVLLGGWLVLGGITASAITLWQIIRSPQKVTRGVRRLQWLLGGITIIIAAISLTFSYLWAESGDAPGLIFIGLFVAAMPFACWVLVSVWQLTLKQQA

SEQ ID NO: 2748 - protein, 146 aa, Lactobacillus paracasei
MAERSLYHTYVRNENGLVGESYVEGNQGLALGVSSSLIDAPGTNPEQFIAFALSTCFNATIRIVQHREGTAEDSQLRTRVDITRDKIGYKFIVDAQILMPSHTREEAQKIVTQALDECPVAKLLKENENVSFRIVDDFTDEPTLGE

SEQ ID NO: 2749 - protein, 493 aa, Lactobacillus paracasei
MSTIQIKQLNFAYDGQAPLFTNTTLDLDTNWHLGLVGRNGRGKTTLLRILQQTLPYSGTVTVPLQLQYFPQTLDETQLTLTAAQAITDVAQWQLERELNLLHADPNILWRPFVDLSGGEQTKVRLALLFIQDNGFALIDEPTNHLDLRSRRQVAAYLQQKPGFIVVSHDRDFLDSITDHTLAIQRQQITLYQGNFSTFMTEKERQDQTELAKNGQLKTEITRLKRTAHDKKVWGENKEKSIYGNPHIKDSGHNAGRGFISARAARTMKKSKNLEHRMTKEIDEKESLLKNLEKVDPLTMLPVSTHHHQLVVAEKVQVGFDQPLFQPISFTLTRGDRIAIVGDNGSGKSTLIRALLKQFTGMQSGHLTLAPVSLSLVRQQYTDNRGTLVDFAKQHQLSRETLLNNLRKLGMPRADFNTSIEHLSMGQQKKVELARSLATPGALYVWDEPLNYLDTYNQDQLVAAIKHYQPTMLFVEHDEHFIEQVATKIIRLQP

SEQ ID NO: 2750 - protein, 207 aa, Lactobacillus paracasei
LKIFVVGAHGQIGQLLVHKLLDRGDTVTGGYRDPIAQTPDPEKNFRAVELDLSWPVDRLADLYAGHDAIVFAAGSRGQDLLGVDLDGAVKTMKAAERADISRFIMLSALDAEDPDKWPDQLHDYYIAKYYADEWLIHNTDLDYVIVQPTALTNDPAKGSITLQPQRPSTISRADVADVLVAALDSNRHRDTVKIASGNEAIVKALHV

SEQ ID NO: 2751 - protein, 281 aa, Lactobacillus paracasei
MKTIKIGGVNVPIMGMGTWYLGEGNAAESEQEAAALKYGLNHGLTVIDTAEMYGNGAAESLIGSFLGDYDRANIYLISKFYPSHADKRQMRTALKNSLKRLRTDYLDLYLLHWRGSTPLAETLEGLQDLQKEGLIKQYGVSNFDVDDMDQLTLEPGGDQIAANEVLYNLQSRGIEYDLLPQQKQANITTIGYSPFGSGSGKSIKLPPELRTLAKEKNISTHQLMLAWVLRHGDVLTIPRSGEASHMAENIAAADVTFSPDELALFDQAFPAPRHHIPLEMI

SEQ ID NO: 2752 - protein, 451 aa, Lactobacillus paracasei
MQMIALGGTIGVGLFMGAGATIKWTGPSVLIAYIIAGLFLYMIMRALGEMLYIDPATGSFAKFASEYMHPIFGYLTAWSNIFQFVVVGMSEMIAIGEYFKFWWPGLPGWLPGLVAITFLVLANLISVRMFGELEFWFALIKVVTIVLMIIAGLGVILFGIGNGGHPVGISNLWTHGGFFTGGFKGFCFALSIVLGSYQGVELLGITAGEAENPRPTIVKAVKDTIGRILIFYVGAIFVIVAIYPWNQLSTLGSPFVQTFAKIGITFAASLINFVVITAALSGSNSGIYSASRMLYTLADAKQLPRIFTKLNRHGVPFYPVIAVGGGILLGVILNALLPYIAPAAKNVFVLVYSSSVLPGMVPWIVILVSEIRFRKVHADQMANHPFKMPFAPYSNYLTLIFLAFTLFFMLLNPETSVSLLVGVVFLGLVVLHYLLYQRRKPATQPVKANRQ

SEQ ID NO: 2753 - protein, 743 aa, Lactobacillus paracasei
LDNKNKFTASLNAYMAKHKLNTNATSAAMGVSVPTLRKALRGQSVSRKTAAKIESIIKSGKVPAEAHKTATKAPAKKTAPKKPAVSKQVKPAATAKQPAAKAKQTKSAEQVSASKSATTPKASRVQTKRAANQQSQATSQTPTAPQTEAAASSKPARRTAKRVTRSTVTSRQNQRPNNQQEHNNNEQTPKQTPVQKKIPTRQHRFTIRQQPDVATQEAEAEAKKRQTEANRSSVSASSSSSQQSTEQRHDNQTERHIKKRTVTAPRRNVNKTDHEPARRDNGYTRNNRNKPNGNRQPNRTRQNRFAANADPQNWQPMTQPAASSASQSMTAKASTDNRHVPAVVNHVETHTPSVIRSTSNDRNGKYNSANTASSSTSDTTSQQATTGTNMHTNYGTHDEAPLVAGKQLQLFIDESFEEHRPDPRTMHMGIAAIFPEGDDDSLIGFRNALYPYGWEPGDEVKARGKQVDALTQLIKAADHENMGMYTVFSQKTTYPDFAPSMEYLYPYIGATIHVLRDVDTTFDSIVIMIDHRNELEGNQLVMGADIVSRYLTLSLERPIKVRFEFADSREHLGLQLSDFVANAALRLSNDELSLIGITPMPELGVSQHDQLVRLTLLGLQQVVMGVRAERAATPSKHSQPDRFMQLIFDATYADSDQVRGALPVVKNAVEQLIDVLPNARVGQISGMPNQSWYDMTARMAGLLRYINKDPKPYGRVLAKIESVTKTAADELEMALDSDDKAKH

SEQ ID NO: 2754 - protein, 660 aa, Lactobacillus paracasei
LNQVVIFGIMLAIVILGNILARHVPKIPLPFFLIGLGAALAVMPSLRNFTLDPSVFSFAIIAPLLFNEGQNASRIQIGRSLTNIVSLAVGLVLVSVIILGFGVHALFPIIPLSLAFALIAIVTPTDASAVSAVAQTNPLSDSQMQLLSNESLFNDAAGIVAFDLALTAYVSGQFSPTDALLDFLFVFFGGILVGAVLGMLIVNLRAWLIHIGDDEPLIMVGIQLLTPLLVYFLAEELGLSGILAVVASGIAQGVERDRLRLTSARMQIVSANVWEMVAAILSGLVFVLLGLSLPNVIVSALRGQAGLFSLLVGIGIFIYAAKSLVRLLWSRTLLRTGKKHRWRNAVIMMLGGANGTITLSLAFSMPQIVNGHSFPLRQGLILIAATVILLSLIVPVLVLPFCVPKQPKRNRQYVWLRRMLSAGIDAMRDESVHHSEAQIVADALSQEMILNDKPSRRMQRDIFDTTIKVEKRTIEALRVNGTITHDEAHYYNRFIDLNDFTADQRTWKNLFLRLRFTFNMGRMYKGLDEAQNAFLTTPLNLEPIFWKRQFTEHGEDLLPIEQAGYDAVMKYLASAENSQNRSAINIVRRFYRDRHRRVHTDSFDGDVLYAMFLKAFHAEFEFIQAAFAEGKLNREIMQRLQTRITFDEITYLQNQNSFIA

SEQ ID NO: 2755 - protein, 135 aa, Lactobacillus paracasei
MRIAKQLLTEAVIGIMIGATVYLTTLMLHLDTINPTPRSIAGLFIMSAVIGILSSIFDLDWLSLPVAYGTHFISTFLIVLATNYLMGWQFLIGSALTSFIISFIVIYAFIWIALYLSWRVTARKMTRILKKRLKK

SEQ ID NO: 2756 - protein, 150 aa, Lactobacillus paracasei
MKVSFDQDPDLNPDDIEVLIKAARLSPAVLQLLQQIQQLSDNRPTLPLTVGDRVVVLAVNDIVAIEVYGDELTVHTMTKVYTSRGQLKAIRAKLDPQLFIQVAKSTILNINYLTSLEASFSGNMTAFMSNQQKLTVSRKFLPDLKRLLGL

SEQ ID NO: 2757 - protein, 288 aa, Lactobacillus paracasei
MLAFIKRNLLLFFRNRAGVFFSVLGALIAFVLYLVFLKKNMTGLWPISHPEKLLDPWLIGGTLTITAVTTTQDGLARMIVDRENGNLSDYLLTEASYLRIQFGYLASAVIIGTIMQLLMFGAMSGAFALLDHVVIPWQLTGKIIALALFSSVVWTSFNLLILSFVSRVTTMSGIATIVGTAAGFFAGVYMPIGAVPSGAQALMKMTPFPYNAAAYRQILLQQPLATTFTGKQEAARASFEKMLGVRIDVNGLLSSSHTYLILIGFTLGVSILIFLLARFSRKAALARV

SEQ ID NO: 2758 - protein, 297 aa, Lactobacillus paracasei
MAILEAKSLTKTFGPKVAVNGINLTVDRGQFVAFLGPNGAGKSTTIGMLTGLIQPTSGTITVADHTPGQVAYRQQIGVVFQDSVLDRQLTVNENLRLRARMYQHPDTAWFDQLIKQFDLAPILNQTYGTLSGGQRRRTDIARALLNHPQILFLDEPSTGLDIQTRQTIWSALAALRVQTQLTVILTTHYLEETENADFVYVIDRGEIIAADTVVDLKNRYAAHQLTIQTTAADRVKTVANQAGLRANIVANEVHVNIHHPQQAIALLTELTDTITDFEFHPADMNTIFVTLTGKEIR

SEQ ID NO: 2759 - protein, 259 aa, Lactobacillus paracasei
MAKSAKRWRRVSISVLVILLLASGGYWLWWQLGSRAIHQQTYRHTGIVTVFVPGYGSNSLTFGPMVQRFKQDKASDQVTTIHVSADGKRTITGADRYNGKNPLINVVFADAKSPQKEVRQLTGLLHWLRVQRHVTRVNLVGHSMGSNLSFNYMTTPHANLQPQVINYVSFASEFYRDPTTQIRALPKTLHILVIGGQVFGAKGDWAVSLAGVKRLAAKFKAAGLSTTLFVYTGTPVGAYHSTLHQNPYVDAEILRFLFT

SEQ ID NO: 2760 - protein, 125 aa, Lactobacillus paracasei
MAVDINGLPQAILVTRANVSDRSGALAMFSLASQTLELVQHVMVDGDYTGNDFADQVKLILNAKTTVAKRNELHMFTVLPQRWIVERSWSWLDKCRRLWKNCERALNSSLQMVVLAFLKIVLKRY

SEQ ID NO: 2761 - protein, 46 aa, Lactobacillus paracasei
MYVEKCWDELWVAVKFQTNLEIAGSLRNSFRVSLGGWIMEVEHCLN

SEQ ID NO: 2762 - protein, 143 aa, Lactobacillus paracasei
LKDAKNVTITDSEWMVMRAIWTMGHATSRELIDAMNELEGWSASTTKTLLHRLIQKQAVAQHAGSRPFTYKPVVGEKESMAAAADDLFDHMCAMRAGSTIAGVIQSRELSRADIANLQAILAEKAKTAPEEVQCNCLPGDQTC

SEQ ID NO: 2763 - protein, 755 aa, Lactobacillus paracasei
MANKEDHMNMKNMSAKNMENNESNMSHMDHDDMKMDHDMTETDHNQMNMDHDMAEMDHGQMNMDHSQMNMNHETMNMSGMNHGDMDMAGTDMMMHGGSMMHMGNLKVKFWVSVVLAIPVLLLAPIMGLNVSILSFSSPLIVGIIIVLFDTALYFYGGMPFLKGAKAEIQDKSPEMMTLVTLGISVSYFYSLYAFIANNFLNPANHVMDFSFELATLILIMLLGHWIEMNALMGAGEALQKMAALLPKTAHLVTDNGETKEVPVSDLKVGQAFQVRSGESIPADGVITAGESTVNEALVTGESAAVTKNVGDKVIGGATNNNGTLTVKISGTGDSGYLSQVMKMVQNAQQAKSKAEDKADLVAKYLFYAAFGVGIIAFFAWLPQGLATAMTIMVTVFVIACPHALGLAIPLVVSRSTTIGAQNGLLVRNRQAIEASQHVSHVLLDKTGTLTEGKFTVNALIPNDGIDETTLLSRLAALENNSTHPLAQAIITEAQAKDIEVVAAEKSQNIPGVGISGNVDGTDYTIVNGNYLTKQGIRFDEAAADKWAAKGNSVSFLLQGTQVQGMVAEGDTIKAGAKELISGLQRRGITPVMLTGDNPKAAEHVANLLGLTEFHAGLLPDDKQKIIADYQAKGNHVIMVGDGVNDAPSLAAADIGIAIGAGTDVAIDSADVVLVKSEPSDILHFLDLAKITNRKMVQNLWWGAGYNIVAIPLAAGVLSFIGIILDPAVGAAVMAMSTIIVAINAMGLTGEKIKNV

SEQ ID NO: 2764 - protein, 86 aa, Lactobacillus paracasei
MIQQSYPAEELGRILGVLNSLLNLAGPIGLIFAGPLADVIGIERLFVIAGIGAAICGVVAVLMPITRQYDIRLHQKLAKLTEQPDK

SEQ ID NO: 2765 - protein, 59 aa, Lactobacillus paracasei
MTKQDETHRVMFTLTDQAIAKLDQLVAKKQQEVNQNPDLAKYHVRVTKSNIVEDWLSKQ

SEQ ID NO: 2766 - protein, 109 aa, Lactobacillus paracasei
MEIKLINTCKIKDTVTLSDDTKLTYILEAEPRENGKFIVKLNIIETDNPELEKVKESGQNIIFAFGTDGTDESDSYQLKDGEDRLVMENISSFNGSGANSVRDDHLTSY

SEQ ID NO: 2767 - protein, 180 aa, Lactobacillus paracasei
MRWVHHYGPIFKALWRRHQTAHAKSWRIDGTYIRVKGRWAYLYRAIDSNGLTMDFELRKHRDYTASYHFLKRLLTTNGRPDRLVTDQYRATLKAVKHLIKQDYLSKSTHQCSKYRNNLIEQDHRFIKRHRVRSASFQSIRTASATLSGVEIVHAIRKRTRRELSLIGFSVVDELEALLAA

SEQ ID NO: 2768 - protein, 108 aa, Lactobacillus paracasei
MAQEILITTTENIPGKKYEVIGEVFGLTTQSKNVISNIGAGLKNIVGGEIKAYSDMLHESREKAIERLRDEAQKAGGDAVVMMRFDSGSIGGDMQSVVAYGTAVKFLN

SEQ ID NO: 2769 - protein, 302 aa, Lactobacillus paracasei
MLGYGFSHAGGPEVIDAIDLATPAPGPQEIQIKSQAIGLNNRDRIARQMGGSGLTVPGYDVAGIVSAVGDQVTQFALGDRVVARTTSAYAELVTAAADMSVLLPESITPENGVALITPGVTGYRMVELGHIHDGDTVIVKGASGGVGSAAIQLAVARGASVIGIAASRHEVDVNQLGVEHFVAYDRGNPVKELAKTADVVINAAMDGIGGDDDVAMAKDNGLIVSVSHHEPLLNRSIRFIHTRPLGGSEVGQALKVLINLMSQGKLTVKVGYVLPFTREGFVKGHQLLDEPHEGRIVIQVTS

SEQ ID NO: 2770 - protein, 438 aa, Lactobacillus paracasei
MNLADTGFVIIASTLVWFMTPGLAFFYGGLVSKRNVINTMLSVFYITGIAILLWVAVGYELSFNGDLFGVIGQVHHFFLSDLSLGAVTTAKIPTGVYVLFQMMFAIITPALFVGAVVGRMHFKFLTCFIVLWSLLVYYPLVHLIWSPHGLLAGLGVLDFAGGTVIHINAGITALTLSAFLGRRTDEHITPYNRPWVLLGTAILWIGWYGFNAGSALGVNQAAMTAALTTSVGAAAALVTWMCLDIWQTGHPTLIGTCTGALCGLVGITPATGYVTSFGAACIGVAATLTSYWFISKIKPRLGIDDTLDAFGCHGVAGIVGSILTGVFASKQVAPDIAHAGLAYGGGWQLLLIQLVGTAIVIVLVGAMVSLITVVLKQFVSIRVSPAAEKMGLDYSEHDEPVDETVAASWARGTYVSQNPDEFKGQLHGFDPQPRRENR

SEQ ID NO: 2771 - protein, 313 aa, Lactobacillus paracasei
MTINLRDVQDVYKDAGSDIIFATLDLKREDAAADKAMIADLAEHLPAFTNSMNIRYPDAKLAVAFGLSRKAWDYLFPAAPVPKELEEFQPVVGPKYTAVATPADLFFHIRSQNSAVPFELMSEIMTIIGDQTVTLDETHGFRYFEGRAIIGFVDGTENPSALDTPEYAVIGDEDPTFENGSYAFAQKYQHNMQAWNDLTTEDQEKAIGRKKFNDIELADEKKLPNAHNVVSQDNDGGVEHKIVRMNVPFSNPAKNENGTYFIGYARHWMVTKRMLQGMFDNSDRLLDFSTPETGELFFIPSKSVLGKIAEGEL

SEQ ID NO: 2772 - protein, 223 aa, Lactobacillus paracasei
LIISVADQAELVIRLVVAALCGFAIGYERKNRFKNAGIRTHMIVALGAALIMIVSKYGFFDILDLKNMALDPSRVAAQIVSGVSFLGAGAILVRHNNVNGLTTAAGVWTTAAVGMAIGAKLYLIGLAATVLVLCIQVLLHHHYRWLPSGDNGILTIRVRSEGFDMVHLRETLGKYHIKVLNVSIKHEGDEVKMNLHVESKANEDMRRLLTFYADNPNIISIEF

SEQ ID NO: 2773 - protein, 272 aa, Lactobacillus paracasei
MNNLITFILILAGMVLLLLRKGTKRQRRANRRLATTLLLFGLASGGYAYTQQHTSLLGTPPQSSSVSNSVPATDATSRQPVTQLTQLNYNNTAEITVNNNEPGFTKAELASDKGPWTTFSNLDSLNRAGTANALLNQAIMPTAKREPLTWNPTGWHNKKVHGEWLYNRSHLIGFQLSGENNNPKNLMTGTRQLNSPLMQAHEDDMAHYLKQSRQHFIRYEVTPIFRGDELLPRGVAMRAQSIGDNTIHFNVYIFNVQPGVTLNYADGTSQLN

SEQ ID NO: 2774 - protein, 76 aa, Lactobacillus paracasei
MNRFRNYTVNRFSNNGDKIESDARSILIPEGTLAEDAAYGAALNAFKVNFKVSYSIDQATLAANVYRNMIQGHLEN

SEQ ID NO: 2775 - protein, 173 aa, Lactobacillus paracasei
VNLTTYWKYLHTIVVLAVLFLISLVFASHTMIQTLLGVGSLAWFLLFLIREIYMNSKQTKRTKFQVRLSHVLIIFGLLLFNASVHQTFISTFGQSDIDQFWGEHEAAIHMNGKAYHLIWTKRSFLSTTYFYNLYERRGLFFYRVNSNVISYVTHPSSQADYGAIETFLHHSKK

SEQ ID NO: 2776 - protein, 62 aa, Lactobacillus paracasei
MTKTNIKVISSGKTIDELIKTTIEQLKHNGYKFLAIALAQQTEFYRTDAERLELVKEYVTLI

SEQ ID NO: 2777 - protein, 62 aa, Lactobacillus paracasei
MDEFKELSATELQKVTGGGNWLSSAIDWYNCHNGDCNPVPTATMWSLRFRQYAEFMQLSHTC

SEQ ID NO: 2778 - protein, 66 aa, Lactobacillus paracasei
MMMYPYLNLGPRDGILLVAVLVPLVLTLVFKWSLLEFVLSVIAVIVAFLAGSMKTDKKNVLAFLKK

SEQ ID NO: 2779 - protein, 52 aa, Lactobacillus paracasei
MMLLNYGQSSTPTDLVTISEGASSPFVPVSEPRLNSDPDTIPPPIDAYLANT

SEQ ID NO: 2780 - protein, 91 aa, Lactobacillus paracasei
MTFPVFKKGQNVRLKIARHAPVPLVLNGKITQIDSGPAVTKDTNVFKVTAQVNITSKQARILRYGLAGEFSIITGKKTYWNFLKDQLLNKS

SEQ ID NO: 2781 - protein, 69 aa, Lactobacillus paracasei
MVAPLGMSVSAYTKSLAVKAKLRESQFSHEETINLAFHRPGNNLKQLPYYAKASDLRVNLNDLPILKRR

SEQ ID NO: 2782 - protein, 49 aa, Lactobacillus paracasei
MLLSQFLPLTSAELANIVGGTSFVPAEEGEPSYFFHLLPYPIDVPAKDS

SEQ ID NO: 2783 - protein, 234 aa, Lactobacillus paracasei
MNQVIRLMKRIALSPLFWIITICSSIFFLENSDLSNYFLISDFATNFPSLSLSGQYYRLLTSLFLHTGITHLISNMFLLIILTWVVSPIISKALYLSLLLLSGVLGNLLADVLIVSLVNSDGNYWSFLTTFGYSHGIVGLSTSITGLYIFALIIFVFKTSKNLPQKKFRLSALIFVSFIGILSLILNFIWGQWFTITAYVHFFGGLVGGILAFIFLYRQHKKLGLKTHDINPLK

SEQ ID NO: 2784 - protein, 95 aa, Lactobacillus paracasei
MANKVERESNSTPLTKKQKSCQYCQEPHKPIEAEDGSFLRIGMSGGNCWDGVHPEKINGAAIHTCTAVGFDNAEVDEPIAINYCPMCGRRLEAKQ

SEQ ID NO: 2785 - protein, 245 aa, Lactobacillus paracasei
MTTEADALKFTAEQAVTANGKRIIETKNRQFLINGNGDIREFRPNDGANEALQVHTLTAVVDYIGKVSERSASPLIVQVVDENSVFVLGELDDFGNREVLIKAKAMHPCYPYGQWLDSESFIIALQAQFMTTEDGKVLLKFVGNLKDESAQTMVDDGVSQVATARSGVASVGKVVVPNPISLRPYRTFLEVEQQESDFVFRMHEGPKLALFSADGDAWRNTAIDLVAEYLSEKLVKFSKHVTGLA

SEQ ID NO: 2786 - protein, 140 aa, Lactobacillus paracasei
MDKLNLNLNELADGAIKEKLTKALAQVTNNILDPNTDQSKARKVTIALNFKPDDSGVVKLTTDVKTTLVPDISVTTNVLLGRGEDGYMEMNELKSGTRGQEYFDPDDSTLKDDKGIPIKDDKVTDAPIDFRKIKNAKEAN

SEQ ID NO: 2787 - protein, 172 aa, Lactobacillus paracasei
MKEYVIMDTEFNSTSNRAIQISAVRIRDGLHIADQFNRFIPSPDKFDQLHIIRTSNMRYSDYLALPSLQQTVRDYVAWMRTTIDIVGWSIEGDAGRIRETFKKGSHGIPKNWKFIDIADIVEKRYSFNATPPLQGLANVLGIPVNRTHNALDDCLRIFGVIKALESRDGKLF

SEQ ID NO: 2788 - protein, 274 aa, Lactobacillus paracasei
MSNLETNQGRLAAIETFAERCPDCGSLLYRPKGLSKVTGKKMAGVCMNCGYKQPPTEPKNVTPDMEKEARKNRTVGYYLAYSVFSTDAIIAKDFNNFHTDGSLGQQQLKLFAVGLSNKICRNEVVHALIIGDTGVGKSHIANGILIDTQAKTGYRKTCLFIDWNALMQRLKSGMSANAQDVRMKNEKIMHEIGKADVVVIDDLGSERGSDFERQTADDVFRMREDKATIVTTNLHGQDLNKRYGERTMSRMAKHGQGNSFGVKGILDQRKEALP

SEQ ID NO: 2789 - protein, 248 aa, Lactobacillus paracasei
MNEKPGYYAIIPAGVRYDKQLPQGAKLLYGEITALTNKNGYCWASNDYFAKLYSVSIGTIKSWLKCLEDNSYIRRVIKYKSGSKEVEQRFISLAPRSENLPPSVRKLTHPRSENCPENNTSINNTTTLGEPELINFWEKNGFGFISPKNREDLMYWVDDFKKIGSTDEQAVQVVKQAMSNAIDNNVRRYSYVNAILKNWESLRLTSLEAVTAYEAQRTQRQKSKSTSRQASTDVYQNQGDVQDEDLPW

SEQ ID NO: 2790 - protein, 104 aa, Lactobacillus paracasei
MAREIGKQPDRLESLAYKVRTDQYLLDYLREWAETKCDLFRDDDPHMTDGEKIQDRLFLKDNFKKYMDILGQTSLDMIKFEADLMDVRQNIADQCFHEGGVDHE

SEQ ID NO: 2791 - protein, 181 aa, Lactobacillus paracasei
MNKYELFSSVVQALTSIVAVVLSTIALIRSSKSERDANKPYIVSFLKVVRSSQTTIIYLMIKNFGRTGATILSVKADPAIDSGQLKFENNPFELFSNQLIAPDQTYAAVISVKNSEIELKTRKFSLSITYSDEFGKKETKDFLLNADVATSFDHITPVPTKTDEVAKSIYITSAERLFNQF

SEQ ID NO: 2792 - protein, 67 aa, Lactobacillus paracasei
LNSPETKLNKKYSPIFGDGISVSANDVQMAVDGIVATLSRHTSNLAEAKAILDLIDLDQYAELKLIK

SEQ ID NO: 2793 - protein, 30 aa, Lactobacillus paracasei
MIGYLLIAGGFGVIVGHCLGHSGNWRKWIE

SEQ ID NO: 2794 - protein, 118 aa, Lactobacillus paracasei
MPLLQVVEDDQISSKKYLAVEEEELAKMIEENQELKRKLAARGMWTLTTATSYVEGHNNTWVVNNILNVPRFHKFLQDTVVSYPPPGKKGYLFHPKPWLDFLDKWFPEISRSLREKGK

SEQ ID NO: 2795 - protein, 83 aa, Lactobacillus paracasei
MVQVPYYDNPGGALAVTVELPHAANVYLVDQANFNAHQRGDHFTYFGGHYDESPVTIRVSGAGRWYLIAENGSGEQYRYTWSK

SEQ ID NO: 2796 - protein, 246 aa, Lactobacillus paracasei
LNEPQPIEQNGQRVLTTEQLAELYGTTVGVVQMNFKRNSNKFIEGKHFFKLKGEQLRAFKNEPTNCGFVGKNASALYLWTRRGAARHSKMLGTDQAWDMFDSLEENYFNPKTRLPQTPEEKLALTMEVATRTVKRIEKLDGRVTDLEEKALLAPGEYNYISKQVNRAVANYVDVHHCKLNAKQRSLFYRDINHGLNDYIGIKTRTQLRKKDFDKADDFIQNWTPSTATLMKAREISLLEDQQQKAI

SEQ ID NO: 2797 - protein, 277 aa, Lactobacillus paracasei
MSKPIDAVAVENISKILGEYTTGPKITKMFSLLGFFDYDLQRQTDNQWFKASTKWRRLDETIRHECNASHNSRPFFRAIQYIARPQDFISKPEEWGRLRYEINECLIFYGYCLDDSGRIASAKTATTFSEAQLRLKTLSARLTELNVHPLVMKFCNEQFLQGDYFHAIFEASKGVVNRIQQLSGIQKDGNSLVSTVFSDKQPILVIKGNMLATETDRDIYSGLRNLLRTVIFLYRNPKAHTPKIYDPSSVDDAVQAFVIMSAAQTMLDSVVNVRDFL

SEQ ID NO: 2798 - protein, 66 aa, Lactobacillus paracasei
MIKPIDAIRNELPVVTSKTLDLFESAVSQELQKRNPKATFQVSILGMAVLGLLVATRLEEVSDINN

SEQ ID NO: 2799 - protein, 82 aa, Lactobacillus paracasei
MVNVQLNWTANRNDWKGYLLHLNLSQLDIAKFLGISDQVMAILVKKMTDGQGLTANQIDKDRWKRAIEYVKYKQSQQKKMTV

SEQ ID NO: 2800 - protein, 117 aa, Lactobacillus paracasei
MSTYDRIKTLASNRGWSLQKLALKAGIGINSIYRWKKMTPSTENVQKVADVLQVSVDYLLGNTDNPNPDNEGSKPVDLSGTNIFTYQGQPVRQDDWEIIQAILERRNNSSKKRDRHE

SEQ ID NO: 2801 - protein, 143 aa, Lactobacillus paracasei
VIVMNDHIEDLLNQVIDYAWDHNIGCSTIPLHEDQGPLVDTEARLIILNNKWPNANELPFQAAHECAHILNGDNGKLRYTNQYTKSRTENGANQRALSIIVPMYFADIPEESANIDQFMNDLAIPQWLEDSAVQCIERFYENY

SEQ ID NO: 2802 - protein, 207 aa, Lactobacillus paracasei
VKDKILILVAGAPGTGKTHSVNIIRQAFPALRTLTLDRFKEDIWDEIGFDDIEQKKSLNKEAQLRFIRAMRRLMIWEKPIISDYPFSDKQRDDIEKIAADYSYHVITVRLEAPDQVLYERQRHRDLFDHRHPGHLQNAYHLEDQAKGTAKLDGMSTFEQFQKRLRKRKYDKFYIGDLLKVDVSDFQQVNYQRIVEQLSESIKQVERT

SEQ ID NO: 2803 - protein, 285 aa, Lactobacillus paracasei
MYKNLGEMLRGAQALNYTVGAFNAHNLEMVPAMITAAKDAGAPIIIQTSVGTAEYVGMKNFVAICRSMADDLLVDVGLHLDHAKSFDAIKSAIDAGYSSVMFDGSALSLRENMERAQRVVDYAHARQVSVECEIGTIGGTEEGVTIAEGKYTDPAQALTFLENVDVDALAVGIGTHHGQFKSKTKLNWPLIEMLHAKISTPMVIHGGTGVDEDDYHRLTNNGFRKFNVGTELLVNWTRVAKEMFGKTEVNSSLRNNILPCNTAVYNIVRHKSELFMNVENQSVVS

SEQ ID NO: 2804 - protein, 254 aa, Lactobacillus paracasei
MDNKVVVITGGASGMGAAMATDFIQRGAKVAVFDLDSKKAALLEQSIGSQSFAYYQIDVTNKAAIETATQKVEQQFGKLTSWVNSAGVSKMVPFLESSEALWDKTIAVNLKATFLCCQVAITHMLVNGGGEILNMSSLSGKKPSSWQTVYCASKFGVQGLTQSIAKEFADQRIRVNSICPGIVPTEMWEDLKYQYAKKRSLQPDQVMDYFKKNIPMHRLVNIEDVINAAVFLLTDNSSYLTGQSINLVGGEWMD

SEQ ID NO: 2805 - protein, 156 aa, Lactobacillus paracasei
MQNLVLTRIDDRLIHGQVMTAWIKERKATQVVIVDDGTANDDYMIEVLEMAIPEEIAIGIFTKEDGVRFFSRPLSEPTILLVKGPEALNYLVDAGIHIEKIDVGGMGSRNNRSVLYKNISASPEERMTFQELVNKGVKVFVQVMPKDKPTDITKYL

SEQ ID NO: 2806 - protein, 158 aa, Lactobacillus paracasei
EIIABCMPNENTMVTMILISHGQMCEGLLDTLKMVGGDDFGIQTLPLLPGVTPENYRESLHQILLSVTKKDDEVLVLTDIAGGTPYQSALYLARDFKMKVIAGMNLPVVLTLALEQSCGASLSDLVKKAQNPETLGFKIETFETKRRDRHAKLSVNEN

SEQ ID NO: 2807 - protein, 564 aa, Lactobacillus paracasei
MVISAILVALLATMGQWWFFGPITKCLVYPLTTGVLVGLFMGDPMTGMLAGANIQLIYLGYISAGGTMPSNTIVAGIFGTAMTILSGANPTMAVTFAIPFSMFGLLLNNIYMTVNAAWIHQADRLLDKGNIRGVRLMNFVPSFVIAAILYGVPAFLLVISGQGWAKDLINAVPKSVVSALEVVGGIMPALGIAMLLNYLGKRSLIPWFFAGFFLTVYSGVSLMAISIFSAIIAILLYIRDRNSNNQNKKTANKRKGVRRLSVDQSVEMSTTDGSASMTPSVTPIASVEPKYAKKLSKRTLIQTWLWTTSTEAAYNYERLQALGIANLMITPIRKLYSSKEDQVRELKKYMVFYNSEVFTIGPIVNGIACSMEEARANDADVSAEDINAVRTGLMGPVAGIGDTIMQGILYPILFGIGCSMALDRSYLGPILATVVFELLIFGCGYFMFMTGYKQGKTSLLRILKNGTIDKIINSFSIVGLMVVGAMAATRVTVDTPLAFKIGDGATKLQKVLDSLAPGLIPLSITLGILFLLRKKVNTTLIIVLIFIIGIVGYYLGILGFSAKM

SEQ ID NO: 2808 - protein, 334 aa, Lactobacillus paracasei
LKAGFYVGDYTYEVREVPDREPQKDEVKIRVAWCGICGTDVHKFQGKNGASVVIPPIILGHECSGIVESVGPEVVYFKPGDRVACDPSYGCGKCIWCQRGFPNFCLVRHGVAKGLADYVFPPEQNVYHISDSLDLEDAAFTEPLSCAIHGVDLMQMASGMTTVLYGLGAVGSLILQLVKETGQSNIIVVEREAKKRALALRLGATEAITDQEIEAVAKNKNIDYVYECIGLRSTMEQAIQIAGKNAKVMLFGLGDPDQPIKFNQFEAYTKELSIYTSFLNPHTSARAVSLLERGKIDTRQIISAEIELADAGKELATQENLRNGKVMIRLSGEH

SEQ ID NO: 2809 - protein, 252 aa, Lactobacillus paracasei
MIIQLNQEIFNSLSASEHKVIDFINNNADAVQTMSITNIARKTFTSVATVSRAIQKAGLNGIAELRYQISHQIKHANESESPYKVNTILLKSFREAKKTIDSISISGILQTVNYINKADRILIYARGFTALIAEEFQQDLQLLGYNAIIMKDVMWIKQTRRFISKRDVAVIFTVRNSTPEILESAETIHAIGAKLVTCCCIAPTKLADYSDVLISGHSELIMRTHGLEVYSKVPLFIIARTLIEYIANTQSK

SEQ ID NO: 2810 - protein, 105 aa, Lactobacillus paracasei
MKALYKGRPAYVWEISKTGERPDWIEEALSKNNIYWLDNRVRILMTALRPPVVKKLKMGEGGTIGGGVDALGVYAYGYVGDFLDATNQRVVSKERFLKHYQVLGV

SEQ ID NO: 2811 - protein, 105 aa, Lactobacillus paracasei
MKALYKGNPADVWEINKTGARPDWVKEAFDENYLYWLDDHLRILMSGLNPSLATNLKIGAVGTIGGGFAGYGMYAIGYPGDFLDVTNHRVVSKKKFLKHYQVQEP

SEQ ID NO: 2812 - protein, 72 aa, Lactobacillus paracasei
MKHKGIWLINGLLALFAVPIAVMILIRRVDGSGYVETGRSRLAALAVLGAAVLIVILCELIYLLMAHAVKKG

SEQ ID NO: 2813 - protein, 185 aa, Lactobacillus paracasei
MSDLSLGSRLKQLRKARGMTQSQLADDLFVSRKTVSSWETGRNQPDLQTICRLASYYQLTVDDLLHQQSVPCADDQRPITWLGPALAIILMGRLGFVALPEMLVLSDVVVIALAWLLVSWWQRYMHLRTIRWACSLLAVTFIVAAGLNLFKMDFGLQLIYLAAAVTLLIPIAGTALIKKIRSRPT

SEQ ID NO: 2814 - protein, 232 aa, Lactobacillus paracasei
MTVAIFGHRGYPARFPENSLQGFEYACEHGIDGIETDVQMSADGHLVIMHDERVDRTTDGSGWIADLTRTQLKGMRLANGEHIPSLREALTVLSHYDVMVNIEFKTGKIRYPGIEALTQDYVEQFNMQDRVIYSSFNHDSINVIHTLAPKMKTAWLTSRVLRGASLPAYLEAVHIEHYNSRLNKAQRVWTIDDPLKMKKLFAAPYVTGLITNRFEEAMDMRALVEQGSGATV

SEQ ID NO: 2815 - protein, 139 aa, Lactobacillus paracasei
MPQVYFLCTGNACRSQMAEGFAKKLLGSDWQIASAGIEAHGLNPLAVQVMAEKGIDISQQRSKVIDPDYLMHADLVVTLCGDARDRCPVTPPNVQHLHWPLPDPAQATGSEAEVLQAFREVRDAIEAKVRQLEMASFTR

SEQ ID NO: 2816 - protein, 458 aa, Lactobacillus paracasei
VKTTYKKMIAIVAALIVILGLGFFFTHQQHTEAADNGTGRTTITFWHSMNGPNEQVLENLVNQFNKSQTKYTIKPIYVGSYELSIMKYANTVGSNVSPDLVQSDQANQSMMIGLNATVPVQKFVDRDHYDLSQLYPGVTAAYKINGKLASMPFNSSSSVMYYNESLFKKYGVADLPLSPTYSDVTKAAVALTKKSKGAVKGMTMQIYGWLPEEMVANQNSLVVNHDNGRKAMATAATLNSPEMQKSMTWLQDVIKQNAFENFGTGSAAANNQSAAFLAQKVGIFMQSSAMLGQLQKNAKFKYGVTFTPHPDGTKANGVAIGGASLWITKNKPAAVQEGAWQFMKFLMTPQSQATWQLGTGYFAVNQKANQIQTLAAAIKKNPALAVPIKQLNQGNINAATAGAFFSNIQEERQNVELAMQQIYSGADVKKALNEAETDTNTAIQKTNEVSGNLLNYKR

SEQ ID NO: 2817 - protein, 271 aa, Lactobacillus paracasei
MTHIKNGSRYLLLTVVAVALLFPILLGIWASLLPTKDIAAGNFLSTNISLNNYWQAFVTTPIIRYMINSFVTAGLITIGQLVLCTLAAYAFAFINFRYKKQLFFAFLVTMMLPFEAQIIPNFQTVKAFGWLDNYAGLTIPFFTSAFGVFMLRQAFLQIPADLVDFGNYLGLGRLQFLWKIAVPYSRSMLITFALYTFLTHWNQYLWPLITTFSDDFRPVQVGLKQLQSEDTFANWGMVMATAIIVLLPTLALLLIGQKFFKRNLNAGGTKG

SEQ ID NO: 2818 - protein, 310 aa, Lactobacillus paracasei
MELNKELNKTATESKSKLAATIKENNKPAFWFLMPSLLILTLFTFYPMIMTVYNSFFATNIRGEAAKFVGLGNYFSIFQDPLFLKSLAGTLVYVVAFAAITIVAGVVLARLATMKLRRISWFQTAFAGTMGTSAAAASILWLFLFNPSVGLASFALKAMGMTNANLLVDPTGAMIVIVLASVWMALGFAFLILLSAFQSVPPEYYEVADIAGWSQYKQTLKITVPMISPTLFFLFVVEIIDGFKMFAQIDLITGGGPNNATNFLAYKIYQDAFTFHNFGTASAESIVLTVIIALATWIQFHYTERKVYYA

SEQ ID NO: 2819 - protein, 372 aa, Lactobacillus paracasei
VSIRLANVSKDFGNTKVLSDVSVEIEPGEFFVMVGPSGSGKSTLLRMIAGLTSVTDGRIYFNDRDVTDLPPKDRKLAMVFQNYALLPFMNVAQNIRFGLENQDLNDDEKSKRVDWALDLVHLSDLRDRKPKELSGGQQQRVSLARALATKAPVVLMDEPLSNLDAQLRTEMREEIARLHREIGMTLIYVTHDQVEAMTMGDRILVLDDEKIQQLGTPLDLYNHPANEFVAKFIGSPEMNLMPITINDDGDRFSIGDTFWTDNAFVLPFDLPAGSYHLGIRPEKLVPVSIANPDTITAKVKSLQQLGNDTLIFCDFDGQTLVSRVPEQFTIAVGADLNLLLPANADEWHLFDSNNGVRITAAAPAREAVKYGA

SEQ ID NO: 2820 - protein, 478 aa, Lactobacillus paracasei
MNMNHAMLTDLYEFSMANGYCATLPHTDQAVFDIFCRTVPDHGSFVIAAGLQQVVEALQAFHFDDADIDYLRSLNLYSETFLNELATMKLACRVTALPEGTPVFPREPLLTVEGPLMQVQLLETLLLNLVNHQSLIATKARRITAAAEGRPVMEFGARRAQGPDASVYGARAAVIGGCASTSNVLAAQLFHIPAAGTMAHSWVESFSDELTAFRAWAKVYPDNSALLVDTYDVLKSGVPNAITIFKELRATGHQPVGIRIDSGDITQLAKQARVMLDAAGFQDAKITASNALDETVIQSLLKEGAPIDNFGIGEKLITSASSPVLSGVYKMAALQTDGQWQPKIKVSASREKTTLPGHKQVYRLYHRDSHRAFADVIALADEILPETIAVVNANPLATQTRVTLADFTAKPLLQPVFAPGHTADVPTDVFAIQKYTRETLAALPEATQRLVNPDFYPVYLTPKLAEMQQKLIAVHHGN

SEQ ID NO: 2821 - protein, 186 aa, Lactobacillus paracasei
MAHTNEALLIIDYTNDFVADEGALTCGKAGQVLAPQIVALADEFLQQDGWVYLPTDVHTPHDPYHPESKLFPPHNVRGTWGRAFYGSLAPWYDAHQAEDHVNMFDKTRYSAFAGTPLDLRLRERKIATVHLVGVCTDICVLHTAVDAYNLNYQIVVHQKAVAALTPAGQDWALDHFAHVLGATVID

SEQ ID NO: 2822 - protein, 243 aa, Lactobacillus paracasei
MADEFLAHPLITITNVIWSFSPTTHQLQVLLIHRAGAPFAGFWALPETTLRERESADTAAIRLIRDKIGIHVNRGSTEQLATFTDPTRTPGERALALTYMTYLPTMPKLQPGYGATDARWFAFSAADEAGYQLQNGRTIFPLGTSTSELAFDHARILTVAIRRIRNRLDYQPTILQVLGTTFTLKEAREVYAPFLMTTANAIDNSNFKKTHQQLFIEVGTAHDRTRSGRPPKLFKLAELKNPM

SEQ ID NO: 2823 - protein, 1769 aa, Lactobacillus paracasei
MHNGSSTRKYRVPRSLLYSSAILSLTAATVYAASAFDVAAAKQPVQATTTRAAKSMLNIVNVSKQDHYFEVTYSNDLKARLFILADNQFRFYVDPSEKFAAPAQSGEGLNAKIFTKSINASSVKDFASAALTSTSDGWSIKTGSLAINLNKTAATLQVKRGAKVIMAESQPLSITADDTTQTLKHNNDQYFGGGTQNGNFTLTGEKIKIVNTNNWVDGGVASPNPFYWSTAGYGVIRNTFTPGTYDFDAANNGEIKTTHQEKRFDAVYFFDDKPYNLLKDYYDLTGAPAMMPRYGFYEAHLNAYNRDTWVEVPEGTSGGIRFEDGKFYKEYQPGKVPAGQSGTKESLNGELNNYQFSARAVIDRYKKNDMPLGWFLPNDGYGAGYGQTNTLAGNLKNLKDFADYAGKEGIEVGLWTQQNLSPVDPNKPKPDDRDFSKEVANGVKALKTDVAWVGDGYSFGLDGLEKADNMMKKVKGDDLRPFGITLDGWAGTQRYAGIWTGDQTGGQWEYIRFHIPTYIGTGLSGQPYVGSDMDGIFGGGNSIVNARDFQWKAFTPIQLNMDGWGSNPKTPFSFDQHTTDINRAYTKQKTMLMPYNYTASAQSVFDGKPMVRGLFLDYPNMPEAYTDLVKYEYLWGDNFLVAPIYQNTASDDQGNDVRNGIYLPDKDQVWIDYYTGKEYRGGQVLNNFEAPLWKLPVFVKKGAIIPTTPAHNTPKEMDQTKRQFQIFPMAGKQDFTVYEDDGISRKYLKGAYAETKVTSNLQEGQLEVNVAPLSGDYTGLKSERTTEFAIRTSGNPSNVIATVGSQQVALKAVTNQKDYDAGENVYFVNSEYHTNQYLEKLTDKKAIDQTFLQVKLAKTNAATNGIKLTVSGIDAKDDPSTDDLPVNDELAIPSTIKQDEKTTTDTAVGINWSPVTDALSYDVKADGVVYRSLKKPAFVLSPVKEQTKHSFQVRTVTKDAVSKWSDKQTFSSDENPLRLALKMTNLKVDSTIKDVPVWQGKQTVDKLFDQDLTTEAHTNWFTSGEKQSTTPMTITADLDGVYDLDHLTYVPRENGGNGNLSALKVETSLDGIHWHEAGEGKGWTFDAQEKTISFGQKEKAQHIRLTIPKASTLGDFVSGKEFLLFKRDGTNKQVLGDITNDGAITGDDQMSLVNYAGLTANIDSDFNGYVQNGDLNQNGVIDAFDINYVMTKLGKTPVSKPDEKIPSGTLALQSDKTTYAPGETITLNLIGKDLTNVNSLFARLPLTNPNVDLIQVEPTAATAGMVNFSKVRTHSNSSRDLYLIFANEGEQKRLTGNEKLATITLKAKTQLTKADLSFALTDPMLTNQWGPEALPEAPAPIVLRPEDNSEHNHAKEQLAALIDAVHALDPKLFTATSWQPVLAASEKASQLLKDDAVSPSDLTAAYTDLKTALGKLEADRGVNQDQLKALITAAATLKADRYTPESYANLQTEITAVKTVSTDAGASQKQIQEAIQSLSRAWFALVLTQTQPQSDLAQWVRVAEALNPDQYTPASFDKLTAALAEAKKALADTATSADTAQTLSTQLQAAIDALVPRGNKQQLADLLNTAEKLKANDYTPGSFAKLTEVLQPTRNVLNDVDATQDAVTKATDALSKALQQLIKQPNKAELVNVITKAAELKETDYTPASFADLKKALTYAREVNKDPETSGETVAKAVTDLKTALDKLVKQTPAPTPDKEKPSNNSPKSGGFQGDTTIKKDQTKDPIKTDHASNIPDTGEHTQSILALLGATIIGVLGYLKLRQPKKDK

SEQ ID NO: 2824 - protein, 261 aa, Lactobacillus paracasei
MTPDKLVTRLDQVNQNFDEKHALLVADTRHVLFGAQVDQPFPAASLIKLGIAAFVKEKAADDPSQLERQVTLPESVGGAGILRFMSPQAWRVRDLLTLMLTVSDNLATNALLTTYGLPTIAAWLTRHYPGVQLRRPLMQSTFDGDNMITASAAWQLLRALLMSDGNEPAADICAQALRHQQNRTKLLLAPTMENFVGWLAGKTGELPHCEHDAACFAAEGERLYAVVLTQFDYDRQTAMQFSQQVGHLIVQAFQEKRDRFL

SEQ ID NO: 2825 - protein, 355 aa, Lactobacillus paracasei
MAGLEPIIQKIQLRPISLPLVRPFTTAMHTVTAADAVQVDVLLTNGTVGHGAGTPNAVVTGDTMSTLQENLQTQVIPALIGRDIRDWNSLLTRLHASTSEQPAIAAVELALYDLRAKQVSIPLTALLGGQQRTVTTDMTIGIQALPDMVSEAKAFVSRGFKALKIKVGGGRLADDLERVKTIAKAAGPDIRLRLDANQAWTTDQAKVAVTELAALQLPIDFIEQPVAARNHEGLATLTAMRQLPIMADESVFGFQDALALLSRHAVNHINIKLMKTGGLAEAAKIDAACASFGVTTMVGCMIESNLSLVPAIAFAAVHDNVTFTDLDAVYMVKKQQAGIQTNGPQLTIGDPMHDA

SEQ ID NO: 2826 - protein, 340 aa, Lactobacillus paracasei
MGTNKQTALLPTVNQAITDGAVFGVSYSLLGPQENALHVIGYQGAGGDRLPLLPQARYDLASLTKVVGTTTRLLQLLIAGKLELTQPIGSLVSGLRYPQLTIEQLMLHRSGLPADVPDAHALDQVGLIHAVKTMAAVAAPDTETIYSDLNYIILGWAIAALDGDLATSLTQHIFAPLGMHATGYQPQHVAAADFVPTENVPARGGIIRGTVHDHKAFLLDGVSGHAGLFATLADLTIFTRLLAGLPVINGDQVLPPAAFALLDRFCKGGRTLGWRCWAQGRHQYWHTGFTGTSIAFDRDTQRGFVCLTNRIYPSRANRAWLAVRRQLLTQFFEVATSWPD

SEQ ID NO: 2827 - protein, 299 aa, Lactobacillus paracasei
MTEQRNPASTHIDTMTTPDLVALINAEDAKIAPAIAKENSHIAAAIDAAGQRYNRGGRLIYAGAGTSGRLGVLDAAELVPTYGIPPERAVGLIAGGMSAMFKSVEGAEDSAELAEHDLKRLNLNANDTVIGIAASGRTPYAIGALAFAQQTKALAISVACVPDSVLAQHADIAIAPVVGPEVITGSTRMKAGTAQKMVLNMLSTGVMIRAGKVFENLMVDVLPTNAKLVDRAERIIAATTGVDQIQAATLLKAAGYKVPVAIVMAKTELDAADATQVLADHDGVISAVLAAWEAKHGHK

SEQ ID NO: 2828 - protein, 310 aa, Lactobacillus paracasei
MKTILETLQSRLSQLSPVNQALARHVITDPETFIAQTTAQIAHASGVSAASVIRFVRQFEFADLQSFKLALAREKTLPAEVMPLDPLVQDDDDLSTMMHKLSQTAIAAVRDLPDELDQSAVQSAITTLRQARHIYLVGVSASALVAQDLYLKLIRAGYVAIFDHDTHTAVERAYYTTPADAMVVFSYSGLTKEVVLAAQQARRNQTPVIAVTRHEPSPLREAASCVIALPPTEPLLRIGAVTSMFTETYVANILFLGVVQGEIKKTEQNYRATSQLTSELKIRGEKYVNRRLNDRAKKSGQHTHRHNDNA

SEQ ID NO: 2829 - protein, 161 aa, Lactobacillus paracasei
MTIVAARVDERMIHGQVAMVWTNTVGANRLMVVNDEVVRDEMAIQGLKIARPAGKKLAISSVAKAIENLQNGKFADDQVFVITRNIPDMAKLIDGGVPIKAFNVGNLSEKPGTKKIKPSVAVSPDDIAIIRRLLKQGVTITAQMVPNESATSIATFIDKAE

SEQ ID NO: 2830 - protein, 278 aa, Lactobacillus paracasei
MSELKLNKITKKDLKQIFIQNVLGLQLGWNYEKMQGLGYAYSVMPALKRLYKDDPKKMKQALNMEMGFFNTTPQMAHLIVGADVALQDQLGMNDENEKAITGLKTGLMGPFAGVGDTIFVAIYNAIIYSITAYLALSNQPIGLLIPVIGCLVILWVRWKLFQVGLSQGTRLATTFADSMATFTEGASILGLTVVGAMIPAVINYKLDLTYKVGKVTMNVQDMLDKIMPALIPLAIALFSYWILGRKHMNSTRLIFVLILIGMVLGNLGAIFGWIGSLV

SEQ ID NO: 2831 - protein, 278 aa, Lactobacillus paracasei
MSISAFALIFLTIYVGIAQLDALSVKIGLFSPVFGGAVTGLVMGDLKTGLIVGATLQLATLGVATYGGATVPDFLSGSIMGSAFAIMSGRGAAYGIGLAIPIGLLLTQMDILARMTNTIFQHHADRLAEKGDYKGVERNNLYGIIPWTVSRMLPVFVGLFFGSAVVKAINAWIPAWLMVGLKTAGIILPAMGIAILMRYLPLKRYFPYFILGFVLMAYFTKTFSLLGTALVGFVFAALHVLDANDRKRNESNNHGPSNHNNGGSNGGDDSDEEVEIDV

SEQ ID NO: 2832 - protein, 355 aa, Lactobacillus paracasei
VKRILKWVGGILGVLLLAAGGYLIYLFTTYYRVPDDQALKVKNQQSTQFKPGQTYTAMTYNIGYGSYPPSYSFFMDGGKYSRAYSKKSVRTSINGVIKTTQAQNPDVAFYQEIDPDGDRSQHVNEVKMVTGAQQQYANVYGQNYDSAYLFYPFTQPIGKAKSGIITLSKAKVDSSRRYSLPVDNDFNKIIDLDRAFTATKTTVANGKQFVMVNIHMSAFTPNVKIQQAQFTKLFKYIEQAYQQGNYVMVAGDYNHRLLKNTAEIFHTKDLDETWTHLFPKSKLPAGFHIPTMGLAKAAVPSVRALDQPYQPGKSFVTLIDGYILSPNIKAESVHVVSTGFQYSDHNPVVLKFQLQ

SEQ ID NO: 2833 - protein, 310 aa, Lactobacillus paracasei
MSTETDSILAAFEKFNTIIIHRHINPDPDAIGSQTGLALLLRAAYPAKTIYTAGPAAPDLAWIGTQQQVSAEAYTGALVVVIDTSNRERIAGDHFDQGAMLIKIDHHLDEDQLGTINWVDTHASSASEMVWDLVRHSPQLQLTKAAATALYAGIIGDTGRFLYDLTTARTHQAAADLLATGIDAAAIGRQEDQFPENVGRLIGWALENVKITDTGAGSLLITKALLAQFGLAYGEEQRAVGNIGKLASIDRWVVFTERTDGSYRVELRGKTKEINTLAVQHGGGCHPLASGAVADNAAELHAIEEELASL

SEQ ID NO: 2834 - protein, 311 aa, Lactobacillus paracasei
MMPDRILRMLQAAIVGDAFGVPYEFKHRDTYIVEPMMIGGGFWEQAAGTWSDDTSFTLALIDHLNEGDSYTDLMDRFVAYMEDGAYTPNGKLFDIGNTCAKAIRKYVIERAAPIMCGDPSEFANGNGALMRLAPLAIALYTESRFVTRAKSYRAYTQMTHRHPRAVLGSIIYLETLWQLLHGKTLAQALMAVNFSIEALPAAEQAELPVYRRLFARDFISLPRSAIKSSGYVVDTLEAAIWVAGNAPDFKNGMMTAVSLGEDTDTVATITASLLAAADQDAVPKSWWQAIANRDLAGKYMLPFAKRFERKS

SEQ ID NO: 2835 - protein, 106 aa, Lactobacillus paracasei
MQWFYLVLAGGFEVVWATFMKMSHGFSRLGFTLATLAGMVLSFWFLALAVKHLPLSLAYPVWTGIGAVGSIIVGVVLFKDQLQPATWFFIALLVIGIIGIKVTSGE

SEQ ID NO: 2836 - protein, 243 aa, Lactobacillus paracasei
MSLITKQLALDLQVPASRLQNTGNLFVTRPPVPTARSWARDVGDIVIRKGRLWVRTTKPEVTAALADAFGQADGAWFLEMKTVEQLTELLRNFGLKVTNMAPFFVPSNQLSRQLTAGMHLIEADAIPKYQANHAIKMAFGYDPAAPDRLGIGYELDGDLVAVAGASQNGRYCWEIGVELLDPAFRHQGIASRLVQQLTAEIQLRRQDVLPLYGTQFSHVQSMNVAIRAGFVLGWTELMIGKAV

SEQ ID NO: 2837 - protein, 166 aa, Lactobacillus paracasei
MTAKVKVIEATASSDFDAIRQVYYVTWQDAYHGLISDDFLAHLSPASWHPERRWQDTLLAVDDKDKIVGVCSFGPARLPDFNGWGELYSIYVLPQFQHTGVGGVMMTRALQRLHEKFDQFYIRVLDNNVSAQKFYQHFGFSVTDQIMEDTTKFGTIRERVMVKQDP

SEQ ID NO: 2838 - protein, 173 aa, Lactobacillus paracasei
LVIKTVFIDRDGTIGGDGHFTAIQQFEPYPGSVAAIRSLRMAGLQVFALTNQTKIAAGQLDEAALRISLLEMGCSDAFICPHAENAGCPCRKPKTGLIAQAHLRYRFANRDAVIVGDSYLADMQCAINAGILGIHVATGRGDAGYQEVAGSFVECASLADAATWILAQQGNGK

SEQ ID NO: 2839 - protein, 345 aa, Lactobacillus paracasei
MTKTMQAALITHYKQAVPEIQNVPLPTVRPNDVLVRIVAASINPIDLKTKDGKLRLLLKYQMPLILGSDFSGIVTKVGTNVTRFKVGDAVFGRPQKDRIGTFADFLAIDQHDIALKPSRLTFEEAAALPLVSLTSYQALHDLMHLTPGQKILIQAGAGGVGTVAIQLAKALGAEVATTTSSQNIAFVKSLGADHVIDYHREPFQDVLSDYDGVFDTLGGTSLANAFQIVKPGGMIVSVSGIPDEKFSDAYNVPIWKKVAFRLANHRISKLARKTGVTYRFLFMHPSGSELEKIGELVENDKLRPIVDRVLPFAQLPEAFAYSQAGHAKGKIILKLVDNPSSLLQV

SEQ ID NO: 2840 - protein, 251 aa, Lactobacillus paracasei
VTLKKITNFRSLGGYQNAHGQMVKDGLIFRSGQLFELEDDQSQYLGQTLGIKHIVDMRSDDERTEFPDTVWEGADYAVLDILKDATANNASLGRMITEKGNVHENMLTTYEQLALSDSAKTGYRQFIQGLLRPNEPTIFHCFAGKDRTGVGAALILKILDVSEQDIMADYLQTNAERTVANEEILAGLKERGFTDQQLKSIGEALKVDADYLRRYFQVIDQQFGSFQQYLREGLKLSAGEIAQFRDLYLQK

SEQ ID NO: 2841 - protein, 173 aa, Lactobacillus paracasei
MIQIRRFRPADAAEVAQVVATTLNISNSQDYSSAYLEATIKRMSPQFFLDKAEQTHFYIVHDGNRIVGTGAIGSYWGSTTEYSLFDIFVLPTYQKRGIGELIIHTLEHDVYFRQAERVEIPASITAVNFYRHMGYTFKKGHETVDEEQLYRLEKFPHQQTASSSSSHQQEGAS

SEQ ID NO: 2842 - protein, 151 aa, Lactobacillus paracasei
MTTYTIQLVTQPTPPQLDRIMAIWLQGNLQAHDFIPADYWTGNVPLVRDQISKATLWLVQDQRDHDIIAFCGLQDNYIAGFFVDEQARGRGVGAALMAKLQQTYPKLTLAVYQKNIGAARFYRRHGFTLLKQDRDETTGQLEDVLVWQQPR

SEQ ID NO: 2843 - protein, 153 aa, Lactobacillus paracasei
LIIRSYQPSDAAPTLALFRDTVQKINAKDYTADQIAVWAGHERSLAAWHASFIKHVALVAVDEAEIIIGFADMASDGYLDRLYVSATHQREGVGKRLVAALEQRVVSSQYTAYVSITAQPFFKAMGYSTIREHRAFIGTTSFRNCLMGKKVRM

SEQ ID NO: 2844 - protein, 159 aa, Lactobacillus paracasei
MNIKIIGVGKLKEKYFRDGIAEYLKRMDKFAKVKIVEVADEKAPENLSEAEMADVKAKEGDRILGKIKDKEWVIALAIEGKQRPSEVFAKEIADLGTYGHSDITFVIGGSLGLSPAVMKRANDTLSFGKLTMPHQLMRLVLMEQIYRAFMINIGSPYHK

SEQ ID NO: 2845 - protein, 366 aa, Lactobacillus paracasei
MIVIQRLIKDRVLQITALLVVISLFIGRPKASDISFATLWSILAMMTVIQIFEHLHILDYWAYRLTSRAKNTRQLTWWFLFLAIFASMFLSNDVTVLTLVPLYLRVAKKYQLPEILPVTLIGMAANFGSAFTPFGNTHNIFLMHQFQIDLRQFFGWSIPLLAVSFLVLVLLSLFLRNVPVPNVPAEHIHIQMRPTMFAIAVACVVFAGVIGLVPAWLGAVLAIALSLALDPKDMRDVDYAVVLTFAGFFIIVSVVGQIPWVIHFLAGLENSEESVYLSGVFTSQVISNVPSTVLLARFTGYVEALFYGSNIGGVGTLVGSMANLLVFKQYMIYGNRPHTRFFVGFTIFNLIGLILLGCAGYWLTVR

SEQ ID NO: 2846 - protein, 276 aa, Lactobacillus paracasei
MKRRTLFSIIVITLTAGFFTLFYGMHSTWTDTRSAQAVQAATDQVNDLFKDQSHQLPSDQLNKQAIAAAETKLQQARQKANDADHAAALASAQADVDAAKHMLIVKDAVTQNSTKLDELKTLSDESQQALTELAKQKPTFVQTYQERVAQLSDQEAAVAKIASLFSDTDFKTPKPNLNSAQVQAALTAVENLDNKQFAAQVMPLISTAQNATSSDDSRDPEPSASSALPSSADSSPSTVASSSDQASSANASGSESEQSQASSSTSTATSSSSQNP

SEQ ID NO: 2847 - protein, 447 aa, Lactobacillus paracasei
MTIPMQDFLTKYLQFHSVSLAEENEIPETAEFLRTQFTKLGATTSRILHTDRTNPAVYAVFPAQTADAPTILFYNHYDVQPAEPLALWQSDPFQLKMTDTHLYARGINDDKGELAARLAALQRLQAQGSLPCTIKFLVEGAEEQGSPNLDYLLAQYADLLAADFCLWESGGRNEQGKFQISLGVKGGVAFQLSVKTADFDLHSSLGAITENPAWRLVQALATLKNAKNEITIPHFLDVVKPLTATQKLLIQDAAFDYAAFAKNYGITRPATVPADDIKAALYNRPSMTINRLSSGYEGPGIGKTILPHTALAKLDLRLVPDQTPAETVRLVKEALTAGGYDDVMVSDFLGEPPFRTDPDDPRVQTALQLARTTYGDDDVQVELNSPGSGPMKYFYDINHAPIISCGIGNAHSAAHGPNENVVIADYLGFIDYLTQLVPQLAKTKTAN

SEQ ID NO: 2848 - protein, 536 aa, Lactobacillus paracasei
MKKHVFLGLGLFGITALLAACGQQAKAATTQRTLNVAVSTEASSLDPAHAVDATSGGILEQIMTPLYDHDKDGKIIPAMATKVVKPTDGGKTYTLTLRKDVKWSDGTPVTAKDFVYSLKRIVDPKTKTEFAYQYDAIANYQDIVAGKKSPDTLGVSAPSKYVLKIQLSQPTPYFASQMTGYYPTNEAAVKRYGKQFGTSADKIVTNGAYKIKNFNTTSDSWDYVKDPEYFAKKAVKIAKVHVTVLKDSSTIDNLFATGKLDDAPLSGNLIQKEAKNPALTKTVAANMNYLQFNTKNPQLNNVNLRRAVSAALDRQAMTTKVLQDGSKPAKAFVPQGLATNPSTGKDFTADADTPLTYSPTKAKAYLKAALKELHTDSISFAIMTSDVDTDKQVGEYIQSQLTKVLPQLKVTVSSLPKMTRIQRSLDGKFDAVLMSWNSTIQDPSDYLNTATATNISNFSKFSDSQFTALMAKVNNTNGQSAKARYQEELAANARVIDVAGYIPVFQSANSRLINTKVGGLHYSMLQPAEYRHAYFK

SEQ ID NO: 2849 - protein, 390 aa, Lactobacillus paracasei
MKRKHIFQILIVTLLAGYLTVFYGMRNTIDTSFEQHAVQAATQQISQLYSSSKRTFPAKHLSRSMVTAAQAKVNQLVHNVENRDQKKIVAKDKRDADAASNMLTIQEATNAQSSNLAQIESEGTRASAAYKAIVAIKPAFAADYQQAVTQLYKKSLAITQIKKLYNDQNLQHPKADLSSSNIDLAINAIENVENQDFAKNVLPLVQVAKKSQANNDTAVAMESTDTSSTKQTATTGRQNQQDTGEPASGVSGNHATTAGQASDQTSQPSQKAPSQPTTSPSGTSSSTDNNAGASASSSISASANKAEPMTAVLSGGLYKTYDDAVASIKIQGKAVDDMKIRSVTMSDGSFQWTWGPNGDSGSSSSKPSSSAPSSSNPTGQDANKNSQPQH

SEQ ID NO: 2850 - protein, 615 aa, Lactobacillus paracasei
MKKNWQLMMVLAVSAIALVFAFGLKQPLIAQGLITVMGSIIALIMFWGMVKTIRSGNFGVDLLAITAVVATLAVGQYWAAMIVLLMLTGGDALESYAATKASSELKQLLENAPTTAHRMVDGHVEDVEVEAVQVGETILVKPQEVVPVDGTVLAGESLVDEASLTGESKPVAKNAGSDIMSGTVNGDAALTVKVTQRAEDSQYQGIIKLVKESEARPAHFVRMADRYAVPFTLIAYVIAGLSWFFSGDPVRFAQVLVVASPCPLILAAPIAMVSGMSRNSRNGIIVKSGTTLEKLSDAKTFAFDKTGTVTRGILKVATILPQAGFSQDQILKLAASAEGQSTHILARSLTDAVPTADRLPATDVSETTSFGVNATVDGRKVKVGKAEFAGTKATVDTTAVYVNVDGQYAGAITFSDQIRPEAKETMTKLHELNDAKLIMISGDQQSIADKVAAQVGIDQVYAEQLPQQKIEVLDNVPKDGRPVVMVGDGVNDAPSLAIADVGIAMGAHGATAASESADAVVLRDDLAKVAAATLIAKETMVIAKQAVLIGIAICTGLMLIASFGVIPTIIGAMLQEVVDTVTILYALRARNGLHRQALVDPVRATAEREQIQQIN

SEQ ID NO: 2851 - protein, 145 aa, Lactobacillus paracasei
MANDLMRRNDWLSDPFFNDLGRHLFDSLTPANVDRSRVLKTDIQENDQAYVVKVDVPGIEKQNISLSYDRDVLSIAVKHEEQADHADNDGNMLMSERSYGRMSRSYRLPNVNEGQISAKVNDGVLTIDLPKMTSDQKGNHQINID

SEQ ID NO: 2852 - protein, 134 aa, Lactobacillus paracasei
MQISIKPAAVTYLKDHVNQDQRLFLALDDGSSKYSKLGGSCAIGNKYQLVVADEDDQDYALPLDNEAGFKLTTGDPETDYFGSGLTLDFKNASLALRDDSGILDGAVTLNKDAALPQNDAQRRDDMTKLGGKIC

SEQ ID NO: 2853 - protein, 442 aa, Lactobacillus paracasei
MDNGSHNFQETPQNEQQPQRAPKKPKNSGWKQIAIVAVVAALIGGGVGGGTAYLAINHSQSLGVTDTSGKAGTTKISNVSVNESSASEQAFAKVKGAVVSVVNMQKAESNSDGLDTFGGLEGIFGQDSQSSSSSQSSSSSLQEASEGSGVIYQKKDGKAYIVTNNHVVSGSDKLEVILSDGTKLTASLVGTDSTSDLAVLTIDGSKVNTVASFGDSSKIATGQTVLAIGSPLGSQYATSVTQGIVSAKSRTVDVTDDSGNTTGQATVIQTDAAINSGNSGGPLINLSGQVVGINSMKLSGNSGSNATIEGMGFAIPSDEVVSIINQLVANGKVVRPALGIEVRDLSTVSATQQKSVLKLPASVTDGVVVAGFTSGSSAKSAGLKQYDVITALDGVSTSNTAALHTQLYKHKVGDTIKLTLYRAGEQQTVSVKLSQTTSDLKN

SEQ ID NO: 2854 - protein, 269 aa, Lactobacillus paracasei
VGEDFGMRVSVLASSSSGNATYIETPGHKVLVDAGLSGKKIETLMQSIGRDLTDVDSVFITHEHSDHVRGVGVLARRYPKLSVYANAKTFAALPKSVGKIPEDQLRLFDMGATLTLGDLDVESFGVSHDAAAPQFYQFHHDGKTFTILTDTGYVSDRVAGTIRDADAYVMECNHDLEMLRTGPYPWPLKQRILGDQGHLSNEDGADALMDVIGLRTKRIYLGHLSPHNNNKPLAHLTVASLLAQQGLAVDHDFRIYDTDPAVADPLFVV

SEQ ID NO: 2855 - protein, 265 aa, Lactobacillus paracasei
VDFRRIEWIFLVVFVGLNIFLGISFFQAQQVDLATTKSGDAATITDITRDQIKLPHLSKQTPEGDYLASQANTALSAAHSKLVKQQVSISEGDYQELQASLDTPITLKKSQQIRQLTTFVKDSIYHGSEYEYAPALSSDERVVFAQHPKAGLIYDRRAAVTLHVVDDRLVSYSQTYLAKLSVLRDRLNLMSEQDAVITLYRDNDIPNNSAIVSTKLAYSYLLDAKGSTVYVPAWYIGVKNRATGNVTVKRVNAITRTVMKNRNDN

SEQ ID NO: 2856 - protein, 475 aa, Lactobacillus paracasei
MKLSNWILRISLIAMVILSFIFTSLIWRNPSRQERRSTSSMQVTTENDPNVKKMEATVYLPSRVYYTHGDQKQMLFQANASMGSRVHQEMASWHMQQIKTIGKVSQNNYENFLTQNGSLQLVYQDVMSFNHFERWFFNKQPNLKSADFHFNRILFDLDGSGNKLIFINDATRTVYEAKMANVTTNKLRDAVAKQATGAFPVEERRLGNSEVAFFTRPIKLQPYAYLMDQQSANYYVSLLMPSKTASNVDSREIGDSTLYTAGSTRRMTADSSTGAIEFENYAANFPSTGLANFFHATFEGLSDLQMTNLASMRYFQYDASRSAVIYKTFVQGFPIFNGYQKGDVTVRYTQTSEEINFSNTNLTVPIPTDQAAQTLPATATILSQLEAAGYRANQITDILIGYQWTGSSNDQQVVDLQPTYYIEMKGEYRDYQSWINHQTDQQANAASEQTAASTATPSNDAASASVSTSGSSQSQ

SEQ ID NO: 2857 - protein, 636 aa, Lactobacillus paracasei
LNKKIRFFQSIHFKIAIVFILLLVVTLELIGAYFVKTLEQQNIEQFKTSVNVDSYIQDKLAADLLRTDTEGANDDIKSTLSQADIANSADLQVVDAKGTIRGDSDINAQTNVGQKSANSSIKNTLYSGQQYEGYEYRDRTGSTYYKVIPIKNPNATGDNNSVIGAIAISASMEQAYDSINKIVGIFLISSLVAGLLGTLLSIVISRAITRPIDEMKKQAIRMARGDYSGQVRIYGQDELGQLAVAVNNLSVRVEEAQEASEAERRRLDSVLAHMTDGVIATDRRGNVIIINQTALNFLNTKNEDVIGVSILKLLNIAKDYTLRDLLEHQTELLLDFSEQLDHELILRVDFSLIQRETGFISGLVAVLHDVTEQQKIDRDRKEFVSNVSHELRTPLTSVRSYIEALSDGAWKDPKLAPRFLNVTQEETDRMIRMINDLLSLSRLDSGTSKFNLETVNLNEFFNYVLDRFDMMLKTDNEHTGEAKTAQPLPQPDGQKKRYSIKREITDQDLWVEIDTDKFMQVIDNIMNNAIKYSPDGGTITARLFQTHDHVILSISDQGLGIPRQDLGKIFDRFYRVDKARSRKQGGTGLGLAISKEVVEALHGRIWVDSQEGRGSTFYISLPYEPITDGGDDWDEA

SEQ ID NO: 2858 - protein, 237 aa, Lactobacillus paracasei
MAKKILVVDDEKPISDIVKFNLDKEGYDVVTAYDGEEALKKVEAESPDLILLDLMLPKIDGLEVARQIRKEHDTPIIMLTAKDSEIDKVLGLELGADDYVTKPFSNRELVARVKANLRRTASSNAASNEEDEANKELEVGDLTIHPDAYTVSKRGENIELTHREFELLHYLARHLGQVMTREHLLQTVWGYDYFGDVRTVDVTVRRLREKIEDNPSHPEWLVTRRGVGYYLRNPDAE

SEQ ID NO: 2859 - protein, 224 aa, Lactobacillus paracasei
MFFYHDQLRLYYQRRGSGPVIVLLHGNGEDHTIFANLIEQLAPLYTVIAVDSRDHGQSSRTNRLSYDAMTADLAALITGLELEQPILLGFSDGAIVALQLAIRQPQLAGALILAGANLTPQGLRWYSRVAFRVAAGYHPSPKMAMMLHEPQITPAMLHRVAIPTLVLAGSRDLIARKETLTIATNIQNAELHILPGENHNSYIKDNAKLWQLIRPFLAGLNRTD

SEQ ID NO: 2860 - protein, 482 aa, Lactobacillus paracasei
MRGIKHWAMAFIALVAMLVGFAANQPVPTAAASEDLTAIQKRGYLVVGLSADYAPLEFHATLNGADTIVGADISMSKQIAKDMGVKLQIKEMNFTALIGALKTGKIDLIVSGMSKTPEREKEVNFSTPYLYETQVMVIRKADKAKYKSIADFSGKKVGAQKQTTQEQLAKTQLPGAKISSLDKANDVIAQVSYNKLDGAVLASTIADSYVARTPSLMVLNPHFATPKAPTAIAVSKQNSALLAQVNKTISKVKGAKYKTYLQAAYKLQDQNQSFWAKYGNYFLRGALYTLIFAVLTVFFGTVIGTLLALMKLSHSWFAKAIANVYIEFIRGTPLLVQAFIVFFGTQILGLDLSAFVAGAIAMAINSGAYVAEIIRGGINSVPIGQTEAARSLGLHQGQAMRYVILPQATKNIWPALGNEFVTDIKESSVLSVIGATELMFEGTVVQGASFKPFLPLVVVAILYFIMTFTLSRLLRLIEKRFN

SEQ ID NO: 2861 - protein, 406 aa, Lactobacillus paracasei
MTEKIVLAYSGGLDTSVAIPWLKDKGYEVIAVVLNVGQPNADFDAIQQKALNVGALDSIVVDAQDEFADHYVAPVIKANALYEGDYPLVSALSRPLIIEHLVKIAHAQNATAIAHGSTGKGNDQVRFEAAIHALDPEMKIEAPIRDFHWSREEEIDYAKEHNVPVPIGKKSPYSIDANLWGRANEAGILENPWNQAPDDAWGMTVSPEAAPDDPTFIDLTFKQGVPVALNDEPMALATMIKGLNKLAGDNGIGRIDKIENRLVGIKSREVYEAPAAAVIMAAHHDLENLTLERDVQHFKPTIEDKITNMIYEAQWISPLFDALMAFIDKTQAVVNGTVKMKLYKGNATAVARKSAHNSLYDEDLATYTSADSFDQEAAAGFIKLWTLPTTVFEQVNHVHSEEKQHD

SEQ ID NO: 2862 - protein, 460 aa, Lactobacillus paracasei
MTDKLWGGRFTEKAAHWVDAFGASIGFDQQMAQEDLEGSLAHVKMLGKTGIIPQADADTITAGLQHLQKELAAGKLHFTVENEDIHLNMEALLTAEIGPVAGKLHTARSRNDQVATDLHLWLKHRLPTIKEALTNLQTVLVGQAKVHAATIMPGYTHMQHAQPITYGHYLLAYFEMFQRDWERFDFTQKHTDILPLGAAALAGTTFPIDRTLVAQELGFDQIYHNSLDAVSDRDFALEFLSNSAILMQHLSRMAEELILWSTYEFNYIELGDDFSTGSSIMPQKKNPDFAELIRGKTGRVYGALMGLLTTMKAIPLAYNKDMQEDKEPIFDAYNTILGSLHIFTGMLSDLTVHEKRMAEATTHDFSNATELADYLATKGVPFRQAHAIVGELVLKGIKTNTALQEMPLSELQAAAPQIQQDVYAELTSKAAVDRRTSLGGTAVSNVLKEVARDEEMIASH

SEQ ID NO: 2863 - protein, 366 aa, Lactobacillus paracasei
MKRLGISLYPDQSSFDQNKAYLEMAHQYGYTRIFTSLLQMYGGDGEDLFAAFSQTIDYANRLGFQTIVDINPALFKELKISYDDLSFFKKLNVWGLRLDEGFTGAEEARMTRNPYGLKIELNMSRGTNYLASIMAYEPDRDNLLGCHNFYPQAFTGLSDQIFAEYSQQYRDYGLHTAAFVSSPTGKIGPWAVNDGLPTMESDRHRSIASQTSHLVMTGLIDDVIIGNAFASEAELQQVAANFVAPYPILHADMLPGMLPIEAKIAFEAPHLYRGDASAYLLRDTQPRVKYGKESIAPHDNHQSFERGDILVVNDAYGRYKGELQIVLTPFADDGQRNKIGQVSDDDLGFLDLIRPWSTFVLEKTNA

SEQ ID NO: 2864 - protein, 139 aa, Lactobacillus paracasei
LEIQMTFKVPAAFMYGQLIRSAQEDIKAHTGREVLTGSLNGFSYKKKWANGMTGTLTITHAIANQRYAYELDTDRDHYTVDYQLSDAGDNKTALHYTETIEGKTAKGKANNRTAGFLLNWQRKHRFKKMSRQMAAQYTA

SEQ ID NO: 2865 - protein, 452 aa, Lactobacillus paracasei
MNGLINWLNKHVVPIAARIGSIRWLVALRDAFIAIMPAMMAGAVSTVLNALIRDIPNQFGWTGFVNSMQWLIGINAVVWTGTLAILGLIFSFTFGYQLAVQYKVEPVTAGIVTLGTFIMSLPQNFTMTVKTGLGKAAIKSLTDAGAAVTGKDVSMWGFFNFGKFFGAYGFFTVMLMGAIAATIYIWLMKKHITIKMPDSVPPAVANAFTGIVPAAVALYAVGIINYLFTQYGTTVIEFIARVLQDPLLNLSQGYGAVLLMTILVQVFWFFGIHGTNVLAPILDGIWLTAQLANINAFQKGQALPYLWTRNSFDLYAWIGGAGSTLLLLIAILIFSKRDDQRAVAKLSIAPGFFNVNEPVMFGMPIVLDPIYFIPFVLAPVVMVSIAYGAVVNGLVGPVKNQIVWSMPPFLNALVATMDWRAAVLQLINMVIGFLIYVPFVKAANKIKPTELD

SEQ ID NO: 2866 - protein, 236 aa, Lactobacillus paracasei
MYHDIAEQLIQDILAGKYPVKLPTEQVLMNRYQASRNTIRKALDVIFAHGLVRRVQGSGYYVIDHSEQSSAVLNMSIGFDQTAMVKGGPLKSKVVKFALIPATAALARRGNVAVGDPVYQVVRLRYLKGQLYDLEESYFPQIIVPHLSAEIAAGSIFTYLRNTYDMVGSTTENYIQSRPLPAEYADLMTTSGKGDLLCLDGINYLASGKVFNFSRTYFVYPGLTLYYHTTNIDLDQ

SEQ ID NO: 2867 - protein, 110 aa, Lactobacillus paracasei
MAEKKIMLVCAAGMSTSMLVARMQKAAEKDGIEVNIFATAASDADNKLAEEKPDVLMLGPQVRYLEGQFKKDLDIPVDVINMQDYGLMNGEKVLKASLKAIADGKQGEEA

SEQ ID NO: 2868 - protein, 109 aa, Lactobacillus paracasei
MSEEDQNLETVMGLIMNGGNAKSSAFEAIHAAKAGDFEKADEKLKESDHFLTEAHNVQTGMLTAEAQGDHAEVTLLMVHSQDHLMNAITFRDLAGEMVDLYKRLSEKEA

SEQ ID NO: 2869 - protein, 183 aa, Lactobacillus paracasei
MTVTLKHFQSEDLETLWKVAFSDPKAEWHQWDGPYFNQEVPTLQELQENQANQTGFQWVANPFVNGIWSNGVLIGLVSAHYEDGDLQRWLDLGIVIYDSADWGKGYGQDALDQWIDRIFGLVNLPHLGITTWSGNDRMIGLAKAVGMQEEARVRQVRYYQDRYWDSVKYGILREEWQAGRQKK

SEQ ID NO: 2870 - protein, 154 aa, Lactobacillus paracasei
VADYIKDIRTKVGHAPLIMAGVIGILTDQAGRVLLQQRSDFTGEWGLISGTIEYGETPAQTMVREFKEETNLEVEVVRLLGVNGNLTLTYPNGDVAQWLCPVFLVKQLSGVLNSDNSETEALKFWDPAAAPDLFNQQHREVLAHFIANETGYFD

SEQ ID NO: 2871 - protein, 173 aa, Lactobacillus paracasei
LNRLIILRGNSGSGKTTTATALRTQLANTLLVSQDVVRRDMLAEKDKPGNPTIELIETIGRFGLQHQRTVILEGILSAARYGDMLKTLIAEADQSLVYYYDLSFDETLRRHAHRAKAKEFGADVMRDWYLPHDRLNVPTEQLISADWSQTMVVNHILTDLAGLNNTESVKPIH

SEQ ID NO: 2872 - protein, 207 aa, Lactobacillus paracasei
MTSYPRRDPVTDRLLTPENSALILIDYQPTQIESIGSMNHHALIQNVVMTAKLAKTYNVPIVLSTVNVKSGRNKDTIPDLKKALGDIPSIDRSSINAWQDKEFVEAVKATGRKNLVIAALWTEACLTFPTIDALSEGYHVYPVVDAVGGTSQIAHETALRRVEQAGAQLTTNAQLACEWQRDWNRTDTVPDFVKLLLGAGDFINLGD

SEQ ID NO: 2873 - protein, 473 aa, Lactobacillus paracasei
MQRSETAPKRWWLLVALGFFAFMTNLDGSIVDIAVPIMAKDLKVPASQMEWTVSLYLIVLSALLLPFGKLGDRIGKQRIFKWGTGTFVLGSLMAGINLGFNFLMLARMIQALGGAMTLANTYGIVTSTFALAERGRAMGVVSTFVALGGVAGPSLGGLILAHFSWPMIFLINVPIGLIALGVSLWSMNNGIPQRGTYDGWGMILQATAIASGFWGLNLAQQSGFDDPVVLSTLALAVVALIAFIVFEQRQQAPLLPLRIFRVRIFTLGVVTVFFIFMVQFFSTVLMPFYLEDARGLTPGTAGTLLSLYPLMMVFFAPFGGWLADKWNVPAVALLGSIFIAVGSLIGATLKLNAPLTIYIISTLLVGIGSGLFQSPIGDVVMSVVPKNQLGIAGSFNALARNLGMVSGTAVATTVLFGTMSQLAGSRVTNYPTAHPEFFISGLQVAMIVAAVLAILGAIAIGLTIKPWQAHEKN

SEQ ID NO: 2874 - protein, 397 aa, Lactobacillus paracasei
MKKNHTSTAWLTWGIMLVGANLRLPITMIPPLLPTIKQTLGLPASMAGMLTTIPLLMFALASPLIAKMGNRRGNEWSLLVALVILLAGSLLRIISSLTALIAGTLLIGFGISGGNVLLPAIIKDQFPHAIGAKTSLYTVTMGLIASLGTGLAGLLNQQFNMQITLAAFSLVGVFGLLVWALAFRTLPKKAARQDVQRKNIAVSRSMLAWWIALFFGLQSFLYYSLLTWLPSLWQATGFSQIAAGNLATIFQLSGMPATLSIPFIAEKRHGLLYSVWGIMLGFVLGALGILIPGANFGLNVVYALLMGVASGAAFAICIVFFQKKTADAYETASLSGFAQSVGYLFAAVGPVLYGFIQTATGSWDLLLWLTVGLTLLMFVAGLIINANHRIFPSKANR

SEQ ID NO: 2875 - protein, 309 aa, Lactobacillus paracasei
MAMTTTIGKSTVTTGKLGLGTNKVGGHNLFPNLHDEDGIAVVKAALDHGIDMLDTAYMYGLGQSEKLIGEATQGYDRSKIILATKAAQDPHNDLKPNNDPKFLTQAIDDALLRLKTDYLDIFYIHFPDDKTDKAEAVNAIANARKAGKVRAIGVSNFSLDQIKEANQDNQVDVVEDNYSLVHRDAEQNLFPYLNEHQISFVPYFPLASGLLTGKYGLNDADKFSRRFSADQFKTILAALREVDGIADAHQATLAQVFLAWYMKNPAIAVVIPGARLPEQATSNAKALDVNLRDAEYASIDELFKKFRTE

SEQ ID NO: 2876 - protein, 121 aa, Lactobacillus paracasei
MVQSINTKSELVVEGTAFMGMPTYGKIMIGDKGFEFFNEKNVRDFYQIPWNEIDLVIASVIFKGKWIPRFAIKTKKNGTYTFAARDPKRVLRAIRNHFPADKIVQSLTFWQVIKRAFRRKK

SEQ ID NO: 2877 - protein, 303 aa, Lactobacillus paracasei
MAEEVHLTKSDRIKVWWRSTFIQGSWNYERMQNGGWAYTLIPALKRLYHTKEDRSAALKRHLEFFNTHPYLASPIIGVTMALEEERANGAPIDDKAIQGVKVGMMGPLAGVGDPVFWFTVKPIIGALAASLAMAGNIMGPILYFVLWNAIRMAFLWYTQEFGYKAGSKITEDLSGGLLQEVTKGATILGMFILGSLVNRWVSVKFTPVVSDVPNQKGAYIDWSSLPSGSKGIQKALELQSQGLSLTKNKVLTLQDNLDSLIPGLMGLLLTLFCMWLLKKKVSPIVIILGLFVVGVVFHVVGLM

SEQ ID NO: 2878 - protein, 271 aa, Lactobacillus paracasei
MTLNFIQVILVLIVSFLAGMEGILDEFHFHQPVIACTLIGLVTGNLAPCLILGGQLEMIALGWANIGAAVAPDAALASVASAIILVLGGQGTKGISSAIAIAVPLAVAGLLLTTLVRTLATAIVHFMDAAAEEGSFRKIDMWQWIAICMQGLRIAIPAGLILAVGAGPVRALLERMPDWLTAGLGIGGGMVVAVGYAMVINMMATREVWPFFALGFVLATVKEITLIGLGAIGISLALIYLALSKMGGGSSKGGSSNSGAGDPVGDIIDNY

SEQ ID NO: 2879 - protein, 336 aa, Lactobacillus paracasei
EIIABCMPNENTMVGIILASHGQFAAGIKQSGQMIFGEQEKVEAVTFMPDEGPDDLHKHLEDAIAKFDPDDEVLFLIDLWGGSPFNQANSIYEAHKDKWAIVTGLNLPMLIEAYGSRLSMDSAQDIAAHLLDAGREGIKIKPESLDKVTKPAAQAAPTTSNAGQPGSLEYVLARVDSRLLHGQVATTWTKTTNPTRIIVVSDSVAKDDLRKNLIKEAAPAGVKAHVIPIDQMIKIAKDDKHFGGQRALLLFETPEDALRAIEGGVPLKELNIGSMSHSVGKVQPNKVLAFDQKDIDTFHQLEKDGVKFDVRKVPADHAENMDAILKKAQDELNAQK

SEQ ID NO: 2880 - protein, 423 aa, Lactobacillus paracasei
MHEYLTNRGYRAILNASLLSGIGDSLYNIVFIIYAATMPFKSLAVTLAAMATSVPTMLSLLTGSLADRTHAKTWHMVATRLGQMLLFLSLAVMILLPASFPLFLSLLLINIVSDSLGQYGNGLTLPLLHRLIPAKELNTALSFQSATSSTVQLVFQGLGASLIVLLNHNYALFGLLNALTFLLAAMTLVFRKKQLKQAEPPVTTGKSQPVIGNIRAVLKFLAGNQFLFAVILFAMLVNTLGSSVDGLMNITLVQEPDLWLSDFGTTVAIINVVFSVGLIFGALFAKDGLQRLSTFKLLSLLMAAIVGLSSSFFLLHSIVAALGFSFVTAYLMGKINPRLATVMMRQVPEQQMGTTAGVVNLAALIGMPVGQVIFFTIANLASAHVSWIVMAGLATGLFLVLIWMSTKILDPVFTDSDQYSQKA

SEQ ID NO: 2881 - protein, 339 aa, Lactobacillus paracasei
MVEKTKATDGAVFRQLRHNHQLTLAQVADDHNSIAFISKFEQGKSNISFSRLTHLLHRINISVEEFVFIRDLQSGVVPTSNDPNFVYNTLTHRAFVEVLDYQDRFSTQEPTPADYAYFLKKEQEWQARYAQDHNRQTRFELISIQLFRLTMIDRVKQLNQPSPFKSVADAMAQLQALAKPVVSYLYSVEIWNYFELYWFRHLMVALPTATIQNLLPLAIKRSEKYRAFNQIRNIRIRTLFAAFSVFINDRQLTDAKKALDTAKTLLHDSDDLTNAAMLLFLHGWYHVIADQPEIGWELCHQAISLAHILDQPKQEQQLRYSLEFIHQNVNNPEKSAFFL

SEQ ID NO: 2882 - protein, 282 aa, Lactobacillus paracasei
MTIGRQFKLLRRERGLTLKMAAHGILSVSSLSKFENGTSQLAADRFFLLLDQLNLDWDVFAKPRSRDKQPFLQRYLAAARHADVQELASILRQLPLANVNQRLLLHLTLHNDAPERFSILPHEQSQAQSLLMTTADWSLLLRLIAVQLAKIIDLDELSQLIAAFSNQIQRPNTPQDHFNLANRMFLAAVLRYVAAGKLTEARNALNLIGQATVGDLGIEFQIACVKRLLMIYSSDKVVALQGRQEFLQLKKMLAQLGAPAWTATWLPAIERLAAAKGCSQEA

SEQ ID NO: 2883 - protein, 291 aa, Lactobacillus paracasei
MPEEHVKIGAYLRALRLEENDSLEEIAAGITTAATLSRFERGETQLSAAVVLKLLTRFDQDVESIQQGYRALNQDNFFQQVNRATVAGKPALLALAKRQYRLWRETGLIFYRLNQINIMAHNGFSDPSFQTTPAMKTDVMRYLKRIKHWGLYELDLFAATLVLFDSKQLVSLVAGMLLDMPKTESHRTRDQYLWAILTNSIALLIHRREFSEAVRLLTIATSMPVPPDDLYSRLMLRYQQQLLVYHRGKHRAATAAVEQLLASLRLLESPFFAQLLTTSWQRFLKEEGAAR

SEQ ID NO: 2884 - protein, 53 aa, Lactobacillus paracasei
VGNENWGVPYHVEPVVSATAEMLHDIRIVRIGPWVHNPWTVEALASGRYDSGL

SEQ ID NO: 2885 - protein, 535 aa, Lactobacillus paracasei
MSVMKKHWVARLGVLGFALSLLLGSFAATPVNAASDSGTFKVGMEAGYAPFNWTQTTSANNAVKIQGSQEYANGYDVQIARKVAKALHKKVVVVKTSWDGLPPALTSGKIDAIIAGMSPTPDRRKTIDFSNPYYISNLTMVVRKDSKYAKAKSIADFKGAKITAQLSTYHYQAINQIKGVVKEPAMNDFPAMRVALESGTIDGYVSEVPEGITAERANPNLMYIHFAKGQGFKTDASDTNLAIGLRKNDPNKAKINELLATISSKERAQLMNEAVDNQPSTESNGNWFIAIMKQYGPMLLRGTGMTLLISLVGTIVGFIIGLLVGIIRTTPKPKKLGQRGLRAVINWLLSLYIEVFRGTPMIVQAAVLYYGAAQAWHLNMDRTTAALLIVSINTGAYISEIIRGGIISVDEGQFEAANALGMTHLQTMMKVILPQAVRNSLPAVTNEFIVNIKDTSVLSVISVSELFFSGETIAGQSFQFFHTYLIVSAIYLIMTFTISRLFRLIEKHLDGPKDYNVMTNQMQVETPKTRTAKEG

SEQ ID NO: 2886 - protein, 248 aa, Lactobacillus paracasei
MANEPLIQVKNLKKAFGNHEVLTNINLDVNAGEVVSIIGRSGSGKSTLLRNINLLETPTGGDILFHGKSILSDEEKLSTYRAKVGMVFQSFNLFNNMTVLQNVMVPQQTVLKRDAATAKAHALDLLKQVGMDPFIAAKPDQLSGGQEQRVAIARAEAMDPEVLLFDEPTSALDPEMVDDVLNTMTALAHTGLTMIIVTHEMAFAREVSDRVVFMNNGVIAEAGTPDQIFGDPQQPETKEFLKRYLNRI

SEQ ID NO: 2887 - protein, 84 aa, Lactobacillus paracasei
MTTFKRILKRTLMYTLLVLGLAILMTFGYVGYRDVTGGKGYLAMRYLILTLESGVGGFFLFLIVVSLDTWSEHRKQKREQQSKK

SEQ ID NO: 2888 - protein, 423 aa, Lactobacillus paracasei
MKRRWLLGFATVLMAVLLVACGSGSSAQKSTKGPVTITFWHRMTGNYNKALEGYIKTFNSSQKQYKVVATSQGSYDNLQKKYLASAKSRTLPTIGQVTDTIIPEYVHDGMLVNIDSQVKSQFSANELKAIYPGIATNLKYEGKYYQIPFATGTRLMFYNKDILDKYHLSVPKTWEELTKMSQQLKDDGITGVAFNKSYDFEFETLAYDAGNRLITPKYQAKIDTSASIKAMTAITTMLKDKTAVTAGLDNYFNVPFVQGKIFAGFGSSATIQQIAATAPKSMHWGTAVMPSFAGKASSVLGNNGISVFKGASADQIKGAVTFMKFLMSTKIQTQWAKASGYVPVVKTATQSSAYQAYLKENPTYQAAVDAYDDAFSSTPFIGYNTYRNNLLDAVDQTVSKNAEPKTVLTNLQKQADTILKDNK

SEQ ID NO: 2889 - protein, 236 aa, Lactobacillus paracasei
MDRTSLKDHAKAELNPNFSYYLRISLPALLLTAFVALVPFPLNENMHRAGIRVVAHGSRRMMTNGYWNNIAMWQTAVTFIGLLTALLMIGVSFAMIDGLRGRSDHRFSWTQMFKIFERGEYFLGSLLIGLLQVVWVSLWMLLLVVPGIVKGLAYSQAQLIYRDAIDAGQPIGYTEAVTRSRQLMYGHKWEFFVLLLSFLGWWLLEMITFGLASIWVIPYRTMTLANFYLKLTEEQA

SEQ ID NO: 2890 - protein, 112 aa, Lactobacillus paracasei
MELNVSAVAASRLAPMLHADKALILDINDGIGPYSRPSKTSGQAKFNLLILPRTNVPDVYDAHLDSPVGPVLIKSYTSGFFKAETELTVSGDHFAIVPGEPQLDPNVRLKFV

SEQ ID NO: 2891 - protein, 107 aa, Lactobacillus paracasei
MNIYSALKFIQIDHEPVNHLQVVITDQSGKPDAGMTDLLADCLNKIDIFVDLSTTDRVSDVIDDLNLLTPLPYDVLEEYQKILEQPITGVNIAMKKQLIELIYAPMV

SEQ ID NO: 2892 - protein, 157 aa, Lactobacillus paracasei
MEQTGQALPATIQRIWRASAALWALVLMIIGLGLIAAWFFWHWSFWLGLGLIGIAIIQLLFRLALVPYRYRFWRYNITPTAVFLQKGFFFRKNEAIPISRIQNVTLEAGPLLQWQTLQQVNIETASTAHVIDGVTRPVADQLRNQILQLAQEARDED

SEQ ID NO: 2893 - protein, 521 aa, Lactobacillus paracasei
MKTDQPQRLAPVALLIIWIRGFISWWPLFVGGGLSILRANMSFNQFLLWGGLIVGVLVLTLIWSILHYLRFTYLVAPNGLTINSGVLIRKVNHIPYDRIQTVQRQQWFFLKPLGLEQVTIETAGKESKKAEGMLSAVPVAVADAINRYRQGNVQPVTPDATDNQAIPAAPDQTSTTAAPAAPVADAAYKINGHDLNQYALTSLGFIPIISGILWLTQKAQEYLPDSWYKNAEHAISGLAVYLIIGLTLIILILGFLISYLNIIQKYYHFTLDRTGDELRTSRGFFQTNTVSARLSRLQAVRFKQSILRQWLHLSTVQALLASSAADDQQNNDLVLMPVIPERQALSSMRAFVSWLPETSPKLQPIPVSNRWYYMRNMVLGHLTLLVLPVVLASVFWLHVSWWLWLVLAGLIWLVVMALQGQYAATTAAIAIAPPKQLIIQVGEMWTRQRYFVRKKDIQAMTIKQSIWMKARDVAHLEVHIRKGNSDQTVNSRYMAVDLAKQIMTWYQPLPSVPQEGDNHAA

SEQ ID NO: 2894 - protein, 258 aa, Lactobacillus paracasei
MLLNRIQYTPPKSKTAYPFNLPWQASFRDLTLSQPVTILTGDNGSGKSTLLNAIAANYNAILMSGASLDEDPEYQNSRALARCLKLTWQYRTKAGFFFRADDFISFIRATRGRIKYAQTQLEQLAPDSLERLPYLNTLSAIHHLYQVDLDKLSHGQAFLALFRARLRPNALYLLDEPESPLTPENQLSLLALLHDAVENGSQFIISTHSPILMAYPNAQLLALGDTLAPTQYDQIEHVAFLRHFLDDPQRFIYHLLND

SEQ ID NO: 2895 - protein, 289 aa, Lactobacillus paracasei
MLTSSWIKQLPLTAITQVTPVGGGDVNQAYRIDTATKPYFLLVQPGYPADFYAGEIAGLKAFDEAQILAPRVIANGQIEGDGFLLLSFLTSGNGSQRDLGRLVAHLHQHHEPNGRFGFDYPYAGTSVSFTNTWTDSWADLFIHQRLDKLAAHLLKKELWQADDEATFQQVRTIISKTLAHHHSDASLLHGDLWGGNYMFTADGQPALIDPAAVYGDRELDIGVTTVFGGFTQDFYTGYQEVYPLDAGYHFRLDFYRLYYLMVHLDKFGMGYAGSVAAVMNQILDHGLAE

SEQ ID NO: 2896 - protein, 246 aa, Lactobacillus paracasei
MSDYRVEMKNVHKSYGDNDVVKGVNLNVANNEVVVMIGASGAGKSTVLRMINGLETVTSGEILIDGEDIAHKGTNINKVREKIGMVFQHFNLFPNMSVMGNVTLAPTELGIASKEEAIKQAKAMLEVVGLTDKADAMPAQLSGGQQQRVAIARALAMHPDIMLFDEPTSALDPEMVGDVLGVMRRLAKQGMTMVIVTHEMGFAKEVADRVVFFDNGTILEQGTPEDIFEHPKEERTKSFLNKVLNA

SEQ ID NO: 2897 - protein, 488 aa, Lactobacillus paracasei
VVLGLKRKWLLGLLIALPLMLGALLPGKSVAAAQKTYTIGTDVTFAPFEFANQDNKYVGIDLDLIKAIAKTEGFKVEIKPLGFNAAVQALEAKQIDGVIAGMSITPERQQKFLMSDPYYKSGVVMAVAKKGTIKSLKDLRGKRVAVKTGTDSADYANSIKDKYGFSTVTFDDSNNMYQDVITGNSAACFEDQPVMQYGINNGMALKIIGKPAREGSYGFAASKNNRALITKFNAGLKKLRANGQYDKIIERYLGNGSAKSQKTAAGNAQTTDRSFFGLLKANWGTLMSGLEETMVLTVVAIFFATLVGILVGLLGVLPNKFAQGVATTFIYIFRGLPLMVLALFIYTGVPSLIGSKVPAFIAGIVTLTLNEGAYTAAFVKGGIQAVDPGQMEAARSLGLPFGKAMRKVILPQGIKIMIPSFINQFIITLKDTSILSIIGLLELTQTGKIIIARNMEGFKIWTMVALIYLIIITLLTWLSNWVQKKVKA

SEQ ID NO: 2898 - protein, 486 aa, Lactobacillus paracasei
MRRVWKWCVAGVMALMLAVVLGSPVSTQAAEKTYVIGTDVTYAPFEFADKNNQYVGIDIDLMQAIAKAEGFKVDIKPLGFNAAVQALEANQIDGVIAGMQITPERQQKFAMSDPYYKTAVAMAVGQNSEVKSLKDLRGKRVALKTGTAAADYALSLKAKYGFTTVTFDDSNNMYQDVITGNSVACFDDKPVLQYAIATGLKLKLAGPESKASYYGFATQKDRSDHLDQRFNAGLKKVKADGTYAKIVAKYLGNGTQAAQKQTSAKTQDSDRSFLGLLRENWGTLMGGLKETMIVTIVAIFFATVVGILVGLLGVLPNQFARGVATTFIYIFRGLPLLVLALFIYTGVPSLIGSKIPAFVAGIITLTLNEGAYTAAFVKGGIQAVDDGQMEAARSLGLPFGKAMRRVILPQGIKIMIPSFINQFIITLKDTSILSIIGILELTQTGKIIIARNMEGFKIWTMVALIYLIIITLLTWLSNWVQRRMEA

SEQ ID NO: 2899 - protein, 182 aa, Lactobacillus paracasei
MFSYLIDYDLKLSLPRPEIDGPLLFEQIETSRDSLAAYLPWVVTTLTADDEINFLNTTLKLFGARTALHLTIYQADAPVGMISLNTIDTLVRHKADIGYWLTIPERGKGIMHKSIEALADIAFHDYDLNKLTINAAVANRASNAVAEKAGFHLDGTLRQDDQRADGTFLDVNTYSLLRSEWA

SEQ ID NO: 2900 - protein, 207 aa, Lactobacillus paracasei
MKKRLGYNLNVIGHYLLIGWLIFFGVTIFVGLVTYLVMGANPNFVRGIFTGLSGKFANNHDSLSAFWAILVNNERVAFCLMIIGMIPIPFLYWISYYLTCASVGLVLGIYAAKLGIGGALAAFVLGILPHGILEMSALIIGVALAAQVNKALRQSIKRFFADPYYRKSSLDVKAIALQYVCIIIPMIAVAALIEGFVTPALLRLLVH

SEQ ID NO: 2901 - protein, 311 aa, Lactobacillus paracasei
MEVNEAQAIFDAARDQVATIVVGKSMPITLTFTALLAGGHVLFEDIPGVGKTTLVQAMAKTLAVPFSRIQFTPDMLPSDVLGTSIFNRATNQFEFQKGPIFTSILLADEINRATPRTQAALLEAMGEGRVTTDGHTYQLAPDFFVMATENPTDYAGTYPLPEAQLDRFMLRLSLGYPDADAEKSLLLTPDRKTMIAQLTPRLDASLLAEAKKLVANVTVSDAIASYVLALVQATRHDNRVRLGISPRGGIALVTAAKAFATLNGRTYVDPSDIQTLLDPVFGHRLIAKDPTLSTATILADILQNTAVPIRG

SEQ ID NO: 2902 - protein, 330 aa, Lactobacillus paracasei
MNWRNFFINAGILLVLSLLIVFGVAFNSSTSWFASDFAILILLLAIPLLWPLKNTLRFTADNPDMIADRPVTRLFTLTHGRWLPNLFLLDSAKTHTWHLPIGQRTAKISLTLQRGIYDQLPMTVTVTDLFGWFRKTLPLRLATPITVGPARRPEAAARIADDFSQKMSAADAGLPSDRIKNFRDYFPGDNIQQIAWKVSAHADTLIVHDDEHEGQASWTLLLLITPTLSLEPALSLFASLMDTGIFSGNGYLLDSRLTSVIQGRQNTSLANFEPDGTATPHSLAALTTPQHQHRAYLILTADTQAAVPFTHALAPAATTLVDLSGGDDHA

SEQ ID NO: 2903 - protein, 720 aa, Lactobacillus paracasei
MPKWLQRLLTILLIWWLLALFVQPFSVINPIAHPRELAGYVVIISLISYLAALWPRAWPIWLTTAFLSMIVGLWAILPLKQHFGITWFNTYVQTFNTATRRFLQVGGVDVPATLSMTLIVALVAFLLLITVVLQLYPGAVAIVLSYLLAVHVFNGSDLTTQFFQLAVVTGLLAVLHLYHTRWRAFLIGSLSIVGLTLGLMWLSTSTPLNDWLTNISVPARERLNQRGFYASLEAYANGSGRTGFTENSRVLGGPVYDDPTPVFTATSREAHYYRVEVDSFYTGTGWRPSTFQTQAAPLDGAIMRDPSARVDYGQATSVKLVFNGGKTFLPLPYGQLTFTGGKPDPTTDFLLNSATQRITASDDQRFERLDIQVQQKQFTDTQLETATSSTQLISSSYLRLPSSLPQRVRTLAKRITADAKTPYEKVIAIQTYLRSDPRFTYSKTDAQQTPANRDYVDYFLFDSPIGYCDNFSSAMVVLCRSINLPARWAKGFNTGTFEGGSGANKQYIIRNSNAHSWPEIYFNNLGWVPFEPTPGFSNPATPDDPAMPSAASNTVSQSASSSAVSSAVSSSESRSIVSASSTQPKPSSRSSLGSFHWTAIIVLTVVLTLCIVLIWQLPALVAFTISFNLTQRNFPRRYRLLLWSLRRVTRRQSSQPLTVYAHRIDTRLGDQRHFTTLTHAYEAWTFGHVAIHPDPLTTSLKSLSTQLAQYARRKFHVKQN

SEQ ID NO: 2904 - protein, 369 aa, Lactobacillus paracasei
MKVMIVLENIVMDGVKRASTVLGNDLVKHYDVSFYSLADAPAYFELDAPLLIAPRPTDPKLLNFFGSDPYTHYRDQINDLIMTIRDQHFQAVILPAGLTTSFAPLIKQALPDVNLIGWMHNNYATYMEDYYVQMQAEFEGGLQAVDTLVTLTESDLNSYKRFNPNTVKIYNPLTLVPTGEANLDAHRIAFTGRIAIAHKGIDFLLEAAASLPDDWQIAIAGSGTDEDMKNFYDLIDYFHVADKLIYQGPLKDQALRDHYRNASIFVSTSRWEGMPLVIGEAMASGLPIVAMENTGSREYLGNNDYGLLTKAQDVPDFVDNLKKMMSQPALRHHYAHQSLERASHFSPETIVSQWMPIIEHQPTRVSVTG

SEQ ID NO: 2905 - protein, 215 aa, Lactobacillus paracasei
MESMKQRMLGGKLYKANDPEISVESQRGSDLVWQFNHLAPDKKAERAAVLKQLFHAFGDNNYIEPPFYVDYGAHTSIGDHFYANTDCVFLDTAPITIGNRVYLAPKVSLFTAGHPIDAAIRGEDLEYGKPIKIGDDVWIGGGVIINPGVTIGSDVVIGSGSVVTKDVPDHVIVAGNPARMIRRITDKDHAQWQQQKDEFLTWQQQADESQQSKQS

SEQ ID NO: 2906 - protein, 264 aa, Lactobacillus paracasei
MFKLIATDMDGTFLRDDMTYDRDFFATLHEKMQAQGIQWVVASGNQYFQLTSFFEAFPDTIYVAENGAYIRDANKVYALSSFENGAIQPILAKLSSIPDLKILVCGQSSAYALKSTDAAHIATARQYYKQLRLVDTFDNLDDRILKFAISCPPEKTAAIVAEMRQLLVGLGEPTSSGHGDIDIIQPGMNKAAGLATLGRHLNIQLADMCAFGDGGNDLEMLREVGLGVAMANATPAVLAVADTTTKSNQEQGVLQFMHHLLSEP

SEQ ID NO: 2907 - protein, 464 aa, Lactobacillus paracasei
MRIEEDCIGKLAIDEDVLYGIHTTRALTNFPISTERTDPLLFKSLIIIKKAAAQVNAAAGTLDVRKSRAIVAACNSLLMGEHQDALVAPAIQGSAGTSVNMNVNEVVANLASAELKTIRVHPNDDVNQSQSTNDTYPTAGKMAALQALPPLKQALTFLIKTLDAKAHEFADVVKVGRTQLQDAVPTTYGHSFHAYASLFRRDLARLTRAAADLQAVNLGGTAIGTGLNASPYYRSHIIRQVNQLIDLQLKPAEDFIDATQNCDVLVAFSGAMKGLATDLSKVANDLRLLSSGPQAGLNELHLPAKQAGSSIMPGKVNPVIPEVVNQIAFQVIGQDVTISMAAEAGQLELNAFEPIIFRDLLQGERYLARGIATLTSNCVAGLTVNREQCETAVHHSAISATVLSPYLGYEATARLIQHSMKQHVAIPDLLRSEHKLSAAMIARLFSPMVMTNQETVPDLSIAEK

SEQ ID NO: 2908 - protein, 194 aa, Lactobacillus paracasei
LTRKIVNHLTVANRHQFRSWLTAHYQDASECWVDVKRGVPKQDDTFWYVDAVEEAMCFGWIDSTYKKLAPDQPASQRFVPRKVGSAWSELNKERCRRMIHLGKMTAAGYAVLPDMNPRHFKFDPRIIRALKRRPGAWQYFQSCPPLYQRVRCDTIQIKSHQPKLFRQRLTKFANACQAQQMIGQWRDGGRLPVK

SEQ ID NO: 2909 - protein, 139 aa, Lactobacillus paracasei
LTIQGKLTVYFERPFYRGLFEQTMGDTYRVAKVTFGTQAPTASELLHLIQQRWEDLHWVAAQDVILPKLQMTISPKRRSRQARKEVRNAKRTQATTFLKLAHKRNLQVKKQRRKQLKDQHACEVRLKKQAKRLEKHQGH

SEQ ID NO: 2910 - protein, 392 aa, Lactobacillus paracasei
MAKKDFNQLALDQAKEFGGKLSVVSKVPIETRDDLSIAYTPGVGAVSSAIAKDKSLVYDLTTKKNTVAVISDGSAVLGLGNIGAEAAMPVMEGKAALFKRFAKVDSIPIVLDTQDTEEIIAAVKAVAPTFGGINLEDISAPRCFEIEARLIEELDIPVFHDDQHGTAIVVLAALYNALKVSGKDIGDIRVVVNGGGSAGLSVARRFLAAGVKHIMVVDKVGILAEKNADQLPPHHAAIAKITNHENRTGTLEDALQGADVFVGVSAPHVLKPEWIKTMADKPIIFAMANPEPEIFPDEALAAGAYIVGTGRSDFANQINNVLAFPGIFRGALDARARKITIDMQIAAAKGIASLIPDAELSTTNIIPNAFDGDVAEVVAESVRHAAEAKAEA

SEQ ID NO: 2911 - protein, 441 aa, Lactobacillus paracasei
MENKTVTPNKSTSPQKKWMDFKVGSVPLPVYIVMAAIIVLAGVMQQLPVNMLGGFAVILTLGWLLGTIGANIPIVKNFGGPAILSLLVPSILVFYNAMNPNVLKAADMLMKQANFLYFYIACLVCGSILGMNRKILIQGLMRMIIPMMLGMILAMGVGTLVGVLLGLEWKHTMFFIVTPVLAGGIGEGILPLSLGYSTITGTTSGALVAQLIPATIIGNFFAIMCSGLLNRLGEKRPELSGQGQLVRLNGAEDDLADAMKDDTGEIDLKMMGAGVLTACTLFILGMLLQSITGFPGPVLMIVAAAILKYLNVIPGETQRGAKQLYKFISSNFTFPLMAGLGLLYIPLKDVVGMLSWQYFIVVISVVLTVVSTGFFVARFLNMNPIETAIVTACQSGMGGTGDVAILSTANRMNLMPFAQVATRLGGAITVISMTAILRMLS

SEQ ID NO: 2912 - protein, 514 aa, Lactobacillus paracasei
MKIKGWRLWGWLSLIFTSTLLLTVLTVYGLTMLENRQQFESREGQLLISIGRQLAKDPRVTAALETNKADSATRTYAGTVEKNFDLDFVVIMNMQGIRLTHPDPKQINRHFQGGDEVTALRGHEHVSVRRGTLGRSLRGFVPVYRQGKEIGVVALGIKVTSLQTLIKTSQDGFRLALFAGTIMGLLTAFLVAYYIKHQLHDLEPKEIARLLEERNAMLEETKDPVIVIDLHQFIMLINKAAAKLQNHLITESAFIGQPLTTLIANPERVNLNVKTEQFYQQDGQDYLFSAAPIMVKKQKIGYVIFLRNATEAIFVADQLANTTAYANALQSQSHEFMNKLHVIYGLVAIKQYDELAIYLQDLLKPEQEFANRLALLVKNPLVAGFMIGEREKFAERKTTLDFEISPELPPNPNTQETKTLLTLSRYLHFGLLQHDLPDTILIQLEYAQNRLTIAYHLDEPAKRTDFISLIHQDYFQQLLTELNGSVTVSSTDPLTLTLTVDYHEEAQNDEHPNR

SEQ ID NO: 2913 - protein, 229 aa, Lactobacillus paracasei
MTNILIVEDDPMVQFIHRNYLEKIGTFDTIYSSETIAEAKKLLASRSIQLVLLDIRLKDGNGIDFLTDLRRTKQTVDVILITAANEVNIVNDALHLGVIDYLIKPFTLERFEKSIQRYRTKHQALVTDQLDQSQLDTYFEPQTTIAPTVDLDKGLSKATLQLIQGAIKQLPQPFTVAQLTTETGLSHVSVRKYLSFLEDHHFLKGDTIYRKTGRPYKTYQMVTAPHALS

SEQ ID NO: 2914 - protein, 285 aa, Lactobacillus paracasei
MKITFIGVGDMGSHMVPHLAKAGYDVTVWDKVPAKMAAVAGDHVRTATSLEDAVTASKVIITSVMSDDVPALHIGTTETPGIVHYLQPGSTLIVTSTLDPRKITAIQAVMPTRTHLLDVPMIGGVKYAREAGLVLIAAGDKQAVADVTPILKTFGTVKYVGEQGNGAKLKLITNVAIMAAEAGIRETLDLADAYDIDYQTTLDLLQMGPLKPVVIRALDESNPRPLKDSVADEVELDNATKDFVDLPIASAAMRRLQKAVDSVAGEAQFIDITNKNTALPEASKK

SEQ ID NO: 2915 - protein, 169 aa, Lactobacillus paracasei
LKTYADKQALLDTIEERYAKFRAEFTDIPEEKRELLVEGVDKTPSEMLSYQLGWLNLLLSWDRDEVAGIEVETPAPAYKWNNLGGLYQSFYEQYGQQSLQDQLAALDLLVKELCTWIETLSQSELFDAGVRRWATTKAQWPLWKWIHINSVAPFTNFRPKIRKWKKLVL

SEQ ID NO: 2916 - protein, 54 aa, Lactobacillus paracasei
MDESKELEQLGQFFHDFRVGRGLTLKEAAGNWSAATLSRFEHGKVDISTEKAAG

SEQ ID NO: 2917 - protein, 533 aa, Lactobacillus paracasei
LLLYPEPASAFPMRIQKLIEINDIDALTKRKNAFFAANKKETSMTKLANILFDTAIHWPEGKYHLDAAAEQYLADRLTMPENLSPFDSELQTAIGAPASHELLVLFWHRTKQMQHDLPKNRLWIILAKLWLGALMDRDLDFLDRFRTDLESEFVKYNQLVDASDCQEVWPFTRLLEQWVLAPSLHNEQKIDEMIADTQAMGCISQAKYFTLAFARTRQGQPHHNPALVDHQESVNVRKTGSFIFRRRTYLGLSLSDIELNRDRSTLRRFEEGKTQLSFSSLVKLSEQMAVLVPTLLIDMYFKKQGQSQNITLGTSWRSLVMAKDQRWPKSKLQSVIDQSMASMKNIAPSLRQAQLFVLQRAAMEIGMTDVDTVAHYSLAHDLLPQILKSNHWGLFEYLILRYICPLLSFDELSMLFQQGKRMMQKHINYDGATFAYEAMSAVFVDAVNALPPDKATDFLHQFKWLYSVDVAKRSRWQAIGGLKTALDLTQRTTATRASVQQFITCCKSTGHGTVLADLRAQWHNLVPEGYFEI

SEQ ID NO: 2918 - protein, 605 aa, Lactobacillus paracasei
MTMKHTSDNLLDLGRFFHERRVGRGLTLQEVSGEWSAATLSRFERGELDISTQKMLELMTRIGIDELDLLEFYEANPVNFPLQLQDLTQLNDVGELERRKAGFFAAHPKRNSMTELARILFEAAQHWPDAEFRFSDEDEQILADRLAVPERFSVLELELYKAIVGPASHELLILLWQRAQGLQKDWWQFREVIELMLWLGALMDRDMDLVNGLEDELKNWFMPQQGRTRLVEFMPNWQFGRSTAHWLRHPSSSNKNKIQQIIDELRRMGVEVDARWFELMLAHTNEGRVHHNLKLKDHPKQLTVAHTAGEVVKFQREYLGVSRADLVIDASVTSLRRFENGQTQLSASSMLQLCGELALVPSQILTLPNQIDEHTPGEISLRAVFRQIKQHKTFGKSEADILTLIQRFTTQFPDMPASLVATQRFVLTVTAGFTSDADVAMHKQASLILARLLQMNHWGSLETHASEELADWLTPDQLVMLYEQGRRVILNHPMTIGIDYYFSGLNQAIARVVDQYSPKVGRSFLTQFKWVLTIHDATPMRWQAAGTWYLANYLIEPTTANKILVERYVHASLRVGHPDAIDNLKKLWVKQLPENFINNFVLTYK

SEQ ID NO: 2919 - protein, 78 aa, Lactobacillus paracasei
MRQGSVKKVDYEYTRHGYCAITSLIEALTGKQSTDVRRHRTAINFADIIEYLVEVLYPKTKKIMLVMDNLNTHRPGSL

SEQ ID NO: 2920 - protein, 949 aa, Lactobacillus paracasei
MKKSVLNTVAATAAALAVAGGVKTVHADAQAPVAPSEAAVVSKSANISTTNQTTQTSVEQAQASVVKGQGGVDQAQKDRDAAAKAAVDAATQQAAAQAQANVAKKAVDQAKADADQKSAAVSSAAINTVEAQKTADAATDLAKSEAAGQVSDAKADQEVAQSVVDKVQDQVNKDQQSVSELHSQATSAAQSTADAEAKVAAAKQATAAAEKSMDIAGAKADVDKAQSDVSTAKSTVTEAQTVADKAAADKANASQTADNAKANLNKTTANINAVKSDLDKTKADTANAQSNLTTAQVGVANAQKVLDNAKNTSTVNLAAEGISVTVSDAAKAAAASLLTGNANNSKFLSENLVAIARGLKITYKPTAADWSQNLNYTDTTKSYKGQTIGVSSIEYVDAFKTLSDAQKTHFEDIYLAVINSIRTQLGMPGIISADTVNGTTKVAAVGPTDTAGGFTLYARAFYPAKQNDGNIKWLDRVPANPITTYNMALLKDNLINYSVLQTLTSNDTDGFQGVYAASVLQPILGFSKTKEATKVLADKISFQSGGPLLFLSIDIATVNNDATYTSSANIPALETALADAKIKLTSAQNALTTVQSKQAAAQSVYDQAAARHADAQAAYSKAVIVQQTAVNAKSYADNALATAETTLTKAETTLAAAQKVLEESQQDLTVKQAKLNAARAAQSAAEKNLATAQTKQTEADTAVTDAKAQRDKDQAALQAAKNKLTSAKQAVTYAEANLYRLNHSQDVLAAAKDAQAKAEAALATAQTAVDQAEKTLSIRQADLTTAQDVTTKAEVALAAANANLADAQAHLEASKQALKIAQVAESLAENVSRQQHRLDSEAKAKVDGYRIVGGRVVDYGGKPVAGWTVINGQMVDMYGNVIARVATKASVKKTSFNNDVSVDSRMTRLHGTASLPQAGEQRTSGLSVFGLVVVAILGMFGYSQRKRRV

SEQ ID NO: 2921 - protein, 606 aa, Lactobacillus paracasei
MTGKKNRDNLLNLGRFFQKIRVGRGLTLQEVSGEWSAATLSRFERGELDISTQKMLELMTRVGIDELDFLEFYEANPSNFPLELQELIQMNNVGELERRKLGFTAAHPRQNSMTELARILFEAGQHWPDPNYRFSEKDEQILADRLAVPEHFSILELEIFKAIVGPASHELLTLLWHRTQRLKKDWWQHREMQVLLLWLGAIMDHDMTLVDRLETDLDVWFTNYRMNTRMVEFMPNWQYGHVVARWLRHPTVHNENKVHHIIADLRTMGVETDARWFELMLARTRGSQIFHNLNLIDHPKQLKLARTAGEVVRNRRQYLGVSRSDVAVAVSESSLGRFENGRTQLSAASMLQLCGDLALLPSQILTLPNRIDEHIPGEISLRSVFRQVTQIQTFGGNNDDILNLIHQFTTQLPGMPKSIVVIQNFVLRSAAGVEPNSDEEMRQQALQILVRLLQMNNWGALETHATEELTTWLSPEQLTMLFEKGKRVILKHPLTVGIDYYFSGLSKAIAQVVDHYSPNVGRTMLAQFKWVLTIPDPTPMRWQAAGTWYLANYVLAPTTANKNLVERYVHASLRVGHPDAIDHLKKLWLKRVPENFINDCVTAYRE

SEQ ID NO: 2922 - protein, 135 aa, Lactobacillus paracasei
MTMKHTSDNLLDLGRFFHERRVGRGLTLQEVSGEWSAATLSRFERGELDISTQKMLELMTRIGIDELDLLEFYEANPVNFPLQLQDLTLRNTGQMLNSAFLMKMNTFLARLVCVQRLGKLSSTKFFEKVRRTFSR

SEQ ID NO: 2923 - protein, 132 aa, Lactobacillus paracasei
MQSDLGSYDYVQRVYNENMRLAAYKLPRVTVDGDVTFVDDGLIKLTMQIADSRVLKITIVTTNPRSSAYMQVFEGFEFGFNAVSTWIQNYEESTSTHGSSRGTVKGMLADYNTTADNVLTVSLTRVSGNAPA

SEQ ID NO: 2924 - protein, 432 aa, Lactobacillus paracasei
MRKPSGRHRGTNKTLSFASVILLGINGIIGSGIFLLPGTLYQEAGVGSVSAIVLAGLSTTLIALSYAMLASKIDDDGGAWVYSNRAFGAFVGFQTGWFGWFLGVITIAAELAAFLTALGGLVPAVKQRDVYISVALVIIAALIIINLTGPNILTFIDNISSALKIIILIAVIAAGGYFISTHGLHLNQPRAASTDFRTAFSTAFYMFTGFSFLPVAANKMRNPEKTLPRALMLVMLVVIAIYGLAQITTIVILGTSLTAEALPVAAAFAAIVGPIGKTVVILGMLISILGVAVAVSFDTPIEMASLATEKALLPAVFGRTNKSGAPFVAIWLTLGIAALLVVSGSYLFFVNLIVFSAFLQYITTILAWFKLRHDPTLPTGIHLPMAPFFMGFALLLIGYLITSATWLTWLIAVIVALIGSVIYATDTRRRSE

SEQ ID NO: 2925 - protein, 309 aa, Lactobacillus paracasei
MVKRLLSASTSEVMTFDGQQLKESIKASEGRIIVSENIVTQENLDSITTAEIAAAFGADMILCNRLDVDDPKIFGLYPGERDLYSAPKHDGKESITRLRKLVGRPIGINIEPIGDNPKMMENQIAILPGCTASEAVIKKAEEMGFQFMVLTGNPGTGVTNEATIRSIALAKKYFTGLIIAGKMHASGVDEPLMTEETAKKFIEAGADVILAPAVGSIPGFDEADLKAVVKVVHRLGGLVMSAIGTSQEGSGSHVLQEMAIRNKICGVDMQHVGDSAWGFESPIDNLYAVSKAIRGERHTIQRMARSINR

SEQ ID NO: 2926 - protein, 306 aa, Lactobacillus paracasei
MHELKLFSLNGNRPLAEKIAEEVGLPLSPARVNHFADGEVQIELPESVRGADVYVIQSVSDPVNENFMELMIMVDALRRASAHHINVVIPYYGYARADRKARSREPITAKLVANMLEMDGVNRIIAVELHADQIQGFFDIPVDHLKAHHLIGDYFKKLDLGDNVVVIAPDHSGTKQARALAEELHTPIAIVDKRDQEHIGVIGDVAGMHAIVIDDLIDTGDRIVDSYKALSEAGALDVYAAATHGVFSRGAVDRIKHLGLKRVVITDTIKLDPKHKFEGLDQISVGPMLGKAIKLINSNQSIHVLF

SEQ ID NO: 2927 - protein, 309 aa, Lactobacillus paracasei
MKQSHLIGLATPLLLSAGTLATAESFYQYAFRRINYIPDARRSMQKYAASYYRHVHWVESQANIEAWHMTAPDNQRLEALWLPHPGSKKAVIVGHGYKGTGITMSNFAHMFYDLGFNVLLPDDRGHGESDGQYISFGWLDRLDYLGWLQRIIDRIGADSQLLLFGTSMGGATVSLVAGEPSLPKQVKAVIEDCGYTDVETELAYLLKKQFHLPPMPLVPLASFLNYRRLGYPLRVVNVRQALTRNHLPLLVIHGAEDVYVPTKMGRQNYAASAGPKALWIVPGAAHAESYWINPEAYQAHVKRFLDIFF

SEQ ID NO: 2928 - protein, 318 aa, Lactobacillus paracasei
MADDDILAKIQAGWAQTAARDKARYADERVPEDVHWETEYRYENSADPQQTLNLYYPAKRRNATLPTVIDVHGGGWFYGDRNLNRNYCRYLASQGYAVMGMGYRLLPDVDVRGQIQDIFASLRWLSHFGPQRGFNLDHVLLTGDSAGGHLASLVACIQQSEELQELFGVDRVNFNFTLVALVCPVAEPGKLPEAAGDMSDMAAFYLDKLSGGDAALADHLNFSQVAKDLKLPPFMLIGGQNDSFYLQSQALLEVFAADKVTYTTKLWPASAGPHLKHVFNVQHWEWPESIETNLAMLRQFDVLSKQRDEAEADEEDDL

SEQ ID NO: 2929 - protein, 384 aa, Lactobacillus paracasei
MMEAVHFGAGNIGRGFIGETLAANGFKINFVDVNETIINALNQRGEYTITLAAPGEKKIHVDNVDGLNNAKDPEAVVKAIAQADLVTTAIGPKILPIIAPLIAQGLQARDAANNHQALDVIACENMIGGSQSLKKSVYEHLDDAGKTFADTYVGFPNAAVDRIVPQQKHDDPLAVSVEDFKEWVVDESQMKNKDLKLKTVDYVPDLEPYIERKLFSVNTGHATTAYTGKYLGYTTIGDAIKDPKVFNQAKGALAETRSLLLSEFKNFDEKDLENYQNRVLQRFQNPYISDDISRVARTPIRKLGYDERFIRPIRELKERGLNYSVLMDTVGMMFHYVEPNDAEAVKLQAMLKDQPLVDVIKEVTGLKDAGLIDEVEASVKSKDR

SEQ ID NO: 2930 - protein, 147 aa, Lactobacillus paracasei
MKGLDVKTIKLGQEAKTKEEAIRQAGQLLVDNGNVEPAYIDSMLDRNRDVSVYMGNFIAIPHGTEAGMKYIKSTAISIVQYPWGVDWSDDPADENLVTVVFGIAGLNGEHLKLLSQIALYCSDVENVQKLADAQTPEEIVNLLKEVE

SEQ ID NO: 2931 - protein, 685 aa, Lactobacillus paracasei
MLLTNREQEMIRLMMSQPAGVSRDELERQLGVSRRTIYRELSQLESDIATIGLKLDKGTGSTYRLVGDTNDLATLTATLAKQDQVVTFDPSQRQSALTLRLLNANGPETMTALAAAVDVSVTTIKQDLDILEPALNEYHLQLNRQKAAGIWIDGAEGDIRRVLVGVLNAEINPYVFFRFLRDPQQTFDPVTHYFVERLPQEELLAANAALLRIKALADLSDNQRKAVLLTVAVNTRRLREDQHVEAQRHFDQERLFQDQQLALEFLAEMDSAIRQKVRVGDYQFLAVELSTIRGGLAGEPVDPFDLTVNLEVQELIREVARSFPGKFSGNTQLYSSLLAHVQRTAGGDWLPGVTMTNPVLAHLRDDYPELYHAVQQAADDVFGRGAFTGNALGYLVLYFASVLDHTHTEVPAAVLLITSDGPGTGSLIAGKLRVQVPEIREIKIIQVSDLPNQNLAHYGLILATMPLPGFKHQYLVITPILARDEISEIRRLLQQVKPKEATQQRQPSLDQTVTAFESLKTMVLAADDMLQHFAVTEITEAVTTSGATIDAMLAHLPDVVAEAPVVKDALLKRLELAPVGIPDTGLAMIHTSSQGVTVPYIGAFDLKTPLSLPAMDMGTIMLHRVLLLLTPNPVAQETLTLLSAVSAKLIASTTNLQLFEKGHYSQLYQIITEVFMNEIKKIDRR

SEQ ID NO: 2932 - protein, 621 aa, Lactobacillus paracasei
EIICBACMPNENTLGAKTANTPAAEKKKFNLKAGMQSFGTKLSGMVLPNIGAFIAWGLITAIFLKGGWYPNAQLAKMISPMVTYLLPLLIAFSGGSMVAGHRGGVVGAIAAMGVIVGTDVPMFIGAMVMGPLGGWCIKKWDDRFQDKIKQGFEMLVNNFSAGIIGMLLAIVGFFLMGPIISTLTNGMATGVDWIINHGLLWVANVFIEPAKILFLNNAINQGILTPLGIQAAAEHGKSILFLLEPDPGPGLGVLLAFALFGKGSAKGSAPSAIIIHFLGGIHEIYFPYVLMKPALFLSVMAGGVTGTTLFSIFNVGLKSSPSPGSIFALFAMSPVNIGNYIGLIVGVTGATLVSFLISAVILRRDKSASGDELAESEAKMKSMKAEAKGQQNVAAAKDVMSAAKGIKQIIFACDAGMGSSAMGASILRDKVKKAGLDLSVTNTAISNLQDKPGLLVVTQEELADRAKDKTPDAAHIAVDNFLNSPKYDEIIASLKAEAVGGTDEAMPATETSKAKQETPEDELKELDLDKITEVDFLHHDQNIGSATMAQATFRAELRKLNKDVKVRNVAIGEIDDKDNVLIIASKETARRVKLQFANVQVYTVDGLLNATNYDKLIEKMK

SEQ ID NO: 2933 - protein, 249 aa, Lactobacillus paracasei
MLHWTRPDRGISMMDVKIFDNDTEAGKYAFDLIKQGMDNGAKVLGLATGSTPVTMYKAMVNSDVDFSNMTSINLDEYVGLAPDNDQSYRYFMQSNLFDKKPFKETFVPNGLAKDPEEETTRYNKVIADHPIDIQVLGIGRNGHIGFNEPGSPFDAETRKVPLTQSTIDANARFFASEDDVPRYAYSMGIGSILKSKKILLLAFGENKADAVKKMIEGPVTNDVPASALQKHSDVVVILDKAAASKLSKK

SEQ ID NO: 2934 - protein, 261 aa, Lactobacillus paracasei
MYKAVVFFDLDQTLLNDDKQVPPENVAALKALEANQILPVIATGRNYYELADIMAATGVHSAIAANGGDIFLDGDHIFQSVIGEPQLTRFLNTSAAQDIQVAMYNSEASALTGHNQLTTDNYAQVRQTPPPVKPSFYEHEAICMMLMFVPWTDAGDQIGKQFIQDFPEMTFYRNSHYTFDVVNHGISKGSGMAILLNQPSLRGLPTYAFGDGYNDIPLLQAADTGIAMGNAYPKVAAVADYQTDDYRENGIPNALAHFNLI

SEQ ID NO: 2935 - protein, 86 aa, Lactobacillus paracasei
MLEQSTMHPVVWINQHTYISIVKNADYNLEVWEITDENRQHRMARMNYKYHRDNFAGFIYRLFPQIDLIQIHNIQKKINPYFDLEV

SEQ ID NO: 2936 - protein, 58 aa, Lactobacillus paracasei
MDSLVIQLLIMVVVALLVTLLVIFAEWRAKNFKPWQLGVQSVVAVVLLGVGISLLTVR

SEQ ID NO: 2937 - protein, 354 aa, Lactobacillus paracasei
MNKGRSKGKRISQRMVIIGIGALAMIGVTVFFLVTSKKPTSSPAPTTIATFQVKKHELRVPGQVQAVRTQKIDIPEGTVQNMTVKNGDSVTLDQQLLTVYKPDVQAKIDEASRALEKQQRSQATLDQQISQIKATLSKTAADDPQKSALQTQLDEAQNNRQDSADAITQSNQDIAKLKQSLNTVVKAPFAGRLYIDYQANGSQTITETSAEVEAVGEVSEFDYSSVKIGQSATVQALASKTKQATDINFISSDPAKSSKPNLAKYELTTKLRDGFLNGQSITITIPLSGLLIPKEAVKDGAVFKIVNKRAIRTKVTYVAKDDMYEVSDGLSSGDRILQKPDKTIKDGAKVNVDD

SEQ ID NO: 2938 - protein, 229 aa, Lactobacillus paracasei
MIDLRHVNKSYLQGDTAFPVLKDINLHIDEGEFVAIMGPSGSGKTTLINIIGFLDTAFEGDYLFQNENVAVFNRATASKMRNQHVGFVFQNFSLINNLNIFENVLIPLSYGGNRRSDVKEKITELLHSVGLVDVETKLPRNLSGGQQQRVAIARALANSPQFLIADEPTGALDSHTSAEIMRLFKTLHQQGVTIIMVTHDEHVALQSDRMIKVLDGQIISDTEVSHANN

SEQ ID NO: 2939 - protein, 396 aa, Lactobacillus paracasei
MRITELIRISFRALTANKRRSLLTMLGIVIGITSVVTIMALGNGIKAATLKNLQTDQSGQQTAEITFLPESSTASTAGFKEDDVDLAYQTAPDKIKKVTIKHEKERLQLNGQLANQDTMLSATLVTSMPKVQLAAGNKLTTDSLQTDGHDVLLSKKLAKKVFYGNAAALTSSIFIGKRSYNIVGIFNTPKASYSALDVDVLIPEKAYTAGQLNPGGQKLAITFQRGSDISQLANAIVRQLKKSGTERRNGSYQYFDYGELLKGIGNVISGLTLFVGAIAGISLLIAGVGVMNMMYISASERSQEIGIRMAVGATPAEIMKQFLLESVMLTLTGGVVGLVLGGLIAWMITAFLPFKPVITLGSIIGTFAISSIVGIVFGILPAKSAANKNLIDILKS

SEQ ID NO: 2940 - protein, 2082 aa, Lactobacillus paracasei
MILKLDSKRIQLARQAEQTVHVRFRMYKAKKRWLIAGAALLFIPAFFQPGHEVKADTSSPQTQVTATSQAAEPATSQSAVTSDQATTSSNAVNATNSGEAVKASSAASAASSQTSSSSAAQTLTSQAAVPEQTTDASQVASVTSAQVASGSGAAQSAAAADQAATQAATASETAASSAASSQASSAQQSASSQAQPVATAAAQPTVTVNTTTTDATVDGLTYSFDETTKTATVTGHDSGATLTDINIGPTVSYNGQAYTVTAIQDVAFFNLSNLTSLHVASTVTTIGASAFAYSKFTGGITVDNAAVIGKEAFAGVNASAITLNGAWNIGESSFAYATITGAVSVAGPATIGQNAFYGLKAESLTLDDEVANIGEAAFAYETINDTINVAGSATIGKNAFYGTKATSLTLGGKATTLAETAFGYARITNVTVDAATISNQAFFHLFTDNLMFGPDVQTITGGAFQFIQNMKDLPNINGQDNPGNQIPTLTIPANISVIDGSAFYGSKLGTVAIADNSRLTTLGFQAFAFSSAMAINLPDSLEQIGDQAFYGGHLIQVAFGPNLQTIGDLAFTEFGPLQNVDFSRATALESIGDSAFAYNTINNAIVLPPNLKIIKNAAFVGNKIPALTLNDGLQTIGDSAFGYNKIQNGLAVPDSVTAIGKYAFVYNSISNLTLGTGLQTIGQEAFEANIILNALNIPASVTAIGAKAFNANLIPEVAIAGTPTIDQEAFSNNRITVLHAATAVPTTPDALNQNADAYTDSAHVSLRDLFSVAISGVSQDQIVVSNIQGTGVAFNTATKSFTMPAGTEQFSFNWSLKAADGTTYTGLYKVHLNDPVIHAHDINLFTGQVWKPELNFGGAVKKNGTEIIEIPLSDLTWTVTDQNGAVIASKDRDGVVTGSVPSDQVTWYTVTYAYGAESGSAKIFYNQRLAASYSLTGTQTATATGQPITVDLTAFSLSLGDGFNAGALQLSDLNFFDASGNQIAADALTKTGVYRVELSKAAWARIAELTNDAGESAANYNFTGTSTAQLIIGLTAIGQLNNSGFTYDGTTLASQAPKLVLNVTLSDGSQQAIDLTSTDISLVEADSPDVGTYRYLLNGSGLTRIQAILGDEVTIDQTDINTHPGVITITPATATATVNGTQFVYDGKTTASQASGLQLTLTAGSGTTVVDLSSTDIVVGSDSVNVGDYQYQLSQSGVAKVEQALNTNYQLPSDLLGSLTGTITIAPAQGTAELLDDSFIYDGKTKASQAQGLTGDVTIGSATVPVTLTSADIAVVNDGVNVGNYQYSLTNTGIAKLQQAVGSNYQLNADDLAKLTGTITITPAASTATLTNTSFVYDGKTKAGQAQGLTAKVTVGSATVPVTLTSTDFVVGNDGMNVGSYQYSLTNTGIAKLQQAVGSNYQLDASELAKLTGAITITPAEGAVNLSDTSFVYDGKTKASQAQGLTANVTVGNETVPVTVTSADIAVANDGVNVGSYQYTLTDAGIAKLQRAVGSNYQLNASELAKLTGTITITPAEGAVNLSDTSFVYDGKTKASQAQGLTANVTVGNETVPLTLAPADFVVANDGVNVGSYQYTLTATGIAKLQQAVGSNYQLTVSELAKLTGNINITPATTTADLNDGSFMYDGQTKASQAQGLTAVVKLGDDTTSIKLDASDIVVADDGVNVGSYHYRLSTDAITKLQQVAGPNYQLKVDDLAALMGIITITPAEGTATVNDTTFVYDGRTRASEASGLNGVVYLSRGTARLTVALTTQDIVVDGDNTTTGTYHYHLSHSGIAKLKAAAGTNYALNETDLNALTGTITITPLTVVATVNNGHFQYDGVTRASQASGLLVTVQLPTGAQTVALTNADIDVANDSVNVGTYTYRLSASGIAKVMVALGPNYQINDTTMNGTITITPAVLSGQLSGMQQKIYDGQPGELNAQHFELIFTDGSHIILEDSDLAFADGIAPIVVGRYAVTLSAGGLKRIQALLPNYLLENVDTQQAVFEIVAKSGPLPDTGTGTDTGTGTNTGTSTGHETGKVPSVTGRPSQSINQQTPVKTTHQLPQTGDTSANDLSIVGLILTSIASLFGLAGVRNKKRSE

SEQ ID NO: 2941 - protein, 361 aa, Lactobacillus paracasei
MKLDLELRPGANRFVSESGALAYLDTILADFNQPVVITGEKSFTAFTKAYPGELNLPVYHYDGSASDENGHELAQEIGHADAVVGIGAGRLIDTAKVAAEALGAELISIPTLASNCAPFTPLAAIYHPQGHTFSYVEYFKKSAYITLVDYNLLLSTPHDFFVAGIGDTLAKWYEMDGITRDKVDQLKAYGQLSRAAAKTIQKILFKDAEQALADLDAGRDTPAFEAVADTIIGLAGEVGGFGGIDGRAAGAHATHNGLSYLPETHAILHGSKVAYGILVQLAETGDDTEIRNLIPFYEKIGLPLNLEDLHVTDQVDEKIKQVAEFAAKPDETFILVDPTLTPAKVADAMTKVEQVTSEPAA

SEQ ID NO: 2942 - protein, 399 aa, Lactobacillus paracasei
MTLTEQLMQTLAADESEMLAIRRHLHAHPEISFHEKQTAAYIKQYYAALNVPVTPCGEGYGMYVDIQGGQPGPTLALRADFDALAIQEDNDLSFKSQNPGVMHACGHDAHTAYLLVLAKELIKIKAKLAGTIRIIHQPAEEVSPGGAKGMVAAGVLEGVDNVLGVHVMSSMPTGLIGYHTGATQTGRANFTDTIIGKGGHASMPHLSNDAIVAGSYLVTALQTIVSRRVDPFDTASVTIGSFDGAGSFNAIKQDVVLKGDVRMMKETTRKTIRQQIVTMNQGLETMFGVKTKLDYDDNYPVLMNDATLTENAMAAIKAANIPEIKAIKDTGVQDPSEDFAYFAQKVPSSFFYIGCQLPDGSNHPHHSPDFMMDEDAILIAAKAVGAAALGYLQSESTTR

SEQ ID NO: 2943 - protein, 162 aa, Lactobacillus paracasei
MRLLIEFLISVLSSIGFGVITNIPKRALLPAGITGGVSWCAYWLIRLQDHSLILPNFTATVIIGLLGNYFAIRHRVPVNTIYIPSLVSLVPGGIAYLGARSFTMGKAASAAQQIYNVILIAMALAVGFVVAEVIFKAVRPQLVRLIAKLPKVQTKSQRGKRP

SEQ ID NO: 2944 - protein, 254 aa, Lactobacillus paracasei
MSQPGTEEVLEVCGKVGEILLNAGAETSRIETTVEYIGHAAGASVACYATITAVFVSLENESRTRLIKSTLGGFNLQKVDELNQLSREFVAHRITFEALKQEVARIDHQVINFPWWARILGAGWVSVAPMLLFKATNGDLALAFFVGIFGYLAAEYVGRRTTTPYFKEATGAFVVAILAELLVSIGWGDSSGNIIISALMPLVPGVAITNAIREILSRQIISGIVRTVDAIFVAGAIGSGVVIAIVLNNVWGGR

SEQ ID NO: 2945 - protein, 69 aa, Lactobacillus paracasei
MLGFWTSRALLFFFLFLVLLLLGLGIVVILRRKDFSLAVKLALALLLIIAFLGIGYVLLFIFFIGFNTP

SEQ ID NO: 2946 - protein, 633 aa, Lactobacillus paracasei
MPDVKKFEAGTYDVIVVGAGHAGCEAALAAARMGQKTLLLTISLEMLAFMPCNPSLGGPAKGIVVREIDALGGEMGKNIDRTYIQMRMLNTGKGPAVRALRAQADKAAYHRSMKHVIENTPNLDLRQGLATEVLVENGQAVGIVAATGAMYRAKSVVLTAGTSSRGKIIIGELMYSSGPNNSLPSIKLSENLEQLGFKLRRFKTGTPPRVNGNTIDFDKTEEQPGDKTPNHFSFTTPDSVYLKDQLSCWMTYTNATTHQIIRDNLDRAPMFSGVIKGVGPRYCPSIEDKIVRFADKPRHQLFLEPEGRDTSEYYVGDFSTSMPEEIQLKMLHSVAGLEHAELMRAGYAIEYDVIEPWQLKATLETKVVDNLFTAGQMNGTSGYEEAAGQGIMAGINAALRAQGKGPFTLKRSDAYIGVMIDDLVTKGTNEPYRLLTSRAEYRLLLRHDNADLRLTPMGHELGLISDERYAEFLAKRQAIETELNRLNTTRLKPKDVNPWLEAHHYAPLKDGVLASDFLKRPEIDYQTMAQFLPDNPTLDHRVIEQVEIQIKYAGYIAKEEASVAKLRRLEGKKIPLRINYAAINGLATEARQKLVKIQPETIAQASRISGVNPADVAILSVYIEQGRISKVAQ

SEQ ID NO: 2947 - protein, 462 aa, Lactobacillus paracasei
MSASITAYDTIAAISTPPGEGAISIVRLSGETAVATANQVFKGKDLSQVKSHTIHYGHIVDPESGELIDEVMVSVMLAPKTFTREDVVEINCHGGIVATNRILQLLLGEGARMAEPGEFTKRAFLNGRIDLTEAESVMDLIRAKTDRAMQVAVNQLDGNLHTLIKRLRQEILEVLAQVEVNIDYPEYDTDEMTTKMLLEKAQTVQKAISNLLSTASQGKVLREGLATAIVGRPNVGKSSLLNHMLHEDKAIVTDVAGTTRDVLEEYVNVRGVPLKLVDTAGIHDTTDKVEKIGVERSRQAITQADLILLVLDQSEPLTDEDEQLIQATANKKRIIVLNKQDLPAQLDTTALLKLVSPDEIIKTAIPTSAGMDALDERIAKLFFGGIENSQTTVMVSNARQIGLLRQANKSLDAVIAGIHAGMPIDLVQIDMTAAWDKLGEITGESAPDELITQLFSQFCLGK

SEQ ID NO: 2948 - protein, 254 aa, Lactobacillus paracasei
MPTFQGSTIQKAIETGLKQLGLPRDAVSVEVVRENKNGFLGLMRKPAIVNLKPLEPPIDADPTPSDDPPAKPRAGKKLATALTDGAGKKIASAFNDITTKKRDNQTALAMVQSYLEDITTGMGIDTQVTSERQGNTVTFQLKTDEEGLLIGKHGKIINAIQYLAQTEFNHYAKSKWTIMLDVGDYRERRQATVTRLAERTAREVLATGKAVYLDPMPSFERKTIHTTLVDNTYVETHSEGVDPRRYVVVTPKRP

SEQ ID NO: 2949 - protein, 278 aa, Lactobacillus paracasei
VKNRQIKRVLVILSMLSLVFILTACGTGPVTQNSTGFWDRYVVYTAGQFVIWLANLFGGNPGVGIIAFTLIIRILIFPLSYMSIKSMSKQQEIAPQLKELQKKYSSKDTETQTRLRDETQKLYASAGVNPVMGCLPIVIQMPFLIALYQAILRTSSLQTGTFLWMNLSQPDPLWIMQILATLFTLGTSVLSMMAQPTRNSSSWLMMIVSPVMIFVFSITLPSALAIYWVVTNAFSMIQQLLIQNPFKIRREREAKAQAEKEKERALKRAYKKATKRRK

SEQ ID NO: 2950 - protein, 174 aa, Lactobacillus paracasei
MTPMNGNGPIVGRCRSFSAQQLKLNVQIRNRQQTADTYRKTPSHLVYLEPDCEGASLRKSYRIKKEAEFQNVFDHGDSVANLNFVIYHMKRDQPHFRVGISVGKKVGHTAVMRNQIKRYIRQSLLELKPNIDAQTDFLVIARKSANQLDMAGTKKNLIHVMRLAGILNEDIEVI

SEQ ID NO: 2951 - protein, 46 aa, Lactobacillus paracasei
MTTKRTFQPKKRHRERVHGFMKRMSTKNGRKVLARRRAKGRKVLSA

SEQ ID NO: 2952 - protein, 449 aa, Lactobacillus paracasei
MPNLEELWAYLNDKFREELTPVGYSTWIQTAKPVKLTKDKLEIEVPASLHKAYWEKNLVTKVVEGVYEFAQLEVDPVIMTKDELQPAPATDQRPAVEEDDQNLTFKAKTHLNPKYTFDRFVIGKGNQMAHAAALAVAEAPGTTYNPLFIYGGVGLGKTHLMQAIGNLVLGNNPAANIKYVTSENFANDFINSIQTKQQEQFRQEYRNVDLLLVDDIQFFGDKEATQEEFFHTFNTLYENMKQIVLTSDRLPNEIPKLQERLVSRFNKGLSVDVTPPDLETRIAILRNKADAEDLSIPDDTLSYIAGQIESNVRDLEGALVRVQAFSTMKNEDITTSLAADALKALKLDDRSGQLTIPQILNAVAKYFQLTVQDLKGKKRVKQIVIPRQIAMYLAREMTDNSLPKIGQEIGGKDHTTVIHAHEKIMASMTTDENLKAQVIELRNILKNRG

SEQ ID NO: 2953 - protein, 379 aa, Lactobacillus paracasei
MKFTITRSTFLKTLNDVSRAISTKTTIPILTGLKIVLNDSGLILTGSDADISIESRINATDENNDLQIGSTGEIVLPARFFSEIVKRLPESTMTLEVKDNFQTVITSGASEFTINGLDANNYPRLPEITADAALSVSADVLRQLINQTVIAVSNQESRPILTGVHLTITGDQLVAVATDSHRLAQRSLTLPTASASDYDIIIPGKSLTELSRMLSDDVEKIEIRIAENQVLFVFGQTAFYSRLLEGNYPDTSRLIPTSSNTQAEFDAPALLASIQRASLLSHESSNNVVRLVLNIADQKATIYGNSPDVGNVEEVLSFNKLSGEDLEISFNPDYMKDALQGFGQTAIEVDFTAPLRPFTLVPTEDKERFIQLITPVRTF

SEQ ID NO: 2954 - protein, 60 aa, Lactobacillus paracasei
MTSTTKSVFGIFLISSVATYVYGNFNTDFHNWLNPMTILVSVLMGCVLAFVYYYFVKRKH

SEQ ID NO: 2955 - protein, 70 aa, Lactobacillus paracasei
MTTIEITTPFLTLGQFLKEAGLIDSGGAAKWYLGENSVTVNGAAEERRGRKLYPDDQVSVAGQTYVIVSA

SEQ ID NO: 2956 - protein, 371 aa, Lactobacillus paracasei
MKLDHLVLKNYRNYAAVDTTFSPEINVLIGANAQGKTNLLESIYVLALARSHRTNNDKELIRFGSEFARVSGQVSRQSGSHQLELIISHQGKRARIDRIEQPKLSQYLGHFNVILFAPEDLAIVKGSPAGRRRFIDMEFGQMSPKYLYNLSQYKTFLKQRNAYLKQLKYHQAKDLVYLDVLTDSLAAFGAELITARAKLLETMSDYAATIQQDITKGRESLHFSYQTQVDPSLRGDSEQVYTALGEMFAKQQAREIEQGTSLVGPQRDDVLFIVNDKDVANFGSQGQQRTTALAVKLAEIDLMKDQTGEYPVLLLDDVLSELDAARQTHLLKAIQTKVQTFLTTTSLEGIQKEIIATPAVFKVDEGTLARA

SEQ ID NO: 2957 - protein, 653 aa, Lactobacillus paracasei
VTDKKETAEEKKDELAAEYDASQIQVLSGLEAVRKRPGMYIGSTSSQGLHHLVWEIIDNGIDEALAGFATRIEVEVNPDNSVTVTDDGRGIPVDIQSKTGRPALETVYTVLHAGGKFGGGGYKVSGGLHGVGASVVNALSTDLDVTVTRGGKRYYIDFIRGKVNTPMKVIGTAPEHEHGTKVHFLPDPDIFTEIRTFDDKILTTRIRELAFLNKGLKLTFTDKRAATHEKLVFHYEGGLKSYVDFLTEKKENLLQEPIYVEGQDKGITVEVALQYTNDYHSTLLTFANNIHTYEGGTHETGFKTALTRVINDYARRSGALKDSDDPLSGDDVREGLTAVVSVKHPDPQFEGQTKTKLGNSDARTVVDRTFSDHFNKFLMEHPADGKLIIDKAMLASKARLAAKRAREVTRKKSGLEISNLPGKLADNTSKDPEISELFIVEGDSAGGSAKSGRSRLTQAILPIRGKILNVEKASMERILANEEIRTLFTAMGTGFGQDFDINKARYHKLIIMTDADVDGAHIRTLLLTLIYRYMRPVLDAGYVYIAQPPLYRLRQGKMTQYIDSDEELQDILGQLPPSPKPEIQRYKGLGEMDANQLWETTMDPDNRRLLRVSPKDAEAADGVFEMLMGDHVEPRRKFIEDNAVFVDPNNIDA

SEQ ID NO: 2958 - protein, 873 aa, Lactobacillus paracasei
MDDRQESRITNVNLGETMRKSFLEYAMSVIVARALPDVRDGLKPVQRRILYGMNELGVTPDKPYKKSARIVGDVMGKYHPHGDSSIYEGLVRMAQDFSYRYMLVDGHGNFGSVDGDGAAAMRYTEARMSKIAVEMLRDINKDTIDFQDNYDGTEKEPVVLPARFPNLLVNGATGIAVGMTTNIPPHNLSETISALHVLMDNPDATTADLMQALPGPDFPTGGVVMGKSGIRHAYETGRGTIVLRGKVDVQTEKSGRERIVITEIPYMVNKAKMVERIADLVHEKKIDGIVTLRDESDRDGMRIVIDVRRDASASVILNNLYKLTPLQTGFSFNMVAIVNGAPKVLSLKQILQYYLDHQENVIRRRTQFDLRKAKAREHILEGLRIALDHIDEIITIIRSSETGDKAKVILMDKFKLSDKQSQAILDMRLVRLTGLEREKVESEYKDVEAAIADYTDILARPERVHQIIYNELLDIQKKFGDKRRTELLVGEVLSLEDEDLIEQEDVVITLSHNGYVKRLATSEFKAQNRGGRGIQGMNVHDDDFVERLISTSTHDVLLFFTNKGKVYRSKGYEIPEYGRTAKGIPIINLLGVGAGEKIQTVINVHEGENDDRYLFFVTQKGVVKRTPVKEFANIRSNGLIALNLKDEDELNNVILTSGQDNILIGTHLGYSVTFKEQDVRSMGRSATGVRGIRLREHDYVVGSDILKPDSEVFVISEKGYGKRTAAKEYPIKGRGGKGIKTANITAKNGPLAGVTTVDGTEDILVMTDSGVMIRFNIQSVSQTGRATLGVRLIRVDDDAKVATMAKVEPESDDPDDGSKPDQPTSPTDASDAPTSQQPADGSYAGDADQQVSQLLDRAEADQPEQHDTGDQPE

SEQ ID NO: 2959 - protein, 234 aa, Lactobacillus paracasei
MTAYTLDQFSRMIDHTNLHADATHADLRQLCNEAKQYHFKMVAINQVQSAFCAKQLAGTDIDVGAAIAFPLGQTSIAAKVFETKDALQNGANEIDYVINITALKEQQYSYLENEMRQIVAVCHAVNVPCKVIFETAYLTKPEIIKMATIAKDVGPDFIKTSTGFGPAGATVENVALMKETVGDQVQVKAAGGIRDVDTFLAMIKAGATRIGTSSGVKIIHELKARMGNQSTFTI

SEQ ID NO: 2960 - protein, 143 aa, Lactobacillus paracasei
MLNSVSLTGRLTKEPEVFRTANELDIVRFTLAVNRVFKNKTGQRETDFIECVIFGKRALTFAGSTTKGSLLGISGRLSNNHFENKQGEQVWRTAVVVDNFAWLESRATTESRRAGTLQATGTDDVMPVEEGTPPQVATDDLPF

SEQ ID NO: 2961 - protein, 98 aa, Lactobacillus paracasei
MAETKYEVTYIIRPDLDDAAKTELVERFDNILKENGANIIDSKDWQKRKLAYEINKYNEGLYHIVNLSAEDDKAINEFDRLGKINNDILRHMIVKRED

SEQ ID NO: 2962 - protein, 198 aa, Lactobacillus paracasei
MLNSVALTGRLTRDVDLRYTQSGTAVGSFTLAVDRQFRSANGERETDFINCVIWRKSAENFANFTKKGSMVGVEGHIQTRTYDNAQGQKVYVTEVVVENFALLESRATTQQRPSEPANPAGQGNQNYGGGQQFGNNQPQNPPSFGSQGAPNNASSSNPGQNPAASQNQGGNSAANPANPDPFANNGKPIDISDDDLPF

SEQ ID NO: 2963 - protein, 78 aa, Lactobacillus paracasei
MAQQRRGGRRRRKVDFIAANHIEYIDYKDTNLLDRFISERGKILPRRVTGTSAKNQRKLTIAIKRARIMGLLPFVSED

SEQ ID NO: 2964 - protein, 492 aa, Lactobacillus paracasei
MGLTLATIPLAVTNLSRMQFAVTAITHFLFVTTTIGMLLTTMIFEFMYAYGRGDTEKYGRLTLFFSRIFFFSFGTGVVTGLIMEFQFGMNWSAFTRLMGDVAGVPLAIESMISFFVESTIIGLWRFTWGKLPKRAHAWLGVGMLGASLFSIVWIIAINAFMQNPYGFRLEGGRARLTSLITLLQNPQYRPEFLHVLFAILITGGFLTAGIAAWQILHKRDTSAFKIAVQIGLLIALPAAFLQPAQGDDQGAATAALQPMKFTAIEGRYETEGSPTTGAPWAMAALINEDTHTTKAVSIPNMGTYFGKNTFTGTMPGMNAVAKMYHAKFDKTVAKSYDGQMTYYPPVTLLFWTMHLMVYAGYFFTMFALFATIMLHRRQSAIEDHPKTLRTLGWVLWLPYLTFTSGWIVAEVGRYPFVVYGLLTQYDAVSPSVTVTEAGTSLALFLMADIFLVTTMIYISHRTVKRGLPQITGDYPEDRTIPDPFAKEAFSHA

SEQ ID NO: 2965 - protein, 339 aa, Lactobacillus paracasei
MPSLSNLQVIFLGIISTELMLFFVLDGADFGAGMATFFVGDDLSKRQQIMKVTGPVWGGNETWAVTAFAVMFAAYPGWYSALTSGYYPLIFLMLFFLIFRGVSFDYRNQWHSRHYNRFWDWALFIGSLMPPFLLGIIFSSTVSGVPIRNGFVYASMGDILTPFSILGGILAVLLSLNVGLNRVIKKVTEPVATSLTVALKRTTWILYPALVLFAILLPFNTQFFTNRPVIVTLLLILLVAFLGVETWAISQQRRRVAFWLSVGTMASFIYTIFLGVFPTLIVGRTAGTSITALTATSGPVSLLWTAWLFGFTIILMVGLQATAYHLINKYYHEPASPMI

SEQ ID NO: 2966 - protein, 64 aa, Lactobacillus paracasei
MKKIWINVFWGLLVVGFWLYQLFWPLFWNPISKFYGMVALYSIAAIAFGFAVRATLKGYGRQKA

SEQ ID NO: 2967 - protein, 197 aa, Lactobacillus paracasei
MNKGRVEAFTDAVVAIILTIMVLEFKTPGTAKWTGIIHQLPYFFAYIVSFLFVGVAWYNHHYMFALALRISKKVYWINNLWLFSMSLLPVATGWVGKFPQATGPEYLYLFVFIFWSLSYLWLSDAIRKTPEHVHTAVSQKIAQMFPFKFLSSIFFPLSIGITAIGIYFYPALGISITFVGLIILSFLTPSDSDQVSQ

SEQ ID NO: 2968 - protein, 123 aa, Lactobacillus paracasei
MYLRFSILGMLLWAQHTSEDQTGKIALSLNGGYILFFLGGMLHSPELSMIPIFLLIYGNANFIKHIKGDEPYLFSNVGSLLIMTVCFATIFLMKSRYAFVLIPLFSLCSNSLLVSLQVSEKHK

SEQ ID NO: 2969 - protein, 100 aa, Lactobacillus paracasei
MAYLNSILQLPMALLLLAQLLVMVTAWFTNAVTIWQRLSMTFAALVLAGSHLVIMYGFGYLADAHVPIAGWTWFALAAAVLLLLATIAGASRHERRSSYR

SEQ ID NO: 2970 - protein, 319 aa, Lactobacillus paracasei
  misc_feature (4)..(4): Xaa can be any naturally occurring amino acid
CAAXAMINTERMINALPRTEASESELFIMMNITYMVDNRTLLKEIIAVSLTAIGWGILPSLAVGMLLGLLSMNTATLLDTRFIILIGFVAQFLGAYLMWQRHKSQLQMIKFSTKVAFKTCVLGSLIGLSAVLINWGIITLLGGYKLIFNYQWSYLPVFFLFLIGYTIQAIAEELICRGYLMGYWLEKKRIVLAFLTNSILYVFLHVVNAGFDAYAALSLFLFSILMSEIRLISGNIWLCGAINAAWHFSEGIIFGTIVSGFPAIRLFITSTPTSNTQWLNGGVFGIERGAISIMLLILLIMIVVRLHKHHLKSLPQQLG

SEQ ID NO: 2971 - protein, 60 aa, Lactobacillus paracasei
MTSLTMFSTLSLQDCAAVTGGSKRKGWVDIGIGLAQEAFGHIDDIVAGFNEGNHRNFPRH

SEQ ID NO: 2972 - protein, 59 aa, Lactobacillus paracasei
MVKQLSLTELSMQELQLVVGGDGSSDFWRGVGKELGIIWAAAGDAGYCRAHKYGGPGHC

SEQ ID NO: 2973 - protein, 411 aa, Lactobacillus paracasei
MKFNKVMITLVAAVTLAGSASAVTPVFADTSDSIASNKSETNALLKQIEDANTEVINLNKQIDTKNGQISDATAKISATDAKISSLSGEIVAAQKNVTARKNNLKDQLISLQKKAGNSVSGNVYIDFVLNSQNLSDLIARTMTVGKLSQASKDALDAVTVAKDKLAGLKTEQENARQTLVSTKASLETQKSQLVSLQKDANDKQDALNKQIADHKDELVALQSQFAQEQSEAAAATQAALKTVAASTASSSTTSSSSSATSTSTIANNTSSSSNNSSSVITNNTASGSGSHADFSGSGNTYPWGQCTWYVKSVAPWAGNGWGNGAQWGGSAAAAGFTVNHTPAAGSIIVFAAGQSVGGQWTADGSYGHVAYVQSVSGDSVTISQGGMGFSSPTGPNTQTISGASSYVYIHR

SEQ ID NO: 2974 - protein, 857 aa, Lactobacillus paracasei
MKPLTKNLWRNIRDSLGRFIAIVIIIMLGVLLFVGVKATGPALKDSLNTTVKADHLADSQLLATTGVSKAQVKAAESVSGVQAEAVKFKYVIGGRASDVVALYGYQKGTTINRLHLTSGQLPTQANQIVLDTAAKKSGYKLGQTYTFTSGSKLARRTFKISGFADSPAYIEDTSRGSANIGDGTVRYFAYIPASQMKMPVASQLNIRFPALQTRDTFSNRYKDAVATKMKLVKQRVKAQGEKDLRAAVYANIVKTATAKAQAQLAASGMPAAAVAAAADQAIKPQLSTFQQQATVTARKQLSTSLTWQTREDLPGFGDYGGSADRIAAIANVFPVFFFLVAALITFTTVSRMVEEARAQIGTFKALGYGKWAIARNYLAYAALAGLLGGIIGVFAGNLSIPRIVLSLYKNYIPLQQVVSLQWPLIALSLLLALIATLGAAAIVVRNELTEKPAALMRPRAPKSAKRILLERITPLWSRLSFNQKVSYRNLFRYKSRLVMTILGIAGGTALILTGFGIKDSITATGIQQYGDVIHYQAIVRLADGKKPAAARDILAKSKAYRSAGTVSGAVAKLSAKGHSLSDVNLFAPANGNDLEPYVSLRSTASNRKLTLPRHGIVITSKLAKALNVTTGDTLKVATTNGQSKRFTIKGIAKNYVGHFGYLSNTAYHQLAGNSAKPNTLLVRLQPQSSKQNDRLAKQLLNHHAIVGISFTTTAKKTLSNMSGMLDPIVLIFILLSAVLSFVVLYNLNNINVSERIRELSTIKVLGFFDREVTMYISRESIVLTVIGIVFGYLLGNLLTAYILYQAETEAVVFPLTISIVGYLTATLLMLAFTGVVTWLTHRRLQRVDMVEALKSNE

SEQ ID NO: 2975 - protein, 233 aa, Lactobacillus paracasei
MAYIEVKHESKRYKMGETIITANNDINFTADQGKLTVILGPSGAGKSTLLNILGGMDSPTEGEVWIDGTDIATFSDRQLTAFRRHNVGFVFQFYNLIPNLTTRENVELAGSIVKDALDPTTVLKQVGLGARLDNFPSQLSGGEQQRVAIARALAKNPKLLLCDEPTGALDYRTGKQVLQLLQDASRKDHKTVMIITHNAAIAKMADRIIEINDAQVRSIHDEPQPTPVADIEW

SEQ ID NO: 2976 - protein, 183 aa, Lactobacillus paracasei
MSGTKDNRRVQYTMDRFKDALLHILATKPLDEVTVTELCRQADLNRGTFYLHFQSPRDLFERIEMDLVEAIRPYLTVKINDMATWLVPILNVIANQPQAAAIILNNPDSVVLKKITDPIRQKTETSYQSWYGETDKSVLTYYYAFFIDGAIGVLTKWLKNGTVERSEQIAAVIENVVTKGAPH

SEQ ID NO: 2977 - protein, 268 aa, Lactobacillus paracasei
MQNVKLIASDMDQTLLTSAGTLPPHFDRYLHRLGEAGIEFAVASGRPLYTLQETFPHFSDQISMVCDNGGLVYSHGQLIGKSLIPEEKYREIVQFIMTKTDGVPVLCALDAAYINATDAQYSPALLPFYHQLKKVPDLLTQSLAVDKVTIYFPNKDSRKNSERYFRPVFGKDYTVQVSGETWLDIQNLGVNKGRGMRILSRHFDIPTTQMMAFGDYDNDIPMLETVGYSYIMANATQGMAQHAKYRTRSNDEFGVLHVMDQVLQAQEG

SEQ ID NO: 2978 - protein, 106 aa, Lactobacillus paracasei
MAVISIRVAIGVYGFLMLLTAWQAWQKKQGDVRLDQLTALAAALVMTAAIIPDKFSALTVLLIGLLALSTVTWFNGVAVYGKPHVNHHIIRLLVHLVLFGLAVWLF

SEQ ID NO: 2979 - protein, 226 aa, Lactobacillus paracasei
VTLAANWIVVIFSLLFVSLGLSAYTYYLRYRFKYDPMSLRRAFKSDATSPYRFGESSNPQISVLAHWAKIVLVGYALSAVATLGFLMIILTETISTGTIDNSLLAIGVFSFTIVLGIVSYVINQKKLMLQMKEYQLLKKTEEISKTIREFFEGQTPSIGLRILNLGIINLVFFESDFKPCFRMFLNDPLEYNLTDQFLKVYQLVIIEPQAVAMLSISQSQSLTVSC

SEQ ID NO: 2980 - protein, 167 aa, Lactobacillus paracasei
LELLQLMLGVLGFTVLLSSLFLTTLVRRQAAHQKRSEAYIEVAKYLGENPTLFKKVNQLVKLESTTKILSLVFFLGGWIVYSINDFLIISLDDSVRVMILWTSIVLFVILTIVQMMLEFRHKKLLASPLSNISLVENTAGEKRWILSKILLMIGTAILTTWLQLVAQ

SEQ ID NO: 2981 - protein, 716 aa, Lactobacillus paracasei
MADEAVRAVQKWLNKTYGSVPGFVAAPENGQTGWPTIYSLRMGLQHEIGISAIGEGFGDTTKNALAPVVGSLKPGYKGNIAQLIQGAFWCKGISPVDFNNEFTNNTLNAVKELQQDAGIAADGSVTVAFMAALFDMAAFVLVSSGDAKVRTMQQALNRKFSGELQELMPCDGIYQRATNTALIYALQRAIGMSSAQANGNYGPGTIAATPTVNQGANSDVVQVIQYGLYVNGFYTGAFGGYFSSDVATAVVAFRKFMNLPPFNSTADLTVIKGLLTSNGNTNRDSNTFDTATQLSAAQAKQLKQFDFSIVARYLTGSVGAGAAERDKYLTSTELANLTEAGLKVVPIYEDGGYELDYFSLQQGIHDGFVASSTAAKLGFPAATTIYFAVDVDVQSGDIDGTIIPYFRGISQAMNNSIFKIGIYGTRNVCNRVTAASGTNILYSYVADMSYGWSGNLGFKMPKNWAFDQFVEYSAAGVDIDQVASSEKDQGSGTFKVDPNAVRLEFARTLINNAYQLKPLQPDIPTLEVDGPEIHVSTILAEFYIKLSSTFASNDSGAPLGFTISNGKLGTQVQSEIDKFKEAHEAARNFDFTALLGTLGPMIGNGNLKVGMSTKNGMLGFKVVCESTTTVVTNGQQENVTTSLSIEIYTKPNGLGIPAEDYKPIYVPVSEHEPNLEWIPWAAGAVVLIATIIMAPEVAATLVGTAAKLLPATFIAA

SEQ ID NO: 2982 - protein, 257 aa, Lactobacillus paracasei
MNFSIFAFLLIAGIGAGLTSTLAGLASLVSYPALLAIGVPPVIANVTNTAALVFTGVGSAVSSLPELRGRGKFLWRLILLVSLGSIFGSALLLIAPAATFEKVVPFFIIAAGLLLLFSGRLPTQEHRPGEPARTLTFGQEAAQTIVIFVTGAYAGYFGAAAGVVMLATLTLTVDQPFIVSNSMKNLTGFAANAIATVIYAFTTKIEWLMVIPLGIGLFIGSYIGPIIARRLPVQLLRFIIAALAFLLAAKLFAQAYL

SEQ ID NO: 2983 - protein, 201 aa, Lactobacillus paracasei
MYMFENSKSRLDAISDGVFAVVLTLMVLDIKVPKTLTMADLYATGFSVVIYFISFAVVGQYWTFHQELLHTVTQPSTNFLVLNFFYLVFICLVPFATSFIGDHPGSRISATLFAIIIFMVDLFQFILFRSVIGEQPKKENLNAHDWEEYRAVSLMVLVAVVYILVGLLLPKWILVVIALGLGARTLNNTIGRRLQRQSKAK

SEQ ID NO: 2984 - protein, 297 aa, Lactobacillus paracasei
MPTPTETWRPVTRDDASGLTQLQIDFGITDEMLGYARDDYEQPHMEYDAESDTFLLIYNVPSDKPDTDGYLSEPMAFLVTDDRLITVGSHDVNNTNAAIAKTVARFGSESVYSLLWQCLLAITDNFVTLVKQQDATRRQIATRLREHTTKKDLLKIAELALSADFLVRATIQNAAVLKQIHASTRVPGITGTQGEQLEDVIIEADQIAEMMNLSSHTLDHLTDSYNTVLNNNLNDIMRFMTVWSILLTVPTIVSGFFGMNVPLPFAHEPLGWIITIIIAAILWIALGLLLNRYIRKN

SEQ ID NO: 2985 - protein, 212 aa, Lactobacillus paracasei
MASSADNILHQTQLFTNFTAKQKLIIIAAIEVFAEKGYAAASTKEIALRAGVAEGNIYSRFTNKRGLLNAIIAPVLSQMFPDELDDFIKSRLHQDYVSLETFLTVLIKDRVTFLKDNAQIIKIVLSELLNDTQVRAQVVDGFTTQYWESMTHDLNAMVKRGLIVDWPLEDILRTMWSMTGGLILGFLYFDQPLDANTVNHAITAAIKALSPN

SEQ ID NO: 2986 - protein, 52 aa, Lactobacillus paracasei
MGLSENLKSTSWSHYSTQPVASIAILANKLSKPNLFLDLYPKGCIFMSDDVE

SEQ ID NO: 2987 - protein, 458 aa, Lactobacillus paracasei
MASEDKKSKREHIIHFEDTPSKSLDEVNGSVEVPHNAGFWKTLAAYTGPGILVAVGYMDPGNWITSIAGGASFKYSLLSVILISSLIAMLLQAMAARLGIVTGRDLAQMTRDHTSKAMGGFLWVITELAIMATDIAEIIGSAIALKLLFNMPLIVGIIITTADVLILLLLMRLGFRKIEAVVATLVLVILLVFAYEVILAQPNVPELLKGYLPHADIVTNKSMLYLSLGIVGATVMPHDLFLGSSISQTRKIDRTKHEEVKKAIKFSTIDSNLQLTMAFIVNSLLLILGAALFFGTSSSVGRFVDLFNALSNSQIVGAIASPMLSMLFAVALLASGQSSTITGTLAGQIIMEGFIHLKMPLWAQRLLTRLMSVTPVLIFAIYYHGNEAKIENLLTFSQVFLSIALPFAVIPLVLYTSDKKIMGEFANRAWVKWTAWFISGVLIILNLYLIAQTLGFVK

SEQ ID NO: 2988 - protein, 119 aa, Lactobacillus paracasei
MESNNLASQITKFVGEKHRIVKAEEIYTAFKEEFSDGQIAGVLRRLRTTGRLVSPKRGYYENTKSSNVLAELVKDISNLIQKYNTSVPITVFNGLNAADRKKYTETLDKLMACQKSIES

SEQ ID NO: 2989 - protein, 480 aa, Lactobacillus paracasei
MDQFVNHLSCTALLVGKKASVDGSTMIARNEDASGGINPKRFIVVQPADQPQRYVSTFNGFQLDLPQTPLQYTCTPVADQSHGTWGEAGINSENVAMSATETEFTNTTMLGLDPLEPDGIGEEAMLTVVLPYIHNAREGVERLGELVTKYGTCESNGIAFSDANEIWYFETVGGHHWAAERIPDDRYVLAPNQTGIQEIDFQAPEHYKYSADLKDFAAKYHLNKAKEGFNFRDIFGEDTQADHYYNTPRVWYAQKMLNPEIDQDPESRTMPFSRVPSHLISVEDVAMVLSSHYQATDFDPYGQTGTPETRRRYRPIGMNRNQEMHILQIRPNMPKSHAAIHWLAEGVNIFNSPVPFFANCTTTPENFQYTPIDKSSTDSFYWLNKLIAMVADPLFAEHDWDAEFAVSESRKFGFAAGRAAVAKGDAAFADVKPEDLPAWHDALNAETAATITNDLQYLLHQLVCIRAEKMTPSFEKGGEL

SEQ ID NO: 2990 - protein, 210 aa, Lactobacillus paracasei
MVGLVLNAAGNGLCIVGAMGSGLWTAAAINLNDWQGWNIGAVLFTFGVLNALSNLLLIRRWDWPRLIGEVIYTLFFSYFVNVFTWLFTWLGLGNWPMVARIFVSCFGVFCFCVAISLYQRANIIMHPNDDTTNILRFLYFKGNATASQITDFIPPIIVIVVAWIATGKLLGINIATLFSFLGNGIIIAWADEHVWPRLVHNFKVKPSEAK

SEQ ID NO: 2991 - protein, 203 aa, Lactobacillus paracasei
MLRLIVILVIFAIFFVPARIIRVEDEKAISFQQKRLPQMTREQIYHARVFYKKTIYARHLLLRILRIISRIFLIITATLFVGALSIQFGLLFNLVPVGMTRLWALSQSDGSRNLLLILASIVGSFGVMTWWYQYSRLLALIEDDSHRPEDLLWTSPTILQRQKECYLFMLVMFLMVVYGFTFLAVTNGIPSSVTPYYLPKIFF

SEQ ID NO: 2992 - protein, 157 aa, Lactobacillus paracasei
MDVYMPFIGMVFIWLLSSAIVSISREKQKSALLREGKYTSESYLETRKQMQRFTTNESNHLFNHIYNIVIVWYFFIVVFSLGTITTNFSSAAVIYLIDTVFFFSFAIFNFGASYYTQKIRRKMNSELPELTFVAKALILIFRDFGTALIFLISYLRA

SEQ ID NO: 2993 - protein, 112 aa, Lactobacillus paracasei
MDYIYFVPHLLVMIIFAVTLRIKSELFKKERIERKDALKKIGAVDTVDLEGNDDNSLNVIIGRNLYTEKMMNSQMIGSYLAVTFLSAGVIYGNPSSGLLLLPSIGFFSFLRT

SEQ ID NO: 2994 - protein, 236 aa, Lactobacillus paracasei
MNDELTIRSGIHDVMPTVFGYITVGMAYGIVAKTGHLSLLMIGLMSLIVYAGSAQFVLVSMLATGSPIGAMVISTVLINARMSLMSMTVAPYLKDESMTQNVLIGTLLTDESFALSMNKLNYTNHHLNAPWFHSVNVGAYLVWFVASLLGALIGGLIPNPDSFGLDFAVVAMFIGLLYLQMITDRSKPFLRHLSVAGVVAAAMVVLVRYLPGTTAIIVATVIGCLFGMGVERHAES

SEQ ID NO: 2995 - protein, 109 aa, Lactobacillus paracasei
MQNPETFAAILSCGLATWLLRVVPIVLVKRMTIPKWLLHFLSFVPVAILSAIFVESLLVIHPGQWPGVNWSNLLASLPAIAVAIITKSLFAVVVAGVASMAILRLLGWA

SEQ ID NO: 2996 - protein, 96 aa, Lactobacillus paracasei
MNEKGTALFKKRYQHVLRFQTFWIGFYVIFMPYLLPKRSPVLEMIWVFVIPFSLITYLIYEYFRLKAAKVGSLVFLIVLLGMLVLVCLQILRVISL

SEQ ID NO: 2997 - protein, 71 aa, Lactobacillus paracasei
MINIKRLWLIVLLIVALVVPIFGLIPAVYLFTKRRSTLDFIALNGWITGALVLQIFYLISVIVIGWIVSLH

SEQ ID NO: 2998 - protein, 297 aa, Lactobacillus paracasei
  misc_feature (4)..(4): Xaa can be any naturally occurring amino acid
CAAXAMINTERMINALPRTEASESELFIMMNITYMLTAFPILAILLFNRKFNFNSTSGNLLTLWTSLFGIILLVIRYKGDPYYLPFAKKRMLHRYAKGFLFGLLLFAINWLFIFGLQGFHVRLAFSFSGIPILGLFLVGFIFQSMFEELVCRGYIMGYWLKRQKLLTACLANTIFFTLMNGFNSEFSVSAFLGIFLFGMLLSEIRLITGNIWFCGAFHAAWNFAESRLFGVTVPGLSDSGMILKSTNTGLSPFITGGTFGVEASWLTIGLYLALSFWVLSLLQKQKGKLYGTTIAGF

SEQ ID NO: 2999 - protein, 227 aa, Lactobacillus paracasei
KDPGALDLASEMQKYDYLNRLIKTNCVVVVRGNDAAEAVKTVDAVIAGGITGIELTFTVPHADRVLDQLSEKYGDRADVLIGAGTVLDPATARLAIIAGAKFIVSPSFNADVAKICNLYAIPYTPGCLTPTEIQTALEAGVDLVKIFPGSVAGPAMIKALHGPFPQLAVMPTGGVSLNNLETWFDAGVTLVGAGNNLTAAAKTGDYAGVTATAKKYRAKLDAIMVSK

SEQ ID NO: 3000 - protein, 230 aa, Lactobacillus paracasei
MQISNYQDEAYTAIKQMILSMQLTPGEKVDKYELSTQLNIGVTPIREAIIRLRREGLFDVIPQSGTYVSKINVDEMNQGRFARVELEKTIIASAAERMTADQVDELEQQIALQGVYEHNQDYGHFFKLDHDFHELFYIADHKQFVWTWVQQMNLQFIRYRYLQLEINGMHWHHIIAEHQAIVDAVKAKDTGLASQMATDHLLAVGKDVKSVLTTYPDYFKSHESNEPQLT

SEQ ID NO: 3001 - protein, 117 aa, Lactobacillus paracasei
MSVKSVWRTHYRNGFRVNQELGMPYHLYCGLKATLMALPYGVFVSSLGPNWSWWGLLSGSLWLFFCFNFEIYVHQHIQTRTLAAMRVSKGQWLTRLGGTVLICGVFVYLHIFYIAAP

SEQ ID NO: 3002 - protein, 106 aa, Lactobacillus paracasei
MKAVYKGRSADVWEISQTNERPAWVKAAFEENYLCWLDNHLRILMSGLNPSLGANLKTAAVGTIGGGFAGYNMYALGYLGDYLDVTNHRVVSKKKFLKQYQIQENA

SEQ ID NO: 3003 - protein, 105 aa, Lactobacillus paracasei
MFNNQKNLQVNQEILSALYDFVLNPSITDRERKIGLMAKADMEKGRYNVAVLNQTLISLQREAMKTGLSQDASKFYDGFQVLLNKNVPFGTNRGAMATMSSYLDW

SEQ ID NO: 3004 - protein, 66 aa, Lactobacillus paracasei
VKYFNSLSSQELHLVSGGVKINGSNGYAWTDKHGHWHYTVTKGAVDTVFGIIGNGWGSAGASGRQH

SEQ ID NO: 3005 - protein, 376 aa, Lactobacillus paracasei
MQRKWTEAEQMLLRMTATYTDQEIAPYDMAMANANHYPDGLIEKLIETGFLTIMLPKTYGGADFGPEVTAAVVERVAQGSASVAVTLEGHYKSVEAVMRFGTPALKAALLPQAAKRIFAFGMTEPTGGSNHLGIQSTAVKQGDGWLLNGNKIMITNGGLAEVYCVLAKTGEQELSVFVVDKDMPGVQFGKQENFIGLRGTPVGEIFMTDVWVDDDHLLGKIGEGRIIGDQAHDDARILMGAVLSGITQHALTLAVQYANERTALGAPIGQLQAIQRKLADIATTHEINKLLYEHVVYLKASGQSYTEEAAIAKAHGSRAAVKACDDALQIYAGYGYSRDFPLAHLITDARALEIAEGTVEKMRTAIALSELAKEAD

SEQ ID NO: 3006 - protein, 262 aa, Lactobacillus paracasei
MKIVVCVKQVPASNNVRFDPVTHNLVRSGMSGRMNPFDENAVEAALALRDAIGGEVILLSMGPNDTKETLHDGLAMGADQAILLSSRAFAGSDTLATGYILAQAIRNIGNVDLTIFGRQAVDADTGQVGPIVAEELNVLQATFVSKLKALDKQHLSVTRNLDSEVQSVTLTLPAVISVRSELNQPRYETPIHIQQSLTKPLITWTDQDLDLDQQRIGQAGSPTVVRKVYAPEATSRAAKRLPDDATAAARVVLALMAERGLR

SEQ ID NO: 3007 - protein, 321 aa, Lactobacillus paracasei
MVEKDALWIVAELTGSGVAPVTLQLITKARKIAGTRSVTVVLLEGSTDSYETELAAYGPDEILIVQDDRLREGSDRVVAWQLTKLAQDFKPNAMLFGATPEGRSIAPRIQDRLRTGLTADCLDLYYENEVLVQVKPSYGDNVMCEITCPTARPQMASVRPNTFEAVRAEAETKIFFITGDIKDDPSWQVDRVDRQIASHTDLKDATKVLALGRGAAKDEQVRTVRQLAKTLGASIGVTRPLTDLPDFTIAQQIGQSGLTIAPAFILNLGISGAIQYQVGMAASKLIVSVNRDENAPMLAQSDYVYVGDAGEFTAALAKQLQ

SEQ ID NO: 3008 - protein, 281 aa, Lactobacillus paracasei
MLNTYIGTTETQIDLLPITGPEAQIPFAILACRTDCCMRLPHKDVALRQGDITLIRSVEPVSLAPLIAGNTYSARLFQVPMGRDADFGPNELIASMLATSEDTHIVFRRIDHVLANGYCDQLARLIEAKPQDAILDYEQRTIAQLLLTELSRWDLNAMMIIESNFPEHDLRHTPKARQAGIILNYVMRHLATVTLSTAATYFGYEANYFSRLCHQLFQKPFLHEVRFIRMNQAKKLLELTMQSISDIANSLGYKNPANFDRHFKAHTGMSPSAYRHQTQVK

SEQ ID NO: 3009 - protein, 121 aa, Lactobacillus paracasei
MNEKFLEVLKHEGPVTIVTINGQPAHAVNTWMSYVTLKEDELIIPAAGMHSLEGDFAEDPHVLLTFGSKEVEGTVGPGAGFHVRGTGRFVSQGPEFAAKQAQFPWLTRVLIVHIDEVQQKI

SEQ ID NO: 3010 - protein, 299 aa, Lactobacillus paracasei
MFRKRNEEMLIIENFGATFKYLRESRGISLSSLADDVVSKGMISKFENGTSDLSTKRFFHLLKEIYVTPFEFTIVMNHFEPLYDNKLSTELTQLALSHNVQGLNHLVDTEYARCQNSHLIFDRLNWIMAECVRTEVEKKPLPSHVPLNILTDYLFQCEDWGNFELVLYGNPMTQLPIETITVFSQTLLDKCAIYIGLPNTYETCMNVLLNTVGLLIRYGQIQHALKTLAVLEQKDLPESFLLERVLLNYYKGILLFKTGQETKGRQLVHDALFALKAGNCVDFVDALKKDLQKLGLYHI

SEQ ID NO: 3011 - protein, 530 aa, Lactobacillus paracasei
MKTYLRHQRGRTGINIVWIIVNVLLYTGTSVLLTFTTNAIFSRDMKALLLWSAINLAVWGTFLISNYFQAVFQEKLTQRIMIDVRDTISRMIVGSSYAQYHKQTTGEYLSEYVNDVGNIESNAIKNLFSLLSDGTTVVFATIALAAYHLLFIPMILFLSILMLKIPSRLGKPMTVATTEMSKGNAAFSNQVTNVLNGFDVLLNANKLSKLQELVKTAAKRYAEVKVSYTKTNARISNSIAALSIFCQVMVDIMTSILAILGAIPLGAISSTGSIAASIFNSLSSLSNDAVQIKATHPLFDKVIQGSSNSARARESTQEPAFQHALKVIDLSYSINGNKILDHLNLTFERGGKYAIVGRSGVGKSTLLKILDGQITDYTGHVYIDDQDLRTMTMTALTKISQYVDQNVYLFNDSVANNTSLWANKQKSGDSLQQALLKAKVDFVKSSDQMIEENGQNLSGGQKQRLALARFFYSPKPIAFVDEGTSALDAETARQVTKQFLNDPDMTLIEVSHHLDAQLKGAYDQVINLGA

SEQ ID NO: 3012 - protein, 46 aa, Lactobacillus paracasei
MRGTILAIFVSERKVHTTESRKKAKMKSMVNDSSLPDLFERMIDIP

SEQ ID NO: 3013 - protein, 1103 aa, Lactobacillus paracasei
MKNLRHRHIPALIFWLIVIIMTLITMPDVSGIVRDKGALSLPKNEESQIAANIEKKANNNQKVRSYALVFNNGDKKLTASQKQAIHQTLKNLKSTGAVKIINVTQASDNAETKKQLDAKDGTTQMALVDVKAQGQVGPQTRNLEKQIKTSNVKTYVTGSDVLNDDFATLTEKGIQKTEIIAAIFIFIVLIIVFRSPIVPLVSLLTVAISFMTSLNIIMNLADKFNFPISNFTQVFLVVVLFGIGTDYNILLYDDFKAVLSQGIPRTKAAEVARRFGGRTILYSGLSVLIGFSVLGLANFKFYRSAVGVAIGVLILLTVLLTLNMFFMATLGEKLFWPSKNLNGHSTSRLWHGLSKMGIARPLITLGIIGIIAVPFLLNANQTLNFNNADELPETLQSKVGYKLIQDHYSKGMASPTTIYIQSKQPLNTQTVLGTIDDLTTYLQKENGVKTVASVTQPGGSQIKSLYLDNQLQTINAGLTDSVKGLKQVQAGLSSANTQITNADVAGSTQQVQTLANGTNTLSSGASSLNSGIGQYTSGVASLNTGIGQLSSQLPALSSGVNTLSTSSTQLAKGMDQLSGNSTVLASGMNQLSDKSGELTSGMNKLASQVQNLTGSAQQIVTLINQLPNGSQLTQSILEEIAKFSGGVQQLTNGTSSLGDGIKTLNNGTTALNSGISTLTSGTHQLSSGIGSLNSQVPSLVSGVNQLNTGSSQLAGQNGTLNSGAAQVASGADQVNTGVQTLNTKVKAISEQVTTMQSGLTSADKALGTIADGSTSMKQYLTELQKSYLGKKFYIPNATLKSKTFKPALTTYMSDGNKITKLTVVLKGDPSTDAAAKQIEAIKTDMTAKLKHTPLADATVAVGGQTSQTADLQKLANGDFERTAAIMIIGIGIALIFVTRSLIQPISIISTLLLAYVTSLGLTKLFSTYVLGRDMLTWNTPFFTFIMLVALGVDYSIFLMVRYRDNALEGGTMTHRIAKAASVIGAVVISAAIILSGTFAAMIPSGITTLIQVALAVIIGLILLVFLLPLVMSSVISLTDKQMNKNNHPQGPGPHDDNDHTSPKSPKTPTPNGPNSSHSATPAEPRTSQKPRVHLAAVPPDSKK

SEQ ID NO: 3014 - protein, 200 aa, Lactobacillus paracasei
MKPIATPDPIIAQAVKLFAERGYAETNLPSIAKAANVAVGTIYRHFKGKEDILNTAFTDIMDYFHDSLADAANCNVSDPESTFSHLFDAAALTMQHYPTELHFIEQNVFNEALRPESRAARDRVTTLISNMLMEGQEHGVIVKADVRTQLAILYGSIVSMIDIVWVQQQLQGHVPDQDQLALELKNQIWNGLTCERSIFQ

SEQ ID NO: 3015 - protein, 86 aa, Lactobacillus paracasei
MSITFLAIAASLLTAGNPQPAKPSTSAVPISTSQVQPLAAPTPDSWQAAITPHHATPVHEEPASLPEQNLDQKVKTSRVKPSRYSK

SEQ ID NO: 3016 - protein, 220 aa, Lactobacillus paracasei
MANMDTWQQFWYYLANNGSYVLSQFARHFLISIYGVLIAAIIGIPIGLAIARHRTLSSTVIGIANVIQTIPSLAMLSIIMLGLGLGVNTVIVTVFLYSLLPIIKNTYTGMQNVDKNLMDAAKGMGMTRWQSLYMVEIPLSMSVIMAGIRNALVVAIGITAIGAFVGAGGLGDIIVRGTNATNGGAIILAGALPTALMAIISDLVLGFLERRLEPKGKAES

SEQ ID NO: 3017 - protein, 309 aa, Lactobacillus paracasei
MKTFRKMLLSLFLIPVLLLGGCGFPGLGGSGNDGTVRIASQTSTESQIMANIIAELINHELGYKTTLVNNLGSGTVVHQAMIRNDADISATRYTGTDITGTLGMNPVKDPAEATAIVKREFKKRYDQTWYPSYGFSDTYAFMVTQQEAKKDGLSTISDLKKVASRYNAGVDSSWMNRKGDGYSDFTKMYGFDFKRVYPMQIGLVYDAVEANKMQTVLGYSTDGRIRSYNLKVLKDDKKFFPPYQCSLVVNNSFLKKYPKLKPLLHRLDGKINLKTMQELNYQVDDQLLEPNVVAQKFLAKHNYFKGSDD

SEQ ID NO: 3018 - protein, 209 aa, Lactobacillus paracasei
MFAFLNAHGSELITKTWEQLYISAIALGLGVLVAVPLGIVLTRFPKTAKVVIGLASMLQTVPSLALLALMIPIFGIGKLPAIVALFIYSLLPILRNTYIGMEDVDPVLIDAAKGMGMTALQSIRQVEVPLAMPVIMAGVRLSAIYVIAWATLASYIGAGGLGDLIFNGLNLFQPDLIIGGTIPVTILALLVDWLLGRLEHRLTPVSEQA

SEQ ID NO: 3019 - protein, 417 aa, Lactobacillus paracasei
MPEEQPMVLFKDVEKVYRGGNVAVEHINLEIHKGDFVCLIGTSGSGKTTTMRMINRMLEPSGGQILFNGKDIHKIDAVKLRRQIGYVIQNIGLMPHMTIYENITIVPKLLKWPEEKRREKAKELLDLVELPEDYLDRYPSELSGGQQQRIGVIRALAANQDLILMDEPYGALDPITREALQELIKNLQEKLGKTVVFVTHDMDEALKLATKIVVMDHGHIIQNSTPTELLTHPANKFVENLVGQDRLVQARADVTTVEQIMLKNPAAITPGKSLAEAILLMRKRRVDTLLVTDDENHLKGFIDLESLETRYQSATSVGDIIKTSIFYVNKDSLLRDTADRILKRGLKYVPVVDHDKKLVGIVTRAALVDVVYDTIWGDNDDKSDDIDSDQADSDTENTASATAASEAPANSDTPKEV

SEQ ID NO: 3020 - protein, 251 aa, Lactobacillus paracasei
  misc_feature (4)..(4): Xaa can be any naturally occurring amino acid
CAAXAMINTERMINALPRTEASESELFIMMNITYLNKLKQLVIGIILFIPFLFLASGVSLVDCFFEGVLLNWLFIVIAASISIPSLLFIDRHIKPSSTQQLNQPLKARYFYIAVIWTIFIVVLTITLNNLPFLPAPTDNVLQSSTAKVLTGPSRWPMIISLCFLTPICEELGFRGVIQDYLTNIFGYWPSVLITSIIFVFLHGFEVVASLCLLLCAIGFSLLNQASGTIKTSIVSHMTYNIIVTILVMLRL

SEQ ID NO: 3021 - protein, 73 aa, Lactobacillus paracasei
MNRDKKVWGALLIVLFNRSIFRYIEALWTNNMIFGNVLKGLSAIVTCAAIYVLIRCLHEKYASNPKLHARKHQ

SEQ ID NO: 3022 - protein, 618 aa, Lactobacillus paracasei
MHFIQTHKQEAMIAGGVLTAGGLIFSQAWVLVLASLVAGLPIAINALAALRYKQISIELLVTIALVGAVLIGEPVESAVVSFLFLFGDWLEQRSLAKTRSAIQGLAAAAPKTARRLDGTMIPVGDLAVGDQVRVLAGETVPADGKVISGQANVVEAAITGEPDAKSKQAGATVYSGTQVSDGTVAIEVEKTGYNTVYQQIIDLIEDAQDAQSPVATFIQKFARWYTPLVLIIALLVGLISQNVRLAITILVLGCPGALVIGAPVSNVVGLGFGAKHGILIKGGDVATKLDQIDTVMFDKTGTLTQGKISVATAQYWANDDAKVAELVAAVEQATAHPLGQALVAYLKPQTTPAVTDVKVTRGIGVQAQVAGHTVSIGNQKSLTQPLTTAQQVAIQNVIKSGASLVVATIDGKLAAVYGLRDQLRTDTPGMLATLQANGKKTVVLSGDSQAAVEHMMADLPLSQTHGGLLPVDKVTAIKAAQAHGEKVMFVGDGINDGPALAQADVGVAMGSGMDVAIDTADVILTSSRLTNLGVLFDLAKRMDNNIKQNLVIAIGTVALLLSGLLIGLVDMASGMLFHEISILLVIANALRLRHTPRKLQNLTTIKDAAAQTVNNEGK

SEQ ID NO: 3023 - protein, 75 aa, Lactobacillus paracasei
MTKLVYQLDGLTCPSCLQKIEGALGQQAGVKTVKALFNSSKVKAQIDPSVTNADALKKTITDLGYTVVNVRSQEA

SEQ ID NO: 3024 - protein, 194 aa, Lactobacillus paracasei
MSVTTGMKSITADQVKEQQAAAAKQADHDHHVPTAGAMSGHVLANLQVLTRKLIQFRVTLRGVTSETDRQLLDQLLQQAQTHFEDLVADLAAQGEDFPTTTAEFGEYTMLKEDPAFRFWTNDMKLDAVVNDLDTCQLFVSRAIPLANKENKAVLAVDMLQLQRWHEQSILRLQTRLGRQVTAGRALLDEDEDDD

SEQ ID NO: 3025 - protein, 219 aa, Lactobacillus paracasei
MTHSCTAVVPLFKNLNDEARAAIDALTHERQVEKGAVLISPDTAAHLLVVAHGKLKTYQLATNGKEQLLRVDGVGDYEGEAGLLNIANPNVYTETLTAATVCTISATDFQQLLLKQPQISLQLLTENARKMQALEKQAGYLGNDSINVRLTHYLLDLRTAAGQDTVTVPMAWTQLADYLGTTPETVSRTLKRLAEEKLMERSGKQVRILNAEDMEDFAW

SEQ ID NO: 3026 - protein, 264 aa, Lactobacillus paracasei
MSKLADVFKNHKVFIPFIVADDPDFETTVKNVVALAKGGADIVELGIPFSDPVADGPVIQAADLRAFAANVRTKTVFDIVEAARKETAVPIVFLTYLNIVFKYGYDAFLKRCADLNVAGLVIPDLPYESRDEIVPIAEKYGIDIIPLITPTSGHRIEKIAKSASGFIYVVSSMGITGERDEFFAGLKALVAEIKQYTNVPTAIGFGIHTPEQAQTMAGIADGVIIGSAIVDLVAKEKQQAPAAIEKFTKQIRVAVDAKKQISVK

SEQ ID NO: 3027 - protein, 406 aa, Lactobacillus paracasei
MKTLNETTQQSTRAGRYGKDFGGQYIPETLMTELEKVTKAFNDLKDNPEFKAELNDLLVNYANRPSLLYYAKNMTEDLGGAKIYLKREDLNHTGAYKINNVIGQALLAKHLGKKRLIAETGAGQHGVATATIAALMGMDCEIFMGKEDTDRQKLNVYRMELLGAKVHPVTSGSMVLKDAVNATLQEWASRSDDTFYVLGSAVGPAPFPEMVKHFQSVISTESKQQLQAKETRLPDMVVACVGGGSNAIGSFAAYIDDPSVQLVGVEAAGKGVDTDRTAATIERGSVGIFHGMKSLFMQNEDGQIDPVYSISAGLDYPGVGPEHAALAQEGRAQYVGITDDEAVEAFTYIAKQEGIVAAIESCHAIAYVEKIAPQMAKDQIIICTLSGRGDKDVASIAKYKGVDVDE

SEQ ID NO: 3028 - protein, 199 aa, Lactobacillus paracasei
MVLVKICGLMHSEDILAVNTAGADFAGFVFAPGRHQISLEQALSLKQLLHPKIKTVGVFVNEPVAEILAIYQAGAIDVAQLHGKSTPAEITQLQQAGLKVIQVFERQAIDLTSMADYLMVDSGKGSGQLLNLKAIPHISRPLILAGGLTPLNVRQAVQLVQPTMVDVSSGVETNGHKDADKITQFIQQAKEDIIYEDIK

SEQ ID NO: 3029 - protein, 260 aa, Lactobacillus paracasei
MILDDLVAVTKIRLARHQRQQSLADLKQTVAKMPRNHKPDFLTRLKQPGLHVIAEVKKASPSKGTIVTDFPYLAIAKAYDQAGADAISVLTEPDYFNGHLHYLKEISQQVSVPTLRKDFTIDPYMIYEAKANGAVIILLIVAILTDQQLRDYRQLAEKLGMHAIVEAYTAAEVTRALQSGAKIIGINNRNLKDFRVDFNNSLKLRAMVPDNIPVAAESGIKTQEDVEKLAAAGFNAILIGETLMRSNQKRQLIAAFKERA

SEQ ID NO: 3030 - protein, 341 aa, Lactobacillus paracasei
MIKQAIEKVVNHENLTFEESEAVLDEIMNGEASEVQTASLLTALTAKNPTIDEIAGAAASMRSHALAFPETKDVLEIVGTGGDHANTFNISTTSAIVVAATGTQVAKHGNRAASSKSGAADVLEALGLDINETPAVSYESLQENNLAFLFAQEYHKSMKYVAPVRKQLGFRTIFNILGPLANPAHPTHQLLGVYDETLLEPLANVLKKLGVTNAMVVHGRDGLDEMTTADETAVVELHDGHLTKYTVTPEQFGLKRRQRADLVGGTPEANADITRRILAGDHGPQRDIVLLNAGAALHVAHPALSIQAGIDLAAKTIDDGKAFEELNRLLAFSDKRKDVVA

SEQ ID NO: 3031 - protein, 380 aa, Lactobacillus paracasei
MTMNKKMSVAVLALGCLSLLTACQPSNVVSKVKQHTVTVLNQKDQVWRETEAVSATVTSQGSLKNEQVKPDNKLSPAITNAGKFYSVATFKQSDYATIKKAIQKNEAQPKTLRFVTVKQVNATLKAMGATKQIKALTDLVYTQQADGHTFPSNDGYLIEGDHLYEVIMAYTTGGNAGTVNRGNVYSRKIKYGTTKQLTFSEVAGTWQSAAGDQATVQDNQLVTIQNKSYVRGKVENLSHLQGEKLYRNTAYSLRQTQLVKQDAKLTQQSLVAGDLYDNMYLFLSKTKMARVNTNGVTIFTKKAAQSQIPDQVFEVFRLLDQRHTDEVAAYLLPHGTDTYSVALTRSINYATVNYEGGATGAESVSIQDGKISVGPDLNHN

SEQ ID NO: 3032 - protein, 608 aa, Lactobacillus paracasei
MTRFTKALCFIGLTIAMFMGTLDTTIVNIAIPKIMTDLNGSLANTSWVMTIYTLAMSVFMITASKIADRFGRKKIMLLGLLLFGGFSAACMTATSLSMLITFRFFQGLGGAIITPIVLPMGIEVFGKEKINRVASVVGAVTALAAAGGPPIGGIILQVASWRWIFGINVPLAILAFVLIAVCAKESYDESLAGGIDFPGLVFLTAALGGVTFGLLEGRQYGWTSLLILTSLIGGVLALIAFIATEKRVKNPLLELDLFREKTLSASSIVYFMTGFALVAPSLILNYFLQNVLGDSPLHAALIIIPVSLTIMIAMPLGTKLLDKTGAIPVTLAGMLLMAASLFLLSLIKTETATALIVVLLVINGFGFGFASVSMVASVRYLPKNKSGIGSGIVNAARQIGTCLGIAILVTVLDTNIDTAKTQIHHAGDQIIAAKTLSPHVKTVAHQQLAAVFAGSSTPTKHQQKKMRQTISEAAKVKTNLPKPAAGSDLRKLYDASAGLQQGSNKLANGSEALAKAAQQTRSPLATSIVQLSTGAATMAQGQAAFLTGIKQVAQKQTLQTAFHDITQRKNTRLAQAFSHTYLIGALIVLCLSPVAFWTDRRLGMNNSL

SEQ ID NO: 3033 - protein, 192 aa, Lactobacillus paracasei
MNGKQRMAAQSRQWLVDALIALMQREDVADISITEIVQTADLSRKTFYRAFRTKDDLVDYLCAQLTDGYFESLQKATRDQEPISFETTMANFFNFWWQQKDLVRLLIRQGLFDRLNGVWLQDAVAHYRAFPAPWHVAGTDQEVNYIMAFALGGFTNILRVWLAQDEPESPEQVQKGALAGFGQLARSIGGTN

SEQ ID NO: 3034 - protein, 124 aa, Lactobacillus paracasei
MKALICLILNALPYAGIALLLDYRYISDGPVLIYFLVQLSISLSICLIMREETKKMWRILFFSQFLSLLLNLLTLYAGNLPFSTYFKPFTVYGWSVLTQFFGLLLQAITAGLFIWVKRVIKDKN

SEQ ID NO: 3035 - protein, 240 aa, Lactobacillus paracasei
VKKRVLVLLISFLTVFFLVPRQSALSKTNTDETKPSIVKKVKVTIGNNGLKLSFHAQPNTSYTLKDLNNNQLAAGTVKKGTVSLNRLRPTSTKLILKTSRHRHTSKKIIPLPESYEIPRRSVYRKPVAIGSKVTYYGANSQLLFTIQTKYLPNTPQNKTGISLTFHNYHYAIPLTFSPTNFTAYSDNQQVALQPQSPLPMIKSNEEKTINFLIDVPREKAIQNGFTFDNSDLTLPINFYL

SEQ ID NO: 3036 - protein, 169 aa, Lactobacillus paracasei
MKKPMANAYVFNLIATVTSAVFSIFLITQNFPNVFQFGVSYKIDASNTALVKQLQMMYTPAIVVALIAAVLVFTLVITMLVLVKKRNVSALGSIIALGITLIQIGYLSGLFWLVQSVQSAFSPAGDILQNPYIGPLLQLINLLLLGGSWIANLVVAIDYRRNGIKEGRY

SEQ ID NO: 3037 - protein, 255 aa, Lactobacillus paracasei
MIQVLVAGFRGAMGQKTVKMVQSHQDFALSAVFDPKITDLNPKSYNLPTNVQVLNTYDQLHAHVADVWVDFTNPSAVAANIEAAINAGIHPIVGTSGMDPANQERLIKLANAKHLGGLIAPNFGLSAVLLMKFAQAAAAYFPDAEIIEMHHQDKADAPSGTAIATAHKIAAGRTQKPLPTIDNDARGQRVDDVPIHAVRLPGYIAHEQVLFGGPGEALTIRQDSFDRQSFMQGVAVAISKVQTADELVVGLENFL

SEQ ID NO: 3038 - protein, 301 aa, Lactobacillus paracasei
MQKAELITAIVTPFNDRDEIDYGVMQRLVDHLIAEGTDGFVVGATTGEGPTLSHPEKITLYTRFADMVHGRALVIANSGSNNTKETAAFTHEVGGIAGIDATLVVVPYYNKPDQNGMIAHYTAVAAAAQKPIVIYNIPGRTGVDMLPATVATLAQNPMIQGIKQCGSLPALSDIIDRTKHDAFNVWTGEDAQALNIKTLGGMGVISVAAHLYAHSIREMYAALDRGDITTVAALQRQLLPKMAALFHFPSPAPTKAALNALGFQVGSPRLPLLPLNASQQQELAHLLGVPELSAIEAEVLA

SEQ ID NO: 3039 - protein, 383 aa, Lactobacillus paracasei
MKEADLITLRRQLHQIPELALQEKETHALLLKTIQGLPQTYLTIRTLPDLPTALLVKVQGSDPQRTIGYRTDIDALPVAEKTGLPFASKHSGIAHACGHDIHMTVALGILSYFAEHQPKDNLIFFFQPAEESKNGGKLAYDMGAFTGDWHIDEFYGLHDRPDLPAGTISTRLGTLFAGTTEINVDLIGKSGHAALPQNANDMIVAAASFISQIQTVVARNVGPTDSAVITFGLMRAGTIRNVIAGRAHLEGTLRGFTQQQIDFLQQRIRDIGQGIAASFNCQVKVALNQGGYYPVENNDKLTKDFIQVMKDDPDVTFVDTKPVMTGEDFGYLLNKIPGTMFWLGVNDPDSQLHAADFSPDEAALVPGVTAVVHFLEHRMLEKV

SEQ ID NO: 3040 - protein, 234 aa, Lactobacillus paracasei
MAQLDTQKIISTIANSKKTTPVKVYLKGKLSELHFPKSVHAFIGKHTGTVIGDWAEIKPILKKAKLDDYYVETAGRNTGVPLLDIKAANARIEPGAIIRDQVLIGDNAVIMMGAIINIGAEIGAGTMIDMGAVLGGRAIVGKHCHIGAGTVLAGVVEPPSAKPVTIGDHVMIGANAVVLEGTTVGEGAVIAAGAVVINDVPAHTVVAGVPAKVIKQVNDQTEAKTVLLDELRKL

SEQ ID NO: 3041 - protein, 448 aa, Lactobacillus paracasei
MDFATNHEGQLTIGGVAASQLARTFQTPLYVYDVGAIRQQIRAFKRVFEEADVSYAVSYASKAFATLAMYEVAKSEGAHVDVVSGGELYTAQAADFPMAAVSFHGNNKSKAELTQALDAGVGTIIVDNFHELDLLDDLLGATVGQQDVLIRVAPGISAHTHAYDQTGQTDSKFGFDLASGQADEAAKRILADDHLNLLGIHAHIGSQIFEVAGFEAVTQKLLHVLNNWHQQFGFIPKVLNVGGGFGIAYTKQDDPLPPEAFVKAILATLKSQSQTLNWPLPAIWIEPGRSIVGPAGYSLYTVGSRKDVPGLRPYVAVDGGMGDNIRPALYQATYTAVLADQPNAAPAEHVHLVGKYCESGDILIDDAPLPTTTPGDVVAVFDTGAYGYSMASNYNRNPRPAVVFVENGQAQLVVTRETDADLIKNDLHYAAPTEQPAPAQTDATAATK

SEQ ID NO: 3042 - protein, 459 aa, Lactobacillus paracasei
VRVVKFGGSSLANGSQFAKVVAIMKANPARQVIVTSAPGKRHPGDTKVTDLLIQYAQAVMRHEAVAAIVAEIVARYQAIADDFELEASIMATIEEELDQLPKLTFKNNDYLMAGFKARGEKLNAFLMTAVLNHEGIEATYGEPKSLGIVVTDHPNDAEVSRETYRNLATFRRPIGVLVVPGFYGYTSDDDIATFSRGGSDITGAILANGFHADLYENFTDVDGVAAADPRVVANPQMIREMTYREMRELSYGGFGVFHDEAILPAIAGQVPINLKNTNHPAAPGTMIVPEQHFVPKHAITGIVSSQHFGAIYLHRYLLNKEVGFTLKILQVLAHNGISYEHMPSGIDDLTIILDDRQLTEAKRKTICAEIQAAVHPDVLKWIDDYAIIMVVGEGMAQRTGLIQTILQPLATAGVHVSMINEGASQISLMLGTSRESANRAVKTIYNAFFIPINQRLEVH

SEQ ID NO: 3043 - protein, 335 aa, Lactobacillus paracasei
MVTLQKVHGSENSFFLFDETQLTQPLTNTQLATVTQQLTNAETGLLGGADGVLAVTAARGTAGKMTVVNTDGSFAKLCGNGLRTVARYLSEKTGQATFKVHTDFADLAVARQPQLAEGVPAYSVEISPVSFAPQDLPFANLGVDRIVDTVLPAIHPSLKFTAIAVPNPHLIAFVSPEVLAGSDLERIGKMLNAKNPYFPEGVNVTFAEILDKDTLFARTYERGVGFTNACGTGMSATTLAFILTHPEEAAFDRVNTVYNPGGMVKTIVHHDGERYWIELIGNATVTATITLPDTALLVGDWQQAKIHATGEQAEYERFIDALPHRKLANTLTEGV

SEQ ID NO: 3044 - protein, 352 aa, Lactobacillus paracasei
MSGYHVAVVGATGAVGTRMLKMVAESKLPIASVLALASKRSEGKQVPYRDGTLIVHETTDDSFKGIDIALFSAGGSVSKRFAPAAVKAGAIVVDNTSAFRMEPEIPLVVPEVNPEAMRQHSGIIANPNCSTIQMVTALEPIRKAFGLKQVVVSTYQAVSGAGQSAVNELLDETRAALDDKPLDPQILPTAGDKKHYPIAFNALPQIDVFEPDGYSHEEWKMIHETKKIMAGDMNSDTIKVTATCVRIPVPIAHSEEVYFEVEDDKATADDIREALAHAPGVVVQDDPSKQVYPQAMNAVGSKDVFVGRIRPDAENPRFFHMWNVSDNLLKGAAWNSMQIAETMDAMGLIQPK

SEQ ID NO: 3045 - protein, 125 aa, Lactobacillus paracasei
MKKHRFVIALVGLSLFAASSTIAADMTQANMDQHSVTYTIKGDGLIIFDKTRTYRTKSTAAAYKGTFAADAPTASFEKVGTLANHKDYRVTRKIRVKAKMQGVAAQTFFYVNGHGWVKGSDLTRE

SEQ ID NO: 3046 - protein, 137 aa, Lactobacillus paracasei
VVKVHFGLTHKKVDSVLIIQFFNAGIIWVHNSKRRWELTGGKLEPGETMVQAAVRESYEESGAVVQASAIVPLGYYVLPTGHTTAVVSAKVERLQAIPTSSEIDDRQVWVEPVPDAERSFHDDIYAQIFQHIGWPDE

SEQ ID NO: 3047 - protein, 288 aa, Lactobacillus paracasei
MSSRQYGFLLNILSVAVMAVTPVMNKFSMITLSPLAASFYNALVSLILTLGTIAFTKTKLVWIKQPIIWTLGLTNCLGIFLQYMSLFFLDPVSVGLVGRFYIVFAILLSVLLLRERFDRKEIVPIVLCMIGTALVSDFSGDVNNILGLVCALGYTFSFALTNTLAKKALINIDEKILLLYNQGTAVVILGGFLLGSGQLSLAPNLGMGAVAISAFCSGFLGLLLFYRGLKLISFRDANLIRALNPIFVLVYSLPFFTIQMTPAFLLGGFCIILSIVWMSLPMKKVGVD

SEQ ID NO: 3048 - protein, 195 aa, Lactobacillus paracasei
MKFSRRSKRFVIVRRSAAVVFALISMTLFFQFSSGVEVHATTKTEFNDTEINRETSEQLKMIDPYLKNIDGITSFDYDAAMNDNVDPVVLKIGAEINKWARSLKNDGPEKGMLLSMARFNLLVYGNYCGKGNNGKAPIDDLDGACQAHDTCYAWGGNNEKCNQEFRQRLLTIMQKTSLFDYKHIVAVAAYKLFGG

SEQ ID NO: 3049 - protein, 99 aa, Lactobacillus paracasei
MKTKAKMVIGNGGILTVIFALMTIITFSGKKNFVGIELGTGFIGLLVIALLIICWQIYLLLEKSALGWSFNIILGSYTLVVGVAIFFIASFFIGFALFP

SEQ ID NO: 3050 - protein, 668 aa, Lactobacillus paracasei
MKKLFERIRMPEFLEDMRMRYAAIAMVVLAVIGILMGALIRPWLALLMLLILISLVATIFYALETIAKNTNQYISDLSYRIKRGEQEALIKMPIGILIYDENLNIEWTNPFLQKYFGDTDVLGQPLEHVDAELAELIRSNENTNETKMVTWGQHQFEIIVQKSIGVVYLMDVTRYAEIEERAEDEKIAIGQIFIDNYDEITQTMDDQVITNLNSYVTNQLTDWANQFGMFLKRIDNDRFFLLAYAKSLKDVERDKFKILDVIREETSKQNYPLTLSLGIAYGDEDLAQLAVTSQSNLDLALGRGGDQVVVRAKGHEARFYGGKTNPMEKRTRVRARMVAQALQELFKQTDKVFVVGHKRPDMDAVGASMGIRRIAQMNGKECYIVIDPDHLHSDVERLMGQVGQDPEVANAIVTPEAALSQATDQSLLILVDHSKPSISAAPDLYKRLAARTVIIDHHRRGEEFPDNPMLVYIEPYASSTCELIAEMFEYQPTNVPSLDKLEATAMLAGITVDTKSFSLRTGTRTFDAASYLRSMGADGMLAQNLLKENIDSFIQRNHLIDTIEMIAPNMALCTGEEDKRYDPVIAAQAADTMLSLNGVDASFVITKRPSGDVGISARSTGDVNVQVIMEAMGGGGHLSNAATQIKGKTIAEVRTDLLAQIKKADEDA

SEQ ID NO: 3051 - protein, 151 aa, Lactobacillus paracasei
MKVIFTQDVRGKGNRGQVKEVPDGYAENFLIRKGLAKAATPQAMSALRGQQRLEEKKEAEKKTEAEAMKAKIEDDKTVVQIQSKAGEDSRLFGSIPSKQIAQALDKQYQIKVDKRKIDLKQPIRSLGFTNVTVNLFPGIDARIRVHVIEQK

SEQ ID NO: 3052 - protein, 462 aa, Lactobacillus paracasei
MDNQLIDQQPPHSDEAERAVLGGIFLNADTLPDAQEYVTADDFYKKAHRLLFQAMTDLQDNGTAIDTVTVSDYLDNHNNLDDIGGVGYITDLVAATPIASNVVYYAKIVQQKSTLRKLISTAQNIASRSYTEQDDVEGLVEDAERQIMDVSENRNQAGFKQIKDVLNQAMAQIDQLYQNDQAITGLPTGFRDLDKITTGLHEDEMIILAARPAVGKTAFALNIAQNVGTKTDKSVAIFSLEMGAEQLVNRMLCSEGSIDANHLRTGQLNEEEWQNLIIAMGSLSKAKIYMDDTPGIRMAEIRAKCRRLAREQGDLGLIIIDYLQLIEGSGQENRQQEVSAVSRQLKKLAKELHVPVIALSQLSRGVEQRQDKRPVLSDIRESGSIEQDADIVVFLYRDDYYRDAEGDEDDDDQGGNDDGDDNVGEVEVIIEKNRSGPRGTVKLLFVKSYNKFTNIAYNGPDQ

SEQ ID NO: 3053 - protein, 387 aa, Lactobacillus paracasei
MDAILMSLMTALNEHLLINVYQRDTDDFYTGYVQVLGHDAVVLGTYNDSGIADGCALIAFSAIDQVEFAGDDLDSMNFRINLAQAQHFLTLQGQEKPLQFDATQNLIQQLATQAKANGQMVMVVVADDDAYLEGQVTAVAEDRFSMAIFNKFNYTDVRALQVDFSDILVMEFHGLDLKLETELVRQRDHLKHVATKLYQNDGQLAGVFQNALANNRLISVVPKGPEDQFFVGRVKAVNDRVVVLSLKDMAGQFGGYILLTLPSIQNVATASDYLQTISFYEKWDQTHHFSQQPVLNADREFDPNDDLIQTIISEAAGFERVVRIKVADSDEHFLGYPENVGETDFDLNLVGPDDGETAQIRYGQIREIAFGHIFAYLQEAQLKNAGR

SEQ ID NO: 3054 - protein, 675 aa, Lactobacillus paracasei
EIIBCCMPNENTMAQDKYQAMGDGIYAHIGGPQNVAKLIHCMTRVRLTIKDEAKVDQAALKKVPGVLGVVQEETLQVIVGPGTVNKVAQAMVDRVGVALGDPFPANTQPPAESNQSAVEAKAAEVRAAHKAKLKQTWWRAALKHISAIFIPLIPAFVGAGLISGVAGILANLLTAGDLPTSWASFITVLKVINGGLFTFLNIYVGINAATEFGATAGLGGIIGGLVYLPGVVAPITINNVFTHQPLSPGQGGIIGVIFAVWLLAVVEKRLHRLIPDAIDIIFTPMLSLLSIGLLTIFFIMPLAGWVSSSLVGTINWTLQVGGAFSGAILGLAFLPMVMLGLHQILTPIHLEMIKSIGYTGLLPILAMAGGGQVGAALALWIKCRQNQQLVRLIKGALPVGILGVGEPLIYGVSLPLGRPFVTACIGGGIGGAVIGMIGHIGAITIGPSGAALIPLIANHQWLGYVFGLLASYAGGFLATYFFGVPESAMVPTSADGTIIEPLAVNTAAVPETPSTRAASPDATQFVAPAAGQLQALSEVPDDVFSQKMVGDGFAIVPSHGTVVAPVDGTIVSIMPTKHAWTMTTATGLEILVHMGLDTVALNGDPFTVHVTENETVKAGQQIAEMDLPAIKTAGKSTTIITVITNMTHVTAMTSFTDQSITAGEDVLRVTSQSES

SEQ ID NO: 3055 - protein, 309 aa, Lactobacillus paracasei
MAINLDQMTTETRNQKTMALDTMTVHDFATVMNAEDQTVAQSVQQALPAIEAAIQTISHSLKKGGRLFYIGAGTSGRLGVLDAAECVPTFGTDPEMVQGLIAGGMKAMTVAVEGAEDSKELGKTDLLQRHLSADDTVVGIAASGRTPYVIGGLDYAQAVGAATISLACNTNAEISQHAQIAIEVPVGPEVLTGSTRLKAGTAQKLVLNMLSTGAMIGLGKVFQNLMVDVLPTNEKLVVRSQRIIQQATGCDAATAAKAFEAADQHVKLAIVMILTQRSSTDAQKLLTQTNGFISQTVTASSEEKTDGTR

SEQ ID NO: 3056 - protein, 289 aa, Lactobacillus paracasei
MSVKGNYQSTRSELSETEKKIVDYVMAHSQAVLTMSVHDLAKAAGTSPASVSRAARRLQFSGYNELKMQLAADLKGDTNQSDDQEIQKNATLTTIKQKLLIDANQSLRETVDQINEANVDTIINLIHQSDRLLVFGVGASYLAAQNIAQKWGRLGYPCHFSDDLNLFLPLAATADVEQTLCWFISNSGESPEVVLAAKLAKKAGLQVIVTTKLGKNSLTKYADVSIQTSQPMEARNRFAATQSLHTQFMLIDILYYAYVSRYYDAAKIATDQSKAAVTAYREFLRNGFK

SEQ ID NO: 3057 - protein, 431 aa, Lactobacillus paracasei
MGTVVIVGTQWGDEGKGKITDFLSQGAKVVSRYQGGDNAGHTIHANGEVYKLRLVPSGVLYPHQLSVIGNGVVVNPKSLVGELARLAEQGVTGENLRISDRAHVILPYHIKLDKLQEAAKGADKIGTTNRGIGPAYMDKAARVGIRMADLLDKEIFEERLKANLKAKNEEFVKVYDSTPMNFDDIFEEYYQYGQQLKQYVCDTSIVLNDAIDKGEHVLFEGAQGIMLDIDQGTYPFVTSSNPAGGVTVGAGVGASKIDRVVGVAKAYTSRVGDGPFPTELLDKTGDFIRNAGHEFGTVTGRPRRIGWFDAVVVRHSRRVAGITDLCLNSIDVLTGLDKVKICVAYERDGERVENYPASLKFLSECKPVYEELPGWQEDITKAKTLDDLPENARRYVERITELLGVDLLTFSVGPDRDQTNVLENVWDKVSR

SEQ ID NO: 3058 - protein, 619 aa, Lactobacillus paracasei
MKKNKAIIFYMLGVITFIGGLLITQPIARAALLVFAAIVAGYQVIAEGIMATIQATRKRRRFSPNIHLLMALAALGAIAIGSFEEAAMLILIFAGAHFLEEYVENKSRKEITALLAMAPQEARRYTDTGALEVVPVTALNIGDQLQILNGAQVPTDGVIIAGTASLNEAAISGESIPREKQTGDEVFGGTINGKSTFDMRVTKSSDETVFAKIVQMVQSAQDSPTKTASVIQRFEPIYVKAVLAVLPIVLLAGPFLLHWSWATSIYRTIVFLVAVSPCALAASAVPATLSGISSLARQGVLFKGGSYLANLTQLKAIAFDKTGTLTEGIPVVTDSEFVSDVDEAALTQIITAMEMQSNHPLANAIVSHYSKSDVPITDVHNEIGKGLTAEYQGHTYTIGKPQRFKQVDPAFRKRAATLSKQGKTVVFVAVDQRVVGLIALMDQAKSSAKSAINYLKRHDIQPVMITGDAQQTGEAVAADLGIDQVVANVMPEQKVAVVRELQTTMRPVAMVGDGVNDAPALANAEVGIAMGSGTDVAIDVADVVLVENDLSRLALAHQVSTKMNRIVIENLLLSMAVVVMLVVLNVLQLTNIAWGVMFHEGSTLIVILNGLRLLIPQRA

SEQ ID NO: 3059 - protein, 116 aa, Lactobacillus paracasei
MTTNDVRNADMNENAVPSDAELRDVLDVFKTMSDPTRMRIILAIAKGPITVTDLAAMLDLGQSAVSHQLRLLKQARLVVGDRSGKQIYYHLVDDHVLEIYALTKAHIEEKQHGQEN

SEQ ID NO: 3060 - protein, 806 aa, Lactobacillus paracasei
MLADTRSYQDKSQAAVLKQLNTTTDGLTSHEAKKRLAQYGPNAIPEQKRNNLLDFLKRYWGPMPWLLELAIVLTLILGHDTESIIIFVLLTINAVIGFVQSNNSQKAVALLKKKLEIMATVRRDQAWQALAASQVVPGDIVQLKIGAIVPADLAIIAGNVTVDQSALTGESLPATASAGDLLYSGSIVKSGEVQAVVLNTGTTTYFGQTVTLVKTAKPKSKQEELMLAIVRYMLYLGIAASVIVAIYGLYLHESPVFILSFVLIFLIGSVPVALPAVLTIVQAVGAMALSKKGIIVSRLTSLEDAASIDIFCFDKTGTITQNKLSIIACQPLTGYTAEQLLDAAGLAADQEHPDAIDQAVLNYAAEIKHPLDFSKRQQFTPFDFATKRTEAVITTTDHRQMRVIKGAVPTILALYAKQHPADTAPASAAIQQLATANAKKGYRSLAVASVVDSQMALVGVLAIADPPRADSASMLARLKNLGIKPMMITGDSVPIARDVAEQVGIGTKILPAKALKTGTAADKIQLIHESDGFANVFPDDKYQIVKLLQEDGHLVGMTGDGVNDAPALKQAELGTAVSSASDVAKASASIILTHPGLHDIIAAITTSRQTYQRMLTWVINKITKVIEIIILFTLGFFWLKVSLVSLLGMSLLVFANDFATMSIATDNVQSTAGPNQWRLGPLTAASGVLGLWFALVDLVIVWLGLNLFHLSLPVLQTAVLIGLVFNSQLRLLIVRERSHFWTSWPSRTLLAVNLFTIVIFALLALTGWLMPAISSPLLVTILLLTLAATIVLDFLKVAVFRWLKIA

SEQ ID NO: 3061 - protein, 292 aa, Lactobacillus paracasei
MNLKQITYFLAVAEAGQMTAAAKQLHMAQPPLSYQLKALEDELGVRLFERGSRGVRLTGSGQQFMTYAQQIVETVAAAENAARRSGEGEIGTLALGLTSSAGDVLPKQKLQAFNRRYPQVEFALYEDNTYGILDKLRRNILDLAIVRTPFNDDGLASCRLSSDHMIAVAAASQPLPATLTIPDLKQQPLIVYRRFSSLFKTTFAEYGITPTIAVLCDDARTALHWAQMGMGVALVPATMAALASQQSHLAVIDYEPWVTHMTLVWQPEALHNPLVARFVKQLSGGESEKYSK

SEQ ID NO: 3062 - protein, 373 aa, Lactobacillus paracasei
MEINVGAVISAHRKQKGITQQALADFVGVSKASVSKWETGQSYPDITLLPILAAYFDVSIDKLMAYDAQLSSTEIRRIYTSMKQAFETQPGEAVLKSIRNLIRRYYACYPFLLQMGLLILNHYDLLPGTSQTAKVTEYVNEARLLFVRVRQNSQEAQLTAKAVELEGYSLLLLQRPGDVLALLGEYVPEQLPADSLIAGAFQQKGDLRRAIATSQSGLMQDLSIIMSQLTNYMTLLKDDPNRLAATYQRGQAIAKAFDLATLNPAVWLNFQLAALNGFAQQDKTDEAVALLQEFTHVLAATKMPLTLHGDAYFDAIEPWLEQLDLGSQSPRVSGQAKQDLADFVLQNPALAKIRTLSEVQPLLAELKQVSGHR

SEQ ID NO: 3063 - protein, 71 aa, Lactobacillus paracasei
MNTNWQLFADYWPFLVPLIILEFGLMIAAVIHILRHQHYRFGNRLLWLLLVIFIQIIGPIVYFVFGREDEN

SEQ ID NO: 3064 - protein, 309 aa, Lactobacillus paracasei
LNILTLQHVSKHFGSKQVLQDLNLTVPAGSIYGFVGENGAGKTTTMKLILGLDQASAGAIEVAGQPVHFGETETNRQTGYLPDVPAFYGYMTAPEYLKLCGQLTGLRGAELQSRVAAMLIQVGLADAKHRISGFSRGMRQRLGIAQALLNTPKLLICDEPTSALDPQGRTDFLQLLASLRGQTTILFSTHILSDVERICDHVGILHHGRLQVSAPLDDLKQQYAKNQIALSFATTAQAQQAAHLLATLQQQGQLTHLEQQKNSLQAAYTGTYAAAADRVLTMLLEAKLIPITLAQQEANLEQIFMEVTR

SEQ ID NO: 3065 - protein, 253 aa, Lactobacillus paracasei
MNAAIIFTKKELLESWRTHRLLILTVVFLIFGILSPLIAKLMPELLKGGLGGIKVAVPKPTSLDAWTQYYKNITQMGIYVFALMLGGCVSQEIQQGTLVNLVTKGLPRWTVIVGKAIVGMLLWIWITSLAFLVTWAYTAYYFPDTRSPHVVLAFLPLLVFGLFFLSLIVFGSTLATNNYGGLLLTIVVMALLYLAQMVKSWQHANPVALIGDNMKILVNSDALTKLMPAMVIAVVAAVVLFFAASKLLDRKKL

SEQ ID NO: 3066 - protein, 727 aa, Lactobacillus paracasei
MIEFYTQIKKRDGRIVDFDASKISTAITKAAESVAKLAPSDVLTIDHLTDTVTAKIRDRYHDDVEIAEIQTVVEQTLIAAEKYNWAEAYTEYRLKRDLARKQKQDVNYNVSRLVNRDESVVNENANKDSRVFSTQRDLTAGAVAKAIGLKMLPPAVANAHLRGDIHWHDLDYTPFMAETNCCLIDFDYMLNHGFSIGNAEVEPAHSIQVAVTQMTQIIANVASSQYGGCSSDRTDQVLAPFAEKNYQKHLREFGSVIDDPAKLEALAVKQTKKDIYDALQTLEYQVNTLYSTQGQTPFVTVGFGLGTSWIEREIQKDILKIRILGLGKERRTAIFPKLVFTLKRGLNLKPEDPNYDIKQLAIECATKRMYPDVVSYDTIKRLTGSFKAPMGCRSFLQGWTDPKTGKEVNAGRMNLGVITVNLPRIAMEANGDKAKFWKIFEERMRICKEGLLYKVERTKQATPESAPILYKYGAFGHKLADTDSIDDLFKNGRATVSLGYIGLYEVGTVFYGSAWEKNPDAKAFSVSIVKALDDHCKAWEKQYGYHFSVYGTPSESLTDTFCRADTKKFGIVKDITDKEYYTNSFHYDVRKSPTPFEKLDFEKDYPQYSAGGFIHYCEYPNLKQNPKALEAVWDYAYDKIGYLGTNTPIDQCFKCGFKGEFTATAKGYQCPECGNHDPATCDVVKRLCGYLGNPNKRPMVHGRQEEIIHRKKHITFSLNQVANRRDK

SEQ ID NO: 3067 - protein, 40 aa, Lactobacillus paracasei
MIAEIFTAKQWQTAELRRGSIVGDLLRGFSEHVDDVAILV

SEQ ID NO: 3068 - protein, 202 aa, Lactobacillus paracasei
MNFSKQLHQIHMAHQMTQVNLAEQLHISRHTVSNWENDRNLPDLEMVTRIARIFEVSLDTLILDDPKLNEKLIHDSKISRHQMIMAVMTTVVAMMSGMAATTLFGFFPQWLAQLILWPYVAVLFLFSYMLSPKSVDIFADWSVLSRSLIAGGFSVLGLILLLTGVVLITVQDVDLQVLLITLSGFVTILMTKPVWPRHQHAR

SEQ ID NO: 3069 - protein, 449 aa, Lactobacillus paracasei
MTLDMNVMAFWQNKLKAIGPRLTATDSHAKFIELLQDEIKNLGFNTIEFPFKINRCLQSSCSLENDSTKEKIPNLGPVPYSGITKEMGVKGEIRFFQSKHDVKMKGKVAVIKVKNFTIPKLLLMHQVAKYPRHTHIGFSIRHPLVAATLTLGKIQAAKDNGAVGVILVWEHISEDLANREVLPFTNSYLGIPSVWVYQTQLEALKRCRDRKEPVRLTLTGQYETNVTTKSFAVLVPGENRGKQILINTHTDGPNDIEENGAIALLTVLHAIKHDNLKFKNTLVFGFVSGHFQIPQSGIEGRQATSRFLRDLSMYETSQHLEMKKALGLTVEHLGGLDYVDSQKENKLIANGLYDPLYVYASTKENRDLVLKSLSGTNVSGRYQILKPRKNAYFGEGQPLYQDGWPTISFIGMPLALCQMASPITEPDIKSMFDQTKLIFQILVASDHQF

SEQ ID NO: 3070 - protein, 254 aa, Lactobacillus paracasei
MKIAALYDIHGNYPALKEVLKQVKKLSPDLVVLGGDLIAGPMPLETLSLLKRVSTTFKTVGIMGNNDQDIVDIYAKKRVGLSRKATEQLTWIANQLSYKQVSFLRNLLPSISIGNYFFCHAVKNDNTTVFSPRQNKAYIEALFKGVQESYIICGHTHIQFELSLPNKKIINAGSIGMPFSNQFGAQWLWLDDNRIEYKRTIFNQQAAIQLISQTEYPFKNEFIANNLRSTISLSQGYSILNTLIRAQNAQHDLS

SEQ ID NO: 3071 - protein, 453 aa, Lactobacillus paracasei
MNNDVNATWPKLPVALKKIAIDPTSDDYELMCSNYFVTGRPKLILRATTERDVIASIQYVKKIRENVSHSIPFSFRSGGHGISMASVNDGGIILDISQLNSVTVTDAEQGLVQVQAGAVWGDVAEALRPFNLIISSGDFGDTGVGGLATGGGIGLLVRRLGLTIDHIVSARLVTADGEIRVTDHQKYPDLFWGIRGGNSQLGMVTAFTFKASKLVEEKSDISLPFTVQTIESQTSNLTKFIQQWQSWITHASSKMSSNLMLTAENRNTVHINASNFWAGSINSDAKALFKSALSLSEVNKQQLETKSYAELVKAPHIPHSGQQPVFVKNILLDTMNANIGDIISKILVSPGIIGIEMRAIDGPLNTINADETAWHDRKAKVFLAMWLQKDTEPHAKEVFGPLQDLGTGVYSSYSSDLSIEESQRIWPEETGRKLRKLITKYDPQHLFNQGHYW

SEQ ID NO: 3072 - protein, 94 aa, Lactobacillus paracasei
MIETLIIVIVISLQTFFGYIENKLLGAILPIAVIVADIYFLANGLLQLSFGDIAMPIIGLLALISLWEGGRQSKLSKQKREMQKMKAQDSKHHD

SEQ ID NO: 3073 - protein, 92 aa, Lactobacillus paracasei
MNPILLLDEDDQEFVRQFVLSSGSLKKLSEKYSVSYPTIRLRLDRVIRKLKAAELDQKNKFQVSIMQMVIDDKLDLALAQEIIQKYKETTND

SEQ ID NO: 3074 - protein, 326 aa, Lactobacillus paracasei
MDQTQKLNAPIRKHIFLIVAGVLLLLLAAAAGFDWQISQTIGDMNDPFATLFQDVGLWTAPLIIMLSCNIVCHYAIRSQQLAWYTRTLMVIGSVIYAGWELWAGYLKYAMTMVITSLNDINAGKPMGMANSDGSKLTLPGATSIILFLILYLAVFIGSQYWLAHKTDEQLHYLLKMAVVATLVCLLSDQIVNAMKTFWGRFRPYELNGNPTHFTSWFQPNGANGHMSFPSGHTQTAATLLTLTWFVDRDKPKRQRLVFWLTFAYGAVMAYTRVRILAHFTGDVTMSLILTWSLILILAAVVQQPLVDWEALTVRSSAKHLNTEPIS

SEQ ID NO: 3075 - protein, 358 aa, Lactobacillus paracasei
MIKPQALQPHDQVAIVSLSAGTLGESFAAHQLQLGTERLKAMKLEPRFMPNALRGQAYLKAHPEARAADLKAAFLNPSIKGIICAIGGDDTYRIIPYLLDDPAFTQAVADHPKLFTGFSDTTIDHLMFCQLSMTSFYGPNFLNDLAELDTHMLPYTAASFQHYFKNPATTAISSSPTWYDERTDFSESQLGVPRKSHKEQHGYLALRGQGRVTGTLLGGCLDSLHDLIYPVRYQDEPEVAKKYQLFPQDWTNKILFIETSEDKITPATYRTYLEHLDEHGVLAQVKAILVGKPQNETYFDAYQQVLLDVTQPYKTPILYNLNFGHAYPRTVLPYGLQTTVDFDQRQVTVDEPYFADKL

SEQ ID NO: 3076 - protein, 83 aa, Lactobacillus paracasei
MYTIQATATITGRGTVITIAPPVERIQPGDPIRLNGTTTGKVCAIEKRQHPHHTDEVPCLGLLVTAPVKVGDTIEFPQSPRWV

SEQ ID NO: 3077 - protein, 357 aa, Lactobacillus paracasei
MKIVVLAGGRSTERNVSISSGYRITNALRQKGQQATFIDLFLGYDLEGKTVEQVFDDANTSKDLNISDAILTDEDINKLRPDGSTQLFGPNVMAICKAADIVFLALHGGDGENGKVQAVFDINGVKYTGSGPLASGITMNKVFSKEVMLYHGIQTSGFKEFKRDQGPKQTVPFDFPVVVKPTSGGSSVGTHIIHNQEELESGLEDVFRFDNSAIVEEFTPGREFSLGVVNGHAYSAIEIKVRSGWYDFKHKFQAGYTDFITPPKDLDEDVHQAMKDVAVQTMDVLGLQNYGRIDFFANEKGVWVIEANNLPGMTPLSLLPQEAEADGVDYGDLVMDIVNGKLKLYADGMTEAGLLTK

SEQ ID NO: 3078 - protein, 163 aa, Lactobacillus paracasei
MQYTRLAIPNHAYFIVADQGKLAFVGSPDAPLSEAADYVSGPLEFNQEEMLPFQHAIDDYLTGKAQTITVPVTYHGTPLQEAVWQYLQTIPYGETRTYAQVAAAVGHPHAFQAVGSAVGKNPVMIAVPCHRVLRKDGGLGGFRGGLPMKRDLLALEQGQRPIF

SEQ ID NO: 3079 - protein, 333 aa, Lactobacillus paracasei
MKIIAYGARVDEIQYFKQWAKDTGNTLEYHTEFLDENTVEWAKGFDGINSLQTTPYAAGVFEKMHAYGIKFLTIRNVGTDNIDMTAMKQYGIRLSNVPAYSPAAIAEFALTDTLYLLRNMGKVQAQLQAGDYEKAGTFIGKELGQQTVGVMGTGHIGQVAIKLFKGFGAKVIAYDPYPMKGDHPDFDYVSLEDLFKQSDIIDLHVPGIEQNTHIINEAAFDLMKPGAIVINTARPNLIDTQAMLSNLKSGKLAGVGIDTYEYETEDLLNLAKHGSFKDPLWDELLGMPNVVLSPHIAYYTETAVHNMVYFSLQHLVDFLTKGETSTEVTGPAK

SEQ ID NO: 3080 - protein, 98 aa, Lactobacillus paracasei
MVLISILLDLIALGGYFLVTANTTQPVFWLLTIVESIIVVILVGFFFSYRGKRRSHFYDPDIGARPYTIRFSIIAVSLFVNGAALFVYIMAIRGNSIF

SEQ ID NO: 3081 - protein, 168 aa, Lactobacillus paracasei
MASDFTQLQQAIRLLNAHTRAADEQAWQVLFDRWLATLPSETRRQMQTVRFNHAQLTLLTTLDQSSRKQLRNQDLTAAVPFSQGLVSRYVARLVQLNLLTKLSLPDNRKAYIVALTPLGQQVAALHQQMHHHTNAQLASVLHTLDPQDVQTTIQVLTKLTAQPLHPKS

SEQ ID NO: 3082 - protein, 310 aa, Lactobacillus paracasei
LKAAIVTHLDQAPIYGDFPAPKPAPEEALISVLASSVNQRVRSQADGSHYTKTPELPFVPGLDGVGRTSDGQLVYFLTRDPKFGALAEQTVTQQQLMFPLPEDADPAQIAASVNPAMAGWMALHIKAGQVVGKRVLVLGATGAAGTAAVQIAKTMGASHVAAVGRNPDKVAALSDLGADTTVQLDDNIALAALPPADIVLDFLWGAPSATVMMTLLKARRDHAAKLIWIEIGGAAGPTLSLPAAALRSTGLTLVGSGQGSLTLADYQRELPALFTALAAGKFVTPTTVLSLSQVHDHWQDRGAARLVFQP

SEQ ID NO: 3083 - protein, 120 aa, Lactobacillus paracasei
VSLISTLLVGLLGLLHLTIMALEMFGKPESQAENFSMPLDFVKQPNAQIALKNQGIYNGALAVVMLLSLILLHGIDQLITLRLLTGFVTVVGLYGGATVSKKIYFVQAIPGALTCLTLFF

SEQ ID NO: 3084 - protein, 116 aa, Lactobacillus paracasei
MWLWMHLVSWAVLIIAAGIALFSKTRQFMLWTMITRVCYLVSIVSGIVLMRFAFARNPLLTVVKILIAIGLIGLIEIAFAGKKDHRLSKPIVWSTLAALVLVTVAGFALAQFRPFL

SEQ ID NO: 3085 - protein, 485 aa, Lactobacillus paracasei
MENFFHLKDNKTTPMTEVMAGLTTFFAMSYILFVNPQVLSQTGMPAQAVFLATIIASAVGTLVMGLFANVPYALAPGMGLNAFFTYTVVFALGFSWQEALALVFICGVINILITVTKIRKLIIVAIPETIQHAIGGGIGVFVAYIGIKNAGFLQFTSEASSINTINGQPLKAGALTLKHGVESVVSNGGIVPALVNFTQAGALLALIGLIIMVILNVKKVPGAILIGILLTTIIGIPMGVTNLHLSAANSFSSTFASLQTTFGAAFSAKGMGSLFTSPDKIALSIMTIFAFSFSDIFDTLGTFIGTGRRTGIFSDADERALEQGSGFSSKMDRALFADSIATGVGSIFGTSNVTTYVESAAGIGAGGRTGLTSVVVAGMFLLSSVFAPFIAIVPTQALAPALILVGIMMMSTFKEIEWEDLSQAVPAFMASIVMGFVYNISYGIAAGFIFYCLIKLITGKVKEIHPVLAIVTIGFILNFVILASL

SEQ ID NO: 3086 - protein, 107 aa, Lactobacillus paracasei
MTLKTIFHLDTTERWPHMASNLDNYLAAEPDADIEVLVNGDGITVFFDQKVAAFIAAHPQVHFFACHNSLQQRHLDETKLPAGVPVVPVGVVKLAQAEAAGYGYIKP

SEQ ID NO: 3087 - protein, 324 aa, Lactobacillus paracasei
MANQLTGLHHLTAITSSSPRIFHFMSGILGLHLIKKTVNQDDVRTYHLYFTDDMGTAGTDITFFDFPGIQKAQHGNNEIARTSFRVPSDAALTYWIDRFDTYRVHHDAIDDLFGAKILRFHDFDGQQYQLISDEHNHGVPAGTPWRHSTVDPQFAIGGLGPEYITTDHYDELVGVMTDLLGFKQIAKDGQYTLLELNDGGHGAQVIIDYQRLIPAAYQGFGGVHHLAFRTDDRDSLQHWIEKIGAAGLNSSGFVDRFYFASEYFRPIPDILFEIATDGPGFLLDETYEEAGVHLELPPFLEDQREAIERNLVPFNTEPQTAGKA

SEQ ID NO: 3088 - protein, 98 aa, Lactobacillus paracasei
MFNFLDNPAEYKRLMKMEILVAVMAIVASVVMFRLSVMTGALFAAIAGAFFIMDAIVEGLRLLGASHGFSRLIGTLIAIPALAGYLLVMMTLFPAPMV

SEQ ID NO: 3089 - protein, 191 aa, Lactobacillus paracasei
MQSFEKYHPIMSVHYTMDWLTTFKIKDIFQLRADRQIAAESGREFDQKITDTARYINRSMRLVMSNNALLYGIKDRANGDFLGSFCIWNFSEKKTVAQVRFETLAERQGEGVMSEVLKRMLGFAFFELGLKRVYVILPATNERAAKLLAANVFTKAGDYHHDRTLPDGTKVPLARFELTADAVADNDAFHF

SEQ ID NO: 3090 - protein, 680 aa, Lactobacillus paracasei
MLLQPLVSSASTQLAKSLMPSESSTSATDSLVSGAESILDSSKTSQPSTSQQKTTQATASSVKASASVEKPTQAKESSASSSKEAAASASVAVSAAKPEPPTAARSKRSIEDSRLRSGAAPVFDQDHPCPVKTTAELKEAIEKGIPYVRLTADINIGREAIPVKNSVTIDGDHKYTYMYNSGESWHRGIYFNASNISITFKNLKIGDRNVAESANNYYGIAPADNHTENSKIIVENVDYYSDRGAQPFHIRKPSNQIVFKGKNTFYTMKKGALVQEFAEATNYLFEEDSDTTIEMADNPLLGTFWASAGSLNLELKKRARLKVVSSNALVYTDGLAHHNNRITIGEDAVLDAYLTDKNDGALMYHHDDLVVDVQKNGQLLIQTTKATPFTKSSSINLGPGAKAELKNLRGDFFHSGDGTIKIDNADELSFGSGDHGTKSPTGLTAGKSANLIFAPFSAETKGYDIYADNQLLETQSDDSDWQLNGKKVERTPTKLDKSAANRIQKSTALRFTRNGSPFKATSPDVKPPDQPKPDEKDKQSGALKLVEVPDFDFGTLLISGETQVVRPQIRGKLLIEDSRKIAKKQSRLSMKVIQPFKNGEIDVTGNMSYISQTGQEQVLSDQSILVEETADVDQRDVSSEWNQTIDSSARGFKLTIPVEKQKLGTFSGKVEWSLQDVPAN

SEQ ID NO: 3091 - protein, 119 aa, Lactobacillus paracasei
MKKMILLTVLLLGFACNPFSRVDAAEAGDGYTSGAEVGFYESPSSASTDSQAKKAGTGQTDDAKDRPDAQTTNADQFGFMPRLGTTQAWLCSMAGLLTILIITLLLILKRNGKDKEEEN

SEQ ID NO: 3092 - protein, 257 aa, Lactobacillus paracasei
MKKSYLVASLAGLTLIGLSSMPVSMVGATTEVVSDGQVMFKTDVTRTPAKNPLDPSDAKPGKPTNPTNPTGTATNGTTGPLSLDYASSFTFGEAMISADDAKYYAKPQVFSQDDGKTVDRPNFVQVTDKRGTFEGWTLKVKQEKQFSVKDDDTKELTGAQLKFLNGNVTSTIDQQYAPTGQKEITLVPGSAEVAPLAAAKDQGMGTWIYRFGDEQTMAKSIELAVPGTSPKMAKEYVTELTWTLESTPTNTTPSPKS

SEQ ID NO: 3093 - protein, 247 aa, Lactobacillus paracasei
MKKFVLLAAAAAMGTMAVNATTVLAAQTNGGVYSTNGSIEFKPTEKVTKPVDPLDPTKTATPIDAEDPKKVVQPGTQGPLSIDFASSFNFGKQEITSETKTYFAAAQKYQDAAGTEKVGPNFVQVTDNRGTEAGWKLVVKQNDQLTSVSGKELTGAQIRLKNGHVVTASTAAHPDGTAEMTLVPGAEQTVMNAKTGSGTGTHLLNWGKDADDAARSVELTVPGATTKYAEKYATTFTWTLTDTPDNK

SEQ ID NO: 3094 - protein, 359 aa, Lactobacillus paracasei
VKKTIFCIAAFVAMLMTPAAHVFASELNFAAKAQMPDNQVNKGVSYFDIKMDQGAKQALHVDLRNDTEKEVAVDVGIASATTNINGVVEYGQNAIKPAKSLAFNMKDYVKTPAQVKIPAKGSTVLNLDVTMPSKPLHGVMAGGITLKEHQPGDQAAKDAGKGVAINNRFSYVIGLLMQQSTDQVAAHVKLNDVKPSQINYRNVILASMENDAATFVNKVAVDAKITAKGSDKSVYQVAKEGLQMAPDTTFDFPIALEGKTLKPGTYVAHLEVYGNQQADGGMTRKTADGKQHYHDHWTLTKQFTITDKVAKNLNQKDVSIKKDNSWQLYALIAVVAVLIMIVALLLVIVFKRKKKEQAS

SEQ ID NO: 3095 - protein, 77 aa, Lactobacillus paracasei
VKDTEAEEKAAQQNLHIWLSDMFTADDQSVRIFDVDRYKQSGKTTQQQAYLADIAYRFAGKTLLARTGTISKTRWIL

SEQ ID NO: 3096 - protein, 486 aa, Lactobacillus paracasei
VKLLELMEKNDQKKLQLLYYLDQHPNRKLKNSELQDKLQISYYLFKRQTKEIAEDIAAFDLSDFFAIEVTNTTVILHEYHNTNASVFLEHYLKQSLQIKILMTLMHEPPAFNLTEFAEEHFGSYAFMYKRYTALRDTLKSWGIVLSNDGKLTGDELAIRLLLTKIMVVAHIDETGFDDNVRSTLHELLQLLKMTEATPSMSQLIETKAYFLISLVRFQQGHVIATSPEIVDLVRNIRERTLETRKRVIAIYQAHFTASDQTIDSECDYFGTFLAIIGIITSEEIVFPDTIKQHGRAFIQGFEANFDVQLTLSEKANIEYVVNKCLIDVLALPFRSEFFDDHIEVSYFFRMYPEFFDYCQQFVQTRSVKLDRNQSKFMFYHCLLTLAANVPLNKVLEPLYVCVDFTLGKEYNTIIERDIKYFSTLNVKVTNEVRPETKLIITDLVNAYHDTDISKVIWLSPPRPEDWENVIEELLDLRLADRTVKKA

SEQ ID NO: 3097 - protein, 328 aa, Lactobacillus paracasei
MKRENDFGPAIKDFFFRAGDFKGVSSRPQYWWLFLAQFLLGLAAGVLFGIAIPFSLMDSHSLGSNIMFTLTTLAFSIFGYLGYPQLSLTIRRYRDAKVSPWWYLGIIIISFIGPLLAVNGMGWWLALLFPLIGGIANLVILLLPSREQKVVPFPAQPNTRGTIGVGFGTAVKDFFIRGGDFTGESSRSQYWWSILFSVIIIIPTFLFMLFSIMSIIIGGAAVSGFNSQNVDHLVNSLGTGAIIIVFILFAIIYAWSMLALPALTVGWRRFKDAGVSPWWLIAFNVVSAFLSTLDRNAGNVPLSLIALLLIIVQIVILALPTKFRDDEA

SEQ ID NO: 3098 - protein, 109 aa, Lactobacillus paracasei
MTQMPSSLQGFPKGEFAAFSTAKMTHFLPYSQETSTDDLKGFFGANYQYLTKTPIGRLKIDIPNTEQLIVQYGEIIARFTNGKFKIIDSTYFHKNFNDPLVDEDEKGIY

SEQ ID NO: 3099 - protein, 448 aa, Lactobacillus paracasei
MDQSLFQNGNFQPLASRMRPQTLDEFVGQTHLLGKDKVLSNLIEHDEISSMIFWGPPGVGKTTLARIIARRTKAQFVTFSAVTSGIKEIKQVMKEAEQNRELGQKTIVFVDEIHRFNKAQQDAFLPYVERGSIILIGATTENPSFEVNAALLSRTRVFVLHGLTSAELVDLLQRALKDPRGYGLQKVKIGKKLLAQIADFANGDARIALNTLEMAVTNAETKGGVVTVTQADVAQLLTKTALLYDKNGEEHYNLISALHKSMRNSDVDAAIYWLARMLEAGEDPLYVARRLVRFASEDVGMADSRALEITIAVYQACQFIGMPECTVHLTHAVTYLALAPKSNALYTAYEGAKKDATETLAEPVPLQIRNGVTDLMQDLGYGKDYQYAHNTKDKLTTMQTMPDNLIGKTYYHPTTQGSEAKVKERLEQIKAWHAQHPDPDSPKTKKKS

SEQ ID NO: 3100 - protein, 396 aa, Lactobacillus paracasei
MAKILAVNAGSSTLKWKLFDMPAEVQLAEGLVDRLGQPQSKVKIKYGDGQKYESDTPIANYQEAVASLMGNIKALGLVEHLHEITGVGHRVVAGGETFAESVVVDDATLLQIQNLRDYAPLHNPVEADYIDVFKKMMPWATEVAVFDTAFHQTMQPENFLYSIPYDYYKKYGARKYGAHGTSVRYVSARAAEMLNKPLEDLRMIVMHLGSGSSVTAVQGGQSIDTSMGFTPLAGVTMGTRSGDIDPSLVAYLMKKLDVPDVGQMIHILNNDSGLLGISGISNDMRDLEADEDTKPRAKLALDIFVNRVVKYVGSYAALMDGVDVLVFTAGIGENGDEIRDKIMRSLDYLGAKIDHDINNKSHGVEADLSTPDSTVKTLLVPTNEELMIVRDVMALS

SEQ ID NO: 3101 - protein, 274 aa, Lactobacillus paracasei
MTMIVVSDIHGHLETMDRVRAMQAKYPHTLTVYLGDYIDGYPYGGRVLTQIREQVQASQAIAIRGNHDQMLLDYLADKDNPWFINGGKATLRQMVQDYAPAKARKSNLQQAVLTYMSPLIQFIAEMPTAVEFDKLLLIHAGLDLSLEDPLKETTPFNRMWVREPYIYNMDETKNREHPIFAHNPIAKTIVTGHTPTALIYGDYENNVKPSLPPTSFSDGYPKCPVKVIQYPDESPRYFIDGGNHMTYKENYGNICVFDETKGVMIDSDQGINAN

SEQ ID NO: 3102 - protein, 242 aa, Lactobacillus paracasei
MDKRLIVMHNLSRHYGKQYWWQQHSLEDWLMMILIQRTSSKNVAQAVHNLQPYMQVDRLMALSQSELETLVRPAGFYRQKAQRIHDLLTWFVAQGGSFEKIAEKPAAELRETLLALNGIGNETADVMLMYTFGKKTFVADTYAMRLFNRLGFGPYTNYAKMQADFAPALDQITLDEAREWHALIDEHGKTQVRHAYDDRFLLQPDLTEAAWPPEAVQVEPPHDDPGSGKWRHAADPSAMTHK

SEQ ID NO: 3103 - protein, 98 aa, Lactobacillus paracasei
MNASVAVQVLPMYPEKQKVLAVVDAVIAYIKSTGINYEVSAFETTMEGDYDQLMAILKEIPIVTAKAGGTSQMVYSKINYFPEDTGLTIADKVNKFKH

SEQ ID NO: 3104 - protein, 925 aa, Lactobacillus paracasei
MIKDEFKFIGKNKLILLSVLVITLIPFLYCIFFLKSVWDPYGDTKNLPVAVVNLDQPVTYQGKKLDVGAQTLTKLKKNHQLGWHFVSEAEAKKGMKADKYYTVITLPKDFSKNAATVLDEHPKKMTLKYETNDSLNYIGQVISGIGVDSLNSEIRANVTNAYASAVFDQIKTIGNGMKTAAGAATQIDAGQVKLDDGIDQYTVAVSQVNDGVQTMKVKVAPMSSQIPKLASGANQVTGGLQTLNGSTTNLASGVNQLAAGSGQVTSGLGTLQSQTGTLKSGVGQLATGSNKVTSGLASLQSQTAPLKSGVGQLVTGSDAVTSGLDTLQSQAGLLVDGTAQLQTGSKKLTTGVKNYTQSVTTLSNGIDQLASSTSSLDNGTKALVTGSSQVTQGLQQVGKSVDSQNQQAAASLPKLQNTLTEYEAKLKSEPNQNPELIAGFEQIQASVNALISQTQTNGAKMATTLNQSLIPGSEELTNGLTTLNQQVPTLTAAIIGLQSGSKQIIANNDQLVTGANNLTDGIGQMATQTPSLVRGVDQLYTGSSQVSGGLSTLNHQVPVLTSGVNQLYAGSNQVSGGLGSLNNQVPALTSGINQLYTGSSQVSGGLGTLNGQVPTLTNGVGQLTNGASQVAGGVNQLNASVPTLVSGVNQLADGTGQINDKSDTLKSGSSQLEDGDKKFAKTLTSSARKVNGITLTGDTAKMFAAPTKTAQKHYSYVPNYGHALAPYVLSLALYVGALVFNFAYPIRKVSRADGTATQWFLSKVAIGGAVALGTAVLEATLMMATGLKVDNIGLFYLTAILFSFTSMYLIMFLSMAFDNPGRFVAMVGLMLQLGGAGGTFPMEITNQFYNAIHPFLPMTYSIMNFRNALTGGIADSTVTLGFMVLIAFTIGSLLLLWGTMILLQRHHLMGISQLDDNQKLQAVEK

SEQ ID NO: 3105 - protein, 189 aa, Lactobacillus paracasei
MAIKHRILDREKVLAAARVMVTRDGIRELTFQTLAKELNIRSQSLYNYFSNLDAVIEALGTEFMHNLHQELIEQVSGIAGKDAIRTFAQTTHRYFEQQQSLDEIIYFVHHFPESSPFVQATGDVIGLLKRLITHTEFKHMAKESFVQNFISSVLGFTVLEVMGFLPDGQPSRDTTFESLLDLYLSEVKE

SEQ ID NO: 3106 - protein, 482 aa, Lactobacillus paracasei
MSTSVKPQNRGLVMAAVFIATFMTSVEVTIVTTALPAIISDLHGLAYQSWIMSAYLLTTAITTPIYGKLADTIGRRGIFQWGVVLFTLGTLLSGLAPHIFLLILARALQGIGAGAVMPLTFTIIADYYDFAHRANVLALNNTAWGLSALVGPLIGGFLVDQLSWHWVFFVNVPLGILVFLLIQIGYREPSREHGVLTIDWLGILWLAVTLIALLLGIQALDRQPVLAGVLLALALVAGLLLYHQEQKAPDPLIAPKMFHNFTFTVQILTALLLSGVLIGYQVYFPIWLQSLYHLGATTAGLVVTSSSVLWLASSFLVGPLIKRFVPRTMTLWLVAILTLAYLLLTIASPHFPVWAFYVIAMINGTVMGIVISMNTVLSQHLVGKEYVGSATSILTLGRSLGQTVMTGIYGATLTLVIRANLHGNTFKAVNAAISANAAAKSHDPQVAATILTGLHGVFVMVVIVMVLVFILNLRDPNRHVIQ

SEQ ID NO: 3107 - protein, 48 aa, Lactobacillus paracasei
MGKHLLKTVMAVTLIGAAAYCLKRFSDELVVYVSPDDAPANKDSWTDF

SEQ ID NO: 3108 - protein, 793 aa, Lactobacillus paracasei
MDTKVKIVDYSSKEYFDKMTAYWRAANYISVGQLYLKDNPLLERPLKSEDVKPHPIGHWGTIAGQNFIYTHLNRVINKYDLNMFYIEGPGHGGQVMVSNSYLDGSYSEIYPRVSQDKEGMKNLFTQFSWPGGVASHASAQTPGSIHEGGELGYALSHATGAILDNPEVIAAVVTGDGETETGPLAASWFSNTFINPITDGAILPIVHMNGFKISNPTILSRKSDEDLDKYFSGMGWKPFFVEGDDPEKLNPEMAKVLDEAIEDIKAIQKHARETGDTTMPHWPVIIFRSPKGWTGPKSWNGEPIEGSFRAHQIPIPVDAEDMEHADSLAGWLKSYHPEELFDENGKLIPELAALPPKGEQRMAANPITNGGIDPKPLVLPDYRKYALDNKEHGKQIKQDMIVWSDYLRDLIKLNPHNFRIFGPDETMSNRLYSLFEVTNRQWLEPIKEPADQYLAPAGRIIDSQLSEHQAEGFNEGYTLTGRHGLFTSYEAFLRVVDSMLTQHFKWIRKAHEEPWHKAYPSLNVVSTSTSFQQDHNGYTHQDPGILTHMAEKKAEYIREYLPADANSLLAISPKLFSSQNTVNVLITSKQPRPQFYSIDEATVLANSGLKRIDWASNDDGVEPDVVIAAAGTEPNMESLAAINLLHDAFPDLKIRFINVVDLLKLRSPEIDPRGLSDAEFNSYFTTDKPILFAYHGFEGLIRDIFFTRPNRNVLIHGYREEGDITTPFDMRVLNELDRYHLAKDVIQHVPAYAEKAAAFVQKMDDTLQYHHDFIRANGDDIPEVQEWTWKPIK

SEQ ID NO: 3109 - protein, 541 aa, Lactobacillus paracasei
MKVKRLVAGAMVFASAALLAACGSKSSSSSSETFNRMEKDVISTMDNAHITDVISGQAAVDTGDGLYRYKGKKLEPAVATKVVKPTNNGLTYTFNLRKTKWSNGDPVTAKDFVFAWKRAADPKTKSEYAYLFSGIKNADDITAGKKAASTLGVKAEGDYKLVVTMDRPVPYFSTMMVNPVFFPLNQKTVDKYGKKFGTQSKYLVFNGPFKLTNWNGTGNSWDEVKNTSYWNAKQVKLDKIHVQVVKDSNTAANLFATKKLDDAVLTGEIAKQHAKDKDYVGDKQGRTTYLDMNEEKVPDFKNLKLRQAVAMAINRDEFANKVIGDGSFGISTITPENSGSNPKTGEDFSKEAAKESKTVQTYDLKKAKQLWAEGLKEVGKSGEDVTLTTDDTDVAKKSAEYLQSALEQLPGMKVSISSVPFKTRIQRSLDGSAQFILSGWQGDFPDPISFLDLYTTGNTYNFSHWSNKQYDDLIKASKGTDANSETKRYDDLLKAQELLSKESPVATLYQTVQGHLRNPKLKGATFSPANMYNFVGAYMAK

SEQ ID NO: 3110 - protein, 262 aa, Lactobacillus paracasei
VFSKQYWKTRSTIAAFLLALLFLLGHLLGNLGYEVNGGKQVAGYFFFSPYMNWLPVDISSNLPIAWNMAAPLLSVLAGGMFAANQGRNGYARLLRTRQSFLTYRRRTFLAAGFWGAMLPIVVLGLDFLGLLVIHPNVLPSQWLNNNVAISYLGFGGDLFYTHTWLYMLGWVLLVALYGASYAIFSNFLYFVTRKMVVALLGLMGLQLLLLSVSLMSQVSLAPIAYLQVVPTIAQPSIAYVILWPVALIGISLLALRVPTIEA

SEQ ID NO: 3111 - protein, 234 aa, Lactobacillus paracasei
MPKRICFLTAQFAPRWQRVAFLLATLLVSLCFTSIGLTTGRFQSGFFDANRSMQRLFGQLVLFLPMTGMMSAALLQLLQNTSVLIRIDARVMIARHILRELIFLTAVVTFSVWGIWFTAVLLWSRVGQSGTAVVANVNLVMNVATALFTYTTLTLIGCLLFRSRAIGIFCGLSLVIVFQAAPVFNLSEIATLITPKLAVNAMWPISVVKQFLMMIFVTGLMVLTLRRIRLPVEV

SEQ ID NO: 3112 - protein, 244 aa, Lactobacillus paracasei
MQKRWQVRPQKQRVIIVTLLFVGLLMGSVALYFEDRTNGLLRQVHDPVMMIFIGASPERFAISQLLWLLLWFGYMLLPIFASAGSTHTYQQGLYPYLNLRFRPRVLTYLWPLKQTWMIEAGVLLFMGVGVGLASFLFWQEQQLFNAGLFTSLIVMSQLLLLVMETVLEGYFGIVIGVVGPLVIVFLSFLQMPLMPLRFAIGSTFASDQQLLGAIGYQLGLIIGLVLIQIFYMPGRWGRYAANHT

SEQ ID NO: 3113 - protein, 224 aa, Lactobacillus paracasei
MPQIIHEPAVHLEVEQLSVTIKRKKILDHLSLSLVSPNIYGIVGPNGTGKSVLLKTLLGFIRPSAGSVKMNGVRVDPRHDLPVSVGAIIEHPGFIGDLNGHDNLMALGNIRSQLSDADIRTIMEKVGLSDDRKAVADYSLGMIQRLGIAQAIMEDQQLILLDEPTNALDREGVDFLTDLLRELRDQGKLVVVASHDFMWLQLLADQIFELTGGQLNKLEAGQPL

SEQ ID NO: 3114 - protein, 158 aa, Lactobacillus paracasei
MKKLHRRLLAVGLLAMIMIFVALFSWRYQTLNAPLAHPAVKTRSLSLPAKVVLHRTTVSLEKVEATIVHGQWRVRLHFRQSITKQNMKHMKFQLAQQREGREVPNEPQADLSQDQKVITMMDAYYSRATDNRVVITTLPQALNSQNLVQIVPFEPSRK

SEQ ID NO: 3115 - protein, 170 aa, Lactobacillus paracasei
  misc_feature (4)..(4): Xaa can be any naturally occurring amino acid
NDIXDMAINPRTEINMLVQEPNDLRFQVHPQAKFDVRAAVLLVHAGQLLATVNSASGIALVPGGAVKFGETAAEAAAREIHEELKLNVVPQLVGIVESFWQQPERTYQQLIMVHRVTLTDAQKAGLVWQEGLEGEWLPFAKAARVLQPRSLAQFLTSGDAIRHFVDHHTE

SEQ ID NO: 3116 - protein, 377 aa, Lactobacillus paracasei
MDMTTRPTLQHFLSDTKHGPYVSLYMSWPENTSVEALRLRFKNMVKHTKSVMTETYPETDFSAYAAELEPYEQDPTFWQTCETNGFGMLTNGAQTYVTPMYEAVDEVAMVTDMPQILPLMLDEATATDFDILALNADSIQLYHNHGHQVRPTSLPDDAPQTLKGTLGTEIRGGEMNSVSQGGGRVTHHGHNEKSAEKASDQRRFYQAVDQYVLANHSNPHKMPLVLMGLAENVAVFREISKNHHLLPKLAVVKSPANLDFVELDDLLTPVRETLRDRRRQNFAEIIENARGNDSYTDHLEEVVQAAVAGRIAILFVQAGARIHARLEGTQIERDSINAQHANLLNDLADIVLSHGGQVELLTEAYLPVEVGAMVRYA

SEQ ID NO: 3117 - protein, 289 aa, Lactobacillus paracasei
LPVKTIARIIGISASSVQRIIDQNLKLRPARRLPTRLCFDEFRSTHGMMSFICLNADSHRLIALLGDRFNRTIKNFFIAHYSLAERTRVQTVTMDMNAAYQTIIHEVFPKAQVVIDRFHIIQLAARTLDQVRVQALKQLDDKHIRPYKIMKTNWRLFHQTAPDAKHKQFLFGLNEYLTQQEAIDIALDTEPKLKQTYETYLALHDALMVKKHPAELANLLATYEPNGTAMDMTIATLKRHKIAVLAAVTSPYSNGPIEGVNRLIKSLKRSCFGFKNQLNFFKRIYQITA

SEQ ID NO: 3118 - protein, 331 aa, Lactobacillus paracasei
MAIYKFIVKHGFTGKYSIVRDYCAKYKDHQVHKATIRVEHTAGLSAQVDWKEEMTLYNRDGKPFTFNIFLYVLPYSKLKYTTLIFERSQDTLFSCLDDAFYHTGGVPKEIWFDNMKQVVDHAKSDIGKRVVLNERFKQFSQDAGYQPIVCRVFRPQTKGVVEALARTTERLRVYNYEFDDEVDLIEIVDELCDDLNHEVSQATNQIPTDKWEYEEKEYLHELPDNLLDPYFEEDITRVVSKESMVIFRKCKYSVDPRYIGRTVGIELTSDEQHIQIYYNGEMIRAHDITTRQFNYNPEDRVEILGSDLLKGRSTKDIKAYIKEHLSDYDEV

SEQ ID NO: 3119 - protein, 378 aa, Lactobacillus paracasei
MTQFNTKLVHGPQLQTDKAGAVVPPVYQSAMYRFAPDGGTSDWDYARSSNPTRDYLERQIATLENGDAGFAFSSGVAAIATVLAIFPDGSHFIIGDSLYSGTDRLLNQYFAQHGLTFTPVDPRDLTAVEAAIRPETKAIFFETFSNPLLKVSSVKAISALAKAHDLLTIVDNTFLTPYYQRPLDLGADIVLHSATKYIGGHGDLIAGLVVSASPEISEKIGFLQNTIGAILAPLDCSLVCRGIATLAVRLDRETSNAQTVAEFLEQHPDVAHVYYPGLKSDPGYALAQQETTGASGLLSIKLADNIDPIKFVNSTKVFDFADSLGTVSSLVKLPWFKLPEKKRSTSGLTPQHVRIAIGLEDQQDLIDDLAQALTAAEK

SEQ ID NO: 3120 - protein, 270 aa, Lactobacillus paracasei
MLKKKLWVLLPIVALSAFVLTACSSSKADSSKTSTVTSELINKNELTIGLEGTYAPFSYRKDGKLQGFEVDLGKALAKKVGVKAKFVPTQWDSLIAGLGSQKFDLVLNNISETPQRKKVYNFTTPYMYSRYALITRSDETSIKGLNDIKGKTFVEGTGTPNAALAKKYGANITPSGDFTVSLNLVKENRADGTINATAAWYAYAKSNSTTGLKSQTLKDSDVKPDEVAGMISKKSPNLQKALSKGIQELRSDGTLKKLSEKYFGADLTTK

SEQ ID NO: 3121 - protein, 237 aa, Lactobacillus paracasei
MWKIVADAVPQMAAAGIKYTIPIALVSFAIGLIIALITALTRISVRKGFWITFAKGFASFYVWLFRSTPLLVQLFIVFFGLPSLIIPGIFPHGIKLDPVVAGIITFSLNTGAYCAETIRAALLSIDHGQWEAAYSVGLPRRLVLREIIIPQALRTAVPPLSNSFISLVKDTSLAASITIVEMFQVSQQIAAENYQPLLMYSLVALLYAVVCTVLTWGQRYLEKVTSRYTSNVQTTQL

SEQ ID NO: 3122 - protein, 303 aa, Lactobacillus paracasei
MKKAWVYGLAAMLGLGVSAVIANQASASAATVPIVIQSATSKCDTGSAPDHGASKSAIVPPLADNKVEVPIVTVSSDDDQKAGNTGSADSSSVSSSQQNGAATSDTGAETVGSQAPVTNGNVTSSATAQQDDRDAHPSVSEPMIKTAQEVNATEASSSKAPTSKERDEQAIVAAAQAATHDNVKSGRTISVVPESVTSFIGSTNKQPQNAFEIIWQALIETVQMRQQCPTNLIQNLVLGMPQPNFDFVQSTFIATKRELSKAFSSPVFGKSLQLDSLSPFNQVFGKMINLIDQVLLTHLVFPD

SEQ ID NO: 3123 - protein, 462 aa, Lactobacillus paracasei
MELSEKKLKTRDYVVIASLLFGLFFGAGNLIFPLHLGQLAGANWFPAMLGFLVTAVALPLLGVLAIAATHAEGVYDIGRPLGRFFALAFMVLIHATIGPMFGTPRTATVSFTTGVLPMLPKAWAQVGLLVFSALFFAAAFFLSYKERKITTAVGKILNPVFLVLLFFVFFIGFSHPMGNPATQTVTAAYKNASFMNGFLQGYNTMDALAALAFGVTVVTAVRGLGLKNDDDVAKSTAKAGVMATSWIGLIYVALILLGSMSLAHFKLSPEGGTAFNQVVTYYFGAAGHAVLATLLTLTCLTTAVGLVAAFAQDFHRHFPKVSYRVWLALTSFLSFLTANFGLEQIIAWSVPMLMFLYPFSMVLILLSVFGKAFHHDPLVYRFVVGFTAVPAVLDMFAAFPAFVSQSALGLALHSFQLHFLPFAGMGLGWLVPAGVGLAVGLVAHAVKVRKAVAVAKLGAEEN

SEQ ID NO: 3124 - protein, 221 aa, Lactobacillus paracasei
MKKVNYIAAGISALTIAGLLLPTGQVFAADINKTSAAEINITPGEIILDKVPDLNFDKIPIADLLAGNVDKPLVDNTVGNGPVKNATEAKDGNATGDLSIIDNRGTNAGWTLSAQLGQMKNDTGKTLSGSLTLKGASLTTDNPDYDQALNPTVAQTLNIGGDAVPIWNAAAGTSTTDGQGQGKNNALIKDASTILHLTKNAAVTAGKYQAAITWTLADAPK

SEQ ID NO: 3125 - protein, 339 aa, Lactobacillus paracasei
MKKKIIFSLLAILSLLWFGGAHQVQAAEGAGCTISPALPQNQIDQSTYFNLLVKPGETQRLLIYVKNTTKSAKKLKVSAVSAFTQSNGTLGYYPNKHTDKSAEYTFSGLTEAPKTIDVGAEAQVPVTFDVKIPEKGFTGQILGSLYVEDPTVHKSGGSGMAINNKFAMLVGVVLQTSEAKVAPELKLMDVKPGTQDNQASVLATIQNIKPRLFGEMTLDGKVYRQGSKDPYLTRSEKGWSFAPNSHFDYAIFSKEALAPGTYTLDLTVKGADKTWHWRRNFTITQQQADVIEEKLGRAPQTPWLWIIIAIILALVILILLWLIWRQRRKRRETDETKQA

SEQ ID NO: 3126 - protein, 125 aa, Lactobacillus paracasei
MRRNKPSFWIMLLMTMNLMVGVGAKAQQVQADTSVAQVELVGELPSTNPDPNPTPTPDPTPTPEPVDHQTTDQHGQATPLTHTGYLPQTGNAVQLWYVVIGVELLIIVILGIVLLRGRSRQGGKK

SEQ ID NO: 3127 - protein, 673 aa, Lactobacillus paracasei
MKKKTFIMICLTVIFGMVLGPLQSVAAAEATWPSGIYPPPATGSFTSLNGVFDRVSTDSSMIMNGADEVGIELNPDATNQAGSMWSKNPIVDLTKSFKLEMPMFFGNNMISGADGMTFALAGTRPSAKGNSGPSLGAWGGQGGTGLKPESIAAQGLQNSFVVAIDTHKDDMDQNADYPGLNPNQQYIGSGYPGQASMYAIGFPLYKTQLKFTPTTQEPLQKFSDNIKDNVSNNLWHNLTVSWTSSPTGGTLNYQLTYRSGSGSKTTPSRSITWTKDQIKQIFGTDKVYLGFTSGTNSGLVLKYKEPHVLGIKSLADFNTVKGTVTLKRGNDNVTETTRLNIGDKLTYDYALDINNLDGRPWPATKIVLPKGEHLEYLKEDGTAAKAGDTLKIQAMIGSTTQTVDAVVQSDNLSAVISSDKLVLPKNTDSIVKFSLPAQVASHDLVSDQAVTDGAGTLTGGTPVKDYKLINAVDQTNNVKYVIAANPGELTLEKVPGFYFEKLGVSGLEDPTVADVINGIPGQNPFPATSAGIDPTQWLNTLGRKTPAGYDGFISVKDSRPTKPGWTLSMKLSPFTRTEGGYVLGDNGNTDGGKAQIVLIDTNPQAQLKVASIKDNGNDTVVKSMPAGNSDWDLKDDSSTAPITQALMSIEKTPSVHAGKYSSTATWTLANAPQ

SEQ ID NO: 3128 - protein, 233 aa, Lactobacillus paracasei
MKRVNYMSAGLIAMTLAGVMLPITSVFAADEPIKKTSVGEVRVGVDPDNPDPNNPDNPDGSKDILSLVKVPDLKFKSVSVEQLATGQQTLPLTSNTVTDKPVKNEPAGNASDGNNQGLLNITDYRGTGAGWKLEAQAGELKNAAGQKLAGSLLLAGVAKTDETDNNPTAISQAELVLEGSGVQVWNAASGQGQGRNTGVYTSADTVLKLSQNTAAYGGKYQTAITWTLTNAPA

SEQ ID NO: 3129 - protein, 119 aa, Lactobacillus paracasei
MTRSIWRFLISLIIVFGVLGEGIMAAHQVRAATSIGEVVVIDDRPKPDKDHNAPGTEVSKPKEEPSVPPRQQVDRLPQTSEGGQTWYSLIGFALLMMSSLRLQLRFKRKDRGDDDENRD

SEQ ID NO: 3130 - protein, 233 aa, Lactobacillus paracasei
MKIVTNFAIAFVTLMLASFVGPHQSVMAADDLGPKKSSAQLTVDAGNIMIQQVPDLNFGGISVHEIVSGSFQRHPLKSNLVNPGPIKTATNANDGNATGLLQIADYRGTGAGWRLEAKMDALTDGKGHFLAGYVDLVGSQLTASNPDINPINPAGSNVPRLNFAKDNTSVSSTVVWQADAEAGTKSGQGQGNNQTTIGTGTALTLVATNTNVTIAKGRYQGAITWTLSNAPKG

SEQ ID NO: 3131 - protein, 36 aa, Lactobacillus paracasei
MGGRGCLLRFVAKKYGAIELQVRWHLQPDYLRKEAF

SEQ ID NO: 3132 - protein, 674 aa, Lactobacillus paracasei
MKKRCYLLACLGMLLCTLLAPVTSVGAAVTWPTTSGYPAPPSFGDVDGLFSPTMGDSSLLTDPTSGHAVGLEINKDQANRSGAIWSKAPMFDLDKDSSYTMYFYLGNKTVTGEGMAFVLAAKPAAPTRVDPGSLGVWGVDRLPPNSTAKQIADTALPNSFAMVVDTIKNGGDAAGGYDQYSAYLDYYFGSGYPAQTAMYRISNPHWMSWLYFNGDPPFGGFQTGLGLQNTLSKTAANGKWHQLTLDWKKDNAGGGTLTYTVTMQKSTGSPYQFDRKIKWSKSDIQKYFAQKSDDPVPRKLYLGFTGTTSSQYEPHVVAIGAMPEATAINGTVALMRGAETVEATTHLKVDDVLHYDYTVNVKATSQATWPESGTATMNVPKGKYFDYLKADGTPAKPGDTLPIKVTIGNSDYQAQGKVQPDGNQIAVTNMPQIPKGATATVKFSLPAKVKHHGLLETTPVQDKPIGTITGDGQTYDLKTPAGKDFLAYILDPETGELVLEKVPSFVFELKNGQTGYRNPTVMEMVKGLPMPTATNWDQANADQWLTNQQGREPTNSTGKVLSVKDTRPTKQGWHLTMQLSPFTLTDNSYVLGDNGNKLGGKARLVLTDQTTQIAAIKDNNNATPVKNMAAGGTDWSLGTQTGNVAAYLGIEPTATAKAGQYQATATWLLTNAPE

SEQ ID NO: 3133 - protein, 324 aa, Lactobacillus paracasei
MPRTEAHLARHTNQKLKGVSFAVIGAIFWGASGIFTQTLFTDAGVKPLWLVGIRLFFAGLLLLLWSGVQEPRMFLAIWKNRHDAILMIVFAFLGMVPSQLTYFLAINAGNAATATILQFLGPVFILLYVAFATHQMPRRIDFVSITLALIGTYLLVTRGHLTGLSLAPAAVFWGIMAGVSQALYTLLPRTLLAKYDARAVTGWSMLLGSLPFLPQYVLHPNPLLTLPDFGAIAFVIVFGTMFAYLLVLGSLNYISPVATGMLSAFEPLTATTLAVTRLHIAFGPAEWLGGILIILNTLLQALPFNKIHHVQQRLTRQFSQKTKS

SEQ ID NO: 3134 - protein, 575 aa, Lactobacillus paracasei
MKLFKKTSLDTADPTDTAALPLPKAFAWLARFRPLLEKRGIQFDQLRLILATKGLLAARESSGLGSMFNKRKRGQDASIKTAFLWNLFFGLILGLLMFLPTSILTTFTLFMTIQLLTSFLAILTTYSSLILDPRDRSVFASRGVNDQTLSFARLINICFYLGMTLLAMGGPGLVMAGIHYGPIVALGGLIGLLLSGVLSLVMALFVYLLVLRFFDGERLRNMLNLVQILLMIGIYVGGQLPNLLPRSMSLFGMSISGQFNWLFLPAVPAWFVGLPMLFAGQVTVLSLTLTVLSVVVPIALTLVFLHFSGVFEAYLEKLNQGDARTRKLGWWFRGVSALLTRPGEERTYFTLGWRVLGSERDYKLRVYPQLAYGIILPLIFVGGGLRDMPFSSAKHFIAYAGIGVIVALAPALVNLRFSSQPQAMAIFQYVPFTTHGLLLRGVVKAMFARLFLPPLLFITILTTALGGFDALLAGIAVIIFTYGMTLMMGWPLVGSQFPFASVYSANANFSGGALGFASIFFGVIIAMIVIGIGGFLGGWLFPLGLIVLGLTLGMLLGHFYRTNLRYELKIKTTQE

SEQ ID NO: 3135 - protein, 264 aa, Lactobacillus paracasei
MAEPIVTLSHIQKSFGSKEVLKDLNFTITPGSIVGYIGPNGAGKSTTVKMMLGLMQPDGGTIELFGQPIKPNDPSYKRRIGYVPESADVFDALTAREYLSLIGQLYGLSAADAEQKAFALADLVNLREAFDRRISSYSKGMRQLILIIASLLHNPDILFWDEPLNGLDANTVLVIEEVLQDLRDRGKTIFYSSHILDVVQKLSDRIIVLNDGMVVADGPFKSIAKEADTNLQQLFNDLTGFAEHGQKAQSFVDIVTGGESHETI

SEQ ID NO: 3136 - protein, 182 aa, Lactobacillus paracasei
MQTSHNTLKNIIFTGLFAAIIFIGISLLRIPIPAMVGRPFIHFGNPLMVLAILFLGGRLGGLAAVIGLGGFDLLNGYAATSWLTALEAIVMAIVVSALVKAFKHNDQPRNIIIIGILAGLTKIVTSYLTGVVEALMVGSVFKAAVVGAFLSLPATVINSIATAIIVPVLYFILRPLFRRFTN

SEQ ID NO: 3137 - protein, 274 aa, Lactobacillus paracasei
VNTKSLIISQDLCGVGQVSMSVALPLAAGLGLTPYVLPTALLSSHTGGLGANTYLDLSSEMPGILKHWQQLQLQPDGIYLGYLGQKAAGQWDRWLPKFHAPLVLIDPVMADNGKLYKGFDAAYVATMQQLAHRATVLTPNITEAQLLLDEKPTTLTDPSAVTALAKRLHAQFDSAVLITGVPFHKQIAVVGIDASGTTLALAQPKETGHYFGTGDLFAAALATGLLKGQNLRQAAATGMVAARLAIKATLATDADPKYGLNLTGVIPALSKQLP

SEQ ID NO: 3138 - protein, 290 aa, Lactobacillus paracasei
MKINQCFKDHQVISFEVFPPRKNASNIALTPILNTLDAVKEADPDFVSVTFGANGNKPHMGTLEVAKLIKDEFDMEPVAHLPAAQLTREQVDAELRGFQDAGIDNILALRGDIPKSGRVSNDFPYACDLIEHIHQVGDFNVVAACYPEKHPESPDVVSDIHHLKEKVDSGASQLISQLFFDNQVFYRFRERAQLAGINVPIEAGIMPVINEHQIERMATMAGVNLPPKFVAMMQHFSGNKEAMRDAGIAYAIDQIVDLLVHGVDGIHIYTMDNPTVVKRIAAATQTIRNA

SEQ ID NO: 3139 - protein, 761 aa, Lactobacillus paracasei
MTTTIIGYPRIGEHRELKFATQKYFKHQITAQELQEQVKALRQHNWETVQAASINQIPTGDFSFFDNTLDVANLLNIVPKRYQALGLSPLDTYFAQARGYQGEAGDVKALAMKKWFNTNYHYLVPEFDQDTQIKVTDWQLFDQFEEAKALGINARPTLVGPYTLLKLSRFIDVTPDDFVADLIAAYTDIIGRLHAAGAEWIQVDEPALVYDQTDADLALFERLYTPLLAQKQSAKVLVQTYFGDLTDSFDRISKLPFDGFGFDFVEGHANLDLLKTQGFPAGATLFAGIINGKNIWRTQYADALATIKTLAKITDKLVLSTSTSLLHVPYTLRNETHLKPEEKQYLAFAEEKLSELHELDAIFETDADHKAYQANVALFSKPRYAENKALNEKIAALTPADYTRTPERKTRLAIQAKAFKLPLLPTTTIGSFPQTAEVRRNRAKLRRHEITEEQYTAFNHKEEIEWIRFQEEIGLDVLVHGEFERNDMVEYFGENFGGFRFTDNGWVQSYGTRGVKPPIIWGDVYRTKPITVAETVFAQSQTDHLVKGMLTGPVTIYNWSFPREDLSQKTSVEQIALALEDEVLDLEKHGIKIIQIDEPALRENLPLRKKDWYPKYLDWAVPAFRLVGSKVKPETQIHTHMCYSQFGDIIKAIDDLDADVISFEAARSDFSLLDILKATHFQTHVGPGVYDIHSPRIPSKDEIVHIIHEILKRLPADHVWINPDCGLKTRDVPETKASLINMVAAAKQVRKELTHENQPVL

SEQ ID NO: 3140 - protein, 572 aa, Lactobacillus paracasei
MRVLFPYIKKYRWDVIWSVLAILIVAFATLWQPHLLQVIMNAIMKNDKQTVWINGLYLIGLAIIGIIGGIVNTIYAARVALGVATDLRADEYAKIQSLAYADVEKFSPSNLVVRMTNDINQVQQIIMGFFQQVTRIPILFVGAVILAIMTLPELWWVIAVMMILVFGVSFFSFSHMGKYFGRMQQLIERVNTLARENLMGMRVVKSFVQGANQIKTFAESSDEMRDVSVKIGNLFALLMPAFFLVANLAMAGSIWLIGQDITSHPSNLAAITSFINYLMQILFAIINGGFMLTFASRALVSLKRIQEVMDTKPSMTFVSGPHRDLDGAVEFDDVTFTYPGDEKPTISDISFKVKSGEMIGIVGATGSGKTTLAQLIPRLFDPDTGIVKVGGHDVRAVTEADLRKTVGFVLQRSTLFSGTIAENLQQGNPNVNLDAMRWAARIAQSAEFIERLPRTYNAEVEERSSNFSGGQKQRLSITRGVIGQPKILILDDATSALDAHSEKLVQEALAHELGDTTTIIIAEKISSIIKADRILVLDEGRLVGSGTHHDLVQHNDVYREIYATQKALEEGV

SEQ ID NO: 3141 - protein, 593 aa, Lactobacillus paracasei
MKDLKNAGKFYAHYLKPYWIEFLITTILVGISTWAIVVAPTYMGRAIEELATYVQQWMNPATRAQATFTAFNHTLAIFVLLYIIDATSILISSLLLSKISGYSTGTMRVGLFRKMQRMKVNYFDSHSDGDILSRFTSDLDNIFNAMNQALIEIFLSGAQFIGIIWMMFTQNATLAWITMASTPVAIGLSAFVMHQASVSVDRQQDDIGRLNGYINEQITGQKMLITNGLQQESVAGFQPYNAAVRKSNLRGQIWSGILNPLLMGLSLLNTAIVIFAGSWLALNGSLSQGAALALVVVFVNYAQQYYQPIVQLTSLFNMIQLAITGARRITEVREQPDEVDPPEGKTLDGLKHELLIDNVHFSYIPGKEILHGVTIKVDKGEMVALVGPTGSGKTTVMNLLNRFYDVDSGAITFDGVDVREFKLASLRQNVGIVLQDPQLFSGTIRDNIRFGDPDADQARVEAAAKQANIHDFIVSLPEGYDTFVSDEQSVFSAGQKQLMSIARTILTNPRLLILDEATSNVDTVTEAKIQAAMDNVIQGRTSFVIAHRLKTILNADKIVVLRDGNIIEEGSHEQLLAQNGFYAELYHNQMVFE

SEQ ID NO: 3142 - protein, 414 aa, Lactobacillus paracasei
MSKRRYLVAIGGILLHLMIGSVYAWSVFTGPIAKQTGWALSSVTVAFSIAIFFLGMSAAFMGRLVERFGPRLTGTVAALLYGSGILLTGLAVQLESLPLLYIGYGVVGGLGLGAGYVTPVSTIIAWFPDKRGLATGMAIMGFGFAAMLTGPIAQNLIAGIGLVPTMYVLGTAYLLIMLTAAQVIRKPRPGEVPAADIAKSVSLTGTAMTANQAVKTRSFRYLWLMFFINITCGIGLVAVASPMAQQQTGMSAATAAMMVGVVGLFNGFGRLAWATLSDLIGRPLTYTLIFTVDVAMLAGILVFSSPLLFGIALCLIMSCYGAGFSVIPAYLGDVFGTKQLGAIHGYVLTAWAVAGVVGPTLLSLSDQYFHSYTYSLIFFVALELVAFILSIRIRRQFSVVARDEKVTDSLERQH

SEQ ID NO: 3143 - protein, 238 aa, Lactobacillus paracasei
MRKYDVIYQDLKDKIEAEIYTTGSLLPSENTLQDMYQASRDTVRKALRLLKDDGFIQSQKGRGSIVINRQEYVFPVSGVVSYAELAKQLHLQTRTVVLANHFAALPAKSFKDVDPDVEVKQMRLLKRVRYLEKEPDIIDIDYLDPRVVPPIPESVARDSLYAYLEGQIGLEIAYATKEITVETATEEDRRYLNLPEGAMVVVVRSCSSLADTRKFQYTESRHRADRFKFHDFARRTRP

SEQ ID NO: 3144 - protein, 548 aa, Lactobacillus paracasei
MGFHNKVIYQLYPKSFYDSNGDGVGDLRGIIDKIDYLKSLHVDMIWFNPFFVSPQYDNGYDVADYRQIDPRFGTMADFDELAKKLKAAGIDIMLDMVLNHTSTEHAWFQKALAGDKHYQAYYYIRPPKPDGSLPTNWESKFGGPAWAPFGDTGNYYLHLYERRQADLNWHNPAVRQEAAAIINFWRAKGVHGFRFDVLNVIGKADKLVDAPPSVASKTLYTDTPIVQDYLKELAANSFGQDDNRVTVGEMSSTTIANSIAYTKPDNHELSMVFQFHHLKTDYKNGEKWSKVPYDFNALRDILHTWGQGLDQGGGWQALFWNNHDQPRAINRFGDVGQYRVKSAELLAAAIHLSRGTPYIYMGEEIGMTDPDYTSMADYVDVEAKNAYAALLGKGMSEKEAFGIILAKARDNSRTPMQWDASDHAGFTTGTPWLRPTNQAAINVQAELAHGEIFKFYQQLIALRKQYPVISDGSYTPFGTEIDRLYAYIRTYGTQQLLVLNNFSDKTMTVPLPEKFQTAKVLITNEATLTPTATMTLPPYVTIGLLQKA

SEQ ID NO: 3145 - protein, 680 aa, Lactobacillus paracasei
EIIBCACMPNENTMADTKKLQLMAPVSGLAMAITDVSDPVFSQKMMGDGFGIDPTDGQIAAPVDGRIMMIADTKHAIGIKADNGAELLVHLGIDTVELKGAPFEIDTAMDARVKAGDLIGSMDLDAIKKAGKKTTVIVAITNSKEVLDHLDVNAGEVNRGEEVAVMTPKPMAATAAAAPKNESKYAATARQIIADVGGSQNVNSLIHCITRLRFYLKDEQLPDDDTVRNIPGVIDVAHGNGQYQVVIGQAVTDVYDEAIKQLGPSYANAEGTAQAIQETQQEAQDTSAMGRIKHGLQALIGTITGSMIPIIGLLAASGMLKGILLGLTKWGGLSTTNPTYEIINAMGDATFYFLPILVGFTAAQKLGSDPVIVGIIGAFLIYPSIAQIATAGKVSGTLLGMSINANFFGLPVHIANYTYSIFPMIFAAWMAAKLEPWIKSWMPLVLRMIFSPLVEIFLVGMTVVLVVGPLLTVASGALTSGIQALLNLTPMISGAIIAGLYQVLVIFGLHWAVIPIIAAQLSSAHPESILNGIVSISMIAQGAGALAVWVKTKHNPALKGLSLSAFISACCGITEPAMYGVNLKYGRVFIFASIGAAIGGLVNGLLGVNMFGFTGSFIGFFSFDAPAWANSPNNLMNFWIASIVTLVAAFLLVYFFGYKDADANQAKTAPKKKRLGKTVE

SEQ ID NO: 3146 - protein, 387 aa, Lactobacillus paracasei
  misc_feature (356)..(371): Xaa can be any naturally occurring amino acid
MYKRYKDVSLILKIVIGIIVGAVLGVMVPSWSFIDVLGKLFVGALKAIAPLLVCLLIMSAISKYSSGAKNHFGTVIVLYLSATLFSSIAAVAVSYLFPIKLVLPGAMKIAESAPKDLGTVVTSLLTNAVANPISALVEGNYLAILFWSLLIGSGLRLTSAVTKKVVTELADTVSAVAQNVIQFAPFGIVGLLHESLSKTGIKGVMAYGQLLMLLVATMVFVYLVVYPFMVWLMTRQNPYPLTFWTLKVSGIPAFFTRSGAVNIPINLKASKDLGLNEESYAISIPLGGSANSGGAAITVSIMTLATANTMGVHVSIFLALLLCFLSAISATGVSGIAGGSLLLIPMAASLFGISNXXXXXXXXXXXXXXXXAGCRYRFYHRRGSRFG

SEQ ID NO: 3147 - protein, 76 aa, Lactobacillus paracasei
MQVVGIGFIIGVVQDSVETAVNSASDLLFTATAEYADDRREGHPVDIRAKVKAAGKGTAEVVTPEKANEAEESEQV

SEQ ID NO: 3148 - protein, 491 aa, Lactobacillus paracasei
MGQVWQRLIRKEDPSVYEDKDSHLPRVLRVRDFLALGVGTIVSASIFTLPGVVAAKHAGPAVSISFLVAAIVAGLVAFAYAEMSAAMPFAGSAYSWINVVFGEFFGWIAGWALLAEYFIAVAFVASGLSANFRGLLATIGVNFPKALANPVGTDGGMVDLVAVVVMVLVGLLLSRGVSSAARVENILVVMKVLAILLFLVVGLTAIHPENFHPFFPAYHLNADGTPFGGWQGIYAGVSMIFLAYIGFDSIAANSAEAIDPEKTMPRGILGSLLIAVFLFVSVGLVLLGMFPYQDYANNAEPVGWALRHSGHAVIAVVVESIAVLGMFTALIGMSMAGSRLLYSFGRDGMLPKKLGKLNSRKLPNHALAVLITIGVLIGAFFPFAFLAQLISAGTLIAFMFVTLGIYRLRPREGQDIAKPRFRMPLYPVLPAVAFLGSLIVFLGLDIQAKLYSGVWFLIGCAIYFLYGMRHSALTKGSAVEQETAALGQEKD

SEQ ID NO: 3149 - protein, 312 aa, Lactobacillus paracasei
MRNNGNIILIGDGAIGSSYAFNCLTTGVGQSLGIIDVNEKRVQGDVEDLSDALPYTSQKNIYAASYEDCKYADIIVITAGIAQKPGQTRLQLLAINAKIMKEITHNIMASGFNGFILVASNPVDVLAELVLQESGLPRNQVLGSGTALDSARLRSEIGLRYNVDARIVHGYIMGEHGDSEFPVWDYTNIGGKPILDWIPKDRQDKDLPDISERVKTAAYGIIEKKGATFYGIAASLTRLTSAFLNDDRAAFAMSVHLEGEYGLSGVSIGVPVILGANGLERIIELDLNPEDHKRLADSAAILKENLKKAQEA

SEQ ID NO: 3150 - protein, 446 aa, Lactobacillus paracasei
MSAASYVQSILTTLKQRDPNQPEFFEAASALLKTITPVLEKHPEYMKANILGRIVEPERAIQFAIPWQDDKGQIQINRGFRVQFNSAIGPYKGGLRLHPSVNLSIVKFLGFEQIFKNSLTTLPIGGAKGGADFDPKGKSDAEVMRFCQSFMTELSKYIGPDLDVPAGDIGVGAREIGYLYGQYKRLKGAKRGVLTGKGLSYGGSLARTEATGYGLIYYTDELLKANGESLAGKRAVISGAGNVAIYATQKAEELGVKVITVSDSNGYIVDENGIDVAVVKQIKEVERGRIKAYADRVADSHYYEGSVWDADLQYDLALPCATQNEIDGTQAARFKAAGVIAVAEGANMPSDPEAITAYTDAGILYGPAKAANAGGVAVSALEMSQNSRRLSDSFEKVDGQLHDIMQHIFKASADAAAEYGMAGDYEAGANIAGFLKVADAMYYQGM

SEQ ID NO: 3151 - protein, 113 aa, Lactobacillus paracasei
LLELGLSIKCDIDGLLLRDIFIQTKQELFVFSVRRNLMKKPPVCLHDLIRTAVFVIKLFERLDAYLIKGTSRKLNDMEPINDNLGLGENLMNNRLISCIHVHGDRLDPSAFSE

SEQ ID NO: 3152 - protein, 29 aa, Lactobacillus paracasei
MNTFDQAIIAPLLVGVFLLLLKHLLDNHK

SEQ ID NO: 3153 - protein, 138 aa, Lactobacillus paracasei
MTQIYFLCTGNACRSQMAEGFAKKILGNDWRVASAGVEVHGLNPLAVKVMAEKGIDISQQTSKLIDPDYLLHSDLVVTLCGDARDRCPVTPPTVKKKHWPLPDPALAAGSEQDRIVVFRKVRDQIEQQIIDLAKVGNL

SEQ ID NO: 3154 - protein, 111 aa, Lactobacillus paracasei
MKKIELFEPAMCCSTGVCGPSVDKELIQTTAIQRYVSVNAQGQAMFIRRNLAQNPDAFVRNPIVVQELKRQGINALPITLVDGQLVKTGEYPTINEFSSYLDMDLVAALVH

SEQ ID NO: 3155 - protein, 431 aa, Lactobacillus paracasei
MQVFFAVGIFLLTLLFVIWQPRGLSIGWTAVGGAILALLFGVVSFKDVGTVTGIVWNATLSFVAIILISLILDQIGFFEWAALHMARWANGHGIRMFILVTTLGAVVAALFANDGAALILTPIVLAMVRALHFDEKQVFPFIIASGFIADTTSLPMIVSNLVNIVSADFFGISFSAYALRMWIPDLFSLLGSIGILYLYFRKALPRKFDATQVAEPSSALKDQRLFKFSWVVLILLLIGYFSSGFLGIPVSFIALSIAAIFLIVGQRSSHVNAMAAIKGAPWNIVFFSIGMYVVVYGLQNVGLTTLLSGVITEIAKGGRFAATMGMGYLAALLSSLMNNMPTVMINALSIKGADVSGLIHHTLVYANIIGSDLGPKITPIGSLATLVWLHVLAQKGVKIKWGTYFKIGIVTTIPVLFITLCGLWLSLSIFG

SEQ ID NO: 3156 - protein, 576 aa, Lactobacillus paracasei
MEKYSPQEINLTKYLFFTGKGGVGKTTVASATAISLADAGHRVMIVSTDPASNLQDVFKVSLTNQPKPIPNISGLFAANFDPVIAANEYREQVIQPYRGVLPKEAIQNMAEQLSGSCTVEIAAFNEFANFLTSSKINQQFDYIIFDTAPTGHTLRMLQLPSAWSNYLDKNDRGASCLGQLAGLNDKKAMYQKAVETLGNPQATTLFLVTRPQKGALLEAQRASHELAALNIKNQQLIINGILNQPTDAVSQTIFKQQQADLQNMPVTLDQLPKLAIPLRAYNVLGLANLRLLLKDQQPQITEEPVTASHFPDLDVVVKNLVQSNKKIIFTVGKGGVGKTTVAVQIAQKIAAQHKTVHLATTDPADHLKYFKITSPLIKVSHIDEKKSLKEYQNEVLTTAKKTMKSNDVDYVAEDLRSPCTQEIAVFRAFAELVAQNDSDVVVVDTAPTGHTLLLLNSTQSYAQEVAHTSGSVPQAVVNLLPRLQDPKQTEIVMVTLPEATPVYESIRLDDDLKRASLAHTWWVVNQSMLATQTTDPCLLARVQSEVKWIDQVKELSNNYFAVMQWQPNYEKTLLTV

SEQ ID NO: 3157 - protein, 107 aa, Lactobacillus paracasei
MDYQNYVQMLKAMADPNRLKIIDLLSCGSLCACDILQHFDFSQPTLSHHMKVLQNAGIVFAVKDGKWQHYSLQKRFVQEFKQNTDQLLAADEHCLCQRSDCEKDVAN

SEQ ID NO: 3158 - protein, 198 aa, Lactobacillus paracasei
MIIGYARVSKDDQNLNRQIDQLMAYGAEKIIQEKFTGTRQRRPGITQLLQTIRAHDVVVVESISRLGRNTLDILNLIQLLHQKQIKFVSLKEQMDTETPTGRAMLQMMSVIAELERNLLADRVKEGIAASRRRGVTVGRPRIAQEKLDIAIRMYQSGDYSVKEILATNQISSGTFYREVNRLKLKKLKRKDDPSASHN

SEQ ID NO: 3159 - protein, 87 aa, Lactobacillus paracasei
MPTNPHHQQSFGTFEGISSADQLRLYFQLTDFDRALIDEMRSATTKLGFAVQLSSVRFLGTFPTNLQQVPAEVIDYLAKQLTIDGRA

SEQ ID NO: 3160 - protein, 156 aa, Lactobacillus paracasei
VIVDAQSVKTTDLTKNSGYDGGKKISGIKRHMAVDINGLPQAILVTRANVSDRPGALAMFSLASQNLELVQHVMVDGGYTGNDFADQVKLILNAKTTVAKRNELHTFTVLPQRWIIERSWRWLDKCRRLWKNCERALNSSLQMVVLAFLKIVLKRY

SEQ ID NO: 3161 - protein, 110 aa, Lactobacillus paracasei; identical to SEQ ID NO: 1270

SEQ ID NO: 3162 - protein, 312 aa, Lactobacillus paracasei
MALISLEHVTKEYDGKPVVNDLSLKVDQGELFVLVGTSGSGKTTTLKMINRLVDPTSGVIEFADKPLTSYKMRDLRWDLGYVLQQIALFPTMTVAQNIAVIPEMKGWSRQKIRTATDELLTTVDLPPAEYRNRMPSELSGGQQQRIGILRALASRPKVVLMDEPFSALDPISRTQLQDMLLHLHRALKTTVIFVTHDMAEAMKLGDRIGVMRGGKLLQVDTPEEIATNPANDFVADLFKGAQANQGLQVTLSQLAPFAADVSARHAVGGNLTLAEALPLLDAHEALRVNSEHGAFVVNTHSVVAYLASAFVS

SEQ ID NO: 3163 - protein, 134 aa, Lactobacillus paracasei
MSFISGFLTKDFCSIVADGRMSQGAKTVGENYKKFMLAESNILIATTGNAQVADIIKDFIKRLHVQSNGAQLNWQLYVNVIQQFVKETLKEAKDIDGNCVNQIVVICGVNGNKIMALAFGQTDAGLDCNNKVTT

SEQ ID NO: 3164 - protein, 147 aa, Lactobacillus paracasei
VVRATRYFSPIDHDKTIENAKEVLGNYWHHKRLAQRTKIALRSPVMDGMPKSPSYGNKAEDKLVSHADELYYIACCEGAIESIENEDYRIILVESYLTPKTTRKSSLQLAAHLHVDRTTLWRQTQEALYAFAEICPLVKLDATSVQQ

SEQ ID NO: 3165 - protein, 110 aa, Lactobacillus paracasei
LQSRLIKLLICAVITVVICAYFFWLLFDHFVSNRRSKTVQIGSTVFIVRIGKKQYVSYFSKCSKEFNTSSEIDSSKLFVLRHDAEAAAEVSGGIVLTLPINIDDPNELKY

SEQ ID NO: 3166 - protein, 103 aa, Lactobacillus paracasei
MTNTAIRYTPEFKQTLIDLHEKGHSFKELHEEYGPSLDTIRKWVQAATVIAIDHQGTAVTNEQFKQLQKENRRLREELDILKRAAVLLAKRWIYSFLGRQANN

SEQ ID NO: 3167 - protein, 57 aa, Lactobacillus paracasei
MNSSEEFPKNSYKSNDEVIAKVSSELSSFENENSTFDAGFGIIFSSGGGSRLRTMPA

SEQ ID NO: 3168 - protein, 151 aa, Lactobacillus paracasei
MLTVNEKLIPFKDSDGQPSLFNINDNTIRPVSSSLFTILTTIIQHGSADEISKDLINQLIAMEWVHESRELKQDYSKSGIFHSNKESLQKAICAPESKNHFLVLGVPYDLGNPVRPGARFGPDEIRVGSWSLLEYTHYQEHVKKDNPRLHN

SEQ ID NO: 3169 - protein, 207 aa, Lactobacillus paracasei
MKELDIHSVTVNKWKAASASKTKVEQRPNLLKQDFSTTGLNQKWTADMTYIQTKRNGWCYLSTIMDLHSRRIIGYSFSKKMDTDLVLKTLESAVKNRTITGDLIIHTDLGSQYTSDDYNQRLTELHIRHSYSRKGCPYDNAPMESFHASLKKECVYPVPVFEDYETAAAVLFEYVHAFYNRKRIHSSLGYQTPLQVEIATLTSQMAA

SEQ ID NO: 3170 - protein, 210 aa, Lactobacillus paracasei
LAPYQDDLNTLLAKLQAIAQTGNYYAKDVFDQQRYTELADVTTKLAIKLGASDQQAKLFVDADFGYVTPKVDVRAVTFIEDQLLLVQERAGGTWSIPGGWADLGYSAGEIAVKETREEAGLTVKPQQLLAVRALRKHAYAKQSSQDVYKMFIACLPENRALKSGIETAKVQLFTREQALQVPLSLQRNLPADIEMAFDAHTASHWMTKFD

SEQ ID NO: 3171 - protein, 174 aa, Lactobacillus paracasei
LRRWLVIAVSVMAMIGVTGCQSKSSKSSSSTGSTMIKVNHFTKQTLQKQYTTISDLVMKTMTEVSLQSDNKTLSQSAKASLSKLDKIRLELDNNKSQDSGDDALAKTLVDYAKQSSDVLTAVINNDGKGYQSSAQAFFKQAVSIGQQSFGGQVPESVRNYANNQQAVTTSGSSK

SEQ ID NO: 3172 - protein, 611 aa, Lactobacillus paracasei
MQKRRHSQKRASVFLLITLLLSVLVALIPPLISKPISVGAGQNIAVTGFGSQDATITDTTGKDFTHAPNLSMYSVYTLTYHWRIPDEVVVKAGDTATVSLAATVVSRADVDFAVVDPTTGATIGHFFSKAGSSSGILTFTDFFSHSTVGRQGELQFMVSGRYDDSGHQRPGWYINKAGWVVNPPTGATPEEKAQYVDDLGRPKIFQWEITINPNMEHIDNVVLTDTLGPGQHFDTSRGLVVHTGTYDDNWFHATGTITPSYQVNGNQVKISLGTITTAIQIDLWTNPTSASFETTDSWTNSVVASGKQGGTGAPAQANGTITWRNGGSGTGQVGQVTLIKQDQKTHQQALAGAVFSLYRADGTLVHDDLTTDTKGKLTFTQLLVGQYYFVETKAPKGYKLNATHLPFTITLDKPQVTVKAYDENLTPPPVTPSTPSSESSSSMTPPSKPSSASSSKPSVPSSSVTPPSKPSTPSSSVTPPSKPSTPSSSVTPPSKPSSPSSSVTPPSKPSSPSSSVTPPSKPSSSSSEPSKPAASSTPSHQESSSSISSSDVIPSFSSESDSSASVEVITPSHNNTHHLPDTGERVLGWLAIAIGSLLSITGILLLIKDYQ

SEQ ID NO: 3173 - protein, 63 aa, Lactobacillus paracasei
MGINGGIVDDRLDTHLIAADCFSYFTVKIDGSHNLNLLVAARFGAGAASDSKDCQQHDAEGGQ

SEQ ID NO: 3174 - protein, 166 aa, Lactobacillus paracasei
MPKLANALADKFAKQDPSKKAIFKANAKKYIASLDNLNALIQKLKQNVRDQKVDVSEPVFGYALDYLGYKVNNTHFAQATEEGTDYSAKDINGVQDDIKEKKIAFFVNNSQASSKIVDGLVKLAKQHDVPVLNVSETLPKGKNYRTWMTSQYQQLEKIQAKADKTN

SEQ ID NO: 3175 - protein, 49 aa, Lactobacillus paracasei
MSLIKHTFKRVEHMIAAPRDPHEEEQARLQENLFYTNLSSLQPKTNAKF

SEQ ID NO: 3176 - protein, 792 aa, Lactobacillus paracasei
MLYNRVKEHVVNDRKKMYKRGSQWVVVSAFALALGGVALTQLQPVNAAETDTHLVVQPVTLTQDGQVSQPAAAQTEPASAVKNTQPVATANAAKANGEASPAAAQQQAAAAYQAASQAANANTSMPASSGMTEAEWQAQQAKYDQAKSDAAVSEAAEKQKASEAETSYANSLASQAAAQKQQDQASLAAASSSAAASLAALKAQQDASYAAASQAATAQIDDLNAQRTTPDAPVENGGTFNYVAEHGLWTNVVTHRDNNSNWNGNYLVQNLPVFKDPSQAGMMDGIYVHTDDDNTPSWSLGDVVHNNQLTDAQKNELNQYAMMLVNNYRKSMGLTPISTTQDFLKLVQQRGQTLTNVAETHHDPDYTNKLFGHGTDETLSSVDPSMFMGNRYNQEPTMLELMEGVSVSINDLLNYDDDSNQGHRNILLDDGEVTEGFSIQYNTVQNAWVMNSNGSYYTYAGNNILYVPAQTSTPSTDQDNNKEIDQKIQQVKDQLQDLKNQQGDQYQSKQAELNDAIQQLADQFASQEAQSEKDNSSKIQAFNTQQESALASFIAALTKQVEALNPGPKPSTPSSGASSSGASSATSSSSSSAASSSASSAGSSASSSAASSSASSAGSSAASSAASSSASSAGSSAASSAASSSASSAGSSASSSAASSSASSAASSSASSASSSAASSAASSSASSAGSSAASSAASSSASSAGSSAASSAASSSASSAANPKTSSAAVIPVVAAQPSSSQPMSRVAQKNGKHAYPATGESQAGAILTEAGAVVIAVLGLAGVRKYRHAK

SEQ ID NO: 3177 - protein, 395 aa, Lactobacillus paracasei
MTKPDEQSWRDLLANLNPYREPNTENKGQWRPELEKKIAEYEKLKEEEAMAEELSFNWLFEADAQYIHKPQARANFNETETTIYDGVPAGPIEHDPQKAQIYIANINPAVASGQVEELIRAEREGGFVNIQKYVHEEDAEWIDGKPANNIIYQQLFRPNKTDTGDMTLTDYLRQNTKRDKQHWYAQHTSMLLRALFDADEKSNTTMPVSEAKQILSHYPIQFIDLVPYRTQNADDFIKFIQIKSTSSYQAKSVEAYQLATNKQKSFKALPSGAQVALLPSTQFILASVIERIRQYLDEPNRIPAPTFVLRSYKNWWQPALQVFLTQRWDILPASLKEKESTVASLLQAFEQDFFWQYVSAQSASISDRNLEKIQGTGDFKDTFVTPFRHATITKE

SEQ ID NO: 3178 - protein, 54 aa, Lactobacillus paracasei
LKTLSKIAHIVSALSGVILVITIISIPKYDSMALNVFILTVSATMIIDNYNREC

SEQ ID NO: 3179 - protein, 118 aa, Lactobacillus paracasei
MVILIGIGAGLGAVCRYGITVLGKMLWPGKPLATLLINVLGSLLAGLLVGLPALSAFRLFLLPGFCGGFTTFSTFMADAFILIKNRRWSMAIFYYVGTVVAGMVAVVVGMMTSGILFA

SEQ ID NO: 3180 - protein, 136 aa, Lactobacillus paracasei
MHHREKIHVSWLLAVFAGGFIGGILRYVISGVTHDGTTMMGTTIVNLIGSFLLAFTTYGLDMKFDLPEWLLLALGTGVIGGFTTFSTLMLDFATLAPRHAIYATLLLMLNLLGGLLAATAGFLASKLVGRRDKKQW

SEQ ID NO: 3181 - protein, 39 aa, Lactobacillus paracasei
MLQFLNAPAHTQKKDTYPDLLKVGVINLRIGEHHRHLIY

SEQ ID NO: 3182 - protein, 95 aa, Lactobacillus paracasei
LSAKDQFFLLTAFGKTYRLKASLERGLITLFLSPADWMAHTPQHFLKCGGDSHAKIRRRKRFAALDVASIIVALSILITSMAKAYAIIKKANLKD

SEQ ID NO: 3183 - protein, 428 aa, Lactobacillus paracasei
MALFIDTVKAREIFDSRGNPTVEADVVLSDGTLGRAEVPSGASTGEKEAVELRDGGDRLGGKGVLKAVNHVNTAINQALHGVSPFNQAHVDQIMIDLDGTPNKAKLGANAILGVSMATARAAALATHQPLYRYLGGTDLELPQTFHNVINGGEHADNGIDIQEFMITPVDRTSFRDGFEKITNTYHTLKKVIEKAGYTTGLGDEGGFAPDLKNSEDALQMLHDAILQAGYTPGKEIAIAFDAAASYFYNHDTKNYDFEGKTYTPEELGAYYIKLLDQFPEIISIEDPYGEDDWDNFAKFTAKYGKRIQIVADDPVCTNPKLITEAIQKGMANSILIKLNQIGTVTETLEAIRLARKNGYTTMMSHRSGETGDTFVADFTVATNAAQLKAGAPARSERVEKYNQLLRIEEELGSDGTRLAHFPDSVQFD

SEQ ID NO: 3184 - protein, 751 aa, Lactobacillus paracasei
MTQYNGLSQSEATARLKSNGPNEVKEPTVSFIQGVLARLWEPSAWILEAALVVEIVLGKGIQAGFIVLMLLFAAVNGAIQSTRARAVLRKLSHELTPLVAVKRSSKWVTKPAKELVVGDLISLRQGDIIPADACLLDNAIQVNESSITGEAASVHRQVNQTVYAGTEVLTGHTLAVVTAIGADSRSGKTITLLNQSAAPGHLQQLLGRIINDLAILDSVLAIILIVAALIRGENLISMFPFLAMLFIATIPIAMPSSFAVANSVEAKVLSRDHVLVSDLSGIQEAANLDVLLVDKTGTITENKPVVVTFTNLSDLPDETVRAYSAFACDQQHPSVIDQAILTFTSNNHVEATLSNFTPFTAETGYASATITIADRLLKVRLGSLKVLQSRDPESPKLPPLALDAGRSVAVSINEHLVGVYILEDTIRADSRQAIEAIKNRGVQLVMLTGDNVKTAQTIALKAGLTGQIVAFSRLPATFSLQNLAGIAEVKPEDKLAIVQRLQASGHIVGMTGDGVNDAPAIRQAEVGIAVENAVDLAKRAAKMILLEPGLTSIIEILDSGHRVYQRMMTWTITKLSRTAELTIILTLGYLLNHFLPLSLNAMILVAILNDLVTLVLGTDRTSISHHPENWHLGKLGFISGTLAIGWTLVGMIILTLLTNLHVAQGQISTIIFNYLIFSAMLTILITRSNRNFWRSKPSRAVMTAITINIVLTITLSLLGWGIVAIRATTILAVLAITLVTGVLLTRMRRLL

SEQ ID NO: 3185 - protein, 315 aa, Lactobacillus paracasei
MKFWKRIAVAGMATIAALSLAACGSKSSSSSTSTSNSYTPKSLNIQFVPSSNANTIEAKAKPLASLLKKELGIPVKVTVSTDYNSIVEAMKSKQVDVGFLPPDGYVQAHAQKAADVLLMAQRFGIKQPGGKSTDKLVDSYRSMIVVKKGSSIKSWKDLKNKKIAVQDVTSSAGYIWPIAELSQKGLDIVKQDTLVTVKGHDQGVMSVLNGDTDAAFVFEDARNIVKKDVPDIMDKVEPIYFTKPIPNDTISVRQDMSAAFRKKLSKAFIDIAKTKEGHAIISSIYTHEGYVKTTDSAFNIVRKYDKIATGESKSK

SEQ ID NO: 3186 - protein, 257 aa, Lactobacillus paracasei
MSESNHPVIEFDHVSKIYPNGVVGLKDIDLTINQGEFVVVVGLSGAGKSTLMRAINRLHDISEGDVRIDGVSITKAKGKKLLNIRRKIGMIFQSFNLVNRSSVLKNVLTGRVGYYPTWKMVLGLFSAEDKQRAYDALRTVELEDKVYTRADQLSGGQQQRVAIARALTQTPTIILADEPIASLDPQTTKRVMDDLRRINQEMGITVVANLHSVEVAQAYATRIIGIRAGQKVFDGPVAEATDEIIASIYSGNEQEVS

SEQ ID NO: 3187 - protein, 260 aa, Lactobacillus paracasei
MTAPTLPKRQLQWRKWLLTGIMVLGLIWSIGITNANLGLFFKNFSQFTVIFTEMAHVDWSYAYYTIDPMIQTLKMAIIGTLIGSAVAFPYALLVSRNIVTNKIVVGIFRFMLNIVRTIPDLMLAALFVAIVGIGPVAGIFALAIFTFGMVGKLFYEAVETIDPGPLEALKAAGAGRIEMIRFAVLPQIANYFVSFVLYAFEINVRASTVLGYMGAGGIGIYLQQALSMFRYDRVGLIVLVIFAVVLVIDYISGKAREVLL

SEQ ID NO: 3188 - protein, 267 aa, Lactobacillus paracasei
MNRSASLPKAPLQHRWRNWLLTIITLAIIVWSFTGMPSLEIKPNAWVVTKSIAAGLAHPDFSYVWTGDGEDLTSTLLQTLGIAFLGTFISAIISLPFAFWAANTQHKFWLTTRSGKFVLTAIRTFPEIVLALMFIKAVGPGSFAGVLAVGFHSVGMLAKLFSEAIENMNNRAGEAVIAAGGNRLDVTVIASLPQLIPEFVSNTLYRFELAIRSASILGMVGAGGVGTPLIFAIQTRSWSRVGIILYGIIILVTLTDWLSGFLRKRLV

SEQ ID NO: 3189 - protein, 324 aa, Lactobacillus paracasei
MKHKKHLWFLVIGLIMWLSVAVYGYTQTTTAASDLETVTIGYQKADPVDIARQHGELIKKMKAKGYQVVFKEFSDGAALMTALKSGAIDYARVGDTPPVTAKAAGTDIALIAAGATKEYGSGILVGKNSQITNLKQLKGKTIAYQKGTAAQYLIIQALKKAGLSTNDVKLVNMDQSSASVAFAKGSVDAWVTWDPYTATAQVNQGAKLLTNGTGLAKNRDFLISTQNYAKTHTALSKLLTTYINDDMTWANNHHTQLIAMLSKTLKLSDAVIQKMVERRTYAMALVKADSSIVDEENQIANTFYQEGVVTEKVDMKTTLVSGSD

SEQ ID NO: 3190 - protein, 510 aa, Lactobacillus paracasei
MSKLTDLLSQNLINERDYPIVKSVAADTWYTGRDLEEDVAALRDQLNKLKIGAGDQILVALPNAPVHLALNQALWEIGAVVHPIAAATPLPELKAEWSLYHYQAVITLPDVGEKLAEPLMPCSRLRLHTIAALAILTDASQLAYRINAPQKRPKEEDLSLILNTSGTTGKPKRVGLTHRMLLNAAQHDAKSHALSADDIAMVVMPMFHINAQVISVLATRLSGGKLVIAPKFSASKFWPLIADNHVTWVSVVPTIISILLMNENALKAYHPDIHLRFVRSSSFALPEDKLIAFQTYFHTQILEGYGMTETASQSTLNPINAPKIGSAGKPVGTELRLMLADGSLSQQPYVEGEIALRGDHVIHDYLEPHPESFKDDWFLTGDLGYLDEDGYLFVKGRRKEMINRGGEKVAPAKVENILNELDWVAQVAVIGLPDALYGEAVTAVVIRQNVTGDPMKAKAALIDYARQHLAAYECPTDVVFVKAFPVNATGKVIRPKLRKQLMQGGQAYEA

SEQ ID NO: 3191 - protein, 410 aa, Lactobacillus paracasei
MKQANDGERREPKKVKHPYLYEIDLMRLIFIAGVLLNHTTTAFQHQTSSGLISTGFLATHLMIHFTRMGFMFMTGLVLTMVYYRRQRNWPLFYKKRFTTVGVPYVLWNTLLLAGSVLLGVGGFTIANFWPDYLSALLHGDQFYLYYVLVTLQLYLLFPAMLWLFKRMAGHHIRLVVASFGVQMLLVIGIKYGLPHVNTSNWLWWFKAYGVNVFTYQFFFISGGLVSLHYEKVKQWLLAHQVLIGWGALSLSIGTIGLYVFNKQVLNFGHNAAVSPHQPYMLIYDVVMIAFVFVLGQRYAVWHTKRPEHWLARLIGHGAQVSFGVYLCQTIAISLLGSLLSLGGFSNGMLILLLPIGYIFILVVSFTIAWLCYRIAPFGWLIGRPQSLSVSSKGVLNHEQTHRSVVSESNK

SEQ ID NO: 3192 - protein, 233 aa, Lactobacillus paracasei
MTDPIISLRQIKKTYNDKTVLHDIHLNLYPGEFLALVGMSGGGKSTILRLIAGLEPPTAGDIQRQNGLVMRMMFQNDRLLPWLTNLDNVSFRSHDPAIVQQAKSLLTAVGLADKSDGYPVQLSGGQKQRLALARALLAKPQLLLLDEPLGALDALTRQHMQDLILDIFTKQHLSSLLITHDVNEAARMADRIVVVKDGKLAYETSGARGQSPEKIANTAARVLNAIVSEPVTT

SEQ ID NO: 3193 - protein, 271 aa, Lactobacillus paracasei
MQEVTTLTQRPKPRTKRHINWFKVLPWIVPLGLLAGWQAAVSFNWLTSSLLPAPLTVIQDGITLWQSGELPKNIAISLYRATAGFAIGGSIGFVLGLMNGLVRPIRALLDSPIQMLRNIPHLSLIPLLIILIGIGESAKISLVAIGVMFPIYINTYQGITTANPELLEMGHAYGLSKRDLFTRIIFPGALPNILMGVRYALGVMWTTLIVAETISSSSGLGYMATNAQEFMRMDTVLLCILIYALLGKVSDLIAKSLERVFLSWRQGGVEA

SEQ ID NO: 3194 - protein, 259 aa, Lactobacillus paracasei
MTRYARLLLAFFKINFKSLAIYDFDFYFSIAGMMIQNLINVAALRFLYLLVPTIQGYTFTELLTTYAIASTSFAIFRCFFINTLNIADYVRKGKFDGLLVKPVNPLFQLLNESFDEDAWGDLAISVLILTTIAFSSHMPLLIFLLVLLMCCATSLIFLSLTLLGGMVSLLSQGLADLSETVYDFFEFSKYPLSIYNTPLKMILTWFLPLGWVAAIPQSTVIDNGRWYFAILVVGISVAFFTLVYQLWRLFLVKYQSTGT

SEQ ID NO: 3195 - protein, 256 aa, Lactobacillus paracasei
MTLRLMMIRIGLKRSVANRYAFGFYLFGNLISIAVMFFLWQSVLRHRPSAVFAETITYLIFMQLLTAVFPKTSFAIHDDIRTGNIARLLLRPVPLLTHYFWESVGYSFGKLIFIGIPDVILLVVVRQSALAWQTLPLLVMAVMLGYVLYFELEAIIGLFSFYTYSIWGINTFKAAVLLAVSGNVFPVNFYPAAVKTIAQFLPFQYAFGAIGKLLSQQQAADFWPTLFMQSLYIATLFGVYHLQLKIAIQRVVVQGG

SEQ ID NO: 3196 - protein, 256 aa, Lactobacillus paracasei
MILGILRADDGTLATFSGDPTKYRQRNAQRIGIVFGQRSQLRWDLPVYDTFLLNKEIYRISKEDFLARVEHLTSLLDAKDFLQQPVRTLSLGQRMKAEVMASLLHDPELIILDEPTIGLDVVTKNKIVKFLQQVEGKTLLYTSHDLEDVEKICSRILILDHGKLLTDISAQALSKIATPSQIEFSLVDSANLPAALADVGVQTLPNGNFRVAGLSSKEVQDFMRRLIATTELASVTIANKRLEYVISSGLTTGGGQ

SEQ ID NO: 3197 - protein, 235 aa, Lactobacillus paracasei
MNLLPEDQVDAGQAYDGLGNSEIIDTAFENKIWQLSKFAALNQPVSVDIDGKVYAEIRQTKYFIGKIPNDKVKTFSALYLNDKVELWVSIHGGTYKQTSTRSDGSITVKTYRDPVTLKLIAEDQQPAKTLNNNSGEEWSEVGKKMYAAKRKPYCLNCKHQLKGERFCPNCGAKIIYPGEHQNGMPINSWEKVANGADKFSQSVDKTGKFFSDFGCAMTLGCTIPIIIIIILFGLI

SEQ ID NO: 3198 - protein, 35 aa, Lactobacillus paracasei
MLKKIVAILLIVLLAGATTACASDQDDDQNVEQFN

SEQ ID NO: 3199 - protein, 78 aa, Lactobacillus paracasei
VLAGYKKPPAAVVEEQLDYVEEKKLQKDNSDKAKSLPDKKSGLFFDRNVQNRSIKLVHKDPVPPKPKMPDSASSKNKD

SEQ ID NO: 3200 - protein, 206 aa, Lactobacillus paracasei
MEMQQLILAGILGFLTFIWLDKLDAIHFDLPARQTDRTIALILISMLNAAGGLAIYQQIWGTVGHSFWSEFGLFVVTLILSVPLAFTYYFLIKLGNSCLIWIQEQFHVATVLPGSPLVEALKNKEYSEEKLVIIFDFNDKLISSGYANRLPGSDDPTQQIGLMTYGQDWTVKLAQKKYDESPQNSEQIIDFDRQLKIYIIGINPYS

SEQ ID NO: 3201 - protein, 86 aa, Lactobacillus paracasei
MKPITVISYKFGEKTWKNFEGEPIKKYEHSVLLDISDTEVFTDKEKTELNDKIVVPFSRIREKRFIKDIPLSNVNEALNKKKAGRK

SEQ ID NO: 3202 - protein, 389 aa, Lactobacillus paracasei
MATFRKRGKYWEYRVKYTDSAGKQLVASHGGYRLKSSAQDAAEAVEDDLKRGGDPSKQDVLLLDYWDQWAEAYRINGKSINTVYRYKLFRKHLKSRFDGRKLNSIRPIEWQKFINDFAAGKDRKEKTTRKRPRERSKDIVTKMNSYVRGMVKAAINERILFSDFTFGTKTSGVCSSGKVKVLDSRDFAKVKAIAIERASYRNIGALAVYIGSMTGMRISEVLALTWPDIDTKLCVIHVTRSWDHLYGTGFKPTKTDSSVRDIEISPSVIELLNKIHQEQAASYLRTGYRDEDQMIMRDPRHNVITDSACNKALHVIQNKAGIPEDKQITFHGLRHSHVSYLISKGVDIYYISKRLGHSDVTITMKVYGHLLDSQRKQEAHKAVLFMDQL

SEQ ID NO: 3203 - protein, 181 aa, Lactobacillus paracasei
MSQIILLIAALFFFTRHVFRFERISRLTLVIIPAYTLVTGILLVSHKWPTFLALGVTILIGAILGWFQTTGLKIHVSQKHDVNGLPIIEIRHGWQYLVGWIVIFIYGLGFALLSGWHVDVLSELSEEIEKDLFVWKNFSSSTWNIMIMSATASLVYTWRLLQKEPKIQAVIFKGTHLDHHD

SEQ ID NO: 3204 - protein, 124 aa, Lactobacillus paracasei
MAVDINGLPQAILVTRANVSDRSGALAMFSLASQTLELVQHVMVDGGYTGNDFADQVKLILNAKTTVAKRNELHMFTVLPQRWIVERSWRWLDKCRRLWKNCERALNSSLQMVVLAFLKIVLKR

SEQ ID NO: 3205 - protein, 106 aa, Lactobacillus paracasei
MPDYPSNISRAQFALIQPDLENFRKHTRPRRYDLYDVFNAILYSLTTGCQWRELPHDFPEWHTVYRYYDMWRDKPDPTADSLLERLLKKLLLPIALHRADRPERRL

SEQ ID NO: 3206 - protein, 193 aa, Lactobacillus paracasei
MRLKHEPNKDPRTLMELCGYDPDKFEMVLGDYKVYEQHSTEDGTVPQYSIHIRVKPKQGLSINEMAEAFNDKIIPVNYGMKKSGDRNLVIPLPDLHFGWTTFADLKDMVSQLREIIMDGYNEIVIEQLGDLFHSDQIHVTQTVRGTQLDHANMRQAFHDAVKLFDQIIPLAIEYSNHVSMTAIWQPTGAVHTC

SEQ ID NO: 3207 - protein, 92 aa, Lactobacillus paracasei
MLAHGDVAKNKLTGLFPFEYKKIFNMAKTYELHSGHYHSERFKDDRGIMWRQLGTAKPNDPYEIKNGFTTGKHLLYAFVYDDTRLRCTYELN

SEQ ID NO: 3208 - protein, 111 aa, Lactobacillus paracasei
MNSTNAMKRVGYGYVSHTEQAIIEKLSREEKHMQAIIYTKPHCQKCRRTVFKLSRVMPVQTITADADDYERFRKLGYRSMPVVTIYEADGTHDEWCDLRVDKIKQYTEGNI

SEQ ID NO: 3209 - protein, 83 aa, Lactobacillus paracasei
MVDGGYTGNDFADQVKLILNAKTTVAKRNELHMFTVLPQRWIVERSWSWQDKCRRLWKNCERALNSSLQMVVLAFLKIVLKRY

SEQ ID NO: 3210 - protein, 499 aa, Lactobacillus paracasei
VLAKDNGQQPEMNDQMIARREKMEALREAGIDPFGHRFDRTHTAAKVREEFGEDDKETLLDEKPEVTIAGRMMSKRGKGKVGFADIRDRSGKMQIYVRKDVVGDDNYMIFKKADLGDILGISGEVMKTDSGELTVKANHVTHLAKALRPLPDKWHGLTDVEQKYRKRYLDLISNEDSFDRFVKRTKIVSAVREYLDNNGFLEVETPVLHNQAGGANARPFVTHHNALDIDLYLRIALELHLKRLIVGGMERVYEIGRVFRNEGIDTKHNPEFTELETYAAYWDLTDVMTETEGIFRFAAHKVLDTGKLTYQGMAIDLDAPFARINMLDAIKDKTGVDFWPEMSVDDARKLADEHDVHYEPYWKVGHIISAFFDQFVEETLIQPTFITGHPIEVSPLAKKNPKDPRFVERFELFVGGGEYANAFTELNDPIDQRQRFEAQAAEKSAGNDEAQGIDDDYVEALEYGMPPTGGLGIGIDRLVMLLTDAPSIRDVLLFPTLRP

SEQ ID NO: 3211 - protein, 333 aa, Lactobacillus paracasei
MWHIADVEIPNRLVVAPMAGVTNAAFRVTAKEFGAGLVVCEMISDRGIMYKNEKTLNMLFVDPREHPISIQIFGGTKETLVNAAKFVDQNTAADIIDINMGCPVPKVTKTDAGAHWLLDPEKVYEMVAAVTDAVSKPVTVKMRTGWDEKHVYAVQNALAAERGGAAALAMHGRTRKQLYSGHADWNILKEVKQHLTIPFMGNGDVRTPQDAKRMLDEVGADAVMVGRAALGNPWVLKQMSAYLEDGELIPEPTPCEKIATAKLQLQRLVDLHGEHQAVREFRMQAAYYLKGIPRSAKTKAAVNMVDTQAEVDHIFDDFVEQTEERARERQAKA

SEQ ID NO: 3212 - protein, 294 aa, Lactobacillus paracasei
MSDYIASALSRDEHFRIFAADATQTVREAQRRHDTWSASSAALGRTLVATALLAASGLKNADDMLTVRIKGDGPVGALVTDGTNVGTVRGYVEEPHVNLPLNLVGKIDVARAVGKRGLLAVTKDIGVGDPFTGQVPLVSGELAEDFTYYLAKSEQIPAAVGLSVFVNADNSIQVAGGFMLQALPGANDAELSKLEANVKTLPLVSELLKSGLTPEQIIQRIAGDEPVQFLDAQPLKFACNCSKEHFGDIMATLPHAQLQEMIDQDGGAETTCKFCGNQYHYSVADLEALMARHE

SEQ ID NO: 3213 - protein, 299 aa, Lactobacillus paracasei
MKFTKMTSALVAGATLLAGLAIAAPAATQAATVEGNAGVNGGQALPQDAKTTAGISFSQLPPTGNTGYLRLQMVPKILDFGNHEQFFSDYPVFTADGQNAGRADNTRYPSYKSGNTNLTAVLNTDDTALANVKGKAWTTVVDKQTTRTDAENAEDKTGQTDSKAGDWTLSVKADGPLSLKDDNGADTGKTIDNATLTMLNTAYGQTGNVYGLTNESQDDGFTPVGALVPLTDISKTTTMTLSGTDTNHQVAHAATGEGEGANVFGWDKTNIKLVLPKTSVVNNGTYETTLTWTLATGLN

SEQ ID NO: 3214 - protein, 715 aa, Lactobacillus paracasei
MKKKQNGLFSSTLTYIIIFVLLVTGFAYYMRDNGTTSSQEIETSTFLSELKKDNVKSYSLQPSGGVYKVSGEYKKAQKSSSSNNSLSLFGSQSTKVTKFSTYIPTNDATLSQIQKATSANNVKTDTQEESQSGVWFSLLITVVPIVIMMVFFYMMMNQAGQGGGSGRVMSFGKSRAKQADKNANKVRFSDVAGAEEEKQELVEVVEFLKDPRKFSALGARIPAGVLLEGPPGTGKTLLAKAVAGEAGVPFFSISGSDFVEMFVGVGASRVRDLFDQAKKAAPSIIFIDEIDAVGRQRGAGMGGGHDEREQTLNQLLVEMDGFTGNEGVIVIAATNRSDVLDPALLRPGRFDRKILVGRPDVKGREAILKVHAKNKPLAPSVDLKEVARQTPGFVGADLENLLNEAALVAARRSKKAIDASDVDEAEDRVIAGPAKRDRVINPKERNMVAFHEAGHAIVGLVLSDSRTVRKVTIIPRGRAGGYAIMLPKDDQFLLTKKELTEQIVGLLGGRTAEEIIFGVESTGASNDFEQATQIARSMVTQYGMSDRLGTVQLETEGQPFLGAQYGQTPPYSETTATAIDDEIRRIIDDAHKQAHEIIEAHREQHKLIAEALLKYETLNEKEILSLFNDGKMPARDQDEFPSEKAATFEQSKAALEHKDKEKQADEEASGKTDSPQSGDQQASDDDTDSDEVEKPDDTSTDNSSSNNDDQQGPQA

SEQ ID NO: 3215 - protein, 181 aa, Lactobacillus paracasei
MSSDILKVLYSQDDIHAITARLGAELKHDYAGKNPLVVCILKGAIMFMTDLVREIDDYMELDFMDVSSYGDATESSGEVKIIKDLDASVKDRDILIVEDIVDTGRTLKYLTDIFKTRHAKSVRICALMDKPEGRVVDVHADYVGTTVPNEFVVGYGLDYAERYRNLPYIGVLKPEIYAAKS

SEQ ID NO: 3216 - protein, 436 aa, Lactobacillus paracasei
MSPKLFQRFGFAPHTRVLVAVSGGVDSMVLLNLAVKAADLDVVVATFDHRLRPESQQEQAFVVAAAQQLQVPVVTGQWRRSDGQPTSEAAARQARYAFLAATAAEQHAEVVMTAHHADDQLETILFRLARSGDPAALIGIRADRTWHGRRLVRPLLPYSKAMIRSYADQHNVRFCEDSSNADPHYARNQLRHQVIPAFKKQNTQLLAHIQTFTMEQTGLLALAEAQLAEWLQRLQVDDATFNWRVASPQPEAVQRLLLKKILQQWQPNVDRQLLSPVLASLSGTKERRFDLGGGISIAVQSEQIVRLTRQAPVKPVTFTKLDQQHRTTRGIFSLQTSVAADKGTPVRVKLPITLRTRQAGDVVQLPNGVIQKLRRFLINTKIPAYQRDQLLVLARGHQVFWVEGQPLERLSAIDQTDILHVVLVQSPDVDKSEDKS

SEQ ID NO: 3217 - protein, 161 aa, Lactobacillus paracasei
MAVEVGTKVTGKVTGITKFGAFVELGDGKTGLVHISEVSDAYVKDIHDVLHVGEPVTVKVLSIQDGKIGLSIRKAVDKPQQSEHENSHRESHHTPSARPGGNRYQGGARSGGGNHFGHKAQPSKDDFDAMMSGYLKESEDRLSVLRRNTEGKRGGRGGRRS

SEQ ID NO: 3218 - protein, 143 aa, Lactobacillus paracasei
MAGEKRRCGQMAKNNISQLNNAYTREHEQKHKRTPNPRAHAVHMKRIRNLLIVIVAILGFGGLSLVRTQMALGETNHAVQKAKGSLTKLKANKSALKVQVDQLHNDDYTAKLIREKYLYSKQGEIIFNLPDKVNKVPDLNVNQ

SEQ ID NO: 3219 - protein, 87 aa, Lactobacillus paracasei
MRLDKFLKVSRIIKRRTVAKEIADKGRIMINDKPAKSSSDVRVGDTLVINFGNKTLTVRADDLVETTKKNDAAGMYTVLKEDYKETF

SEQ ID NO: 3220 - protein, 525 aa, Lactobacillus paracasei
MHNQEMKHLMRGAWILSLSSLIAKILSAVYRVPFQNMVGDTGFYAYQQIYPIYGLGMTFALSGFPVYISKLVAEADSDEAKLTVAHQSRVILTWISWALFLGLQIFGGVIAQAMADPELLPLIQTVAFMFLTMPLLATGRGYFQGTFDMAKTATSQVVEQVVRVAVILLAAWWFLQYHWSVYQMGAVAMTGAFFGGAAAALTLWRPYRQVFGQQNFRFPGMQAYVRLISRFVREGGAITLYAALLILLQLIDSFTVTKGLTASGIAMVTAKSLKGVYDRAQPLVQLGLVVAASLSTTLLPSLTQARQARQRRQFIRSGAELVHFNLAFALAATAGLIVLMPAIDLLLFGDTAGTFALQLYAVAIVVVAMINAYNAILQSLDQYAGISVALLLGILLKAVINQPLVVKFGTAGASGATILSLGLILCLIYYAVPETIKGASAIRLFVPKLIIVTGIMAAAVYAAVGWIPLSSRMVAAGVTVVGVLLGVIIFLAAGTWLKMLTLREMLDLPGGKLYMKFLQRIKRGN

SEQ ID NO: 3221 - protein, 1174 aa, Lactobacillus paracasei
MNLIDMVQADPALSALWPKLKTGRHLVTGLSGSAKTVFFGALLQQRPQQILIVENNRFHADELAADLSSLLGDAVVYDFPVEDVLAAEVAVSSPETRNDRINALTFIQSGKPGIIVTSLAGYKRLLPSPADWAASELAIDMTSELDPQTVAKQLVAMGYRRDSLVSAPGQFAIRGGIIDVYPLNQDDPIRIELFDTEIDSIRSFDIATQRSLQKLQQITIAPATDMVATDQVLAAAGERITKQANAYKAKVKNAAAKQAVTDGLLTTGQQLSAHERPENLALYAAELYPEQQRISDYLQPDALVAFDDYSRLLDSDTTLVQDTAEWYSQLQEEGRLLPSTPNLTIQELAQQDKRPRLYLSLFQKGMGQLRLDSLTNIPSRNVQQFFSQMPLLKTETDRWVKQQQTVVFLITDKNRLEKLSETLSDFEISNVMTAPTKLLPSQVQLTEGSLKNGFELPDLKLVVVTEHELFNARQRRHARHQTLANTERLRSYNELKPGDYVVHVNHGIGQYTGMETLEVDGVHRDYITIVYRNNDKLFIPVDQLNLVQKYVSADGKTPSVNKLGGAEWQKTKRKVAARIEDIADELIDLYAKREAEKGFAFGPDDDLQHKFEAEFPYPETPDQLRSAKEIKHDMEKPKPMDRLLVGDVGFGKTEVALRAAFKAIDYGKQAAILVPTTILAQQHFDTMKERFADFPIKVGLLSRFQTAHQNKETIKGLKNGTIDIVVGTHRLLSKDVAFRDLGLLVIDEEQRFGVKHKERIKQLKSNVDVLTLTATPIPRTLNMSMLGVRDLSVIETPPTNRYPIQTFVMEQNPGVIREAIEREMERGGQVFYLHNRVEDMERTVSQLEELVPDASVGYAHGQMTETQLENVIYDFLHGAYDVLVTTTIIETGVDMPNANTLIIENADHYGLSQLYQLRGRIGRSSRVAYAYFMYQPMKVLNEVAEKRLQAIKDFTELGSGFKIAMRDLSIRGAGNLLGKQQHGFIDSVGYDLYTQMLQEAVNKRRGIKSAEKTDAEIDLGLEAYLPTDYVADSRQKIELYKRIREADSDEAETEISEDLIDRFGDYPQPVTNLLAIAHLKRFADLAWVNHVTKAGQKLTVVLSPQATAKAQGEPIFKALSATTLKAQVAITDGKLTVTLALPKDMKTATWLDQLTGFLQGLLTVVNPQPEKKSA

SEQ ID NO: 3222 - protein, 185 aa, Lactobacillus paracasei
MKMIVGLGNPGQKYAGSKHNMGFMVVDGLAKRLNLTIDKLEFDAATATTRLNGEKIFLVKPQTFMNASGRAVRELMMFYQIQLDEIFVVQDDMDLTLGKLRLRKRGSAGGHNGIKDIISATGSDEFCRLKIGIQHPQRQRVVDWVLTPFSKTDQPLIDDAIEKADDALEDWLNGMPFDQLMNKFN

SEQ ID NO: 3223 - protein, 326 aa, Lactobacillus paracasei
VASITDKDHQKVILVGDGAVGSSYAYAMVLQGIAQEIGIVDIFKDKTKGDAIDLSNALPFTSPKKIYSAEYSDAKDADLVVITAGAPQKPGETRLDLVNKNLKILKSIVDPIVDSGFNGIFLVAANPVDILTYATWKLSGFPKNRVVGSGTSLDTARFRQSIAEMVNVDARSVHAYIMGEHGDTEFPVWSHANIGGVTIAEWVKAHPEIKEDKLVKMFEDVRDAAYEIIKLKGATFYGIATALARISKAILNDENAVLPLSVYMDGQYGLNDIYIGTPAVINRNGIQNILEIPLTDHEEESMQKSASQLKKVLTDAFAKNDIETRQ

SEQ ID NO: 3224 - protein, 456 aa, Lactobacillus paracasei
VKKNKRWLLVVGVLVVLMGGFYIIQSMHYRDHFLPNTEILGVDVSGQTVNAANKKLTDQFDQRQYTFVEKNKKILKVKGDALGLSQDFKKGLTQILNKQNPWQWTTSVFAGQKTNAQEDPTINTAALKQFATSTADKLNQNRQEPVNAKLVTSGDQFKIQKEVNGDQIDADKLATTVTSALDNHRQVIELTDAYKKPTVKASDRDLQTTERDMNKLASTKVSLQIQSTTVTVPQATVLSWVTNDNGKATVSSQAITNYVTALSQQYSTIHKTRQFNSQQQGTVSVPAGTYGWSINISATSAMILASVKAGQDLNKEVSHSGSGYTTTGDIGNTYVEVSKEKQHEWYIKDGKVVMDSDIVTGKPGQDTPSGVFYVWSKQRNATLRGKNDDGSSYASPVSYWMPIDYTGVGLHDSPWQPKYGGDWYKEHGSHGCVNNPPDFMAKLYAAVDEGTPVIVY

SEQ ID NO: 3225 - protein, 221 aa, Lactobacillus paracasei
MLIKSLVLKKEFLTTVKETVTLEDALKILEDSGFRCVPILDESGTIFRGNIYKMHIYRHKSQGGDMSLPVTYLLKNATKTIPVNAPFFKVFFNIKDLPYIAVLDENANFYGILTHAKLLGMLSEAWNVDVGSYVLTVMSTGERGDLAKMSKILAKYVSISGCITLDAKRDEFVRRTLFTLPAGTDENTLNEIVSRLEKKSFRVVEIDDLQSGQPIRIDEDL

SEQ ID NO: 3226 - protein, 234 aa, Lactobacillus paracasei
VKRITRFFDQIAASIHFFKTHRLKRNYRRALLFFAILLPVCVVAIIAGQRLHQPTPSSSKAAIALSTTKKKQQRHKATSHKTKVHTAPKNIDWTAPSEKQAYPDLTQHPNITLDVNLKKQRVFIKEGDKTLYTMYASTGIDDSTPRGDFAIQDERGYEFFNPNEQMGAHYYTSFYLHGTYLFHTVPTDVGGQYIKNEAAKLGKEPGSHGCVRLSIADAKWIFEHVPTGTPVKIH

SEQ ID NO: 3227 - protein, 492 aa, Lactobacillus paracasei
NADPHSMALLCHAINMADPKGFLKYPRQDDPMRPIMQRIKDFNVMELDLDMAERRKQAARCMNCGIPFCHHGVFFGGGRAVSGCPNDNLIPEWNDLVYRDQDKRAFERLSRSNMLPDMTGRVCPAPCEVSCVQALNGAGITIRNNEKFIIEQAFKHGWVVDSGKPLHRTGKKIAVVGSGPAGIAAAWRLNQLGHAVTLFERDDRFGGFLMYGIPNMKLPKDVVQRRIDTLTKVGIELVANTEVGKDITADELKKTFDRVVICTGAREARDLKVPGRELSGIMQATDFLKAATQTVLKDGPAANDQLKGKHVLVLGGGDTGNDCIGTAIRQGCADITQLEITPALPAERTPQNQWPEWPMVLKTGYGQKEAKALFGDITAYASTVTAFFGKDGQVKEAEISQVDHFKPVAGTEKKIKADLVVLAMGFTGAEQWLFDQFGITAKNDNFTTNDTQIYVAGDCRRGPSLVIWGIHEGRMCAEKIDASLQTLASEKI

SEQ ID NO: 3228 - protein, 205 aa, Lactobacillus paracasei
LVGEANDYVGKGLSGGRLIVAAPPQARELYTHSPIVGNVACFGATGGEAYFNGRAGERFCVRNSGANVVVEGVGNNGCEYMTGGVAVILGRTGRNFAAGMTGGIAYVYDWTHDFAKHCSQDLVDLYHLDEAGDDSILIELLKKHVQYTHSETAQMILDHWEKEKGTFVKVYPRDYHRMRDLIDAYTKPGLSEEQVIEKAFDEAMK

SEQ ID NO: 3229 - protein, 174 aa, Lactobacillus paracasei
MDNRLQLRQQNKKHAHRGLKIFSIIMGVLILLIIAGVFFFPQLNNTVRNVTGNDTPVDSAVKARLVSGITAQKTGDATTDAAIQRAADTLKATKMSTIMAAAKDQDQAASLLQKASGVNHSQAEMAAAALFQESSVTPIRQAIASGDYYQAYQDAKTLQQQGGTSALTSFLSGQ

SEQ ID NO: 3230 - protein, 170 aa, Lactobacillus paracasei
LAQVKLTIHYVDETGKSLGPENHLTNAVGQRFRLTAPTLIGYNFQKAVLPDGSEVGDPTVVGVMTKDEQQLIFIYSATASLTSQPTPATLVIKYVDEHQQDLRDVQVLHTKTGHQFELTAPFFPGYQYHHALLPGGMVMSDQTVSGRLIRAHNELIFSYRVHSQNHPNKI

SEQ ID NO: 3231 - protein, 212 aa, Lactobacillus paracasei
MKIAIIGATGHAGSAIFKEALKRGHEVTGYVRHPDKSVGILPPDADLIQQDAFTLTREQLTGYDAVIDAFATTVEQAYLHIDLADHLIHELRNTDKPRVIFILGAGSLKNGDQTLYDTLKKDPHAAAFINTPLNQFRELQLLRWTDNVNWLGISPSANFQPGPATAYVRGKDELLKDDSGKSVLNSDTLAVALLDELENPTIKQARFTARNA

SEQ ID NO: 3232 - protein, 250 aa, Lactobacillus paracasei
MHRQETKSKKGLIWGIAILAVVLLGGGIWFGVHQQAQAKAAAASASSSKAAVRSRASAKKMREATQASEKAKDPVYKDFAADGLSFNQVQAAKQLDVTAVGDSVMLGSEYLYKELFPKIYFDAGVSRQIYEAPDLFKSLAASGKLADTVIIGLGSNGTFTDAEFASIMNTLGSKRQVYWINVHADTTWTDEVNRDLVSMSHRYQNLHIVDWHKASEGHDDWFVADKTHPTTEGQPHYVATVAKAVLAKVK

SEQ ID NO: 3233 - protein, 67 aa, Lactobacillus paracasei
MQALIDVRESGAYLLMSVGGSGALRRHLAEMGLVVGKKVTVVQPASKLSGMVIFFQGQRLAISDEIA

SEQ ID NO: 3234 - protein, 87 aa, Lactobacillus paracasei
MDADTPAIALADLPLRQAGLIRTIKGDPPLRHRLMDMGLTKGTLVKIHQIAPLGDPIELAVRGYKLSIRKQDAAHVLVTEVTSDGDT

SEQ ID NO: 3235 - protein, 703 aa, Lactobacillus paracasei
MAIRETLALVGNPNSGKTTLFNALTGAKQHIGNWPGVTVERKSGRLKADNALVIQDLPGTYSLSPYSSEEIVTRDFLLNDQPDLVLNVVDATNLERNLYLTLQVMETGRPLIVALNMMDVLVKTGHRTINLKKLSYALQVPVIATTATKPAALQELVQTIQAPLPKPYAFPEYDARLESALTMLEDVIDQKVPADRLRWYAIKVFEKDPQVVKQLAFSSDEQHQMNEILRTAEHVFDDTTDSIIVNARYDFIARVIAMCVVDKDDFVMLMSDKIDRIVTDRYLALPIFVLVMWAVYYLSIQTIGTIGSDYLNDTVFGGWLPSVVGGTLKSWAVAPWLSGLIVDGLIGGIGSVLGFLPQIMMLFLCLGILEDCGYMARIAFVMDRLFHRFNLSGKSFIPILIATGCGVPGIMATRTIESEKDRRMSIMLTTFMPCSAKLTVIALVSGTFFPSNSWVAPSAYFMGIIAVICSGIFLKKTALFAGPPAPFVMELPAYHLPRLTNLYRSVMSRARAFVQKAGTIIFLSCVLLWFLSNFNFGLQMVDENDSMLRALGTIIAPVFAPLGFGDWHATVATLAGLIAKENCVGTLHISFGAGSASGFGQALRATYPAMAGYAFLVFNLLCAPCFAAIGTMYKEFGDARWTWRAVGYQTGVAYLLTMLIYQGSLVVSGQASVMSIGLVLVAILLIVYGLLIKRPVPAIAASF

SEQ ID NO: 3236 - protein, 55 aa, Lactobacillus paracasei
MATWIIGGIVVLIIAVVAYRTFFKKNKAGCSQCEEVGCPLIDHAKMVQANNRRKA

SEQ ID NO: 3237 - protein, 555 aa, Lactobacillus paracasei
MTSKQSFSSSDITSQSGYFSALKATVETAFYGENVKQVTTIAQAYALAKTAPGVIITDLPIKHTAELGLPPDAKVLVANDGRVVGRTAAARQIIGQPDVDETKLAAIDREAVFLGSRKTFLRGDVTVGLSSDFAIKAHLMLPEAYANNLYTYLLNFQIDTPQRNAEYEQSRPLPEDDIYLYADPDWHDPAYPNGLAVFDPTHNAAIVLGLRYFGELKKGTLTLAWATAHRNGFVACHGGMKQYTRQDGDFTMAAFGLSGSGKSTITLASHGDQYPVKVLHDDAFVIDRQTGATTALEPSYFDKTQDYPLSDPGIQYFLTVQNVGVTLDAAGKKTLVTQDIRNGNGRTVKSRYVTPNRVDHLTESIDAIFWIMKDDTLPPVVKLEDPDLAAAFGVTLATKRSTAENVIGDVDRDHLVIEPFANPFRSYPLGEDYQDFHQLFEQRQTACYILNTGSYNGQNVKPADTLGAIAKIVDETAAFKPFGLLPKMRYLPLSGFNVDFGDNDYRARLRQRLEDRLAFIATKDVDHDGYDRLPIDASRALEDVIAALDQQAAAM

SEQ ID NO: 3238 - protein, 105 aa, Lactobacillus paracasei
MAIHFVIYEKPNCESCRLTKRWLAEHGQHFRTTNHRGESNLVDINANDPLKRAWSHQKIVKFREAGYDRFPVVRVRDDATGDVLATWGGFRPEALASWTAINQLG

SEQ ID NO: 3239 - protein, 378 aa, Lactobacillus paracasei
MTRPSAVNIHRTNPPDWFKQADFGIIIHWGPYSVPAYAPVNIPDYGTLIKTKSLGYLFEHQPYAEWYGNSMLLPNSPVAAYHRTHYGNTSYADFAKTFKQTAQNVDVQAWAAAFANAGAKYVVIVTKHHDGFVMFDPHTNNPYEPDYHLNFDFVGELAQAVRAHGMRFGTYYSSLLDWTFPHLPIKDYGSFLLGNDKSQTYKDYVWHQWHELIDRYHPDVLWSDIGYPDDHRLETLFKYYYQQVPEGLVNDRWQQFPDWMRTSWIRPIFNLVAAQVIKRDQHHSDDLSEVKYYDYRTLEYRTDWPQTNRYFEMTRGMDKSFGYNRLSRPEDYITADDIKQLIAELRSKRGRLLLNVGPDMNGQIPSAQLSILQQLSNR

SEQ ID NO: 3240 - protein, 382 aa, Lactobacillus paracasei
VLIGSLLAGILGMMLFHIPQNFSNFGKEVYLYIVYFLFMFAATIIVTVPLTSTMSADQEVRAKLISWPRITSNIVGVVFAFFMAIATYLGTKRNPNIPLTVDLIVIPFLILSLIGIVMVKEGPVTEEAKPPRLRDIGQMIKINHPFRINLYFTFVGGFVWALLTATSLYYIKYAFGVKNLGTQSMYFGLLTLITLVAGTLISQKAMQYISAIRGVQWCYLAMAPFLVIMFIINEIHVIDNPWVFYLLIGIVMTIAGAQFVPANLIIMETMDYNRLKLNAGMEATINAVNMFLQKLQSGLATIGVGAALLIVGYNAQTLEKATHVPDNLLQSLGVVLFAIPAVFSFLAYLIARHYPLQGAARDEMYAALAAKRVTNTQSSKSK

SEQ ID NO: 3241 - protein, 67 aa, Lactobacillus paracasei
MKGYPKQYPLDRQTLFGINTMGLMSTTAYYLYTAVLMMFITDYSGIYSGVPGKAAAVATTLLFVGRL

SEQ ID NO: 3242 - protein, 140 aa, Lactobacillus paracasei
MHTRCQEPNYVEVVNQNLERLLVFETVFKEYVHTCKNIEKGNCYASESLDHLRLYFTKNVMKFCTFVDSVDAEAAPCNYAAFHKVLVNGLRGIRGGVLNMLQAIGTDKVDHDRFAAGLAEQQAARAEIDTAFSKILDPIF

SEQ ID NO: 3243 - protein, 124 aa, Lactobacillus paracasei
MAVWRMMFARPQFKHRQIKRMVDDLNREGNFGGMPIHRITLTRQTRELIYVDLEFQLTTGLTQPLFEQMAKYILVAVAGLAHAPQPIYLAAMANPFAKLNISYYIYPDHSLDLIYWQPLLRKPT

SEQ ID NO: 3244 - protein, 772 aa, Lactobacillus paracasei
LLDLKHIKKYYQTGDYTTKALDDVSVQFREQEFVAILGPSGSGKTTLLNVIGGLDRYDSGDLLLHGRSTKNFKEADWDAYRNNSVGFIFQSYNLIMHLSILENVELGLTLSGVSAADRRKKAEAALTKVGLKAHMGKQPNQLSGGQMQRVAIARAIVSEPSILLADEPTGALDTETSEEIMRLIADLSRERLVIMVTHNPQLAHEYAERTIEFKDGKILSDSRPFKDEEKTASFDLHRTKMSYFTALKLSFTNIMTKKGRTFLTAFASSIGIIGIAVVLALSSGFQKQIDNTQAETLAQFPITISTNATSLTAGAADNTKTSTFKTTSTVVAKQSASDKAQHTNKLNQKYIDYVNGISKKLTDNIGYTYGTGMNLLRDVNGTIKPVQFSTAKPSSNQTQRGLASASSSVYPVDREGGTSYLKKNYEVVAGSYPKHDGDVILIVDRDNSTNINALKNLGFDVKDGQKVKFNQIVGTKIKAISNNAYYQNVAGNVYVPTKDYANAYKQNDNRELTVAGVLRTRSKTSDGLLSQGFAYSDRLTKDLVALNKDSDVVKAQRASDVNIFTNQSVDKATKDQLITALGGSETPTQITIYPTSFKDKDKILSYLDKFNRGKKKADQVVYTDLAGTISSMTGGIMSAITIVLVAFAGISLVTSMIMIAILTYTSVLERTKEIGVLKALGARRKDITRVFDAETIILGVSSGILGIIIAWLLTFPINAILYSMTELPNVAQLNPIHAVILILISTILTVLGGHIPARMAANKDAAIALRAD

SEQ ID NO: 3245 - protein, 479 aa, Lactobacillus paracasei
MGHPRGLLTLSMTEFWERFSYYGMRAILIYYMYYAVEKGGLGFDQPTALSIMSIYGSLVYLSATIGGFISDRLLGSRRTVFWGGVLIMLGHIVLSLPIGATGLFGSIVLIVLGTGLLKPNVSEMVGSLYPEDDLRRDSGFSIFVMGINFGSLIAPIFVPWMADKVNFHAGFSLAAIGMFVGLIFYVIDGRKYINPADNTAPDPLKPEDVRPLVIRVVVAIAAVGVILLAMAGFNALTIANVISLITLIAIGLPIWYFVLMIRSKKVTKTERSRVIAYIPLFLAAMIFWAIEEQGSVVLALFAAQQTKLDFGFFKILPGNFQTLNPLFILLYGPLFAWLWMKLGKRQPTSPKKFYLGLIFAGASYLWMVIPVMLFGSSAKVSPLWLVMSWAIVEIGEMLISPVGLSVTTKLAPKAYSSQMMSMWFLADASAQAVNAQIVRFYTPNHEVAYFAIVGLVSVGFAVVLAFFTPRIEKLMQGVN

SEQ ID NO: 3246 - protein, 275 aa, Lactobacillus paracasei
MVKIAFSVDNHFDVNRVDGFEMLKKQAAYLVEHDYQIYVNAGDTYNDFTKSLAYFRALQAEVGSAVTIRFLAGNHDMVNGATYDEIQSAVDPLYLHEKILPVPGTNAVIIGNNGWYDYSLGQLGNMKTDAEYAQWKRAFWIDSAIDAPVTDAARMQRVLTTTKAALQANQTHQMIYVTHFVPIREAMEYTVDRPPWQMATALMGSAKLGDLLTGRVSAVVFGHEHFRDAPKLLSGTTYYHQPLGYGLKRLFEWQSQDWWTEWRQTLVTLTVPTLS

SEQ ID NO: 3247 - protein, 36 aa, Lactobacillus paracasei
MAADACDINRANVVLNAITFKNTKNAVKNQTNAVDF

SEQ ID NO: 3248 - protein, 658 aa, Lactobacillus paracasei
MAIKATDLFKLVSLSYPSATDDGYFVQENRISEADNTYYQRICFVNHRGGTIAYGFDQKHDRHPLLSPDQQWLAFLSQASDKTTQVFLQAVNGGTAKQFSAEKEGVSYFGWQADSQALFIQTTVGAKPKKTDKQWPQPVTVSRVPYKLNGVGLLPEHVAYELRVQRLRQKTSRLVMGREHEFEVGAISPDGQTLAFTAERLPDDPNDFSQATYLLNLADQQVTMVNDQLPQAALSPEAFSADGKQLLLVGSDNHLPNVSQSHLWHYDLATKTLQDVADDIDFDIPGHVNGDFQQDLSEKVADFATADYYLTIGFDHGKTSLYAGGPDEQLTPLIGGRRHVTDYALTPDHHGVVFTESTMTVPSRLSYFDLATEEEHVIYDPNRRVTRDMGLVTPQTFNFQRDGFEIEGWYFPPQQATASHPAILYVHGGPAVGYGYTFFHEMQFLAAQGYGVICPNPRGGLGYGEAFTAAVIKHYGQGDYEDCMASVDEALKLDTTIDPDRLYVAGGSYGGFMTNWIVTHTHRFKAAVTQRSIANWLSMYGTSDIGYFFTPWELEGKWTGDLSDVKSLWDFSPLAHIDFAQTPTLVMHSENDQRCPIGQGEEFYIGLKLHGVDTKFMRFPNATHELSRSGLPNLRLARLAALVDWFKTHSATEESHQA

SEQ ID NO: 3249 - protein, 265 aa, Lactobacillus paracasei
MTIGFIGAGNMARAIITGLLAKNAVTPEEIVLHGGQPIHYEPYAAKIGAKAVASNQAVADTADIVFLAVAPKLGVPILKTIGPTLKQRQVPIVSMLTGVLLATLEDALGSQDQPILRIMPNVNVAINAGMTAYAANDSVAGQLDGLLDLLNVLGKTMALPEDQFSTFVALAGSSPAFVYLFIDSLSRAGVKYGLTKKQATAIAAQAVMGSAQNVLASEQSPFDLIDQVSSPGGTTVAGLLAMEQAGLMSAVIKGVDATIAKDRQG

SEQ ID NO: 3250 - protein, 381 aa, Lactobacillus paracasei
VTVTVLKHATIYTGLERIDDGYVRFDDKILAVGDMFDYRAQSGEQTFDLQGKTLIPGFIDVHAHGGYGFDAMDGDADQIDEMATKMMTHEGVTTLFATTMTQSTENIDKAMRGVKQAAERNHIIQGVHLEGPFISKVFKGAQPEEYIKNPNVDLVKQWQELSGGLVKLITYAPEDEGSQAFEDYLLAHNIVPSVGHSNATREQMLHSKATHVTHLYNAQRGLRHREPGVTGHAMLEDNMYCELICDGFHIVPDMLRLAFDQKGPERIELVTDSMRSKGMPEGKSELGGQTVYVKDKQARLKDGTLAGSVLMYKDAFKNAMSFMDASLFDAVEMSSVNQAREFNLTSKGTLEVGKDADINVLDRNNDLVATYSYGVKHDTED

SEQ ID NO: 3251 - protein, 233 aa, Lactobacillus paracasei
MDAPVYIQIHNAIRADIEAGKWRVGDRIPSERDLAVTFKVSRMTLRQAIQTLVDEGILERRVGSGTYVANQKVQEKMSGVTSFTDLMQAQGKVPSSKTVSYHVAQPTSSEVEKLKLEPKEQVLRMERIRYADKIPISFETAAVPYNLVKNFTKKEMTASFYHTLEKKGGYVLGGAQQTVSAMLASERISEYLDIKRGEAILRLRQVSFLQDGTPFEYVRTQYVGERFEFYLER

SEQ ID NO: 3252 - protein, 487 aa, Lactobacillus paracasei
MTTQLGEGLTLHTDFYELNMMNTFFEQGISERNAVFEVFFRDLPFGSGFAVFAGLEHVMDYLNHLKFSEDDLAYLQSQTDYSDAFIDYLRHLKFTCTVKSALEGDLVFNNEPIWQIEGPLAQAQLVETAVLNMINYQTLVATKAARIRSVAGADPLMEFGTRRAQETAAALWGTRAAYIGGFNATSNVLAGKEFGIPISGTHAHSLVQAYGNDYDAFKAYARSNKDVVFLVDTYDTLRSGVPAAIKVANEFKGKINFLGVRIDSGDMAFISKRVRQQLDDAGYESAKIYASNDLDENTIQNLKMQGAKIDIWGVGTRLITAYDQPALGAVFKLVSIEDAAGKMRDTIKLSNNAEKVSTPGKKQVWRITRQDDGKSEGDYVALADETIDTQRSLYMFHPNFPYINKTVKNFEAKPLLQTIYDKGQQVYHTPPLQEVQAYATRSTNALWDEYRRILNPQDYPVDLSQRVWDNKMDLIKAVKSAVADREE

SEQ ID NO: 3253 - protein, 397 aa, Lactobacillus paracasei
MRASKRRSQHRWLILSLLVGLVVGIAAYASYDHFYLKPQIEAKEERTRRKYETELNRHRAVEQRLQNETRTATSATDKLMQPVNQAEAKPFMKILEANHFSGTALMIRRGKIILNTGLGYADAESGRLNGPETLYQIGSIQKGLTAVLLMRLVEQGKVHLSDPISKYLTGIRTGKQVTLRMMLNMRSGLSLTRAQSASLSDAGIVRWSIANLNYGTVRYDYQPVNYVLLAGVIEKVTGRLYADLIQQEIFKKLKLTHSGFMPELFHESNQAFGYSGPINNPYAKRYTEPSVNYNRELGTGNIYTSAGDLYQIIKAVNQGKIISTASLKALRNLDNGQYTAGVYNFGGYTLTHGVVASQSAGTMIDTSGQNAVVLLANTDKITQSLIKNLYLNMIKGV

SEQ ID NO: 3254 - protein, 275 aa, Lactobacillus paracasei
MRPLQAEIIKALGVQATIDPETEVRRSVDFLKAYLKKNTFLKTYVLGISGGQDSSLAGALTEKAMQEMRAETGDDAYQFIAVRLPYGEQADEADAMAAIDFMHADVVKRVNIKPSVDAMVAAVEADGSKISDFNKGNIKARMRMIAQYAIAGNNAGAVIGTDHAAEAVTGFYTKFGDGGADLTPLYRLDKRQGAALLKVLGAPAHLYEKAPTADLEDNRPALPDEVALGVKYKDIDDYLEGKDVTDQAAETIEKWYQKTAHKRHLPITVFDNFWK

SEQ ID NO: 3255 - protein, 385 aa, Lactobacillus paracasei
MSGKHRYIWLGVMLILCAVSIGAGTYLWQQNSRSAVNTKSKSAKTVTKAVRQDRGKSKEEILAMTLDRAATTTEGQPLEQELTNDKFIGSALIIKHGKVVFNNGVGDADTTTHRRNGPTTLFQIGSIQKAVTAVALAQLAASGKLSLDDPVGKYLTGIKTGDQVTLRMMVAMRSGFSLRKYQPTVMDDANIIQWSIANLTYLPQDNYAYQAVNYVLLAGVIEKVAGRSYEQQVKNNIFDRLNLKHTGFLPAMLTDPERAITYTGPAANPYQTAIGEPAVWYNRELGTGNVYTSTGDLYRLLRGIDTGKVLPLSTLKTLRNRNDGVYNAGIYNHADFYSTNGVVAGQMASTAISHDGQNAVILLSNYNSHALNLHDLAVHLFSELG

SEQ ID NO: 3256 - protein, 886 aa, Lactobacillus paracasei
LANKPPYALSSEAVLKQEQTSLTGLTKEAAQTRLNENGPNELAQAEKKGMLARFLDQFKDFMIIVLLVAALIAGFLLSEWADAGIILAVVLLNAVFGVFQESKAEEAIDALKEMSTPNAHVRRGDQVLTIPSSQLVLGDIVLLEAGDVVPADLRLVESANLKIEESALTGESVPVDKTTAPLDADDVGIGDRTNMAFMNSNITYGRGVGVVIATGMQTEVGRIAGMINSAEETNTPLQENLKSLGKTLTVMILVIAVIVFAVGIWRQAASLPEMFLTAVSLAVAAIPEGLPAIVTIILALGTQKMAKRHALVRKLPAVETLGSTDIIASDKTGTLTQNKMTVEKVYYDGQLNDASAGIHGGNPLMTIMNFANDTQVQDDGKLLGDPTETALVAYGKTQNYDVAKALTGEPRIAEVPFDSERKLMTTVHRRADGKLLVATKGAPDELLKRVTDLATGENTAPLSDSERDAILKANKDMATQALRVLGMAYKVIDTLPEKVDSDTVENHMIFAGLVGMIDPERPEAEAAVAEAKAAGIRPMMITGDHRDTAEAIAVRLGIIDQGDDDAVITGAELDQQSDDEFAKNVAKYSVYARVAPEHKVRIVNAWQKKGKVVAMTGDGVNDAPALKAADIGIGMGITGTEVSKGASDMVLADDNFATIVVAVEEGRKVFSNIQKAIQYLLSANLGEVLTLFMMTMLGWDLLAPVHILWINLVTDTFPAIALGVEPTEPGIMKQKPRGRKSNFFSGGVGPAVIWQGILEGLLTLGVYWIAITYPVHSGSAAIHADALTMAYATLGLIQLFHAFNVKSIHQSLFTVGAFRNKAFNWAILASFVLLAVTILVPGFNGLFHVTSLDWHQWITVLGAGVAMIVIVEIVKVFERARRKQRA

SEQ ID NO: 3257 - protein, 145 aa, Lactobacillus paracasei
MNKQQMKLANYGTTINAVVEATQDNQEKMAPLFEPLRKAIDENKLADYDLEAYQQTQTVFSEGTSNYEALLVKLQQVAAPVRLLGPHHTLVRDFAAFTEACKAMTASLHADRQVDVAAFNAAEKAQDEAIQKFTKQIQKISVMLS

SEQ ID NO: 3258 - protein, 53 aa, Lactobacillus paracasei
MAKAQPFLSEATYVPVSKRAGSRLQKLPRQVRTRRGNKKSPHSPTFGVSMRTN

SEQ ID NO: 3259 - protein, 331 aa, Lactobacillus paracasei
MKRMLGLIFIMAAFLGIAYFQTGTTTPQTQATPTVGILQLTTHPALDAIHKGIIDGLKEKGYVAGKNVKIDFQNAENDQSNLKSMSERFTEEHAAATVGIATPSAQALANVNQKTPIILGAITDPVAAKLVKNVKRPGGNITGVSDQAPIAAQLKLIRQIMPNAKTLGVIATSSDDSAQTQAKMVEKLGPKQGFTVKRYAISSTNDLNQVATQMVSQVDAIFVPTDNTVASAMQTLVAVANTRKVPIFPTVDTMVEQGGLATIGLDQHHLGVLTGRMLADILSGKTKPATTPIHFETTGKLILNEKQAKLLGIDLPSSLIKTAEAKGTVIK

SEQ ID NO: 3260 - protein, 299 aa, Lactobacillus paracasei
MSIGVSAIGQGLLYGLIGLGLFLTFRVLDFPDMTVEGTFPFGAAVAVSAITHGISPIVATLLATGAGMLAGLATGLLTTKGKIPVLLAGILVMTGLFSINLRIMGRANLSLLHQANLFQTAFLKDLPPYFNSVVIGVIVAVVVVGLLMLFLNTQLGQAFIAAGDNPSMARSLGIDPDHQMVLGLMVGNGLVGLAGGLLAQNNGYADVNMGIGIIVIGLAAIIIGEVVFGELTLSQRLVAVILGSILYRFVLLVVLALGFNADDLKLISAVVLAIAIMVPQIDHRLRLRRVLQKGVQAHG

SEQ ID NO: 3261 - protein, 250 aa, Lactobacillus paracasei
MAELTLTNVTVNIPVGTEVKTLLQDVNLTVAKGEFVTVLGNNGAGKSTLFNAITGDMPVSGGTITLADQTLNGKRPEQRARHIARVFQDPKMGTAPRMTVAENLLLASHRGQRLTLRSRGMTASKAALKTLAAKTGNGLADALDKPTEQLSGGQRQALSLLMATMRKPDLLLLDEHTAALDPHTSQAIMQLTNEIVSDQQLTCLMITHQVEDALRYGNRLIVLDAGKIVADFDQAKKAAMSRDDVLAFFS

SEQ ID NO: 3262 - protein, 150 aa, Lactobacillus paracasei
MTDQELQARVETISLKAFHQPFRHHAVFNNRLKTTGGRFHPADMNLDFNPKLFAVYPASVTDGIIKHELVHYHLYDHHRGYQHRDHDFKQLLTAVGGSRFAPPLPVNGHQYVYVCTHCGRQFVRRRHIDVRRYACGVCRGKLRLQKTLAS

SEQ ID NO: 3263 - protein, 170 aa, Lactobacillus paracasei
GNATFAMILYPRTEINMLREAQFIDLGAIVHLYQQLTAEMATMAPETYRPLTSDNRQYFADYLQNDLARLFVTETAGTLSGFALVVLARTGDNAEFVPQHFAQLIDLYVIPAQRHQGLAKQLMDAVTAFAKSHDATFIQLNVLNANQTAQQVYAKAGFEPVSLILQKPLN

SEQ ID NO: 3264 - protein, 201 aa, Lactobacillus paracasei
MTQRGKAYNIAIIGILGALIILQAYIPMVGYVQIFPAWPAISTIHLTVIIGGIVLGYGGGASLGLLWGLTSLIRAYTSATDPVTLLLFRNPIIAIVPRVMVGLVAAFIFHQLFKKKQTPLAQTVKMVFAGVVSALTNTLLVIGFTWLMFASKAAQIVPGADATNLGWLLMTALAINAVAEALLGGIVTPILGHALLRFRRK

SEQ ID NO: 3265 - protein, 379 aa, Lactobacillus paracasei
LTEEEQVVDLLSAMVKIPSVAAKEGQVADLIETFLAPELKAGLIKRERISYAPGRDNLVLTIGNPNAQRWLGVDGHMDVVDPGNVNKWQFPPFSAHVEDGKLYGRGATDMKSGLAAAVVAFKQAAHEKLDHGIQLMATVGEEVDNDGARQLSAAGYGDRLTGLLVAEPGNSNVDAAERGIIDYTLTAHGKAAHSSRPDLGANAIHGLFAFANAALTATAPLQAKEDPILGHATHNIDIIHGGNQINSIPESAYLRGNIRTTMIADNDAFIAALKQAAKTTVPKGVRLSLSIDSVLGAAAASPDNDLIQLVQTARQRAGLNRGQVAYRTGITDAALFYHDGLDLAIYGPGNETSHETDEYVTLKDVFDSVKVFKDVFMNY

SEQ ID NO: 3266 - protein, 272 aa, Lactobacillus paracasei
MQLSAKIFAKVGSERITQYSLVNDHQMTLRFLTFGARVQQVRLPNAAGDDPNLLLGFVTLEDYLHQPGYLGAFTGPLQAADAELAPGSWQNWNWAVKTSQETDLAITFTLTLPENADGQPGQRELSITHRLTNDNLWQIDMQVATTADLKIHPRLNLPWLLTADPAQTMLSAKLTADEHVTPVPKTARCETAQRYSLAAADWQLAYLSDASFTRIDSYAGINSENNFNGILGQPNVAVGFSPEMNQDALPWVLPAGATWRHHAEFHLSSNAN

SEQ ID NO: 3267 - protein, 187 aa, Lactobacillus paracasei
MRTLLKKAYQLLWGLFILGLAYSFWARSFLPRQLRQYGDPASFGIISLFVVINAIMLYHHHFRFRDLKMETVDIMEGEKFESFCAYLLKRNGFNHIQLTQASGDQGIDIIARKKGKTIGFQCKRYTGFVGNKAVQEVWAGHHFYQLDEAAVITNSEFSDSAIALADDLGVMLIDRKKLKRLMRRLPS

SEQ ID NO: 3268 - protein, 276 aa, Lactobacillus paracasei
MLLGLKASTDERQIRDRLQYHPDVFEFHLTENDFTEAGWSHFVQMAALVQSQVPTVVFHHPMRFRGQRNELAMNPTKYPTRYDFLMTSSVKLMNFAKKANATALIHGGYRVDTPGDYAGWTDVGKAQDIALARMIAFAQEAPGHVVFENSMSPIFRYGDPTFEDRLLRWHLPLAYDTSHTFIVLHGDNDRLMASLAHLKPLIRHYHLVDSMGQTHDSLPLGRGRIDWARVLPLLNQDASRIYEIGLKDQFDCREMIESHHYLESVAKRLAATKHPA

SEQ ID NO: 3269 - protein, 99 aa, Lactobacillus paracasei
MRVTDLLALLADQNKNASVLLDTKPTPSRFDDFKLTTVNDQPQLVFQPNPERKAALRVWELQLLLNQPDLQQRFVYLADVDEPRALFGFVKRQIGLLLN

SEQ ID NO: 3270 - protein, 393 aa, Lactobacillus paracasei
MEEVVILSAKRTPIGKLGGDLAGASAVDLGVAAAQAAIKAARIDPALLNQAIFGNVMQAGSGQNVARQIGLKSGMATSSTAMTVNEVCGSGLKAVRLGQAAIQLGEADAVLVGGTESMSQVPYYAEAVRSGHKFGDTTLVDGLSRDGLNDAFSQQPMGITAENVATQFNVSRQEQDEFALRSHLRAAAAAAEGRFKSQIAPVTIAARHGDVIVDRDSAIRPDTSLAKLAQLPPVFEVGGTVTAGNASGINDGAAALILMAKSKAEQLGLHYLATITGFAEVGIDPAIMGYAPKLAIDKILQATGGSIAAIDQIELNEAFASQSVAVARDLGLKDEQFNINGGALALGHPLGASGARILISLLYDLAERNQRQGIAALCVGGGIGIAMQIAMHV

SEQ ID NO: 3271 - protein, 426 aa, Lactobacillus paracasei
MKFYELSPEKRRDQLVQEGWLTTQDAALLAGTHSLPEVTGARLIENAIGEFPLPLGVARNLLVNGQLHQVPIADEEPSVIAAASNGARLATANGGVRTHVAAHRVVAEVVLTNLTDLVQARQTILAHQTDIQKVIAVAHPSMIQRGGGLDQLTVESLGAQFLKIRLTLDPQQAMGANYANTVAEAVAAAVTSWVDGDVLVSILTNAPTELVTAEVSLEPVSLATKAVSGDVIAKKIVQLSDLAFVDAERAVTHNKGILNGIIGAVLATGNDTRAVAASIGAFACASGRYQPLSRWYMDQGHLVGHLQLPLPMGAVGGAIGALPMAQVVRRLGGYQNLAIMQQVIAALGLVQNLAAMRALAGPGIQAGHMKLQANALAIAAGATETELPMLVNALRQGSMDLKHAQQYLTTIRLNKKVGQSKDENRD

SEQ ID NO: 3272 - protein, 388 aa, Lactobacillus paracasei
MKIGIDAIAMDTPDFYVDLVKLAQVRGDDPDKYTIGIGQDEQAVPPSSQDIVTMGANAATKLLTPAIRASLGMVLVGTESGVDASKSSALFIHDLLALPEWVRAVELKEACYGGTAALMMARDYIAAHPDKTVLVIAADIARYGLATAGEVTQGAGAVAMLIKAEPHIMTIEDDSVYRSESIDDFWRPVYQDTAIAQGKYSTEQYLAFFQAIWSRYQTQRHHTASDFAAMTFHLPYTKMGKKALKLVLPDTDEATGERLQRRFEASTRYCRRVGNIYTGSLYLGLLSLLDNDTSLKAGDRIGLFSYGSGAVAEFFSGILQPDFAAQLHAANHAKMLADRQELTVPEYEAVFSDKVPYDPEDYRSDPTYYHGQFVLTGVIGQERQYQQR

SEQ ID NO: 3273 - protein, 584 aa, Lactobacillus paracasei
MTEKINAADAMIKVLEDWGIHNIYGLPGGSFDSTMNALYNRRHTINYVQVRHEEVGALAAAGEAKVTGRIGATFGSAGPGAVHLLNGLYDAQYDNVPVLALVGQVPTAAMNTNYFQEMNENPMFADVSVYNRTAMTAEQLPHVVDEAIRQAYKHNGVAVVTIPKDLGWTQIDDNYVSSANLYQKPLLPDPDPDQVAAAWDILKDAKKPILYVGNGARGARDEIIAFSEKTHIPIITTALAKGIVPDDYKANMGSAGRVASKPGVEVARGADTVLFLGSDFPFQPYFIAPNAKYIQVDIDGSKFGRRHTVDLAVLADAKKFIKALSEKADQLPESAWYRAALANKENWREWMTSFEDDGSTPLRVEPIFKLINEMAEKDAIFQVDVGNVTINGMRYLKTNDDQVFTTSGWYATMGYALPAAIGAQAEFPDRQVWSISGDGGFAMVMQDILTQVKYHMPIINVVLTNESLGFIEAEQDDTQQPHSGVDLIDADYGKAAEALGAQGFEVHNLDELKAAFAKAKDRKGPVVIDVKISDLRPIPVEQLVLDKQTQDPAAVDAFVKKYHAESLIPFRQLLEDAEKPVTNA

SEQ ID NO: 3274 - protein, 104 aa, Lactobacillus paracasei
MGKKTIMLVCAAGMSTSMLVKKMEDAATKDGIEAKIFATSASDAHDKLDSEKPDVLMLGPQVRYLEGDFKKDLSIPVQVINMQDYGLMKGENVLKTALKLIDEQ

SEQ ID NO: 3275 - protein, 105 aa, Lactobacillus paracasei
MNEQEQLVIMQLIMAGGNAKGSSFEAIKAAKVGDFSTAEAKLKEADSFLSDAHNAQTGMLTEEAQGKKHPVSLLMVHGQDHVMNAITFRDLAGEIVDLYKKLATK

SEQ ID NO: 3276 - protein, 164 aa, Lactobacillus paracasei
MSDQNKARYDKSRRELSLTSMYFNRYLLIRYVTAGFFFANLYWFFLSLGTQGAMKWVPFCLTVINAVVAVEQVSKYWRRDSKLPFTKFGYVVQLISNFLSLSIIVAGSGTKLFPFLGQKGLSLATTVLLIGLGICFYLLVRIRLIEKNQDRYLQQINKFAQSIQ

SEQ ID NO: 3277 - protein, 454 aa, Lactobacillus paracasei
MDSSNNKLFKFMNNHLMGPMGKLASFRIVRGVMAAGMASIPFTIVGSMFLIINVLPQSFPALVGIWKGSFDKVANLYMLANGATMGILALYFCLVFGYEYTRIQAQEEKIDINPLNGALLSMMAFFMCIPELVFKGGTATLVTEITKDNKIIDGYAIAGGVTRLGTTGIFTAIIMSIIAVKLYAWFVKKNIVVSMPDTVPAGVSRSFTALIPTAAIALTVIIINGILMAFNTDIYKIVAIPFGFVTNLTSTWVGLMVVYFIMHALWIVGIHGATIVTSFLTPIVLSNMQLNQKGANIPFAGEFNNCFVTIGGSGATLGMVIFIAFFAKSAQLGALGKASVVPAFFNINEPILFGMPVVYNPYTAIPFFLAPMASMSMAYFAISMHWVKPMIAQPAWPTPLGLSGFIGTAGDWRAIVLAFVCALVAFLIWFPFIKFYDGKLYKDEQAKGAAEAAA

SEQ ID NO: 3278 - protein, 478 aa, Lactobacillus paracasei
LTAFPKGFLWGGAVAAHQFEGGWQAGGKGVSIADVMTAGDNETKRRITDGVQSGENYPNHDAIDYYHRYHEDDQLFADLGLNCFRTSIAWTRIFPNGDEEQPNEAGLKFYDDVFDDLLSHQIEPVITLSHFEMPYHLVKKYGGWRSRKVIDFFVKFATVVFDRYKDKVKYWMTFNEINNQVGMMNEWSLFTNSGLLIKPDEDKEAVMFQAAHYEAVASALAVQIGHRINPDFQIGCMVAMGPVYPATPNPNDVFKAERTMQTNYYLADVQVKGKYPAFLDRYFDRHAFNLDITLEDRDVLLAGKVDYIGFSYYASHVTEASQDEPTDFITMGHNREVKNSTLQRSDWGWEIDPVGLRYALNWFSDRYEVPLFIVENGFGAFDKINQDGHIQDDYRIDYLRQHINQMRLAVEVDGVKLMGYTPWGIIDLVSAGTGQMEKRYGVIYVDKDDQGKGTLARSKKASFNWFQKVIRSNGDDLA

SEQ ID NO: 3279 - protein, 245 aa, Lactobacillus paracasei
LSQRESSYDIKTLENQLIKAIQQGAIQDEDGQLPAEPELMRQYQVTRYTLRQALKDLANLGYIYQAHGSGTFARPHHVEGAISLQNNVGLTEEMARQGRVVKTTAIHQQVITLDQADFLPESQKLPNETTLISVTRQRTLDGQPFLVEHSYYLRSIVDNIPNSALKGSLFAFIDQKPGLKVGFIDSVIECEMISGLPAKFFGIADGSPSLVVRDDSYLSSGKLFAFSKIFYDFRKTKFFMLKKMH

SEQ ID NO: 3280 - protein, 157 aa, Lactobacillus paracasei
MKIYFANALFSHADFNYNAQLAAQIRRALPDVDMYVPQENAAINNKEAYADSKMIAEADTKRLLSADLMIAILDGPVIDNGVASEIGVAYAAKIPILGLYTDSRRLGAANQQKLGALQQVAENQFHYLNLYTTGLIKLNGAILTDEDSLIASIKSRA

SEQ ID NO: 3281 - protein, 455 aa, Lactobacillus paracasei
MAVTVKIGQRFPLTIKRLDINGAGIGYYQRKITFVTGALPQEVVVAEVTGIHDRYLEAKVHKIRTASPNRVTPAEPLFGQIGGVELNHLAYPAQLRFKRDVVAQSLAKFKPTGWTHYDLRPTIGMAQPTHYRNKAQFPVRVIDGHVRAGLYAPNSHHLIPLTKFLTQAPLTMKVVTTLCQILEQLQIPIYNEKKRSGIVKTLVVRESFATKEVQVTFITNSPKLPHEGELLNGIATQLPMVVSIAQNINPGETSLIWGKESRLLAGLPYIQETLLGRTFQLSPQAFLQLNPKQTETLYTLAAKALDLGPHDTLIDAYCGIGTVGISLAKGNQPIYGMDTIAEGIADAKANAKANGLTNAHYSVGKAEDIFPKWVQEGMKPDAVIVDPPRAGLERAFIDALLELDPPKFVYISCNPSTLARDLVFLTKRYKVDWIQSIDMFPQTARCEAVVKFTRA

SEQ ID NO: 3282 - protein, 124 aa, Lactobacillus paracasei
VKINYSNTMSRKMTATVWQNDTPHTIRVGETLDLKVQRGDKITYKVGRFNAIHTIDYQSPDAQFEIQINRSLQNAYFVVMFAMVVFLWFNRNFSQTILIAAVILGLAGYEALVYFVGYTAKPIH

SEQ ID NO: 3283 - protein, 511 aa, Lactobacillus paracasei
MFEASFFDRHSLINYQLFRAMKTLQQTTMSINTLSRNTGLSYSQTYTAFQTVLAQLNQILPDKKIDESSFAAVLPDVSIDRYRFSLLKNSLPFEFFDGVFKNPHSDFHAFKQHHQTSISTLRRRISPFRDYLADNGVTLNSTTWAIEGDELHIRLAMFTFFTLAYRGAGWPFSSAEEREPKALLKVINQTKQAFLVSPIQPMSKEALLILAIQMLRINCGHALLPNRRMQLLFDGETELPDLIFTPDYFPNLSASELKAEKQYYYFSRMYFMTVTRQPHQIDYQIMTHFQSKDNLVNRFVRHLVTSLNNQLKETKSQLIAENQVMIANLYRLSFTEYVLNGHFSQRLDFASTLHDEARTSQLTAKIRDCLKRIPKMAPESIYADFTSQFINGLYILVNDNYPELNRDMQMVVNVLIEHDSFVKRDLLNFLNDLGFIRVVPPTEAINPDLIITTLTKPKRVIPCMGHPFDPTVPLITWSKEPSDQDYFHLFQRLKRLQREQRTAADTNQTRQ

SEQ ID NO: 3284 - protein, 264 aa, Lactobacillus paracasei
MSEITKITAQKRRGRYNIFIDGTYAFPVSETTLVDYRLAKGMVLTAETIAQIKSSEVTAMGLEIGLTYISHQSRTSKEVSDRLAKEDLPADVIQKVLTRLTDLGFLDDADYAHRYIEEHLKMGELGPRTLQHKLQQKGLKPDLLANELAAIPTTAWLDAAVRAGQKNLRHHQHRAYKDQLQRLRVALMQKGFDDTTIQTAIATIDPQPDPEAESDLLKLEAAKQWRLKAKYGDRERKQKVKTTLFRKGFDVEAIDEVLNDLAES

SEQ ID NO: 3285 - protein, 178 aa, Lactobacillus paracasei
MRIPKEGDSFAIQSYKHDGSLHRTWRDTMVLKTSEDALIGCNDHTLVTESDGRRWLTREPAIIFFHKHYWFNVIAMIREGGVSYYCNLATPYTMDQEALKYIDYDLDVKVFADGEKRLLDVDEYEAHRKLWQYPATTDRILKTNVKVLVDWINHGKGPFSQAYVDLWYRRYIQLAHRI

SEQ ID NO: 3286 - protein, 172 aa, Lactobacillus paracasei
MKQIPKQPAQLFAGHAYTVENSDQLGTFQPAWQDFEAQLGFKTLDDLAEIPNRSAMVVFSPYDTFLYWIGSLLPADAAVPKPYEAFRLPEATAGQVRQPATSVLLKQLPLATSFNKGLQIIEKAGYPLPERLGQTDHPYYLESYLIQDGAVHQVAYRLYIDPHQLKGVDEYE

SEQ ID NO: 3287 - protein, 144 aa, Lactobacillus paracasei
LEVKTTTTLDSQIHQDSVQIRTHVFVEEQHVPPELEVDADEAKATYFVICDAGVPVATARILPEGDAYHVQRVAVEKAYRKHGLGKMVFEAIMTYARAQQIQALRLGAQVQAIGFYKALGFQLTDRPEFLDAGIRHREMILKLA

SEQ ID NO: 3288 - protein, 392 aa, Lactobacillus paracasei
MFDRLRHSKLMFWSVEILILIFVVIGLTQVSFLFAPVATFFSTLLIPILSAGFLFYLFNPIVKLLQKFHISRNISILLIFLVVIGALVLVFMAVLPNLIYQVTQFVTNIPDFLKGVRLFISKASHYTWYQRLNIGKYVASLQISPSKVLSRVLGGFSTGLPTVIGSVASMMISIITIPVMLFYFLKDGENFVPSIQKMLPHRYHEEVATVFTRLNSTLSHYIGGQAIECLFVGTFTFIGYLIIGMPYAYLLGFIAGIVTIIPYLGPYIGIAPALAIAATEGWTKMLLVVVVVVIIQMTDGNFIYPNVIGRSLDIHPLTIIILLMVAGNLWGLLGTILAVPTYAVIKTVVTYLYELYRFHQEHKHDEDADSDEENAGEAHQIKDQADPQLKNK

SEQ ID NO: 3289 - protein, 446 aa, Lactobacillus paracasei
MGSDPDGQIWGQLILIVILTLINAGFAAAEIAVVSSSRTRMKAQADKGDRKAAKLVTIMKDSSNFLATIQVGITFAGFFASASAATTLADRVAPIFGGWSFAHEAAVILVTLILSYFSLVFGELYPKQVALQMTERVAKMSVTPISWLAKVMRPFVWLLSASTKLLMKLTPMEFNHEGETVTRDEMVSMIESGRNSGAIDPDEYQMFEGIISLSDTMAREVMVPRTDAFMVDAQEPDHTAIDAILNNIYSRIPVYEEDKDHVVGIVHIKNLLKEARRVGFDHVKIESVMTAPVFVPETITVDDLLTEMQVKQQQMAILLDEYGGVVGIVTIEDLLEEIVGEIDDESDQVEKLFTKQGDHDFVVSGRMPISDFNDLFKTDLDAPDVDTIAGYVLTQLGAIPSSHHSEKMQLAPGVLLATGKVEGSRLVNVHVHLSSEPEEASHEADS

SEQ ID NO: 3290 - protein, 524 aa, Lactobacillus paracasei
MKPQELAKEVAKRRTFAIISHPDAGKTTITEQLLLFGGVIREAGTVKGRKSGHFAKSDWMEIEKKRGISVTSSVMQFNYQGKRINILDTPGHEDFSEDTYRTLMAVDAAVMVIDSAKGIEAQTKKLFKVVKQRGIPIFTFMNKLDRDGREPLDLIAELEDLLGIEGYAMNWPIGMGKGLKGLYDRVNQRIELYRREGDDRFLPLNDQGQLDPSQPLTQDSIYTQTLDDIELLNDAGNQFNLKKIMAGEQTPVFFGSALTNFGVETFLNSFVQYAPEPGPKKTEQGGEVNPTNPELSAFVFKIQANMNPAHRDRIAFVRIVSGEFERGMDVILHRTGKTMRLNNSTEFMADTRETVSTAVAGDIVGLYDTGNFQIGDTIYQGKEPIQFEKLPQFTPELFVRVTPKNVMKQKSFHKGMQQLVQEGAVQLYKTYNTNDYILGAVGQLQFEVFQFRMLHEYHSEVIMTPIGSRTARWINPDQLDEKMSSSRNLLVQDIHGDPLFLFENQYAERWFADKYPDVKLTAKM

SEQ ID NO: 3291 - protein, 60 aa, Lactobacillus paracasei
MSIVAHKKRLSNVSRFLCALINLAMCKNLIGIGKHGTILLRVTLLAAQAWEQSLLPDDDP

SEQ ID NO: 3292 - protein, 97 aa, Lactobacillus paracasei
MRLINVTNSFRNLVSQQLSGTDARLVKVFSLGQTTVVYTEAPSHIELLFTNERRNIQRAEIAFTLERLLQKDIGDVSPIMGHHLAEVTVPKLERQAE

SEQ ID NO: 3293 - protein, 698 aa, Lactobacillus paracasei
MRPTDATDPFGFGSLDDIFRAMNQGMDQPQQPNAQTPPTQAGRGGNGNNGRNGNRGKGLLGQFGVDLTEQARNGQIDPVIGRDKEISRVIEILNRRTKNNPVLIGEAGVGKTAVVEGLALKIANGDVPSKLQDRHVIRLDVVSLVQGTGIRGQFEQRMQQLIDELKKNKNIILFIDEIHEIVGAGNAEGGMDAGNVLKPALARGELQLVGATTSNEYRQIEKDSALARRLQPVLVEEPTVEETIKILKGLQPRYQDFHHVKYTDAAIEAAATLSNRYIQDRFLPDKAIDLLDESGSRKNLTIATVDPETIKTKIDDAEKQKQAALKQEDYEKAAFYRDQVTKLEDMAKKQSNLPENEIPTVTEKDMEQIVEEKTNIPVGELKAQEQAQLKNLAGDLEKHVIGQNEAVDKVARAIRRNRIGFNKSGRPIGSFLFVGPTGVGKTELAKQLAKELFGSEDAMIRFDMSEYMEKFSVSKLIGSPPGYVGYEEAGQLTEKVRRNPYSLILLDEIEKAHPDVMNMFLQILDDGRLTDSQGRTVSFKDTIIIMTSNAGSTDAEANVGFGAALSGKTHSVLDQLGNYFKPEFLNRFDDIVEFKSLSKDDLLKIVSLMIQDTNNNIKDQGLTIHVTDPVKEKLVNLGYNPAMGARPLRRVIQEQIEDRVADFYLDHPKAKELEARISNGEITVGEPAKAETTQKSKK

SEQ ID NO: 3294 - protein, 63 aa, Lactobacillus paracasei
MTQDYVALIDELKTGQRDKITVTPETFMAFRAAWTNYPDREEIVGMAKRDGVIEYHYRSVDSR

SEQ ID NO: 3295 - protein, 88 aa, Lactobacillus paracasei
MEKREFNIIAETGIHARPATLLVQAASKFNSDINLEYKGKSVNLKSIMGVMSLGVGQGADVTISAEGADEADAIAAITDTMKKEGLAE

SEQ ID NO: 3296 - protein, 575 aa, Lactobacillus paracasei
MAEHLKGIAASDGIATAKAYLLVQPDLSFQKKTVDDPSKEIDRLKQSLDQSNDELKVIRAKAAESLGEEEAQVFDAHMMILADPDFTGQVETKIKDEKVNAEQALKEVSEFFIKTFEGMTDNPYMQERAADVRDVTKRIMAHLLGRNLPNPALIDEEVVVVAHDLTPSDTAQLNKKYVKAFVTDIGGRTAHSAIMARSLEIPAVVGTDDITKKANNGDLISVDGLTGEVVVDPTDDEVAKFKQDAEAFAKQKAEWALLKTAKSITADGKHFDVAANIGTPKDLDGVLANGAEGIGLYRTEFLYMDSAELPTEDDQFEAYKKVVETMSPKPVVVRTMDIGGDKHLPYLPLPEEQNPFLGYRAIRISLDRQDIFRTQLRALLRASAFGNLRIMFPMIATIAEFKQAKQIFTEEKDKLVKDGVKVSDDIQLGIMIEIPAAAVLADQFAKYVDFFSIGTNDLIQYSMAADRGNEHVSYLYQPYNPSILRLIKHVIDSAHKEGKWAGMCGEAAGDPIMVPLLLGMGLDEYSMSATSVLKVRSLMKKLSTADMAKMDEIALNQNITNDENADLVKKTTGQK

SEQ ID NO: 3297 - protein, 470 aa, Lactobacillus paracasei
MYQSKTHNHRFTGHLASAKTRLRLVALISTMGGLLFGYDTGVINGALPFISSELKLAPGSQGWVTSSLTLGAAFGAILVGRLSDRYGRRRLITMLAGLFFLATVASSLSPSAGWLIGARLILGLAVGGVSVLVPSFLAEIAPTSHRGRLVTQNELMVVTGQLLAFVLNAFLGTTFGNVPGIWRWMIVLAVIPAIILGIGTYFVPESPRWLMMKGRPAAARSSLEVLRSAAEVPAEIDHLKQNLAEDTKHKQASVRALKTKWIRRLVLIGIGLGVIQQIAGINVMMYYGTSILQMTGFGRDSALIANIANGVTAVAATIVTLQLLKHVPRRPMLIVGLIGSTVAITGVTFASRLPAGSSFRAFATIGMMMLFLAFFQGAISPMTWLLMSEIFPEQVRGIGMGAATFCLWLANFGVGVLFPVGLAQIGMFWTFVCFIGTNLISLLFVLIFVPETAGRSLETLHREEKARLNH

SEQ ID NO: 3298 - protein, 201 aa, Lactobacillus paracasei
MQQHKQLVVILETAIIAAFAMALTYIPHTTGVSAIELNYGLIPIAVLAMRRGLVPAAWAGFVWGILDLILRGIGGGSVLNPLQGILEYPIAFTLVGLMGLTFASFQKAVRGSEKVKASGYAFAGIIIGTFAKYFIHFIAGVVFWGAYAPKGTNVWVYSLIVNGGSALFSTVLTIVVVGVLLTVAPQLFVAKDGKSFSTKAA

SEQ ID NO: 3299 - protein, 161 aa, Lactobacillus paracasei
MQKVAVVMGSTSDWPTMQQVTAQLTSLAIPYEKRVISAHRMPDELADFGKQAVALGFGAIIAGAGGAAHLPGMLAANTLLPVIGVPIKTRTLNGVDSLLSIVQMPGGVPVGTMAIGDAGAVNAALFAAAILALNDSELADRLQAFRDAQTKRAKESEAALQ

SEQ ID NO: 3300 - protein, 371 aa, Lactobacillus paracasei
MIDVVTSPATIGIIGGGQLGRMLTQSAKSMGYRVGILEPTPNSPAGQVADFQITAPYNDQAALKQLADASDVLTYEFENVDLAALEAVRSETRIPQGTAILAITRDRIKEKTFLKTHGVPVTPFAAVNRAAELAQAVATIGLPSILKTTTGGYDGHGQQDINTPDDFPAARELLTHGPCILEKRQQFDREVSVMMTRDGRDQVRVFPIVENRHQHHVLHLTLAPAPNISPVLAKKIDDLATKIALGLDLRGVLGVELFIEGDNVVANELAPRPHNSGHYSIEACNFSQFDAHILSICGLPIPPITLKQPAVMRNLLGDDLTIAKQKWPQHPEWHMHDYGKAEIRSGRKMGHLTVTDDRNVLDILKQMEAAW

SEQ ID NO: 3301 - protein, 242 aa, Lactobacillus paracasei
MVNKTTLLYTGKAKQVYATDDPDVLWMAYTNQATALNGEKKAQIAHKGELNRAISTLLFKELTAAGIPTHYLDSPDSTTMIVKKAAMLPLEVVVRNYASGHFVTKFNVKPMMKLDPPIHEYYYKSDELGDPFMNEAQIFALHEATPEQLKQVHALTDRINTYLTQRFAAIGITLVDFKLEYGTLKDGTLVLADELSPDNFRLVDQQTGASLDKDVFRQNRGPLTPVYEEVLSRLQEKGAAHV

SEQ ID NO: 3302 - protein, 86 aa, Lactobacillus paracasei
MFKAKIYVTYKPSVLDPKAEVIKTALGRMAYHNVEDVLYGKYFELTLAGSEAEVRKQVDTICDQLLANVNMETYRFELEPMAEVNA

SEQ ID NO: 3303 - protein, 228 aa, Lactobacillus paracasei
MKAAVISFPGSNCDLDLQWAVRAIAGAECDLIKPTQTDLTAYDVVMVPGGFSYGDYLRSGAIARFSPVMAALKQFAAAGGYVIGICNGFQILTEAGLLPGALQWNRDLNFICEPVALTVENAGTAFSNQYQVGEHLTLPIAHGEGNYYADPETLAALETNGQVVFRYANNPNGSMHDIAGVTNETGNVLGMMPHPERAVEALLGGTDGLGVFQSLINQTEGADVRGAR

SEQ ID NO: 3304 - protein, 738 aa, Lactobacillus paracasei
VVHVEMSPEAIATQKPYLDLGLTEAEYDRFAELIGHQPNDTEIGLASGMWSEHCAYKYSKPVLRQFWTKNERVLMGPGEGAGVIDIGEGKAVVFKAESHNHPSAVEPYEGAATGVGGIIRDIFSIGAKPVAMLDSLAFGDIEQPHTQHLVDRIVAGIGGYGNAIGIPTVGGETNFDGSYTRNPLVNAMCVGIMDKDQIQKGKAAGVGNALIYVGAKTGRDGINGASFASGDFSDEEAADRSAVQVGDPFMEKLLMDACLEITGHHQEALVGIQDMGAAGLVSSSVEMAGKANSGMVLDLDLIPQRETEMTPFEIMLSESQERMLLCVRAGFEQEVLAVFADYDLDAAIVGHVIAGHQYQLYHHGKLVCDVPVSSLTDDAPIYHQQGKMPKRLAQPAADFDPIITDPVQIWTDMMAMPTIADKSSLYKRYDAQVQTNTVVLPGSDAAVTRIRGTHRALAMTTDSKGRYLYLDPQVGAAMSVAEAARNLVASGAEPLGITDCLNFGDPTKPEAFYELAEAAKGIIAATKAFNAPVISGNVSLYNETNGEAIYPTPMIGMVGLIEDLSTITTAAFKQADDLIYLVGETHGDFNGSELQKLQTGEVTGKLFDFDLEAEKQHQHFVLKAIREHLITAAHDLSDGGLLVALAEMGFDAQLGAQINVTLPTAWGFSETQGRFLLTVAPENQAAFEALHGPAQLIGRVQAAPEFEVTTVNQHFSASLQQLQTAFEEALPCHMNQKA

SEQ ID NO: 3305 - protein, 484 aa, Lactobacillus paracasei
MPHEPKGLNEECGVFGVWGNPNAASITHLGLHTLQHRGQEGAGIVGLTKDGMRRHYGLGLLSEVFTNTDQLTPLIGRAALGHVRYSTAGGRVLENIQPLLFRFSDEAIALAHNGNLTNAISLRRQLEDQGAIFQSTSDTEVLMHLIRRQVGQPWLTQLKTALNEVHGGFAFVLLTEHGLYAAVDPYGFRPMVVGVLSDGGYIVCSETAALDAVGAEFVRDVQPGELITIDDAGLHIDHFTTNTQLAVCSMEYIYFARPDSDIHGINVHQARVRMGERLAKEQPAEADIVVGVPNSSLSAAIGYAKASGIPYEMGLMKSQYVARTFIQPTQALREKSVKMKLSVIKPVVAGKRIVLVDDSIVRGTTSKQIVKLLKEAGAAEVHLRIASPPLRFPCFYGIDFQTTSELFAANHSVAEMRDLLAVESLGFLSTQGLEESVGLSATAPNGGLCVAYFTGQYPAPLDDYAFALDKEVASLKVNVAEVSA

SEQ ID NO: 3306 - protein, 336 aa, Lactobacillus paracasei
MTDYKDAGVDIEAGEAAVQRIAALAKETTNANVLASVGGFAAAYRLPEISEPTLISATDGVGTKLLLALQCDAHETVGIDLVAMVANDLLASGAQPLFFLDYMAVDHLDVDRTEAVVRGIAYGCQQAQMALIGGETAEMPDMYPQHHYDLAGFAVGLVSASKRLPQKVAAGDVLIGLPSSGVHSNGYSLVRKLLAETDLGSQSLDDGSEMLNALMRPTRIYVKQVLPLMQQGLIHAAAHITGGGITENLPRVIPDGLVANIDPLAWQRPELFDRLQHAGHLSETTMRSTFNLGIGMILVVPEQAVSLVQDAIPSSKVIGTVGEDPVEKLHWQVSRR

SEQ ID NO: 3307 - protein, 189 aa, Lactobacillus paracasei
MKDLAVFASGHGTNFEALANAADQPDSGYRIAALVCDQSQAPVIQKAAARNILTIVVDFKSYPNKTAAETAILEQLPPVSALILAGYMRIIGPTLLRAFPKKIINLHPALLPSFPGRQGIQDAFDYGVKVTGVTVHFVDAGIDTGEIIAQVPVNITDGMSLAELEQAIHRQEHQIFPATVKNLIQEGAI

SEQ ID NO: 3308 - protein, 507 aa, Lactobacillus paracasei
VKRALLSVSDKTGLVSFAKGLIDRGFELVSTGGTHRELAAAGIAVTSVEEVTGFPEMLDGRVKTLHPKIHAGILARRDDPAHMEALADHDIQPVDLVCVNLYPFAATIKRPDVTRAEAIEQIDIGGPSALRAAAKNSDSVWAVVDPADYEAVLTGLDQDDAHLRQKLAAKVFAITAAYDAQIVHYLDPEPFPEHFTPTYTKRQDLRYGENSHQQAAFYVEPDPNPTSLAAAKQLHGKELSYNNIKDADAALAMLREFSEPAVVAVKHMNPCGIGLGKTIEGAWDKAYAADPMSIFGGIIALNRPVDLATAEKMHKLFLEIIMAPAFDDDAYAVLAKKKNVRLLTINTADTPAELGTETTAIYGGLLIQTRDNQTETPADLTVVTTVKPTDEQLKALAFAQTVVKHVKSNAIVVAQADQTLGIGAGQMNRIGSVELALTQAQQNDNFAGAVMASDAFFPMDDCVDYAAKHDIKAIIQPGGSIRDKDSIEKANQYGIAMVTTGVRHFRH

SEQ ID NO: 3309 - protein, 412 aa, Lactobacillus paracasei
MKQVLIIGGGARESALALKFKQSPQVDHVYVAPGNPAMTLLGVDPINIDDNDFTKLIDFAETHQIDLTFVGPEVPLAAGIVDAFQAADQPIFGVTKKVAQLEASKTFAKDFMARHQLPTAGSKTVHNAIDAHAEAATMGLPLVLKKDGLAAGKGVAIAQDAETLDETIEKMYADSPDATVLLEQYLAGEEASVMALFNGEKRVILPLSQDHKRRFANDRGPNTGGMGAISPLPQFNDDQVAAAHQLVDATLKGMQADGLDGQGVMYIGLIFTPDGPKILEYNMRFGDPETQVLLPQITNDFYQLISDLLANRQPSLTLSDKAYACFVAVNPAYPSSALKTVPVIVPTDWPEGTWLPAGVAKSDHGWESHAGRIFSVVAGAESLPDAVKAAKTAMEKIQGVLDYRTDIGFHTL

SEQ ID NO: 3310 - protein, 146 aa, Lactobacillus paracasei
METPKVEISQSEWEVMRIIWTLGPLTSSTLATILAEKMGWKVATTKTFLGRLVKKGALTTEKNGREFLYHTAVGEQESMDAAVAELFSHLCQMKIGTAINHLMTNVTLSKHDIEILQQTLLAKQHDAPKTVSCNCLPEGCKEAAHE

SEQ ID NO: 3311 - protein, 750 aa, Lactobacillus paracasei
MNDDEMKAMNDTKRSQTDKKDQMNHDHMAMGHHGDMDHMHMDHDSEEEHAGMAKMQMEPGSMDHAAMDQMHMNHGAMDHMHMHMDHGSMDHGGGHMMHMGNLKQKFWVSLIVMIPVLLLSQFMGMDIHLGVLQLPIVFPGSDWLVLILSSFLFFYGGWPFLTGAKSELQSRQPAMMTLIAMGITVAYGYSLYAFVMNHFIAPHAMVMDFFWELATLIVIMLLGHWIEMNAVMAAGNAVEKLAALLPNQAHVVHGDSVMDMPLSEVQVGTRLRVLAGEQMPADGEIVSGSSSVNESLVTGEAKAVRKAGGDKVIGGSINGDGVIEIQVTGTGESGYLAQVMKLVQSAQANKSKAEGMADKVAGWLFYAALAIGILAFILWMPSGLATAFERMVTVFIIACPHALGLAIPLVIARSTSIGATNGLLIRNRQALETAKRAKYMLMDKTGTLTEGKFTVATTLHFADQSQEEILATMAALESHSEHPLATGIKAAAIEQKLTVPAAENVQVMKGVGLSGTVDGIQYEIVNARYLQDHQLTYDKTQADQWAAAGNSLAFLLKGQHVLGMVAEGDQLKSSSKAFVAELKQQGITPVMLTGDNHETAKKVAGQLGLTEFQAELKPEDKVAQVKAYQQHGVVMMVGDGVNDAPSLAQADIGVAIGAGTDVAIDTADVVLVHSDPADILNFLSLAKATNRKMVQNLWWGAGYNILAIPLAAGILAPVGFILSPAVGAAIMSLSTIVVALNAMTLHLKRA

SEQ ID NO: 3312 - protein, 192 aa, Lactobacillus paracasei
MIENKLPQNPKPKEWLASELSQQRIADYKPFNFVDGEGVRCSLYVSGCRFACPGCYNRVAQNFRYGKPYTQELEDQIMTDLSQSYVQGLTLLGGEPFLNTQVCIRLCKRIRQEFGHEKDIWSWSGYTYDELIQDSDDKLELLKLIDILVDGRFLLAQKDLTLQFRGSANQRIIDVPATMAAGEVKLWKNLIR

SEQ ID NO: 3313 - protein, 366 aa, Lactobacillus paracasei
MRFRDYLKDHLSPIGGYILCVGLAALIIWLDPQHRVKAMTLWYAVLLVTLLASAFLIARYWRVRRFAARLQERIDAQEAALDWPLPGGESATEQLVTKTYNQILTQHRQQVTALLAQQQDQKDFIDSWVHEIKVPLAAVTLLAESFEGQVPDDKLDNLNLQLDQIEFYVEQVLYYSRLDSFSKDYLLHETSLRPLINDVVANQRNGFINKRLSFRLNGTDQIVLTDNKWLRFILAQLISNAVKYTPEGGRITALIRNTGKETQLQITDTGIGIPKDEQHRVFEKGFTGSNGRLSNHKSTGLGLFLAEKLAEKLGHHLSLTSVINQGTTVTIHFPYVSYYGEADQTVHHPESHAIAVQTQTRSHPDS

SEQ ID NO: 3314 - protein, 224 aa, Lactobacillus paracasei
VFKIMIVEDDQTISGLIADNLKKWQFDPVVVTDFNAVFDDFLQEKPHLVLLDINLPVFDGYYWVQKIREVSKVPVIFISSRNTNMDMVMAMNMGADDFLNKPFAMEVLIAKINALLRRTYNYADQGTDVLEHNGLMLNLKNGMAQIGENEINLSKNEYKLLQILIRQHGQIVSRSRLLKDLWQDERFVDDNTLTVNINRLRKKIEEAGLKDYIQTKVGQGYIVP

SEQ ID NO: 3315 - protein, 256 aa, Lactobacillus paracasei
MAILEVSNLSKIFGQRHDRVRALNDLSFQVNAGEFVGIMGPSGAGKSTLLNILATIETPSTGKVNIAGNDLEALNERQQAAFRRDHLGFVFQDFNLLDDMTVTQNVLLPLTLQQELQPDRAERLQTVANHLNLTPILQAFPGELSMGQRQRVAAARAVITQPDLLLADEPTGSLDSLAATDFLNYLRQLNEKEKTTILMVTHDPFTASFASRIIFIKDGAFFAEVTRGKSRQQFFDRIIDMEATVSGGGHTRVASD

SEQ ID NO: 3316 - protein, 567 aa, Lactobacillus paracasei
  misc_feature (539)..(552): Xaa can be any naturally occurring amino acid
VWHLIKTNLRRHRHEDGLQVLVAALISAVMYAIGAVANNEPILSDASKRLGDLDIVPILLMIVMMVLALFAISFLLYFNTLLIARRDREIGLYRLLGLSGAKLGLLVCIESLMIGIFGMALGLLLGLIISPLLGMVLIRLMALHTPISLMLSFPAMVDVVILMGVVYLLVGSINAIYVQNPLRNFIRQQDVSAAPKPQTWWRFSLGIAGVVLLAGSLFTMVHLLPVSGVLMHILPRTQGRLIPPLLMGFMLVALLLGLFLVFEEFLPGIVAWFQQRSQMKTRNAHAISRHLIIKRLQGNAHSLWLTTLLCAITITMLGSSAMLFQYNQDLVQREIPTTVVAAGAGVDNVTKILAKAKVKPTQAIILSSKLVYAEIRLRDQADQVRKQPGVYNVIAMRDYQRAAHLQHYLAPVRLRGNEALLMLPTRTSFRPVGARRNPDRAIILPGSDASLLLTRTTNLFPTGRNNFFDRGLLVSDRTFDMLEGTTDRLYMARLPKSKATAAALRQLQHLENSQNLQEYVNIGSSERDGNDLRVTDRAXXXXXXXXXXXXXXFGAIRWEFSPSSREL

SEQ ID NO: 3317 - protein, 133 aa, Lactobacillus paracasei
VNTLYGFLFFLILLLGGVFVVATGSILLLKQVIAARQEARHFQILKHLGMDPRQLRITIYRQAAVVFAVPFLFGTTIGLCMISVLTTYLDNPPSRYLGLMILIYAIIDWLFYEATVHITARMVDEPVSRWAID

SEQ ID NO: 3318 - protein, 168 aa, Lactobacillus paracasei
MSTIQTVFGSKSFLVKLLDERHDPQLKLLKPAEEGLDYMIYDPSGKAHFSAPLQYETLADLGTPADNGYIHFMYFNLSSDDVKVFLAKIKDLIDKHDIFLGQTQVLVAQKVKHPDDFVVVSGWQSSNDYYEFKNTPALSAVKEFIRRAASANGFHQAGYAVIDPHQKN

SEQ ID NO: 3319 - protein, 245 aa, Lactobacillus paracasei
MKLTVLGYLGGYPDAGHATSTYLIESGDYHLLMDLGSGGLLSLEQQFDPLKLDAVLLTHYHHDHIADVGVLQYYYQLRKGDKKVSPLPIYGHTKDPLNFASLTFGPYTTAKGYTADSTLHLGPLTLTFLETQHPVPAFAVRIVEDVTGKTLVNTSDTRCFPALAPFSKDADLLMADTNFLADQPQPRWHLTAPEAGKLAKDAQVKRLLLTHLPQQLDLVTLKQQAQTAAGGIPIQLAEDDLTISI

SEQ ID NO: 3320 - protein, 218 aa, Lactobacillus paracasei
MSAVLANVYMIPFDHAMKTLAQSYGGIYRRYSDDFVLLIPKAVSRSSIRTVIRDINVMAQRLSRLQLEKKKTKVLLYTKAKESVVKLSEELELSPSVFDYLGFVFDGRCVTIRAKGLFKFSHKSRHSVRQVAFGQNQLIKGNNMIYIPYQEAYHRLTGQYLNMSEEAQTFRGYASKADKIYKTNNPGYGVKIDDQARKVVKKSQLYLNERRKEYAQWR

SEQ ID NO: 3321 - protein, 74 aa, Lactobacillus paracasei
VYLHLSFNNDWHSEDVRVLDKHFAEFYHELQARQHLEAQAKDYAKFFEVKATPKRGHQVTPKDEAVKQAKEFCR

SEQ ID NO: 3322 - protein, 173 aa, Lactobacillus paracasei
MINGGIYTTIVYKKDMRSGITYAYDSKSHWDKEKQQSRSTQHLIGRVDPATGEIVPTDGRNRTAKAKQPVKPNQDFSHKYYGATYLLTQLAVKTGLAQDLQACFGNLTDMILSIAEYLVLELESTLYRFNHWQKLHVHPANQPIFSQQSNDLLGQITKSQITDFFRRQSKSRP

SEQ ID NO: 3323 - protein, 75 aa, Lactobacillus paracasei
MRISEMNFPDILKKYRDRDVLIIFKSGKRLKTHVDEIENQLDGWDDVLFMVTADNMPTVPVDAFLKDIEDIDILN

SEQ ID NO: 3324 - protein, 55 aa, Lactobacillus paracasei
MKKEVRDYIKEENNEIELMLGKFTNLKIIGEGGNGLVYSAEFLGEPVALKILGET

SEQ ID NO: 3325 - protein, 72 aa, Lactobacillus paracasei
MSLDGKVDSTKDKISGKAKEVEGKVTGDKARETQGKAEGILGKAKEKLDDAKDAVKDTVDDVKSKLSTDKKD

SEQ ID NO: 3326 - protein, 39 aa, Lactobacillus paracasei
MSIYLEQFNFSLLKSFKQQKSSRGRIREPQEQRKFFIRK

SEQ ID NO: 3327 - protein, 116 aa, Lactobacillus paracasei
MRVEDTEIDDFKNFEVSIEDVYTDGDLFFISGQASEEAEATINASHHIDDGEYGLPESISYEVSGTSGFRIKLAIDATKIPFKDQASFSRDIMDQMQNCDLKIEETNIEVPPEPLD

SEQ ID NO: 3328 - protein, 155 aa, Lactobacillus paracasei
MKYTKTKAVLNQLVADLSQMSMIIHQTHWYMRGPNFLKLHPLMDEFMEEIDSQLDVISERLIALDGSPYSTLKEMAENTKIQDWPGEWDKTTPERLAHLVDGYRYLEDLYQHGIEVSDVEKDFSTQDIFIGLKTAIEKKIWMIQAELGSAPKIDE

SEQ ID NO: 3329 - protein, 264 aa, Lactobacillus paracasei
  misc_feature (258)..(261): Xaa can be any naturally occurring amino acid
MCRILGVSRAQYYRYRSPKPSKRRAEDAGLKQRILRIFAEFKQRYGVMKIHHELNLELQPLQLRCSPRRISRLMKELNIHSVTVNKWKATSASKTKVEQRPNLLKQGFSTTGLNQKWTADMTYIQTKRNGWCYLSTIMDLHSRRIISYSFSKKMDTDLVLKTPESAVKNRTITGDLIIHTDLGSQYTSDDYNQRLTELHIRHSYSRKGCPYDNAPMESFHASLKKECVYPVPVFEDYETAAAVLFEYVHAFYNRKRIXXXXPGS

SEQ ID NO: 3330 - protein, 207 aa, Lactobacillus paracasei
MKELDIHSVTVNKWKAASASKTKVEQRPNLLKQDFSTTGLNQKWTADMTYIQTKRNGWCYLSTIMDLHSRRIIGYSFSKKMATDLVLKTLESAVKNRTITGDLIIHTDLGSQYTSDNYNQRLTELHIRHSYSRKGCPYDNAPMESFHASLKKECVYPVPVFEDYETAAAVLFEYVHAFYNRKRIHSSLGYQTPLQVEIATLTSQMAA

SEQ ID NO: 3331 - protein, 186 aa, Lactobacillus paracasei
MTKKYVANIVPLNAEGIGTAPHGTATFVEDGDQLHVAIEMFDTPANTQHWEHFHGFPDGKAAQIATMAQDANHDGFVDLPETEPVSGTTMVPFDNAPHHMDVPNDNYPVADAQGHFAYEIDVPLADLQAKFKEVFGTDDLELDKRVIYIHGVPQDLALPATVAGEVGAYDAHVTLPIAVGKIEVAD

SEQ ID NO: 3332 - protein, 48 aa, Lactobacillus paracasei
MTGSSGRYVYFFRLSTEALKTRNRLTIMVPTGEARMFLIQRLLNLDVS

SEQ ID NO: 3333 - protein, 41 aa, Lactobacillus paracasei
MPTRYDKEFKQNIINLYKQGESAAQLAREYGIGYSTVHKWI

SEQ ID NO: 3334 - protein, 288 aa, Lactobacillus paracasei
LSVFGEQDNSALVAAELLIRQQESRLTVNQPHSEIMTINQLAGYDNTEISSGTYALIKNAVLASQKHFGFNALIGPLVKLWKIGFNGANVPSDHDIKSRLLLSNPDNIIMDDALHTVKLVKTGMELDLGGIAKGFIADQIRSIWFAYGIRAGIINLGGNLLFVGESPRRSDGRWIVGIQDPNKGRNIGIGTVIKPACAAVTSGIYERFLIKGGKRYHHLLDPQTGYPLQTQLAAVTVFTRDSLQGELEAKRLFFAGKPIPGWEKDPNNLGAVFIYQNGNTQTVKASIH

SEQ ID NO: 3335 - protein, 227 aa, Lactobacillus paracasei
NADPHDEPENDENTFMNREDCTASEMLHYVGIAGTNIQRSTNLKLLQYMKKHYSEEAVIEIVDISNLPVFYKASQDHIPEAVNVISEKIRKADGVIIATPEYDHAIPAVLSSALAWFSYRIHPFAGKPVMIVGASYGSLGTSRAQAQLRQILDSPELKASIMPSSEFLVGHSLEAFDDSGNLKNLRLGVQLNGLFSDFSVFVKLTKQMIHSQKQAKEQTKNVNWQDN

SEQ ID NO: 3336 - protein, 437 aa, Lactobacillus paracasei
NADPHAZREDCTASEMKIVAIAGSIADISYNRQLLTFIANHYASQIDIELLEIKNIPMFNEDKDQTQSAAVQFLVHKIESADGVILATPEHNHTTSPAMKNVIEWLSYKVHPLNQKPVLIVGASWHTQGSSRAQLALRQIMESPGVGALVMPGDEFLLADAKKAFDELGNLKDSKTIAFLDTVINKFIRWINVLDALQEKKKQEPWRQEDLAGKHPVETSIDIDISDDWVEKAAKLVKATSGNHYVQLNRGVLTVDQLNWFLNSMPVELTFMDDNDQFIYYNHFLDHDAMLAPRDPKQVGNTADLVHPKRAVEHVQQVIWALRQGQKELIAMPVPGNKINQKYIMHFYKAMHDADGRYRGVNEWVLDIWPIVSDYLKRTGQKLIKDPDSKPDATTSASQSEPQRVLSSRVEGKDVQTINDMKTSTADAVTGASETTK

SEQ ID NO: 3337 - protein, 142 aa, Lactobacillus paracasei
MIIGDNDQIAITETLMKESITMDQKFLDVMKHEGPATIVTINAQPAHVVNTWMSYVQVTDKQLLIPAAGMHSIEQDFSTDNHVIITVGSKEVEGTQGPGAGFHVYGTGQFLTSGDDFDTMKKKFPWITRVLKVDIDKIEQKI

SEQ ID NO: 3338 - protein, 58 aa, Lactobacillus paracasei
LKAIVIDQPGGPEQLKLKDVPTPQTKPGWSLIKIKGFDEFSNQVQLFVPKDFGGSSPA

SEQ ID NO: 3339 - protein, 70 aa, Lactobacillus paracasei
LSPYNHLTLIDRETILVGLKTGLAQTEITTQIGRSRSTVSREIKHNGGWQNYSAAAAQANYKHERLNSHR

SEQ ID NO: 3340 - protein, 128 aa, Lactobacillus paracasei
MDFELRKHRDYTASYHFLKHLLTTNGRPDRLVTDQYRATLKAVKHLIKQDYLSKSAHQCSKYRNNLIEQDHRFIKRHRVRSASFQSIRTASATLSGVEIVHAIRKRTRRELSLIGFSVVDELEALLAA

SEQ ID NO: 3341 - protein, 457 aa, Lactobacillus paracasei
MHSPTIKHRGAFVATLLTGTFSMSISQSSLSTAYPAFMKAFGLGADTVAWLTTGFMLVMTLMIPVSPWLLHNVPFQRLFQAIELIFAIGTGLCIWAPSFTVLMIGRLLEAIAVGIIFPSFQTVLLTITPHSERGRVMGTAGLVMGSALAVGPIISGVLLTWFPWQALFLFFLVVSLLVLAVSTVTIASVMPLQPTQLDWVSFFLSASFPILLYALGALSKKGLTVGVVSLLILGVLAAGIFVVRQLNRQPPMLQMRVFATGMFTKAVFLTGISYVGLIVTTILMPLYFQTLLGLSPLISGLSLVPAAVLLSILNPISGRLLDRFGPRVVAMIGMLLITGGFGLLAVFAHHLPLIGAIMLAMATEAGNAFVMMPSVTAGANALPNELVADGTAVTTTARQLFGSAGVMFATVLLDGMQTTLRSHAGGFAVTFAVFAGVGLIGLLLALTLPKEVAKKAA

SEQ ID NO: 3342 - protein, 509 aa, Lactobacillus paracasei
MKTYTDYFFDEPAFDLHDGGYVPLEVSDAPEKPLNVPPLLKPDKETATDVYYTVTAEAGETQLLPGAKTKTWGYNTSLLGQTIVYRRGQHTHVTLKNTLPELTTFHWHGANVSGPYVDGGCHAPVYPGESKHIDFTLEQPATTLWLHAHPCPSTAEQVWHGLAAMVIVKDDHEASLPLPRNYGVDDIPVILQDRRFHENNQWDYRADYDPDGVAGPTAMINGTINPYFDVTTQKVRLRFLDGANRREWRLHFSDDLPFTQIGGDGSLLPKPVKFTHLMLTCAERAEVIVDFGQYHEGDEVTLYTDDVPLLKFRIHAFKPDQTTLPDKLFDVKAPVVDPALPVRHVVMQGMDEGVAIDGKKFAMQRIDATQPIGKAQYWDVTNSNDAPGMVHPFHVHGTQFLVLSRNGHAPYPNEHGFKDTVGVNPGETVRLLVRFDLPGVYMYHCHIIEHEDGGMMAQIETFDPAKPKQEYKLMDMDTLMMALAKERGVKPSEIWMGGMQSYEKMGMKM

SEQ ID NO: 3343 - protein, 63 aa, Lactobacillus paracasei
MQQMSKTMGWLMLALNVVLLILIGTMHNMAAMWLMGLIMTLDAVTGLVTAYRPQSSQQHAHQH

SEQ ID NO: 3344 - protein, 212 aa, Lactobacillus paracasei
MQQLSMTQKQTMTSALRVEYFSTAWMAFEFIVGFWSGMQAGSILLIAFGLDSFLEIISGSALIWRLKKEANGAPSAEVAQAEQRSSLIVGSVLLLLSLYVIGVSGYNLVTHAAADTSYSGMAIAIASVFLMPVLTIKKRHLGEKLTSPALIEDGMCNITCAYMAATVLLGSLLTWLFNWWWADSVAALVLVYFVASEGWEALQTGLGHGDDA

SEQ ID NO: 3345 - protein, 110 aa, Lactobacillus paracasei
MDTDTLELVTTAKLTEAERIFKLLSNPIRLQMLKLLEQRELNVGTIGDLLGLEQSVVSHQLALLRKHQLVSAKRVGKANFYRLDDPHIITVIDAMLAHADHVARGKRHGE

SEQ ID NO: 3346 - protein, 313 aa, Lactobacillus paracasei
MKKILISVVAVLTMVAGVFWFVNNRSTTQKDSASTNQQLRVVTTNSILEDMVHNVGGDRIELYSIVKRGTDPHEYEPRPTDVAATSEADVVFHNGLNLETGGNGWFKKLVQTSHKAFNKDVFAASDGVNPMYLTTNTKEQDPHAWLDLANGIQYVKTITKVLKQKDAKNANYYQMNADQYVAKLQKLHQTAQSQFLDIPERQRLLVTSEGAFKYFSKAYHVTPAYIWEINTEAQGTPEQMQTVLAKIRASDVKHLFVESSVSPKSMNKVAKETGLSIHAKIFTDSLAAKGTKGDTYYSMMKWNLDKIHDGLAE

SEQ ID NO: 3347 - protein, 298 aa, Lactobacillus paracasei
MTSIMEFFTALGKYDFLQSALITAIMVGIMSGLIGSFIILRGMSLMGDAISHAVLPGVAVAYMLGINVMIGASVFGIIAALLIGFVAANSKIKTDTSIGVVFSAFYALGFILISMAESATNLHHILFGNILAVSDSDIVTTAVVLGIVILFVVLFYKELLITSFDNTFAKTYGLNTTMIHYALMLVLTLVTVSALQTVGIILVVAMLITPAATAFLWTDRLETMLITSASVGVFSAITGLYFSFTFNWASGPAIVLVAAVLFAISFVFSPKQAFFSFSKKQREKKTAAATHTAEEAVR

SEQ ID NO: 3348 - protein, 247 aa, Lactobacillus paracasei
MLTVKDLTVAYADTPVFADVAVHFNAGKITGIIGPNGAGKSTLIKAILGLIKVQSGTVDFSGRTLKEVQQSIAYVEQRKDLDLTFPINVQDLVLTGTYGRLGLLKSPGKKERQAALDALTQVGLEDFKKRQISQLSGGQLQRVFVARAIVQHAEIIIMDEPFVGIDMKSEQEIMTILNQWRDAGKTLIVVHHDLNKVSKYFDELVVMNHGIVAEGPVKEVYTAQNIERAFSADLSSVLFTAKEGARV

SEQ ID NO: 3349 - protein, 488 aa, Lactobacillus paracasei
MAELQSTHYQMYINGKFMDSASGDVETVIDPSTGKKLWTAPAATIEEARAAVDAAWAAKNAWRRVPAPTRGAYLRKLAALVREHEDELVKILMLEQGKIHALAKTEIEFSADYFDYMANAARVYSGDVMQSDNENENIIIARQPIGVAVGIIAWNFPFFLIARKMGPALVTGNTIVIKPSSDTPGLALAFAKLVDEVGLPAGVANFVSGRGSIIGDDLAKNPKVGIISLTGSTASGKKVMAAAANHVAKMSLELGGKAPAIVAKDADIDLAVQAIFDSRIDNNGQICNNAERIYVQEDVADEFIKKMTAKMAAVKVGNPNTDPDAEMGPLINQGALDKVDGLVQRAVEAGGQIQTGGHPADIDGGFFYEPTVITNVAQDSEIVQNEIFGPVLPILTFKSIPEAIEMANDTVYGLTSSVYTRDLETASYVANEIEFGETYINRFNFEGIQGFHAGWKQSGVGGADGIHGVEEFTNTHVIYLQRHPENLK

SEQ ID NO: 3350 - protein, 89 aa, Lactobacillus paracasei
LAKKSKIAKAKRQEKLVQQYAAKRAALKAKGDYIGLSKLPRDSSPVRLHHRDVLDGRPHAYMRKFGMSRLNFRELAHKGQIPGVRKASW

SEQ ID NO: 3351 - protein, 305 aa, Lactobacillus paracasei
MMKRLLAGISVALLAIFAVACGSNGAAKQSSSNGSKIQVVASLDFYGEVAKAVGGNKVSVQSIINNPAVDPHDYEPTTKVGKSVASADLVVASGIGYDGWMDKVVKSADKSKNYLRVADDLMNKKEGDNEHIWYDPRTMPKLANTLADKFAKKDPADKATFKANAKKYIASLDNLNTLINKLKSKVNGQLVDVSEPVFGYALDYLGYKVNDDHFSKSTEDGTDYSAKDIHGIETDIKEKKIAFFVNNIQASSKTVNQLVKLAEQNNVPVLKVTETLPKGKNYRTWMTSQYQQLEKIQDQATNSAK

SEQ ID NO: 3352 - protein, 209 aa, Lactobacillus paracasei
MILGAHGQIATLARHQLLKETDHHLSLFLRNAGRLQDVNPQRETVIDGDVTDTAKLTKALAGIDVVYANLGNKGIEDQAKSVVKAMDAAGVSRLIWISTLGIYDEVPGAFGKWNHQMLDGGYLETYAAAAKVIENSDLKYTIIRPAWLSNKNIVSYELTEKGEPFKGTEVSRRSIADFVVKLINDPSKHIGASLGVDQPNTQGDKPSFY

SEQ ID NO: 3353 - protein, 49 aa, Lactobacillus paracasei
MAIITLVERSQIELMQHHTIQYIAATLAVLVFLLGMNFTVALKVITTPL

SEQ ID NO: 3354 - protein, 277 aa, Lactobacillus paracasei
LQFEFNPMQMMVTAGASFVGSGVVKFNPAMKAYVGAGTGDLINTMITASIAVLVLMWVKDKFGSTAVVAMPILVGCGVAYIGVLLLPFIAAFTAAIGDVINSFTTLQPIFMAILICCSFATIIISPISTVAIGLAIQLNGVSAGAAAMGVAATALALVVYSWTVNKSGVTLAIALGAMKLMMPNLFKYPIILVPCLFTAIISAIPVALLSISGTPQSSGFGIVGLVGPLASMEAGLAIPLVVLCWIVIPVAAALLSKLLFEKMLKLFDSNVVFKFQG

SEQ ID NO: 3355 - protein, 103 aa, Lactobacillus paracasei
MKASDIPSSKTVQAHILANKIKHGWNTTDTNFEMLLAYHEMAELTTALLKDDHANIAEELADVTIYLLGIAEMTDVDLAQAVHKKVAINDHRVYDAQGHKHLE

SEQ ID NO: 3356 - protein, 567 aa, Lactobacillus paracasei
MSFDGIFTHAMANELNATLSGGRVAKIQQPYENEVVITIRAGRKNHPLLLSANPQYARVQITHIPFTNPDVPATFTMTLRKYFNAATLTAVHQVQNDRVLHFEFSTRDELGDELGLRLIIEMMGRHSNIFLVSERTGKIIDLIRHVSADQNRYRPLMPGAPYVEPPKQDKTDPFHDPDRRYHALEREVTPALSRAALLQQHYQGLAKDSATELALRLNQGDAGWDGFFAALATPVPTITAQGKKAVFTAIPYLSLTGEQSQYPTLSTMLDAYYEQKAEHDRVLQQGGNLIHVIKNVLDKDRKKQRKLQRTLEETEKADDYRIRGEVLTTYLSQVERGMTSIELPNFYDDNRPIKITLSNQLTPSRNAQKYFAKYTKLRNAVAHVHQQMQENQEEIDYLEGIMAQIDVASPKDLADIRLELQQQGYLRKQKTNKKGAKRQKVAKPDQFYASDGTKIWVGKNNLQNDQLTLHTAKKTDIWLHVKDIPGSHVIIDSHQPSEKTLLEAAKLAAYFSKARDSANVPVDWIEVKKIRKPNGAKPGFVVYEGQKTVAVTPDVELVDKLRNPPTK

SEQ ID NO: 3357 - protein, 288 aa, Lactobacillus paracasei
MKIAIVTDSTCYLPQAEIDKHHITVVPIPVILDGAVYDEGKDITTEEFYAKLKTAKTFPSTTQPPLGEMLKLYENLANEGYDTIISIHLASTISGFVNTLKGAVDEVQGAKVYVYDSQITVILMGWLVLAAAQMAEAGDDPEAILARLDNLRTTMGEYFIVNDLQNLVRGGRLSNASAFIGGMLKIKPLLTFDDQSHKIVAIEKIRSIKKAYSRVETLFQEELDRVDYPVRAVVIHANDPDEANRWLADLQQKFPTVPFELSYFGPVVGTHLGEKAIALAWMKDFTKA

SEQ ID NO: 3358 - protein, 186 aa, Lactobacillus paracasei
MFFDQPLAKGKILSETPHYHGPIFDVVTQHIKTPDGLTVERDLIRHANAVAMLAMTDDGRALVNREYRVAVNSEVFGLPAGLMDPGEDWQTAASRELREETGYVTHDLQWMTAIRSSEGMTDETVNLVLAHLDLVDKTKQDFDQDEFVTSRLVPFSELVAGVKAGKIRSAQTVSAVTYYLAFIAKD

SEQ ID NO: 3359 - protein, 365 aa, Lactobacillus paracasei
MLRKSVAKLPDYVSDSTPERLAKAAGLAKLTRLSFNENPVGTSPKVKEALANWAFSQGRNYPDPDALPLRTAVAERLHVNPDQLLFSSGLDEMIALICRTFLEVGDESLQPWPTYPEYQLQAAIAGATTVNAAVTPATGLIDLDDLAAHITAKTKVIWLCNPNNPTGTYLPISQIAQFMKRVPADVLVVVDEAYIDFVADVPNPSALSLVTQFNNLLVMRTFSKLYGLANFRVGFSIVPQHVIAKMQNVRLPYNISGISQTAALAAWQDQAFTQTVKQQLLTARQQWSAFFEANHIQHYASQTNFMLYQVADPQALGAFLKQHGYLVRDSMVPGWIRQSFGTPAQDAEMRQLLLTFLKTDTEIPN

SEQ ID NO: 3360 - protein, 382 aa, Lactobacillus paracasei
MSNRHLPIGTRDEFGPRAIRKENLIQTISQQFIQAGFERVKTPLLEYRDVFKPLAVSGEQPYQMLDDAGESVVMRPDLTLPLARLLSTTSIVPPVQWWYVGDIFRVKKSLSGTYNQITQAGIELIGYRSLKAEWACLSEAGKICRTLGLTHLTLELSDAQFVPQILRTLQLNDAAADAFQTAFFAKELSTYQDLIAPLATNPLYPFLQQWPWLFGDSETIFAELKRLLPSNVITDRLAPLQQTVAFLKDQFPELRVTIDLTSRPPQSYYTGIFFHAYVDGGHQYLFSGGRYDKLLASFQQELLPAVGLAFDIDAVTDQLPNAPDQPLTFVYGLPSQWQAAAAMVATTPNARLCLVDTLAEAQAAATKQHANLIDLSPKEAIL

SEQ ID NO: 3361 - protein, 211 aa, Lactobacillus paracasei
MTLTIALTKGRTETQVLPLLAAAGIHCEAIQAKSRRLIFADDPNFHFILVKAPDVLTYLNHGTVDIGIVGSDILAEQGHRQFDMLDLNTGRCRFILASTADFDPKQTKRKLIATKYPHIAQQYFQKQGEDVEIIKIEGSVELAPLTGMADAIVDITETGTTLRENHLKVFAELAPVSTHLVVNRLALKQKRTEIYQLIQSLQKVRPQEASL

SEQ ID NO: 3362 - protein, 430 aa, Lactobacillus paracasei
MKILTGTLSQLKQQVDIRRTAVAQNTDVQTIVQAIIAKVRAEGDSALRTYSNKLDHVTVNDFQVDQALIDAAPAQLPAKLLKALQLAKANITSYHQNEIERGFVDTPNPGIIRGQKITPLAAVGLYVPGGTAAYPSTILMTAIPAKLAGVKKIVMVTPPQPDGLNPVVLAAASLAGVDAIYQVGGAQAIAALAYGTESIPRVDKIMGPGNRYVAEAKKQVFGNVAIDMIAGPSEIGIIADESADPIRLAADLLSQAEHDPNARAMMVTPSEKLASAVSEQIDIQLPTLPRESIARAAIENQGFIAIVATINDAFSLMNTIAPEHLEVQLPDPITYLAQIQNAGSVFLGQNAAEPVGDYVAGPNHVLPTAGSARFFSPLGVYDFVKRTQFIQYSSEALASQADAIVTLAQAEGLDGHAEAIIKRVPAAKEV

SEQ ID NO: 3363 - protein, 194 aa, Lactobacillus paracasei
MRTATITRTTKETTITISLNLDQQSGIQIATGIGFFDHMLDAFAKHGRFGLTVDAQGDLDVDPHHTIEDTGIVLGECFKQALGDKAGIERFGSAFVPMDESLARAVVDLSGRAYLVFDAELTNQRLGGFDTEVTEDFFQAVAFAGEFNLHASVLYGRNTHHKIEALFKALGRSLRAAVAINPEVQGIPSTKGVI

SEQ ID NO: 3364 - protein, 208 aa, Lactobacillus paracasei
MIVIVDYDTGNTRNVKKALDYLGVNNQLSADPAIIMAASGLILPGVGAFKEAMKALNQRQLVPVIQAFAATGKPLLGICLGMQLLFDRSFEFGETAGLGLIPGEVVAIPTDSGLAVPHMGWNTNSLTQPDLFAAVFADQATYFVHSFCATTLPQFTLATTDYGQPLTSIVRRNNVLGTQFHPEKSGAIGLAGLKKFKEMTEDEALSRD

SEQ ID NO: 3365 - protein, 238 aa, Lactobacillus paracasei
MKLYPAIDLLNGKSVRLTQGDYDQVSLTEDPLYQAQRLTDAGFAHLHLVDLDGARAQRPINRTVITRIREQTSAFIELGGGIRTLAAMEIYLTIGIDRLILGSAAVSDPDLVEQAIARFGSNRIAVGIDTRAGKVATNGWLTTSQQTANALLTAMQQRGVTTFIVTDIAKDGMMQGPNAQLLADLQQAMPQATIIASGGISSLADLHRLQTAGIQAAIIGKAWQTGATELAMLKQMEG

SEQ ID NO: 3366 - protein, 252 aa, Lactobacillus paracasei
MLTKRIIPCLDVDHGRVKKGINFVQLKDVGDPVAIAKAYQEQGADELVFLDITATNEARGTLVQTVEAVANQVFMPLTVGGGIQSVADMHALLRAGADKVSLNSAAVADPSLLTAGAEKFGRQAIVAAIDTRWQADQNRYQVTVNGGRTPVDLDAITWAKQAVAAGAGELLVTSMDADGTESGFDLRLYQQLTAAVQVPIIASGGAGSTTDFVQLFTQTTVSAGLAASIFHFGELTVPQVKTALKQAKVAVR

SEQ ID NO: 3367 - protein, 110 aa, Lactobacillus paracasei
MITLDWEKANGLITTVVQDATTKQVLMVAYMNQESLAKTMATGETWFWSRSRKTLWHKGATSGNIQTVKTIAVDCDADTLLVTVDPAGPACHTGHISCFYRHYPEGKDLT

SEQ ID NO: 3368 - protein, 110 aa, Lactobacillus paracasei
MTQAKQSIPALYDFIKERQANPVAGSYTDYLFTKGLDKILKKVGEESTEVIVAAKNPDDPAFILEVADLTYHVLVLMVERGITVDQIATELASREGKKSRLQERSKIEKY

SEQ ID NO: 3369 - protein, 363 aa, Lactobacillus paracasei
MLKHTVTHLQPYIPEKPLADLAQERALPHIVRMSANENPFGTSDKVQTAIKNWDFTQSRDYPDGNASRLRSAVAAELGVTESQLVFGNGLDEIIELIARTFLEAGDEVVEPWPTFSEYQLHAQIEGAKVVNVPVQATTGAFDLEALAQAITPKTKLLWLCNPNNPTGTLLSLTELEQFLQQVPPSVLVLIDEAYIEFTDDYPATSALKLLPSFANLVVLRTFSKIYGLANFRVGFAVVPEQLAATMQTVRLPYNLSSVAQLAAFTALGDQTFVQTARGQVRQAREDWERFLTKAGLPHYQSQTNFQFFQAPQKQATALKEQLLNHGFLVRDGLKPGWLRITFGTTAQNIAVQQIMTAFQQAKK

SEQ ID NO: 3370 - protein, 211 aa, Lactobacillus paracasei
MLENNNFDEVVLKRHTAREFDPEITISKGELLQMITYATKAPSALNMQPTRFVVAQSNAAKEKIAAVAGTNAPEILSASAVVLIGGETDLGPFEEDLFKRAEAAGLLTDRAIEHQKPMIENLVATFKENQQALREFIIQNSSLAAMSFMLAARAYGYETGAMTGFDHEKIIPALDLDPNHFLPTLLIAVGKPKSAPDSLYRIPASKITVFK

SEQ ID NO: 3371 - protein, 148 aa, Lactobacillus paracasei
GNATFAMILYPRTEINLPYTIKINAPLSVQQVHDLYQQTHFNKPINDPTRLQTMIDETPLVLSMWDGAKLIGFARCLTDFEYCCYLSDLLILPAYEGHHLGRQLMTTLQAYIGPRVTLSLKAADSAIGFYERIGLPKADNMFRIGREG

SEQ ID NO: 3372 - protein, 147 aa, Lactobacillus paracasei
GNATFAMILYPRTEINMIKIATDQPITADQFIHVLTASGIKRPTEDRGRMQRMLNNANVLLTAWDDEQLIGVLRGVSDRSYCTFVSELAVSKDYQHQGIATKLLHQLWTMQGPNISIMLLSAPSAMTFYPKVGFEPVPTGFKVQRRY

SEQ ID NO: 3373 - protein, 354 aa, Lactobacillus paracasei
MTYVSLATALPAILISLTAGVLADRYNRKMLIVLSAAVVTLLTLLVASIFAFMTQDLWLLLVIAVIRSFGNGLENPAANALLPQLVPAKHLTRVNGYNQILMAAMLVMSPLLAGYILSDLGIFWIFVVDALSAALAILFLSVVHVPTPSASHDRAAKRADGILAGLQYVRRTPILLAFMLFTGLAFILVAPSSQLSTLYVNRTFGSEVWHLTFNEWFWTIGAGLGGLYIARHKHFRDQLGLIAIGFAGSGLAFAEMGLPQSFSFYLLFMFVSGIFYPLIQAGQTIYLQENVPADKLGRVFSLWAILSTGIYPLAMLVYGPLADQVPIGRIFVVTGLLLIGVAYWFWHRLRKLSW

SEQ ID NO: 3374 - protein, 230 aa, Lactobacillus paracasei
MTQKIFIVEDDAVIAKTISDYLNRWAFAVSTVTKFDQVDAEISAAAPDLVIMDISLPYFNGFHWLSELRKHSKVPVIFLTSSGDDMNLVMAMNLGADDFLAKPIELPVLLAKIQGMLRRTYQYQQIDTNLSHGAFTLVPTDNQLKTAKQVVALTPTETKLLSLLFSADGEVVSREAMIEKLWEGDDFIDRNALAVNMNRLRKKVTSIGLAQLIETVKGKGYRLASEGTKP

SEQ ID NO: 3375 - protein, 318 aa, Lactobacillus paracasei
MMKAYCRSRWAIWLLLATLLATGFLASWLLANSFEIVLNMWFFATAPLAVIVSIDYWRFRREWQQLQDDHPIDPVQITDPLSLAYYQKIQTLTQKLRTTRDTAHEQEQETLDTLQLWTHQIKTPLTALDLLLQVEPVNAKDARLEISKIDRYLAVMLNYLKLTTLNTDLVLTELPLKPLVNETVRDLAKLFIAKDLTVTVGPLPTVISDSQWLHFIFEQLLTNAIKYTPHGSIKIYAKGDAVMVADTGIGILAEDLPRIFEQGYSGYNGRANQKASGLGLFLSKQIAEKLGLTLTVTSEIGQGSTFAIHFPQTRWQVE

SEQ ID NO: 3376 - protein, 256 aa, Lactobacillus paracasei
MSTLLKLKNIEKTYTSRGAQPVRALTNISFTVEAGEFVAIMGESGSGKSTLLNLIATLDDPTGGDISLNGQDLSNVKEGARAKFRREHLGFIFQDFDLLDTFNVQDNIFLPLVLAKKPLEIMRNRLTKLAPRLGIDALLKKYPYELSGGQQQRVAAARAMITEPEILLADEPTGALDSKTSTELLDLLTDVNAENRQTILMVTHSAVAASHSRRVLFIRDGQIFHQLYRGDLDQPAFLTRISETMTAMLTKAGDGQ

SEQ ID NO: 3377 - protein, 663 aa, Lactobacillus paracasei
MKFYFKLAASNLKADRRLFVPFVTTTSFLMAVNLIMLNAYASSDVLFKKLGAAAGKSLFMFGTDVIVIISVILAIYANNFLRKQRIRQLGLYNIIGFGKGELGKMMAVEKLLLLLTTLLFGGILGTVLSRISYLALAKMLKVDHNLDFGLSQQAFSIAGIITIGLFVVLLLVDELWLIRKRPIEIVRAQRAGEREPKTKWVTLIVSLIALIAGYYIAVTTTNPLQAMSMFFVAVILVICGTYGLFTAGSVFVLKWLRNRKNYYYKPKHFINVANLLYRMQQNGAGLASIAILVTMTLITLASTATLFFGINEVVNTNTPVDLSYVLKANDTTAPGKVARMASANHVIIKSQHTFVGPSSTMALLDGNRLESQANVNGPFSMGNARSVQLMTIESYNRFTGHHARVKSGEVLIYTSKNFPSKTIRIGQKTYRIGKRAGSFPNAQATFIPNLFIAFPEEKQMIDAMQHLRNARYQNAAEAQADITTSQDVMLQGSHANQLKLYEAVVKSRIAESASVQSKAVNYDETMSIMGSFLFLGIIFGVTFILATLLILYYKQLSEGYADARRYTILQRVGLSLREVRATINSQLLMLFYLPLLVAGIHVGFALPFIQRIMILFGLPNWQFFLTVSLITLGIFAIIYVLMYKLTGNVYYRIVSRRQATSRS

SEQ ID NO: 3378 - protein, 117 aa, Lactobacillus paracasei
VLDVKDSVNRLAWTTEHHFLHIQARHDFMRAWAVQFEMAYTDFRVIQMALQLGGEQYHDLLKRFAAAYEAVYAYEYAFAAGGLAGFDEQFADKMADYQTAEQTLLKIIDEIKALQPA

SEQ ID NO: 3379 - protein, 370 aa, Lactobacillus paracasei
VSTQNYSKLIHTMLPALPDYIQDYYQSQKAIPIADSTLYQYLHFYQEFLNWLINSGVTAASSTQTVPLTVLEHLSLRDAQAFIAYLLERPSKTHHNKRMTRRSVALRLVGIKALYRFLTEESEPHADGEPYFYRNVWNKVKLKTHTETASYRNHKLQEMLFVDGEDAKFLQWLDQSYAQQLPAKPRRYFEATKVRNLAMIALLFGSGVRVSELVNMNLEDLNMDRHTVQVVRKGNFQDRVNFADWIDPYVQAYLTQRAAIIGYQKPTSPLFVTVVGQKINRIRQNTIEAFFKRYTTDYGRPSTPHKARHTLGTNIYTVTKDVQQVADQLGQTTTSATDLYINLSDKSGKEALREVSETAAKATDRGHEQA

SEQ ID NO: 3380 - protein, 310 aa, Lactobacillus paracasei
MTTLIFGHQNPDTDAITSAMSWAEFQKQAGNTDVEAVALGEPNDETKFVLDHFKVQAPRVIKTAANETDHVMLVDHNEFQQSVSDIEDVTIDSVVDHHRIANFHTAAPLFYRAEPVGSTNTVIFEMFQEYGFKISPTLAGLMASGLISDTLLLKSPTATDKDKKILPEMAKIAGIDLQSYGLAMLKAGTNLAAKSDMDIIEGDAKSFTMGGKSIRIGQVNTVDLNDIYARQDELISAMTKEAQAKGYDDFLLIATDILDSNSTGFAVGADRDKIASAFNEQFDKDARLALPGVVSRKKQVVPPMQSTFEG

SEQ ID NO: 3381 - protein, 322 aa, Lactobacillus paracasei
MKTKQERIFSSKTLTYFLQLAETMNYTQAAQLLGITQPALTQQIKKLERTVGAPLFYSVGKKLHLSDAGQTMLKSTHEIYEILNQTTDEIQQTTSATVGKINIGLLSSIEDSAFIAFIAHYYQLNPEVEVTLRMMTRHEIWESLENNQIDLAIMNLPDETIKNWKPYASKKIIDEQLLFLHHDDALANRKRIHFKDTLAEPWATYPDDYFLGQLLREAYKNQMVDFPHVVAHFTTPYQLTQFVNLSGVNTALPTSFVRARADQIKAYAIAFDPAIRFEISFVYRKEKADIPRISNFFQTFDDYLKEKDYLSRVSENRVKLDK

SEQ ID NO: 3382 - protein, 283 aa, Lactobacillus paracasei
MKLIDQSQSPLNILEQVGQDHDGPIKGYVHSVESFGSVDGPGIRFVVFMQGCRMRCQYCHNPDTWNIGVGEEMTADQILADAQRYKAFWGDQGGITCSGGESLVQIDFILELFTKAKALGISTCLDTSGGPFTRDQPWFGQFEKLMAVTDISLVDIKHIDSAEHKKLTGFPNENILDMVQYMSAHGDDMWIRHVLVPERTDFDPYLKRLGDYIATLDKNVVQKVEILPYHTLGVKKYHELGITYPLEGIEPPSADRVKNAENLLHVKDYTGWQSWRPKPVASN

SEQ ID NO: 3383 - protein, 753 aa, Lactobacillus paracasei
MKQLDETKVPNYWEGFNGGDWQEEINVRDFIEHNLNQYDGDESFLAGPTEATTVLNNQVLNLKKQERANGGVLDADNNIPSTITSHGPGYLNKDLEKIVGVQTDKPFKRAFMPFGGIRMAEDALESYGFKTDPQEHKIFNEYRKTHNQGVFDAYTPDMRKARHYKIVTGLPDAYGRGRIVSDFPRIAVYGIDRLMAEKFKDYNLTGDGEMTDDVIKLREEINEQYRALNDMKKMAKEYGYDISRPAANAQEAVQWIYFGYLAAVKTQNGAAMSVGRIDTVIDAYIQRDMRLGKLNEEQAQELIDHLVMKLRMVRFIRTEEYNSLFSGDPIWATLSLAGMGNDGRHHVTKTAFRFLKTLDNMGAAPEPNITLLWSERLPEGFKRYATEVSIQSSTIQYENDDLMRNEWGTDYYGIACCVSAQPIADGVQYFGARANLAKTVLYAINGGKDEIQEAQVGPEYAPITSDYIDYKEFMNKFDKMMDWLADTYVNALNVIHYMHDKYYYEAAQLALKDTQLNRTFATGISGLSHAVDSISAIKYGHVKAIRDENGVAVDFVADNDDYPRYGNNDDRADDIAKWLVKTFYNKMNTHHLYRGAKLSTSVLTITSNVVYGKNTGTTPNGRQKGEPFSPGANPAYGAEKNGALASLMSTAKIPYHYATDGISNTFGVTPNTLGHDDETRKDTLVHMVDGYMENSGMHLNINVFNKETLIDAQKHPEEYPTLTVRVSGYCVYFADLTKEQQDDVIARTFFEEM

SEQ ID NO: 3384 - protein, 814 aa, Lactobacillus paracasei
LANQIQELTLEEVMGDRFGRYSKYIIQERALPDVRDGLKPVQRRILFAMNQDGNTYDKGFRKSAKSVGNVMGNYHPHGDSSIYEAMVRLSQDWKLRAPLIQMHGNNGSMDGDPPAAMRYTEARLSKISKEMLADIDKETVDMVLNFDDTAQEPTVLPAGFPNLLVNGATGISAGYATEIPPHNLREVIAAVLYLLKHPTADLDTLMQYVKGPDFPTGGIIQGLDGIKQAYETGRGKIVVRSRTHIETIRGGREKIVVTEIPYDVNKAQMIKKIDELRINKKVDGIAEVRDESDRFGLSVVIELKKEADAHGILNYLFKNTDLQIAYNFNMVAIADMQPKLLGLKAMLEAYVEHRRDVVTRRTRFDLNKAAARQHIVEGLIKMLSILDQVIAAIRASKDKGDAKRNLVKKFDFSEAQAEAIVSLQLYRLTNTDITALQKEAAQLAKAIAEYQDILARPAARDRVIEGELKRIAKEYGDDRRSSIQAKIETLEVATTVTVADETVMVQVSRDGYVKRSSLRSYQAVDPADNGLKANDLAIFTGELSTLQHLYIVTNAGNVIYRPVHEISDARWKDTGEHLSQTVGLGTDEKVLAVFAFDQLDGAGSFVLGSSDGYIKQTALSDLQPQRTYKSKPMMAMKLKDPAAIVTNAYFTTDQQQDVFVVSRHAYGLTFPLNDVSTVGARATGVKSMDLKPDDEVVNFILVKDPTTAKVGILTQRGAFKKMALSEVGEMSRARRGLLVLRELKRDPHRIVAMMSVDDATRLNVLTDTGKVTTLNPAQHPAGDRYSNGSFVIDTDVLGKPVFVQTKEEPADQVE

SEQ ID NO: 3385 - protein, 670 aa, Lactobacillus paracasei
MDKATQAYNDSSIQVLHGLEAVRKRPGMYIGSTDGRGLHHLVYEIVDNSVDEALAGFGDEINVTIHADNSVTVQDHGRGMPTGMHPSGKPTIEVILTVLHAGGKFNQNSYKTSGGLHGVGSSVVNALSESLTVRVVRDKHAFEEHFINGGHPDGSLQKLGKVNEPNGTTITFKPDPTIFQTTVFSYDTLAERLRESAFLLKNITINLTDERTGKHDSYHYPDGLVSFVKYLNEGKDALSQVINFEGKKDGIVVDFAGQYNDGYSENLISFVNNVRTGDGGTHEIGLRSGMTRAFNEFARKVGLLKERDKNLEGSDVREGFAGILSVRIPEEILQFEGQTKGKLGTPQARTVVDGIVYDKLSTFLMENGEESQELVRKAVKARDAREAARKARDDSRTGRKRKKDQGLLSGKLTPAQTKNPKRNELYLVEGDSAGGSAKQGRDRKFQAILPLRGKVLNTQKAKLQDIVKNEEINTMIYTIGAGVGADFDLQQANYDKIIIMTDADTDGAHIQILLLTFFYRYMRPLIDAGRIYIALPPLYRLQKGAGAKTKISYAWTDEELAKETKAMGKGYTLTRFKGLGEMNADQLWETTMNPETRTLIRVRIDDAQLAERRVTTLMGDRVEPRREWIEHNVKFDMDDDGSILETPTANHEKLQFGAKQIVKQLDKKGK

SEQ ID NO: 3386 - protein, 90 aa, Lactobacillus paracasei
MVLMPKRAHQPRNLRVRTLGTMVKAQPSRPRPLTLRLLTAPARALLKRVHQPRNLHIRTLGTMVKAQPSHPRPLMLRFLIGMARALIFYF

SEQ ID NO: 3387 - protein, 207 aa, Lactobacillus paracasei
LILVLCFILAYFIGAIPFGVVIGKLFYHTDIRKGGSHNIGTTNAYRMLGPVGGSIVLVLDILKGTLAASLPILFGIEHHWLVLIVGLAAVFGHTFSIYIRFKGGKAVATSAGILLAYNPPFFVIAFAIWFSLILLTSMVSVASTLGMVLITAWSLVYHDWLLTTVACGLLVVFLIKHRANFKRIKAGDENMVPFGLGQYLRQHRGRS

SEQ ID NO: 3388 - protein, 292 aa, Lactobacillus paracasei
MVTIANDFLTVKISRHGAELTSIKDNLTGRERLWQADPAVWGRHAPVLFPIVGALADNQYHYAGKTYHMGQHGFARDRDFTVLSATPFKASFVLKDDDKTRAMYPFAFRLIITFALENNNLHVTYHVDNPDKSEPLFFSIGGHPGFKVPMTPDTQFSDYYLNFKPRKSLVQIPLVAGEGIDYTHRTLAATDANLALTHETFDHDALIFALLGKTTFNLVSDKTKHGVSVTMTDTPYLGVWSPYPTTGDFVCIEPWWGIADTIGSTGDLTRKLGINRLEPGTAFEKGYMISIF

SEQ ID NO: 3389 - protein, 469 aa, Lactobacillus paracasei
MAEVQTPKQIVEKLDQYVIGQDDAKRAVAVALYNRYRRMQLSPKMQEEITPKNLLMIGPTGVGKTEIARRLAKIVEAPFVKVEATKFTEVGYVGRDVESMVRDLAETAVAMEEEKQFSKVRIRAEKEANKRLVKILVPAIRKEKNTNPMAEMMSMLQGMQNGKMPAGDDADAGGEVTDDIRNKRLSVAEQLEKGLLEDHEITVAVNDEKKGGGMGDMYGQMGIDLSDTIGALMPKKKVERTMTVKEAREIFIKEESDKLVNHADIYHDAIQSAENNGIIFIDEIDKIAAGNKHNSGEVSREGVQRDILPIVEGSQINTKYGPINTDHILFIGSGAFAEAKPSDLIAELQGRFPIRVELKDLTEKDFVRILTEPDNALIKQYIALIGADGVKITFTKEAVDRIAEIATQVNHDTDNIGARRLATILEKLLEDVLYEGPDMAMGAVTVTQQYVDDKIGHIAADSNMTRYIL

SEQ ID NO: 3390 - protein, 174 aa, Lactobacillus paracasei
MTTIAAVRKDGVTALAGDGQVTLGEKVIMKGNAQKVRRIYHDQVVIGFAGGVADAFTLQDWFEKKLEHYAGNLRRSAVALAQDWRKDPTLQKLEAMMIVIDEHDLLLVSGSGEVIDPDEDVVAIGSGGNFAQAAAIAMLRHAPDMTPADIAKEAVNIAGNIDIFTNHNVIVESF

SEQ ID NO: 3391 - protein, 298 aa, Lactobacillus paracasei
MKPIAAFQEYLEVERQYSPETVTAYLSDLQEFQAFLKANGGFTDFRHVDDLDVQTYLTDLNKQDLARTSIARKISSLRSFYRYLTRIDVVKRNPFELVELKKQHHHLPQFFYEAEIQELFKTVAGKTPLDQRNRALLEVLYGTGIRVSECAKLTLNQVDFNTALLLIHGKGNKDRYVPFGQYAQQALRTYLKDGRQVLMAKSQAQHRYVFVNQYGRPITSRGIEYILDQLIKQTTLTANIHPHMLRHSFATHMLDHGADLRTVQELLGHASLSTTQIYTHVTMAHLKNEYMKYYPKHN

SEQ ID NO: 3392 - protein, 439 aa, Lactobacillus paracasei
  misc_feature (223)..(226): Xaa can be any naturally occurring amino acid
MPTVNVIGAGLAGSEAAWQIAQAGVDVNLYEMRPAKMTPAHHTSNFAELVCTNSLRANQITNAVGLLKEEMRQLHSIIIQSADATAVPAGGALAVDREPFSELVTQKLTSNSHIHVVNEELSAFPDGITVVATGPLTAPGLAQAIVDLNGEAGLSFFDAAAPILDANTINEDIVYKKSRYDRGEAAYLNCPMTKDEFLTFYQALVSAEVAEGHDFEKMTVFEXXXXIEVMAKRGIKTMLFGPLKPVGLEDPRTGKEPYAVVQLRQDNAAASLYNMVGFQTHLKWGEQKRVFRLIPGLENVQIVRYGVMHRNTFMKSPVVLEPTYASKRRPDLFFAGQMTGVEGYVESAASGLIAGTNAARMALGETPLIFPETTAMGSMAHYITHTSAHHFQPMNANFGIMPALTVKVRNKKERNQQLADRALKDLATFQAGMNRVEQV

SEQ ID NO: 3393 - protein, 694 aa, Lactobacillus paracasei
MADKKLVIVESPAKAKTIEKYLGRTYKVVASLGHIRDLPKSQMGVDVDNDYEPKYISIRGKGDVIKSLKKDAKKASKIYLAADPDREGEAIAWHVSHILGLDPKAKNRVVFNEITKDAVKNAFKTPRGIDMDLVDAQQARRILDRLVGYSISPLLWKKVKKGLSAGRVQSVALKLIIDRENEIKNFTPEEYWSLDAEFQKGRSKKFSASFYGLKNKKQALKNNEAVQKILGQVDKTKPFAVTNVVKKERKRFPSPPFTTSTLQQEANRKLGFRTRKTMMLAQQLYEGINLGGKLGTVGLITYMRTDSTRVSNVAKTETSHYLHEKYGEAYAAVKIRQGKLQEGAQDAHEAIRPTSTLRTPDSLTAVLDKDQMKLYRLIWSRFVASEMTPAIIDTVAVTLDQNGVTFRANGSQTKFEGFTKLYVSSRDSDQKDNILPPLAVGDDVKMLKTDPAQHFTQPPARYSEANLVKALEENGVGRPSTYAPTIETIQKRYYVKLNARRFEPTELGEIVNSLIVEFFPDIVNIKFTANVESELDGIETGEADWVKVIDQFYKPFEKEVAHAETGIAKIQIKDEPAGFNCDVCGAPMVIKMGRYGKFYACSRFPDCRNTKAIVKEIGVVCPKCHIGQVVERKSKRNRVFYGCSRYPDCDFVSWDKPVGRDCPVCGHFLVEKKSKAGTQVVCPNNDYKEALQKA

SEQ ID NO: 3394 - protein, 271 aa, Lactobacillus paracasei
MTLRNFLLAWHIATRQNPRMAVALEQAIRGKDDLAPFQAELKKRLTDQFSQQLIAAKHVPFMTYVDAAYPPRLREIPQPPLVLFYRGQLGLLNQLTLGIVGSRRATGYSATALAQLLPQLPSMVIVSGLAAGADAMAHEAALSARLPTIAVIANGLDQVYPAKNRDLQVQIAHVGLVLSEYPPATGPQRFQFVARNRIIAGIAHGVMVTEAEMKSGSLITANYALQHNREVFALPNRIDAPLGAGTNVLIQAGAALVTGPETLVENLNFYP

SEQ ID NO: 3395 - protein, 252 aa, Lactobacillus paracasei
MPTLNEYKALLAADEVAPAILAALKEDSRIGAGKLLAAYQRRQAHQAAEEVALRYRSRYERQLWGTYEYVAGLDEVGRGPLAGPVVTAAVILPHHFQWPVNDSKQLTAHERNVLYPHILTEAIAVGIGVADNRTIDRENIYHATELAMAQAVDHLRVAPECLLVDAMHVPVDLPQKRLIKGDANSISIAAASIVAKVIRDRLMMMYDKIYPGYDFKDNMGYGTKAHLAGLAAHGVTPIHRRSFGPVRDRLRS

SEQ ID NO: 3396 - protein, 286 aa, Lactobacillus paracasei
MAQIQWFPGHMAKARKQVQEKIKQVDLVLEVVDARTPESSRNPMLDELVADKPRIMVLNKQDLADPALTAAWVQYYQDQGFAAIAIDAQHAKRLQQIPQLATKLMAEKIARKKARGIRNPMIKAMCIGIPNVGKSTVLNRLVRRNIAVTGNKPGVTKNQQWLKASDNFQLLDTPGILWPKFASQTIGMRLAFTGAIADAVFQEDMVGLYGLTYFMAHYPAALKKAYHVTEDDLNEAPHDLLVKLTKSQGFAEAYDRMAERLIFDARQGKLGRFTLEKPGETDADAE

SEQ ID NO: 3397 - protein, 266 aa, Lactobacillus paracasei
MNEKVLGHFLRYKRTHADRAKFDVPDIKHRTPGLTRDEVATLANVSTDWYIRIEQGRTGVSASADVLRDLCKTLKLNQAETNYIFNLAEEIPPTTDQSTSYDSVQRFVDEQMPNPAFALDQNLTVVAANKMYTAIYGNFLAESALRRHLVFRTFNDPHFRAVMVDWENYASALTAKFRQLYSRTPDSKVLFEVYSAVKDDPVFKQTWDQLKVEELGEERLLLNVPNAYELYLIETFLKLLGAGDIIGVQLPGDEETRKKLGEMVND

SEQ ID NO: 3398 - protein, 341 aa, Lactobacillus paracasei
MTVKIGINGFGRIGRLAFRRILEVGPTANIEVVAINDLTSPTMLAHLLKYDSSHGTLNAEISATENAIRVDGKSYHVYAEPNAEKLSWVANDGVDYVLECTGFYASKDKAQAHLNAGVKRVLISAPAGKDVNTIVYRVNDNTLTNSDTIVSAGSCTTNCLAPMADALDKEFGVEVGTMTTVHAYTSTQMLLDGPVRGGNLRAARSAAVNTIPHSSGAAKAIGLVLPKLNGKLQGHAQRVPVTDGSLTELVTILHTKDLTVDTVNEHIKPYTINNESFGWTDAPIVSSDIVNTTFGSVFDPSQTEVVTAGDTQLVKTVAWYDNEYGFTCQMVRTLIKFARLV

SEQ ID NO: 3399 - protein, 223 aa, Lactobacillus paracasei
MEDQLTPFFKDPVAYATHAATIQIFLTFNVQPRLKDPEAFITGVQKLGQQHGVTMTAENFEIDQLNVIAGFDQPADLPEVKYAAERGIKISRRGDYFMTMKRPEGLPHATQVGKYEWKTVTAERTTKEGFWFALDLVELKKDLTASHVYGMPTLIFIALVTTFYASMYADAIETPKRWAAPALEDLFQKARRDLPKSAFKRYWRAIDLVVDGLARCHRNRWMK

SEQ ID NO: 3400 - protein, 721 aa, Lactobacillus paracasei
MQDQMTIQTTRLDYKLNLMALQSDYRFLQVTVKEGAFSNYNKLIASWLPEAVMTPRRNMYVLMFRQLPLLQQVEKLEMREIMLAEMETDSIYPNHILQLLLNQQAFGQPAISEVNKTPELLVSRKEWQYQRQDLRRQCHALNVKVNWDQDLELNVQTYTETAEWDWKRPLYKLDLARGFLERCYQPSDGPYFYQGNHTSRKNQVKFLSIKNLKSFERSKVGIARALLDNLNQNTTRYLRNSVKFHQSQVEQSCQLKLERTDAIWKQIAGCSINIYPQANDSLAAELANRMTAALKQSQIVQQVKVNIHCSRSSQSGLNIQVIRDTRDHAKYDHYEVGTVDRIIQHVTVEKFGAYQKGDEGVSWEPHDGKKSRDAATDPALIKLAQELCIKQDLANRQLTMVDAALARKIQPFTFYRFEYIRELPAPEVMVTKLAFTMTMGLVFSKKQVVLKADHLKTDDEYTRICDKVFKVLGSKKQKYIWDRVDCVVQFGTKQIMIQQFARTTMPDGEQIKKQLELCNPNKILSRKNAGQELERVRPIDADDEAFMTAFKQLQSVVAESPSTFNLKDLDQAARDAGLNPRQPGMRQVNQFLEAKASFTLKSTLQRNLPDSPLLGLKWIGLTRIEEWNGYSIAQYFVGANQSLKPDIARAVTLRRLLPLSYGDKVVDEVFPELAAMMSVEFVRNRQYTVVPFPVKYLREYWLAEQREHPEYRWKRLPSDRS

SEQ ID NO: 3401 - protein, 1184 aa, Lactobacillus paracasei
MQISDFWRMITDLESRSPEHALMLLNAPTGTGKSYTIAQALCQYAADHENFRAFFVTDQKKNFNEHTFKAAWNKHARSSCGTFNQRVAILRSLEDTVNKIIGDWDNQQMPAKYRSSESVRKVFKNLKMHLGLFQAYKHQAADSQTSWEALRKAEFEFRQAITVQLADSVELTVPLDDEGQKKACDYVAKQVNSETKWLNETYPTIDLYRRQIIILTTAKFTRSYTPFFQEHAKSFQFAPIIHNALIVMDEFDSTKQQVLDKAIDDALKIQADLIMLFEALHQGFKKMDEDVLPSQLRDCFTARKQFNVLKEEGKQLRSKFALRHLYKTEAVSLDSGFVIHTPQRQLISAGKPWHAYLDHHLKQVVLGQQARDDLHFQRMLPRVYTFLRRTTRFFRDRARDYQGLKNSEQSNFDDAMTIDDACHSIYNALGLSGEQIKVLLSLGHDYSSAQGIKSNYHAHSTHRFQQQGLSLFQMMNDYQHEFRTDIDASFFKVTPERYLLNLLNKANILGLSATATLPTVLDNYDLTYLREMLGPRMINGIEFLSAETQEELDFEGRYAKGNIQVNAEMANIGTSFASIFENRLKQNGLVIESTIIRQLDAALEKKANAVKNNEQEGGSGKDYFKQRYIALFDSFVVFLTDPMLTSFLGLQSLLPGKEQGGMDQEYLSVTFDRLKELLTQQFTEAADTKLKVISPRNGENVQSDLAEALAIPSHEDKRVYILSAYQTVGVGQNLQHVMNEFEREHAVNIAPKGANSYDLRHESVDLAGIYLGDVTHILTNTRQFRMDASGLRAIIEREYLFDTYEINVTTLNTFFTNLERGRWQAYPKNARSLYVSYSRTIIQALGRMNRAFNKMPCVRILASANVLGSITGNGIDLEETSFEYRRLLDYADEKAPTFEKTRSEAFKQNATLYTHRDLLFLKSHLQTNEQDAEYYRDLRLFVAKHPTASEEERIGNAVFKRRNDESGFQYLPAEKHETKYEVKPDTRDSGCFDFSKIGMEISAEASGLTIMCRYPGLKTHFEDLEIPTEWLPNELILNPVQYRNLYRGQIGEVAGQFIFEKEWRQKLQDFDDLANNELFDFQCQGEVAIDFKNWQGQPNKDTEKERQHVAQKLRHLQVNTGREWRVIIANVVAINKGKPTITIDGKILEISGLIDEQGKLVLTPEQKIQIGRFLHARPNDNSDD

SEQ ID NO: 3402 - protein, 106 aa, Lactobacillus paracasei
MSVELEGFAVYPNKVVRTNAWMTFLRTHQREVDVTLRPEHILVERIFSSSVGGRFYLCWYPEQTAASPDVTESLNPIDQAHVTFWRECVDEKVPRLRFRLENSFHA

SEQ ID NO: 3403 - protein, 461 aa, Lactobacillus paracasei
LIIVIVALGGGVAGGYALSYQQAQQSVLKTGVPKELAPVIAAYETVTNNYYKSVNTTKLTDGAIKGMLATLDDPYSVYLQNNDKTNLDDTISASFGGIGATVQQNHDSLSIASILPDTPAKKAGMQVGDVLLKVNGKDVSKQTVSKAVAKIRGKIGTTVSVTVKRGSKQATFSMKRQKITVDTVTGQLASANKQVGVITISTFSEPTVKQFKATVKKLRKEGAKSFVLDLRQNPGGMMSAALSISSMFSKNGQTVLQVEDRNGAKEVYKAGKKLDDGFKVTEKTAVLIDGNSASASEITAAALHQNSNIPLVGEKSFGKGTVQNVGEMGSNKELKLTIAKWLTPNGTWINHKGLTPDIKVDYPAAAKITLINATQLKPGDKGSDVKSLQQMLTALKVGSVTVNSQYDDATQAAVKTFQQANKLDATGTADQDTLATLAQKLSAQLTKDDPMMKAAVDAVAK

SEQ ID NO: 3404 - protein, 80 aa, Lactobacillus paracasei
MHRTFYEYLMTLRNPNDHSEIAEFAKNAFLDQSFPKQEKDYHRLSDYLELNGNYLPSMAVFDETYRAYEASESTGGDSYQ

SEQ ID NO: 3405 - protein, 173 aa, Lactobacillus paracasei
MKKETAIFAGGCFWCLVEPFEEQPGILNVVSGYTGGHVANPTYEQVSSHTTGHTEAVEITFDADTISYPKLLDIYWQQTDPTDAMGQFQDRGDNYRPVIFVKDDAQREAAEASKTALAASGRFSDPIVTQIEAAKPFYPAEPEHQQFYAKNPRRYALEHAQRQAFIDKTWKDQ

SEQ ID NO: 3406 - protein, 209 aa, Lactobacillus paracasei
VTEKKRQRKQKSISWSMINWWKWAFLILIGLILGSGIWFTKTVLAPVSLNTATETKTISNDPVFTVKVTKSSANRIMAHYLKTYLKDSPIKYAVTLGNNEAALNGSFKFLGNNVKFQLTFDPLVLKNGDVLLKSKKLNVGTLPVPISFVMSYIGHSYKIPSWVSLDSKAGNVVLKLSQFKLQNGMTLRATKLDPTNDDLEFAVYLPDNQ

SEQ ID NO: 3407 - protein, 281 aa, Lactobacillus paracasei
MAKLKSFLISFGVILLAGIAAFLSWQVFGPAAAPSQVKLTADQPKQLKLTAVGDSLTYGVGDATNNGGFVGLTQADLEATGQYQVTTKNYGVSGNTSTQILSRINKQAKIRTDLKQANIITVTAGGNDLMHVLQQHFLSLSEKEITAGSTAFQKHLTTLLTTIRKENATAPIYVFGIYNPFYVYFPKMTAMTNSVSAWNQATQKTLQGFQRVYYIDIDKVLSNGETVANKASAKEALKEATSGDGNPLIFSQDHFHPNNAGYAQMTKQLMTKLTATKKDWE

SEQ ID NO: 3408 - protein, 294 aa, Lactobacillus paracasei
MSSINEPNRKRGSDMANIKIVTDSSVQLTPEEISQHNITVVPLTIMIDNTVYIDGETITRDDFMDEMAAAQNLPKTSQPAVGTFADVFDKLTADGSEVLAIHMTETISGTVNSSRQAAQIAKGKVTVIDSQFTDRAMAFQVLVAAEMAEAGKDMKTILDKLEQVRDNTTLVLGVTNLDNLVKGGRLSRVSGLISSFLNIKVILQLQNGELKALRKGRGMKTINNFIAETIAKMAKLSNIKSVGISTAGAKELGEDIGRRIAEVLPSVPILVRPTDPVIATHTGPGAFAITYYVD

SEQ ID NO: 3409 - protein, 213 aa, Lactobacillus paracasei
MRVAKSKHYEFNNEMFSAITHAFALGLAVVGTIALGIKGANSGSQLELISYLGFGISLIILYTASTAFHGFYFSKARHVLQVLDHSGVFILIAGSYLPYCLVAIGGPLGIGLLIAIWALCFGGILYKLFFLNRFKHLETMIYVILGWLCLIGMVPLWHHLGPIGFWLLVAGGLAYTGGAMLYLQKGIPYIHVIWHLFVILGSLCMYISIYLFV

SEQ ID NO: 3410 - protein, 163 aa, Lactobacillus paracasei
MVAFLWAQDRDGVIGKDGHLPWHLPDDLHYFRTQTEGKMMVVGRRTYESFPKRPLPDRTNVVLTHQADYQAPGAIVLHQVAEVLDYAKEHADQALVIAGGAQIFSAFKDMVDTLLVTRLAGSFAGDTKMIPLDWDAFTKTSSRTVEDQNPALTHTYEVWQKQK

SEQ ID NO: 3411 - protein, 316 aa, Lactobacillus paracasei
MLEQPYLDLAQKVLDEGHFKPDRTHTGTYSIFGHQMRFDLSKGFPLLTTKKVPFGLIKSELLWFLRGDTNIRFLLQHKNHIWDEWAFEKWVTSPDYHGPDMTDFGHRSQKDPEFAASYREQMAKFDERILTDESFAAKYGDLGLVYGSQWRAWHTSRGDTIDQLGDVIEQIKTHPYSRRLIVSAWNPEDVPTMALPPCHTLFQFYVNDGKLSLQLYQRSADIFLGVPFNIASYALLTHLVAHECGLQVGDFIHTFGDAHLYVNHLDQIKEQLTRTPRQAPTLVLNPDKHDIFDFDMQDIKLLNYDPYPAIKAPVAV

SEQ ID NO: 3412 - protein, 630 aa, Lactobacillus paracasei
MQTLTAQGLSKAYGDKQLFNQIDFLINEGERIGLIGVNGAGKTTLIRALAGLDSVDAGEIKTPKQYRISYLAQIPDLDPDLAIMDAIYHGDSPVFQAIRQYEQALAEYTKDPMNPEKTAAYTKADARMTQEDAWSAETDIKTILTQLHIDDLSMRVGDLSGGQQKRVGLAQVLIESPDLLLLDEPTNHLDFDSIAWLEKYLSNYRGALVVVTHDRYFLDRVTNRIFELDRGRLFQYQGNYQAYVAKKAEQLEAEKSANHKQAQLYKQELAWMHAGAQARSTKQQARINRFQTLQAAKDAAPEANQQLDPIQIASARLGKKVIEMHHASLQFDDQPILKDFNWLVQPGTRIGITGKNGAGKSTLLNIIAGKQKLDSGSIELGETVHLGYYTQMSANLDPNKRIITYLQEVGEEVVQADGQRVSVTQMLEQFLFPRSMHGTLIGRLSGGEKRRLYLLQVLMRQPNVLLLDEPTNDLDIATLTVLEDYLDQFPGTVITVSHDRYFLDKVADQLLIFNGNARIDRAVGEFSDYLAQQQTKQPAAKPKTSAADAVPKKAAPKKKTKLTYAEQIEYDKLQNELDELDDKLAKVKAAMAEVNGEDYVKLGDLQAQIDKINQTIDKKFDRFAELDQYV

SEQ ID NO: 3413 - protein, 151 aa, Lactobacillus paracasei
MAEHVFEQLIFHFRNGDEWTVEHDELADVWISRVTTSYGRIHGGQIQEIHPCKSFKVEILPEADHVKSSDINTGSLEMGMFGRATKYQDIEKMDLVFNAEDKKRVQIYFPFKQKDPSGLDNEYQSSKLAANGHLYIVIDEKHTVDDEYPRI

SEQ ID NO: 3414 - protein, 398 aa, Lactobacillus paracasei
MRLDLTQPDFKAAIPILKKIEAAGYEAYFVGGSVRDAILGLPIHDVDIASSAYPAEIKRIFKRTADTGIEHGTVMVLDHGTGYEVTTFRTESRYQDFRRPDHVTFVRSLAEDLKRRDFTINALAVRHDGTIIDLFDGLKDLQHHQLRAVGNPHERFHEDALRMMRAVRFESQLGFGIEPATKAAIADNAKLLVHISVERVAAEFNRLLTGIDRRAGLQDFIETRLFAYAPKMAAHETALTQFSQLPDTQLTSLASGWAALIFLLRTQPLAMLKAWKQSNELITLVTQTVKLLQVMPNPTAWDLYQAGEAAVTTASEVQKLLTPDFDQQQLAEAYAALPIHSKKELALTGADLIKAGVRPGPAMGKALNQIEQRVVAGALPNELKKLLPIATEMSQDRL

SEQ ID NO: 3415 - protein, 292 aa, Lactobacillus paracasei
MSRTTRTCWDLLMIVLGCALYGFGLVYINIANHLAEGGVTGITLLIRYWWHLDPAYSTILLNIPLLIVGYKFLGKRALAYTVFGTLMLSAWLWIWQRVPLTINLDHDLFISGVLAGLFGGFGSGLIYRHGGTTGGTDVVARIVEQQTGVPMGRTLLVFDAAVLTISLTYLNIELMMYTLLGAYVFSQIVNFTLDGAYAAKGLLIVSDKSQEIATAIMNELERGTTFLHAEGGFAHDRKQVVYAVVSSTEIAQTKRLIEAIDPHAFISILDVHEALGEGFTYQKKRRRLLFGH

SEQ ID NO: 3416 - protein, 422 aa, Lactobacillus paracasei
MSYAKEMLDAIEAGQMETAKQLFTQVLAHDDDETQYNLAEELYALGFNGQAKRLYQGLLGRYPDQGDLATALADIAVSDGDTDAALNYLSRIQPGDPAYVQSLVSAADVYQTLGLYEVSEQKLLEAKRLAPDEPVVTFALGEFYFDWGHFAEAISAYNELLAAGTTELAGVNIEARLAASLAQTGQYEDAVAAYEDVGVDALDLNGRFELGGLYLQLDDPAKAITNLQAVIDSDPTYANAYLPLARAYEAQNQPDKALDTVQAGVMVDDTNPTLYALGGKLALSEDNVKLAETYLQKALAIDPEDQGNMLAWSNFLVQEERDQENVDFLDQIDRSGDVDPQIYWNMAKSYDRLENIKKARENYLLAFNRFQDSPDFLHDIIDFFQSTGARAELKAALVRYLKLVPTDDEMQARLDELNTETD

SEQ ID NO: 3417 - protein, 91 aa, Lactobacillus paracasei
MANKAELIESVATATGLTKKDATAAVDAVFGSIQDSLSKGDKVQLIGFGNFEVRERAARKGRNPQTGAEIKIPASKVPAFKPGKALKDAVK

SEQ ID NO: 3418 - protein, 435 aa, Lactobacillus paracasei
MVLPTLAIVGRPNVGKSTIFNRILGERVSIVEDTPGVTRDRIYGTSEWLGKEFAVIDTGGIDLGDEPFLAQIKDQAEIAIDEADVILFLADIESGVTDADERVAQILYRAKKPVVLAVNKVDNPERRQDIYDFYSLGFGEPYPLSGTHGIGLGDVLDAVLAAFPSEDKSVEDDSIKFSLIGRPNVGKSSLVNAILGENRVIVSPIEGTTRDAIDTKFEAVDETFTMIDTAGIRKRGKVYENTEKYAVMRALRAIDRSDVVLFVINAEEGIREQDKKVAGYAHEAGRGIIIVVNKWDTVEKDNHTMKDFENLIRQEFQYLDYAPIIFVSAKTKQRLQSLPAMIVAVSENQTRRIQSSVLNDVLMDAITVTPTPTVNGKRLRIYYMTQVAVKPPTFVVFVNDPDLLHFSYERFLINQLRQAFDFSGTPIHIIARKRK

SEQ ID NO: 3419 - protein, 439 aa, Lactobacillus paracasei
MSDNNVNENTETMADALKSVTTVKIGDTVKADVLAVEDKQLIVGIEGTGVEGVVPIKELSTQPIDDIHDVAKVGDKLDLVVLSTVGKDKENGQFLLSKRRLEAQKVWKEIQAKYEAGETITAPVTSVVKGGLVVNAGVRGFVPASMVEDHFVEDLSQYKGKELEFKIIEIEPSENRLILSHRAIVEASKAEARKEIFAKIQPGDTVEGKVARLTNFGAFVDLGGVDGLVHVSEISFDHVDKPSDVLKVGQEIKVKVLNVDPDRNRISLSIKATLPQPWDDIEEKAPAGSVLTGTVKRLTTFGAFVEVFPGVEGLVHISQISHEHVATPADVLKEGQEVQVKVLSVDPDAHRLALSIKALQERPAGSEEESHEGGNSSRDNSDRGDRRRSSRPRRGNDRHQSTSIPAEYQQDDSGFSLGDILGDALKDAAKGNDDQDDNK

SEQ ID NO: 3420 - protein, 221 aa, Lactobacillus paracasei
MQIAIDGPASAGKSTIAKRVAKELGFIYCDTGAMYRTVTYMAIKDQLGFGDEAAIMQHLANMTIRFEPGDPEQRVLMNDEDVTLAIREPDVTNNVSQVSALPKVRTELVKRQRDIAASSNIVMDGRDIGTTVLPNAEVKIYMVASVAERAKRRYKENIQKGIETPLATLEQEIAERDRKDSHRAVSPLRQASDAIRIDTTSMTIDEVVERILSLIGQVKTK

SEQ ID NO: 3421 - protein, 206 aa, Lactobacillus paracasei
MAEKDEHQHDNEDHKRTNGEDPSKPWETLFDDDRDDQGNLSRVATKKKRQGSSKLTWILAILLILVVLAPIIYVKISGDQSRNGANLSNDRVVIQSTKKSSKVSKSKKSSKASKASKTSVASSQAASTQPSQAPSVTSQQEEQTSASAQPSEQASASTAGSSYTVQAGDNLYRIAVNHGMTLDELLQMNGMSAGSSIAPGTVLKVK

SEQ ID NO: 3422 - protein, 469 aa, Lactobacillus paracasei
VSQLEAQLQQHFGFQEFRPGQKALIQSVLDGHDTLGILPTGSGKSLCYQLPTLISNKPSLIVEPLIALMNDQVGRLQAAGEKRVIALSAQMPPVAFTQILKRLASYHYIFVSPEILQRADVLLALKRLTLGLFVVDEAHCISQWGPDFRPAYLQLGQVRQQLQADAILALTATAPEPVRRDIVQHLSMQSPAILAGSVDRPNIFLGVETGLTDKEKALRLDQLLHEVVGPTIIYSATRAACETLAIRLQKAGHAAAFYHAGLDRHQRDLIQRQFQSDQLQIICATSAFGMGIDKANVRFVVHTYVPESLEAYYQAIGRAGRDGKQSLAALLVTDHDVQHGAILAGMLPDAALIRLIYAHPEAYRTFDDPQINLIEAYVDAGFSVEATQQQLQHRLTEKQASFAAMAAFVNESECRRAVLLQHFDSPIEPHTALCCGEITTTILRQLQPEVPQEQPKLASWQAVFHQIFR

SEQ ID NO: 3423 - protein, 326 aa, Lactobacillus paracasei
LLTDFVIQFFSEQPRRERAVFGLLTGKQTISILYAALIHQQLQWLHLYPSLSKEAFSAAITTLKVQRMLRETETGLILTENGQHLKQAAVTQLPLPTHYQPWMNLPVFAPRFFLGVQVLSEASYANSAYQPISVNWATQQVVKQWYQQVDHRAAVTTLSSLFQGLPTELADTLAANMIGHDYAGQLMPATLEAHFERLDALAALVQQLANTRSMWTALWGGPRDFVSRPARQTLAQARAGMALPTIANRSHRKQSTINEHLLLAAIMGETLPIEHLVPLKIHRALDRVTQIYDHQALLAAIPGSTFFQIRLFQILSFQGRWPRVTT

SEQ ID NO: 3424 - protein, 85 aa, Lactobacillus paracasei
MALYGRVERPECIACGLCQMLAPALFDYDQAGIAYYKPDRNTGTEPLNDQATIDFRLAYQRCPTHAIKRSDHPFNARPFSETGKA

SEQ ID NO: 3425 - protein, 192 aa, Lactobacillus paracasei
MASSSKVHRLVGIALLAAIGYVLMMFSFPIIPAFPFLKLDLSDLVVLLGGLLYGPAGGIGVAFIRSLVHFALTGGGVVNLIGDLAAFIASVGFLLPVVYTIRGKHSLLRQIEGLVLGTASLTVVMSVLNWLVITPMYMAVFNFNLGMSLTRYVLIGVVPFNLIKGIVASVAFFAIAKALAPWLARREIQPSH

SEQ ID NO: 3426 - protein, 247 aa, Lactobacillus paracasei
MTTKTERLQKIIANAGIASRRHAETLIATGHVKVNGQIETEMGIKIGPHDEVEVDGVPIGKEAKRYFLFYKPRGVISAVQDNKGRDVVTDYFKDITERLYPVGRLDYDTSGLLVMTNDGDLANHLMHPRYALEKKYVAKVQGVPNRPALAPLKTGVEVDGKMTAPAKVDIISTDKAKKTAIVSLTIHQGMNHQVKKMFKAVGFPVLKLSREAYGNLTLVGLQPGEHRPIKPQELQALRKLAGESENK

SEQ ID NO: 3427 - protein, 206 aa, Lactobacillus paracasei
MEPALEAILYTAGESGVTLGELAGILEISESAMRQQLDAYRQRLAADDQRGLQLQQFADRYYLLTKPAYAPAIKKYFAGPPAAGLSQAALEVLAIIAYQQPITRIEIDEIRGVQSSGALTTLAARQLIKEAGRKEAPGRPILYATTQFFLDYFGLNRLADLPPLADAPADTGEVDLFTAFRHDDDQEEATIDEKKMEQNQQHDNQN

SEQ ID NO: 3428 - protein, 241 aa, Lactobacillus paracasei
MALTLVLNDFSGPLDLLWHLIRTNEVDIYDIPIAEITAQYLDYLHQMQDLALDVAGDYFVMAANLMVLKSRLLLPQPEPETMAPDEAPDPRADLVAQLLTYQVYQEAAKDLKAREAKRAQAYAKPTTLPDAKMALPLAPGSVKLVDLQAAMARVMKAQQATRQTIAHIETEPVSVEKRIGEVLQTLQKGGQCLFADLLSVQSVEQVVTTFLALLELMKNDQVICEQEAPFDPITVTLKEAA

SEQ ID NO: 3429 - protein, 128 aa, Lactobacillus paracasei
MLVKYKNDYEKIAMGLLSFIPDLKDVGHLKTELKMYTEDDSHALYLYKHKNDFVGVVGIELSADFVLVRHLSFSPNFRDQATAFAALTELTELFPNKKLMGALEHAPLIAAFNKFRKEDDHGTDTRAE

SEQ ID NO: 3430 - protein, 293 aa, Lactobacillus paracasei
MHGLIADFIHYLNVERGLAKATQTSYQQDLITFSAWLAARKRRTFPEEFSTIQSFLKEQNATKAPASVSRMISALRKFYRFLLREGAISADPMTKIDTPKRAQHLPATLSSQEVDALMAKPDTDKPLGLRDRAIFELMYATGLRVSEVVDLRLDQLHLAMNLLQVTGKGDKERLVPISPQATQWVDRYLQEARPKLLKRVQPKNVFVNFHGGPMTRQGIWKNLKAYIASIGIEKDVTPHTLRHSFATRLLENGADLRVVQELLGHSDISTTQIYTHLSNQHLVAVYHKTHPRG

SEQ ID NO: 3431 - protein, 292 aa, Lactobacillus paracasei
MNFNGSIVTAQVTDHNDTEVFAQHDGVTLAIDRSELAELPEVGSDVEGFAYENKQGQARLTTKVPTVGRDHYAFAKVVEVRKDLGVFVNIGLPDKDIVVSEDQLPEISRLWPQKGDQLMVALTVDKKDRMWGNLADESIIHAVANRAKPEQMNADVTATAYRLKMAGTRVLTDDFYLGFIHPSERDAEPRLGQILHARVIGVSANGELNLSLKPRAYQAIGDDAGMILAVLQHDPSGRIAYTDKSDPEAIKQTFGISKGAFKRALGHLLKAGLVKEEAGYTILTAAAKASRE

SEQ ID NO: 3432 - protein, 153 aa, Lactobacillus paracasei
VESWLFLLGILAIAIVGKNKSLIIGVSAVMVLKLIPQTQNFLKLLQTQGINWGVTVISAAIMVPIATGEIGFKELLNVIKSPAGWIAIGCGVLVAVLSAKGVGLLAMSPEMTVALVFGTIIGVVFLKGIAAGPVIASGLTYVILTVFNLVPGH

SEQ ID NO: 3433 - protein, 588 aa, Lactobacillus paracasei
MKKTKIVSTLGPASNTTDIIVKLIEAGANVFRFNFSHGDHEEHLARMNMVHEAEKITGKTVGIMLDTKGAEIRTTLEDTPNGKIDFHTGDKVRISMDASLKGTKEKVAVTYPGLYDDTHVGGHVLFDDGLIDMKITEKDEKNRELVTVVQNDGVLGGKKGVNAPGVAINLPGITEKDSDDIRFGLDNGINFIAASFVRKPQDVLDIRELLEEKNALNVQIFPKIESQEGIDNIDDILKVSDGLMVARGDMGVEIPFEHVPIVQKRLIKKCNSLGKPVITATQMLDSMQENPRPTRAEVNDVANAVFDGTDATMLSGESANGDYPVESVAAMARIDEYTEAAMMDQDAFALKEYSNKNVTEAVGQSVAHTARNLGVKTIVAATESGYTARMISKYRPKADILAITFSEKTQRGLMVNWGVYPIIAEKPANTDAMFDLATKKAQDLGFAKEGDLILITAGVPVGESGTTNVMKVQLIGSKLVQGSGVGDESTIGKAVIASNAQEAAAKMQKGDILVVKTTDKDYLPAIEKAAALVVETGGLTSHAAVVGIAMGIPVVVGAENATSVISDGQIITVDSRRGIIYKGATNAL

SEQ ID NO: 3434 - protein, 319 aa, Lactobacillus paracasei
MKRIGILTSGGDAPGMNAAVRAVARKAMHEGLEVYGINYGFAGLVAGDIFKMNESTVGDKIQRGGTMLYSARYPQFAQEEGQLRGVEQLNKFGIEALVVIGGDGSYHGALALTRHGFNTIGLPGTIDNDIPYTDFTIGFDTAVNTVVEAVDRLRDTAASHERTFVIEVMGREAGDIALWSGVAGGAEDVIIPEHDFDVKKIASKLQSSRERGQKHAVILLAEGVMHADQFAKELAAHGDFQLRSTVLGHIVRGGAPSARDRVLASQMGSYAVELLLQGKGALAVGIENNKITAHDVRTLFDAKHHAELSLYTLAEELTF

SEQ ID NO: 3435 - protein, 1098 aa, Lactobacillus paracasei
MTFTQLQVHSNYTLLHSPLALSNLISAAKSRGYSAIALTDTNVVYGLVEFYRQAKAAGLKPLLGMQIAIDDAKLLVIAKNNQGYHQLLKISTQIMLATSPVAFADLLPLTGLVAITLPDSPFSAAVAANDHDRAVAFLQELDNKKPEAVYVGLDEAHLDTPLPAFATSQQLHLMALGNVLYRDPTDAFTQKVMAAIGDGSQLNFRDPVLTDAGPWWLKPPADASAPFVAAGLQAAVDNTAQIADQTDVTITFKQPQLPHYQTPDQLASKDYLTKLAQEGLANRFHDQPIPTTYQQRLQYELDVIIKMGFADYFLVVWDVMNYAHKVNIMTGAGRGSAAGSLVSYALAITEVDPIAYDLLFERFLNPARAQMPDIDLDIPDNRRGELIQYVHDKYGRNHMAQIITFGTFGAKQAIRDVARVFGMSQFESNTWSRAIPNLLHMDLKTAYDQSQPLKNLVADSPKNRMLFQTALALEGLPRHYSTHAAGIVLSEEPLTDTVALQPSGDGLEQTQVPKDDVEALGLLKMDFLGLKNLNILAAASHFVTRDTGRTFDPKQIPLNDQPTLALFARGDTNGVFQFESAGIKNVLRKLRPTDFEDVVAVNALYRPGPMENIDTFIARKNGQEPIAYPDPALEKILKPTYGVLVYQEQVMQVASVMGGFSLGEADLLRRAMSKKKSSVLAAEQDKFIEGAVKQGFPEATAKTVYAYIDRFANYGFNRSHAVAYSMVAFWLAYLKVHDPAAFFAALMNASMNNLPKLRTYVQEAKARQVALLGPDINTSNGGFKLSDGKIRFGLLSVKGMRRDFSEAIFTARKNGPFKDFRDLLQRLEPKWLKADNFKPLILAGALDSFDDNRAQTIANLDELINSVKLAGNDVGLFSVLAPKPIVVPEMPAGERLEEEANVLGVYLSGHPVDKYAPLKTQYTLVNVVDLAEGRTVDILLLVRHIKRIRTKTGKPMAFVDGQDATGTVSLTVFPNLYPTLEKIETDMVVLVNGRVEKRNDDLQLIVNRIQDAAPLLEALPKAQLFIRLDADNVDARTDLLKKLQTAHGPIPVITVDTTSKESVLLDKRYWVTADTSLMADLESRFGAANVVLRKRQEE

SEQ ID NO: 3436 - protein, 64 aa, Lactobacillus paracasei
MRYLPTIIWGVILGQVVGFLISALSGGSYDPKTSAIISVIFVVILFFFPPIMQHFAKPAEKPEH

SEQ ID NO: 3437 - protein, 303 aa, Lactobacillus paracasei
MLLVVIELCIAKGLFGLMKIWKYTMVGLLAFVLAGCGQQLSTTKTSYGRDGLVAIVKGTARGVDRVSYTSDAGKGSVPVNSGTFVVNVPVSDVAQKVNLKAGSMQTNVTVRAGQSLGTYSTIAAKFNQMLAVSSLPKADQAKLKQAQAASANAQKNAATMSPTEKMAMAQQAQQLKTLMAQANANTKASQLPATAKTGIHSILKSASGDYRASIVDGKAMGFAVVVPLSVLKNSKKMQTFATDFGLLTTSVGADAKSVFSQFKKLTKDAKSKNNATTISTIKSHGVKIDVGYSTTALYLYVTK

SEQ ID NO: 3438 - protein, 517 aa, Lactobacillus paracasei
MKLTILSTSDTHGFVLPTNYVKRDQDLPFSLAKAKTVLDAQKAAAEGPVVTIENGDWLQGSPLAYYVAKISKQPDQLTRLYNEVGYDAGIIGNHEFNYGSDYLRQALKTLTYPTINANITENGQPAFGAPYQLIERSGVKIAILGLTTNYIPHWEAPAHIAGLAFQDVVATAKHYVPLLRQQADVVIVAYHGGFERNLQTGQPTEPLTGENVGYALTQVPGIDALVTGHQHRQLAGLVNGVPITQPGYRGEAIGKITLDLNQTASGYQVTASKAVLVKTGGSIASPTILQSAADLNQTVETWLDQPLAHVEGDMRIQDPFAARVHEVPYIEFIQKVQMASTDTDISGTALFNNEGRGFGETIDMRDVVTNYIYPNTLAVLRLTGADLKAALEQCAEYFSLDADGKLTVTPRFERPKPQHYNYDMYQGIDYTLDIHQPVGSRVTRLLYHGAPVQPTQTYDVAVNQYRAAGGGNFKMFGPDKVIRENQKDMTELIADYLQEHPLIKATADQNFNVLPSM

SEQ ID NO: 3439 - protein, 183 aa, Lactobacillus paracasei
MADNEQFADYLGQLQEAQFPRWTDLPQFDLYMDQVIQYVNDIVTPLGFGEITSTMVNNYVKKGVIKAPLKKKYRPEQLANILVIAMLKPVFALDAIAAGIQFSLANRPVAQAYDAFILTFSSAIEQANSDFSDGLTISRVNKPDMTTTQHAIVTMAINAVLQKLLVEKMIDLAADDSEKKGKK

SEQ ID NO: 3440 - protein, 63 aa, Lactobacillus paracasei
MAVPARRTSKTKKRMRRGHIKLNVPNLQFDAATGEYRISHHVSPKGYYKGAQVVKKSDDNANA

SEQ ID NO: 3441 - protein, 868 aa, Lactobacillus paracasei
MNPDNFTQAVAEALGAAQQIAQVRRHQEIDIPHVMKSLVQPNQLAEQIYREAGVNVQGLNAAIDAALEAEPVVEGASAYGQSMSQNLSQLLTDANSVKDEFGDTYISTEAVLLALYQQRYNPITQFLLNDAKVDAKRLRQVIENLRGGEKVTSKNAEASYKSLEKYGTDLVKEARSGKMDPIIGRDEEIRDVIRILSRKTKNNPVLIGEPGVGKTAIVEGLAQRIVKNDVPDNLKNKTIISLDMGSLVAGAKYRGEFEERLKAVLKEVKKSEGQIILFIDEIHNIVGAGKAEGSMDAGNLLKPMLARGELHLIGATTLDEYRENIEKDKALERRFQRVLVQEPSVEDTISILRGLKERFEIFHKVRIHDTALVAAATLSNRYITDRFLPDKAIDLVDEACATINVEMNSRPTELDVAERKQMQLEIEQQALKNETDPASKKRLADADAELANLKEKTNKLKAQWEAEKKDIRQLNEKKSAIDKAKHELEDAQSRYDLETAARLQHGTIPQLEKELQTMEHSDRPQSWLVQESVTANEIAAVISRETGIPVAKLVEGDRQKLLHLADNLHQRVIGQNEAVSAVSDAVLRSRAGLQDPSRPLGSFLVLGPTGVGKTELAKALAEDLFDSEKHMVRIDMSEYMEKASVSRLVGAAPGYVGYEQGGQLTEAVRRNPYTIVLLDEIEKANPDVFNILLQVLDDGRLTDGQGRTVDFKNTIIIMTSNLGSEYLLDGVQEDGTVSQQAKDNVRQLVGKAFKPEFLNRIDDIIMFNPLSLADVEKIAVKDLKQLGTRLADQQISLDITPAAQEWLAHKGYEPAFGARPLQRLITSAVETPLAKELIRGTVMPGQEVVITVADDQLQFKAKTVPVKA

SEQ ID NO: 3442 - protein, 111 aa, Lactobacillus paracasei
MKGQQRFIIGLVLALILIVFALLNGQDVSVNFFGIQLKWPLIVIIAVSVLIGAVVTWLISTSAVSSAKKQIRELQQRITELTKSNKTDKPAPKPVQAPKEEPSTDATDTKK

SEQ ID NO: 3443 - protein, 261 aa, Lactobacillus paracasei
MMNQHPTVVISGGSSGLGKAIGLEAAKQGATVVFLARRREKLRQAQAEASTLSGRPAYAFPVDVADPVAIEATVDQIHETVGPVDILVNAAGFGHFETAFDTDMQVVERMFRVNVLGMMYLTKLLGRDMVTRQQGQIINIASMAGKMATPKSAIYSATKFAVIGYSNGLRLELKPFGVKVTTVNPGPIATNFFSEANALDYLASVSWLVLDPDKLARRIVATFGRPVREINAPWFMNLGADFYTLFPHLGDWLAAGMFNKK

SEQ ID NO: 3444 - protein, 320 aa, Lactobacillus paracasei
MEIQFLGTGAGSPSKSRNVSSLALKLLDERNEVWLFDAGEGTQHQILQTAIRPRKIAKVFITHLHGDHIFGLPGFLASRSNQGGTDPLTIYGPSGIEDFVKTSLKVSQSHLSYPLKFVLLQHPGVAFEDQTFKVTFDRLDHRITSFGFRIEEKPHPGELLIDKVRAAKIPSGPVYAALKAGETVTLPDGRIFDGHDFIGPAQPGRTVAIFGDTRMCNRALPLAAGADVLVHESTFGPDESQLAKQYYHATNVQAAALAKRAGVGRLLLNHISARYLSPGVAMLEKTARQIFPNTHVVKDFEEINIPFRSEQSEPAVTVKS

SEQ ID NO: 3445 - protein, 659 aa, Lactobacillus paracasei
LKQTRGRKRRYIHGFDGLRTIGVIGVILYHLRPELFRGGYLGVPIFMVVSGYLITDGLLIEFDRNHRIDFKSFFIRRFKRLYPGLITVLFGTAAYITLFSQNLLHNLHMMVLTNLLYVYNWWQILNGQSYFARYANGESPFTHLWTLSIEGQYYLIWPFLVLALLLLVKSRHQIANIVLILAAASGAWMAILYMMTIAHVQPAAFDPSRLYYGTDTRAFSILFGAALAFIWPSGRLSQHLGKKWVIGLDLLGTASFLGLLVMVFTIDAQSSFLYEGGMVLFSIVTTILVAVVAHPAAHFDRLLSNPLFSYIGSRSYGLYLYQFPVMIFWENRFRNIADHPVLYPVIEVVLIVVITELSYRFIEQPAAHFNYHKTWAFLKGLANPKVRMGKTRWVSYVALIILAIGSVGLAKAPSVKAEGDNSPLAQQLKKRGVSTKEKEKRLAAMRSSIAAQKKADKNKAAEESSSKALEAKYASQAKTHPVNREYEQYGLTQIQLQQAQDIGLTAIGDSVMLDGENGLQQLFPKAVIDAAVSRQMINSIDLVRSYADRGVLGNIVLIGLGTNGPFSDDQLAQMMQAIGPDRQVFWINVRVPTRAWQNDVNSKLAAAQKQYKNLTVIDWYDKSNGHPDWFYNDMVHMNPNGNPQYAALVAKTILDKVKN

SEQ ID NO: 3446 - protein, 428 aa, Lactobacillus paracasei
MFVDQVQVEVQAGKGGDGMVAFRREKFVPFGGPAGGDGGHGGSIILYVDEGLRTLMDFRYQRHFKASAGGNGQGKQMYGRAAEDRRIAVPAGTTVTDADTGEVLGDLTEPGQTLVVAKGGRGGRGNMHFVSPKNTAPEISENGEPGEHRFIKLELKVLADVGLVGFPSVGKSTLLSVVTQAKPKIAAYQFTTLVPNLGMVQLDDGTDFVMADLPGLIEGASQGVGLGIQFLRHVERTRVLLHLVEMDPDNGREPLDDYDQIRKELGAYDDNILKRPELVVATKMDLPGAAERFADFKASLLARGVAADHIFEISSLTHRGVTPLMHKTAEVLKTAPHFEPKQAAVKTADYKYQPEPALKVTRDSDGTFVLTGDKIERAFKMANLDHEDGAMRFARQLRSMGVDDALRDAGAESGDLVAIDDFTFEFVE

SEQ ID NO: 3447 - protein, 249 aa, Lactobacillus paracasei
VLTEERRQYILAQLQQHTVIKSKALMAALDASESTIRRDLDELEAAGELKRIHGGAKRINGLGDEPDVASKSAQNLRAKQTIAQAAVRQIEPDDLIFLDAGTTTAQLIPFLADIGVTVITTGVDNASLLADYQISTLMLGGMVKPTTKALIGATTAEALNHYRFDVAFIGTNGVHPEFGLTTPDPEEAVIKRLAIHQASKPVILADPSKFEQVSFVRFADISDATILTSSLQGLPTSYQRFENIKEVHS

SEQ ID NO: 3448 - protein, 304 aa, Lactobacillus paracasei
LIYSVTLNPSIDYVIELPELELGAVNRLTHAVKLPGGKGINVSRILQTLGLPTTAWGFLGGFTGTFIQDRLDAIDMPCDFTKTAGDTRINVKLKAASETELNASGPTIDAAEIAAFKNKLDKLEAGDVVVMSGSLPKGLPNTFYRDLIPVIHAHKADFVIDTTGQALLDTLPDHPLVVKPNHHELAALFGDPEYTSTDAIIKAGRRLLGLGAQHVLISMAGAGALMIDQDHAWHGTVPKQPAVNSVGAGDSMLAGFTGTFAQTHDTLESFKVGIACGSATAFSEDLATADKIAEVKQTISITEV

SEQ ID NO: 3449 - protein, 669 aa, Lactobacillus paracasei
EIIABCCMPNENTMDIRDLLLKNVMIMDLKGTSKEAVIDEMVAKYHAEGIVTDENEYRQDILKREAESTTGIGEGIAMPHAKDSAVTRATVLFAKSDQGVDFNALDGQPVHLFFMIAAPEGANNEHLAALAALSSLLINPKLVADLKQAKTPDDVLALFGKAQAEKEAKDKAEEAKEKAQEEQEKADKQAEFKAEKRQERPFIVAVTACPTGIAHTYMAEAALKETAEKLGVDIKVETNGSEGIKHKLTDSDINRAAGVIVAADKKVAMDRFNGKKLLNRPVIDGIKKPEELIEETLQGKGQVFHAAGTDNSDAASEEASGGTLWNRIYKDLMNGVSNMLPFVVGGGIIMAISFILEQWLGKTSMWFTFTNNLGTFAFSFLVPVLAAYIAESIGDRPALMPGFVGGYMATVATASVVKAQNPAGFLGGLVAGFAAGWMIVGLKKLLSKMPHSLDGMRTILLYPVIGLAIMGLLMFFIINPIFAAINGALISFLEGMGTGNAILIGVILAAMMSIDMGGPFNKAAYTFAIGVYQASGFKDGRWMAAVMIGGMIPPLAIAVASTFFPKKFTLQERNAGLSNYALGLTFITEGAIPFAATDPLHIIGSSVIGSAIAGGLTQLWHVNVPAPHGGVVALLLTNQKLGFIMSLLIGTIIAALILGFWRPVAKENK

SEQ ID NO: 3450 - protein, 602 aa, Lactobacillus paracasei
MASAHIEHKLSLLPDLPGSYQMKDINGKIIYVGKAKNLKNRVRSYFKSSHDGKVAAMVSQVADFDFIVTSTDKEAFLLEITLIQKYQPYYNIKLKKGTGYPYIKITHERDPKIEITGTIRKDGGYYFGPYPNVYAAQETMHFIQKVYPLRRCNGYQGRPCLYYHMGQCLGACFRTVPEKEYTDQIERIKRFLNGNVGKAKASLTAKMERAAKNLQFERAAEIRDQLHYIEQTVEKQKIISHDNTTRDLFNFYMDKGWISIQVFFIRQARLMKRESRLFPVVNTAKEEFESFILQFYSRKNNVKPREVLVPAGLDNKVLADILEIPVRTPQRGEKRDLMALAAKNSQIKLEDKFRLMELDNRTTIGAMKELMAALNLPMGHVAEAFDHSHIQGADPVSAMVQFVDGQPAKNNYRKYKLDADKTHNGADEAANTREVIRRRYTRLLKERAPLPDLILMDGGEIEMNAAKDVLENELNLDIPVAGMVKNNKHKTAALLFGNADQLINLDPKSQGFYLLERIQDEVHRFAITFHRQLHAKNSLASRLEGIKGVGPKTRLKLLRKFKTINKIKEAPLEDIQELGISKKVAQALKLSLTAEPTPARRV

SEQ ID NO: 3451 - protein, 248 aa, Lactobacillus paracasei
MQHKPLIQINHLTKKFGDNVVLNDITETIDKGDVIVVIGASGGGKSTFLRSLNLLNRPTKGEILFEGTDLVGLSEKELDNVREKMGMVFQSFNLFPNMTVLENIKLAPLKVKAVTDEEATKTAKEILDQVGLAEKADAYPSSLSGGQQQRVAIARALAMHPDVMLFDEPTSALDPEMVGEVLKVMQDLAKTGMTMVVVTHEMGFARSVADEVWFMDGGKILEKGTPEQLFEHPQEERTQDFLSKILAQ

SEQ ID NO: 3452 - protein, 485 aa, Lactobacillus paracasei
MKHLRRWLIALVAVFAAVVTLNMQTVHADDSLAKVQQKGTLVMGTSPDYAPYEFLVNKNGKNQVVGMDVEVARKIAKDLGVKLVIKQMNFNSLLVALQTGKVDMVLAAMSPTNARRKSVDFSNTYYKSGQDILVNKTDAKIYKDHKSFANKKVGVQNGSLQETLAKTQMKTSSTLGLTKVTDLILALKTHKVAGVVAEGAVAKAYTSNDDSLVEIPGHFNLSSDTVGTAIGFAKNSDSLVAAANKSLAEIKQKGLINQYLKTAGSYMKTNTEDTSMIHYWTYFLKGVEYTLLISAIGAFFGVLLGTIFALLRLSKNKLSHLIGVSYIEFVRGTPLMIQVMFVYFGIGIFIDIPALIAGLIAVSLNSAAYVAEIIRSGIDSIPVGQTEAARSLGLSERQTMMSVVLPQAIKNIWPALGNEFISLIKESSIVSIIGVTDLIYQLTVVQTATYKGVQPILVAMVLYFVLTFGLSKLLSHFERKMNHAA

SEQ ID NO: 3453 - protein, 53 aa, Lactobacillus paracasei
MALKINTQTNLNDMFDKFASLPGDKENATGPDPKHHDKLAKKAKEKTEKEAKK

SEQ ID NO: 3454 - protein, 96 aa, Lactobacillus paracasei
MNFNDYQQKANRTLAGNEHVLTNLSLGLASESGEAIDLIKKYTFQGQDLDKVKLQHELGDVLWYLSQIALWADIDFDDVATSNLQELAKRYPQAKK

SEQ ID NO: 3455 - protein, 198 aa, Lactobacillus paracasei
MDVHDVKLTISAVAAAQYPEDGHPEIAFLGRSNVGKSSLINKLIQRKAMARTSGVPGKTQTLNFYDLDSRLFFVDVPGYGYAKVSKTARAKFAAMIETYLTTRQPLRGVVLLVDSRHEPTADDISMYQYLKYYQLRTLVVATKIDKTPKSKRLHVAKQIKQRLDLNQTDDVILFSATTGEGYEAVWSWLEQTAGLEGR

SEQ ID NO: 3456 - protein, 416 aa, Lactobacillus paracasei
MFDNVETTGPVTCSFCGKSQDQVKKIVAGPGVYICNECIDLCKEIIDEEFKEEAYQNLLEVPKPVEIMKTLNEYVIGQDAAKKALSVAVYNHYKRVNQMQTATKDDTELQKSNIALIGPTGSGKTFLAQTLAKILNVPFAIADATTLTEAGYVGEDVENILLKLLQNADYDVERAEKGIVYIDEIDKIAKKAENVSITRDVSGEGVQQALLKILEGTIANVPPQGGRKHPQQEFIQIDTTNILFIVGGAFDGIENIVKNRIGEKTIGFGTDSNEQVDPDKSLMQQIIPEDLMQFGIIPEFIGRIPILAALEKLNEDDLVRILTEPKNALVKQYQKLLSLDDTDLEFTPNALKAIAHQAIVRDTGARGLRSIMEAIMQDTMFDLPSRSDVDKVVVTKSAVEGKAKPQLVLTKGREAS

SEQ ID NO: 3457 - protein, 445 aa, Lactobacillus paracasei
MSAKWEKKGTNDGELTFEIDLPQIQQGLDQAFQRVRKNLTVPGFRKGKVSRTVFKRMYGDAALYEDALNILLPDAYEAAVKESGIDPVDQPQINVDSMDEGKPWVIKATVTVKPEVTLGQYKGLEVPKQNVEVSAKDIDAELEKRREQQAELVVKDDKAAENGDTVVIDYVGTIDGTEFDGGSSKNYSLELGSNSFIPGFEEQLVGHKSGDEVTVNVTFPEDYKAADLAGKAAEFKTTIHEVKVKELPALDDDFAKDLDDDVDTLDELKAKIKKELTDQREEAAKNAVQEAAIKEATDNATIKEVPNAMIEQEVHNQMDQYLGNMQRQGISPKMYYQLTGTSEDDLHKQFEADAATRVRTNLVLEAIVKAEDIQPTEDQVNEEVKNLASEYNMDEKAVRKALSEDMLKHDIGVKQAIDIITDSAKEVESAKDDADKEASDAKADK

SEQ ID NO: 3458 - protein, 578 aa, Lactobacillus paracasei
LAKSTTWRMIAFFWHQLADMKRKLLRIIVALVGVAVASYLVPRLTQYVIDQVIPKRAMGSLIGTIALALLLTAVAGLLSGLSTYWIGQVSLSAIARMRDALFRHTLGLDMHYFETSKTGDLMVVLTSDVNTLQRLISSNTLGLFGSMLSFFVVLVLMLIQNWQLTALILLTFPVLFVLNNIFVRRIRAAYRRVRTSSGVMNNQIQQALTSIGLIKSFTTEKATANTFENVNEQNRDNQLTATRLGATFSPITDFVNYLGTAIILGFGAFQVMHGQFTVGLIVAYTAYLGILQAPIRQVTGLIQQLQQATVSFERIETLQAAVPRVVSPPNAIKLARFHDRIQFDRVGFSYDPSVLVLKNIDFSLAKEQVIALVGSSGAGKTTITNLLDRFYDPTEGKITLDGVDLRQADLESLRQQIAIVSQDVILLDGTIKENLEYGTPNASEAAIWQAAEAANIATFIRELPDGLATQVGERGIRLSGGQKQRIAIARVFLKNAPIVILDEATAALDNESERFVQASFDRLMADRTSLVIAHRLSTVRHADNILVLEHGEIVESGTHDQLMAQNGRYKELYDLQFT

SEQ ID NO: 3459 - protein, 127 aa, Lactobacillus paracasei
MGYPIGKFSKMVSLSIDTLRYYEKERLIIPARDQNNRRTYSEADQRWIAFIKRLKATGMPIKEIKTYARLRYQGNSTIDERLQLLFTQKNRLTAQRQEIDAHIAFLENKIATYYQLKTKLMAENLKK

SEQ ID NO: 3460 - protein, 124 aa, Lactobacillus paracasei
MSDKTRLENGQETLAKVDGAAAANVMHSLADIAPDVGKYILEFAFSDIYNRPGLDLKQREMITVTALLIQGDTADQLQVHLNGALNVGLTKTEIVETMIQCIPYIGFPRVLNGLTDARRVFETR

SEQ ID NO: 3461 - protein, 244 aa, Lactobacillus paracasei
MSVMKQKQRLQQAATLIRQHHQIVAFTGAGISTESGIPDLDGIDQILHKSHKFAGDVFRFLDPTEAIADPHTFYQLYRQTFCQPKALPNKAHEALVKLEQAKKLLGVVTMNVDYLHQKAGTRNLAEYWGDVRRNHCTICHRPCDWQKTSTSAVPTCPNCGGLILPDFVLRHLATYPDEIRHGQQMLAKADLLLIIGTRYPATSFQVSCPKIVINASQVSMENLAESNTVYLSGEATELLSSIIA

SEQ ID NO: 3462 - protein, 29 aa, Lactobacillus paracasei
MLNAQYHLLEIQRKKQPYNGDLQQPIFPR

SEQ ID NO: 3463 - protein, 149 aa, Lactobacillus paracasei
MVTYNNRFFHGERPLFGQKHATIIGTTFGKGESPLKKCRHIKLNQSTFQCKYPLWYSQHIAVSNTIFETMARSGIWYTVDIAISDSAIQAPKTFRRNQDIRLKNVHFSDASESLWNCDHISLDHVQASGNYFGMNSTNIVADYLDLIGD

SEQ ID NO: 3464 - protein, 285 aa, Lactobacillus paracasei
MSLVTKRFHSLGGKVYINPDGHEWKRAKWSAPVREYWKQSERMMVKRADLIVCDSKNIELYIRNTYRSYRPQTTFIAYGADLPRTFKTSDKTDLVEWLKDHNLKERDFYLVVGRFVPENNLKTIITEFMKSDTEKELVIISNVEQNKFYKQLLLETKFDQDSRIRFVGTVYNKGLLTLIRSVAAGYIHGHSVGGTNPSLLEALAATDVNLLFDVGFNKEVAEKSAIYWSLKSGSLSAKIHQVDSMDSKKIKILGKESTDVIRERYSWLYIVKEYEKLFTTHRGTE

SEQ ID NO: 3465 - protein, 451 aa, Lactobacillus paracasei
MRVLHYFLGWPPARSGGLTQYAVDLMHAEANKGTEVYALFPAYNFFRNFCPLSDLKNKYDSKVITFSLNNSEPLPLKGSISSPKDFMKPGNIIAYLNFLKDLHPEIFHIHTIMGLPREFLLACKQLGIKIVFTTHDYFGISPNPKFIFDGKDFSCKNSTETWLACSTDSASVTKLRLYQNPLYPFVKSTLRTFKRILQKDNIAEKDFTHKSGNNNFHNEDLKSFQVLRNYYLDMLKLIDHYIFNSFVTKDVYLKNLNFNPTFDVVPVTTAEVKLPKKRIVLPMYTSRNILKIGYIGPYTKEKGFDLLVDVVQKIPKSRVKLHIWGDSSFTGVSSGNIFNHGRFEHKTISDVFRTFDLLVIPSVWKETFGLTALEAIANHTPVVISSKAGSSMLVKQLFTFEPTKDGLSQWFVDYCNRAIPNEQFIQVSQSLTSMSEQAEAIQTVYWKVLEK

SEQ ID NO: 3466 - protein, 329 aa, Lactobacillus paracasei
MANQTVVLTVTYGKRADYVSKMAQKLKEDTNVSKIVVVDNGSDNSLELDELAKQFGSLITIIHSEENNGSAAGFARGLQYIFENLKKADYIWLLDDDNLPSSECLSILLRQYRSCQIEKGIFAAFREDRKELLASGGSHYIPNSFFGFDLKTKLLFNKKDIQKESEEKLLACDTVPYGGLLLPMSIAKSNGLPNTNYVLYNDDNDYTYRLTKQGYQLNVCVDALIHDLESSWYRREQVPMFQGIFKTKMLRNAVYTIRNRTYFEKNNIVTNDTVYNLNILIYLIYVFLFYMPKTRNGWVRFVLVTRMIKQGLCGQLGPIKNTKYEYAVK

SEQ ID NO: 3467 - protein, 394 aa, Lactobacillus paracasei
MSVRLISRSTKIKFIFPLILGFFLSFFNRKKHLGPNTPLVLVGGHLGKEFDDNAKAMYLYLALKTDVNVYWMQAKDSKYKIKEIENPKISTIGSIESYRLYFSSRFVFFTHSNSTDIAPLADHFMIHRPFEVYISHGIEALKGPIKGGRVEADLFTAVSPFEKKIKVEDWKLPSRNVKVTGMARFDAYWPSSDKKVRRILYLPTWREWDLGSDGKGWEESETYKHLLQLFDDQQLLTLLAENQAKLIFHPHPFMNGTMGIFKQRSNNYIKFDSSTPISQEIMDCDALITDYSSVAIDFLYLDKPLIFYQFDQSEFLKRRGAYLDYKTELFGPVVYNEAAVREEVQKLLEGDFESKRDSKISKKLFAFRDHENCKRIWLTAIKEGRIRHQSKRGG

SEQ ID NO: 3468 - protein, 437 aa, Lactobacillus paracasei
VIKVIVAFIGVALIFFSVYYFFNPRREFKPLYFAVVLFAISFSIALSHQTYRIVGEDLTLYIHFYTIVIFTLLLFHIRPTMLKPSVDWVFFIPLGIQAIISWRTGLIVSLPDFLRLGLNYATIGMIMAIAKSAPKFSLRTFFKIFNYLAIFNGILSVAQIITKKSLLLGNADSSILYTEGIVDTFRAVGIAGSNNSAGNLACLLFVICLYNLRDKFGWLPLSGVVMSIVAALLAQTRIAFVGMAIAAFIWFFSYETYSRNALLTKYIMGILFVLGAMFVLGIEFDKIIQVFFSDRGSTQDARFSQYVNAWDFGLKLHPFLGIGMGQWRSYLYNFTSIVDIPIHSQYFAVLIENGIFAFAGFVLFNFSLAKKAFQTDKDNRTLRSFVVAFFIANFVVANFNPNQIYTVNIVIYYLVICLIAYYKKRPLSEFNLGSKKN

SEQ ID NO: 3469 - protein, 409 aa, Lactobacillus paracasei
MKIRKILRDFSYSISSNLISLAVSTLVVLIVPKFIGVTEYGYWQLYIFYTNYVGVLHFGWLDGIYLRYGGYHYRDLDRPTFFSQFIQFLIFELFFCLILVSVGLSSNSPENQYIIVSTAFAMVLINLMQFFLYILQDTNRIREYAIVTTIGRILYFVGVLFCLVVGIKSFQEYIVADLIGRAIALLYAIYTCREIVFLKLTYFNASLKETWLNLSVGVKLLIANFASNLIIGVVRYGIQLHWGVRVFGKVSLTLNISSFLMTFISAISLVLYPVLRRMNEERLRKVYSVIKTLLIFVLLLGLFVYYPLNWILPIWLPKYGEALKYMAILFPMCVYSGKFSLLIVTFMKTYRLERKLLIVNLLILALSLVLTMFNVFILKNLTLTMVSMIVILWFQSTLGDLDCNNKVTT

SEQ ID NO: 3470 - protein, 306 aa, Lactobacillus paracasei
MAIITLIERSQIELLQHHTIQYIAATLGRSRISIRHELHRCPEGDYCAIIAQDQANACRHRCGRHSILTPRLKRMVTEKLNLGWSPEMVGYAVHCAPHTIYHWIYQRQVDFQPSQLFDHGKRHKRKQDLRSRYNQAVGTSIEMRSESANRRTEKGHLEMDTVRGGRGSKAAVLTIVDRVTRLMATTKLENLSQNAVLKGFARLMVNFPGPVRSVTVDHGKEFSCDQALTKRYQIPIYFCHAYHPNERGTNERFNRELRYYFPKGTQFDQVSEANIQRATAFINNKPRKCLRWQTPVQAVSKPLSRW

SEQ ID NO: 3471 - protein, 219 aa, Lactobacillus paracasei
LKNISKDLTKLSKFQILIAAGIKVLRGVGTKPFLQQSHGILFVGKHVHISNRQLISVDSKVKFEDYSEIQGLSQHGVHFGEASTIGRAVQIRPSSYYGVGHIGYGFQIGSNSSIGPGGFIGCAGKVLIGDNVMIGPNVTIIAENHNFDRKDESIKKQGVHQEGIVIEDNVWIGANVTVLDGVTISTGTVIGAGAIVTKDVPADSILIDKLTPRVKPRIR

SEQ ID NO: 3472 - protein, 222 aa, Lactobacillus paracasei
LETASDHRRVHVEQVNLGGLTPRYLITKRCFDFTASLVGLILLSGLFLVLAVLIKIDDPHGQVFYSQTRLGKDGRLFQMWKFRSMVTGADRMVDKLLKKNDVEGAMFKIKDDPRITRVGRVIRKYSLDELPQLYNVLRGDMSLVGPRPPLPREVVKYTDYDRQRLTVVPGVTGLWQISGRNDLGFSEMVALDIHYINNACIPEDLKILFKTVLVVIHPTGAY

SEQ ID NO: 3473 - protein, 152 aa, Lactobacillus paracasei
VANYIREIRSKVGHMPIFLNAVAGAVVNEQGQLLLQKRTDAGNWSLPGGMMEYGETFVETLQREMKEDAGLLVEPVKALHTFDQGFTTYPNGDQAQIICRFYLVKPVGGSLAEADPKETLALQYFDFDQLPPLFNQQSRDMISFVQAYLQAH

SEQ ID NO: 3474 - protein, 229 aa, Lactobacillus paracasei
MAKLVLIRHGQSEWNLSNQFTGWVDVDLSEKGVEEAKHAGQLVKQAGLEFDQAYTSVLTRAIKTLHYVLEESDQLWIPEMKTWRLNERHYGALQGLNKKETADKYGADQVHIWRRSYDVLPPLLKATDEGSAAKDRRYADLDPRIIPGGENLKVTLERVIPFWEDHIAPDLLAGKNVIIAAHGNSLRALTKYIENISDADIMNLEMATGEPVVYDFDEKLNVNSKNKLD

SEQ ID NO: 3475 - protein, 68 aa, Lactobacillus paracasei
VKKIWLSIAGVWLISVIYFIVYLTVPAMQVAVNASGLLSLVHGVMDLILLGGAFALIAGALYRIFHRR

SEQ ID NO: 3476 - protein, 356 aa, Lactobacillus paracasei
MFKICPNCGAHNTATAKFCTRCGTSLAGVVATAETAVQSAQPTSENEASTANTAAVSEQSSVPSSLTSSTAQNQPVTPQQAQSQVTPPDNSQQQVPPQPAGTQTQSQQTAQGPAPTAQPYQQADQTQQQAQTPPEEPNPTVEATKKYAGSYWRYLVDSIKHPATVTRPYHQYFGLTSLAITIVSLALTIALMTGSAVSSLPGAIASNVLMTFLKLVFLVAVLMIAVVAVYYLVVNGMLGDRRRSFLTFTTEYAFHCNWMVFFSVFTLLMQMLGMINIGSIFLIWLLLSLGSGLFVISGTYMLFTAQSTNRFDKIYAYLIVGILLVIVFLIIMTFGLSSILGGIGQGINDFGRSFNF

SEQ ID NO: 3477 - protein, 102 aa, Lactobacillus paracasei
MTNTAIRYTPEFKQTLIDLHEKGHSFKELHEEYGPSLDTIRKWVQAATVIAIDHQGTAVTNEQFKQLQKENRRLREELDILKRAAVLLAKRWRWSASSRQVK

SEQ ID NO: 3478 - protein, 76 aa, Lactobacillus paracasei
MKKPPVCLHDLIRTAVFVIKLFERLDAYLIKGTSRKLNDMEPINDDLGLGENRMNNRLISCIHVHGDRLDPSAVSE

SEQ ID NO: 3479 - protein, 47 aa, Lactobacillus paracasei
VSISDALQLMLGFGMFVVALLALVVELIKNQQKNILSLVMNHDPTGL

SEQ ID NO: 3480 - protein, 845 aa, Lactobacillus paracasei
MARTKAEIKAWEHEMAQRATEQLSALADTQKFKQYLRQNAAFHGYSVRNVLLINMQHPNATRVAGFKQWDKLGRHIRKGEHAIKITMPIVKRLTPEEQVKYKTTAERAIVGYRYGSVFDVSQTNGKSLLSATDFIKERLGDHQNVDRLYHAVVDVINTEGHVKVSEAPIDELGVRGFFRPSTQEIVISPQETDAAMKLKTLFHEYGHSQLHGIGQTFADRPRAWKEAQAESVAYIAMQNIGIDTGDYSLGYVATWAKDPKVMAQALKEINEASVHTIELSDQAAQTLGFDQAQTAEATLNDAPEQTANLNSGKRERLTQSEINRARKLSLVDIARSAGIDLKEDSRDYYRGVDHDSLVIDAKKNLWKWNSQNLGGGAIEFATTFLDQKGFYQAVKFLNAGHYDETKIQTAPKAAYHNYLKRADSFDQARDYLTIARGINPHLVDRLYQKSLIFQDSQNNLIFQWARNGKAVGASIQGTEIDFKKYGKRGTQKKIAANSQSGFGFNFSLGQPQDLYVFESPIDALSYWTQHPELTNCMIASVDGTKVESVVNMAVNMYKTKGQLPATIYVGSDNDPAGHQLYDKLQDSILANTEAEVTTFKPLFPQDNAITQTTYQGLKQAANQAGIDWRELAAAVKATTNLSTNYQQAFPLPQAIAKSSMLINPGKTNFNSDEALLTAAKFIKANRTDDNKPNWDAITKKLNPGIEDHDREHLATKSSYYNTRYQADNGILPVTKIAKDWNELAKLAQHPATMDQQLEKTYRREDGQTVKLIAKDQNQYALVDRKQPDKVVGYFEANDPQQCAYLIKQYGYNAVDKEDEQKYQQTQPVKPQQHKKQRAAGLEQSM

SEQ ID NO: 3481 - protein, 81 aa, Lactobacillus paracasei
MPAIYADEMQVLGSELPVIDNLADYPTVSLQPTSTKMRRVAWQQVADNQYRALYALEPIIKPVPGAEENVTWEEDGEDGED

SEQ ID NO: 3482 - protein, 414 aa, Lactobacillus paracasei
MPSRVSPGIVNVTDFVAAHAKKFGSYINYIDREEAIRIDHFDQQNILSVDGYNHYMENPKKSSGIFTDQYDHLTPTQRVQLKKQFTVAQKHQSVMWQSVFSFRNDFLAENNVYNPKTKQLDEAKLRDATRVAMNDFTGKMGMTHSAIWSAAIHRNTDNIHIHVAIVEPQPTREWKRVTVEGKHGETYQEWQRKGYVPKKILNHFKAAFANEMVDRDRSLARISDLIRQRLQPDQRSVWRHQSSLDFAVRYQELVKSLPRDRRLWKYNNNAMQPYRGQLDAMSRNYLMRCKPEELGEFKQLLAQETRFREALYGSGTKEANRAQDYTDNKLHELYARMGNSILKDISAYRTEQEAVSQTHHQPSVANHLNGLQKIFNADIKAQRLAKREYQRRQSDQDREREQDKKKQAQQTRFY

SEQ ID NO: 3483 - protein, 145 aa, Lactobacillus paracasei
VRIRKTVTLDSNLEGFANPEDVQKYMDQNDLKTLSAALKSLMDEHHQLSQQVMQKQQLVHEIVQGIMEQLKPTTKKVTMTDRNLLVLLKLFDGVVVQNGWDNLPIPDDTMKPTTVARRIVSDQIKTEYIRHQTTQVHHRGGGADA

SEQ ID NO: 3484 - protein, 84 aa, Lactobacillus paracasei
MAELKVRDLSEQDLAGIESSAKRAHLSREAYLRELIHHDATDHLLSGDVSDLRELTRQMAIIIEQNTKAYLDFVDAVRRLPSEN

SEQ ID NO: 3485 - protein, 59 aa, Lactobacillus paracasei
MDKKNETRRVMMTLSDQAIAKLDHLVAEKQRELNQNPELAKYNLRLNKSNILEAWLSKQ

SEQ ID NO: 3486 - protein, 273 aa, Lactobacillus paracasei
VNIKMMNQGIHFQDKNKYSLRYVKLLGILLAAFSLLIFAIVLWPRQTDNKQISLGQTFDQGNNQFQFAGIDTDKQSAAMYFYVTKNTIDPLAPLTTVVVTKKTHSGNDFHTQLKQIADDYYVVKLKKSAISNGRLFVKLGLGKDLSVVTSAIDFVLLDLRHPTKVTSLTEGVYLKNYLKILRSNTTDRVASLEKKLVQYNHDLKILKTSLARQKDTANLQVGKQKRATEQRMTQTETNIQDKKQDISDTQSAIKVAQNNLQSYEKRYQHYAHH

SEQ ID NO: 3487 - protein, 135 aa, Lactobacillus paracasei
VKHPFRHFLINAVIGIVIATSSLSALYVYAPKAMINVATPITINAQKKDQYILYYSPTCSVCQQVYRTYFWRSVTGQLKFASVANEQNKEAAAALGITKVPTLVHYKKGKVVTQYTGHQEQQIDKVLAGGKAGEH

SEQ ID NO: 3488 - protein, 214 aa, Lactobacillus paracasei
MNRKTILVSVMMILALGVGVYGWTSANTANKNISQQKQELRTMASKNGSLETQLEALKLSNQVDRASSQADNASKKSTTTSSQSDNLTDTTQKITEMMNGLLQGMYSPKTATTMGQYEAMKPYLTGEAIQSFMPDRDTPISANGFQESTINDLRVFVTPQGDDYLLMARYELGNNKTNTNKKTTMVFQGTVRKVSNDYKLAAFDSNRALSGVTP

SEQ ID NO: 3489 - protein, 336 aa, Lactobacillus paracasei
VKKLSKRWLLRLIFGSLSSFVLFFVLFMVLIAAMFAGLNDKKGGGSDCDITGSISATGNFNKDTYQQAWSKYFTSGVLKDEADYTIKAANKAGVSPTLFASIMGHESGWGKSSAVSHQNNPSGQMSGSTIISYPTIEAGIDATAATLHNLVVERKLSTVEKLGSVYCPVGAANDPTGLNANWVPSVKKTMLEFGADAGAPLTTTCNSGAGSVGNGSAIITEAKKYLGVPYVWGGKSPATGMDCSGFVGYVLMQVTHKSYPQYTVSLESKGTMLFNGGKPVMSELQPGDMIFCGDHGASHHIAFYAGDGQVIEEPEPNDVCHIRPYKDYEPDFAVRP

SEQ ID NO: 3490 - protein, 642 aa, Lactobacillus paracasei
VKLKKLDLDQHFVFKTQPAGGIDTRNELYLNMGDHYMTTIHIFDIPEEFSDFWLTGITEIPGVTTTVDTVNNNKADFVDNIAEAITELTVQLDHAKNIADSDEIQNEIDPLRSLSLSLRKDGEVIRQTYIRVYCYAATRDQLERKVNEVVKQIRKMSFKASVFLGEGMEEYQAMFLPAGEQRYLKNAREGIPLSGEVLGLSFAHNQTSLNDPFGSYFGYTQTGGTVYWDQFLVDKQRTYYNLFLSGDLGSGKSTQLKKIIWERAIRSDLVRIFDRSGEFRDTVHALGGKVVSLDGRDGTINLLQVYPSVTVGDSNEVDPVGSYKAHLKDLSVKYRLFNHDASRQEAQYFATQCDGLYRQLGLLGDSKGLTQKPFITERDANDYPTLSQLIDFVDQKRQNRTDDMEKKLLDHIYVTLNNLRKTYGELFDVHSTLPDYDGELVVSYDLSALADSYPEEVQDLQIYNALISSYNVCMKQGRIEKKAFDDGERSLEDIHHFLLVVDECHTLLNTNKAYVADLFVRIMSEDRKAFGAICLATQRLERMFPSGDNAQDRDTVSAINALRQIYTLCQYKIVLKHDATTIGTEKNPRILRQLLGDILSPSEFLQIPKFDKGEAMFLLGSEKLHMHFQVTKQELAIFKGGA

SEQ ID NO: 3491 - protein, 198 aa, Lactobacillus paracasei
VATKFDAVEARKRQKEAAKKKERKDGVGRIYPVVGITNSGYIKLAHNGLMFYADVFKPKSFDLFELSVQDADQIESELWGLHQQYPGSIKELYMNFPETNQRQQTYFRRKIEQTRNPIYLELLQHDLAVLKQLEKTYRKLSSWIWFFGDSVPELERNLELARHASTLYTFERAGLAEKEKMLQMMNNPEVSVSETEEA

SEQ ID NO: 3492 - protein, 111 aa, Lactobacillus paracasei
MAHKVIYSRRLIVKGQYNKLLTIRDVFIAGAVSGVTFVVLIVTTPMAVALFGLILMFVLTAALRIQSGVPQKNNLQVMKQLLLRKRVIYHAIDDPIRQLLFKRGEHRGNKV

SEQ ID NO: 3493 - protein, 685 aa, Lactobacillus paracasei
LSTIEYLEKFQPVLHKATWINDGLRWIGWQIIRMLANLADGLTSMYSQAFKLIDFWNSKDVSGFVAAYQPIFWVLCTLGIAWVGFMMIHRTKTDFHQKINNLMVALFIFIGLGTLTSTLSGLVVAGVGTSLQKARPAVSIVSNNMTDLMRINNDGWKSLSPNPSTSIKTIDDVNNLDINETLDTGNTLLNHMGSKLNATGNEIMSHQLTMGGDGKYQLRDMKAFFHDIAYYRYSFHPYLTFFELFAFTIAIILVIIKVFVSIMEIGFITMLAQGMALSDIDSGKRNLALIQKLRDTFIVLFLTSVMLQLFTFWTSALANPSNQQSPVAQCFGIIAGAMFLINGPNIVTSLFGMDGGARGIGATLVGGAMGLRAAGGLGRGMARGVSNAAHATAHGATRAAGYGAGFANAFRSNKSNRSSGSKPSIDGIGAEAAKQNAATPDLETPATTDPALGKQSGTDANPTSSSGAGPDMASLSGTEAASEAPATTGPDMASLSSTEPASEMPAAAGPDMASLIGTEPASEAPAAAGPDMASLSGSEPMQGDQGELSKPKTAQRTMGQPAPKGSNFATGTNTRGQSATSNVGSQAGNRASIGNTSPDSGTQVESGTQAVDTGSAPQQIPAETRTLGQMWGGRVVPALAKHSQTVRLAQRSYNRGAAIPSNTRKVIQSAKNSYQNHNEQPTFRR

SEQ ID NO: 3494 - protein, 818 aa, Lactobacillus paracasei
MNHEKRQWREALGNKRFLIAIAGLWLIGGLLILNWLTHIPSMFLKLMKQAPSLQTIVATVLHPANFLWPDFTYLLVVLLYLVGLVALVIYVLIRTYRWRKAFQSINTGQKGTGRFARVAEVAAASIAIPLNDYPYVGKSGVPQLHIKKDQMDKYELKTVVQQYRGADQHHGVDLVDTSGTNTVAVAGPGGGKTTLFSLPVLDFIMRASVHDSVIITDVKGEMLRSTKAEFEARGYRVAALNLVDPTYSIAYNPLELVKQAYAAGDFDNAQMLCNTFSYSIFHNPNAKEPMWEQSSISLLNALILAVCKVCFDQHTPEKITMYTVTTMLSELGANPDENGMTKLDKFFSKLPSGDPAKLQYGTIQFSQGITRSGIFTGTMAGIKNYAFSNIGRLTATNDFNIADLATGDKPVAFFIIYPDYDNSNYSLVATFLSQVGYVLAKMATLAADSKLKRRVINLYEELGNLPRIEGLPHYLNVGRGRGLVYYLILQSIAQLEANYGKEGAAEIMGACGNKYDILADNYDDAEYFSKQIGQTTVIAPSRHGAPMDTDKSFGESQETRRLMMPDELLRLRKGEVVLIRSKQRSDLNNRSITAWPIHANPDEGTELPFSFEYLTRFNHQATFAELYGDKKPAHNDIDLKKMLLDITVTTIEPQNENDDPEITVKVNGHSLNADSDEPQVEQSTSEPPATDENTDQSTEETPPLGSQKSGQESKPDQDNIHRSEEPEPKDPKKQITTEIDQQATPLSTLFSKSQLQMIEKGVQELLTQDDYAEYQSLDSVEAMTHWLNARRAMKDFAAQLDFAYQKLDAFKKKEGDNA

SEQ ID NO: 3495 - protein, 192 aa, Lactobacillus paracasei
MRAIKTISSFTSDGLDDRVNETTRYLIAAGYQVIGISVAGEWCKTATIIYETGVSADQMKPTTLRQHSERALELIVSLLALVLLYHALPAALLTQSQLYQFVLTAAALVCAVFFVQSLRVIFPQWGIMIGLLVLAVYAHILEQDIYGIKEHPLMLIVMTIIVALALYVLKIAYRRFRKVYWRLVEWMARRGE

SEQ ID NO: 3496 - protein, 139 aa, Lactobacillus paracasei
MEDINSVQLSGTVITDVKHRQNQDFLTASTYLECIRDHQDRTKKVNVPVKLYNETAADFVKNVKLGDRVLITGRFDASVFSEAPGQSTTRYFIMAASFVKIVKEAVPAVDDQLNNPPKATHDTPTESSNYSNVLPRGFN

SEQ ID NO: 3497 - protein, 516 aa, Lactobacillus paracasei
MKNQQTNNKKRHIIITTTAVALLGAGGLWAATQAHSNQQATHTSSYQTKMQKPKASKGSQAKKEKGKNTVNDIIDQALGDSNTSTSSEDQAFKSATNSVLDSNPIAAIAKTLDTPAAKASLAAATAAVEPPKALNDNSDDTASVKPLTNDTTETSQTDQGKTNDDGKTPIPVNPIEPVDPDKPVNPITPVNPDNPDNPVNPVDPVNPVQPEQNTAPVLNVPEDQTVSLSHNGTFDVLNGVTASDKEDGDLTKAIKVTGNVDLSKEGTYTLTYSVTDSAGQTTSAKRVITVANDLPVISADDQTIEVETSFDPVVNVTASDVQDGDLTKDIKVTGNVDTTKLGTSQLTYSVSDHDGGQTTKTINITVYAKDASFSGLDALTVQQGSTPDLRKGVSVSDPYSATPSDFTVTACDTKTLGQKSVTYSYVDKWGHVTTKDRVINVVAEKPVFKGLQDQTIKQGDHFDPMTGVSATSTNGPVTISYVGEVNTQKAGRYTLTYTATDQNGQQAEQTIVVTVE

SEQ ID NO: 3498 - protein, 413 aa, Lactobacillus paracasei
VYAKFECSRKLRQFLKKKRQLSLSEAEKMISAADDYAIQHHFKEDVNFKIIGQDGIEYEDNLPIGTGQGWLHNLLLILDHAYQTVLSDQSPEAFKAFSDRVRQELTIEEQPKAVQETLPVVARQEKAHHLKPIVSKEEEAVRKAESSAPAAAKQKPQKSKPVPLRRQARKKPMWQFPQLKRPKIRLSAQIIKRFVLAAATILVVAIFMLFLMRPKPVPSYQTLIQNASYVQAAKLYPSKHSDIEARLVKDNDEKSLAAFVQKYPSNNGRFDLAYMQKKFSTVISVSQDADLTAVRKVKLAISYIYQNQPENALTINSEIKSPQLQQLIFLALIHEGKLDQAATLAKSMNNKDADKVLEVGKTYQAAYEKAKADANNSKLSETDRKQALKDQHNWLALRKSLGGKSRYEESTNE

SEQ ID NO: 3499 - protein, 75 aa, Lactobacillus paracasei
MQGKVIALLSAILGFIIAIAGGYAAVKFGLMGIAHMTKDQQKIREARDGMTNVAIGLIVVIFASAAVAWLQGLAG

SEQ ID NO: 3500 - protein, 58 aa, Lactobacillus paracasei
MAISKAQMNNQKQMLTEILKQQNLAYEDWLYQRMTDEIESHRKLILQALKNLNMKEGH

SEQ ID NO: 3501 - protein, 88 aa, Lactobacillus paracasei
MFNLVLQTKDIKEAKRKNGLLEIRFPHPKEKALMLKLRHAVLSIETGWPILPDTTCIGEIVRVLPSKDRVIVAYVRPQNGFQRFVESH

SEQ ID NO: 3502 - protein, 92 aa, Lactobacillus paracasei
MAEPVGIWLHDRNLKLISKDHDALSYRVRASWVKDHADYPIKPGMTVVIGNIKPPNQLKNVLVLKVGSAELKRDGSLVISGERIKSVPKNLI

SEQ ID NO: 3503 - protein, 119 aa, Lactobacillus paracasei
LATKTMKLAIENNDGIKPDTVHSDQGTAYTSSTYNTFLAGEGITHSMSRPGTPGDNSPMESLWRHLKIERFSFEHCLSELEMMKRIEAAINWYNNERRQETLNGMTPMTYRNHAVKKTA

SEQ ID NO: 3504 - protein, 77 aa, Lactobacillus paracasei
MDASLMEQRRVSEEGFRVVKLCCWRRMVGRVTVVGVTVSNQKATANYVPAAAVIRRWQALSGFIGRKASAGGFLSLM

SEQ ID NO: 3505 - protein, 400 aa, Lactobacillus buchneri
MADSKVQPRMGNTGFIIFLALLSAFVPLSTDLYLPALPEMTKFFAVPEIVMNLTLILFFVFYSIATLFWGPLSDRYGRRPILLVGLTLYMLASILCGIATNAYEIIFFRILQAIGGGVATTVATAVIKDVFVGRKQETTLAIVQSMVVISPAVAPVIGSLLLTFISWRGIFFAQALLGLSVIYGSIIFKETHASERGTTSVMKSFGRLGALLINPGFTALLITFSLMSIVSLSYISSSSYIFQNTFHLSSRMFSLFFSFNAIGMLLGPLVYIPLSKYIDRFTIVYTAFGFTIVAGILVMVFGRMSPIAFALTQFPATLASSAVRPPGTYLVLKQEENDNGSASALYSAGGTIFGSVGMVIVSLAEATPVAAIAWINIVMGAVCAVLLLVSMTFLRKKIVV

SEQ ID NO: 3506 - protein, 152 aa, Lactobacillus buchneri
MIEHIQGIKGEKLNQIAQIWLDANLDAHSFVNPTYWTNYYDGVKRELAKAELFIDTEDGQIQGFLGIEGNYIAGLFVAKQYRGQGIGSHLLSAAKQTRSELTLAVYEKNSRAYHFYINEGFQEENHELDQVTDEFAVNMKWTKDGGAKDGRQ

SEQ ID NO: 3507 - protein, 831 aa, Lactobacillus buchneri
MHSYQGLPKNNYYKGRKSKQYFLCWMMIVISMFVGMIIGVYNAKADDTALENPFSFSTTLNDTSTYSSNQAINMTFLLQKTAGIKAGDQIKISVGKDDSGTAGFDLDSLQINAVSSGNFFDVSTDSNGDQATITLTAKDGIDYASLAKAGVSIYLKPATDDLNQKSTVTYPVHVTYARGTSTAEIQQLHLNVNNVPGTSGGGATTMNEEIFGGLGGLTAPSGFNSDGEDKWDGNFYAYTPMGSDAPADEALLYWYSQNATVAWVQVALPTNADKVPKSFTWTLSTDSQNNPIADPEKLKVYESPDNDKPMANQPEVRWKYDAAASTNGKVVIQIQNLSAADAGRDLNIPFAVTTKSVTDKFIVTSNISNIPNNGAPLHKTAQMMYNSTIGAGFIPTLTVKTIKTSLSNARKMLFNNDSQTLKSDEDVLKQFATASDHNQPHSANQLHFGNGYKYQSMLAYDKIQAGQTYEIPIYASNDAGDTQTKYAKLEVTPDENQLTNLNAEFVDVDGQTSFPNNHFTLTPTSSTKAGDTWDLNKILTYGTVPTGYHVASGTELNGKVQPTVVWGTTTSPVDVYVKKDTTPTPTPKPTPTPTPTPSPTPAPKGTVVYGLKKIYLYQNTTFSTHERRAGYVSKPRVYRPMFVVTGYGHSANGRLRYQVRDVNHLTKNRGKTGYITAQWAYVRPVYYQTMHSTVTVINPRGVNAYMYKNLTAKTRNYKQGTVLQVTKIVKHNLTTRFVLTNGQYITANRKLVTMDKQTQPRYIKVKKAIYRYQDVNLSKRNKRTHFKKGTKIKIKNYDYSHANSVSNHGALRYHVAGGYITGNTKYVKIVK

SEQ ID NO: 3508 - protein, 160 aa, Lactobacillus buchneri
MSTYKNKVYLASPFFSDGQKDRIAQVVALLKQNPTIDADGIFIPQDHQFESEPFGSFKWQDAVFASDMRQVHKADVVVAILDYQLEEGLTEPDSGTIFEIGSAHEANIPVIMVQFGENGQLNLMLARSYTAFFNGKDDIQTLKDYDFNNLEQKYTEKKVL

SEQ ID NO: 3509 - protein, 404 aa, Lactobacillus buchneri
MAFIGALCLLLILTTLAGHLANRIGIPSVIGQILVGIVVGPAMMGWIHLDNLINLFSQIGVIILMFIGGLESNLKLLRKYLRPAIIVAIIGVIFPVIMIGGACWAFSFAPLEAIFIGVVFSATSVSISVEVLRDYKSLDTKEGATILGAAVADDIIGVILLSIMISVMGTAGVKTGDSSTNLALIFIEQIAFFALTYLMVKWIVPYLMQIGERLLMASSVTITSMVICLGMAYIAEAVGLSGAVGAFFAGIAVAHTPYRETIENHMEPIGYAVFVPMFFVSIGLNMSFANIGNSLLFVGVLTFLACISKLFGCGLGAIINGFNLNSSYMIGSGMISRGEMGLITAQIGFSSGLLSDSYYSDLILVIILSTLIAPFLLKHAIHLLPADDKADLSLPVENGVPSDH

SEQ ID NO: 3510 - protein, 460 aa, Lactobacillus buchneri
MENNTKKLSFKHYLIIGSMLFGMFFGAGNLIFPIHLGQLAGAHWMSAGIGFLLTGTLLPLLAIIAIAVTHSNGIYDLAKPIGSRYATFFMVLVCATLGPLFATPRTATTPFQIAFASHLNPTQQPMWLLIYSLIFFGITFWASRKPTGIINSIGKILNPAFLALLAIIFAFAFMSPISSASKAPIADAAYQNGSILNGFLQGYNTMDCIAGLLFGIAIVTAIKSLGATSAKEISMTTMKSGALGIGLEAIIYIALIWLGATSLGSFKLSIDGGIAFNQIANHFMGITGEILLAMMATLTCLTTAVGLSTSFSEALHAKFPSISYRAWLIIATGLSFGIANFGLDTIIAWSTPMLMFLYPLAITLIILSIASPLFNHDRRVYIWTTIFTIIPAILDAIAAAPAIISKSAFASTILKLDDFLPGASLGMDWLLPAAIGLIIGLAIHYIGAMMGAKTTQIEND

SEQ ID NO: 3511 - protein, 50 aa, Lactobacillus buchneri
MRNMLNRSKSGGISRVTNNQYKITGILAYINYEERLIWKIIQRNYHLNII

SEQ ID NO: 3512 - protein, 588 aa, Lactobacillus buchneri
MGSRHSSTILKTVLKSAFVLTLTGAAVLGAQGNDVKVNAKSDTSVSNELNPVPASYGYFVDHYKENVKTNSTPDTNPAIALFNNTFLSYWNPTDGTKTNQKVLQDNLDKSIQITNGASQAEIDRSYLTDRRDLRYNLISGFGPYAPAFIKDTNVQTDFNAVPDAPLPAGSPYSSMQWADENSTLGSAVKLVDIAEDSAWSGTGTPKAYIKFTRPYRQSDQVKVNPYLKNVMASAAANDYDFPSGHTTAAFETGETLAYLFPERYQQLITRSSEVGYDRVLAGRHSPLAVMGGRVIGTAMTAATLNDPDNKQLINQAYQDTQKDLAKAQDKSAKDDFSDYQTNLKNYTYRLTYGFSPIGDTTKPMVVPKGAEVLLQTRLPYLNATQRREVLYTTGIPSGYPMTDDTEGWGRLNLFEAANGFGSFLDNVTVNMDASKGGFNAADTWKNNISGKGSLTKEGSGSLSLLGNNSYKGGTTVKAGTLAAENDNALGDGSLTLAGGNLTLSAKNVVVKGNYTQSGKGSLNVNSGDKVSVSGTAKLGGKLVVKDVKGLKSGVVILKSNKLSGKFAHQSLPKGWHLAYTTHNVKLVK

SEQ ID NO: 3513 - protein, 465 aa, Lactobacillus buchneri
LNKHLTLLIATGSLLTAAIVSMQIPTTLDAKVKITTNQSYKKTSFLINSNRNAHVWNAKYNRKLHNLKNYPRTNFYSTKRVTIRTNHYFGSYYYIHSANNKIKGYVWHGFLIKGTYYKGGFYRYPTFNVLLSNQPYRRGGMSRIGEWDASGVYASSNRIHGTVNQNELKPFAITPALNDQKQALTYLKQNWSYLPEMLNYGQHNGARIVMRKVYYATNQWLKVPMIDILNGPAISGNWEEINPFAAVLDLSKLPNGAKPIANYDVGQVTVLPLGSRAFDFPDPTAQVTNYNSGPITRIYGNNLGPNHNLSLVDLNRWLHYVPTNDIFKLSNTQPTLKDGIWYFAPSFESGVGSGTHLQQMLNQINPTQSPYYRTMTGEGFIQAHYENGHWHQQFELSTNLPAFNKGNGITLTISKMITKSSGSSSYTTADNANAKTVKHFDSNDADVSDYFFKPASYYETFLNND

SEQ ID NO: 3514 - protein, 582 aa, Lactobacillus buchneri
MAKMTAGQALAKVLVSWDIDHLYGITADSINNTVDGLYQERDKIKYIQVRHEEVGSLAATADAKLTGKVGVSFGSAGPGATHLFNGLYDAKMDHAPVVAIVGQSATPIMNTYFFQEMDQDPLFVDLTDFHKQVTNPEQIPYVMDEAIRYAYQTKGPAVVIIPDNLSGEEIDFEPYKTAKVLKPATTMNVDQKAVDQVYDLLKQAKHPVLWAGLGLKDARDEVVAFSERFSVPVLTTAPATGVMPTDHPNFMGSRGRLGTKPGFEVTQAADLIILAGTNYPFSRFLPKGIKFVQINNNVEDLGKQHDIDLTVLADAKPFLAKLNEKEPIAPTPFLKAAQKDKQNWDAWLNKVADDDHDGLAPEAVIRAIKENSDDNAVFGLDVGNNLMWSIRQLPFNHDQKLSMSAWFGTMGYALPASIAGKLSYPDRQVFSISGDGGFSMVMQDLLTQVQYQLPIINVVLENGAFGYIQHEKITASQEPYGIHFIGANWAGFADDMGAIGIQVTDRQSLKGAFEKIKELQVNGNTKPILIDAKVKNQDPVDTSFMPIDPDQFDQAAIDSYTKQSNLFDQPALSTLLKEESNS

SEQ ID NO: 3515 - protein, 413 aa, Lactobacillus buchneri
EIIBCCMPNENTMHLFITTIKKTQKGFLGFINLLADIFVPIIPAIVAAGLLMALHNVLVAPHLFMTASLVAAYPQFKGFAAFINVLANAPFAFLPVLIGFSATKRFGGNPYLGAAMGMMMVSPSLVSGYDVSNAVANHSLGYWHILGMPVAQAGYQGSVIPMLAVAWLLSVIEKQCHKRLPEALDYTFAPLITILLTGILTFMIVGPVMRDVSDGLTNGLLWLYQTSGAFGTGVLGLFYAPLVITGLHQSFPAIETQLIANVKQTGGSFIFPIASVSNIAQGASALAVFFLTKDKQQRGLASSASMSALLGITEPAMFGINLKLKFPFIASMIGSAVASVYLGLTHVLAVSLGSNSVLGFISIATNAIPAFLISMVIAFVVSFSLTYVYGRRQEVSDLLREDDTDAGETVVAD

SEQ ID NO: 3516 - protein, 395 aa, Lactobacillus buchneri
VTKYKVQSLVFILVAFMLGCNEFIVVGILPDLSAQFHTPISTMGYLVTIFAMVYAVSTPFVTILTSRYSRYKTLLTLMIVFLIGNTLSALSIGYLTMMASRIITATTAGSIISLIMTFASTIAPRDKRASLVSWIFAGFSIASVFGVPIGVAVSTSFGWRYTFWGISVISILTFLLLTQILPKKVKQTTSTIKNQLTILLDPRIYYGVFLVLFTAATMYGYYTYIRPLLTTSMGFSTQSLNWLLFIIGIMSIISNRLSGMLAEKPNSLQKVPLFYVADILLLAVFPFALHSKIAGLAIILILTLIVTIINSPVQIHFLNLAESEYPQSLVFASSLSSIFFNFGISLGSATASSLVGIVGLDRISIGSVVFAVLSLGSLFLINRAIKAHSSTKAGN

SEQ ID NO: 3517 - protein, 170 aa, Lactobacillus buchneri
MNKSLGLTIIFWLNFMISPLFAYVINGVTFFQLFNSGTLPFVKPKLMPWLTVSTFIWILITSYICVGILTKKYFVCKPIVDNQTSKITVQLVILEIILLIIGNVLRLITEGTYSVTSVVNDIAVVSVLPLLFWLNYKFWKSNSQNWVFMGLIIQNLFVCLFMQGFYESVW

SEQ ID NO: 3518 - protein, 259 aa, Lactobacillus buchneri
MKKWSLLLLSLGLGIVMLSNPTTHASSGYTVIKSSFPAGVGKMYHAANPKQNAYVWTTTKHTKKLANIKNYPNTSWHSTGTVVLRHNHKNAVYYRVDAISPTKTKKSVSGWIWRGYLKPGYNPNFTKVKSISLDNATNEEYNQFIKQSKYQQLTRDILALFPNSTVSKPLSRYALFREPKDKIINNVATFKAMDDFLNVKNRLTNQQRLAKIKAILEANGYTAANRQKKYVIGIYLTNFQWSDQYDTGDMHQGFVIGTK

SEQ ID NO: 3519 - protein, 61 aa, Lactobacillus buchneri
MHKKILWLIQFAINCSFMIYLASFPSNAVYSGSGWSILIGLFLVIIAVVAAIILTNLVTER

SEQ ID NO: 3520 - protein, 304 aa, Lactobacillus buchneri
MKAFGYEKNGGPEVFQEYEVPTPEIKSNQILIKTEAFNLNNFEALQRAGQFKPVDHRIIPGRDVAGFVEKVGEDVTGFDIGDRVVAHGHHSYAEYSIGEDSNTVLIPSGVPYLAAAGIVTPGLAAYKGVHLFGKVQAGQTVVVKGASGGVGSLAAQIAMDVGAKVIGVGSSENEEYVKSLGVDQYVAYDQEDPAEVLADTADVVIDAALNGNGAESDVKIVKDGGIVASVADNDAPTDKTVHFNHIHPTQEISDDDALNAMLKLMAAGKLKIRIGYKLPFTLDGVIKGHQLLDSKHAGRIVIAK

SEQ ID NO: 3521 - protein, 246 aa, Lactobacillus buchneri
MRELFDDELKKLHGRFVEMGLTISEQIYKSTTAFIEHDKKAAQEVIDADEETNSDEMKLEKQALSLIALQQPVATDFRVIISILKASSDLERIGDHAVSMARETIRVKGNPRIPKVEKAIAKMTEEVRDMLESALDAYVKSDADAAKKLSDNDVKVDEQYLLIRDEITEAVQSDTATIAASSSYFMVIKLLERIGDHIVNLAEWIVYSAAGQIVELNPGKSNPELVDKLYSEAIVKDKDKGKDSSK

SEQ ID NO: 3522 - protein, 251 aa, Lactobacillus buchneri
MPKIITSKDVHLSYGPKEALHGISLDFEEHDITALIGPSGCGKSTYLRCLNRMNDLIKGVTITGSMKLEDEDIYAPGTDIVDLRKRVGMVFQQPNPFPFSVYENVAYGLRLAGEKDKHVLDERVETSLKQAAIWDEVKDHLYDNALSFSGGQQQRICVARVLAVQPEVVLLDEPTSALDPISSAKIEDTLLNIRDQYTIIIVTHNMQQASRISDKTAFLLNGDLVEFSKTEKMFIHPDDEKTSDYLNGKFG

SEQ ID NO: 3523 - protein, 264 aa, Lactobacillus buchneri
MQEYDYNKTHIIDIPLEKAMTTENLQVFYGDNHAMHDATLQFPRHRITALIGASGSGKSTYLRCLNRMNDRIATVQGKIMYRDMDINSKKINVYEVRKHISMVFQRPNPFAKSIRENITFALKRNGIKDKQELNKRVEESLKAAALWDEVKDDLDKSALALSGGQAQRLCIARCVAMKPDILLLDEPASALDPISTAKIEDTLMELRKNYSIIIVTHNMQQASRIADYTAFFHMGHVLEYDVTEKIFTTPQIKATEDYISGNFG

SEQ ID NO: 3524 - protein, 295 aa, Lactobacillus buchneri
MNSKTSNNIATGVIYFLVACVLAILVFLLGYILITGIPHVSWHFLTSAAQSFAAGGGIRDQLFNSMYLLVLTLIISFPIALGSGIYLSEYAPDNWVTGVIRTAVEVLSSLPSVVVGLFGFLLFVVNFHMGFSILAGAIALTFFNLPLLTRSIEESLQDVSELQREAGLSLGLSRWKTITGIVLPAALPGILTGIILSAGRVFGEAAALIYTAGQSAPTVNYGDWNPMDSASFLNFMRPAETLAVHIWKVNTEGVTPDAASISSGASAVLIVVILLFNLLARMLGRWLYKRMTATK

SEQ ID NO: 3525 - protein, 307 aa, Lactobacillus buchneri
MDEIKHDLQNPSKATHEDLFGRGITYLCIGFVSLLVISILYFITTRGLATFTTNHVSLWKFLSGTNWNPALLDKHGNPQIGALPMIVTSFSVTVLAAVVATPFALGVALFMTEIAPERGTKILQPVIELLVGIPSVVYGFIGLSVIVPLIRHSFGGTGFGILAGTLVLFVMVLPTITSLSVDSIKAVPMFYRSASLALGATRWQTIYKVVLRSATPGILTAVIFGMSRAFGEALAVQMVIGNAVLMPHGLLTPSSTLTSQLTTGIGNTTMGTLPNNALWSLALILLLMSLVFNILVRVIGKRGSLKK

SEQ ID NO: 3526 - protein, 297 aa, Lactobacillus buchneri
MKKRSFFSTIVAVAAVGVLLAGCGSSSSSKSKKSSADSNVKITAVGSTALQPLVEQAASNYQKANKGVNISVQGGGSGTGLSQVQTGAVQIGNSDIFAEQQDGIKAKELVDHQVAVVGMTPVVNKDVNVSNLTMAQLKGIFTGKYTNWKQVGGKNEKITVVNRAQGSGTRATFESAVLEGAKAVKAQEQDSNGTVQKIVSSTPGTISYLAFSYVNSKLKALSVNNVKPTDANVTTNKWKIWSYEHMYTKGQPNKATKKFLNYMDSSKVQDSLVQKLGYISIHDMKVTKNASNAVSEK

SEQ ID NO: 3527 - protein, 241 aa, Lactobacillus buchneri
MPLEILLISQNLKLADKLEKLLAAFQINTRISFEPLDHLLQQVSGVVWDLDTTELPENDSELQILRSQIAGPILLLDKQPRSVETICSYFLDYHLDDYICGESASEIVARIVQKIWVYQNKDNLQLTQQSQESESLVVGHLKIDLSKFEVNNGRKKLNLSPIEYKLLLFFVSNSNTVLSRTQIASAVWGNTTGATLRIIDTHISNLRKKIEIEPKNPQMLTTIRGFGYLFKNKGNQQSQVP

SEQ ID NO: 3528 - protein, 262 aa, Lactobacillus buchneri
MAKPRPREQTYEFTDKPSYREWLIETVRAALPDGLELAASNYARSTASSYWLIKGYDDHDQVFWLTLRIATHRLWLQNAHQIEVLWEEPGTFGDLFNAVSNSLHPVAVQNAKFTLSSKDIAVLNLLIALEHHKLIWFIRMVPDIAKAHKDKLFDLKSDFLDCQLLLGDRNNANNLLLPVDVPAFQHQLATYFGENLLFSQFTKHSLLKLLPTNQWIQPMLDEQGNDGEWENEIRNAYGDDFVELCQRELKHQAKVYRKSVGH

SEQ ID NO: 3529 - protein, 359 aa, Lactobacillus buchneri
MKIIKVDLPDRSYNVEIARGILGCTGQLVSSVWSKRKIALVSDSNVAPLYQAQVAEALEAVGFTVHEYQFPAGEESKSVDVLADLARQMAADSFNRDDGVIALGGGVTGDLAGFLAATYMRGISLIQMPTSLLAQVDSSVGGKTAVDLDTTKNIIGSFYQPDLVIIDPDTLKTLKKRDLVEGYGEIVKVAALSDGDLWNLVKSINSPEDILANAEELSIHSIQYKADIVMGDEKEGGLRQLLNYGHTIGHAVEALSDGGLRHGEAVSIGMIAMQQIFEDKGLALTGITQELRERLEAVGLPVTSDLLDSDQVFEKIKNDKKNRDGHLSLIYIHTIGGPVIKSIPSDQVKDFLAIKTVKA

SEQ ID NO: 3530 - protein, 338 aa, Lactobacillus buchneri
MIIVLKNGHEDIIDEIKSRFTETNEVFVHNNRVAIQGVSEDDLNAEEKNAIDLIIDNVPAAVQGSRLFHPEDTVVVTPHSQIGGDNFTMMAGPCSVESAEHVMKMAKVAKSGGATILRGGAFKPRTSPYSFQGLGEDGLKFLRAAADAYDMDVLTEVMDQDHVAMVEQYTDIFQIGARNMQNFSLLKAVGKTQTPVMLKRGMSATIDDILNAAEYIAAGGNHNIIITERGIRTFDNKYTRNTLDVGAVPVLQKLTHYPVIVDPSHAAGHTEFVTPEALAGVAVGASGLVVEIHDDPAHAFSDGAQALKPDEYRAMAQQAFAIRKVITTPVEEKSEVKL

SEQ ID NO: 3531 - protein, 493 aa, Lactobacillus buchneri
MNLDQLKQYTKDFSAIPISINFAMPDFDPIAVTQRFDQPDAPCFLLTGKPKQQEDGYSFIGLNPTLTITYRNGVLTRSDEQGNVSHETTDLKPVLERILADNRMPKLKHMPPFSGGLVGYFSYDYARYATTADLPAVSDPMKLNDVDLLLINRVIAYNHTTKMVTLIQVIPADQLTTQYESVMSSLTDLKDEIMQVHKQQPLPPFTMTPFKLQFSLCEFEEKVAEAKHHIVDGDIFQVQLSNPQHSKMTGSLFAATPTLFKESPSPYQFYFRHNDFETIGASPETMITKRDNTLFTYPLAGTRRRGKNQLEDDAFADELQHNPKELSEHNMLIDLGRNDLGSISQFGSVKVTAYRNLLKFSNVMHMGSVVESKVDPDVSSIDIIHSLLPAGTLSGAPKISAMQIIGELENNKHGLYGGCLGYLGFDGDLDMCIGIRLAYRKGDDLVVRSAAGIVADSIPKHEYQEFNNKARAIVTALQETAAKGGVCDALSNR

SEQ ID NO: 3532 - protein, 202 aa, Lactobacillus buchneri
MHYLIDNYDSFTYNLYQLIGTQTSEEIKVVKNDAITVENLMKANPESIIFSPGPGRPEDAGNMPAILDAFLGKVPIFGVCLGHQAIAEALGAKVVHVPKLMHGKPSNIQISLDDPLFADCPRHFEAARYHSLIVDPTTVPDSLDVTAVTDDGEIMAISNPAKMVYGVQFHPESIMTDPEVGKQIINNFLTIVKIAKVSTTAR

SEQ ID NO: 3533 - protein, 182 aa, Lactobacillus buchneri
MKKKFRLQDVILLAIVAIVFGAIFVGTDYLYNFLAVAIGPFSNEALFGLWIMAGPLSIYLVRVPGAAIIGEVLGAAAEVIFGGTFGASALISGIVQGIGSELGFTLWGYKNWGWPVLTTSAVTTTVVSFGYELFRLGYVHYHLPMILALFSVRLISVFFFGAVCVRAIFKMLSRSQVLRQVQ

SEQ ID NO: 3534 - protein, 425 aa, Lactobacillus buchneri
LTDKQALLQAVDAHQDQLLVLLDRLISFETMSPPARNTVAIQRFLDDKLTKIGFKTKREAFYDGDELLSAEKAGTDAANYHSLLLNGHVDVATVDRQSWHTDPFKLVHEGDLLYGRGVSDMKGGISSFVYIFSLLKQLGIDLPGDLRFQSVVGEEAGEAGTKTLLKNGETADFAVVGDTSNLNFQGQGGVVTGWITLKSPHIYHDGNRAAMITTGGGLKAANMIEKMMVVIQALEKLEQYWGITKRYPGFAPGIDTINPAYIEGGLHPAYIPSVTKLWITVHFYPNENVDDITHEIEDQVLAAAKVDPWLRDNLPTFTWGGDSLLVDKGEVFPSLELDPDHPGMQALESNFAEVAGKQPTLGMSPSVSDSGWFGYYHIPAVDFGPGTMKQAHSDNESLSFQQLLTYTKIMAAFIYDWCHSKGEKS

SEQ ID NO: 3535 - protein, 158 aa, Lactobacillus buchneri
MKIRKYLVTFGAAAAMVAPTFLSSVVANADTVQPQRQQQGHKQDNAKAAKQVGGKNLSQQPRETGSQYTNDNSGYNVTVKATNLINTLHYNVKTSTDSGASSADPFSISIYKDGELYKTISSSTGTLSGSLWVGSGTYSIKVYTSSAASHWTGGLATS

SEQ ID NO: 3536 - protein, 53 aa, Lactobacillus buchneri
MSDQADEKEPKPTKIRRPMQGNCPKCHRPMSISYGLNRCPNCGFIFKSNFKVE

SEQ ID NO: 3537 - protein, 182 aa, Lactobacillus buchneri
MDHQLTRLSKRLSYVLRHHPDKIGIQLDRYGRVDLQTLIQKFNQHFGTPISEKIIREIMKDSDKQRYAIEGHTIRALYGHSIPVDPLTPPVEPPEKLYHGTTHAAARFIVDEGLKKMDRDFVHLSANPQMAIQVGKRRDPHPVIFEIEARKAAASGLLFYPTESGVWLVDSMPAKFLKIIDQ

SEQ ID NO: 3538 - protein, 212 aa, Lactobacillus buchneri
MKTIYFVRHGQTLLNQFRRMQGWVDSPLTQKGESQAKATGEKLADVHFDLAISSDMMRAIHTLDIILANNQSSAGVSREVSLDVREIYFGSFEGIDSIQTWNMIGGPLGHRNQEDLIEEYGLLKMRDFMHAADPFHEAETSAHLESRINSAVEHIQSELVDGQNALVVSHGTFLRNLATLYTDDATSVKQPRNGSITQLDVTDTPHIISYNE

SEQ ID NO: 3539 - protein, 195 aa, Lactobacillus buchneri
MKVFKEIMSWVIPILVGLLVALLIRQFVFTFARVDGPSMEPNLVNKERLIVWRHAKIKHLSVIVFDAHGEDPTATKPKTDYVKRVIGLPGDTVSSKNGNIYVNGKVVPQKFISMSERTTGTGNWNLKSLSKSWDKNTNATKVPKGEYFVLGDHRSVSNDGRYWGFVPKKKITGVAKTFFWETNKTKRTNVNSLGY

SEQ ID NO: 3540 - protein, 400 aa, Lactobacillus buchneri
MNTNLKLGNKIWLVFILGTISATGPLSIDLYLPALPEMTRDLSAQPSLIQLSLSACLIGLALGQLISGPLSDKYGRKKPLMIGFFIFGLVSLMIAYSSSVYLLIGLRFIQGLAGASGQVLSRAIASDMFSGPLLTKFYSMLSAVNGIFPVISPVIGGFMIRYVEWQGIFILLAVIGFVLVLALWLGIKETLPQEKRISGSPGKSIGQMFKLLKNSRFVRLVLATGLVSGGLFSYISASSFVFQNFFHMSVQNFSLLYALNGIGIAIGSVIPGALAGHFSEAGQTKVILTSTFITSVLLTLSALFLNNLLLVIILVFLTVTQFGMLFTLTTSIIMNLTLHNNGGLSAMLGLSQNAIGGVMSPLVGLMGTGTYLPMSVAIMGCMGLSLFLFSTIHNSQRSLS

SEQ ID NO: 3541 - protein, 643 aa, Lactobacillus buchneri
VKSLRVSDVKQKYRGQDYDVIVVGAGHAGCEAALAAARMGNKTLLLTINLDMVAFMPCNPSVGGPAKGTVVREVDALGGEMGKNIDKTYIQMRMLNTGKGPAVQALRAQADKHAYHAEMKHTIEKEPNLTLRQGIVDSLIVEDGVCKGVITNTGAECYAKAVVIAAGTAARGKIIIGELMYASGPNNSQPAEKLSGNLEALGFDLERFKTGTPPRVDGTTIDYSKTEEQPGDEKPHHFSFESSDENYLAVKDQLSCWLTYTNETTHKIIRDNLDRAPMFTGVIEGVGPRYCPSIEDKVVRFADKSRHQLFLEPEGRKTEEWYVDGLSTSMPEEVQQKMIHSIVGMENAQMMRPGYAIEYDVVAPYQLKPTLETKVVKNLFTAGQTNGTSGYEEAAGQGLIAGINAGRRALGKGPFVLKRNEAYIGVMIDDLVTKGTKEPYRLLTSRAEYRLLLRTDNADMRLTEKGHEIGLISDERYAKFLAKKKAIEAEFDRLNTIRIKPSDEVNQFVQEHGDKPLQDGVLASIFLRRPYVDYETLMRFIPQAETKPDRHVIEQIEIQTKYAGYIKKAEQSVEKMKRMEAKKIPDRIDYDAIDGIATEARQKLQKIHPETIAQASRISGVNPADIAILSVYIQQGKISKLAE

SEQ ID NO: 3542 - protein, 464 aa, Lactobacillus buchneri
MVLTTTEFDTIAAISTPPGEGGISIIRISGEEALDVAKKLYRGKDLDKVASNTINYGHIIDPDTNEEVDEVMLSVMRAPHTYTEEDIVEINCHGGIVATNRILQLALSHGARMAEPGEFTKRAFLNGRIDLSQSEAVMDLIEAKTDRSMKAAINQLDGNLSHLIKHLRQDILDVLAQVEVNIDYPEYDDVETMTSKLLREKATDVHARIVQLLKTAKQGKILREGLATSIIGRPNVGKSSLLNNLLHEDKAIVTDVPGTTRDVLEEYVNVRGVPLKLVDTAGIRDTTDKVEKIGVDRSRKAINSADLVLLVLNASEPLTDEDKKLLSATQDKQRIIILNKTDLPTKIDQDQIKSLADGQNVISTSAIKADGLTQLEELIAKMFFDEGIESSQNDIMVTNARHIGLLNQAKQALEDVVKGLDDGMPVDLVQIDMTRCWDFLGEITGDSYQDELIDQLFSQFCLGK

SEQ ID NO: 3543 - protein, 236 aa, Lactobacillus buchneri
MTIYSGKTIQDAVEQGLTALSLTSDQVEVTVIQQPKNGFLGFGRKLAQVELVSKTNTKQQTNLNKSTNQPVSESKHHEEETENAVDIEEVSQKLANYLNDVLEAMGFSFKLKLDLKNRHSIYIDIDTDQESRLIGRHGRTINALQNLSQIFINRLGANNVTVELDTANYRSRRSESLVQLADKTARNAIANGKPVYLNPMPAFERKQIHNALADNDHVMTYSTGKEPHRVIVVAPK

SEQ ID NO: 3544 - protein, 317 aa, Lactobacillus buchneri
MANTNQYDAGRNIQIDRQHRLSKLQEASQITWVNLSAYSAIMVAELIIGYLAQITVLIADGLNNLTGVCGAAILIIGLKMSKRPPDSNHVMGHWQYENIAALLSATIMFAVSIQIFVDGVFAVQRFLAGHTIRPNDWSLGVSIIAAIIIGILARFNKTKGIQLKNQALTASGQDLKSDAWTSFGTFLSIGGAYLGAQWLDGVATLIVGCLILHSSISIFRTTIMRLSEGFDPKDIQRYSETISAIPGVLGIEGIEPRWLGDQIVMKIGIYLDDDTDLKTAYAIGEKVEHNLMEKYDILDADVMSYPVSQKDNPHSAD

SEQ ID NO: 3545 - protein, 256 aa, Lactobacillus buchneri
MAKLAIVTGAGQGIGEGIAHRLAKDGFAIAVADINGETADKVTADLVNDGYTAKSYHIDVADRERVFELVQKAVADLGELAVYVNNAGVAFIDEIVDSAEKDIRRLLDVNLLGTYWGTQAAAEQFKKQGHGGRIVNAASLAGVEASALQSAYSISKFGVRGITQAASKELAKDQITVNAYDPGIVRTPLRDGIDKRTAEIKGISVAEQQKNCLSEISLGREATPEDVAKVVSWFASPDAAYITGQSILVDGGMRYQ

SEQ ID NO: 3546 - protein, 336 aa, Lactobacillus buchneri
MTKMMKAAQIQHFGQQQLEIADVPIPTIGDHDVLVKVAAASINPIDLKTRDGKLKMLLKYSMPLRLGSDFSGTVVQTGTLVKDFKVGDEVYGRVQKNRIGTFADYLAVDQGDIALKPANLSLVESAALPLVSLTSYQALIDLMHVKPGDKVLIQAGSGGIGTVAIQLAKSLGAFVATTTSAKNTGLVRQLGADQVIDYHQTAFEDVLFDYDDVFDTLGGSQLANAFQVVKPGGKVVSISGLPNRAFAQQAGLPMWKQLAFSLATAKIRRLQRQFQVGYEFLFMKPSGTQLAKITKMVEHGTLQPVIDRVVPFFDIQSAVDYSAAGRSVGKIVIKMA

SEQ ID NO: 3547 - protein, 112 aa, Lactobacillus buchneri
MADLHQIQTEFANISSFLTALGDQTRQAIIISLLKTNSCEGLQVTELTSVTGLSRPAVSHHLKILKDAHLVAVRSEGTKNFYYLSHDIKEINELKTLLDHVTAIIHQTETKS

SEQ ID NO: 3548 - protein, 225 aa, Lactobacillus buchneri
MKKVLIVLTNVTRYQGTNDPTGLWLGEATEFAETIQKAGIDVDYVSPKGGFVPLDPRSMKYTNESIMKFYETEDFQKRALTNSLRPNEINPDDYLAIYYTGGHGVMWDFPNDRALQQIAWSIYDNGGYVTSVCHGVAGLLNIKDDAGRYLIAGKSITGFTTAEEIIAGKKSVVPFLNKQAVEKRGGKFKKKRAYKEYAIQDGRLITGQNPFSPRAVARLLLENVH

SEQ ID NO: 3549 - protein, 375 aa, Lactobacillus buchneri
MKTIVIATDSFKGSASSQEVAENLQRGLTVANPSLKIKKVPLADGGEGTVTAIVDATKGRLISTRVSGPTGSQIDAKWGLIDDQTAVIEMAAAAGYTQGQTTDVAVRSTYGVGELIEVALDHGVSKILLGLGGSSTNDGGVGMAQALGGHFYDRNGHEISRGIGGLKDLAKVDLTQIDHRISVVQMIGLSDVENPLTGQLGATRIFGPQKGIQDEQIADFDARLQRLARLTAATVGKDLSQVPGAGAAGGLGFGVLAFLKGKLTSGIEEIMKLVDLKAMLCDADLVITGEGRIDSQTLSGKLPMGVAKLADSAKVPVIAVAGSLAADIQPLYDQGFDLIVSTTTRPLTVQEAIHQAPQLIEQTGFRIGKLIQLIN

SEQ ID NO: 3550 - protein, 278 aa, Lactobacillus buchneri
LKKRIKKLLVLLSLVSLTVVLSACSNAPITNHSTGIWDGWVVLNFSRAIIWLSKFFSDNYGMGIIIFTILVRIVILPLMIYQTRSMRKTQEVQPQLKALQKKYSSRDAETVQKLQAEQKKLYAEAGINPLAGCLPLIVQMPILFALYQAIWRTHILRSGTFFWLQLGHPDPYFVLPILAALFTFISSWLAMKGQPESNSMTTMMTVGMPFFILIMAISLPSALSLYWVITNAFQVGQTLVIQNPWKIRRERENKQREEREKQRAIKKAIKRAKKSKRK

SEQ ID NO: 3551 - protein, 121 aa, Lactobacillus buchneri
MRKSYRVKKESEFQEVFETHNSVANRQFVVYSLDKPNQLHFRVGISVGKKIGNAVHRNWVKRRIRQSLLELKPYLRQDVDFIVIARPAADQMSMSDVKASLIHVLKLAKLIDPNYDSEEKS

SEQ ID NO: 3552 - protein, 44 aa, Lactobacillus buchneri
MKRTYQPKKRHRARVHGFRKRMSTSNGRKVLARRRQKGRKSLSA

SEQ ID NO: 3553 - protein, 449 aa, Lactobacillus buchneri
VLDKDSLWQKLSEQFRSNTTDLTYDTWIKPVKPISFDGSTLTLSLPSELHRDYWKEQLAPNLIEYAFVITKGNIEPKFILDSDVNKEAQEKPVDNNVSQDQDGDEFSFSKENHLNPNYTFDNFIIGKGNQMAHAAALIVSEEPGKLYNPLFFYGGVGLGKTHLMQAIGNKRLEDHPETNVKYVTSEAFTNDFINAIQTNRTEEFRREYRDVDILMVDDIQFFAQKEGTQEEFFHTFNDLYNNDKQIVLTSDRVPQEIPKLQERLVSRFAWGLPVDITPPDLETRIAILKNKAKLDNLVIPNDTLSYIAGQIDSNVRELEGALSRVQAYSKLKDEPITTDLVYEALRGLKLSQDNRQLSIVDIQNKVASYFHISINDLKGKKRMKSIVMPRQIAMYLSREMTSNSLPKIGKEFGGKDHTTVIHACDKIAEIIKLDADLRKEIADIKSALN

SEQ ID NO: 3554 - protein, 379 aa, Lactobacillus buchneri
MKFSIGRTAFTKGLNTVSRAISTKTTIPILTGLKIVAGPDGLVLTGSDADISIETTLKADDPDNMLVIESEGAIVLPARFFTEIVKKLPKDTITLEVGENFQTMITSGQSSFTINGLDANNYPHLPEIQTNDSIPLAADLFKQIISQTVVAVSNQESRPILTGVHFVISDNHVMAVATDSHRLSQRKVTLETPINGSYDFVIPGKSLTELSKMIDDGQDEVSLSVTENQALFVIGNTLFYSRLLEGNYPDTTRLIPDSHDTRISFEAPELLAAIERASLLSHESRNNVVKITIDPDKKTVTIYGNSPDVGNVEEDLEPKSLEGNELEISFNPDYMKDALRSFTQATINIDFTSALRPFTLTPTEDSDSFVQLITPIRTF

SEQ ID NO: 3555 - protein, 76 aa, Lactobacillus buchneri
VKKDVFIDSPYITLGQLLKEESIIASGGQAKWFLRETTVNVNDEPDNRRGRKLYDGDHVEVPDVGLFFIRSKQGNE

SEQ ID NO: 3556 - protein, 372 aa, Lactobacillus buchneri
MKLTEIELHNFRNYVDQTLEFSDGINVFLGENAQGKTNLLEAIYVLALTRSHRTNNEKELINWNSQTAQIKGRLQKRLGTVPIELDLGSKGKRAKVNHLEQAKLSTYIGQLNVILFAPEDLSIVKGAPQVRRRFMDMEFAQMSNRYLYNSTQYKKILKQRNRYLKDLHYKRQKDRVYLDVLSDQLSAYGAEIIYQRLQLLKQLEKFAQNVHSEISQGKEQLTFDYHTTVEADQLGSVESIYQSLLKHFAAIKDKEILRATTLIGPQRDDLHFVINGKEVQSFGSQGQQRTTALSVKLAEIDLMKEQTDEYPILLLDDVLSELDDFRQTHLLTAIQDKVQTFLTTTSLSGVQQELLTNPRIFRISEGNVTLAK

SEQ ID NO: 3557 - protein, 647 aa, Lactobacillus buchneri
MADEKETKKELAHEYDASQIQVLEGLEAVRKRPGMYIGTTSSQGLHHLVWEIVDNGIDEALAGFATKITVTVEKDNSITVTDDGRGIPVDIQKKTGKPALETVFTILHAGGKFGGGGYKVSGGLHGVGASVVNALSSELDVEVTRDGKVYYMDFSRGHVKTKMKVVREVSDDLHGTKVHFLPDPDIFRETTTYDIKVLTARLRELAFLNKGLRIVVRDLRPEKPTEQDFMYEGGIKHYVEYLDNSKETLLDEPIYVEGVMNGITVEVAIQYTNDYHNTLMTFTNNIHTYEGGTHEEGFKRALTRVINDYARKNKLLKDNEPNLSGEDVREGTTAVVSIKHPDPQFEGQTKTKLGNSDARTVTDRIFSDHFTKFLMENPKMARKIVDRGMLASKARSAAKRAREVTRKKSGLEISNLPGKLADNTSKDPKISELFIVEGDSAGGSAKQGRSRLTQAILPIRGKILNVEKASMDRILANEEIRSLFTAMGTGFGEDFDLSKINYHKLIIMTDADVDGAHIQTLLLTLIYRYMRPLIDAGFVYVAQPPLYQVRQGKMSRYIDSDDDLNAFLGTLQPSPKPVIQRYKGLGEMDAEQLWDTTMNPENRHLLRVESSDAAEADKVFSMLMGDKVEPRREFIEDNATFVENLDV

SEQ ID NO: 3558 - protein, 850 aa, Lactobacillus buchneri
LANKDNHDEPIAGRVTNVDLSKKMRTSFLDYAMSVIVARALPDVRDGLKPVHRRILYDMHELGVTPDKPYKKSARIVGDVLGKYHPHGDTAVYESMVRMAQDFSYRYMLVDGHGNFGSVDGDGAAAMRYTEARLSKIAMEMLRDINKDTIDFQPNYDGTEREPSVLPSRFPNLLVNGASGIAVGMATNIPPHNLSEVISAIHVLMKNPDATTADLMEALPGPDFPTGGVVMGKSGIRKAYETGKGTIIVRAKVEIEGEAGGKQRIIATELPYMVNKAKLIERIAELARDKRIEGITDINDESDREGMRVVIDVRRDASAEVILNNLYKLTLMQTSFSFNMLAIVKGTPKILSLKEILNYYLEHQVEVIQRRTKYELNKAQARAHILEGLRIALDHIDEIIKIIRGSQTGDVAKNQLIEGFGLDDKQAQAILDMRLVRLTGLEREKIDKEYNQLMKDIEEYKAILASRERVNEIIYQELLEIQNKFGDPRRTELLVGEVLSLEDEDLIEEEDVIISLTHNGYIKRLPTSEFKAQNRGGRGVQGMGVHNDDFVEHLVSTSTHDVLLFFTDAGKVYRMKGYEIPEYGRSAKGIPVINLLNIGNNEKIQAVINVSDKNNDIEKDLFFVTLMGTVKRTPVSDFANIRSNGLKAINLKDDDQVSNVLIASEDQNIIIGTHRGYAVSFNAADVRSMGRSATGVRGVRLRENDYVVGSDILKPDSEVFIISENGYGKRTPAAEYPIKGRGGKGIKTANITEKNGPLAGLTTVNGEEDIMLITDQGVMIRFSVEDVSQTGRATLGVHLIRMTDGAKVATMAKVEKQDDSEDDTKDQSSDSEQASDDSSTNADQNSDSDN

SEQ ID NO: 3559 - protein, 369 aa, Lactobacillus buchneri
MTVVNGYKQNDNEEKINILNLEELEERAKQIIPTGGFGYIVGGSENNWTLKANRKAFTHKQIVPRALSNIENPSLDTNVFGIPLKTPIMMAPTAAQGLAHSQGEKDTAKGVAAVGGLMAQSTYSSVSISDTAAAGNGAPQFFQLYMSKDWDFNYSLLDEAKKAGVKGIILTVDATVDGYREDDIKNNFQFPIPMANLTKFSEGDGKGKGIAEIYAAAAQKIGPDDVKKIADYTDLPVIVKGIESPEDALYAIGAGAAGVYVSNHGGRQLNGGPASFDVLEDVAKAVNGRVPIIFDSGVRRGSDAFKALASGADLVAMGRPVIYGLALGGAEGVQAVFEHLGDELKTTMQLAGTKTIADVKKTQLLSINY

SEQ ID NO: 3560 - protein, 63 aa, Lactobacillus buchneri
MTLLLLIIVGVSAFYYFRSSQTNTRSSRYQNGQDPHAYAYARNEHPEILDKGQTTGRPRKNIN

SEQ ID NO: 3561 - protein, 98 aa, Lactobacillus buchneri
MEEKKYEITYIIRPDIEESAKSALIERFDKILTDNGAKVLSSKDWSKRRFAYEIGGFNEGTYHVVTLTTDSDASLNEFDRLSKINGDILRHMIVVRDD

SEQ ID NO: 3562 - protein, 188 aa, Lactobacillus buchneri
MLNRAVLTGRLTRDVDLRYTQSGTAVGSFSLAVDRQFTNQQGEREADFINCVIWRKSAENFANFVHKGSLVGIDGRIQTRNYENAQGQRVYVTEVVVENFALLEPRSARNNSNGQQNGNAPQQNNGNANTFDNHSNAGTGNSGNSNNNGGNNPTNNGGNNGNNGNNNPNDPFANSGDSIDISDDDLPF

SEQ ID NO: 3563 - protein, 79 aa, Lactobacillus buchneri
MAYQRRGGGRRRRKVDFIAANHIEYIDYKDIDLLKRFVSERGKILPRRVTGTSAKNQRALTIAIKRARIMGLMPFVAAD

SEQ ID NO: 3564 - protein, 471 aa, Lactobacillus buchneri
MRNSRVSLREAILVLVVALAIMGTGVIGLGLSPQVPVLLAITVTIFWAKVTGFSWDEINAGIKDGIDKGIIPIVIFILIGAMISTWIAAGTIPTLMVIGFKAISAQWFLPTVFLVCSLVGAAVGSCFTVVSTVGIAFFGIGVTMNFNPALVAGAIISGGVFGDKCSPLSETNNLAAAVVDTDLFDHMKTILWSTIPAATISTIAFALLGMGHNHADMNKINTTVAALNNDFHISIVALIPIILVFVCAGFKMAAIPTMLLNIFVSAGMMFVNNPGLNVTKASTIITNGFIAKTSNSEVNLLLSRGGIVSMMPTVALIVLTLSLGGLLVHFGLIRAIMSPLATRLNNPAKLVTAALGACIGVNIFVGEQFLSIILPGRAFKKTFNNGGLASRALGRVLEDGGTVLNYLVPWGVGGVFIANTLSVPTIQYLPFVFFSLLCPVFSLLSGFTGVGLKKLGPDQQVDNAKPVTNEN

SEQ ID NO: 3565 - protein, 463 aa, Lactobacillus buchneri
MKSKIQENQDGTMRALSNRHVQMIAIGGTIGTGLFLGSGSTISKTGPSVMLIYLVLGLFFFFMMRGIGEMFYSDPSQHTFVSFISRYLGPTVGHFTGWTYWIGLVFVCMGEISATATYVKFWFPQVPAWIIEVVFLGVLAGINLIAARLFGEAEFWFAMIKIVAILALIFTGIFMMFSHSVTPLGHATIGNIFHNFQLFPHGGVSFIAAFPMVFFAFMGIEFVSITIGEAKNPQTVIKKAVNETLIRILIFYIGALTVIMGIIPWSSITPDSSPFVQVLKLAGLPAAAAVINFVVLTSAASSLNSCIFSAGRHFYQLATEVPEDSWMRKTFAKISNNGVPARAIIFSAALVLITPLISLTNSLASVFTIVTGISSDMYIIVYTLAMLAHRKYRQSADFLPNGFLMPAYKIMSPLTIAFFVVIFGSLFFVPEDIIGAVGAIVWTVVFGAATYIHQRRLVPDTDQ

SEQ ID NO: 3566 - protein, 670 aa, Lactobacillus buchneri
MKNWFTNNRGELPSFVHNRRLRRIMMFISLIVIYGIVISFLYNIVASLILIVISVVGLIFTIVMMNEISSDTNRYITDLSYRIHRGEQESLLEMPIGVMILNDDEQVEWANPYMVKYFKDENLLGRKIDDIDHDLQQLITKYAESDEFHTITWRDHKFTMLIQKEYNSVYLMDITRYANLEERYNEEQISVGQIFLDNYDEITQSMTDQEISNLSNYVTNELATWSQKYGMYLKQIDDDHFFLLAYSKSLTAIENDKFNILDTVRETTSKQNFPLTLSIGIAYGEDDLNNLADQAQSNLDLALGRGGDQVVVKSLDGTARFYGGKTNPMEKRTRVRARMISQALNELMSASDQVFVQGHTRPDMDSLGACLGIRRIAQMNNKKCWIVLDKEKVHSDIQRLLEATKKYPEIADSIITPSEAIAKATDSSMLIMVDHSKPSISISEDLYKRMSAKVVIIDHHRRGEEFPENPMLVYIEPYASSTCELITEMFEYQPHEEEPINRIEATAMLTGIFIDTQRFSMRTGTRTFDAASYLRSAGADSDEMQQFMKENIDSYLQRNHLISKVEFFHKNMALIVGEEDQVYDPVTAAQACDSLLTMSGVDASFIITKRSDGQIGVSARSTGAVNVQVIMEQMGGGGHLSSGATQVSDKSVADVKKMLLETIKNIDDNE

SEQ ID NO: 3567 - protein, 150 aa, Lactobacillus buchneri
MKVIFLQDVRGKGKRGEVKEVPDGYAQNFLIKNGKAKAATKAAMSQLKGQQKAEEKREEEELEESKQLKAKLEDDKTVVELKAKAGTDGRLFGSIPSKQIATALEKQYGVKLDKRKIELPEPIKVAGYTNVPVKLHVDVTAKIRVHVSEK

SEQ ID NO: 3568 - protein, 460 aa, Lactobacillus buchneri
MSNEFVNELPPQNIDAEKAVLGSIFLSTDALVESMEFLEPDDFYKHAHQIIYQDMVTLNDRDEAIDVVTITNILTEQNNLDDVGGMEYIADLAGSVPTAANVAYYAKIVKDKAILRRLIQTATNIVTNSYNTDDDVTTVLDDAERDIMNVAENRTQSGFKPIKEVLNNAFNEIDRLSQEGDAVTGLSTGYPELDKITTGLHSDELIILAARPAVGKTAFALNLAQNVGTKTDKTVAIFSLEMSAESLVNRMLCAEGSIDANHLRTGQLTEDEWQNLVVAMGSLSRANIYMDDTAGIKMSEIRAKCRRLAKETGNLGLVVVDYLQLIEGSNAENRQQEVSGISRQLKKLAKELHVPVIALSQLSRGVEQRQDKRPVLSDIRESGSIEQDADIVAFLYRDDYYRDEDDDSDDSGSEGEDDENNVGEVEVIIEKNRSGPRGTVKLLFVKSYNKFSSISYAQQQ

SEQ ID NO: 3569 - protein, 434 aa, Lactobacillus buchneri
MSKWFSNKFSWLGMLVASFIAVSFVFCILPAFKHMPTNTQNLPIVIVNQDNQQISDKVADGLKDNLPFKHISTSSSLSRTKHRIELRKASLAVVIPDGFNKDVRAGKRPTVNFVVNNANSMVQTNVNQGLISRIQSTVNAQLTQQSLVGMYAKQLAPKMMKTAMATGMKTAMQKAMTASKGQAVNQKQIQKQVQAKVQPKIQKQVMARATKMAAPFNITAKSSTDTMGTKQVNMQHQMAPMFISMGQYLGLMIASIIITMTFMSVRFIAGKWKTFLGLQVTGVITAVVLALLTVGALRCLVSFDGGVFNALLWQNVLYDFAAFELTSGLALLFGGLPSLLIQLPLFVLQIMAGGGTLPRAAMTSFYKFLSQTTPMYQNIYSSYNIMANLGNTGAFQQTLWWVALGGLVIGSLAVWIGYRGKERRGLAAVIPTKF

SEQ ID NO: 3570 - protein, 220 aa, Lactobacillus buchneri
VADAENDFQQLYKETLKKMDGLTDKQKRILQAALELFSTQGFSETSSAQIADRAGVAVGSVYQRFHNKQALLVAVLAPLLNDVLPKAVDEFGNTAFSKSYDEVEPFVRAIVPDRLRFIDQNYAALKLLAGQVIVEDEGIISQLTEAFSSHISSNVIPNIKHLQKTGKMARFPERYVIQFLFSSVIGYFGKRILGIPVNIEDEIKYMTVFLTNGLTDHNVK

SEQ ID NO: 3571 - protein, 238 aa, Lactobacillus buchneri
MAKKILVVDDEKPIVDIEKFNLTKEGYEVSVAYDGEEALQQVKDVDPDLIILDLMLPKVDGLEVAREVRKTKDTPIIMVTAKDSELDKVLGLELGADDYVTKPFSNRELVARVKANLRRQGTNSSSNNEEDENKDIKIGDLVIHPEAYSVSKRGENIELTHREFELLHYLAQHIGQVMTREHLLQTVWGYDYFGDVRTVDVTVRRLREKVEDSPSHPTWLVTRRGVGYYLRNPESDQA

SEQ ID NO: 3572 - protein, 617 aa, Lactobacillus buchneri
VNNRIKFYQSIKFKIALVFALILLVTLEIVGAVFVRQLEHQNLATFKNQIQLQTYVTNSLTTQLSSADETKANGRIKTILNDSDSGNTAQIQVIDNKGTIRGTNQINNQAIVGQKTTDDNVKNAIYNGKKFEKTTYDSSTGARYYTMISPLIKSSNNNSTVVGVVYTRANLDSVYDSINSITLIYLFAASIAIILGLLISIVISRAITRPIEEMKKQTIRIARGDYSGQVHVYGNDELGQLASAVNNLSVRVEESHESTESERRRLDSVLANMTDGVLATDRRGNVIIINETAASFLDLDENQAMGKSILDVLDIRKDYSLRDLLEKPDELILDFSSEDHSLVLHAHFSLIQRESGFISGLVCVLRDITEQQRIDQDRKQFVSNVSHELRTPLTSVRSYIEALSDGAWKDPKLAPKFLKVTQDETDRMIRMINDLLTLSRMDSGTQKMEVELVNINELFNYVLNRFDMILKKEDHPEKTYTIKRYFTKRDLWVDLDTDRFTQVLDNLMNNAIKYSPDGGVITCRLYETRNKVILSVSDQGLGIPRKDIPHIFDRFYRVDKARSRQQGGSGLGLAISKETVEALHGQIWAESVEGKGSTFYIALPYEPVEEEDLWDEV

SEQ ID NO: 3573 - protein, 432 aa, Lactobacillus buchneri
MRFSKYLIPLALTIAVVASLTLSVVLWTNPANYRTNKQTAQSPQTQQMIKPKRYVYSPVQAIHTNADGTQQIMVNKLVNTVTEIKKTMHHYQNPRMKTLSKNSQVDYFRIANQTDSIMLNYSDTVSMRTFNAIVSNRFRKLPNIKINRVVLPTNNSTKLYLLYDKNFTVYEVDVKKHSLKSLNKVLQMDMRTQPASFKLLNNRPTVYVTSSVQMQPYKYLIDRQSDDYYVSRLLNTQDSTSINVKRRKNMTIYGDQSSLQLTFNSRNRMAEFSDFRPNHNRRSLTSTINDSYKNITKLGLPMDNVRFFSYDPKSRTVMYRTYVEGFPIFRASGFGTVSTRTLNSSAQRIQFSLDNPEVPLPSNKGYVSLPSTETMLKRLVNRGYNLKDLQKVRLGYTWKKDSTSPLLIDLNPDWYIYYKNQWRSYTALMNQY

SEQ ID NO: 3574 - protein, 276 aa, Lactobacillus buchneri
VNFRRIEIIFLVTFIAIDIFLFGMFKKNMDMQADNVSQGDSDSVIVKEMRNDQIKVGNLSKKNETAYYISGEQSDVLRNQMGQLVNQTPQFVGHELESELKQPITVDKNNPRKSIDKLLTDSTFVLFGDQYVYSKNLSTSRNIVYNQKAMGSSIYSSEAQIRFTLNSNYQIVSYTQSYLQGIKSLRESSETISETRALIWLYQYNEIPNNTTVAWASLGYTKLLSIDGDRVFIPTWIIAIRPQNSTQVQLKRINAFTGGIIKQTDENLKNSQTSMN

SEQ ID NO: 3575 - protein, 267 aa, Lactobacillus buchneri
MNNDDMKISVLASGSGGNVTYIETPDHKVLCDAGLSGKKIEALMNSIGRDLSDVDSLFVTHEHSDHRLGAGVLARKYGIQVYANEGTWNAMAPRIGKVADDQKNIIAPDSVMDMGDLDVESFSVSHDAAEPQFYVFHHNNKSFVILTDTGYVSDRMEGVIKDADGYLLECNHDIEMLENGDYPWMTKKRILGDQGHLSNEDGANTMLDVIGHRTKKVFLGHRSLHNNMKTLAHLTVASILEDHDMGVGEDFKLYDTSQDHASPLMII

SEQ ID NO: 3576 - protein, 419 aa, Lactobacillus buchneri
LAQNNGFGKFIATAVIAGALGGGITYGGVSYFNNNNNGTGTELVSGTNKNGNTKVSNVKVNLNTQAEKAFNATKSTVVSVINLQKQSSSDDTLSGILGQIQGGSSSKKKSSGELEASSEGSGVIYKKSGNTAYIVTNNHVVAGANALEIILSDGSKVSASVVGKDAVSDLAVIKINSDKVKKVATFGDSDNIKVAEPVLAIGSPLGSQYATSVTQGIISAKKREVPQTSESGQQIGNATVIQTDAAINPGNSGGPLINFAGQVVGINSMKLASDQQGTSVEGMGFAIPSNEVVMIINQLIKNGQVIRPALGIGYTDLSNISEQQQRSILKLPKSVTQGAVVLNVNANSPAKRAGLAKYDVITELDGTKITQQSQLRDILYKHKIGDKISVTYYHKGDKKTGSITLNEKATSKVLSEASK

SEQ ID NO: 3577 - protein, 725 aa, Lactobacillus buchneri
MKIHIKGSILVSMAALGVFAAVGISQSSTVSAKSRVRVTSNVKLKGTGASRNVTFTGKAALWTKASALKGAKRVATTITLRDLAKSTRSSKNVRAYRVARTNRGKVYYKVVTFDGKDRGWIYGGKSRSSFAGGVKSYLTFQQNSLTDDMSNGTFQFANPGTANNNQTVTYKQPAWTQYKVGRQVTDSRPYANVSYQIDQTGMRTREGDQWVHISATNNGNSGADGWILYSGLKKTTNINSPIADNAIRIKLVDSATGSSLTSVDFTKTGVTKGATIGANVNGTWKLDSNDSSSIQSQIASALSPLGYPGFTLTQGQIAAIAQGTFGSSVTISVVKPTINKAVRIVLTDPSGNVINYVDYTTANAANGQPVGVQDGSTWKLAATDTAAIQAKLVDALKGTGFALSANNTLTTDQQAQIAQTTFGNQVSIKTVAVNPIKDNEVQLSFVDQAGKAVGSTTLTKGTNDKTALDTIKTVSVADPTSPYAATLKKAYAALLAKAGIKGYTTDGLSKDQLAANLAAIKAAAYGQDVKLVVAKLPAKALVSSALFFDKSDTKDVTQDLAYFENANGKRDSDANFSKALAGDANINGYAGDVVTVANLNAAVKDQGLNTIYYAAKNDGFLWGAGTHLAASDYSGTNGTLFADGMSGKTIYVFKLTFTAKPDNPDTSIGNRLDSNKPLFDKQGNATIGDTGNQVVLKYDEVKAGKQITLDSNNMKAKTLAELFGE

SEQ ID NO: 3578 - protein, 46 aa, Lactobacillus buchneri
MTVKLVNHDGEWVLPIPEDISPKYESYHVFQTEEGVILCVPLRALK

SEQ ID NO: 3579 - protein, 159 aa, Lactobacillus buchneri
VNIKLVVVGKLKEKYFKQGIAEYAKRLSRFCKFQIVEVPDEKAPESLSQAEMDEVMDKEGARILDKIKDREYVYALAILGKERTSEAFAKEIADLTTYGHSDITFVIGGSLGLSKHVLDRADTQISFGRFTLPHQLMRLVLTEQIYRAFMINEGSPYHK

SEQ ID NO: 3580 - protein, 335 aa, Lactobacillus buchneri
MKVITLEEHFSSQKLGQKMAEVLPKRPIGNVSPEMHDYMQRSLPPEAELEDVTGSRIQWMDQHQISMQILSYGNQNPQNSDPKFAVELTKLANDELAKAVAAAPDRFRAFASLPVSHPTDAAAELKRSVEELGFKGAMLVRPTSQAHPFFDDPFYLPIFEAAANLNVPVYLHPSFPDSQIIDYYYSNGPWDDKVSGILGTAGYGWHTDVGIQTVRLLLSGVFEKYPNLKLISGHWGEFASFALERMDQVMYPETNLSEPISKIYRDHVYVTPSGILTEPQLKFVKDEVGIEHLLYSIDYPYIKPENSGSFIESSPLTDEEKELFAHGNAEKLLQL

SEQ ID NO: 3581 - protein, 100 aa, Lactobacillus buchneri
MSLTPQQEIDTKKQINANFKLAEVPIEQVAQDLDTTPEHVQDILDLNPTRLEEPWILKAYLDEKIIEKGGTPVPYTALLGDPKHYWFLNNRFLKKGKLLS

SEQ ID NO: 3582 - protein, 138 aa, Lactobacillus buchneri
LKDRNSVSSLIHQIAKLEEGLINQQLHELNLNVDQAHTLRYIGDHPGTNQRAITIILRRSAASVSNLLKGLETRNLIEKKFNPDNDREKQLTLTPNGNETVTAVKGAFDVLDEKVDAALLAPDAIYDQLTQIYQQLKE

SEQ ID NO: 3583 - protein, 321 aa, Lactobacillus buchneri
MTKVFIADQIPSKAVKKLQSAGLSVTIHDSEQGLITHEELENAVKDSDFLITTLSTKVDESIISAATKLKLIANFGAGFNNIDTKAASTHHILVTNTPVVSTNSVAEVTLGLILAISHRIVEGDRLMHNQGFSGWSPLFFLGHELAGKTLGVIGMGHIGQDVAKKAQAFSMNVHYWQPEQFRLPRDEENRLNIRFAEFTDLLQTSDFITIHAPLTEENHHQLDAKAFKQMKSSAFLINGARGPIVDEAALASALENHEIAGAALDVYEHEPTVTPELKSMNNVILTPHIGNATVEARDSMAEICANNILDFLAGKSIQSVN

SEQ ID NO: 3584 - protein, 133 aa, Lactobacillus buchneri
MTDSVREAVQEKLANGIFNCPKELTLSMISGKWKINILYHLGTDGPYYFYELQKLLPAASRKEITAKLKELVEDGLVNRKPLKTVPVKVQYSITPLGKSLMPIIDAMLKWGQQRLDDLQLGQVEFGLGKVKHE

SEQ ID NO: 3585 - protein, 195 aa, Lactobacillus buchneri
MNNNSQKPAKPWYKKWWVWVLVVFGLVIAVNAVSGEEDDSASNQSITTATQDSSSSNGDGTLKSNYNVGEVANYKGYKFKINKVTFYNGNEFDTPKDGNRYVICNVTIKNDTDEKQPYNSFDFKLNANGNSTNMMEVVTNEKYTNNTLNSGDLDPGASVTGNLIGQAKQDADLKLEYQPSIWDDKTVKVDINESA

SEQ ID NO: 3586 - protein, 255 aa, Lactobacillus buchneri
MTDRLKNKVAIVTGAGSGMGAAMAKLFTAEGASVVAADLNKDRVDEVVAAIAKDGGKAVSIKTDVSNEDDIQAMFKLAKSEFGQLDIVVNNAGIMDNMAPVGNLTDDMWKKVFAVNTDSVMYSTREAIKEFLPKKQGVILNIASVGGTNGGRAGVAYTASKHAVVGLTKNTAYMYQNDGIRVNAIAPGGIKTNIAESMGKNVDKFGYERQSQGMGASPEPGTAAEIANTALFLVSDEARYVNGAVLPVDGGWTAY

SEQ ID NO: 3587 - protein, 154 aa, Lactobacillus buchneri
MTKSLIIYFSLSGTTKTAAETIQKYTHSDIIRLEPKTPYPAGYDKYSKVGMQQMRDKADVAIQTEIPDLHQYDYIFIGYPTWDGQVPRIFNTLFKENDFSDNRLVPFSTSVSTPFEDTLGSLKAAVGDGVAIVGGFRYSGETQVRDYLKNNNFK

SEQ ID NO: 3588 - protein, 76 aa, Lactobacillus buchneri
MAKFESRILSIPDYVPADIIRIRKLVSADKTKMALFMNVSLRTYKKWETGQSHPSKPARRLLQILEKNPQLIDNWF

SEQ ID NO: 3589 - protein, 550 aa, Lactobacillus buchneri
MSISVIKRSLLSLGILATTVLLAACGSKSSDQGSTKLASNQKISLSTTAEITSLDLSKIYDKTSFIQIDETFEGLYRYDANGNVEPALATKTKISKDGKTYTINIRHNAKWSNGDPVTAKDFVYSWQRAVNPKTASQYTYLFDNVKNADAIVNGKLSPNKLGVKANGKYQLKVQLARPTTYFKMVMARETLYPLDQKVVKKYGKKYGTSAKYTVYNGPFKNVGWTGTNDSWKLVKNNQYWDKKAVKLSQINYTVAKSPSTAYNLFQSGKLDLISLVGEQAKQLGKSKDAVKRPLAATEYLQYNQRKGVFKNRNLRLAFSLALNRSQLINKVMQNGSIVSKGFVPADFAKNPKTGEDFAKEAYVPGTVDHDATKAKQYYKKALSQLGKKNLTIKLLSADDDQTKDVIEFIQSELQETLPGLKVESSSIPFASMLARASAGNFEVNFTGWSADFADPISFLSQFTSNNPENNGKWSSQAFDQAIKDSNNKDANNATKRWQDLINAEKILATDQGITPIYQANGIDLVNPKLKGVVYDRINGHYDYRTAYLTK

SEQ ID NO: 3590 - protein, 358 aa, Lactobacillus buchneri
LDKKSALNLIEHLSNANGPSGFEDEVKDYVVQTASSFSSVHADHMNNVYLKNNQNSPSKGKTLMLDSHLDAVGLIVQAVKPNGTIKFVPLGGWVPANLTAEKMRIRNQDGEWITGLVATKPPHFMTEAEKKKPIDIANLVIDVGTNSAEETKEVLKIDTGCPIAPDTEWEYFKTQDVMMGKAFDNRIGTACLMTAMSDLAEENLDVNLVGAIASQEEVGCRGAKVTVKKVHPDIAICLEGCPADDTFTPEWLIQTGLKRGPMLRDMDTSFIANPHFQQLAVDQAHQNGIPFTRAVRTGGGIDGSELLEFQGAPTICIGIPVRYEHTNYGFVAYSDFENTVKLLKAIILSLNDKVIDGL

SEQ ID NO: 3591 - protein, 255 aa, Lactobacillus buchneri
LDKQYVIGLPAETRIINNLARNTVNDDEVAGVIKHGGVPVLIPTRNPEIMEHYVDLIDGLLLPGGPDVAPKFYGEEPVQNLGDTDAFLDASEIALVKLAVAKRKPIFGICRGVQVLNVALGGTLYQDLYSQRNHPTLQHYQKAPMPQGTHTISTTPDSYLAKIIGQGDSTLVNSHHHEAVKAVAGQLNISALAKDGVIEGVESQDDDLIIGVQWHPEAMFRTDEKQDALFADFMARVEKFANQKAVHDSVSTENE

SEQ ID NO: 3592 - protein, 766 aa, Lactobacillus buchneri
LPKLPTYQTDHQTITFNNSNRQIQLTIITPEIIRVSENRGDHGASYAIEGDKETTTTYTVKQQPDHYEITTTALTIKVDAAMHIDAYDANSNPLVTDYRGSRTPLDRGIDEEHKKFVQEEGHNVPGADDQNNPDYFQVVKDLAPDEQIYGLGDKTGYLNKRGYEYDDWNTDNPAPHLENFTRLYKSIPVIIGLKAGHPYGLFFDNPYRSHFDFGKENPNYYFYSAEAGNLNYYLIGGKTLKDIVTNYTYLTGRTPLPQKWTLGYQQSRWGYSASQKMVQDIVDSMHKYDLPFDVIHLDIDYMRGYRVFTWNDEAYQGNPQKFVTDLKATGTKIVAIIDPGVKKDPGYNIYDQGIKNDYFVKDPAGNVYVNQVWPGDAVFPDFGRRAVQKWWGKNDQFLTDMGVAGIWNDMNEPASFQGEIPQDIVFSDHDQPSTHKKMHNVYGHNMAKATYDGVKRATGRRPFVITRAAYSGTQKYSTVWTGDNHSIWPHLQLLIPQLCNLGISGFTFAGTDIAGFGSDATPELLTRWIEAAIFSPLLRNHSAMGTRAQEPWAFGEPTLSIYRKFLKLRYRFIPYLYDLFAKESKNGLPLMRPLVLNYEDDPRVRNINDQYLVGDAILVAPIVQPSQTKRLVYLPAGKWIDFWNHREYDGQQDIVVDAPLDKLPMFIKQGTILPWGAEVDHISETPDSTMAFNVYGDSGSYHHYQDNGLDFKYQHGEFNDYLVNVDHGQVSVELVHHGFQPYREITVNLNNQPVTLTYNSTTEHYE

SEQ ID NO: 3593 - protein, 276 aa, Lactobacillus buchneri
MNPRLHYLTRSILLPVVLLLIFVFNTSVRADANSADGNPRPVISDELHILNQKQISQIKQINRHLMKKYEGQQIWIISTNKTLAELQDPKFERYLVNIRKKGPTVSRFAMAANPFGDYFAKKLLNYQSQTAYDQDEIVIEGDVNIILIDPNLPYHVMPIASQSFMDNIYDFQNLFMGLQLDYMDVSAANVMNTVDVLNKSIQKNYYAPYGLRDSTFEEVKSALVMLAGFIIFVVWIIDHWNTPLGGGYVRSDEDNYDSGYMDGYYIGLHDHDDDHH

SEQ ID NO: 3594 - protein, 222 aa, Lactobacillus buchneri
MELTTAKNYLLLTERIGKKPMLRTRFTAQAYFVLAALFDLVDQRILDIGETISIKDDQEFAELPDYLSIFKSELTDEIKQGHDLQTQLAIITSWDIANQLYEGLGAGLLADQLVEKKSVKNNLDTHVIYLPKDAARKQVQDYLRNQITGAKVSHDAVNLVLILSELDALKWVFTDKEELANLTAAFQQKVAGDAFYIKEKALAKVAQDVITKKKFWYDSWLS

SEQ ID NO: 3595 - protein, 340 aa, Lactobacillus buchneri
LNAKDNKTFLTLLEKSQEAFTLGLELYNRPTVKYRVEGFSFYICNAWELLLKSYLIKSADSLEAIFYSTKATKRSQSYSISECIKKVFTDKREPLRRNLEKIVSLRNTSIHFVTEEYEQMYAPLFQACVINYVNKLNDFFHIDITERLDQHFLSLSVNIDSLDSKAIKKKYPTSIAEQILRDQMELNEETIHTESTHFGIPINHNIYITKNKKNADFIVSVAKDSETKAAIINKLQDPKNTHPFSYSEVVNQINKWISRKKINFQVTISHGIRVAFNKSDLDLFIKFYEIKTNIDYAYKHVLGNNNQYTYSQKAINLIEKEIKDNPQRIISILKSEIKKR

SEQ ID NO: 3596 - protein, 68 aa, Lactobacillus buchneri
MLNMVKKKRIICEYAFHKTSKELIYEKSKNHDPWENGQFGNFDFRANMEDVGNYDKGSDVGKERVKWK

SEQ ID NO: 3597 - protein, 396 aa, Lactobacillus buchneri
MTSTLFKNLQLFDGLTDQIQSNAWFITDDQSGKIIARGTADFPKADRSIDLCDKYVMPGFINVHTHITSNPATFDGGRNRSETETAVDAYQNLQTFLKSGVTFIRGCGNSYDIDIKLKRMRNKGMLKHTPEIMPSGRTFSMTGGHGDHPHSTYLVDSSDEIRKAVRTGLKNGSQLIKLMATGGVMTPGDFMADPQLSVTEMRTAVLEAHHKGQRVAAHAEGNPGIQNALDAGVDSIEHGFYVTEREANQMINQGTFLTPTLIAEWAIPEFGKHTLPAWEVKKAADALDDTYANISRAFRLGVKITCGTDAGTPFNGFDQTPKEMELLTTKLGMPPFEAYQCSSINSAALCNISDEYGTLEEGKFADFQVLTENPLEDVLAVQQTDKQVYLHGKREF

SEQ ID NO: 3598 - protein, 394 aa, Lactobacillus buchneri
MTTFFNFNLFDGKNNQIQSDAWFTIDDQTGKITDQGTGSAPKDNNSIDLDGKYVMPGLINVHTHITSNPRTFDGNPGDSETEAAVTAYQNLQTMLKSGVTFIRECGTSYDVDIKLNRLREQGSLKKTPEMMPSGMAYSMTGGHGDSPHFGHRVDSPDEMRKAVRQGLKIGAQNIKMMATGGVMTPGDFMADPQLSVEEMKAGIDEAHHKGKIVAAHAEGNPGIQNAIDAGVDSIEHGFYINEEEAKKMIHHGQYLTPTIIALWAIPEYGKGKLPDWEVKKADDACEDAYRNLSKAFKLGVKFTLGTDAGTPYNGFDTTPKELELMTEKLGITPFEAYQCSSINAATLCQIQDEYGTLEKDKYADFQVLNADPLADVKALQQDDKQIFLHGKREF

SEQ ID NO: 3599 - protein, 534 aa, Lactobacillus buchneri
MKHKLISFGAILIAGISLAACGNKQAASKSNKPLNVTLPDEPLTADPNKSTDTNSAQLIFQTYEGLYTYNKANKLTPGVATKIVKPTNNGTTYTFNLKKNAKWANGQTVTAQDFVNSFRRTVDPKTKAQYASLYDAFKNYAAIQAGKMSADKLGAKAIGKHKLQIQLTKRVPWFNDLVASKFYPLNTATVKKYGQEYGTNASKTMANGPYKLTGWTGSNSSWHYVKNPHYWDAKNVKINRINVTVTKDQNTAINLFQSGKIQETNVSGQYVKANAKNPNLHKHLTGRMNYLYFNNKYKPTNSENLRQAFSYIIDNQTITDDVLQDGSAPAKSMIPIGDQKDPATGKDMATSIGNLLPTDKAKAKAYWNKYLKETGKKSITLNLLTDDLDEDKHVGQYIQAAAEKNFKGLKITLTSLPHAQHVDRDFNGKFQLNLTGWSTNWLDAYDFLDLLQTGNSVNFTNWSNKTYDNMLNEANAATGQARYDKLAAADKYLMSVKGAIPLYQPAENKLISSKVGGLTYSILNEAQYKYAYWK

SEQ ID NO: 3600 - protein, 296 aa, Lactobacillus buchneri
MAIKKVTVAGSGVLGSQIAFQSAFKGFDVTVYDISQEAVDKAEERIKGLRHAYRHDIAATDEEFNAGISRLKFTDDLAAAVKDADLVIEAIPENPDIKHEFYQKLSKLAPSNAIFTSNSSTLVPSMFAADTGRPKQFLNMHFSNQVWLNNTAEIMGSPETDPAIYQEIVQYARDIGMVPIQLKKEQPGYILNSLLMPLNAAAGALWLKGIADPKMIDRTWMAATGAPWGPFGILDAVGIRTAYNITLAASKKDPAVMPLADAFKKMLDEGKLGVESGEGFYKYPDPEYKTKEFLEG

SEQ ID NO: 3601 - protein, 398 aa, Lactobacillus buchneri
MTKVLAVLYPDPVDGFPPKYVRDDIPKITHYPDGSTVPTPEGIDFKPGELLGSVSGGLGLKKYLESKGVEFVVTSDKEGPDSVFEKELPTADVVISQPFWPAYLTADLIDKAKNLKLAITAGIGSDHVDLNAANEHNITVAEVTYSNSVSVAEAEVMQLLALVRNFIPAHDIVKAGGWNIADAVSRAYDLEGMTVGVIGAGRIGRAVLERLKPFGVKLVYNQRHQLPDEVENELGLTYFPDVHEMVKVVDAVVLAAPLHAQTYHLFNDEVLATMKRGAYIVNNSRGEEVDRDAIVRALNSGQIGGYSGDVWYPQPAPKDHPWRTMPNEAMTPHMSGTTLSAQARYAAGAREILEDFLEDKPIRPEYLIAQGGSLAGTGAKSYTVKKGEETPGSGEAEK

SEQ ID NO: 3602 - protein, 237 aa, Lactobacillus buchneri
MTKLTTLYQHGTLALLVPGLLAGTLTMGDLLQHGDTGIGTGEGLDGELIILDGTPYQVDSDGNVNVVSDAFNMPFANSHFANYSPLAELENLSQADLEEQLISLTQASNTFFSIKITGSFSAVKTRAVKKSTPPFQTLAQTAKNQSIFTRDQVEGTLISYYSPTLFDGAAVAGFHNHFLSADKTFGGHLLDFHLDKGHVAYQLFDTLEQHLPVDNRDYMDHDFSLDNIQDDIHEAEG

SEQ ID NO: 3603 - protein, 558 aa, Lactobacillus buchneri
MANKKRGSQALIQSMINQQVQYVFGIPGAKVDQLFEDLQYSDQPNAPKLIVTRHEQNAAFIAAGIGRLTGKPGVVATTSGPGVSNLVTALMTATAEGDPVVALGGQVPRDDLARYTHQSIPSKELMSVASKSSVEVQDSNNLSEAFTNAYSTAISGKPGASFLSLPADVLSGEVTRLEMQQLKEPEQTQTSAKTLNQIIDLLKKAKLPVILAGMRASSPAVTEALHQLLAKVSLPVVETYQGAGAISHEFEADYFGRVGLFRNQIGDTLLKQSDLVIAIGYDPVEYEARNWNVEHNDQIINIDTVAPELTVDYQPDMVIESDIAGTLSALTDALPASYHLPKTAVDQLAKLRSEFDGQSTTATTAKPGTMHPLDIVNTLQEKVDDETTVTVDIGSHYIWMARHFRIYRPRHLLFSNGMQTLGVSLPWAIAAKLVRPAEKVISVSGDGGFLFSGQELETAVRLKLNIVQLIWNDGYYDMVKFQEEAKYGKNAGVKFGPVDYVKYAESFGAKGLRATNSEELANALDQAQQADGPVIIDIPVDYSDNIELKSALLPDILN

SEQ ID NO: 3604 - protein, 148 aa, Lactobacillus buchneri
LERKIILKDIGYLAQDISILHRQYYKDTGKLFKEQQLNPTAACILLTINDNAEINQNQVAKSLVIDKGLATREIKKMQALGYLTKTAGSGKSIILSLTAAGQQVIPTIQAIRKNWWEERFADTGIQPDSPLVSAIEKVVDSIVDESLE

SEQ ID NO: 3605 - protein, 335 aa, Lactobacillus buchneri
VKKRLTISEIAKMAGVSTATVSRYLNGHFEKMSDETRVKVQHVINDTGYHINRQAQSLKNQTTHLIGMVVADIENIFSSILFKGADKIFEQHGYQILLMNSDNSGDREHDQLQRLLDLQVDGIILQPIHNNSASYQFIKDTDTPTVIVDRKTTPQIWPEVTTDNYGYSKALSDLIIRMGYKRIVTISEPLADNEVRMDRYHAVQEAAKGTDVIVDSIEITENTSDDLIYNQIMRKTDSLKTKAVVYALKGTVLMRVIKLLSKFHILIPKDIGVTAFDDWDWAQLMQPEITTIQQNPKKMGQKSAELLIDLISDQPIVEKTVLVESELKIRNSIID

SEQ ID NO: 3606 - protein, 347 aa, Lactobacillus buchneri
LKEELIFGTYSSRISKGIYQAEFDTDSGKIGTVHLSTEIGAPTYLALSDTNVIYAVNQDGDKGGVSAYDLSGGQFNKLADHLFNASSPVNITIDEKRKLVFASNYNNGFVQIFKIMSNGDLSLVDEIHNLGHGVLPQQNTSHLHYAQITPDGRRLCVIDLGTDEILTFDLSSDGHVLQKATTFHTRPGFGPKKITFTRNGVYAYVLGELANQVILLKYHPKTGTFDQIQSISTLPDNWVGENGCGAMYLSKDEKDLYVSNRGHNSVSVFGVDETNYQLEMIQNISSEGNFPREFCLDQSEKYVIVGNQKSDSLAIFQRNPKHGNLTLLSVNHNVAEPVCIICTQDNQ

SEQ ID NO: 3607 - protein, 426 aa, Lactobacillus buchneri
MINIIIGVLLLLTFVGFIAFVMKGGNIMIGFLMMAILWTVIGGISYKDAITNVFSQPALNYGSTIMVIIFGSWFGRVLVDTGIASAISEQTVKVSYKRPIIATILICLVTAFIFTSSYGVGAVIAIEVILLPILRSLGLSKNVAITAFVMSIGAPMYVNIVIIKQLQLFFPKVVYGAKYLIYGFSAMSVQLVIVIIFILIHAKSIHKNDTKEVSADDSKKAISNVPKIAYILPIMPVFMNLAFQWEPIPALMLSIFLVLLITGKLKTYKSAMELINKTISQAISDISGLIIMLLFLTMFSAAAVKVTGRFSDILQSIVPHSPIVLAIAFGILAPLALFRGPLMVWGAGSATAAVLAATGFFNQYFAFAAILIPGVSIAISTCITQSWNLWVVEHEKLDVKQFLMTGVPFGWITSVLNLLLAAIMFK

SEQ ID NO: 3608 - protein, 246 aa, Lactobacillus buchneri
MNSNRLVLNTLVAQAAHDAGSNQEQLVEDLLSSGINNIELRREYGNATINELDQLSELGKRDRLTYFYSVPDNLFVNQQLNVKLLQYVAEAQRLGAGYIKMTLGDYNDAKPDCIDELLTVIPTSIQLNIENDQTTSNSDTGKLVLFFKQFDRRDRKVGFVNDLGNWIFTNQDALTATNTLLPYTRFIHLKGFVLNQDGNPETVSFVQGKLDWWEILRIFPTDLPIALEYPADADMLNSDISKLLNN

SEQ ID NO: 3609 - protein, 260 aa, Lactobacillus buchneri
MGKEVAFNTDKFRLDGKVAIITGGASGLGYNYTKAMLISGAKIVIASYDERGWEETTEFAKSVNGEVKFIKVDVTADGAPVKIVSEALSDFGQIDILVNNAGMQRRENWKDFKDSDWNAVINLNLNALYFLSHAVAKVMANQGSGKIINIGSMQSFRAGKFIFPYTASKHGVVGLTKAYADALAPDNIQVNAIAPGYIDTPMTKALQEDKSRNTEILAHIPAGHWADPSELMGTVVFLASAASNYITGVTIPVDGGYLLR

SEQ ID NO: 3610 - protein, 313 aa, Lactobacillus buchneri
MGKNVAIPQGLSQAGKDYLINHGMDLVELPDTKAETIISQAPNVDGIVLMTEPFPNETIKQMPNLKVIARHGVGFDNVDPNDMGENNVWVTITPNANAATVAETTLAEILDISKNLTAISDSMRKGVFGYKSSHMGFDLAGKTLGIMGYGRIGKMVAKKVRSLDMDILIYDPFVKFAEYGKIVDKGTLIANSDVITLHMAVTPENEQGIDRDAFRKMKKSAVLINLGRGQLVNQNDLLEALKTHEIRGAALDVFNEEPLPLTSEFYKLDNVLLTPHIASNTTECMARMAVDSASEVVRVLSGEQPKWPVNSVE

SEQ ID NO: 3611 - protein, 282 aa, Lactobacillus buchneri
MKNSLIPQITLNDGYTMDAIQFGTFKIRGGEGLQETLAAIKDGYRSLDTATNYDNERMVGEAIRHSGIPRADFFITSKLPGKYHQYDEATKAIQESLYRLGLDYLGLYLIHWPLPKRDHYVEAFQAMIDAQKRGLIRSIGVSNFEPEHLDRLVNETGITPAVNQIEVHPYWNNARMLKADQERGIVTEAWSPLGRGSAALQEPIIQDLAKKYGKNSGQIILKWHTQRGIIPVPRSSNLIHQHANKDLFDFELTEEEVKAINGLTKAAGRVDGQDPNVYEEFD

SEQ ID NO: 3612 - protein, 87 aa, Lactobacillus buchneri
MEKDVRTHIDPEKFAYQALTTIHFHETDDYERQNKERLAVFLMLKYLADDFNDLESKAFDISSNNDEQLSKLGFDDLLSRINQLNKY

SEQ ID NO: 3613 - protein, 199 aa, Lactobacillus buchneri
MILQNLFLPFVKDHPQVRFAFKEENGQRLATHISDGTLDLAVTPNYGKTLFLENSNLHSKSIASGKLVFGISKSNPLSRQTAIKFNQISNMEILYYSPVESSYLKTIFLEKFPNKIDSEKIRRVNTLEQRDMLVAFNFGIGFYPSPFMKREQIVNPMIQYLPIEDMDVDTTYSSDILYNPSNHKAAVKQLLTTIAVKKH

SEQ ID NO: 3614 - protein, 56 aa, Lactobacillus buchneri
MEIAKLTTFLKVVEYGSFKAAADKLYLSPRAVSKQINQIEAEIGIKLFSRELTILN

SEQ ID NO: 3615 - protein, 445 aa, Lactobacillus buchneri
LGTSYVAFIGFVMMFIIIYLLLKQKVSTMFAFSVIPIVSAFLVGMTPTNLGNALEKGLGMTTPVSLIMLFSLPYFMMMADTGLFNELVRKIVRHVKITPPVLTCLTIVVAMIVGMDVSITSIYIIAIPLLLPFYRKLHMSPMLLMFLTTLGVINTFDVPWSARMLRAASLVPNVKGGSIALFSKMLPTQIVFTIVLFALAIVLGIRIQHKNKNNGEINDDELEDTSQSTDSIQDDPELARPKMFWINIIFTIFLVVCLVMFPTIPSYYIFAFGLVVAFAYNYPDLKMQSKLLKKYSRSLMPVMPTILLSGVVVGVMEYSGMMKAMVNILLKIIPSQLGPWLYIIIALVGVPLMFLFTNDTWYYVMLPIVISIMKAYNIPGEIVVVTLFMNMGAMLTPIAQPQIYIGANMTGDVITIPQFIKKSFLPIWGLSIVWTLIGLMMGAFR

SEQ ID NO: 3616 - protein, 442 aa, Lactobacillus buchneri
MSIPKIVKMDVYPVAGYDSMLLNLSGAHGPYFTRNIVVLTTDEDQVGVGEVPGGQAITSTLEKSKELIVGKSIGEYKQILQNMRKKFSYLDAGGRGQQTFDLRTTIHAVTAIETAFLDLLGKHFHVPVAELLGDGQQRENVGVLGYLFFVGDSSKTDLPYLKNDDNSDDWGKIRRGPIMDAASLVKSAKAAYKRYGFKTFKLKGGVFDGETEVQCMKALHKAFPEAKLDLDPNGGWSLKEALKYADELKDVLHYIEDPAGAEDGFSGREILSEFQKKTHMPTATNMVDTDWRQMSHAIALNAVSIPLADPHFWTMEGSVRVAQLCDEFGLNWGIHSNNHFDISLAMAVNAAAAAPGSVYDIDTHWIWQDGQNLTKNPYQIKDGQVKVPSSNEGLGVDIDLDAIKKANQLYVEKHLGARDDSKGMQYLIPGWKFDPKRPALVR

SEQ ID NO: 3617 - protein, 300 aa, Lactobacillus buchneri
MRGLLKVIVKTNPIQAKFQHFIEIIEPIYETINPAIRFRPNYRQLKADDVIILACMLMRIEERDGSETYFHQKLVSWGITVPERSRYNRRCRDLALIMKFMRVTLLKQWVPPVTYEIIDSAPITLASARRSNQAKVLNGFANKGYNATKQTYYYGFKLHAVMANQGYFLAWELTPAALDDRKAAEELLLTAPARRVLADGGYLSQPLKDRLATTFSIHLWTPLRKNMAAQTTVDTGFLKNQRRHIETNFNNLDTVGHFEHPGIRTMSGLESRLEALLLWHTIRVHEQLAAGKSGLKLGHY

SEQ ID NO: 3618 - protein, 445 aa, Lactobacillus buchneri
MISPRITSLEVVPVAGHDSMLLTLSGAHAPLFTRNIIILHDDAGHEGIGEIHGGDAISKMLESYQDIVVGQALVNYRKILMDVRENGWRPNNNSGQGLQQLDLKNLKFVVHAEAALECALLDLYGKFVNLPMCDIIGQGRQRDSVEMLGYLFYIADSAKTHLPYVQNDDDSDDWGKLRRKPAVTPDAVVREAKAAQKRYGFHSFKLKGGVLDGETEMATVDALHDAFPNCRINIDPNGAWSLDEAIKLTNDHRDSLTYIEDPTGPENGFSGREIMSFYKNATNMPVATNMIATDWKQIYPSLMMKSVDIILADPHFWGINGSLRVASIMNDWGLTWGSHSNNHFDITLALFAQASAAAPGKITAIDTHWIWQDDQQLCDDAMNIHDGKITIPNKPGLGINLNHEKLEMAHQLYLTMQNHDRDDSMAMQYLIPNWQYDPNQPTLVR

SEQ ID NO: 3619 - protein, 326 aa, Lactobacillus buchneri
MKKVLISEKIDDDAVQLLQKNGFDVEISPAVDEATLTEHIKGAFGLIMRSSKLPEGVVDSADQLRIISRTGTGIDNVNIDDATKNHVLVARVNGANAYSVAEYVITTMLAMSRRIYKSDRLFKAGQIVSTHGESLPGLAVKYDLNGHEIRGKRLGILGLGRIGKIIAKLGDALGMDIIGYDPYVKASDVKLTTDLNDIYNSCDFISVNMPLTKETKNLIAAKELGQMKDSAFIVNAGRGGIINETDLADALNNGVVAGAALDVFTEEPPRSDSPLLTAKNILLTAHIGGTTYEASKAVAIGAAQAVIDYSTGKKPQFTVNYKDLKN

SEQ ID NO: 3620 - protein, 343 aa, Lactobacillus buchneri
MKPIESLKSQLFRMTKVEKLQNHFGGNVNYMDLDYIHDPIPRMPQWDFFWDSDIDVTKNNRFSYVPAHTHSFIEFNYMYSGMCTQYINDTKTVLHEKELLVMDKDVVQRIDYTNENDILINIIVKTDSPYEEIFNSIPQSTNEITQLIYNGTRVNSLHNNFMLFDLKNAETSLNLINALIATGINHARHRSESLRFIFSALILGLPSLITYKSINFADSSSDDLLPILKYIEKNFATTTLSNVSAVFRYNTNYLGNKIKANTGKTFNELIERRRLSAAQNLMLKTNLNLSEISETVGYQNSSSLFRLFKKYLKTTPSEYKGRVHPKVPEYISSQINAKKREDS

SEQ ID NO: 3621 - protein, 441 aa, Lactobacillus buchneri
MNNNTVDSSFKKYRPLAVAAGIGSILGSGIIVGLSATITVWQTGLGLTNTQVGIISGALTFAIAIGSMIAGQITKTFGLIRSFNWLNLLYAIGALVCVFSNGYTMLLFGVIITGLASGADLPISLTVVSHDSPNEKTQSQLVSSTQIFWQIGIFMSYVCAFIVSKMAGASGARVVFTILAIFALITWLWRTFSSKFRAFHQEGEKRRIKHDQEANLTDKVSVKNVFTGSNRSKFLGFFLAIMIFYICWNLLANTFGQFQTFVLVQAHATQSFATAAGLILNLVSLCATITFASVSGGKYRNKFFIVGALVQALAMLGLALSSHALWPIVIAIGCYSIGNNVAGEAMYKVWTQESFPVEIRASVQGFINGFSRFLCGLFAIVTPALVVPSAIRNTMFGFTGLVIVFFIAGLVMMYLQRKHNIIPGVEENERGEDDGVHISNQ

SEQ ID NO: 3622 - protein, 527 aa, Lactobacillus buchneri
MAFTFQINDEVQFNHDERLLNKAKQYKPVIHQDIVFPKSIVELVPDSQKLEGWGVQDTQDIEGLPNIKLKRNQKITLDFGSHQVGKFSIDINSVGSPMDAPLFIKLKFAEMPAELKHKSEDYHGWLSKSWIQEEYIHLDVLPTHLELSRRYSFRYVEITVIDTSPKWQAVLSNPQVESETSASNEQLSVPSIKDPEMKSIYQVGLKTLQDCMQDIFEDGPKRDRRLWIGDLRLQALANYATFKDVGLVKRCLYLFGAMTAKDGRIPANVFTQPQDIPDDTFLFDYSLFFISILDDFQRFKQDQELLSDLYPFAKKQMDVALEKVQLNGELILDDSYPVFIDWSNDFDKNTAGQAVLIYTLRQFIHLAKMMNDNVDGYSQKLHELISYSQFNLFDAEKGLFVSGPQHEVNIASQVWMVLARVLDDRQNKQVMIHTINELFPITGIATPYMYHHITQALFEAGMNDEAIKLMKDYWGQMISLGADTYWEAFEPAKPEYSPYGSPILNSYCHAWSCTPVYLIQKYLIGEE

SEQ ID NO: 3623 - protein, 430 aa, Lactobacillus buchneri
MGNEKISLSRDNVLLIIVAGIASYLDAALLVSLGVALPIWADYLHLNSWIVGLLSTTLTIAVAVGSFAGGWLSDKFGRVTVFNYDILFVAIGSAIVAFSRDVPLLLVGVIVAGLASGADLPTSLAVISERMDKRTYGRAIASTQIFWTVGILLSQFIGMLSANAGMGSPMTLFGWIGLVAFVNWCVRVFSKNFRQIEEGLAEVVEEKMESVGEVKKRYKLRELLRNSSYLLPLIFLTTFYLFWNLPANTWGSFVNYFIVTVDNRSQLYSTVIALVANVFCLLVNVIYLKISDSKYRYKAMYVGIATALIAFLSAGIFSDHWQVFTFAYIFYSGSTVLCGEALYKIWSQTFYPVDARATLTGFSYGFVRIITAMFSLITPTLMGYSPKILLWIMVGCTLVFGTCALIIVHLVKRFKVSDPTTIGHALSNES

SEQ ID NO: 3624 - protein, 660 aa, Lactobacillus buchneri
MDSTAHWIWYPGDFSIHQGMLQNFAREERGMGWPAYWYIDDCNRNINFSRTYDLDNPTDFTVYARGIGYVDINGKKFRLGETLRCESGKNVITIFVGNPTGLPCVYIDGLVVKSDKGWQASNFVSELPAGNDPLFTSKDQNPNVIEYQKAELNPTKVKEIDNGVLFDFGRAVNGSLKVKLHQIDEVTICYGESRTEALDVDMCYYKQESVDETTHIRKRAFRFVFIPNAKKDNINLIAIHEYIPKQNISDFQTDNPLINKIWNVSTETLNLCSDLFFIDGIKRDRWIWAGDAYQANFINQYSFFNEEVDRRTLLALRGQDNIKQHINTIVDYSMLWVIGVLNHYEMTGDREFLKIVYPKMESMVRYFINQTNKQGFIYGRENDWIFVDWSEIDKDGTVAAEQALLIEVYKTMVTCGSVLNRPIEYYQTLHDQLLENFLQHFWNEKKGAFIDSYESGKNHVTRHANIFAILFDLVDDDKKESILKNVLLNDKITRITTPYFKFFEQDALCKMNRQDIVYTTILDYWGGMLANDAVTFWEEYDPTKSGKDMYSMYGDPYGKSLCHAWGASPIYLLGRYFVGLYPTRPGYREFHVEPELDQFNKFHAILPIKNGKVIVDKNGDTLSVLASKGGGTLVLGKNEYALIPNKKLTVSLNHAKVDAG

SEQ ID NO: 3625 - protein, 403 aa, Lactobacillus buchneri
  misc_feature (5)..(5): Xaa can be any naturally occurring amino acid
NADHXIDASEMTKHYSFLNNFKFKNGLEIKNRVVIPPMTEVSSFEDGSISTDELRYLQMRAGGVGLFISPVANVSENGKGFEGELSITSDRFIPGLAKVASAMKFNGSKAILQIFHAGRMSNSKVLRGVQPVSASAVAAERPNAETPRELSNEEIEGIINDFGEATRRAIEAGFDGIELHGANTYLLQQFFSPHSNRRTDNWGGSLEKRMNFPLAVIKRVHEAVVKYANHPFVVGYRISPEEIENPGIRMSDTLKFVNVLADQPIDYLHVSMGYAWRTSLNNKEDTQPLILKIKDQLNGRLPLICVGSVETPDEAAEVTDKGIDMVAIGREILREPKWVQKVETDDEDSIRYTISEQDLDDLGITPPMWNFLIFRLKSAMHISNQPDYDPEQFKNKLAPHEGA

SEQ ID NO: 3626 - protein, 249 aa, Lactobacillus buchneri
MTLILNTWIFESDVQKGAKQADLVDRVAKLGANGIEVRREYFKDLDVELPDVAKHAREHNLIVNYSVPDVIFEPDGSVNPKLADYFEEGETMGISKIKFNTGNFDKFTGDLKTELGKFPIDKIEMNVENDQTPVSGTVNAIKTFLDAAYAAGLTQLGYVYDLGNWAFTHGDATEAAKTLAPYTHYIHLKNAIDNNGKLTTSDDLDKGMFDWRQLLTLLPSNVQFALEYPMTSDAQISDQIKLFNKEVGE

SEQ ID NO: 3627 - protein, 430 aa, Lactobacillus buchneri
MTSTIISILLLVTFAAFIVYIVKGGNLMIGFFVMAILWSVIGLVPFNTAIQKVFAEPALNYGPTIIYIVFGSWFGRVLVDSGIAPAISEQTNKVGKKKPLIAAILVVFVTSFIFVSAYGVGSVIAIGVILLPILLSVGLPRDLALSAFALAIGAPMYINVVLFNQIKAFFPKAIYGGKYLQFGMVATAVQIIAVVIFLIIHRKRIDASKAEENLQIIGAAGADEKQIESVPKIAYVVPIIPVLMNMLFHWDAIPALTLATLIAIVLTGRAKNFKKFVDFLNSTIKQSISDIAGLIMFLMALIMFSGAASINAPRFKPIFEAILPNSHLTLAIMLGVLAPLALFRGPLHVWGAGAATAAVLSGTGLFSDAFLLPLLYVPTLMAVSTDITQSWNVWGLDYMKVDSKSFLKLGIPVMWAVSIINELLVYYFFG

SEQ ID NO: 3628 - protein, 320 aa, Lactobacillus buchneri
MSEVITVGEPLCTFASKDPDVSLADAMNWHKIMGGAELNVAIGVKRLGHSVEYISRVGEDPFGEFVIKTIKSHNVGTKYVSQDPVYWTGHQLKQLVTKGDPDTYNYRKGSAASHLTSEIMDQVDLNGVKIAHMSGIFPAISDTAEKSFRSLLSRLVDNNILTTFDPNLRPSLWSSQEKMISTINELAGSANIVLPGLAEGKILMGSDDPEEIADFYLKGKRTDTVCVKIGPAGAYVKTKDGQSYTVNGFKVDNVVDTVGAGDGFALGVITALLEGKSLKSAVLRGNAVGALQVQTPGDNDGYPTPKELKEFYLQEGVSED

SEQ ID NO: 3629 - protein, 208 aa, Lactobacillus buchneri
MKLQAAIDRVSLGDAVTLAHRLDGIADVIEFGTSLVKDYGLVMIKENPLHLKKSKLLLDLKTIDEGPYEFRRGFEAHGDILTVMAGSSYDTISKTYDITQDVHKEMLIDLLEVDTAKIKTISGFKNAIYGLHHSRDAESNFDAISATKKFHEDFPDIKRIAVAGGIDVEQAKGLSQQGIADTVIVGSKIVGEEDPVKAAKQFKEAMKK

SEQ ID NO: 3630 - protein, 180 aa, Lactobacillus buchneri
MALIEQVMHEVDEVMSLVDESQIDDAEKVIQKDQRIFVLGAGRSGLMAKGFAMRLMHIGYTVFVIGETITPSIQAGDVLVSVSGSGKTGMVVEPTEKAKTNGVKVVAITSNSESPLAKLGDAVIVVPGATKAGDGVQSIQLLSTLFDQSVHITLDVLCLKLSRRDHISNETAKATHSNME

SEQ ID NO: 3631 - protein, 227 aa, Lactobacillus buchneri
KDPGALDLASEMLQKVEAITKVANSGVVAVVRGQSKEESLKTAIACIEGGISGIELAFTAPHADETIAELNSRYTEDEAFVGAGTVLDPATARVAIIAGAKFIVSPSFNKDVAMLCNLYAIPYIPGCMTPTDIQEALSYGSDIIKLFPGSVVGQNMVSELHGPFPQASLMVTGGVSLDNMQEWFDKGATVLGAGGNLVGPAKTGNFDQVKKNAQAYRKQIDIIKSSK

SEQ ID NO: 3632 - protein, 333 aa, Lactobacillus buchneri
MTDKGKSKTSDTVTMKDVAALANVSIATVSRFLNGDLSRMSTNTAKTVKSAIDKLNYVPNSAARQMVTKSSGLIAIIVANIDDFFSTELFKGISAMLESKGYVGVLFDSNSDVTREKELMTIVSTHTFDGLIIQPFSSVKVISDTIRRNIPIVIVDREIEQSPWTQVVTNNYEAARNAAKYFRNEGFTHAIVVTSNLNLATNRRERYRGILSEIDNTTLVEVSESSYNHKKVSQLLEKLLKDSKEKTLIFALKERWITEFVPSLFYKGYIDNKRVAITGFADTSLAKYIDPHTKLIAQNPYLMGASAAEVMTDKLTNMNVRIDNTIVVPAKFE

SEQ ID NO: 3633 - protein, 538 aa, Lactobacillus buchneri
MRKVFTYGLVVTSAILLSACSSKGSTSNKQKTLNVTMIQEPSTADPNKGTDVYSASLVHQTLEGLYDVTNTGKVVPGVATKVVKPTNHGKMYTFTLKKNAKWQNGKPVTAEDFVTSFDRQVDPKTKSQYASRFQAFKNFADVQKGSKKPTALGVKALGQRKLRVTLTTPDPEFNFRAATEYYPLNTAAVKKYGQQYGTSSVKTLSNGAFSLQGWDPSKDAWTYKKNKYFWDAKSVKLPKVHVQVVKEPSTAQNLFASGKIQETLITGEFVKQDAKRYPKNIVYTKKGQMRFLSFSAKNKTTSNRNFRLAVSYALNRKQLTDNVLQDGSTPAKSMVPEGDGTDPTNGKDFNKELATNLKYDKQLAQSYWKKAQQQLGKKTLSVQLLTEDDSDQKKLGEYVQSAVEKTLKGVTVELTSVPQQQQLTRMFGGNYQITATGWSTDYPDPSDYLNLMTKANTVNFTHWTNASYENVMAKVNDTSKYSGKERWNLMVKAGNIAMQQQPDVATYQDTDVHLVSSKVGGLKYSLLTDSLYRYAYWK

SEQ ID NO: 3634 - protein, 646 aa, Lactobacillus buchneri
MSQMLTEEDFYKLKMLSQPVETDNYYFVTQTYMDKQSNGYRSNILGFDKGGKFVGNFDNDNYASKSPVGAKDYLFFLSQSNADSEFQLFQVKYTGGTAQQVTHLAHSVEQVIAVPGTNTVFFKTRETKEVPKKPYEKYPSVRHVFRVNHKADGFGFYPTDGLYVLYSYNTDDQRLEKVYSAKQDFSLTDVASDGVRVAVITDNKPDNDLDYGRGVYVLDTSNQHVDNITANNPEWVFTHAKFSPDGSKMLLVGRSDKYDANTQFSVYGYDFNNQKFLDYVNEMEEETADFLFTDFTQNLSDEDAFWVNNGAFVFRTAYHGRTKMFLFQNGKVSSFYNEAERITDWSVFNNHLIVTYSTGILPVMMATLSLDGYQADVFNPNERFDQEHEYVKPERFVYKASDGLAIEGWLMEPAKPKESNPLVLYIHGGPHYAYGENFFFEMQVHAANGYGILLLNPRGSKTYGQAFCQENVGHYGEKDFTDLMEGMDYVLAHHPEFDKNLQYCAGGSYGGFMTTWVVGHTNRFAGAVAQRPVTDWISFSGTSDIGFMFTPQELKTDRYDIETLWKYSPLAYAKKVKTPTLVMQGEWDTRTPIGQGEEFFSALVENGTEAEMSRYPQSWHGVSRNGLPNLRVERIKETRSWWDKHQ

SEQ ID NO: 3635 - protein, 396 aa, Lactobacillus buchneri
MNFIIAFLVVMVFMFIGEWVSTMSHAFIPSVFVSAVLFVIGFWTILPKDVVTQASYGNEFVSICVAMLLVHLGTLMSLKELVAQWKAVCIALLGVCGTMLLCLTIGSLIFNWKTVVAAVPPLTGGLVSALLMTNGLKAQGVTALVALPVSMFVIHSVVGYPLTSLMLRQEGGRLIKEFKAGGSKLGPEVTELAEDEQPSAFKSQNVFNLKPEYETPAFTLARVAMVALFSTWCAGLINNAINPNVVCLIFGVIAHQFGFLEDNALNEAGVFNWLMYGLLAYVFAQLSVTTPQIMGSIILQIIVLIALGLLGMFLASRVLAKPFGMSWQMAYACSLTSLFGFPADYILTSEVAHTVAGTKDEERYLLHNMMPKMLVGGFATVSVASVIIASIFLKLI

SEQ ID NO: 3636 - protein, 394 aa, Lactobacillus buchneri
LSKTTYTNFNLFDGKSNEVKKSAWLVVDETTGKIDQVGTGDAPSTDQQVDLNGKYVMPGMVNCHTHICMDPTAGDGGTGANVVDATVHAVQHLHDLLKSGVTYIRECGSTFDIDIALNELRKKGVLKKVPEILPSGRPYSMTGGHGDFPNFGHLVDSPDEMRKAVRTGLKKGTMAVKVMATGGVMTPGDFMADPQLSVEEMKVAADEAHHKGRIIAAHAEGNPGIMNAIKAGVDSIEHGFYVNDEEIDLMLKQGTYLTPTFVADWAIPEYGEGKMPDWEIKKAADALDDLYKNIMHAWKRGVPITLGTDAGTPFNDFTMTPVEFQLMVEQGATNFDSLETSYTSAKLMKIDKEYGTLEPNKYADFLVLDNDPLADVKAVQQEDKAVYKKGVQVY

SEQ ID NO: 3637 - protein, 400 aa, Lactobacillus buchneri
MSTIYYNASIFDGKNEEITRDAWFEVTDGRIAQIGTGKPSKKAEKNIDLKGKYVTPGLINAHTHMMMNPVTNKLEYLSETEVTATAIQNLRDLLESGVTYIRDCGCAFNTDIKLRNFAKEHDLEAPGIIASGRPMSMTGGHGDFKEGADGEIDWSYLTDSPDEMRKSVRTALKIGADNIKVMATGGVMSAGDNIDDTALTPAEMRVAVEEAHHKGKKVAAHAQGNSGIQNALDAGVDSIEHGIYVDEKQADYMVKNNVYLVPTLNAAASISKYGRDKLPSYMIRKNDQVKSDFFKNVSMAFKKGVKVIVGTDAGTPFNSFKTGTWEEMQLLVNEIGATPTQALLSATQYAADLIGISDNYGTLEPGKFADFLVLDQDPTQSIDAITQDNKLVFQHGKQIK

SEQ ID NO: 3638 - protein, 442 aa, Lactobacillus buchneri
MQQEEVEQYALDNLDNVTDYLRIPSISAQNKGINETNEWIMKQFKDLGAAKVEKWTDQGGNPVVFAEFNGKSDKTVLFYNHYDVQPPEPLDEWKTKPFEPTVVGDKLVARGVCDDKGELMSRLTVVKYFNEHGGIPVNLKFFVEGEEEIGSSDVDKYVRAHADQLQADVCIWEGGGKDESENFQIVCGAKGIASFNLHVKTAAADLHSSLASYADNAAWRLVQALASLRTPDNRVAVDGFYDDIEKLTPSEEKATQSMAFDADKVRANYGLTRPFVYNDPREELVNGATMTINGLNAGYTGDGVKTIIPKEASAKLDCRLAPNQDPQKIAGLISKQLEKNGYGDVKLDYLLGEDAFRSNLDHPFVKLNKKVADEVYTSEKVRLIPNMPGGGPMKQFADSVHAPIVMVGIHYSGSHPHSPNENIRLADYKQGTYFLARLLEEY

SEQ ID NO: 3639 - protein, 277 aa, Lactobacillus buchneri
MKKSIKYLIWVVVVIAIVVIGYFSFGRGNASQSKTVTIGVITGTKKDQAIWDSVSKTAKDKYHINIKLKNFTDYSQPNKALSSHNIDLNAFQSMNFLIQWNQAHKSHLTSIGKTLITPLRIYSKKYTSVNQIKSGSQIAIANDAANEARALELLQSAGLIKLDSSALPTVNSITSNPKKLRIKTVDANQTARALPDVGASVINGGFAVTAGIPEKYSIFKEPLQKQYVNVIVANNKDKNKKLYKEVIKAYQSAATKKEITKQYGDLILPAWDLKFSK

SEQ ID NO: 3640 - protein, 358 aa, Lactobacillus buchneri
MSDSIIDINKVSVSFLQKGNRLDAVKDVSLSINRGDIYGIVGYSGAGKSTLSRTINLLQKPTSGTVVVDNKTFFDSSKSRKPIISAKELRIERQKIGMIFQHFNLLNEQTVVQNVEFALKHSKLKEKQVQQRAQKLLGLVGLSEYANTYPAQLSGGQQQRVAIARALANDPKILISDESTSALDPQNTNQILDLLKHLNLQLGLTVILITHEIDAVKRIANKAAVMDAGQIIESGSIVDVFVHPQKQLTKTLIGFNEGPKKAISILNSNGLKLNSNEQYIKLTYFGNEVSEPVVISLYKDLDVTANIIYSDVDILGDTLVGTMFIIIEGKSENVEEAIDYLRQRDISIEKLDRSEVNS

SEQ ID NO: 3641 - protein, 232 aa, Lactobacillus buchneri
MSTWFAKTFPNVVYQGWNGSDGWFTAIIQTLYMTFWPAIFGGVLGIIFGLGLVLTEDGGILENKVAFNVFDKVVSFLRAFPFIILLAFIAPVTQKIVGTQIGTTASLVPLSIGVFPFYARQVQVALKSVDKGVIEAAESVGATLPDIIFDVYLREARSEMVRISTVTLISLIGLTAMAGAIGAGGLGNMAISFGYNRFANDTTFVATLLVMILVLLVQFTGDFLARILNHKQ

SEQ ID NO: 3642 - protein, 382 aa, Lactobacillus buchneri
MEKEEQLQILKDLIQIKSVNSNEVEVAEYIGKLFQKHHISYKIDKFGEDRANLVAEIGSGKMDEVLGFTGHQDTVSVEDPSAWKHDPFKAEIDGDKLFGRGAADMKSGLAAQVITLIDLVDEGIEIDGKIRFIATAGEEYGTPGANRLNEQGVANDLSALVVGEPTNGQVIYAHSGSLNYQIKSIGKAVHSSRPAEGINAITGLSKYIDAEATLFNDAPKDKILGQLQHSITLIKGGEQVNIIPDYAELYGNIRPTESFDNDQVISTIKNEVAKINKDTEFHLEFHLVHNFRPVETEPDNPFITLVDQAAKDNYQDRDVELQTINAATDASVFITSNPKLPVVILGADESGVAHQTDEYTTLTSYYETVETYESIAKTYFKQ

SEQ ID NO: 3643 - protein, 427 aa, Lactobacillus buchneri
MDDNVTTVGAKSKANDPVNVSRRYWWRVVALCFVGWILIYADRTILNPVQEQIGAQFHIGNTQLGLVNSIFFLTYAICQIPFGVLGDKIGRRLVIMGGFVLLGVMTFFSGFAFSFGIFLVFRALAGASQGTYYGPQYALSTEAIPTKDLTLGTAIINSGMAFGTSGGYLLSSYMVLQKGMSWTSPFWVMALPTIIVGILFYVILKEKVIRPEDQKNEQKTEEAVEAEKEKVTLKDLFKNRNLVLAFILCFCSIYANFVILTWLPQFLQVERGFQGSSVGFISSLVPWASIPGALLFARIYDKLKKTKMMIGFLVPISLIAVFGIAFVTNKSLLIVLLIVYGLTGKLAIDPILIAFVTKNSPRGSLSTALSAYNFIGMSGSILAPYLTGWISDQFGSMQIGFYLAAVLLLVGVILFTFTSDKKNAIHA

SEQ ID NO: 3644 - protein, 279 aa, Lactobacillus buchneri
LQTVTYKTTDRTQIQGSFWKTPENSDKPTIIYIHGGGLIFGNRDDLPQAYIDLFLKSGYSVFTLDYLLAPESPFSAIIESLRAGVKYFLNHFDDLNLPNNHYVLFGRSAGAYLSMQLMAGGLPEFPEAFIDFYGFESLLASNLLKPNALYSSYPTVNKAEVKQLVNNSPISHSSYEERFLIYVYARQTANWQEMIFKRNETELKISPNTLKTQFPPTYMCQSNSDPDVPFINSIMLKAKLPDAKLIPVTSKDHDFDRTVTPESLTIYKGVIEWLNNLTR

SEQ ID NO: 3645 - protein, 535 aa, Lactobacillus buchneri
MAVTLKDIQQIDSLTSAKLVAGNAGINKTVDNIMITEAPDVERWITPNEVLLSSLYGFDKLSTDSIHDFMQSLNKHNCSGLIVKTSRFINDIPQQIIEDSNQFDIPLIEIPQDVKYSDIMLETMQLLFNERNRMLNRYKTINQQFIKLAIQNSSYQSIVTLLSTLVENPTYIFKIEDSNGVDIVHSKQAQYPIQSIDFSSRKLLPKTEYTNYQYFEVSLPEGYKFLMVKIANSQDDLYLGVLQEKRLQDIDFMAIENAVNFTQMEVIKQAALEQGLRTYANDIIDDLINGKITSEEEYQATLKHFKLMEDKDYRVTVIQVLVNGEIQTDYFRDNPRDANSVVAQFKTFWPDAVYRVRQNRIILIIDDEPTAKLQSNLRKVLQTLDASHPSMNFQIGLSENCHPKDFPSHASQALKTLQIAGHLNKSDQIFNYNDLGFYRFLFQVDDPTKLKSFVTEDLLKLYQDKPELYTTLKTYLDHNQNAKASADALFIHPKTMSYRLNKIQERTNINFSDVDEIFRLNVGIRVLNVLDEENN

SEQ ID NO: 3646 - protein, 1010 aa, Lactobacillus buchneri
LLYTVIRKNSYQDSINLMLLTQNISSMPGVKEVQVMMGTDANKDIFNEAGLLTDEAKHAEPNDMMIVLDADKKDVMDDVLKQIDKFLSDLSVKSDDEATDSKTVTNWDDAMKAVPDANLAVISVPGIYAADEIDNALDHNLNAFVFSDNVSLSDEARLKQKAHKKGLLVMGPDCGTGIVSNVPLAFTNVVRSGNIGLVGASGTGIQEVTSMIERLGGGVTHAIGTGGRDLSDKVGAITMEDAIAGLAHHDPTEVIGIISKPPAKEVRDDVVSLLHSIDKPVVAIFLGEKPDHHEDSVYLAHTLEETSRILMDLAEDKKVKDNYYPAEPLVKADPQLDGKHIIGLYSGGTLAYEAGMMVSEALNLGGIISDEGYVLRAKGNEVLDLGDDIYTQGRPHPMIDPRIRVEKINEYANDSDTGVILLDDVLGYGTDDTMARSLADAVTTASRKHPRVKFVATVVGTREDPQDYDAARKTLQSAGIIVLDSNAQAVRYALNLVGKDVNEPAKKVIPYTGATHEVPMPSESVLDLLYTKPRVVNVGVAEFLDPVIKFGGTGVQYNWKPIAGGNQKMIKIIKKVKALQDRNAENATIVDAYKKAAPFLVDVVPAGTVISELKGHTLLHAGPPIEYDEMTEPMQGGCIGAVLFEGWADDETGARKLLESGDVKFLCNHDVNAVGPMGGITSAHMAVLVIKNALKDNYAYCTMNEGIGKVLRFGAYNDEVINRLKWMADVLAPTLSKALKKIDGGLNVNVMMAKAITMGDEFHQRNIAASLVFLKEVAPLIVSLDIPEKEKQDVIQFLADTDQFFLSIMMATGKSVVDAARTYKHGTVVTTMTRNGKDFGIRISGLGNQWFTAPVNTPKGLFFTGFTQDDANPDIGDSAIAETVGFGGMAMIAAPGVTRFVGAGGFKDAQRISNEMAKITLDRNPNFTIPTWDYQGTAIGIDIVKVVETGITPIINTGIASKVAGVGQVGAGTVHAPLACFEKALVAYADSMGLLDDDEQAAIEKDLVKE

SEQ ID NO: 3647 - protein, 276 aa, Lactobacillus buchneri
MNLNHNQATGEKSNMLPLHLFNKNHGIVSTVFQHSFNIKFPELLFHVGGISESLSATGITISDELVDRLLKDVDVGNRVLYKNEQLFIYTNSDIKTISLSDLTEVDLRIPQVTFDQTPLEQIISAFKIIDFAEDWGLSDKYSPQKVVNMIHQSQTDTERAKTLNFLYGRGRGLTPSGDDIIVGCLSILAAMGYPQLTQWQEVIHKRLELGGTTDVSESYIGAALDGYTSKKMVAFLKVIQVGAIEQIEPAILGIQDFGHTSGTDTLLGMYTAFTML

SEQ ID NO: 3648 - protein, 319 aa, Lactobacillus buchneri
MAKIVVALGGNAILSKDASAQAQMKAVKETAKELVNFIKNGDQLIITHGNGPQVGNLLLQQSAADTPENPAMPLDTCGAMTQGSIGYWFQNAMREELLNAGIDKDVMAVVTQTIVAEDDPAFQNPSKPIGPFYTESELDDIKAIHPEWQLIEDAGRGYRRVVPSPKPLEINEYRAIKMIVEAGIVPIVSGGGGIPVVKKGNQLIGTEAVIDKDFSASKIAQLIDADKLIILTSAGGVFYNYGKPDAVELKEVGIDEIQKHIDANEFAKGSMMPKVEAATDFVRNTGNHAVIGALEDVKRIIAGEEGTTIVSEDIAMVAK

SEQ ID NO: 3649 - protein, 188 aa, Lactobacillus buchneri
MKTGLSLSKEALYTALGIGIFTFFYGLLSGSLEFWMAPVAFITSAFYAGYGSKKNTSINVSLSFGMGIIWGLIAFNLFQIPNMNMLLWTSSVFGIMAFIAIILQGTILPFTRIPAWLLGWGTFMEISLNKTITNWPLFVVELAACMLLGVYFLDFGSDLFKKMMYAWFPEKRSKSKSTQVNNKQHSEI

SEQ ID NO: 3650 - protein, 418 aa, Lactobacillus buchneri
MDLLLKNVRINDDEELMNVAIKNGKIEKISSSAIDEHATKTIDGEGHVLIPGLVESHIHLDKALISNRVHNQSGTLKEAIAVTAKAKPTFTKEDIYQRAKKALEMEIAHGVTSMRTHAEFSPDTGFDGFKTILRLKEEYKDMIDIQVVAFPQDGIFKLPGMTEMMDEAMQMGADVVGGIPYVDPDPKQHIDFIFQLAKKYNKDIDFHQDFFDDADNITVDYIAQKTIDEGMQGRVSVGHETALAALPPDDLKPIVELMHEAQINVMSLPETDLHLGGRTDTYNVRRCVTPIRKLRDGGVNVSLSTNNIRNPFTPFGNGDIMQVGFLAVPVAHLGGLSDLPTVLDMLTYNPAKALRLSGYGLAVGDNADLVLLDTKKKNDAVIDIPDRLYVIKNGRVTVQTEKKVSLYRRTEDILASQR

SEQ ID NO: 3651 - protein, 329 aa, Lactobacillus buchneri
MNHYQHITIDERETIFLMRSHGNSLCAIAKEIQKSCSTVSRELKRNSDGGRYSPSKAQAKYQQRKRNCGRPSLLSVSQVFEVVREHFCEDRWSPEEISNRLAVEKHAVQISTATIYRGILKGLFDNLFKSGSSSAVRHLRHHGKSRHNKTYQEKRGKIPIPNKIHDRPREADNRLEIGHWEGDTVLGKSGKACVVTLVDRKSRYLLIGKAAKRTSSAVTNTLSQLMRLWPGRSLTITPDRSKEFAKVQCLTEEFGTSFYFPDPHSPWQRGTNENTNGLLREYLPKGTDIDSITDKQIQTYAEQMNNRPRKYLGWGTPSEIFFNVVLHLI

SEQ ID NO: 3652 - protein, 952 aa, Lactobacillus buchneri
CRISPRASSCIATEDNCLEASEHELICASECASMPTLSTKATTLWAKKRPTENGKQLWLPLIIHLIDTQNVINYLFNQWLSPNQRRILAGNLSDEDIHKLIKFAGFTHDIGKATPAFQTKPSWGHDDLLDDELIEKLIRNGFPELNDIHLPSRSASPHARAGEAILDKYEVPDSIGAIIGGHHGKPEFSRQKDDINVHTSNYYQCEKDPVIQANWIEVQKELMDYALESSGYQTVSQIPTITQPQAVILEGLLIMADWLASSEYLLDDEETVLFPLIEINQTYADVDTTNRFHQAMANWNLNGEWQPQPVDTTTDPYEARWGFHARPVQAAMTDAIEKTIDPGMVIVEAGMGLGKTEIALLAAEQLAYIKGQDGIFMGLPTQATSNAMFDRVSDWLTTIAKSQGESFPIKLIHGKAQFNRDYTSLPKASNVGDPNAVVVNSWFSGKKSILTKFTVGTIDNLLSMGLKQKHLFLKHLGFSGKVVIIDEVHAYDAYMNQYLYKAITWLGAYHVPIVILSATLPKEKRNALLKAYLKGKYGIKYQQTFQAPAGWQEQQAYPLLSILDGNQLKQVTHFPGQSSQPSTKLQVYRLNLDDADLIQAVLKKISGGGIAGIVVNTVKRAQALAKLVPEDVKMMLFHSAFVATDRESQEEALQKTIGKGATRPAKMIVIGTQVLEQSLDIDFDVLYTDIAPIDLILQRAGRLHRHNIPRPKALESPQVYIMGINGPGDYGDANESIYPKYLLMKSDYFLEATVMLPNDISKLVQKVYDRTTDAEIPQEKMPGIANARAEFDKHLDQEKSKAKAFQIAAPQYAGHPTIHKWLKRSQSGIDTNEQKANAAVRDIRETLEVILVQHTSKGDRLIDGRRLADVSSQNIAQQVIRLPAATTLDIDAAINTLESLTSTYYPEWQQDIWLKGALALPLDTHLSAKLGDWNLSYSSKFGLSYSKEDDHG

SEQ ID NO: 3653 - protein, 606 aa, Lactobacillus buchneri
CRISPRASSCIATEDPRTEINCASACSEMADKRFNLTTDPWIKVLDKTTNRERTVSLIELFKNAQDFSQLSGEMRSQDLAILRFLLAILTTVYSRYDANGRGYDWLDVNPDTMQAEMNDDLEDSEINVYLYETWAHLYRSNHFTNIVTKYLKRYADKFDMFGDQPFYQVTETQYNRLVPKKKQISGSEGPGTVAVKQINRLISESGNTPSIFTPKSDEFKNDIQVDELVRWLIMYQNFTGVTDKTKIETADKFSASAGWLYKLNPVFADGETLFQTLMLNLVLRSDEHASVIQQPVWEYDTIDAYVNERKKQVQPTNIAALYTTWSRLLHIDWSERGQPTIFSAELPMFDSDEAFIEPMTTWREDKKTGRYRPAVKTLRSLGTAMWRNFGEYVKVDPSDSGHEAGIVDWLSDLRNQDDSDDQIIRGSLLTLASVGLVSDGNATSQAPVAEVYDDMHINADVLFDPDEDQALHWPHRIEEMIQLTQIIGSDYWHFAADVARIRNLEVRPFANQLSAQFYEGLNKPFKDWLADLTNQDDRDEKSEEWRKFLRKYVLDAAGNVMQTSSSRDIGGFMDVSGIIDKNKGLVNIFTVNNRLKYRVQVHMNQN

SEQ ID NO: 3654 - protein, 233 aa, Lactobacillus buchneri
CRISPRASSCIATEDPRTEINCSECRISPRCSEMERTINQITYEIIQELYGHGNPNKAVLASIRSAASMTSPRAQKVWPIMMDKLEKSMLSKNGQPTHAETAIYAALRLYAIHQQSSRDAFVYGSSGRDASADGLTFFQALANLRRNSDTREALDRRVQALFGTTNVNSVINSMTHLIDILKATNPTQKIDYPKLANDLYWFQKSYQDATQTRLKWGQQYYQFIKPTTEGEKK

SEQ ID NO: 3655 - protein, 387 aa, Lactobacillus buchneri
CRISPRSYSTEMCASCADESBNITCASCMTNQNLYVDINVLQTVPSSNINRDDTGAPKTAIYGGVSRARVSSQSWKHAIRESFKANDITTGIRTKEAVQLLADKLNEIDTSLDEDAALVKAADIFKAAGIKVSKDNETGALLLISPGQIEKLAQYATDHDELDKKEVKTLLKSDNSLDLALFGRMVADNPELNVEGSAQVAHAISTHEVVPEFDYYTALDDLQSDDTSGAAMLGTIEYNSSTLYRYANLNVNELAHNLGESSAVQGAADFIKSFLLSMPTGKQNTFANKTLPNYVMITVRTDTPVNLVTAFEDAVASKHGYVAESVKKLEDEYQSTLRFVDQPVSTIVLSDSKYHSKLDDQAANLSELLKRVTEVLTKAVQDEDTTN

SEQ ID NO: 3656 - protein, 278 aa, Lactobacillus buchneri
CRISPRSYSTEMCASCADESBNITCASDMKTLLIRLTSPLQSYGNEATFSRRTSGDYPSKSAVIGMIAAAFGYHRDDSRITHLNNLSFAVRVDQPGTTLTDFQTVEWKKNTRKITYRNYLQDAVFVVGVGSNNDQQIDNIKEALRRPQFQLFLGRRSNVPAGVLKMTVVPNADPVKALQRLEWQASRWHQRRYLRREQKQYAENVELIADANLLPEQRSAMVKDRVVSFDQRHRQHGYRAFATKTLNRVKLNDSYIQRPDTDVAHNQVETSHDAFDAV

SEQ ID NO: 3657 - protein, 253 aa, Lactobacillus buchneri
CRISPRASSCIATEDENDRIBNCLEASECSEMYLSRVEIDLNNRQKIKELTHLGAYHNWVEQSFPDEIAEHTRLRHLWRIDRLAGKSYLLVLSQEAPDLELLGAYGVENTAMTKPYDPFLDRIKEGEIMQFRLTANPVRAISQPGRKQPRMVPHITVEQQRKWLTDRAEGLGFEIVKTVSADSMDSEGTENFDIVSRDWPILRRGHRTLRLSRVTYEGLLRVNDLDQFKQTLMNGVGREKAFGMGLMTVIPRG

SEQ ID NO: 3658 - protein, 345 aa, Lactobacillus buchneri
CRISPRASSCIATEDENDNCLEASECASMKRKFGAKKPELTELSRVRDRITFLYLEHAKLNRQDSAIIVTDSRGTVFVPAAIVSVLMLGPGVDVSHRAMELIGDAGLGVAWVGEQGVREYAHGRPLNHSSKLLEAQARLVSNPKTRVAVARKMYQKRFPNDDVSGLSMQALRGKEGSRVRQVYRTQSQKTNVPWSRREYNPDNFEAGTPINKALTAAHQALYGLSYSVIVAMGASAGLGFVHTGHDLSFVYDFADLYKAEISIPVAFQVAAEFGDDKDIGARTRLAMRDAFADGKLLVRMVDDLTSLLGVTETSIGAGVINLWDDKLGLQKFGVQYHEFKGDGDS

SEQ ID NO: 3659 - protein, 296 aa, Lactobacillus buchneri
MIVITLTKVPQSLRGDLTKWYQEVQTGVYVGNVSARIRDLLWERVIKGIGTGEATMVYSTNNELGYQIKTTRRQYQVVDFDGIPLMMRLNAETTPVKHGFSNASKFHKAKVMAHKVANKDHHSAVHPLVAIDIETTGLDVTKDRIISIAAVKHSGDGDPISFQQLIQIDQPVPHQITELTGILSEMLTEQGVSLESALASLRDFIQQFPVVGYNLHFDASFLSMAFRKLDQPDLSNQMVDLMPVVKKVNQFLDNYRLETVLAEYHIKNSDPHRALADAKATLSLALKLIENGDLTI

SEQ ID NO: 3660 - protein, 282 aa, Lactobacillus buchneri
LKKSVLIASLALAVFSATGAAIQSVAPANAQVVATQGVKVHEIDLKGAMNVRDLGGYRTTDGKTIKSGRIIRSASLANLTKADQQKLTRTCNLKYDVDLRTPMEMKAAPDPTMAGVDFIKDPVFKNVNTSSNQTITDKTMEQGYTNFVTTKQARTAYHNLFTTLLNNKGNSAVLYHCSAGKDRAGAGTIFILSALGVKKLTIVDDYLATKGVYEKHYAQLKKSGASQKELQTVKALEDVKPAYINATYSAVKKHYGTMDNFLNKGLRVSNTDIAKLRAMYLK

SEQ ID NO: 3661 - protein, 530 aa, Lactobacillus buchneri
METRVNFMKYLRRTILLGTSLILFGLASTNTVSVKADSSITSTTISAPNISDQTYYHSSATQLAKMVRSGKVTPQQLIEHAVAKIKADNPQLNAVISLREDQAMKEAANLKDTGQPFYGVPLLIKGLGQPIVGSSNTRGLVPLADQKATTTSSFVQRLQSMGFIVIGQTNFPELGLINITNSALNGVAHNPWNHADNTGGSSGGAVASVADDIVPVATGNDAGGSLRIPASWTGVIGLKPTQGVIEGDDTTPSSVNFADAKNIQDMQTLFNGMLATSDHSGDAMLKSVPKNIKKIPIAYSTKSPVNTPVSKDAVNAVKQAVSFLRSKGFKVVKANSPVDGVKLMHIYYLESTGTGTSANNLIKSVTGKNMTFDDVSPMTWALYQADQKQPANADTTVQNELNLVNRQMTAFHKKYPLYLTPTTAVTAPKNTDPAYLPQYVDKLRDIGNLDHNQQIQTIYDAWLHGLTKTPFTQLANLSGEPAISLPTYVSKQKMPLGIQFEAAKGNDKLLLKVGAYFQDNHKFKMLDNYR

SEQ ID NO: 3662 - protein, 246 aa, Lactobacillus buchneri
MRSKIGMVIYDWLIVILALFSILLVVLDFTKTINLDASPWFFIDNGILLIFTFDYFSRLFASKNKWEFFKHNIFDLLAILPFYSVFSFFRFARVFRIMRLVRAFRFVRLIGFVGKVQKYSSKFLKTNGFIYLLWVSLAVLIISATLYSLAENVSWGESLWWAVATATTVGYGDISPHTLVGKIAAVMLMMVGIGIIGSLTSAMTTFFTNRDNVDNSSKIYRKLEMIESENRDLKKQLDKLERKLDK

SEQ ID NO: 3663 - protein, 496 aa, Lactobacillus buchneri
MTTPKEILVDGLQEFAKKVGGKSRNGKELFITRTAVTDQLTPDGKQYTFISLIRNDQQASGPYSGISLKVNPGINHYRISLDIGSEGFGDDYQLVATPGTRRRFVELQSVINEYSKENRKQISCFCALNFTDNSNKQQLKNLEKQFSDDNINSHPQDLFVVYVDKPTIDNGIHEDEDFWKIYKAMVGTYSEIRNWPNKGERSTINKFKNAFNLQASYSNEDLAQVKNLLSREHYVVIQGAPGVGKTYLTSQLAQEYNPQNIIFTQFHAETTYSDFIGGYKPVQLNTGLSYQYQEGPLLKAIRQSIAHPENNVLLIIDEINRANLSNVLGESFYLFEKSELKNRSVIHLGEPANDVDTARKPLSVKQLPKNLYVVATMNTADRSLAVIDFALRRRFAWYTIVPHKLVKSELRNNEDFHSDEFDRIHDIFQEYATSQELMMEPGQSYFITEKGQSIKERIQYELLPLIREYLDNGYLANAADEFNQFFIDTISTSIYL

SEQ ID NO: 3664 - protein, 451 aa, Lactobacillus buchneri
MGLDTNVPIIELKTFSDTEYTLPKSMRGDPRYPNESNDKFLQLNQHAFEFLNIEAHGKNGKIHFRTNELVGAIPIRMPNNGSGTPQTDLVVKPRYQSNQSGSWYEWMSGLAEFSNHTLITEQNSLFPLTRLEGSPSPKYLLAKEIILKILPVLRENSWRKFDSLQKVANRPVGNVDWDQYAINSVDPQKRLIFETRINSISEDNREFRNALAYFNAAVQDLRSFETPLSVKVPLQSFIDQIQNRIISLGIRPSCSLCNQKFAILHQDPTSIQKLKRAINNYIDNESKQVFAWRIDFSKIYEDYVQKIVQLGLESVKNNDRISRLAIPGYSHQVTRLMPGYLEPDIIAEFGGSKIVIDANYKSYFFDRQLKVKESQRERMRSDVHQIVAYTSLFNSKIAMLVAPVIDQDIRFDLIQYGDVYVAVIGLPLEWRRSGEYARQIRKFVRGILEQM

SEQ ID NO: 3665 - protein, 81 aa, Lactobacillus buchneri
MESNSQIHSNGHAAFLSIGWVSAVVSLFIPFIGVLAIIFGILDIVKSKSKTAGIVLLVFAIIFLYLGLTGFGYGFSSSYGS

SEQ ID NO: 3666 - protein, 141 aa, Lactobacillus buchneri
VKSKGIKKAGIALIIGLSLGIGGATAPCVVGNTTNIIVASASSSRSAALSSAYFYARSEHMSKRAIYHQLISKYGDGFSKHAASYAVRHLHGISWNHNALKSARFYRHNEHMSNNAIYHQLISSYGDMFTRSQARYAVRHL

SEQ ID NO: 3667 - protein, 103 aa, Lactobacillus buchneri
MEYNQLIKELTAFRDSRGWNQYHTLPALARAVGIESGELNELFLWDMENDNKFSEKQKHDMELELADILTYCYYMCDKLGVQPNDIVQEKLDINKKRHWKFDE

SEQ ID NO: 3668 - protein, 581 aa, Lactobacillus buchneri
MSDIGYPIIEKIKYDSQAATNLEDAIDGDKLKRKLLIEYPTVYVICSPIKSGGFKVYVGETNDIERRTEQHLNEDPKVRDDWRELSHAKDAEMFVIGHDHFNKSLTLDIENQMMLFMLGVPNVKHLNNRRENEQNEYYTSDEKDKIFSRIWRKLRGFNQDLFPVERIIRDSAIFKASPFHNLTTEQKNARDLIIDRVIDALLSKKTGQLILVEGEAGSGKTVLLSTIFYLISTLKDDGSPLRQGFDNLKNYVLVNHDEQLKVYEDIINKLNLNYKNDDVVSKPTHFINTHDESDPADVVLVDEAHLLWTQGKQAYRGKNQLDDILKRARITVAIFDRNQILKTEEYLEPQQIQTIEEKAMEQNNLIMLSNQLRIHANKQTIEWIRDITDKKIIKKIPRDSTYDLRMFDDAKEMYDAIREKALGDQKSGLSRILATFDWKYNSKRKPEDGDYWMVTAGDLSLPWNLQLKQKGRSLKKLAWAEQPQTIDEVGSTYTIQGFDLNYCGVIIGPSVKYRNGHVVFDPDASENTNAIRNRTLQDGKKRKVASQLLPNELNVLLTRGVNGLYIYAVDDELRNILLRSQ

SEQ ID NO: 3669 - protein, 435 aa, Lactobacillus buchneri
LLGINNNFVITGDWGSSSDNLNVSGTLTFKSGKVTLVTVQRLSLNKDSTPSIFGIGHIKVEGINTDDIVMISLLGVVESKNYSKTKFFPHNTAIQSSNYEYTALSMFTGDVFVSKDIVIRTVKEYPTNFSAWMHSLQDFEQSKEDSGVLQVSAKENQGYVIKSKDGKKTYSFRRSLVPTQQNQVNQINRTIQITDFFQVDDSSGMSLEESMTIGPMVSSWYQLITNKDENIYCNCFTTVTGENITFFNLSKSVSIQQRDYSRETTVLRRTRQWKENMLCSLVNWIRSYEVLAPIAMAIYPPQTLSVDFRIQTECVAIETIVDNYYKEIKKAYYKKKVSYFMEQVDDFVTVDAFKTFPVAENVDSLADKIKQYRNPLSHNYLQAGIKPLEEKVLLFNVLKAMIRDWTLNIIQIDQKSIKTDFQIFSSIPGRVIKAL

SEQ ID NO: 3670 - protein, 590 aa, Lactobacillus buchneri
MLTKHSLLMKLMLGSVTVILSSTAILTTHKPVQAKSQSSAKIEKLLAPHKADYGYYVDQYLLNRKENDTPDTNPSTALFTNTFAKFYKGDGTKLNPQILQENIDKSIKISENVTPAEELRSYITDRQDSPYDVIRGLGPYAEAFIENSNAKTLFYNLPTSELPADTKDDPGSGITWADDSSKLGSMVNLVDTTALWYYSSSGNAKQFYKYIRPFRQDPRVQVNPYLKAAFDATPQNDYDFPSGHTTQAWETGLSMAYAFPERFQQLVTRSSEVGYDRILVGRHSPLAVMGGRILGTAVAAAVLNNPQNKQIADKAYQNAQSVLLKSNVTKSKDDYKNYQTNLKNFEYRMTYGYKPISSMKEKMRVPKGAEVLIQTRFPYLNATQRREVLYTTGFKSGYPMGQDTEGWGRLDLFKAGAGFGSLLGNTVVNMNAKRGGFNVSDTWRNHISGRGALIKKGTGSLTLEGANSYQGGTFIKGGTIVAANQRALGSGSFKLSNGTLRLSAKTVNVKGNYTQRERGALQLAGNQALNVKGNGHLSGKLVINLKSRLTKNHVLMKFHTRSGKYKHVTITGQYSHYHVKYTSNSIVLVK

SEQ ID NO: 3671 - protein, 809 aa, Lactobacillus buchneri
MIKHSNKQLKRQLLLAAGVLVGVSTTTGLDQSKVHADDQVPTTATTPTTQQPATTSANTDSGQVTFQAPTQAEQTATDPSTPQAYGTGKMDTQATEETVTPTTSATESATVTQTPQATTDQTTQTTTQQPTVTAQTQQAPQAQQTTNQGVTEQTSAATQQTAAQTAQATQTDTQTTNHSSSKGTTATSKHKQRTTSQTPKQDKKAVKTAKADTNSTKQNKAEEVKETFVLWKNATGQDDRRNIIYRQVTINPQTRETTIEHYLFEPDNANDPEGTGKYRLLENNDPLIDEINKADDAGVVQTTLLGEDSTAAFLKAVEDGDDNVLSYKIVRNDTNDPRNIPEVIKDNGVAMIVQYYFKNDGNKPNQAVPVYVAQFDNGTGEPSYFSYNPDSDAFDIPVDSSDIDEAIRAGALQVGYTTDEDLTDFQRDYEASIAEGSQLTTWNKYKVITEDDEDRIPNGASSFTHETAEQKDYVKPSDANATEIHTVFIGSDGYVYKYDSESGDLVELSPEEQNEYNAAAAVAETKALLKKGGSKLEEAAIKSAVKDGSDFMTFNNTPYIVKSAHDNQNFHPDTVFYKPQGGGSTRYYAENTQYGVKITPAKTSYIYGMNESYAKSEAPLYTYAVNERYGVKVEKTVTPPGGGGGGNNGGGTPGVTPETPETPTPTPTPTPETPTPQPPVTEIPSPDDIVEQPQGLPAKDDEKEATSSSDKKTQSGKKEGLLYLKVNPNSASRGMTSLQALSGERGKTFKYANSTTDATVKPAVQQDLNVKGAAMLPQTGDTHSANWLALLGLSLLGLLGIGKLRKFRS

SEQ ID NO: 3672 - protein, 687 aa, Lactobacillus buchneri
MNRMTKTLLSVGAILFGVTCLAGFSTTTQAATVSPPTTSLAQPQALADENGGQLGDVTWKIEGDTLTLSGGTLPNLGNSDYDYPWSHSGTPSSVTKVVIEGGLTLEGDSGQGLFKDLTHVTSIEGLDKLVTTNTTSMQNMFLRDYALTSIDLSAFHTENVTNMSDMFGEDHALTSLDVSQFETGKVESMDGMFDGDNNLTSLDVSNFDTSQVTDMGYMFDEDYELTTLDLSNFDTRKVDQMDFMFAQDHKLTSICFGKLFDTANVVGMTSMFEEDRALKAVDVSHFDTAKVENMDSMFLDDASLSSLDLSSFDTDQVEEYGLDDMLTGATNLTRLVLGPQVELRDGVGLEAAKDDSDWQAVAKGTIEQPSGQTFDPDSLVEKYAAAGVPKELYVPEDGFKDQSKVTVTPSITLSLGDKFDATEHFISAITPEGRSVTKYCDAAAEGLVIDGGNIDTSKLGTYTVTYHFYGSDQKATMTVTIPAAGGGGGGSVTPPAPITPAPQPTPTPSPAPTPTEPTKPTTPNIPNYAATKKAAVYALKTIYLYQNPTFKKAQRMARYPKQKRINRPMFVVIDYARSNGGALRYKVRDVNHHSKTDGKIGYITAKWSHVRPVYYRSMPKGNVITVISKKGVHAYKNKNLTGRVKSYKKGTHLKVKSLVKHNLTTRYVLSNGYHVTANKKLVIQGKY

SEQ ID NO: 3673 - protein, 501 aa, Lactobacillus buchneri
MNKDDQKELITKINKMQPEEIKNFVLRLASLDDNLAGVILTVLNDEPIEASHPDREAPLANGSSFTEVDQEAVERDIRRIRGLVSNSIRETVGNTDYLTPKKTEELTEFFNHLVKRFQDGYKSGEMPIELTVPLLLMLYQNQIQLLPKVVGRRDTFEDGCNGVLSALEEVIGNGNSLSANKKNRLMQQVIKLFKKNIFQGFPQERYDLFYATLPLVTEETAPKMLTVSNKLKKQASILDMIYLESNQIILKLRIALILGHKDEAQQIIDDNITNDNVRLEYVSILEAQKKYAKAEEVIQDALTNNVGDRRMWRFQLGQIYELTNQINKLKQLLKDDLMSGNIQVYKEYKDLLVKNNEWKHEYPQLLTELEDNLGRYDYCEILLQEKEYTKLIDQLKKYNSMVMIRKYAPEIYQSAKIPVTDLYLKSVVIPQSNKKTVTGPAQLASDISKFLNFSGDLKTTKKWVHQLRARLGDNEKFRDAFDKMDDSISRYSPHSGRSLSD

SEQ ID NO: 3674 - protein, 298 aa, Lactobacillus buchneri
MNVNKVVILGGGVLGSQIAYQSAFSGFPTVIYDISDEAVDSAKQKVASYPKQYQQDINATDAQIDTANSNLSLTTDLKSAVTGASVIIEAVPERLDIKESTYKNLAPFIADDALLLTNSSTLVPSQLIDFVPNKQRFMAMHFANLIWIHNVAEIMWAPDTPQSTIDDAENFAKQIHMIPILIRKEISGYIMNSIFLPMINAALSLWANGFSDPISIDKNWMVSMGVDRGPFGFLDIMGLNTAVNIEMGFYENTKDETYQKIADKLNELVKANKLGVATGEGFYHYPNPEYQNPDFVKA

SEQ ID NO: 3675 - protein, 632 aa, Lactobacillus buchneri
LRGKSFVITALSGLMVLGASAAIGSASQAATVKRTVVNVTFKPSTSEADLSNYVYDTVDPTSPNHHHYLTPSEFADKFGQSTSYIQSFKDYLNKYHIRSYAYPGNLAMKLTATPKNMQKAFNAKYVKPAKKGYEATTSYKLPGNLSSKVVAVIGLYAQKPTKKTTAKKTTKKAAASHALMADLPISSQQPNTNVSANTFSLKYGAGKFAKAYQLNPLYQKGLQGQGQRIGIITVSDIHDGDVATYWKQSGIDANVSQIHHHYLVNPKAEVQKSVNYLLGSPQTETTVDVESASSVAPKADIDLYIGDDTNPNTSDPSAIYTGTMSAISDNQDKQLSSSFSAAPEVTADWGDPSATVKQTSDAFNLMYEQAAAQGITVFQASGDYGPVSQPSAKENHGLSTSPYQVLVGGTTLPYQKILNNKVITVSKERAWGDTYAQTAQEKQMGIFGGGGGGFSALNPTPRYQQGVSGVNTFRAENLLTYKNGKFTLTKHPHIIFGTGNSRNIPDVAGNADLQTGYATYVTGKNPVLKGKKVLRIPSTKWLIGGGTSYTSPQMAGANAVMNSGRQTPIGFWNPQIYKFAQESDSPFNVLDDADNNNNLYYTGQPGKIYNQASGLGTINFTQLYDKFADETN

SEQ ID NO: 3676 - protein, 226 aa, Lactobacillus buchneri
MEFLQVLLGLGYIGLIIAAIYLYQKRQKQEPAPFGWKHLGIAFCVLFVIGMATGGTQSDNSSSTQTSQQADSATESSASEESLDESTEAEEPASSESDDDEDPYAALSAKERDEFNQSLDDELIQDQKEAENGEDAYAWSLFVGGIVYDKRRGFIVKVNDNFQQLSNANKTIIGHSVQSFIQSQLLMIGKDVQPDDPYPYINFHYGYDRVGHSRMWDPAKFKFSES

SEQ ID NO: 3677 - protein, 451 aa, Lactobacillus buchneri
MNTKNKLKATLLIAAGALLLGISTTQPTSASATASSTTSTTKSTSTRYDAQIITPKSLASGYQIYSNVPGVKNTTGTPTTTTDSSKYNNQYVRVMQTQKAKSVTYAQIRLNGKILGWINANALKQTSFKAIAQATMQKYNAVGSVLVSHNKSLQPTLVNNGYANMLHSTKNTSDGSVLYPLASLQNTMTAAMIQQLINTKKLTATTTLSKYFPQVAHSKTITIQQLLTMTSGIKGTIKAPDDQVTEDQAYTNAIKALKSTNKHSFSYSDINYVLLAGVIAKVTGKSYTKNLQSRILNKLGMKNTYAINETQPDLTAIKAVSYSSSNGNDYQNSQSVSYPALSALPGAGNVLTTPNDYYKFVIGLQNGKVLTAKGYQQLTSYSTKYSGGMYVDQKGMKSNNGTYPGSGFNTGYTASDGNQHVAVVFLNQSPLKNNMTASAFLAKMNIVATYY

SEQ ID NO: 3678 - protein, 397 aa, Lactobacillus buchneri
MKRGRTYLYITLIILAVVGTVGGAMYWRANNQELRTQQAAKRANRRRQEQQLSSTAKKREASTQKSAPRQIQHKTTQQTKQITSYLKRNHFVGSAIIVKNNHILYQQGFGYANYKSDIPNTPSSEFQILSIQKSLTAVMAMKLITQGKLSLNTKLSKYYPKIANSRNITIRNLMDMDSGLTMSEAGSVRTLNEENVIKYAVNHIVTRSPKYKDWYQPVNFVVLAGIISKITHKSYGKYFDQLFTKPLNLKGTGFVQHWGTRPNRTLGYHWLAANQLKQNYSRQYHEAKASMQNELGTGQVFMTPFDLFKVEQAILKGKIIPKASVAILHQPGLNAPYGGGIYNQQNGIRSHGIGYGYESSLFITRNGKSGVVLLSNDYRPANQIQNLAARLFDDLAT

SEQ ID NO: 3679 - protein, 47 aa, Lactobacillus buchneri
MPVRQWLQKPWVRFTITTLIYFSIMLVLFYLYDYSGINQAKFIYNDF

SEQ ID NO: 3680 - protein, 508 aa, Lactobacillus buchneri
MIETLISTIDSHAQNQGDKVAYAYDGEKHTYQELKDYSDALAERIDSMALPLNQPIIVFGGKAFTMIVSFLAAVKSGHPYIPVDINSPKERLEMINQIAKPVAVIATEPLPEKLPDIPEIDQEQLDHICLEKVDYRLTHPVHGDQTYYIIFTSGTTGVPKGVEISYNNLAGFVDWMVSDAFDLPKDLQMLQQPAYSFDLSVMSLYPTLFQGGTLHVLSKKTTDNFIVLFTALRTMPINTWVSTPSFVDICLLESTFDQAHYPKLHDFLFCGEELTHKTAAALNKRFPDAHIFNTYGPTESTVAITEIEITNDILNHYERLPIGYLKPGMNAQVVNENGAQVTDGQKGELVIYGQNVSKGYINNPEKNAQAFFKIGDQQAYRTGDIVTMAADGLLRYFGRKDFQIKLNGFRIELEDVSALVSKEEHVKQAVVVPKYNSQHTVSMLIAYVVPQENDFKNNLELTAAIKKNLGQDMMAYMIPQKIVYQKSLPLSSNGKVDIKAVIAEVNSQ

SEQ ID NO: 3681 - protein, 405 aa, Lactobacillus buchneri
MRWYIPYGNPTYFIWLALAIIPLMIGLLYGHRFRGYQTIISLFFLILTFGGPNWKTGISLIGYLIYQLILVWLYSTYRQKKDTPNKGWIFVTAVVLAIVPLVIVKLTPLFTPGRQSIIGFMGISYITFKVVQTIMETRDGMIKEFHPVLFGQFLLFFPTISSGPIDRYRRFEADYAKVPEQSAYLDMIQKGVRYVFQGFVYKFVLAYYFGSVLMPQIQMRALMAHGFSWNIVAYMYAYSMDLFFDFAGYSLFAVGISYLMGIKTPMNFNQPFKSKNIKDFWNRWHMTLSFWFRDYIFMRLVFFCMKHHIFKSRTTTANVCYVINMLIMGFWHGETWYYITYGLYHGFAMVINDTWLRFKKKHQDHIPHNKFTEAFAIFLTFNVVCFSFLIFSGFLNTLFFAPKPF

SEQ ID NO: 3682 - protein, 77 aa, Lactobacillus buchneri
MDDKQTVLDILKDLTGEDFSDNLDEDLYSSALLDSMGTVQLLLDLQDKLGVQAPVSEFDRNEWNTPAKIIAKVEAAK

SEQ ID NO: 3683 - protein, 425 aa, Lactobacillus buchneri
MSVKKRLFMIFGPIFAAALLMLAVFLSPLWSGFSYVNPTVVDNAAASLSPQVLKGQLIKRNALEHDYVPFFGSSEWSRFDPFHPSVLAAKYKRSYRPFLLGARGSQSLTHFFVMQSVNPQLKNKKAVVFVSPQWFTPKGEDPNAFSFYYSTLQTTNWIKQQNGSKMDRYAAYRLLQMPSGNSDKVIAGALARIAAGLKPTTSQMLYVNLRNRILLNEDQIFSRYRIPLNNEETIDKNEELLPAQYNYQKLDQLAGKIGAEKTSSNDFQISNSFWNRRLKTHVKKLKGFQSNMSFLKSPEYGDFQLMLNQFANDHTKVLFIIPPINAKWQKYTGLSAKMLDQFSNKITYQLRSQGFTHIDNLSHDGNVPYFMTDTIHPGWRGWLKMDQAIRPFLTKKVKTPHYRIDNYYYSKDWQNESGSDNDFDE

SEQ ID NO: 3684 - protein, 436 aa, Lactobacillus buchneri
MLFLAGLLSVGGLMAGNKAFAAYNAVMATSNKHYDAQIVNQTTVKRGYNLYTDGPYNTNATTKTADGNGYKYNNAYVRVLQTKTTKTGTYVLLRYYNQKLGWMNIHGIKSVSFNTIASNMMKQYNVVGTAVLASAGSNNTAVVSNGYANALRNVVNTSNGTVVYPLASLQKAMTGAIIQQLISAGQLTPTTPLSKYYPTVPYSSQITIAEMLSMTSGIDNTDVTPSSQLTENQAYASMIQRLKSTGQNTYNYSDANFVLLAGIISKVTGKSYAQNLQSRIFNAVGMKNTIIVGSKQPSTKSTVAVGYTNQGKYNYQDADAVSYARLSAIPGAGNLLSTPSDFYKFVQGLQNGQILSASQFQQLTSYGNYYSGGLYVNKDGLKYNNGSFGGSSFHTSYYARDDNYHMALVFMNQYPLVGGISAKAFTQKMYDVATYY

SEQ ID NO: 3685 - protein, 171 aa, Lactobacillus buchneri
MPIVVLKDFYQPNDLIQIVTAAIHANNADCHAIIEPNIIVSSSNVVSNPRRYEDLMHFTVRPFNQKLKGIYSFYKERGNVYLEKLPDNSVMGLSPIYLGEGKESTVPKQLMAALEKKIESFCYENGVANVDRYPFDQLKLAEVTLRIVSEDTYQVPGFTFDIQALPEVEVE

SEQ ID NO: 3686 - protein, 233 aa, Lactobacillus buchneri
MAYIDVKHVSKIYGSGEQEVRANDDINFEIKKGELTIIVGASGAGKSTLLNILGGMDTPTKGDVIVNDRNIATYSPKQLTTYRRLSVGFVFQFYNLIPNLTALENVELASQISPDSLDVPEVMKDVGLAKRTNNFPAQLSGGEQQRVAIARAIAKNPELLLCDEPTGALDYKTGKSILKLLQDFSHKTDKNVIIVTHNGMIKPMADHIIEIGDGQVKNDELNDSPEPVEEIEW

SEQ ID NO: 3687 - protein, 287 aa, Lactobacillus buchneri
MKYAVTGATGKFGQTVIKVLAENVDNRDIIALARNTEKAEKLLPGIEARPGSYDSQEVLEKSLAGIDKLLLISSIPGQAVSRIQQHQNVINAAKKAGVRFIAYTSFPHADTAKSPLAVDHKNTEQAIRQSGIGYSFLRNNWYLENERLQIPAAINNRPFVYSAGNGRVGWALEREYAEAAAKVLMTDEPKTVYEFSGPQHDYADLARALQLVTDNDFEVMSVSDDEYRKRLVATGYSPAAAASIVGMQRLIRNGDLEETSNDLPEALGHPLPTFEESLKEVIDKLKK

SEQ ID NO: 3688 - protein, 133 aa, Lactobacillus buchneri
MKNNGWYRLGQVSAVFCGGALGGISRYEIGNWIHSANGLLGTSVVNLLGCFLLTFTIYGLDLRFDLPEWQILGLGTGFVGAFTTFSTFTLQFVQGISNNPLGSLIFLLVNLIGGMLCVPLGYLAATRVGRRQR

SEQ ID NO: 3689 - protein, 118 aa, Lactobacillus buchneri
MTTMIWVGLGAGLGAACRYGITVLGKLVSPTIPYATILINVIGSFLAGWLTGSQLPGTWALFLLTGVCGGFTTFSTFSVDTFVLVRNRRYLLAGWYWCGTVVLGVLAVVSGLWLSMHS

SEQ ID NO: 3690 - protein, 293 aa, Lactobacillus buchneri
VNVFYNELYIKEVFSINKQILRNDLQIIVGALVYAIAINDFLIPHQIGEGGVTGLTTIGYYALNIPPAVTNFVLNGILMLVGFRFLDKKTIWYSLWAVAWISIFLKLPRLLNYHTSQTIIPAIAGGVLMGISMWIIFRGEGTIAGSTILAKIMNRYFGMKNGSAMLMFDLCVAIPSVLVIGFQNMILTVIELYISAVVLNGLLSRFGARKAVTILSNQTDEITSELSSQLHQGITLISAKGYYHQEIRPMIYVICTDKQVAQIVPLVSSVDPDAFVVVENVHSVKGEALEKIL

SEQ ID NO: 3691 - protein, 515 aa, Lactobacillus buchneri
MDAQVEKPKKHFKLKMPGAFVILFILTIVAVAATWMVPAGSYSKLSYTNSSLQVTDPHGKVTTVPSTQKELDKLGVKINIKQFTDGGITAPVSIPNTYQRLKQRPASIAAVPTSMVKGTIEAVDIMVFILVLGGLIGVVKASGAFESGLLALTKKTKGHEFLLIFFVAILMVLGGTLCGIEEEAVAFYPILVPIFIAMGYDSIVSVGAIFLASSIGTCFSTINPFSVVIASNAAGIDFTQGLPERVIGLVIAASFVVTYLHWYSKKVKADPKFSYSYDDRDEFNAMWEIAPTGEDAKSKFTMRKKLILILFVVTFPLMVWGVMSQGWWFPTMAASFLSFAIIIMFLTATGKNGLGETGVVDAFVKGASSLVGVSLIIGLARGINLVLNNGKISDTMLQYSSTLVAHMNGPMFIVVMLIIFFLLGFIVPSSSGLAVLSMPILAPLADTVHIPRYVVVTAYQFGQYAMLFLAPTGLVMATLQMLNMKYSHWLRFVWPVVVFVLVFGGALLVTEVLIN

SEQ ID NO: 3692 - protein, 138 aa, Lactobacillus buchneri
MGKYIISSKLRKVGAQVDTKTGIHQFIVDEPIAGHGTDAGPNPVQYLLSAVGSCLAITANDIARKHPEIQIKKFETKTTGETTQYQDGRSAVTKIVVQIHAETNLDEAGHKAFMHSVVKDCTVHETLKHAVPIELQFI

SEQ ID NO: 3693 - protein, 543 aa, Lactobacillus buchneri
MGKIRKVSLSIGIVMVAVFLAACGKQSSQNNAQNKSITLMQTSDLTSLDNTNQAMLPEFNTLTNISEGLYRLNSKDQPVPAMATKIVKPTDNGKKYVFHIRSNAKWSNGDPVKAEDFEYSWKRSLNPANNPVYTYVFSGIKNADAIINHKKSYKTLGIKATGDKTLEITLDHPMAYFNKLVAMPVFMPQDKSFVQKVGVKKYGTNAKNTISNGAFKITNWTGTNDAYRLVKNPYYWDKSAIKLDQINYKTVKDSNTAHNLFEDGKLDDATISGVTAKSLQKNKDLKRVPKAWTYYLQVNQRKGRPLANQKLRQAISLAINRKELTNKVLADGSLPASSFVSPGTAVDPTTGKDFSQETSFSVAPNIKQARSLLAAGKKEAGITGDLKLSIVGDGQDVTKNVAQYIQGQLDSKLPGVKVSIANLPDKAQQARRSEGKFDLAQWYWLADFGDPINYLGILTSNNTMNPGKFSDATYDSLIEKAKTAANQTDYWKYLRQAEKRLMNQNGIIPLYYVRESHLVNPKLSGVEYHVAGFPDYTRATITK

SEQ ID NO: 3694 - protein, 555 aa, Lactobacillus buchneri
MTKKWWQNDVIYQIYPQSFQDSNNDGIGDLHGIIKRLPYLKKLGVDVLWLNPIYQSPLKDNGYDIADYEKILPEYGTMADFDELLKEVHAHGLKLLMDLVVNHTSDQHRWFQESKQSKDNKYADYYMWHDPVDGHEPNNWHAAFGGSAWTYVPERGQYYLHLFAPGQPDLNWENPAVRESVWNIMRFWLDKGIDGFRMDVINLISKPEGLPDAPEPGTYPLTEGLVADGPKLNDYLHEMNQKVLSHYDVMTVGEMPSSKPEDAINYTGLDSHELNMVFQFQHVALEPNPDKRLGKWNDQPVKLPELKNALSRWQKALDGKGWNSLYWNNHDQPRAVSRFANDDPKYRVRAAKMLGTTLHMMQGTPFVFEGEELGMANVHYTSIDQYEDLESINAYHELVEEKNLVDGPTMLKYLANISRDNARTPMPWDDGKNAGFSDAKPWFALNPTYKEINAKAVVDDKDSVFYHYQKLIQLRHDSDLVKFGSYDEIDPDDAEVFAYRRHYQGKTLLVISNFTADTVTRDYGQGKADKLVISNYDNDQGTELRPYESKVYVFN

SEQ ID NO: 3695 - protein, 463 aa, Lactobacillus buchneri
MDAKVKAGNGDVKTEPKSFASHLPSLKVSTIFAMTFGFFGVNMAFSLQQSQMGRIFQTIGANPNNLGFFFILPPLAGMVIQPLIGKYSDRTWTRFGRRMPYLFIGAPVAAIVLVLLPNAGSFGFGYGSAAALWFAAIATLFMDLSSNVCMQPFKMIIGDMVNEDQKDMAWSWQQSFSNLGGVLASLVPFFLAFIGLSNVAQKGEVPITVKLAYYLAAAVLLLTSFYTIAKVHEYNPEEYALYHNIDLTKQKKQPSLWELTKKAPRVFWEISIVQFFTWFAILYSWTYAAGAISLNVWHTSNPSSAGYQAAGNWYGVLTCIQAVASVIFGLLVQARTKPEHRKAWYVFGLLAGALGFIMIFFIHIKWLLILPFCLIGITYITMNTQPFSLLTEALNGENEGAYLGLFNCSICLPQIAASLCSFFIFPMVGHSMPAMFLVGGVSLVIAAFSVGFIHSKLSKPVKL

SEQ ID NO: 3696 - protein, 328 aa, Lactobacillus buchneri
MAVTIKDIAKQAGVSTATVSRVLSDQTAFYSEKTAKKVKKTAKKLGYQKKSAAVELVTRRSKVIAVILSSTKSNFSDQIINGIQQEARRHDLNVIIVFAGENDSQMERKALETVIERSVMGILLVAVNLNPANEDLLLNANIPFLFLSITIKNRGLPFITSDDFQIGYQATKYLIDKDHSKIGFAAADLDSVTGQLRLDGYRHALADNGLPLNSGWVLGGDFAYEDGVNAMKQYGREPEVTAVIASSDLAAIGVMNQARDYGLKIPADLAVMSIDGTKLCGIVRPQLTSVTQEFLEMGVRGMQQIISPLAKAAKSSFTPFKIIPRQSV

SEQ ID NO: 3697 - protein, 384 aa, Lactobacillus buchneri
MTFLVARMIQSVGGGGIFVIASSHVLSTYPKKAQGGLLGALGAVNGIASVVGPNLGSLILNLTGRWNWLFLINLQIAIFVIVAGWLVIPETIGSHVKSLDLKGLTILSLGIFSIMLAITNLQSGHLLVSLLTPQVWGAGLVGIGLFVGFVLVEKRIAPRFDPFLPYHLLANKGFLLTLLMGLLSGMLIAIFVFIPSFVEQVYGISANNSGIWMSGIGLGSILGAGIGGTLVSRLGATKTVIVSGGLSAAGWFLATSTLAGFGFGMLMGAQLSVLMAQFADQADNGIAFGTLSVSRQVGLTIAPTIYATIIQSGFSRLSLSTPLEEYYRILLAKAAGSHSDKLATFYQIAQQAYQHLFVVAVVISLIILAGGWILIRRRGSKNIA

SEQ ID NO: 3698 - protein, 97 aa, Lactobacillus buchneri
MGTGKQHSKFAMGILILGVFMSALDNGIIASALSSINYSLHISEVQGTWGITLYTLGMAIATPIIGKLADKFGRRKLFLIEIAIFELGSLLVALSPT

SEQ ID NO: 3699 - protein, 445 aa, Lactobacillus buchneri
MAISDLFKIKEFKQQINELKITNDNLTSQNEGLQKSLKIKLSVQQMKPVELESLIDEKSGIIQSLTPQAEDLKNRVAQLQQEVENLQAEVGELEASKEMSSFGLYTPHYEFATSLGYKEALNAIRDQQKQAIKNRTAVSFDTMWTVNGKLSQGKKMTKNNIKAIFRSFNNECTDAINKVTYSNYERVAKRIEKSFLQHNKMYEVVNVQMQPSYLKLKYEELNLAFEYAQKKQEEKDLLREQREKEREEKKLQQEIKQERKKVDKEIQHYSQAIQELENRMPLENTDEEGLRAEIQNLQQKLDGLREKKSGIDYRESNATAGYVYIISNIGSFGKDIVKIGVTRRLEPLDRINELSSASVPFKFDVHALIFSENAYALESKLHNQFANNRVNKVNNRKEYFKIPIEEIEKELKQYQDVTVDFHENPDAEEYRETLSLGDSSVTQPV

SEQ ID NO: 3700 - protein, 364 aa, Lactobacillus buchneri
MKIATAVAQQQGTKLTVESAELDEPKANEVLVEIKASGICHTDAAGRDFATTPYPVALGHEGAGIVKEVGSSVTTVKPGDHVVLSFSYCGHCENCLTGHPANCIHLNELNFGGHNFDGTHRIHSEDGKNISTFFGQSSFSTYSVVDEHGVTKVPSDVDINLLGPLGCGFQTGAGTVLNYLKPEFGSSIAIFGTGAVGLSAMMAAKIIGMDHIIAIDIHDNRLELAKKLGATETINSQKHNPEEVIKTLLQAGIEYSIDTTGVPAVIKQAVHVLKPSGTCALLGMAGDVTFNIQEEVMGESKRVVGVIEGDAIPQLFIPKLVNYYKKGLFPFDRLVKYYKFADINQAFEDSADGSVIKPIVKISN

SEQ ID NO: 3701 - protein, 81 aa, Lactobacillus buchneri
MLKLKKATLTVVAAFTMGGGLMSIPPQEVSARTTYVWIAPNHGKRYHYSKTCRGLSNAGYKRHVTKHWARSHGYRLCGWER

SEQ ID NO: 3702 - protein, 195 aa, Lactobacillus buchneri
MATVAELFKQIQDDPQNQSFTEQGIQPLFHVDPQAEILIISQAPSRKAQASMVFWDDPSGDRLRDWMGLSKTEFYHSGKIAVMPLDFYYPGKGAHGDLPPRKGFAEKWHQPLLAEMPNIKLKLLIGQYAQKYYLGNRRQRNLTETVCHFEDYLPDYFPLVHPSPLNYGWMKQHPWFLTDVVPDLQERIGKIIQDN

SEQ ID NO: 3703 - protein, 144 aa, Lactobacillus buchneri
MGQKTIYFLCTGNSCRSQMAEGFGKQYLGDHYRVLSAGMEKHGVNPLAVQVMAEVGVDISGQTSKLIDPTILNHADLVVTLCSDAEKRCPITPPQVARQHWPFPDPAVATGSSSERLQAFREVRDGIKARIIAFDNLEAGQKNH

SEQ ID NO: 3704 - protein, 466 aa, Lactobacillus buchneri
MLAAEKIEVNKDGTRRGLSNLAVQMIAFGGSIGTGLFLGAGSTIHRTGPSIILVYLVIGIFFFLMMRAIGEMMYSDPEQHTFVSFIGKYVNERLGKFAAWSYWLELILAGMAELTAISTYVKYWFPDVPAPLIQVAFLVILSGVNLAMVSSFGRSETFLSGIKVIAILALIVIGVYLVFTHHQNPAGTHASWGNLTDGFTMFPNGIHQFIMAFPMVFFAFQGMEFVGITTAETKNPRRVLPKAVNQIIARILLFYIGSLIIIMAITPWKTLNPNQSPFVQIFNLAGIPGASAVINLVVIAAAMSTLNSAIFSTGRHLYQLAQESHSKEMKPFQKVSKSGIPIVSVLFSAGMMLLAPVISSFNSLGAAFSFIASVSSDIYILVCMLTMVAHWKYRHSKDFRPDGFKMPKYRWSNPLTIAFFIAIFASLFFSHDSLLPAVGAVIWALVFYAVLRRRNTENLGVEDSSD

SEQ ID NO: 3705 - protein, 309 aa, Lactobacillus buchneri
VKNVYFDHDGNVDDLVSLLLLLQMPEVNLIGVGVIDADGYIEGSVPASRKIITRFGNGAQVSVAASNSRAVHQFPKEWRLSSFSFDAFPLLNEHGGPTTPLAEKPAHLDMIDKLKQADGKTDLVMTGPLTDLARALEVDPTIVDNIQRLYWMGGTMRTEGNVLEPKHDGTAEWNAYWDPEAVKTVFDADIDIQMVGLESTNQVPLKADVQQHWASLRRYPMMDLIGQGYALVSSYEANSTYYLWDVLTTVASQYPDLIQSKDIHGDVLTTGAGAGRTFETDNGRLINLVTEVDGQAFYDKFDELLTQGH

SEQ ID NO: 3706 - protein, 319 aa, Lactobacillus buchneri
MSTLKMKDIKVIANIGAGTMGHATALQFAMNGYPVNLLDMNQAALKHGMELIEHDLATFEENGLIKGNQKADILARIVPTTDYSDALADADFVIESVVEKLAVKKTVWQKVEHYVSEDASMATNTSGLSPTAIQADLKRPENLVVTHFWNPAQLMPLVEVVPGEQTSEATVKTATALMNHIGKHAVALKKESLGFVGNRIQMAVLREAFKIVDDGIASPEAVDDIIKYSLGRRWSLVGPIASADLGGLDIFENISSYLYDDLANNTGTDPVLKKLVDAGNLGLKSGQGFYNWEGDMGKEAIAHRDQALLQLLVEDQKKR

SEQ ID NO: 3707 - protein, 40 aa, Lactobacillus buchneri
MKKTLKKMLERVFAKKVQDAGNLQTSESNRLFWNSVTKGQ

SEQ ID NO: 3708 - protein, 176 aa, Lactobacillus buchneri
MYSFINQIRNYIWLKSIAYIVFGLLFLFDPHDTLNIAINLIAAFFIVFGVINLISAWRQRRNNEVVDYSLAVGITQLIVAVIVFLLAEPLLSFLPFILGIVLIVTGISNVFTALNHRQYVNVSPMPFVLYGVLLILVGILLAFNPFGTILVLLQIFGATMVVMAIMEIITSWKLGI

SEQ ID NO: 3709 - protein, 249 aa, Lactobacillus buchneri
MQYPNVHLAKFIDRPNRFISHCRLIETGEVVTVHVKNTGRTTILQPGVTTALVHNDNPNRKTAYDLVAAKKYDRQWINIDSQAPNKVVKSGLISNYIQLPGIESIATVNPETTYLDSRLDFSGTGDLGQRFFLEVKGVTLANQGIAAFPDAPTTRGLKHVLTLERAAQAGYFAYLLFVIQMKNIHKMTIDRDIFNDLALAIAKAQNNGVHVLAYDCQVEPGSLTLDQPILFDLDQPFVSDGLPSSIGHI

SEQ ID NO: 3710 - protein, 215 aa, Lactobacillus buchneri
MFPENSLKGFAYAIDHGIDGLEFDVHLTKDNVPVIMHDEKIDRTTDGTGEIRSYTLKQLREFHLSDGETVPMLKELLTLANGQPVHLNLEFKTNEIHYDNIEQIVLDMVKQYDLVYPVIYSSFNLDSLKIAYKLDPTQQYCYLSEEDIKNPRELMAKEHLVGLHLSHYVPMRHVKERIWTVDDPKVQKHLFGLNVAGIFTNNFEGAEKIKANVTA

SEQ ID NO: 3711 - protein, 643 aa, Lactobacillus buchneri
MSKWIRRFLVGFVALFSLALFNSAAASTVDAFGTIFENMIMANRMKPTALKANSTASFDIVMKPQDSTAYYQKALDVNDPTKADFKDYLSTSDIRQQFGQPDAVINGWVALFKKNHLTTHVYQDGLVLNVQGKTKDVNRLFKTNLSDATYHSDPLQFGKSKPSIPANLQDSVLAVMGMADHNKKFWFPDSDVTFKSTPKATKALADKNAGYTSHFTKTYGVDQLYDQGLTGKGQTIGLVSFGNVQTGDLTHFWRHEHVNASKSRFQMVKVLGDNYRKDIKSTSDGEATMDAEYAGSVAPEANIKMFNSGSVIPTLINLINTYLTAYDDGSVDQISSSWGMGPNNYFQILEKMNLLPSQYVEVLNLVLAQSALQGISNFVASGDSGALNYTVVGIHGNDVLLDRKISDADPYTTSTWITSAGGTSLPFKQSVAPNGKSIGTISNQKQRAWGSDYWWPFLQVNDDYLLTMPEFFNDISDGGGGGFSHVYQTPAYQEGVPGVNTFNAREYLSQLSGPVYNAPLVSGTDDGRNYPDISANADATTGYFTYQKTSTSNGWEISGGTSIVSPQFAGVAALINSQTDHARMGFWNPQLYQLATKSDSPLQPLNDTENNSNLYYTGQPNTVYNQASGLGTVDFAKLMDVYK

SEQ ID NO: 3712 - protein, 69 aa, Lactobacillus buchneri
LIKITLNVVMAERNISTGELAKKVGITPTNVSILKTGKAKAIRFSTLEKLCKALDCQPGDILKYSPDEE

SEQ ID NO: 3713 - protein, 192 aa, Lactobacillus buchneri
MSKLLDRSIGAVSVLMQIAFVVVCFSFITPFVYLYNGFTHANIMKMIADNGDFLIVPGHTQVAHSAVAHFPILPYSILMAIGIFLAILSALFALSAFIRISHNLGKKQYFVADNLAMLRRIVHSQIMAICSDVFLAIGNQMTQSFLGRVNNGIFNSTWENLLDDAVMLVFVALIYTLFRMAMNIKQENDLTV

SEQ ID NO: 3714 - protein, 362 aa, Lactobacillus buchneri
LSITLRNVRKDYDAQTEVLKDISVKVETGEFFVIVGPSGCGKSTLLRMIAGLTPITAGEVSINDKVVNDLPPKARKLTMVFQNYALFPFMNVRDNVAFGLKARKMDQADIKQRVDEALKMVNLTELANRKPRELSGGQRQRVALARAVASDAKICLMDEPLSNLDAQLRIKMRQEIYALQRKLGLTLIYVTHDQVEAMTMADHIMVLNDKHVQQIGTPSEIYQNPANDFVAKFFGTPQINILNAQRSQNDNHVLNVSSDLEIALDEEVPAENVKIGIRPDDMKAEAAESVEANATVKNTEFLGDETIIYATLNSGEDIHVVVPGQVNYRIFQPIKVSADSNLMFFDTEGKRMNLSKEAYVHA

SEQ ID NO: 3715 - protein, 320 aa, Lactobacillus buchneri
MLKSPAQSTPTSPVSVEKTKSKLAEQEAKFTLNAKDKYFAWAFLGPSLLILGVFIFYPMVKTLYLSLFLTNTVGKPTVFVGISNYINLLTSADYLSSLGVTLFYVFAVTIITIALGLVLANLASKRLPGIGLFRTLFSATMGVSVSVAAIFWLFIFNPSTGFLSLISTWMHLPQIPWLTDPTAAMWAVIITTVWMNLGFTFLILLGAMSSVPTTLYEAANIEGASSRFQFFHITIPSISPTLFFVSIITLIESFKSFGLIDLMTKGGPTNATNMLVYRIYKDAFYSGNYAQASAESIILTIIIALFTLLQFKVLEKRVNY

SEQ ID NO: 3716 - protein, 276 aa, Lactobacillus buchneri
MDLVTKPKLSRRIWDYALLTILAVIVLAPFLIGLWTSFLPTMQIAQGNFLSTKVSFQNYIDAFTQTPILRYLGNSLVISTATMIAQLIFCSMSAYAFVFLKFKGRKFLFGLFLATMMLPFEAEIIPNFQTVKAMGLLNSYSVMVIPFLTSAFGVFMLRQSFMQMPIELKEAADIEGLGHFQFYWKMVLPYNRIPLMTLGAYSFLGAWNQYLWPMLTTFSNDFRPVQNGLRQLQSEETFNDWGMIQATAAIVVIPTLIVLFIGQHYFKSGVNEGAVK

SEQ ID NO: 3717 - protein, 453 aa, Lactobacillus buchneri
MKRVTAFLKTYALPIFAIFAIVLGIAFVNGSKNASSAKAGRIPVVFWHEMGGPAEQALDKMVDDFNKSQDKYEVIPQYQGAYDEAVQKIIQSHGTSASPALFQSFDISTAQMMHSKYTTPVQKFIDEDNYDASDISPVARSFYSNKGTQLAMPFNTSQPVLYYNASLFKKYGVTPPSKSPSYSDVTRAAKELYAKSHHKVKGMTMEIYGWLMEEALANAHTSLINNGDGHTGNPTKIDLNNPTTKKFLTWIRTNIKSGDFVNYGSGASAETNEIAAFLANKLGIFVQSSAYIGQLTTGTKNKLGISYFPHPDGVKANGVGIGGAALWISNDKPAKTQRGAWEFIKFAETAKNQANWQKATGYLALNKNSQKTKTLQDLYKKIPAARVPGEQLASAKPNNTNSGILMEGMQLTRELEETAMEGVYNGQNINSALNTANKAMNANLKTTNKADGR

SEQ ID NO: 3718 - protein, 231 aa, Lactobacillus buchneri
LSTKTLIFGHRGYPFKFPENSLKGFQYAIDHGIDGLEFDVHLTKDNVPVIMHDEKINRTTDGKGLINSYTLKELQQFHMPDGETIPTLKNLLALAVHRPVHLNLEFKTNKIHYPKIEQIVLDLVKQYDLMYPVIYSSFNLDSLKIAYQIDPNQQYCLLSDHVIKNPKSLIVKEHLAGLHLSHYQPLANVDERIWTVDDPRTQEKLLADHVAGIITDNFEQAVRIKNRAVAI

SEQ ID NO: 3719 - protein, 548 aa, Lactobacillus buchneri
VKINQHLLTITGALALILVLAGCGNQSAKKSSNQMAKDQTVNISTDSEISTLDTAKASDSGSLTPLYQIGEGIYRLGPKSKVENALATSTKVSKDGLKYTFKLRTNDKWNNGQPVVAHDFVYGWRRVVNPKTASGYSYLFEGVKNYSAIQKNKLSPNKLGVSAPNKSTLVVHLSHPVPYFKLLLAFPTFFPQQESAVKKFGSSYGTSSTTTAYNGPFELADWNGTSDTWTMKRNPNYWDKQAVKLDKLKFQVVKTPSTGLSLYQQNKLDVVTLSGEEVPSYKNRPEFKKFVGGSTIYLEMNQKRVKALKNVKIRQALSQIINKQSLATQVLRDGSTAPKGFVSTNFFQNPKTGADFASDAYEKSGVAYNQSQAKKLWAAGLKQTGVKKLHLSLLSDDTDQSKKTTQYLQSQFNKLPGLSITIHNVPTKSKLSRSTSGDFDLVVSSWGADFADPINFLDLMTKNNPTNNGHWANSQYDRYIEASKTTDANNRTKRYADLVNAEKVLMKDQGVIPLYQPATTQLWRTNIHGFVWNPAGMSNGYKGLYVTK

SEQ ID NO: 3720 - protein, 287 aa, Lactobacillus buchneri
MEVRILTNNAIPEITLNDGYKMATIQFGTFQIRGGEGLQQTLAAIQDGYRGLDTATNYDNEGMVGEAIRRSGIPRSEFFVTSKLPGKYHQYDEATKAIQESLYRLGLDYLDLYLIHWPLPKRNHYVEAFQAMIDAKKRGLIRSIGVSNFEPEHLDRLINETGVTPAVNQIEVHPYWNNERMLKEDQQRGIVTEAWSPLGRGSAALKEPLIQELAKKYDKNTGQIILKWHTQRGIIPVPRSSSLIHQRANKDLFDFQLTEDEMKKINALTKPDGRVDGQDPNVYEEFD

SEQ ID NO: 3721 - protein, 101 aa, Lactobacillus buchneri
LNDSKEYLDFFNQTYNDPNKHSGYSTNSNLRFESRADALQVKNMLIEKSPHAKFYDFSVEYINPNKSMQVGWYITIKKVDQQPTKPHPKTQPKNNDQQTKK

SEQ ID NO: 3722 - protein, 324 aa, Lactobacillus buchneri
LVKNGLLLVNLGSPVSPSNADVKAYLKEFLSDQNVVTLPKWFWQPILRGMILPMRTWRSATFYQHMWTKAGSPLTAYTEIMKQKVQQDLPDWDVQYAMNYGQPRIVDVLHEMKDRGDRDIVVLPLFPDYTQSTHDTIIEKVQSSGVATHIIKNFYDEPVYQQILARQIDEAYPKKQYDAVIFSYHGIPMSMVKKGDPYEGECLATTQGVMKYVKQVPSDKVKTVFQSKFGPMPWLKPYLKNYLMELAAMGKRNVLLVTPSFVEDCLETIEENNVQNYQTFKASGGNVFDSVKPMNGSDDFCQFLADLSVKQLRGGGADEPRANA

SEQ ID NO: 3723 - protein, 442 aa, Lactobacillus buchneri
MSQEQTHKSLDEINQSVEVPSVYETSFVQKFLAYSGPGALVAVGYMDPGNWLTSLSGGSQYRYSLLSVLLMSILVAMFMQTLSIKLGVVARLDLAQAIAQKVPKAGRYTLWIINELAMMATDMTGVVGTAIALKLLFGLPLLYGILFTIFDVLLVLLFLRFGIRRIEFIVLTAILIVGVIFGVEVSRATPNLAQIAGGLLPTPKILTNHEMLIMSLGIVGATIMPHNVYLHSSLAQSRRYDYHNPAQVNEALRFAKWDSNVHLVAAFLINALLLVLGGTLFFHTNGHLSAFQDVYNGLKNSAIVGNLASPLMSTLFAFALLITGMISSITSTLSGQIVMEGYLHIRLPLWERRLLTRFVTLIPILAIGFLVGFNDHDFEQIIVYAQIALSIALPFTLFPMVALTSNHDLMGIHTNQRYVTMIGYLLTTIITVLNLQFVIAAF

SEQ ID NO: 3724 - protein, 253 aa, Lactobacillus buchneri
LKILGILGSHRNDGATDMMLETVLSAVKAPNTTDMIYLEDYPFKPDQGDHKDPVLDELEAKMLESDVWVIAAPTYWGGLAGKMKDFFDCMRQRLVRFDHEGGTHPDRFKNKHYLSITDCYTGTFENWVTGVTDQSFRTIDKVMSAAGVIKIHELVLTNTWGMKALPENKKQACLKWGARLNTEQKRDDSTLKRYIELFFMVAVMALLTMGIQVGLRLVSTADFWWRYASFVVIFYVLLGCILHFFTVVKHRRR

SEQ ID NO: 3725 - protein, 459 aa, Lactobacillus buchneri
MNSGEKQSLIKAVNEASPEGLRQFIINQAQFDPTFFRDVTAQFGDLDTDAELVQTKKLIQSTVRKNKSYGFIDYQGCIVVCNVLDDVINKYMLRFRQGHYHHAMNGLLLVVETAAKMLSDADSSSGALTDTFDRVFGSMKNLSTNIAPEILESQKEIVIKDVVRVFKRKIFAGWPEQRYQVLYNALPLITPKSAKLAQSASRAVIKAADEGFETTQSEIYDKVLHARILIQLGEQSDAEKFMDEHKTIPQIREVEIQNAIQNKNYVRAEELCLEASKQDQGWRRIWEQYLIKIYDATDQQQKQEAVLENRLFANYPDAYEPLKKLRQQDKSWDAQYPTFLAKAAKKLTPENYAFILDKEREFDKLMQLVMQHPELTETYSKDLYSNYPDVVNKLYYQNVVLNEKHPGRQAYRRMGRRIKNYTAFGSVQTAIKWIDGLIDEYPSRPALAEELNKVKKKLQ

SEQ ID NO: 3726 - protein, 599 aa, Lactobacillus buchneri
MKNVKKWLVIGTISLSTLAFAACSNNKSSESQSKPISMPTTYSATGKATKTGNDSTLNAAEVVDAPFTGITLAVLQDNVEDSDVYSPGGGDQLFKSNKDFKIVKGGLANLKLDRSNNTATITIRKNAKWSNGSPVIAKDVEYAYEIIGNQNTGAEQYSSDMATIKGMAAYHTGKAKQISGITYPDGQNGKQVVIHYTHLSPAMQYAGNSFLWGTVVPYQHIKNVKISKLSSSPAVRKHPIFVGPYKLQNQVQGESTAWVPNKYYWGPQPKIKHVNIQVVSSSNAAAAFKAKKFDFALGGLPASQYKSVKNIKGYTLAGAPGLSYGYFGFNVGHFDTKTNKNVMDKHSKMGNKNLRKAMLYAVDLDKVNKKLLSGVQWRPNTLIPPIFKKYHDNKAAGFPYDMAKAKKLLKDAGYKKKGKWYVQPNGKKLTIHFGAMQGSAASNEISRYEVQQWRKLGLNVQMTNGRPLEINSFYSILGKPKQKQIDVFVGGWQLTYEPTPTQFYGEDATYNMGHFVTKKNTKLLNSLNSNKAWNQKYRIKQFKKWQVYMNKEAAYAPQSTLLSFTPVNHRLKNFKQAAYNNYLFPTFWDQLELTSKTPK

SEQ ID NO: 3727 - protein, 178 aa, Lactobacillus buchneri
MITQNKPNWVNNPRKWIWMLVGFIIIEKFLENGILVPVLLKLPFGDLTSNILYKGIEVLLVLGLNIWLIKQKLYFSVNVTLKTTLFFLFGIVYISLFISSGPVKLLPPIILWTLLTAISEELLFRGSDFWGFIQTPHSASSDEVERCNCNWFIKPAVQFATFEQFGKSVIDGYSLSDG

SEQ ID NO: 3728 - protein, 96 aa, Lactobacillus buchneri
MVETFGMGILLAAIYVRTGSLITTIFAHFLIDFPILYLSQISTGFASTANMSGNVSVVGSIIVAIVYALVGIVVIRSKIADNKLPAITHTIENLPN

SEQ ID NO: 3729 - protein, 142 aa, Lactobacillus buchneri
LKTATVKTYSITEVSKMYHLPTTTLRYYEDLGLLYDIPRIKGRRAYTQEHLNRLGAICCFKDTGMTLKELQELFAAQDDDADLDKTCEILDNHYQRVLEQLALLKKNERHIKRKVRFYHDIRTAKENHSKMPDWDDYRDRDF

SEQ ID NO: 3730 - protein, 334 aa, Lactobacillus buchneri
MYQASKDRYDKMVYNRVGKSGLKIPALSLGLWHNFGSVDSFENQKAIIHQAFDLGITYFDLANNYGPEPGSAEENFGRIMAEDMKPYRDEMIIASKAGYYMWPGPYGEWGSRKNIIASANQSLKRMGLDYVDIFYSHRFDPDTPLEETALALDELVHEGKALYIGISNYDGKQTAEITKIFNDLNTPFVIHQPRYNMFDRHIENDLFPVLKKEHKAAVSFSSLAQGLLTDKYLNGIPADSRAHKSTSPFLHEEQVEETIKTVKKLNQVAADRGQTLAEMALAWNLREPEIASVLIGASRPEQLLDNVKALDNLEFSSEELKKIDDILATQKPIK

SEQ ID NO: 3731 - protein, 131 aa, Lactobacillus buchneri
MNEKEKAQNAKRANIMWIMLSLMVLIVIAGIVGIIMKSHQTNQYKDMIRQSIVAYNKTDPETTLSPTSKTKVYRVRKSGDGQFFVQLNGTSPKFVYQKTKGKWSSVGTQKKANIVLKYRAVYTSSQPSMGS

SEQ ID NO: 3732 - protein, 244 aa, Lactobacillus buchneri
MNILLLIIVGFIIGTVVITLGGGGAAFYLGILTTVFGLGPASAAATSLVTSFPSLLIGSYSYFRLHKIKLRIAWRMIIFAVPAVVVGSLISPYIPVKIYSYIIGGILAILGLQTLFSRQKDHQNPNKWLAPVYGVISGLMVGVGGLSGGGPVVAGLLVMGSDMVTAAATSSLVLVVMTATGLIFHLSAGNVDWSVGLGLMFGAILGSFLAPVLLGRLDPQKFTRYVKPILGVLLVVMGVFTALK

SEQ ID NO: 3733 - protein, 243 aa, Lactobacillus buchneri
MSKYTTGELARLGGVSIRTIQYYDQKGILNPTTISDGGRRLYTDKELKTLRLILLLKSMGLSLTTIKDLLSEDNSTQVLSLMLKEQEKKIQHEMTMTADQLEMIRKVQDSLADYALISQPDLDGIENMMESKPKLTKFRWWMLTWGLMMDALEILAIAVWIITGNWVPAAIIFPVVIVMAIWIIREYYNKVEYICPNCHQHFKPSWRDFTFSKHTAKTRKLTCPNCGYRGFCVEVYDVKQTSR

SEQ ID NO: 3734 - protein, 285 aa, Lactobacillus buchneri
MDDQWLSQLPIKGITKAVPVGGGDVNQAFRLETKDDTYFLLVQPQTTADFYAGEIAGLKAFEEANVLAPRVLGNGQINGDAYLLLNFLESGSGSQSDLGELVANLHQHYSKNGKFGFDLPYVSNDESFDNSWTDSWSELFVNHRLDRLRDALMKKHLWNPSDDEKYKRVREVILDQLSKHESEPSLLHGDLWGGNYMFLADGRPALIDPASFYGDREFDLGITTVFGGFDADFYAAYNAVYPLDPGANERLNFYRLYYLMVHTNKFGTMYKSSADSAMNQILEHE

SEQ ID NO: 3735 - protein, 407 aa, Lactobacillus buchneri
  misc_feature (5)..(5): Xaa can be any naturally occurring amino acid
NADHXIDASEMNYLQVAKPLVLPNGQQVKNRFFKSAMSETMANQDHQPDDRYATLYRAWAMGGSGIVVTGNVMVDSTALAEPGNVVVEDERSLATLQKWAQAGTTNHTQLWMQLNHPGKQSPKFLSAQPAGPSAIPVHGPNQKYFNPPRELRNSEVHEIIAKYIRTAEIAQEAGFSGVQIHGAYGYLVNQFLSRKGNQRTDEFGGSLENRMRFLADIYKGIRESCGPQFSIGLKLSVLDLDLEGFTEHDSIAVIQKMATLGIDLIEISGDDYEDSAVGFSGYAHMIHQLTDVPIVLSGGFRRISTMEEALGTHDADMIGMCTPMAVMPDLPNQILAGSYQPVPLPLTMGSRKLDEKYSPTFITAYCEQQARRLAEGKRPQLYTSAWRALAASIQMHGPNGLTPRRAQ

SEQ ID NO: 3736 - protein, 460 aa, Lactobacillus buchneri
MSQPFEPNSLDELKDQYDVVVIGSGSAGLTSAIRATELGLKPVIFEKMPNVGGDTKRASSGMNAAATFVQTEHGIEDSVGAFYYETLRGGHGQNDPALLKYFTEHGARAIEWLYKQGVQLDDLTITGGMSVPRAHRPSSTQPIGGYLINGLLSQVQAKRIPLFTNAKVIEILHNDRVSGVQISTPDGPQTVHAKAVIIAAGGFGANKSLIAKYRPDLTKYKTTNQPGNTGDGMLLAEHLGAQLVDMDRIQIHPTVQQDTDHVYLIGETVRGEGAILVDQNGKRFVNEMETRDKVTNAIEKLGGTGAYLIFDAKVRKRAKAIDFYDHVGLVKTGDDLAKLGKLIGVDGEILSQTVAKWNEAVSDRMDINFGRTTGRHILETPPYYAIHIAPAIHYTMGGLKTNDQTQVLKADGQPIPGLYAAGEVVGGLHGDNRIGGNSIAETVVFGLQAAQQVRDYIFEM

SEQ ID NO: 3737 - protein, 73 aa, Lactobacillus buchneri
MSQGKRESGYSKWFRMLNHLIGPVITIGIISGIIIIISDNAYAYVVDVIVSVFTFIWLSTFIVESVIKIFGKK

SEQ ID NO: 3738 - protein, 302 aa, Lactobacillus buchneri
LNNSVKIGKSEVVSGPLGLGTNKVGGHNLFDGLKDSDGEAVIKAALNDGITLLDTAFMYGLGKSEDIIGNVIQDFDRSKFVIASKAAQDPNNDLKPNNDPKFLTKSIDESLERLQTDYIDIFYIHFPDDKTPKAEAVDALAQAKKAGKIRAIGISNFNLDQIKEANQDNQVDVVENNYSLVHRDAESEIFPYLKAHQISFVPYFPLASGLLTGKYSRNDADKFSRFSPSKFNQIMDSLDQIKTIAENHQATIAQTILAWYIANPDISVVIPGARLPEQVDSNAKALDVQLSSAEFDEINGLF

SEQ ID NO: 3739 - protein, 159 aa, Lactobacillus buchneri
MADKYDFPKTRAQLNQLVADLSQLQTNIQQTHWYMRGENFFRLHPLMDDYNDQLADQLDNVAERLIAINGSPFATTHEFIDNTGLPDEKVTWDQLTMRDFMQRLVDQFRYLRDQYQKGIEVTDEEKDFPTQDMLNGFKEDIDKNIWMINAYLGKGPYDE

SEQ ID NO: 3740 - protein, 446 aa, Lactobacillus buchneri
MQRYSQKRVTSNIIKGSLGNMIEWFDWYIYASFAIYFAGSFFPDGDQTVELLSAAAIFAVGFLMRPFGSFIMGKYADKKGRRATLTLSVSIMATGSLLIAIIPTYSSIGVFAPLLLVCIRLVQGLSLGGEYGISATYLSEMATSGRRGYYASFQYVTLISGQLIALIVQIILQSMLSDAQLRAFGWRIPFAVGAVGAVIVLYLRLSMDETNQFKQTEKTKATRGSLRELAKYPNQVLTVVELTFGGTIAFYTYTTYMQKYMINSLGLAPKLVTMINFVALLIFMAAQPLFGHLSDKIGRKPLLYWFGIGGTILTVPIFLGLKSFDSPVASFLLMLGGLLIVSGYTSINAIVKAELFPTEIRALGVGFPYGLTVAIFGGSVEYIALWLKHIGHEDWFFYYVSAAAFISFLVYVRMLETSKHSKLEESPETTEPDQPQAPTVSGPKDH

SEQ ID NO: 3741 - protein, 226 aa, Lactobacillus buchneri
MKYSTLLFDVDDTLLNFQAAEHDALKKLFQTIGQPLTTEVYADYHQFNEQLWQQYELGEISRQTLLDTRFRRFFDHYGQVVDGKAYEQRYRSFLAEGHSPMPQAKQLLADLSASHDIYVVTNGIAKTQHRRLNESGLAPYFTNVFASETVGVQKPNPGFFDYVAHNIQGFSKDQSLVIGDSLTSDIKGANLYGLDSVWFNPTHQPNTIRLKPTYEIDHLLRLEAIV

SEQ ID NO: 3742 - protein, 236 aa, Lactobacillus buchneri
MANHITLYQHGTLALLVPGLLKGTITMGELLKHGDTGIGTGEGLDGELIILDGKPYHVHATGDVTLAPKSFTMPFANAHFARYTPLAELENVDQADLNKQLVSLSRAANTFFSIKITGTFANIQTRAAVKSQPPYNTLAETAENQSVFTRDQINGTLIGYYAPQLFEGAAVGGFHHHFISDDRKFGGHVLNFHLVKGDVSYQLFDTFEQHLPVSDKDYMQHDFSKDDIAGSIQKSE

SEQ ID NO: 3743 - protein, 461 aa, Lactobacillus buchneri
MEKAVATEKKISSGFIYFFGSFGGILFGYDIGVMTGALPFLQTDWGLQNNATITGWITSAVMLGAIFGGAIAGQLSDKMGRRKMILLSALIFMAGSLLSAISPHDGQFYLIAVRVFLGLAVGASSALVPAYMSEMAPAKMRGRLTGINQTMIVSGMLLSYVMDFVLKDLPENWAWRSMLGLAALPALILFFGVLKLPESPRFLVKNGRPDDARRVLSYIRENDTEIDDELEQIQDTASQEKKISKSTSWATVFSSKYRYLAIAGIGVAAFQQFQGANAIFYYIPLIVEKATGTAANSALMWPIIQGIILVIGSLVFLGIADKFKRRTLLILGGTVMGLSFLLPTAIKFLVPNASPLLIVFFLSIYVAAYSFTWAPLTWVLIGEVFPLAIRGRASGAASSANWVGSFAVGLLFPIMTASMPQDAVFAIFGVICLLGVWFIHSRVPETKGRSLEDIEEENINK

SEQ ID NO: 3744 - protein, 228 aa, Lactobacillus buchneri
MTKALMVVTNNPKFKKIQRATGIWLKEATHFNKVMADNGIDVDYVSPKGGYVPLDPLSLGTDDMDATDWEYYLDDTFRNQHLAQSLTPADVNPKDYQVIYFVGGHGTMTDFPQNTELAGLAETIYANGGIISANCVGVCGLLPMRTEDGKRFVHGRKLTAFTNDEEALNGLTNDVEFLLEDELDKAGANFVKGTAFEPNVVVDDRLITGQNPNSATGVGEAIIKELLQ

SEQ ID NO: 3745 - protein, 303 aa, Lactobacillus buchneri
MADSILNVEHLNKNFGRKQVLKDVSFSVQTGHIVGLVGPNGAGKSTIMKAVLGLFNYSSGKITIDGDPVSPTSHRAMDKVGALIEYPGIYPFLTGYQHLQLFSKESTSKDQIMDIVDKMKMDSYINRKAKTYSLGMKQKLGIALALVDRPKLVILDEPMNGLDPQANKDLRTIILDLAKQGTTFLISSHILSELEKLVDDLVVIDKGQIVYTESMANLENGGKKLLVLKTSDDAHAKTILSQNGYQLDDGDKLSIVETDSTKMADVIKLLSDNDIDIEDVQHVHSDLETSLLNLLKNDKVKES

SEQ ID NO: 3746 - protein, 258 aa, Lactobacillus buchneri
MITLVKQEIFKLLHKKSTYAVSATLLILMTVFGVLTRNYPKYWGDPKGLFVEMFTGINWIVLFMIAACSSIIAMEFQYGTIKELLYRKYYRGQILVSKWITMLLYSIYFYALSFVWSMLLKVVLFNDKFKLSDTYQSGHSVIEAQWLGIIGSFLTIWLVLSLVLLLANVFKSTAAAISIGIIGYFALSMVSGVMFLLMHKWEWLKWNPLNMMNLPQQLLSSSVHKMTLLSTPEMVVGSLVYTAIFMAISYVVFKRRSV

SEQ ID NO: 3747 - protein, 381 aa, Lactobacillus buchneri
MVHKSWLLLPLTVLLMGCSAHKTTTAQTTSSTASEQDGKYNGVTLDVARRHYQVGTLQKFIQLVGDHNGRFIQLHLSDDRNFAIENDYVGQSLKNAQKVDGVWHNKKTHQFFYSKAEIKYLVNDAEQHHVTLIPEIDTPAHVTALVKLMKANGKAQLAKQVSWYSKSYRDEIHLNQTGIDFTKKLDDEVGALFAGQANPRFHLGGDEFSDKLTSNAAYVKYLNATSANVEKMGFTPEAWNDGFLNSSLSKLNKNIQVTYWNWTADQTGKLAAERHKYWASMPKLISRGFKVFNYNDYYLYFNLSKTNMSKKNVAYMIKDMKQYWKPTLWHNDVDTKLKSKRGIVGSSVSLWADSAGSVNDQQVYAASEQFIKTFLALAESR

SEQ ID NO: 3748 - protein, 404 aa, Lactobacillus buchneri
MSTLSDFVILYPVIVSTIWIVGSIFFSIQERRVPLNNDHQGQPADLVSILIPAHNEQDTLAQVVESVSKITYQRIELILMNDGSQDNTLAVMTQLQERYGHQFPVKIVDIKVNKGKANALNEGAKVAQGEFLLCLDADCYVDQNVLEPMLARFYDDPKVGAVAGKPIVRNRTSILGRLQLLEYVGVIDIIKRGQAFVIGHITTVSGVVVAYRKQAIIDAGWWNIDAITEDIDITWRLYHHGWQVRYCPESVAWILVPERIIDLIHQRRRWARGGFEVLFRNRGMFITGRLSEQWLLMDMVLSDLWAISCSFVTLFYLFTIMFTGDIIMDGVILFLLLLISLIQFLIGYADSRESDFIKWQDLSLLPLYVIFYWFINLVSCLTALGSFFLDPSHVGSWRSPDRGL

SEQ ID NO: 3749 - protein, 103 aa, Lactobacillus buchneri
MKKKTNNLIIRKRSSILKLLERFIFLVALWAMTVYVIYVNVCFLLNAYSDTLVSDYLFLNLSYFAYARFAILVVVMVILMTIFGWLRIKKLERRAKNHEQNKS

SEQ ID NO: 3750 - protein, 296 aa, Lactobacillus buchneri
MSKTSRKWILSGFILVFLVLLAVSVRHNIAYQLGNRPDFAISKRDQRIKNGIMVFSYHRILAPNDIVRFDEKVSPNTQFHDFNVNLPSFKKQMYYLKSHHIKVISIKQMIAMAHSKRPIRGKYVVITFDDVDRTSIDNAFPILEKLHYPFTQSIITGNTGWYKQGTKLATWPAIQRLQKQAGSLVTFGVHTNRMHYLVDHGIPVFNIPANYTRFKRDYAVSQDVLKEKVGYKSPIFTYPYGSGDSQIQKFLANRPGLKVILTLNDGLVTNHSNLKLTPRIIVNNYSWPSITKWINN

SEQ ID NO: 3751 - protein, 150 aa, Lactobacillus buchneri
MTFYTYDYLQGSQSSWQYARIIILSVLAVIFIGFLVHYLRNRMDSKYKDLTIIVGTLLLLILAIQYDDFSAIQSASAQTGQITQTVKQIAKRLHVGTKSVSINSTTQNANLMAKTPSGYYRVDYNADGSQFVLEKVELDGSSHIKVQEAN

SEQ ID NO: 3752 - protein, 212 aa, Lactobacillus buchneri
MFTYSDVALKLIVGFLFITILINLTGKGNLAPTSAMDQLQNYVLGGIIGGVIYNPAITMAQFLVILLLWALLIMVTRYLKTHIHWFGKFIEGEPITLVRNGQLLVENCIRANLSGKDVDFKLRTAGVYDIQDVKRAILEQNGQLTVLNKGEGSIRYPVIVDGQVDPDVLDLMGRDQQWLEDELAKQGFDNIRDVYWATYRENVLKVAAFPEK

SEQ ID NO: 3753 - protein, 391 aa, Lactobacillus buchneri
MELDSINPYVLKVMPSAMRKFDHDISSDPKIIKLTLGEPNFNVPDHIKQAAIDAINHNESHYPYYWGYQPLREAASTYYQAKFGYHYSADQILVTVGATEAVASAVKTLFKPGDAVIIPTPAYPLYNALTTLNELNTILVDTSDDDFILTPTKVEQAIADHPDWDVKGLILNDPNNPTGVAYTEEQINALAPVLKKNGIWVISDEIYGELTYGQKHYSISKVLPDQTVVINGLSKSHAMTGYRLGLVFGPSGFIDEIAKVHQYTVTAAASIVQYAAIDALTHGQDDSKPMLKEYQKRRDFVAKEMAEAGFGVVHPGGAFYVFAKIPADLQMNSWDFVNTLAKEYHIGLMPGDPFGDNEYVRISYAASDEALAAAMKAVKQLVADDSAQTTE

SEQ ID NO: 3754 - protein, 479 aa, Lactobacillus buchneri
MEKSLNADQASVEPKQKHAAKPVARPFLAMLGMLIGGFVGMLSETSLNIALPSLIAELHVSIGTMQWLVTGYMLVIGIVLPMSSLLQRIFSTRSLILFALCDFIVGAVISALAPNFAILLVGRMIQGIATGLILPLMFTVATLIFPPYKLGSAMGMIGLVIMFAPAVGPTLAGMILGLLSWHWIFWLFVPFLVIAFILAFKYLPNVGDITKPKIDWFSIVLSAIGFGGLVAGVSLASDSGWGSPQVIGTLIVSILLLAWYIRRQLKSETPILNFRVFQKHQFTVGSVLVMLDFAIILSSMYLLPMFWQNGLAIPVAMTGIVMLPGGIVNAIVSAIAGRFSDTVSTKLLTTLGFGVTIVGLVLLLLASSTSPMWYVILAHIIIMLGVPLAMSPAQTFGLGALDEQTSGDGSTIMNTFQQIIGAMATAIATSLLAFGNTAAGHVSHQVAFTNGVHVGLWFTLIVAAVAFLLSFTIKDRKRA

SEQ ID NO: 3755 - protein, 40 aa, Lactobacillus buchneri
MKHTVLILTGIGVVVAGACLLKSMGWFEDDSHLYDEYEAK

SEQ ID NO: 3756 - protein, 564 aa, Lactobacillus buchneri
MTKNKAIMIGAGLANMAAAVYLIQEGNWKGDQITFYSIDDHGSNDGSPASEAAGEYWNKVHPMENTKGFIARGGRMLNYRTYVDLMDLLSRVPSATEPGMTAAEDTRDFDAKHRTFDKARLMEGGKGIINGGKMGFNNKDRLKLTELIMMPDSKEEQLDNVTIADYFKDDPHMFTTNFWYMWETTFAFRVQSSAQELRRYMHQMIYEFTQIEHLVGVNRTRYNQYESIMLPLINYLKDQGVNIILNRRVTNFEFKDTPMQDEITVTALRMTNTETGEEEDVPVDDDTAVIFTNGSITDSATLGDFNTPAEENMDYGAAASLWKKATNRFYNLGNPDKFFNDRNASEWVSFTLTTKDHVLLNEITRITTQVPGNALNSFISTSPITPMGNKDVNMSIVVHHQPHFTTQKANESVIWGYFLYPRRKGEFVDKQYIKMTGKEMVEELLGQLSKVDPGPGNIMDKKQEIMDSVINCIPAYMPYASALFNNRAKTDRPKVIPEHSTNLAFTGEFVEQPYQMVFTEQSAVRSGEIAAYHFAGVPMAKLVKNPRYDKDIKTLAKATRKMFE

SEQ ID NO: 3757 - protein, 311 aa, Lactobacillus buchneri
MVKQFLSISCIPTPTYIQSGHVVFSPGERHPNRKNFQFFVMMFMKRGKLFIAEDNTEYTVSAGEMFILQPQHHHYSWKPMDETTEYYWIHFATAGNYVQAPEPKQMRPVIPVPAIHYYTSAITLFLEKQQPIPNEDTVISMIKKIFANSRKSNENHSDTTQNSIEFWKAQQLFLDLLQQIQVQTPQESPTTMIANKIQRYIEDHFDEKITYEELGKEFHIHPNSVSLYMKKTFGITPNNLLTKYRLEEATKYLLLTSDQISTIATKVGYQNVYYFSMAFKKSYGMSPSEYRKKYISLKPNTPDDGAGSQFM

SEQ ID NO: 3758 - protein, 46 aa, Lactobacillus buchneri
MKPVSYYDIKYLPDSTLKETFERNINWMLSLTPDQLLYNYLLLLLS

SEQ ID NO: 3759 - protein, 448 aa, Lactobacillus buchneri
LTNVKSYIESIKDQIDRRDPNQTEFQEAVFTVLDSLAPILEAHPEYVKSNLLAQLVEPERAIQFRVPWQSDDGQFNVNRGFRVQFNSAIGPYKGGLRLHPSVNLSVVKFLGFEQILKNSLTGLPIGGAKGGSDFDPKGKSDSEIMRFCQSFMTELQRHIGPDLDVPAGDIGVGGREIGYLFGTYKRLNGYQNGVLTGKGLTFGGSLARTEATGFGLLYYTNAMLKAQGDTLTGKKIKISGAGNVATYAIQKATELGAKVITVSDSNGYIYDPKGIDYKVVQQIKEVERGRIREYADRVASAEYHGGSVWDFDVDYDIALPCATQNEINKDQAKLIVKDGVKYVCEGANMPSYPDAIAIYRDGDILYGPAKAADAGGVAVSALEMSQNSEQLAWSFETVDNRLQDIMEDIFAKSEAADKKYHLDKDYQAGANIAGFEKVAEAMMAQGLV

SEQ ID NO: 3760 - protein, 487 aa, Lactobacillus buchneri
LKKIRRLLIIFVSAFSFLFLMNNVASAQSKEHYTIGVGPTFVPFEIQAKNGSYNTAHPGLDIEILRAAAKKENFTYTLKVMNFAAAIQALEGNQVDGVIAAMMATPERAEKIDFSKPYYNVGLALAVPKGSSIKGYNDLKGKTVAVKTGSTSEQYAESIQKKYGFHITRFNDSNTELSNVLVGNSAAAIDSTATLLYSIKNKMKLQLVGKAANKNPVAFGVKKGHNQELLKRFNAGLAAIKKDGTYDKIVKFYTGEHSKSAIPVQSSSDRTYFGLLKSNATSFGNGIKMTLEITIVAIFFATIIGIILGILGATPNKFLRGLSSTYAFVFKSIPVMVLAFFVYIGIPNLTGEKIPLFIAGVITIVMENSAYTASFVRGGIEAVEGGQMEAARSNGMSYFQAMRYIVLPQALRIMAPSFINQFIIALKGTSVLSAIGVAELTQQGTIIISRNMEGFKVWLLVSLMYLAMIGLLSYLSNLVKKHYQLAS

SEQ ID NO: 3761 - protein, 418 aa, Lactobacillus buchneri
MDNNEKLRILKDLISFRTVNGNEHLVTAYIHDLLAKHGISSTFIKYAEDRDNLIAEFDTGNPGPVLGFSGHADVVHEGALSTWTTPPFEPNVRDNRLYGRGAADMKGGLAGLTIAFISLVESKSVHNGILRLYVTMGEEVGELGSKLLADKGYVDDLDAVVIGEPSGVSKERLDAYVDSGGAKFTPELAAKLHQVSHDQKAPEQHFIFFAHKGWLMYEVVAHGKAAHSSMPKMGINAIDMLVNYYLKEKQFYQSIQATDPILGDTVYAPTIIAGGKQINSIPDIASLKVKIRTIPEFDNQTIIKKLHQLIDHLNQQPGYNLTIDITSKRPVINHPGSAIIDIAQKAGAHHLHESLDLPTIGVSLGTDASEYTRVNQKMDVVVLGPGNTTSHQHDEYIDLDTYYNMIDTYKEIGQQYLN

SEQ ID NO: 3762 - protein, 388 aa, Lactobacillus buchneri
MVETAPVTDELDRYMIEQFKQFHRHPELCDQEKWTTAKITAELHKMAISILDFPIQSGLVAQIGPGDGPTIALRADIDALPLQEETDLPYKSEISGAAHACGHDFHIAALLGAAKLLKERESQLSGNVRLIFEPGEERHVGAREMIHAGILKDVLAISGIHNMPTIPVGTVGMKIGKLMASNDNFDVTITGVGSHAAMPQTGRDPIVAVANTIMTLQTIVSRNISPSDRLVLTVGAISGGHVNNVIPESAGFKGTIRTFSEADRKLAKRRFYEIVNATASAYGQTATITWDQGPAPVDNSEAITNLIANQASQFMKVTDAIPSNADDDFAEYEQLIPGCYAFMGSKGQANLHHPDFIANPEGLKYAAKFHEQAALALLAHFNQKDKVE

SEQ ID NO: 3763 - protein, 183 aa, Lactobacillus buchneri
MGLLITGIIIIVLIVIVVALYNGLVSQRNLVDEAASQIDVQLQRRGDLLPNLLETVKGYAKHEQETFEKVTAMRSQIQDPNASLGDKVKADNELTGALNHLFAVSENYPELKANQNFLALQEELTNTENKIAFSRQNYNSNVMAYNNKLQTFPSNLVAKFGTFPARSYLEVPEQSKEVPQMKF

SEQ ID NO: 3764 - protein, 334 aa, Lactobacillus buchneri
MDTINQQVQQNRRRTWSVMAFFVVLIAVIGFLIGLVFAVATQDESIDWLIPTYTMVGFLIGATIYSFFVYMSVTNILMKSANAHQLQESDDPELFNIVSDLVMVAHIPMPAIYLTDDPSPNAFATGRDPQHAAVAVTKGLREMMNREELEGVLAHEISHIKNYDIRVSSITVALTTFIAGAGTVLIVSGISLIRGGRWFSWFGSDSDDDAKSSWAIAVGILVFGLIMWLGGWIIRAVGVPVAQILQFSVSRERESLADVSGVNLTRDPQGLINALTLLKNDTTPTNNPTAKSAALYINEPVTRQGKTPFLAKMFDTHPPLDERIARLKRLLGEQ

SEQ ID NO: 3765 - protein, 641 aa, Lactobacillus buchneri
MTITKRFWIALIFSLPMLAEMILKPFGWMIPGGEWTMLVLTTIVMIVAAGPFINSAWASFKKHHSNMDTLVAIGTTTAYVYSIYAMATHQPVFFESAAFVTTFVLLGQVFEERMRNNASNAVEKLVNLQAKDAEVIRDGKIVRVPISEIVVGDLIKVRPGEKIAVDGQIVSGSSTIDESMITGESMPVEKKAGDSVVGATVNGTGTFTFKAAKVGKNTMLAQIVELVKKAQNSHAPIQGLTDKVSEIFVPLVLIIAISTFLIWYVFIGASVANALIFAVSVVVIACPCALGLATPTALMVGTGRSARMGILIKNGEVLEAVNDVKTVIFDKTGTITVGKPQVTDIVGDTTQVLKIAASLEASSEHPLATAILKNAKDSGIDYSPAENFSAIEGKGVRAVVDGKSAFVGNAKLLNDVEVSDTFKQQMATLQAQAKTVVFVGQNHQIVGLIAIQDAPKPTSKDAISALKSQGLKTVMLTGDNQAVSQAIASQVGIDQVVADVLPADKADQVKQFQSTGKVAFVGDGINDAPALSTADVGIAMGSGTDIAIESGGIVLVKNDLRDVYKALELSKKTFNRIKLNLFWAFVYNVLGIPVAAGVFYFIGMTLSPELAGLAMALSSLSVVTSSVLLNRTKITPSAQVA

SEQ ID NO: 3766 - protein, 90 aa, Lactobacillus buchneri
MNENKQTVNVTVAGGYQPSVIKLKQGVPAEINFKRINDQGCLDVVHSNELGFSEELPVNVTKTVQVPTDQAGEFGFSCGMDMFKGKVEVI

SEQ ID NO: 3767 - protein, 122 aa, Lactobacillus buchneri
LKIVVLIAGLALIGFIGWWFFGKHQVAQANAKVNDDQQVVDVEVKGGYSPEVVVLKQGVPATLNFTRTDSSSCLDRVVFSDFGINQALPQNQKESVEIDTSQSGEFQWACGMDMFHGKLVIK

SEQ ID NO: 3768 - protein, 333 aa, Lactobacillus buchneri
MKFAMIGAGAMGLRYGILLQEAGNDVTFIDTWQPHIDKIREQGGVYVMRDHKDRHLTKIKLETPETFDGHPDMFIFFTKQMQLQDYLDRCSHFFHEDQYAFTAMNGMGHIEKLQKYFADDKIIGGTALIATVLPGPGEVDFMGKRGAGKMNMCPLNEKPDAMCQALFDELQKAKMNPTLTDDFTGTLMTKVIFNSVINTICTMFELPMGEFGNFKGAYQMGRQLIDEAYDICARADIKLVSSRDEEMAALDHNTRIDMPLHYPSMYQDMIKDRPTEVDYINGYIAELGRKYHYEASTHLFVTQAVHLAEFHRQNLAKQRAIKAKQEAPAAQTA

SEQ ID NO: 3769 - protein, 280 aa, Lactobacillus buchneri
MKFSVLGPAGTFADAAAKAYLKTQPLTNVTFDYHPTFDQVYQAVSGDNIGLLPLENQLDGYVSATLQRLQTADVTEIGEVTIPVDFGLVANVADLQQIKRLYVQFKTEGQCQKLLSTIPNVQIITTSSNMISLEKFQSGQPGDAAIIPQSQMADLSVPLMMDNVADQDDNSTRFIVFKSRRAHLDRLAQQTLVTDQFKAPLFVTPAFNDHPGTLYDILGYFAASQLNLVALMSLPTKTQLGVYSFYLEVSGTRDQQADLFKTLERMAANYQVHPLGYYAV

SEQ ID NO: 3770 - protein, 315 aa, Lactobacillus buchneri
MKLANIKPSKFKTLILPLTAITAGSFWVSLKLFDIAFKRVDYVPETSKEKQQYADLYYQYVDWFHQMPSEEWYLNRNDPDKRMVATYIPAEGISKKTVIIAHGYKGNRETMANYAKMFHEMGFNVLTPDDRGHGESAGKYISFGWLDRLDYLKWIDQVIDHVGEDGKILLFGVSMGGATVEMLSGERLPTQVKAIIADCGYSSIKEELTYLLKKQYHLPEYPVEPMVSEINKRAAGFGLDSASSVKQLAKNKRPILFIHGGKDTYVPAHMAYENYQATHAPKQIWIVPNATHAESFWYDPVAYKRRVQEFLRTYF

SEQ ID NO: 3771 - protein, 584 aa, Lactobacillus buchneri
MTKMIAGQALVKVLEDWGVDHVYGIPGGSINHTVEGLYLEKDKMKYIQVRHEEVGAIAASADAKFTGKIGVAFGSAGPGATHLFNGLYDAKMDHVPVLALVGQVPQPTMNTNYFQEMDETPMFSDVSVYNKQVTTADQIPYVVNQAIKEAYRQKGVAVVILPEDLTSQEIDYTPTRTPLTVADDFKQSVDPKAVDDTLKMIKEAKHPLIYAGRGLLGARDTLTKFSEQFNIPVMNSVPATGVISTDHPNFVGTTGRLGTKSGFEAIQNADLILFLASEYPFANYWPQDTKMIQVNNNPYDIGKRIDVDYAVIADAKSYLQAMIDTGESRPKDAWLEANQENKQNWDKWLEQLADDDSDGLNAESVTKKIAELAGPNDTYAVDTGNVSEWGVRGLPMNKNQRFAISGLFATMGFGLPGGLAGALSVPDAQAWSLSGDGGFAMVAPDILTEVRYKLPVINVVFSNDRFGFIWYEQMQTKQHFYGVDLNDADWAKVAEGLGAIGFTVKSIKDLDEVFAKIKDLQASGNQKPIVIDAKIKQDDPVATAFMPLDAQKYGEETAEGFAKQYHIDRKQQPSLEELLRSKEK

SEQ ID NO: 3772 - protein, 134 aa, Lactobacillus buchneri
MKKFATIITVASLALPLAFAAPLAVSAATTPTTTAAKTKGTTYTIAKNGVKNFKARAYHIKKNITLYKGFFYADAGKVTFTPKGKLTKPMTYSVTRSVTVAATKTSKAKTFLYVKGYGYVLSSQITKGRYMSAD

SEQ ID NO: 3773 - protein, 248 aa, Lactobacillus buchneri
MTATLTLITGADKGIGFETAMALAKLGQHVLLGSRHQDQGQQAVDKIRQAGYDAELVILDVTKQSDIDRAKATIDEKYGYLDVLINNAGIALDNHENAETLSTNVIRTEFDVNFFGTVSMIQAFIPLLKKSKSAKIINVSSNMGSLGLASDPNSRFYNVSSLGYQSSKAAVNFATITFAKELKDTHITVNSVNPGWTATSFGGRDVSQPVPQGMQSVHQGAQQIIKLASDPANELNGTFTENEGTLPW

SEQ ID NO: 3774 - protein, 397 aa, Lactobacillus buchneri
VIDLQKIANKEQKYIVQVNQVPLANRKVNAITIMDSGTADGWAQAGQIVITSSRMMPEKIETAKTLIHQLVEKQASCLMIKPYADNEESDIPQTLIDYCTHLDFPLFQIRENTTYIQIMNDINAILFEGRRINKMADLDLDYLLKTNSASDKDFDFISSLKNVDLYSLKVRVARISLSEIPKPSERIAVQFNLMNQIRAFFDRVQQEKRIKTYFIVESADGATAISFFDHEQMELPPDDRIPFKRLISNVRIPRFTVYEGVSNAHPAKKIHRSYIEASFGINIAKTLDWSRRPIFYRDVSLWDLVKKLSRVQDSRLYPEEMDQLLENHEMFETIREFFRQNESVKKTSQALITHPNTVRYRLEMIYKRTGLDYRLTNDKFLIYIAFIKKLLAKVNNE

SEQ ID NO: 3775 - protein, 324 aa, Lactobacillus buchneri
MSKVLIAGRIPEHALNILKDAGLDIDVFDDSQNLITKDELSKRVADKDFLITPLSTKVDSDVIDAAPNLKLIANYGAGFNNIDTDYAKSKGIPVTNTPKVSTTSTAEVTCALMISLAHRVVEGDQLMRTKGFTGWAPLFFLGHELSGKTLGIIGMGQIGQAVAKRMHAFDMKILYNQRHQLDSATEEKLGAKFATVDEIVKNADVITLHAPATPETHHLLGAEQFKEMKDSAMLINAARGPLIDEAALLTALQNGEIAGAGLDVYEAEPKVDDGFKALKNVILTPHIGNATVEARDAMAEIVAKNTVAMDKGDKPDYIVNGVEL

SEQ ID NO: 3776 - protein, 73 aa, Lactobacillus buchneri
MKKKMKAGVVPVVGLLLSVLIGIWIVADSGYTLYKGTADIVDKVMNLIFLVIGVVILIGSIVTWFFQRNRSKD

SEQ ID NO: 3777 - protein, 106 aa, Lactobacillus buchneri
MMWNHYYVSQLDETDCGAAALAMILKYYGSRVSISTIRKYAQTDKNGTTALGLIHAATHFNLAPKAIKTNISFLKGNIPDIPIHFIAHVNKKYGQHYGCRLIPETT

SEQ ID NO: 3778 - protein, 74 aa, Lactobacillus buchneri
MNVSQKIQYCRTLRNLTQDEVGNLLHVSRKTISGWETGRSSPDILSLVKLCNLFDISLDDLLCDEHMIDRDYHG

SEQ ID NO: 3779 - protein, 467 aa, Lactobacillus buchneri
MQELHDLNPSPLRKRDYFVVSSMLFGLFFGAGNLIFPIHLGQLAGGALVTRRGRFLVTAVLLPLLSVLAISVTHSEGVYDVGKPLGPVFALTFMVLIHATIGPLFGTPRTATVPFTVGVQPLLPSSMAHVGLLVFFAVFFGLAFLVSYKESNVMTSVGKVLNPVFLLLLFSVFALGFANPMGVAGKQAVTAAYKGDSFFNGFLQGYNTMDALAGLAFGVTVVTAVRQLGKTKPSSNAKVTAKAGVFATGAIGLIYLGLIWLGATTLSTYKASADGGVAFNQLVTYYLGGLGHALLATLLTVTCLTTAVGLVAAFAQDFHNHFSKVSYRGWLGFMCVASFATANFGLDTIIQWSTPMLMFLYPFAMVLILLSVFSPLFNRDPLVYALVVGFTTVPALLDMVAAFPPVVSQSAFGQALGAFQQHVLPFANLGMDWVVPAAAGAVLGLGLHFLRPVLGRAKAPSSEENND

SEQ ID NO: 3780 - protein, 205 aa, Lactobacillus buchneri
MTSFDKRGADDRLLSPDNAVLTIIDYQPVQIGSIGSMRHADLLKNAEMVVEAAKLFKLPIVLSTVNAHNQRNSDTVKPLKDLVGDIPSYDRSSINAWEDKDYNDAIKATGRKKIIILALWTEACLTFPTIDAIAEGFDVYPVVDAVGGTSTIAHETALRRVEQAGAHLITIPQLVCELQRDWNRQDTVPGFVKLLQENGAFTNLQ

SEQ ID NO: 3781 - protein, 222 aa, Lactobacillus buchneri
MVKKVFLAMVTILVSVLMLGSVNSQASSKVNNYIASHNISHNQVSSKIWGGFPHYKYRHGKNKPEGVVVHETGNSHSTIFGEIAYMKKNYRNAFVHTFVDDDHIINIASTKYLCWGVGYPGNARFVQFEQVEMHSKKSFAGEVENAAYYTAYILHKYHLKPNDAVYDGHGTVWSHGAVAHYLGGSDHTDPKGYYANRGKKYFHQSYTMAQFYQLVLTNYHNL

SEQ ID NO: 3782 - protein, 300 aa, Lactobacillus buchneri
MLHKFSGFKAWLLVVVAVALGIGLTGCASNSASNGKIKITATTDFYGEVAKAVVGSKGDVTSIITNPNVDPHDYQASTKVAKETVGSKIVIANGIGYDGWMNNLVKDSSKVDYIKVGEDLMGKQNGDNPHLWYNPATMPKLANTIATKLGKLQPKNKAYFKKNAQKYIASLKPVNDKIAQLKQLAATKKNKEVYVSEPVFDYALEATGFKVGDTQFENDTEKGVDPSPQTIRTMQNGIKNHKIAFFVFNKQVDSKTVNNLVALAKQNKVPVLPVTETLPANKTYVSWMDSQYTQLINILK

SEQ ID NO: 3783 - protein, 380 aa, Lactobacillus buchneri
MRKSFKRGAVILGLFAGGILFGTNATAHAALTPSSTQPGANMVDVSSWQGNLTAADYQTLAQNGVKAVTIKASEGTGYINPYLSQQVQYAQQAGLSINFYHFVHFTTTDQAAQEAQNFMNAVQSVTSSKDVVMVADFESSELGGISKANNDANLAAFDSALNQGGYNKTDLYTMASWLGVKVDTNASNQGWIADYPATPTGSKYPSANAWQWASDYRFPNINQNLDVSQLNNSFYLNSGSAAASTNTNANSSSASSASSASSSSSATKPSNSGSSSKNDGEIVKIPGPSGKQYSAARSASVKLVWRANMGKHYYTTTKGARYSKHLGTRYGYNSELPNVTWVTDAHEKLYKKNTGNYAIYYHVRSTVGNHGGWIWRGYLN

SEQ ID NO: 3784 - protein, 65 aa, Lactobacillus buchneri
MKFFTKKFAGQSILSWVFQLALIYVAWQVSTHAMANNITTISIAAVLLLAIYWSFSLDRRSGNNK

SEQ ID NO: 3785 - protein, 316 aa, Lactobacillus buchneri
MLFSTFTMEKTLLYYKGGEFLAHKGWHHRRMYHKGDYELILCIKGPIYLQIGDRRYTLNTHEVLIVPPFTTFYGYQDSPGDVDFYWVHFFSQHKEDTLTADEDDMTEKVKASTSKKRQIFLPQYFKLADYEEATILIHQILSIHNELSFIEERDYLVSALLIQLYKSYFNRPDANEDSSRINSLKEWIRANMSSDLTVAEIADRSHLNPDYLTRLFKHCTGMTTLQYLNHVKIEVATLLLIRTDMSIKQIADNSYFNDPKVFMRRFKSATGLSPTEYRKSYNLIHLNNPHVDPQIPIPKRIADSIDYIPENGDIPE

SEQ ID NO: 3786 - protein, 472 aa, Lactobacillus buchneri
MSSNANVDSNTASAQALLNDTLPWHRKITYGFTDMSGNLLYCIISSYMLYFFTNVFGLSVGTAGVLLLIGRVFDAIGAPVMGILVDHTHSKYGKSRPWFLWMSLPFAIFVWLLFTTPALSGTLKVVYAGVMYILADLSYTAMSTPITSVLPNLTSSTDGRMQANSIRLVLGNVGNFFAVTFIIPFAGLLGGGNEQKGWSLAVGVYSIVAFLLLIIAFFDMREKNIENEKVITIKESLKATKGNWPWVLIVVANLAYWTAFIVRNASMPYYFQYNMGSKGLISFFNGFTIIQVIGMASVPFFVKFMHKWGTTIFFLLMTMVGQAWVGLAGSNVTSALIGWCVACIGSGSACTMFFAMVGDTVDFGEWKTGIRANGFLTAIGASFCIQMGSGFGSFIASMLLKGFGFNAANATQSSSSLGGISFTFVWVPIIIYAISVILMIMYRKWENHEPVVKADLAKRNAEAEKNAEAAQA

SEQ ID NO: 3787 - protein, 656 aa, Lactobacillus buchneri
MQVYTTPKLNKVKVTSDFWKRYRELVVKEVLPYQWKVMNDEADISISEDPQNNGQDKNSHAIANLKIAAGQMKGHHYGFPFQDTDVYKWLEAAAYSFGYHPNPDLKKITDNLIDLIADAQDDDGYLSTYFQIDAPERKFKRLQQSHELYTMGHYIEAGVAYHHETGNEKALDIAKRMADCIDRNFGLEEGKIPGYDGHPEIELALSRLYEETGEKRYLDLAHYFLNQRGQDPAFFEKQIQADGDSPDRDLIPGMRDFTREYYLAAEPIKDQKVPHGHAVRVVYLCTGMAYVARYTGDKDLLAACDRFWNDIVKRQMYITGNIGQTTTGEAFTYDYDLPNDTDYGETCASVGMSFFARQMLNIHAKGEYADVLEKELFNGALSGMALDGKHFFYVNPLEADPVASKGNPGKSHVLTHRADWFGCACCPANLARLIASVDEYLYTVNGDTILSHQFISNDAEFDDGLKISQTNHFPWSGDIHYEIANPDAKSFKLGIRIPSWSANFDLTVDGKSTTLPVEDGFIYIDVDAKSLTIDLKLDMDVKIMRASNRVSDDFGKVAVQRGPIVYAAEEADNQAPLASYEVATDAKTDYHFDEKLLDGVGVVKVAAQRQKLDSKDAPLYVDASQPVESESVDLKMVPYYAWANRENGQMRVWLNK

SEQ ID NO: 3788 - protein, 157 aa, Lactobacillus buchneri
MNKKSGMMSFSILMLSLLPMSTGATASTIPGLMKQFPAVSSETAELTVTIPSFTMAVVIILSSLIVKRIGTKKLVLAGTALTAFGAGLSMFSPSVSVLLIARAIMGAGIGAFNTLCISLIDRLYSGQQRERMLGFQNTFQGLGAAGGALGVGLILMY

SEQ ID NO: 3789 - protein, 239 aa, Lactobacillus buchneri
MYSNWRMAFGIYLISVVLFILYLFYVPEVRYDNDDPQTVGQADEKVSWMSKLQFGYYWIVMFILMVFYMTVNVKMPTYILNNHFGALSVGSTAVVVMSIGTIIGGLIYGFIESIAKNATLVMAIAIEAVGVFMISTAGSALDCFIGAFAVGFSFGLFIPFIFSKGLSFVPKKYGNDATTILMISTNGANFLCPYVSKFINIGGTDRSLFMMAGVIASILGIIELVKLLANRPRRTVPEA

SEQ ID NO: 3790 - protein, 335 aa, Lactobacillus buchneri
MGDKMTTIKDVANEAGVSISTVSRILNFDDTLSVGEDTRRRVLEVAEKLQYKKRNRHVPKGGKKIGIIQWHSDKEELTDLYYLQIQYGIENKAASLGAGVEKLTFDSIDKSRVKGLSGMIAVGKFDKTEVMSLKSYDIPLVFIGENYLAYDCDSIRSDFESPVRKIIDRFIEHGIKDIGMIAGKETTVTEKQGVRDPRVSTFDSYLSEKGLFNDAFVFQGPFGPDSGFELMNTAIKQLGDKLPHGFLIGSDSMAVGVLRALQQQNISVPDRVSLISFNDVAIAKYTSPALTTVHVHTELMGERAIEMLTDRIKEPKKVPELTVIATELMERESSL

SEQ ID NO: 3791 - protein, 603 aa, Lactobacillus buchneri
MEKGLLYPVTNQFRQDQKLDGLWDFKFDPQAQGEAKGWTTGFDDPIKMPVPASFNDFFTDKDSREYTGDFWYAKKFFVPTYMDGQTIQLRFGAATHRATVYVNGQEIRSHEGGFLPFTADITDAVKLGQENIVTLKMNNELHRDALPAGDTATLKNGKKMAKPFFDFYNYSGLNRSVHLLAVPKNHIYDYSTTYDVSEDQATVHYSVQATDGSNFKVSLSDGDGKVVATAEGQTGDLVVKNPTLWQVRDAYLYTIKFELLDAGKAVDEYSDEIGLRTIEIKGHEILVNHKSVYLRGFGRHEDSIYAGRAFDLNVERRDMNLMKWIGANSFRSSHYPYDEQVYKFADREGILITDEVPAVGFKMAAASFLGGLNQSFFDGDWIDELYKKHIDQVKDMIKRDKNHPSVLAWSLCNEPDTSTDSAVPYFTKLFNDSKDLDPEQRPRTFTLNEDDTFEKSKCLKFPDFYLLNRYPGWYHKWGYEISDGEAGLRAELDEWKNSDIDKPIVFSEYGADTEPGLHKLPSIMWSEEYQIELLDMFDRVFDSYDFIRGEQPWNLADFQTVEGNMRVNGNKKGIFTRDRQPKAAAFYLKKRWTSLPLDYKAGK

SEQ ID NO: 3792 - protein, 850 aa, Lactobacillus buchneri
MNQTSFVIDGEQLDLNAKDANTFKGFGYLSCNNSSRLLLDYKWEHRDSYDQILQILFGGKHPLMRMLKVEMGDDANTSSGTEPATMRSASETANVNRGAGFQLIADAKKIQPTLKTAILRWGEPGWLRKDWFDAKSADPDGDVPETAYEPMYRWYKQTIISAYQTYGYLIDYIDPDRNETKHPMVKWIKWFADRLANDQSGFPNDFPISRYQQIKIIAADQNYERDFGDMMIADADLRERVEALGFHYNTDDGEKQPFTKLADDYHHEVWYSEGIAPMTMGKYRVRASNGDGIGGRQSGLDVANRLIKSYVKSRRSLYIFQPAVSAYYTGVNYSHKELINACRPWSGYYEVDNVGLQCMKHFTDFAKAGWEDEGAWRYLTSACDSQVGGTENLDHNRQAPSYMTLMAPDKANYSVIFDNDSPEARTYQIQLKNLPACEDKPVAVWQSVGPEHTGDAYDSRMKQLRQTVSPTDGLLKIIVAPHSIATATTLDLADDPEVVYHRLESPHEDHTLGIKSDDGVLYEDDFSYSGYPENYLSSRGNTPRFTADQGGAFEVVRTDEDNVMQQMITEKQRALDWEYSFAPNLTFGDDHWTDYEVAVSMKFDDQTQQNSPTGNYFGIGLREMTDVKGRLESAPYVFKVAIDGGCELVKDDRIVALEHVDGLDVSATHQVTFAAEGNHLTATFDGQLVFDYTDTDNPHYSGRVKIGSGYYHTQIKQLTVTQGKQPHLIEHRVDDLDSAVQYTGKWDHVCGLGNTKWNRTLSTASADQDNVPGFKFDFNGSGFSLIGVQDVASHLKVTVDGAVRNWNLAPQVGADRTENIVVHGLSAGKHHVSIEVVGGRYTLDAVDFLK

SEQ ID NO: 3793 - protein, 190 aa, Lactobacillus buchneri
MKRIAVYCGAATGTNPVYVTAAKKLASWLVSHDLELIYGGGGVGLMGVLSDQVLAEGGKVHGVTTKQLVARGAESPRLRELSDLTVTDNMSARKAEMMNISNGCIALPGGIGTLEEITQAFSWARLGDNPNPCVFYNVNGYYDLLAKMFDKMTSEGFLSAADRKKVLFSDSLDEIYTFMTTYTPPKIRQY

SEQ ID NO: 3794 - protein, 146 aa, Lactobacillus buchneri
METYILDDSDDMWQHFAKLIGDVSWPAGKYLANEMLGGRVSDWERVIVLMDDDQLVGFCAVVREDIVKGTGYSPFIGFVFVSEDYRGRHLSQQLVKLAENQIKQIGFHKAYIVTKHVGLYEKLGYEQIDTSVDQLGRKMRILAKQL

SEQ ID NO: 3795 - protein, 400 aa, Lactobacillus buchneri
MREETTVPNRQKVILGALLIFLVGANMRTAITIVPPILTNIQNSFKMPEWFLGSLTTIPLICFGLLSPTVTYFIKRFGILPVTMVDLGLLTIGNFIRVYSFTSLLFGTILIGCGIAMLNVLAPTLVSYLFPMQIGTYTGMYVFALSLSSSISAGFSAVVSHLITWQVMIQFISIIPVITIIVAIMLRTSGKRKTSAKKPSTPLNPEVKVSVWKRPLAWALGGFMGLQSLLFYSILTWLPPILMASGINQNTAGYLLGLLQLVALPISFVVPRIISSVAKQSTMIGTISGLFIVGLGSLMMAETSFWFAVLACVLLGLSTNMAFSEAMTLFSLKTRTPNETASVSGMGQSFGYLLAATGPMICGWMHGLTTNWFAVLIFLLAVTVVMTFVGLLVDREEYVF

SEQ ID NO: 3796 - protein, 539 aa, Lactobacillus buchneri
MKKIVVSVVGLVSVLVLSACGKSTSSKDATSRTFRTTAQTNVITVDPNRATDVGSYLAISQVVEGLYKQNNQGKIVPSVATKIVQPTNGGKTYTFNLRHDAKWNDGSRVTAGDFVASFRRQVDPKTKSQRAGHLSDIQNYEAVNSGKAAPSKLGVKAISKYKLQLKLSHPVPYYNYVIATQLYPINQRALAKWGSKYGQDSKHAASDGAYEIKNWNSSKDTWNLVKNKDYYDANKVDLTRIHFQVVKTPQTSMRLFQAKDIDETQISGSLVADAKKQFKNETVVSKYGQLAFIPWNNYRKTTRNLNLRRALSYAINRQSLAKNVLKDGSLPAQSVVPEGEVKDASGKDFNAGVTPKLTYNLTKARHYFKLAQEELGKETINVQLLTADTDAYKAVAEYIQSQAKKVSPNFNLTVRSIPLQQEISDFSNHKFDAGTLGWSTDFPDPIDYLNLAAKAGVINFTKWTNDKYQKLIDQINDTTHQTAAQRVKLQQQAASLLNELQGVTPLYQYASVHLRTKNIKGLDYPLIGYQKYEYASWKK

SEQ ID NO: 3797 - protein, 241 aa, Lactobacillus buchneri
MTIKIGIASNHLIHPTERFGTNFVDYIQRDYVTGLRHAGTLPLVLPLGDPKDAEDYIAGVDGLLLSGGQGVTPILYGEEPLAEVAETDIYRDQFEIALIKAAQKADKPVLGICRGMQVINVALGGNLYQDIYKQAGATEKHNQYPTSWEIPTHHVTTTDDSWLHQILGERFAVNSFHHQGIHEPGDNLKVVAKSDDQVVEGIESNDGRIIGVEFHPEMMRVVHPEFQRIFDYFAKLATENQ

SEQ ID NO: 3798 - protein, 248 aa, Lactobacillus buchneri
LIGNHRQEMRVWHHKRDSLSLIFFSFIGMAASQYTYFMAIEAGNAATATILQFLAPAMIIIYLALWTRRFPRRIDVFSVIMALCGTVLLVTHGQLTTLAMPLGGFVWGVGAAVSSTLYTLLPRNLLKEYGSIPIVGWSMLIGGTAFSLYYRIWDDMPAFSWTTYGSVSFVVIFGTMFAYLFYLQSLRYIQPTTASVLGSFEPLSATTLSIIFLGVSFGVPETIGAVLILGTVAVQAWATYTTNPAAEI

SEQ ID NO: 3799 - protein, 460 aa, Lactobacillus buchneri
MFDKIGQIIFNNEIVANASDFNMGIEVETIRIDSAGRLTKEPYPKALGNQRKNHFIKTDVYQIQSEIITPTARKSLDAMHYLMALNDTLRNALEPNELLWPLSMPPVLPQDKSTIPIADVDPEQKAYYEKWIKTRSDTQGIPVGVHLNVSINDDVLKTVWQAVDDQYDSYADFVNYIYIKIAQGFDYYRWLITYLFGNSPIAEKNFFKPDEDQPQHEERSIRSSNYGLTSDVTHNYRSVPDYVKNIESNIASGALFSEAEYHSSVRLKTMHGDLTDMIKNGTEYIELRMLDLDPTTALGVRTSAIRFFRILLSYFMMMPTLESDEKINLKLEQGRAMNEVVALESPSQQTIYHHEAQTFLDQLQLFGAQIQWGPEYQEVLDTMQDRLDNPNLTPAATLCDHEVDGSLMSYGLAMANRYQNRAHENPNPFTGFEEQPDMTANELRQRLFGVMGKPENYKNG

SEQ ID NO: 3800 - protein, 440 aa, Lactobacillus buchneri
MKQAKEVSDFINSTVGLEVETHRINKSGQLSHKSYPKGLLNERQHHFIKNDFLETQSELITPPTKTTLKGLKYLGVYHQALRSELAGKEYLWPYSMPPKLKADHSDIVIAQTDPKSYEYRQQVAKIRKIERTAETGVHVNIGLTKKAIKDLTAQDANVSTDDLYLQAAVGFMRYRWLLTYLFGATPVAFTNYFAPDTDAPTSPVRSLRNSHFGFGNGFISSYQSVQQYVDGILKAVDDQKLIAQREYYGTVRLKRSDNVSALLTKGIAYLELRIYDLDPFEPLGVSEDAVDLVRLMFAYFVSHRPFDLRTADEDIAKADQKNDVVALENPLKISQYHDEAAEFIGKLEKFSAQAVIPFNAQHLCFKLMEMIDDPVLTPSGRMVNWLGEDSKKVFDELLKFAKGYQDDLIHNPAIGFESLSAADQKEILATLKQGIPVRIK

SEQ ID NO: 3801 - protein, 212 aa, Lactobacillus buchneri
LKVMILGAAGQIGQMVTDDLLTQTDFDLVLYGHNVSSRLAAKKSPRVTFVDGDFTEFDKIKANLSGVDAVYLSFVAGPEITGGIVKVLDEAKVTRFISANIPDLYQEVTGKFQAWYRKHTGIIWKSDRKKSADIVEASDLDYVILRITWLYNQAGNTQVHVTKKGEPFKEAQVTRQAVAQFVTDLLTGKADYHRESLGLGEPGTEWSKPSFY

SEQ ID NO: 3802 - protein, 288 aa, Lactobacillus buchneri
MNTPTFKLNNGIEIPAAGFGVFQIENGGTKQAVADALSAGYRLIDTAQAYGNEAEVGDAIKESGIPRDQLFVTTKVWVSDTGYDATKKEFEQALTKLKLDYLDLYLIHQPYGDVYGSWRAMEELQKEGKIRAIGISNFNADRFVDLAQHNEVTPQVNQVELNPWFQQQDELDWMKKLGIQPEAWAPFAEGKHGLFTNDVLSEIAQNHHKGVGQVVLRWLYQRGVVTLAKSVHKERMIENINIFDFELTDEEMQLIQNLDMKESAFFDHRDPKMVERLGGGGRWNNDDK

SEQ ID NO: 3803 - protein, 102 aa, Lactobacillus buchneri
LNWIFLAKSLRSAGLSIESLIEFATLARKGGAVRQAQKDILHEQLTILNEKLKEMQDTQALLKYKIDTFDEHLAKFDAGEMTADNAEKLWQKPYLKDNHKGE

SEQ ID NO: 3804 - protein, 43 aa, Lactobacillus buchneri
MNSKKVSELLGVSTDTLRYYERIGVIPRLNAITTVIVSTKPMT

SEQ ID NO: 3805 - protein, 327 aa, Lactobacillus buchneri
MCTSVTFLSETGDNFLARTMDFAFELDGRPIVIPRKQHFDSDAAEAGYDTTYGFVGAGRNLGHYILVDGVNEKGLSAAALYFSGEATYAKTAKTNRVNLAPHEVLNWLLGNASDCEDLGRKVDQLNIIDAPVKILGKATPLHWIISDRSGACYVLEMLADGVHYQKNPVGVMTNSPDFGWHLKNLSNYTELKPSPHPARSYNGYEITSFGPGSGALGMPGDYTSVSRFIRTVFMREYADQVPTDQTVNELSHILNSVEIPKGVKLKQDGSEDYTQYRGYMDMKNCAYYMQPYDNQTIYKVSLSEELLNKKAPSEFPIKHQQVYETLR

SEQ ID NO: 3806 - protein, 246 aa, Lactobacillus buchneri
LRPRIALPADTLAEATNVINERNAAFAPRPAIEAIVKSGGVPVIFPSVNPEDVRDYMTLFDGVCFLGGADVDPTFYGEEPFQKLGMTYLKRDLFEIELLKQSVTAGKAIMGICRGMQLINVGLGGTLYQDLSQDLHATLKHSQEAPGNMPSHHVTVDPHSRLNDIIGQRPYVNSRHHQAVKDVAPYLKVTARADDQVIEAIESVDNDQILAVQWHPENIYKHYEDSRKLFKDFINRSQKVADKTRK

SEQ ID NO: 3807 - protein, 458 aa, Lactobacillus buchneri
MFSEIGQLIFDNEAVAKTSDFTMGIEIEMQRVDENGNLSQEPYPAGAGDEQTNPWITNDFLETMSEVVTPPAAHALDAMHYLFSINNALRSALSPGELLWPLSMPPRLPKDKSKIPLAKMGPKKEAYLKEWLKRHGFSQGTPCGAHINLSIDPHVFDLVLANMSDRFNSKVELQNYLYAKIAQGFLRYRWVITYLFGASPVAEANYFDPGKGPKAPIRSIRQSSHGFGNPFSGDYTNVQRYVDRIEKGVADGKLISDYEFHGAVRFKGNTHLRELPKTGVSYLELRMLDLDPSSSVGIRTNTLRFIRLLASYFIMSPAMNPEEVEKVIARSDKMNEEVSEEHPNDVSKYQANARAFLQSLEMYADRIQLGPEYQEELEDLQDRVENPLTTPSAKLITHLKNGSLEEYAIKRAKRYQQSALQSIRPFKGFENKAKLSANELKQELFKGSWEPDKSKVDK

SEQ ID NO: 3808 - protein, 583 aa, Lactobacillus buchneri
MSIFVKLGWYFKREWKIYLVGLFGLLLTALVGIIPPRIIGNLVDSIHNGKLTAKYLMFLLIVLTIVSFAQYGARYMWRTAIWGEAAKLEKVLRNRLFFHYTSMDHEFFQRYRTGDLMAHATNDLSAIQRVAGGGILQFADSMITGGTTLIAMVTLIDWRLTLIAILPFPLLAVMARYLGTKIHIAFRDSQAAFSRLNNKAEESITGIKVIKGLGQQKEDMQDFDNQVARTININRRVNFLDSLFDPMTTMIIALSYVITIVYGGYLVTNGTITIGSLVSFVSYLAMMIWPMFAVGMLFNTLERGNASYDRVMDLINQQSKVIDDPNGVTTTPKGEIDYDVKRFSYPGDKRLALQNIDFKVPAGKTVGLVGKVGSGKSTILRLILRQFDNYEGSIKFGGIDIKQYKMDALIPAIGYVPQDTFLFSQSIRENIRFARPDATQAEVEQAAKKSDLYDQIQAMPDGYDTAVGEEGISLSGGQRQRLSIARALLINPELLILDDALSAVDAETETQILENLHAERSDKTTIISAHRLSSVMNADEILVIDDGKIVERGTHDQLMTRGGWYHEMFERQELETKVKGGNS

SEQ ID NO: 3809 - protein, 598 aa, Lactobacillus buchneri
MADSSKHQSAWSKSIPVKQQMHIIGRLFKYAAPYKWYFYFSVLFAIAVAVVNILLPRIIQTFMDSHLVVGHPDFAMMWFFAGLYFFGMLAKAVMQFTQTYLYEMGAEYMLENTRRKLFAKLHTLGMRYFDQTPSGSILSRLTNDTMAFANFWALFSSLVVTISAMVSSFVAMYLADAKIAMWLLVFMPFLFVTVWYYQRYSTRVYRRMRERLSLLNAKLAEGITGISVVQQFRQEKRINHEFSDTNDQYYNTRRAMIRINSLLLNPIINLFYALGTVLVLGMFGIRGLHGYVPAGIIYAFVTYLSNFYNPMSEMMDRLSDFQDGVVAGSRVLRIMDDQTYEPQQHADPDATITRGKIEFKHVTFSYDGENDVLHDISFVAEPGQTIALVGETGSGKTSMINILMRFYEFGEGEILIDDRDIRDYTIQELRKKMGLVLQEPFMFYGTVASNIRMFNQEVTDEEVHEAARFVQADQFIEDLPDQYDSRVIERGASYSSGQRQLISFARTLVTDPKILILDEATANIDTETEQIIQTGLAKLQEGRTTIAIAHRLSTIQNADLILVLEAGRIVERGTNDELLEKHGFYYDMIQLQNSAHLD

SEQ ID NO: 3810 - protein, 144 aa, Lactobacillus buchneri
MANELMNRFAMDPFFDTLARRFFSPTDADNDYMVNGDLKTDITENDKNYIMKVDVPGIDKKNIHLAYQHGDLALSIDQERDSEKKDEQGRVVASERSHGVMSRTYELPGVDRDNISAQVNDGVLTITLPKAADSHEDSGNIEIQ

SEQ ID NO: 3811 - protein, 144 aa, Lactobacillus buchneri
MANELMNRFDLDPFFDRMAHHFFSPSDFDKDYENFGNLKTDINETDKDYSLKIDVPGIDKNNIHLNYQDGVLSININQEHSSEQKDENGKVIASERSHGVMSRSYQLPGVDRDNISAHIDNGVLNVTLPKVTESEDQTGNIDIQ

SEQ ID NO: 3812 - protein, 231 aa, Lactobacillus buchneri
MIDRFFNKKFIWKMIWVGIGTILACLLFLSVGFSTQLSPALVDQNDTPTQQVDTTTTPAYSPETNFHWSTKTVAYFITKQTNGHYRDVWMRAVKAWNAVGVVDLIPADDADRADVILSVKQSYHEGGGTVENITGGVVGYTSEEFGHVDGIPLFVHQNKSYLIIDSLKQAHYDSVNEQASVAMHELGHDLGLEHSDSPHSIMQQAAPTYLDSIPEVDAKHLAQLYAGVPRG

SEQ ID NO: 3813 - protein, 234 aa, Lactobacillus buchneri
MVSVRSKKKKDGQTMDEKLNTLRAGVLGSNDGILTVVGVLFSVAVATTNQFTIFIAGLSDLLACAFSMASGEYASVSTQKDTEQSVVTKEKALLKTNYQDQLNVVSDYYVDQGVTKETADKIAKDLMSKNPLETIVNVKYGLKLGHYMNPWDAAFSSLFSASAGGIFPLCAMTLTPVAFQWPATILAVCLSVGLTGYLSARLGNGLVKTAIIRNIIVGIITMIIHYSVGVLLAV

SEQ ID NO: 3814 - protein, 226 aa, Lactobacillus buchneri
MAKKRSLSQKINVLRASVMGANDGIVSVAGIVIGVAGATSNNFAIFISGISGMLAGTVSMAMGEWVSVNTQKDSQRHAISLQKAALSSAYDNEFNTVKHKLMGDGISANLAAQATSEMMAKDPVKTTVRQKYGFNVGEYTNPLSAAIASMISFPTGSILPLLAITLFPKTIRIPATFIAVVIALAITGYTAAQLGNANKGRGMIRNIISGILTMLVTYTIGTLIGS

SEQ ID NO: 3815 - protein, 254 aa, Lactobacillus buchneri
NADPHVTNPILEQLTQHRSIREFEDRPLSPHQVTELVNAAQHASTSTFSQQYSIVSVTDPAKLHAIADVTGHRWMVNGGHYFVMVADQYRNLKIAKAHGIDPYMLHSTDKFLASVFDTAIATENIMVAAESMGLGGTIMGSVLNNPRKMIELLNLPEMTFPLLGIALGYPKDKPELKPRLPKASMHFENQYDLDANFDQELTDYDQLIREYYQSRSTNGRSETFSHHIVSELSGNRNLRSDLFAMIQAQGLMTH

SEQ ID NO: 3816 - protein, 220 aa, Lactobacillus buchneri
MSSWAVIQQSLPMFEKGFQLTLWLSFVGIIGSIIVGIIVSLLQYFKVPVLHQVASIYVEVSRNTPLLIQLFFLYYAFPVIGIKFGAELCGIIGLIFLGGSYMAEGFTGGFNGVSKGQLESGKAIGLSRWQLARYIVFPQGFSLSVPAMAANVIFLIKETSIFTVIAIPELTNTALDLIGMYYRSNEYLFVLVVGYAIILIPLSIILTLLEKRVRYGSFGN

SEQ ID NO: 3817 - protein, 229 aa, Lactobacillus buchneri
MDHSGISVLFEGTNFERLLGGLWVTVKIAAVALIVGLILGIILGVLRTFKNRPLRVVLRLYLEFFRIVPTVVLLFLFYYILPRQLNFNLPGDQLATLVFALWVAAEMSDIVRGALISVPQHQRESGKAIGLNRYQLYRYVLIPQAISLEIPATINLATRVIKTTSLLMLISVMDVINIGQQIIEANNHTHPTGVFWVYGLIFLFYFLIDYPLSWWAKRLEKKRLERANG

SEQ ID NO: 3818 - protein, 246 aa, Lactobacillus buchneri
MAEQILQVEHLEKYYQKKHVLHDINFHVDKGEVVTLLGPSGSGKSTLIRCLNGLEEYQQGTITFEGKQINPTEKNWQQIRQKIGMVFQSYDLFPNLTVMDNILLGPTKVQKQDKFAAKKEGLELLERVGLEDYANAYPRQLSGGQKQRVAIVRALALHPDFMLFDEVTASLDPEMVRGILNIIQDLADVDHMTMIVVTHEMNFAQQIADRVIFLEDGHILEQTPSKQFFSAPQTKRAQAFLDSMDF

SEQ ID NO: 3819 - protein, 284 aa, Lactobacillus buchneri
MKKRSFTRIIAIVSVFAALLLVLTGCGNSKKSSSQSNNPSSVQQIKKNGTIRIAVFGDLPPYGWVNKDGKRVGYDVTLAHQVAKDLGVKVKFVQVNANNRVDALNSNKVDLVLANFTVTPERKQVIDFTKPYMKVSVGVVSPKNKAITKASQLKGKNVIVTKGTTAENYFTSKQPDVKLLKFDSKTQQFNALKNGRGVALADDNSYLYAWSKDNPNYTVGIKSIGPKSYIAPAVKKGNKSLLDWTNKEINKLTKESFFVKDYNTQLKPYFGKEVKPSDIVLPVK

SEQ ID NO: 3820 - protein, 422 aa, Lactobacillus buchneri
MTELMTKSNKRRLSMALYLNYLVHGIGLIILTQNMQALGGFWNVPIATVSYVISGIGIGKLIAYFIFGYLSDRFGREKLVLTGTLSYMVFFIGIPFTHNIAIAYLFAIIAGVANSALDSGTYPTFVEMGGNSSASNVFIKAFMSVGEFILPLFIATLEAHQLWFGWSFIGALLVLVVNLFILRGAHFPDRNQVDEEFSEEHQSLSKVRRVIATIALALYGYTTMAIMILFTQWISLFATNDLGYSSLISHGLLSLYSIGSISGVVVMFILLKLNFTETKLLVVTNTISLIAILTVTHASTVIVTAVACFVFGFTAAGGVMQIALNVLLKMFPKHKGVITGTYFTFGSIATFTIPIVTGILSKTSLQSVMNFDVMIGLVGTVLVVVTALAISTGNVFAHAGQSMMTLLHMGPAPVSQGRSKDE

SEQ ID NO: 3821 - protein, 252 aa, Lactobacillus buchneri
MSGKLTVRRTSFVTGTTKIAVPITGRTVDDILAQAQAAVSAHPDVIEWRIDYDQAGLDPAIYQATYAKLRQILGDTILLTTFRTAGEGGEADLDEAAYVTLYKRLIANELTDMLDVELHFSEEAISNLIYLAHQHNIKVILSAHEFQGTPPELEIINLLEQMQNQNADIAKIAAMPNKFKDVLTMMRATATESDKLEIPIIAISMGSLGRISRITAPLFGSVMSFATVGDASAPGQIAIDDLRTEMKRFETQ

SEQ ID NO: 3822 - protein, 338 aa, Lactobacillus buchneri
MINKRALLTFSIAAASLLTFSISNHSVPQAHAATTLTYGKITNNSLHRLGTIRQLTRAQLAEDHKLSGKQVQNLIYLPLPKRLTAHNFTLSKTALTIHLVKNSYGVKDVAIPLSKLTGIILNCYMPSQYDFVKPKTPKKVVALTFDDGPDPTLTPKLLKTLKHYNVHATFFEVGSSVIRYPSISRLVLKYGNQIGNHSWNHPDLTTLSSAKAIHQIALTDAAIYKATGTIPTYIRPPYGAVNSRIGNLFDRPIVRWNVDSRDWAYLNTPKTVSHVLATTHPGSIILMHDIHPTSVAAVPQIIRSLKKRGYTFVTLPTLMQKPLLANLQYFGRGDFRGF

SEQ ID NO: 3823 - protein, 545 aa, Lactobacillus buchneri
MFKDIRFTAIISVVIGFMAVLLSGCASTAVGGGAGSAEKALKITIPGEPLTIDPTKSIETNGGAVIDQVSEGIYRRDANNKIAAGVVDKVVKPTDNGTKYTFNIKKDAKWQDGSPIKSEDFVNSIDRQADPKTKSQQTTSIQYIENFAAVNSGKADPSKLGIHAVNDRTFTVKLTKPVPFMNYEFTNFYPIQTAAIKKYGSHYGTNSETTVANGAYTITGWNGSNDSWKYEKNKNYWDAKNVKIPEVDVTVVKDNNTAQNMFNGGQIDLTSLTGQYVKQNKNNKNLVVTETGRNNYIYFNDKKKATSNENLRKAISMVIDQDQLAKDVLQDGSIGANNIVPKNYAKDPKTGEDFTSEMGDQAPTDTTKAKQYWAKAQKEIGKDKISLDFLVDDTDTEKKLAEYVQGAVSDNLKGLTINIESVPHATHVTRDFSTDFDICTVGWGPDYPDAQNFLDGMRSNNTINFSKFKDQQYDDLMNKVDDTTKYDANQRWDFEKQADKRLMSIAAVAPTYQASQAHLISSKVGGLKWDAMSGQSGKLQYAYWK

SEQ ID NO: 3824 - protein, 42 aa, Lactobacillus buchneri
MAYQLTKSKDVPSQLVCNQAFYIERKIYYDKNQLYECCNLQP

SEQ ID NO: 3825 - protein, 421 aa, Lactobacillus buchneri
MTKINYTNVAIYNHEKQNFIANQHMVVDTDTGKIVEVGNGSSTNQVVDEVSDMHGRYVMPGIMNAHTHITSIPTYWWNDGKEQRHSDSREFNTMFAVRNMADAIDHGITYIRNVGAAFDIDIEVKKMQEKGWIRGPKVMTSGKAFSITGGHGSGGGYEVDGVDEVRKGVRQAMKNGVDNIKMMVTGGVLKNGETPDDIQFTPEEARTAVVEAHHKGKTAAAHAQGNAGVKEAVAAGFDTVEHAFDIDDETIAMMKEHGTVVVPTMNAMYAIYKYGKDTVPDWARKKVIVNIKKHFASITKAVQSGIPIAMGTDAGTPYNGFRNESAYEMELYVEKAGMTPAQAIDSATINCARAMHVDDEYGQIVAGNYADFISMAENPINDISVIQHDKDVYQNGTRVHKQAVLTATERQSAPSKVSAAI

SEQ ID NO: 3826 - protein, 105 aa, Lactobacillus buchneri
MTNKIETATESDNQAIRAAREQINQLDQGIVDLLKQRFQTSALIGMIKENAQLPVLDGDREKQVLDQVAQLDSDPGTRKYLQKIFQEILKNSRDYQHELMQKETK

SEQ ID NO: 3827 - protein, 389 aa, Lactobacillus buchneri
MMNYLTAGESHGPQLTGIIEGIPSGLHLDVDAINDQLKKRQGGYGRGNRQKIEHDEVTITGGVRHGITLGSPIALVVNNRDHAHWSQIMDPVSPETPENTLRKVERPRPGHADLVGGIKYRHGDLRNVLERSSARETAIRVAIGAVCKQFLQQLGIDIVGYVEQIGQISTDENPELNVAKIEAEISQNDLRIIDQTKVSPIHDLIDQTKRDGDTLGGIIRVVATNVPAGLGSYISWDTKLDGKLAAAVMGVNAMKGVEIGDGFKAATSFGSQVMDEIDWNQDQGFFRNTDHLGGFEGGMTNGMPIIVKAAMKPIPTLYKPLQSVDIQTKEVKKANVERSDTTAIVPASIVIESVVAIELAKALTDKFDGDNLQRLQEQLDQYRDELKKF

SEQ ID NO: 3828 - protein, 438 aa, Lactobacillus buchneri
MEKVKTQSTKQLQGSLQNGLQGELAVPGDKSISHRGIMFGAISEGTTILHHFLTAEDCLSTLKAFQQLGVPITRDGDTVTIQGVGLHGLHQAEQPLDMGNSGTTTRLIMGLLAGQNFPSELTGDASLSRRPMRRVSEPLAEMGANIEVTDGHLPAVINGEQLHGVDYHLKVASAQVKSALILAALQADGISILVEKQPTRNHTEKMLRAFGAEIETESDDVTITVYPEPHMKGITLNVPGDMSSAAFFMVAASLVPGSKVTLRNVGMNDTRTGLYSILKRMGGRISLSNEQSTGEPTADLTVEAAELKPIEIGADEIPAVIDELPLVALLAAKANGISKITGAGELRVKETDRISAIVTEFRKLGIDIQELDDGFIIDGRKPWQVLDSKLDSHGDHRIGMVMAVAALLVDQPLTLTGADSINISYPEFFDDLATLIER

SEQ ID NO: 3829 - protein, 283 aa, Lactobacillus buchneri
MTTVLISGLGLIGSSIARIIKNGDTTVEIIGSDPDDDSAQFLLDHQIIDQRADFAQAATQADLIILAGPVSVILRQIDELAQLKLKEQVLVTDVGSTKQSIMTEAKRLTHKGVAFLGGHPMAGSHLTGSRNGSIDLFNGSKYFLVTSSQTKQQLRDFEQLLDSANVDWTEITAETHDKLVSELSHLPHVVAATLVNSVADGLAHDPVGLKAAAGGFKSMTRIAASDPKMWTAIMMSNSQAIAQELATFQTALSHFEEAIQDQDEAAIYAAFAKAEQIRKSLDD

SEQ ID NO: 3830 - protein, 173 aa, Lactobacillus buchneri
MKLILVGFMGSGKTTVGNLLAQKLGLPYHDLDDVIVETAGKSIKQIFADDGEPAFRQLEHDALKASLADDGILGTGGGTPIQAANFELLKASDVPVVLLDVMPETIIARLKNDTDRPLAQQLGLHGLVDLKGQRDTLYQQVSDFRIATDDLTPLEVVDAISQEGFLKMSFGRN

SEQ ID NO: 3831 - protein, 290 aa, Lactobacillus buchneri
MIDGHTKLFGLLAHPAAHSLSPLIHNTSFQVTGINGIYLAFDVTSAGLADSLAAMRAMHIGGFNLSMPLKTDVLPLLDEITPRAERLSAVNTVINRDGRLIGDSTDGQGWVDALKQDDITIDEKVVTVLGAGGAGRAIISAAVDAGAKQVYVFKRTNDLFDARKEQLEGWSDVVTVLPYEDEGLIAEAFDESQIIANATNVGMAGDQSLPVSQSVMNHLTPRHIVSDAIYFPLETPFIHAAKQRGSRTYNGIGMLVNQAAGSFLEWTGQRMPIIPVIEAVHQAVLQRSKN

SEQ ID NO: 3832 - protein, 176 aa, Lactobacillus buchneri
MQRNTTYKMVLTAILSAIGVVGGSMFEFTVGVAKVAPMQHLINLISGVLVGPWWAVTQAFITSLIRNLLGTGTILAFPGSMIGAFCVGWLFQKTNRLIIAAFGELIGTGIIGAIVAYPIASWMMGTTGAIYLFIPSFFLSALVGVIFGYIILKSIWKRIIVPQQDKLGIGRKTNRD

SEQ ID NO: 3833 - protein, 337 aa, Lactobacillus buchneri
MATIKDISRLAQVSPGTVSRALSPDKSEYVAKETRDKVREVADKLGYKYSLAPKPDKNQLNFALITTLSLKEETRDEYWRFVRRGVYEAAKSQNISIKRVVRLDEGVEPNDFAAYDAVIIVGSLSKSAINAIKSFNPNVVLVDGGSDVDDVVDTVDTNLAQLTDKALNEMTPHAQTIGFIGGSRHEVNLDGSQGRIIDDARTLTYKTWCSINHHQPIVKLTDWTTKQSMDATDDLLNEYGNQLDGLLVASDPLSIGVMKGLAKHHVVPGKNVKIISFDDLEFASYLTPSLTSIWLPKVELGYAAVLHAETLVKFPRDWHVRNIIPGKFHYRETFNPD

SEQ ID NO: 3834 - protein, 656 aa, Lactobacillus buchneri
MASNTNITTGRRITSRLSYSFGAFGHDMFYATLSTYFIMFVTSHLFDKSAGGQNDRMIFWITTIISLLRFVELAIDPFIGNTIDNTETKWGHFKPWILAGGTVGSITLAILFTNMGGLNQSNPLLYLLIFGVLYITMDIFYSFKDVGFWSMIPAISFDSAEREKTATFARVGSNIGANIVGVIVMPLVVFFSINANHGQGDLRGWFMFGAIIGLISWLSAVVVAMGTKENDSLLRKNAEKTRMRDVFKVLARNDQLMWLSLTYGLYTSGIAITNSLELYYFTYIMGKPGEFSVLASLNMVIGIISVLLFPPLAQKYSRRNVFFLSISIMIVSIILFTFAGTSLPLVLLAAILFYIPQPLIFLVVLMILSDSVEYGQLKFGHRDESLTLAVRPLLDKLGGALSNWVVGIAAVLAGMTAGATASDITTHGQIIFKLFMFGIPALLILSGTFIFFKKVTLDEKEHAKIVDELEKTWNEHLETNGEESMADIVKEVAKDTTYKAPISGTMIALSDVSDQNFASGNMGKGFAIKPSDGKVFAPFDGTVEATFPTRHAIGLRSDNGILTLIHIGIGTVEMRGTGFVQYVQKGQHVTEGQELLEFWDPAIKKAGYDDTVMVVINNWKDIKDFNYTVESGDVNHGDDLLTLSKPEESSDDSDQK

SEQ ID NO: 3835 - protein, 741 aa, Lactobacillus buchneri
VAIRIEDQNLLFHLQTDHTSYIFHVMENGELGQIYYGKRVHSKPSYDNLATREWHNAAAVWRLDHKDVQPQVLKQEYASLGKGDFRYPAYQVAQANGSRITEFKYESYELVDGKQRLAGLPSAFDDTDDDAQTLTIALRDKLLGLVMHLNYTIFPHQDVIIRSAEFQNQGNEKLRLNSAASAQLDLPDADYDFIQFSGAWARERHMIRTHLRSGVQSVGSLRGTSSHQQNPFVMLARPNTDDAQGSVFGFNLIYSGNFSDQVQVDQYDASRVLVGINPEEFAWNLKPGDKFQTPEAVLSYTDAGMNQLSQQMGAFYQDHLVNPRFAHEQRPTLINNWEATFMDFDEDKLLSFATTAKKLGLEMFVLDDGWFGHRNNDDSSLGDWFVNEPKFPSGFGTFTQKIHDLGLKFGLWFEPEMISIDSELYKQHPDWLINAPGRHASPERQQFVLDMTRSEVVDYLFDAMSKIIEMTKLDYIKWDMNRNITETYSSQLSADDQLEVPHRYILGVYQLYDRLVKAYPDVLFESCSSGGGRFDLGMMYYAPQAWTSDDTDAVERMLIQFGTSYGYPQTMMGAHVSAVPNDQVGRITSLKTRANVAYFGDFGYELDITKMSPEEQQQVKEQTAFYKEHRQLFQFGKFYRIDNPFANGGNVMSWEVVSDDQQHAIAARYQILNRPNTGYIRLYLKGLDPDTKYTVNGGSEQFYGDELMNAGLFVSDILHETHGTDQSADFNSKLFVIDAVK

SEQ ID NO: 3836 - protein, 202 aa, Lactobacillus buchneri
MNNLERKAKHLLYHPDVPELMDRQQEYLEKLYSFNMTSPRETDKRSQLLAEMCAEVGENCYIEPPMHANWGAHHLHLGSDVYINFNLTLVDDDDITIGNHCMIGPNVVMTTAGHPVLPILRQNSYQYNFPITLKDNVWIGSGVQILPGVTIGSNTVIGAGSVVTKDIPDNVVAYGNPCRVARPINDHDKEYYFKSHKLDVWE

SEQ ID NO: 3837 - protein, 496 aa, Lactobacillus buchneri
LSKRDIMIVTCALLLSNAMSGLDNTTINTALPAIISDLHGIELMGWIVAVFLLGTAVSTPLWSKLGEHIGNKRSYQLAATLFVVGSFLQGMAPNIVFLILARTLMGIGNGGTVSLPYIIYARMYKNPRKRMQVLGFVSASYSMATIIGPLVGGYIVDTFSWHWVFYLNVPIGLISIVLVQIYYKVSHETRQTQAVDYRGAIMMTIGLVGLLAGIEMIGNANLILVLAVIGFSIIVLIVMGILEENVDDPIIPSRLFKNLPLMIDFVLFTLIWGAFIAFLIYSPMWAQGLLATSALIGGATQIPGAFTDFIGSEVVAPIRNFLSPQRVIAMGIVMLMISFIIMVISGVQTPYWVLLIAGAFEGFGNGACFNELQVKVQQDANPTDIPIATSFSFLIRMLSQTFTASIFGIIMNNALRDGVSKAGGSISMKMMNELSDASSSGSLPLHLLPQMRLILYNGLHNIMWLSLILMIVSLLINIWAQKLEHDKFVKRAAKAS

SEQ ID NO: 3838 - protein, 614 aa, Lactobacillus buchneri
MLSYFALITLVKLSGLLIPFIWLLVIADRRGRTYGTLAIVLLFIVSYINTYFNLPDLAYPSLIDGWLMWFIFGMIVVAALRRFLYSPHAAVARTTEAGDGIVGQIVQRFTGAFGWLGKIAMVAVLAVIVFIILGSITSLVTKMNPRPAVQSIQTDMNDDTKNAPMPVIKNSAETPVVNAPQTISTDMNNSLNSFKNSNVYDLNHMRVQMYKGKMIYVAPVEFSGGFWRYLHYLKVPGYFRTNATDKNADPKFVAKPMKYTPSAYFNNDADRRISAHSLGYSMVGATAQLEIDDNGTPYYVRTLAKPISYLNRNYDFKHYKVAVLNTITGKVKVYSPKQVPKFVDIAVTPEFVSQEVSMFGRYRHGFWNATSFGGHSGVMKPTTAGTEGGDKLTPYAYKGRVYYFTGMTSVNEHQSSILGYTFVDARTNTLHYYREHGNVMTPERAISYAQQDINPQNYRGTLPLLYRINGDPTWVVSMLDRDNNSFMKYVYLLADGNNQSGTYAIGDDAQSTLAIFEQRVEAKTGVAASVPAGKTVSGTINRVVRTDNSLLFILKNNNQVYKIDTSAKNFNPLLQFIAEGDRVSFKAETVTGNSLATANVSLSTFKDTSLTAKK

SEQ ID NO: 3839 - protein, 291 aa, Lactobacillus buchneri
MSKIAIVTDSTASLSDEEVQRLGNVTVVPIVVNMNGTTYREGIDITNDEFYSALAKAKKLPTTAPPTPMEMLKVYDQLANQGYDQILSIHLTAGITGFVNNLRTVVRGYTNAQVEVYDSHITIEPLGYLVKYASMMANQGESMSTILQNLDDVRATIDEYFVVDDLKNLVTGGRLTNAAAFAGGLLRVKPLLTLNDQHQIEAIGKIRTMKKALKHLDEEFNTQYQQVAYPLHVMVTGTNNLPAVQKWCASLKPKYPKASFQVGQIGPVVGTHIGSNAFVILWCKRVPELTV

SEQ ID NO: 3840 - protein, 362 aa, Lactobacillus buchneri
MDTEANKPVDKLTVKDYVYLVSAGVSNAVLVMLGVGLLTQTIANFVNWPQLHQVGAIAQWLLAPAFGAAVASQLKTNTLVLFSSMIASTVGANAVYFISSGVHAATATGNQMAQAAGTGVFTTGQPISAVAAGLIAALVGKYLTGKTPLDMMLVPLASTLVGSIAGLGLASVTTPALNWLSAFIAQSMQVNPILGSMAVALAWSLFLMTPASSAALAVAVMLDPLSSGAALIGTTAQFVGFTVISWRQNNLGANIAQGFITPKVQFPNLLANPRLAIPSMTAAVVAAPIATMFFGFKVPYTLGGLGLNSFIAPLNLASTNMNMFVAYLAMGIVVPAVISIVLYRVLLGMHWVKDQQLHLEIV

SEQ ID NO: 3841 - protein, 163 aa, Lactobacillus buchneri
MKANKFAKTMLLAFSITGVLLGGAVGAHAATAGTNSQPIAQTSVVSAAQGAWKPVYSSMLGKPYKHKVIKYSPTGWGDFEGGDRKAYFSSDKHIQYRYIKKSRTMIYRYNNHDKALRSKYNYQKIVLRHGHKTPEYSYYYKLGKQKWVYTVTYKFWLVKPVKY

SEQ ID NO: 3842 - protein, 149 aa, Lactobacillus buchneri
MNLLGTRQHQITLKRLLMLAFFSLLVLVPTSASASTNWKHLDMNSLGTATKMKVLKYNSLNWGEYYDDQSDLFKDTKHVQYKYAKRTRTLIMRYRNPQQFLLKTKYNYRKLIYRHGHKNPIVTHYFKVGHEKWKFATTIHYWLKKPIRY

SEQ ID NO: 3843 - protein, 122 aa, Lactobacillus buchneri
MTKDIPQQGDLIWIDSEPHAGLEYGGHNPDPSNTFRPLLVVSDKAYNQRTGMIIGFPITHATKIKAPFQITLSSHKIEGHVILTGLLGYDYIAGSGKIVDHVNAAELAQAMTAVKDIFGFFD

SEQ ID NO: 3844 - protein, 80 aa, Lactobacillus buchneri
MTVKTRRQGNSIMVTIPASFNIGENVEFEPIKDENGVISLLPVRHNIYSADSNYDLRKAMEEENIGDNGTPVGREDIWND

SEQ ID NO: 3845 - protein, 197 aa, Lactobacillus buchneri
MKVIKSIFSWILPIAIGLALALLLKAYIISPVRVDGDSMMPNLQNNEHVVILKAKPIKRLSVVVFNAYKLAPDTQPNTEFVKRVIGIPGDRITYTKTGHLYVNGKYIKQPFISRQQQTTGTLSNVDDNGFNLSILSKKWRRGGQTAVVPRGQYFVMGDNRNISYDSRYWGFVPKSHMEGVVYTFPWDANRQEINNYG

SEQ ID NO: 3846 - protein, 116 aa, Lactobacillus buchneri
MLDVIKSLDRLTWNTQHHFAHIEAQHDFIRAWAIQFELGYTDVRVVQMALQLDGKHHDLLTKFTAAYDKVYDYEYAFVAGGLEGFNEKYGDKIEDYRQAANEFLGLIDQVRELNGK

SEQ ID NO: 3847 - protein, 273 aa, Lactobacillus buchneri
MLLKRWIRFVYVTVAVMGFVFVAGTICVNASDNVNQGTNDEQVGAVATKVGNTQKVGITSGTTSDNSVDENRQNSALAQRPKATASNPSNKKIVTNRLQMTKPKKAKLQKNKASKKSVTVTTAIPWSKAKKLDKAEARREAKVAEIDKLKAELNKLKKEQAANNKVPATNQTTGQETNGNVTSNNSSNSTSTQSTQDTSGSGQSAATSQQTDQLTPSQQADQDAQDANTQLQPSLTRAQITYYQTASVSNVVGQGVSIVNAIAEVISALRSLI

SEQ ID NO: 3848 - protein, 147 aa, Lactobacillus buchneri
MNKVKFNNTRCLRMLLMVLLVPTLGMLVTESGVHADQSMSDSQTASSNENNNNNNNNSNNNNGGIIIPGGGSINNGRNSGGIVNTGSTIGSGTVSNNPSTLNTPSSQQVVNSNSNRSNVNSGLTNGNGSSIASQNSNQPLNGSGMSG

SEQ ID NO: 3849 - protein, 84 aa, Lactobacillus buchneri
MSKKAIGMKLGFNVSKSTTVTVHIPYKTSGKGREVVEYTVRKIRYKITRTKTITTGINGYVTSRKKLVAYVYKYDGIIGRVVKD

SEQ ID NO: 3850 - protein, 80 aa, Lactobacillus buchneri
MKYLQTSAVFLSFGLLTVFFMQIIQEISDTFTIGGGPTDAPINYWASSMILVPLAFGALFIITFALGMYQIYQEKKQSKK

SEQ ID NO: 3851 - protein, 1021 aa, Lactobacillus buchneri
MPKREDIKKVLIIGSGPIVIGQAAEFDYAGSQACLSLREEGYSVILVNSNPATIMTDDEIADKVYLEPLTVPSLKKIINKEHPDAILPTLGGQTGLNLAVELSKDGILDELGIELLGTSLQTINEAEDREKFKDLMEELHQPIPDSKTVYDLQDGLDFAHKIDYPVIIRPAYTLGGTGGGIAHNDDEMTTILNRGLTMSPSTECLVEKSIAGFKEIEFEVMRDHHGSSIIVTGMENFDPVGIHTGDSIVFAPTQTLTDKEYQRLRDASLTIVNALKIEGGCNVQLAQDPNSEAYYVIEVNPRVSRSSALASKATGYPIAKIAAKIAIGLNLDEIMNPITQTTFAMFEPALDYVVAKIPRFAFDKFTNADRKLGTQMKATGEVMAIGSTIEESLLKAVQSLELDQQAQTDLIPAYTRNMSMGDLLEKIKTPTDYRLFEIFAAIGKGATIQQINRSTQIDMYFLSKLENIIKMQQQMTDGLLSADEVLKARKLGFNNTMIQAIHHATDDELTKLDKMSDQHLVYKMVDTCAAEFESTTPYYYSTVGNENESKPLGNSIVVIGAGPIRIGQGVEFDYATVHCVKAIQAAGYNAIIINNNPETVSTDFSISDKLYFEPLTIDSVMNIINLEQPIGVIVEFGGQTAINLTEGLTKHGVSILGTSLHGIEQTEDRHQFEDLLIDQNIAHPKGATATDAPEALEIANHLGYPVLVRPSFVLGGKGMAVVHNDDELNEYLIPALKNSHGEPILIDQYIPGTECEVDILSDGNDVFVPGIMEHLEGAGIHSGDSIAMYPPQTLTDDQKEKIVAIATKIGKQVHAVGMMNIQFIVADEVYVIEVNPRASRTVPFMSKIVKLHLAQLATQLILGKSLAEIGLKPGLHPEPAKVYVKAPVFSFAKLPGAPTALSPEMKSTGEDIGAGHNLQEALHNALFDSYHIDTNHLTGDVLLSAFDANNASLVEQLKGSGFGIQTYHEGMEWPSNLAFALSSEDETVDQKQLVANALSHQVPVFTAQDTVMGVFQPQLIK

SEQ ID NO: 3852 - protein, 352 aa, Lactobacillus buchneri
MKKYLTLENGDVFVGEACGDLGAEIDGELVFTTSMTGYQETLTDPSYKHQIISFTYPLIGNYGISLGTNQSDTVQAAAVVVKEMTDQVFHYQSVISLDAFLKQSKVPAISGIDTRQLTKIIRRYGTMKASLTNHPIVDQPKADRSASIIKSATLSAGDAKDVEHVVVVDFGVKDNIVKSLQRPGVDVTVVTPESTFEDIANLHPTGILLSNGPGDPTDYSDFVPVIQKLQDNFPLFGICLGHQLLALANGATTYKMTFGHRGINHPVKNLITGDICITSQNHGYAVDVDSVKDTPLEVTALEVNDKTCEGLRYPGRPVFSVQYHPEAAPGPHDATKLFDDFIEMMHVNGGVH

SEQ ID NO: 3853 - protein, 315 aa, Lactobacillus buchneri
MMQITKPVSFENVVSMEDLSAEDVLSFIHEAQDFKAGKQIELKRPVYAANLFFESSTRTHTSFEMAERKLGLQVVNFDPSNSSLSKGESMSDTVKTFQAIGVDLVAIRDKKNEYYKDLIADPNVHVGIANGGDGSGQHPSQSLLDMMTIYEEFGHFEGLKVAIVGDLTHSRVARSNMEVLTMLGAHVYFGGPKKWYTEEFAKYGEWMPIDDLVEEMDVMMFLRVQHERIADDENGAFSAEKYHAQYGLTAERESRMPQHSIIMHPAPVNRGVEIADELVECDKSRIFEQMHNGVFVRMAIMTSMLRNRDLIKEEY

SEQ ID NO: 3854 - protein, 424 aa, Lactobacillus buchneri
MKRIIANGQILDRGQLVKRDILIENGRVAKIAEDISTDGVDEVIDAKGNFVSAGLIDVHVHYRQPGQEQKETVKTGSLAAAHGGFTTVCAMPNVTPAPDSVNNMEALIKLNHTDGAVHIKQYAAITTNRGGDELVDFKALKDAGAFAFSNDGNGIQKSSTMYEAMQQAAKLDMAIVEHVQDDALTYGGVLNGGAAKRLGMKEMPWVSETAQVARDVILAEATGVHYHVCHASSKHTVNVIRAAKQAGINVTAEVSPHHLLLSDANIKEDNAMYKMNPPLRGEDDRQALIEGLLDGTIDMIATDHAPHTKADKDQSIATAAFGITGSETAFSMLYTRFVKTGRFTLAQLVNWLTKQPASVFKMRGAGSLAVGQPADIAIFDLKHEHEIKESDYLSKGKNSPFTGEAVYGDTVMTLVDGDIAYKRS

SEQ ID NO: 3855 - protein, 183 aa, Lactobacillus buchneri
LFKTWHHPGKILDQKNIYTGRVFAVDQLHIQTPDGLKIERDLIKTDPTITILAISPADQVVMSSEYRAGVNSDSVSLPAGIVNPGETSEQAAARELREETGYVAQSVTKMTRITSSEGFMDQFADLMLIKFDPSERVERHFDQDEFVNSELVPLQQIVDWIREGKVNTAQAVSAIGYYTMFLK

SEQ ID NO: 3856 - protein, 104 aa, Lactobacillus buchneri
MNWVFLIIAGIFEVVWATAMKYSHGFTNLMPSIVTIVGMLISFFLLAHATKTLPLSIAYPVWTGIGAVGTVIAGIILFGDKISPITWGFVILLLVSIVGIKMTS

SEQ ID NO: 3857 - protein, 136 aa, Lactobacillus buchneri
MKDVKVVYPIIIIKDPNDKSVPYIVSIPNLGGYTQGTSIENSIEMGRDFIGLKVLDLIEDGGSVPKSVYSLPDTKPNELATLVDVNISAYRRQHDSHPVKKTVNIPNYLNEKGIESNLNFSQLLTKALEEKFGIKK

SEQ ID NO: 3858 - protein, 57 aa, Lactobacillus buchneri
MKRKRLLQLFERHGWYLYRHGGNHDIWTNGKEKEVIPRHPNINEWLARDLIRKHQLR

SEQ ID NO: 3859 - protein, 388 aa, Lactobacillus buchneri
MYQVKTYNAIAQAGLDRFSDNYQINKTDDADAYLIRSVNLHDQEFPKKLKVIARAGAGFNNIPLDKATANGTAVFNTPGSNANAVKELIIALLVASSRNLFAAADYAAHNSGADISLRTEKDKTKFKGTELTGRTLAVIGVGHVGSLVANAASALGMKVIGYDPYLSADAAWHISTTITRATTLGEALQQADYVTVHVPKNEETTGLIGAEQMAIMKDGVKLFNYSRDGIVDNEAAVDYLDARKIRTYYTDFGENILLNRDDVVVTPHIGGSTLEAEANGATQGANTIMTYLETGNIENSVNLPNLQVPFNTPYRLTLIHKNIPNMVGQIATLLADAGINIESMSNAARKDVAYTIVDLDNLNNEEEHQLVDRLSKIDAVFRVRVLQK

SEQ ID NO: 3860 - protein, 358 aa, Lactobacillus buchneri
MTVYNFAAGPATLPDPVIKQIQAELPSINGSGMSIMEISHRSKMFDDIINAAEQDVRDLMDVPDNYHILFFQGGGTGQFAAVPMNLATKHKKIALLDSGHWATRAGDEAANLGYQVDVLASTKNQHYQALPQLNQRISANDYDYLHITTNNTIEGTAYHQLPEHGDVTLVGDLSSNFMAEQYNVNDFGLIFGGVQKNLGPAGVTLVIVRDDLVQPVDHIPSILNYNLFVKKNSMYNTPPVFNIYATGLVLKWLKDQGGIAGIEKVNRQKASLLYDFLDDSKLFANHIKASDRSLTNIPFTTGDADLDTQAITAATEAGLMNLKGHRSVGGLRASLYNAMPLAGVQALVDFLHNFEKQH

SEQ ID NO: 3861 - protein, 209 aa, Lactobacillus buchneri
MTDFYFVRHGQTAANAAGLKQGTINSEITYLSETGKQQVESLRKGFDISFADRIIASPLQRAKDTAAILNQSANLPVTYDNRLLEISYGDWDGEKNTDLMSKYPEFFDFTLNDVLPAYADVAHGETFDHVIDRVAELMQETATNYPNDKIILVTHGFTIKAAVLAAIGRPKDMMVIEEPDNTSVTRITLQTTTHSYYLRYYNRVVNSQF

SEQ ID NO: 3862 - protein, 35 aa, Lactobacillus buchneri
MQMSAANMMCCSMCQAQLSADRGFFGKRLDFWDKL

SEQ ID NO: 3863 - protein, 546 aa, Lactobacillus buchneri
MRKLRSLLLLALSAILVVTLAACGKTATKSNSQKQTLNLSTTAPLDTIDISKSTGYGQTGNVFESFYRLGKDGKPTAGLAKSGKVSKDGKTWTFTLRNAKWSNGDPITAQDFVYSWRRTLKPSTKSTYAYLFSGIKNADQVNAGKLSPNKIGIKALNNKTVQIQLEKPIAYFKVLMAYPLFGPQNQKIVDKYGKKYGTNSKYMVYSGPFKIQNWNGTGNKWQFVKNNRYWDKQAVKLHKINYTVVSSPTTGLELYQQNKLDLTPLSNEQVKHYKGNKEFQQYPYSFIGYLKYNFKDANQTKRKAMSNKDIRLAISLAIDRQQLTKKVLGDGSDTPTGFVASGLAKNPKTGEDFAKEQTVPNTVDYNVKLAKQHWQKGLKALGTKKVTLTITASNDDPTSNPITQYMKSELQRDLPGFKLDIRNVPSQVANQEVLKGDFDLSLSGWGADFNDPISFLQIPETGTAYNSGKYSNPAYDKLIKQAQNQDANNADKRWNDLVKAAKLFNADQGMTPLYQQVTSYLQKPDLKGVIHNTAGTQWSYKYAYMK

SEQ ID NO: 3864 - protein, 308 aa, Lactobacillus buchneri
MTRKIGVIGMGHVGSTAAHYIVANGFADDLVLIDINEDKVKADAIDFEDAMSNLPVHTNITVNDYSALQDADVIISALGNIKLQDNPNDDRFAELPFTSKAVKSVAQKIKDSGFNGIIVAITNPVDVITSIYQQITGLPKKHVIGTGTLLDSSRMKRAVADELNLDPRSVTGFNLGEHGNSQFTAWSTVRVLSHPITEIAKERGLDLDALDKAAREGGFNVFHGKKYTNYGVATAAVRLANTVMSDAHTELAVSNYREELGTYLSYPAVVGRDGIIEQVQLQLTDDEKKKLQISADYIKTKFKESMEN

SEQ ID NO: 3865 - protein, 356 aa, Lactobacillus buchneri
LANYETVFHPDGYNSPEYRSLNYSYQNKMAELFSHRRIDYPAKELQFEIETVKISSTMTQQQYLKLQSLVESFPETQRSGDAPVIGKDDYQSIILYHDYRLFDSTQYVVRSPLGFGYTVSKLITITSEPAGGPHHQVKVTLAINPNRFVGVPEEPLLRLVIEEVLPLMVIPQISEMDLTLDMPLIMNNFHVQMGGQAGTKQQITQRLNDHQEYELSRIAYVDPQQTRKLVVADKFQSLLDNQLLVADTDYISAREAEYYRDQVGERQFLTRIELAVTTPNAVMRYMKNHEWLMRDISIEYRDNSGISRFAGTDYATNGKDFRRSFNRMLTYRLKEVQPRARKLPYLTDAIWQNTLK

SEQ ID NO: 3866 - protein, 314 aa, Lactobacillus buchneri
MTRKIGVIGMGSVGSTVAHYIVSGGFADDLVLIDVNEKKVKADALDFEDAMANLPNHTNIAVNDYDELADADIVISAIGKLQLQRDNPSNDRFIEYPYTQKAAASVAGKIKDSGFNGILIVITNPVDAITSIYQAVTGLPKKHVIGTGTLLDSSRMKRAVAKKLHIDPRSVAGYNLGEHGNSQFTAWSTVRVLGKPITELADKEGLDLDKIDEDARMGGFVVFRGKGYTNYAIASGAVRLANVVLNDARTELPVSNYREELGSYLSYPAIVGRDGIIQQLQLDLTDEELAKLQNCANIIKEKFEESKAKDFATE

SEQ ID NO: 3867 - protein, 134 aa, Lactobacillus buchneri
MKKERVEAFTDAVLAIILTIMILEFKTPESFAISAILDQVPYLISYAIGYLFIGVAWYNHHYMFAKTNWITQNVYWANNLWMFTTSFVPVATAWVGRGLNEQGPEIFYFIVFLAWSSAYYYLSNRLIKANEKDH

SEQ ID NO: 3868 - protein, 55 aa, Lactobacillus buchneri
MVIYRYMSNWKLVAAQLILSIAVLKFMPALQMVIVTLMIIFIGARFNADSDRLFR

SEQ ID NO: 3869 - protein, 304 aa, Lactobacillus buchneri
MSLSTFSQLVELRAKAASIFPFFTGLFFSWYLLDSVNGLYATLFFIAMILFNMTVDTLDNYNDYMHSTAEEWKTGTNIIGRDHISLNLIRFMIVIMVVPSALIGIFLVFKIGLPLLWMGLICFAIGIMYSSGPHPISSTPYGEVASGFAMGVMITLISVYVNSYQLFTWNASLLGQILLASSPLFFWIANIMLANNICDDQEDEVNHRWTIVHYIGKKNSLLMFNTANVLAVLLVFYAMYVGVFPLALFSILLAVPLIIKQSLIFNHEQIKTKTFVCSVQIMIFGSLSLCVGFLGYFIYTLIAH

SEQ ID NO: 3870 - protein, 237 aa, Lactobacillus buchneri
MTLTNKTPETKVESLFDQIADNYDGMNSLISLGNHKHWRKLVMQQLNVEPGSFAIDVCCGTGDWTIALAKAVGPSGQVVGLDFSEEMLKLADKKVRAAGLQDRVTLVKGDAMQLPYDDNHFDVATIGFGLRNVPDADQVLHEMSRVVHARGQVACLETSKPTNPVIKFGWRVYFDLVPLMAKVAVDKYQEYAYLQKTTAEFVSAQQLVEMFQNAGLVDVHYRPFTFGAAAFHWGMKP

SEQ ID NO: 3871 - protein, 392 aa, Lactobacillus buchneri
MSKLSDKMNKRVAALTPAAILTFNQKISAIPDIVKLTLGEPDFNTPEHVKQAAIKAIDDNESHYTNSRGTEGLRQAAANFLNTKYGLNYDPDKQVIMTEGATGAIYSALTAMINPGDTVIVPTPIFPLYVPILMLAGAKPIFVDTSDNGFVLSPEKLSAAIEANKDTVKAVILNFPNNPTGVTYHKDDLQKLADVISKHDIICLSDEIYSELTYDGTHVSMGSILPEQTLVMNGVSKSHAMTGWRVGMICGPKDIINEIAKVSEFTITSLTTNAQAAAEEAFKNGMDDALPMKKEYMTRRDLLVAGLEKAGFSCPNPNGAFYVFAKIPAGLNQNSEAFCYDLAKEAKVALIPGSYFLPGGEGYVRISYAASEENIQEAVSRIQKYVDKQSVK

SEQ ID NO: 3872 - protein, 330 aa, Lactobacillus buchneri
LKILMYNVRPDEQKPLDGWVKQNGVQVDTNSVPLNADTVDLAKGYDGIVIQQHGSVSDPTIYEKLHSFGIKQITLRITGYEIIDLDQAKQNDLVVTNVPAYSPRSVSELVLADVMSLLRHIGEVGEREKHGDFSWKGVEAREIHTLTVGIIGAGKIGSAVARIFRALGATVIAADPIHRPELNDTLTYVDHETVFKTADIVTMHTPLTDETNQMINADVFKQMKPSAIFINASRGQVVDTGALVNALENQEISAAAIDTFEGENTIVGQDLSGKQIENDNLKKLLAMPNVNVTPHIGFYTEVAVQNMVEIALNDVVMILKGQKSPHEVGE

SEQ ID NO: 3873 - protein, 142 aa, Lactobacillus buchneri
MNLPAEPSARLNGRELIMNTLNGLSVGIIVALVPGALLNQLLKALLPVFPQAAFFLTLTGMAAVLMAPISAVCVGMMAGFGFAGLIGPIAAVNGYGNANLMNIVLVSLLFFVIPITLGYVSNYLFNSKLSYFDAQDFELDYL

SEQ ID NO: 3874 - protein, 102 aa, Lactobacillus buchneri
LGTEFAVLVLLIFVGGAIYYYYFSKQEPSMIVGYRTKQSRSTTAKWRASQKWFYQGAITCAAVVVVVNLVTPFSIGVNLVVLLVYLFVISYFIERRLREMGD

SEQ ID NO: 3875 - protein, 441 aa, Lactobacillus buchneri
MANYDYDVLYIGSGHGTFDGAIPLAARGKKVGVIESGLIGGTCPNRGCNAKITLDAPVALTRQTERLQGILNGSLAINWTANEKHKQEVIEGLPDMIGGLMKSVNIDIIKGHGTFQDAHTVMVDGEAKTAENIVISTGQHPHRLDIPGTELAHDSADFMNLTHLPANITIIGAGYISLEFATIANAAGAKVTVITHGDKVLRKFYQPYVKQIVADLKSRGVDFVNNTEVANFEQDDHNFIVNYKGGQIKTNWILDATGRMPNVDDIGLDKVGVDYSEKGIKVNDHLQTNVDNIYASGDVIDKDQPKLTPTAIFESTYLMHTFAGDTTDPIDYPAIPSVVFTSPRIAKVGVSVEDAKKEGFTTKENHLPDDWYRQVTKEEIGDNTLVYDKQNHLVGATEISDQAEDAINALLPAIVFKFEPAQLERLVTLFPTIAADAWGQI

SEQ ID NO: 3876 - protein, 168 aa, Lactobacillus buchneri
MRRKDREVTDIDEIKQILQDSHVIHSGFRTADYPYVVPTNFGYEFDDDNHLTLYIHGAPVGRKRELIKEDGRMGFEIDDGGQLMVPKDPKQNTPSFAYRSVMGYGDAELVDDPAVKKHALQVVLAHETGQQLGEFTVSDKTIAYVGIIKITVKEFTAKAHGGDDPDFE

SEQ ID NO: 3877 - protein, 77 aa, Lactobacillus buchneri
MSMQQLRDRMIQYLIITVPLAGLIVSILGICYFMWWSGDHSTAALIYSLIPFGMGVLISIPGWFWKHEAQKHDHRKE

SEQ ID NO: 3878 - protein, 318 aa, Lactobacillus buchneri
LKKLRSLTQKELDQQLHSDAIYLVLFVLTILCFSISWAQYTAYKNDASSLIWIQQRDKRAGVDVDQILAGGPITFSNGEKAEVVTDLKDAGEKVKQDLVEMAPRNSFDHILGSSMFIVFPITMVIYTISFAYRELKNNQVKIKASMNSIQNVVLSKLISLSMLTFLSLIFICLTSFIFQLGFNNFIHIPNKLALIRYLADGQSYLAQAPLQFLSVFGLSLIAVIVSYYLTLLLKRPWLAGILMFGYFSGIPVLGSFDFKQNAVLLYSKLFHENSPFTPIQINGDFTLMGFVGCCLVTLLIAGVIDYIVTRNHYLTRTS

SEQ ID NO: 3879 - protein, 345 aa, Lactobacillus buchneri
MFFIDTSRNGKPVYDPIVNQSLDNYLVNDLKLPGHGLIMYVNQPAVIVGVNQNAYAEVNMPYLKEKGIKLVRRTSGGGAVYHDYGNIIFENIVINDDQHFGDFKYFAQPIIDALHDMGATDAEMRGRNDMVIGNQKFSGMTMFKVGKSYAAGGTLMFDLDMDVATEVLTPEKDKLESKGVKSVESRVTNVKPFLKPEFQKLDIEGFKKALLLRLFNAKSLDDIETYHLNDHDWSIIDERLKGKYDTDEWNYGKNPGFDYYVSKHYDIGTVSFNYSLNGNQISDIKIYGDFITGGDISVIEKALKGVDLSKDALVDALNQVDIKANLGDISAAELADLLLEKTRIN

SEQ ID NO: 3880 - protein, 597 aa, Lactobacillus buchneri
MNQAPNQHDDSGEQNGVSMMGMFKFVFGTVLKRPWILIVNVVVLTILSLMDFLLPQFNQYIIDHVIPNKSTAQLAVVVGLLLLTVTISGIFTYVSTYYMGVMSQGAITNLRNQLYQYLIRLDTHFFESSKTGDLMVRLTSDINNLQNLISPNMLSLIGSLFTFVGVLGFIFFVNWEMALAVSLTFPMIFVVVRIFRTRIRNSYQKARQSQALMTNQLQNTLTQIQLIKSYTTEDLESSRFDKLANMNKNNIIEATRNQAIFSPLVTFIEYLGTAIVLFLGTLFVFKNQLTVGQLVAYLSYVGILQSPISAFSRLLNQFQQSLVSYGRIVSIMGLKPAIVDEDDAVGFPQIKSGVQFKHVTFSYASDEPKSPHKAAIQNVTFDIPFGKQTALVGHSGAGKSTITDLLDRLYDVDSGDILFDGIPIKHIKLKSLRQNIAIVSQDIFIIDGTIADNIRYGTPGATEDQLWDVAKLADIDAFIKGLPEQMKAQVGERGIRLSGGQKQRIAIARALLKDAQIVVLDEATASLDNESEKTIQHALENLMEQRTSLVIAHRLSTIHNADQILVVDNGKIVERGTHDQLMNENGYYKQLYEAQFE

SEQ ID NO: 3881 - protein, 284 aa, Lactobacillus buchneri
MIKHMKGKGIRFELVSEPDAIQMLATKNYYFKLTSYRKNFHQIDGKYENLDFAYLTDLASIDMQLRRYLLGISLDIEHGIKTRIIDLITKDPEEDGYSVVKDFSTFNQRGYDQTMKYLKRNDYLHDMYVKHRNHPSIWMFLEVATFGVLSRFVDFYYHRSRNKDVKLAHILLKYAKHIRNASAHNNAIMVNLFSAEEKVKHRNTTVVMFATKMGIDASLVTDMKVNDLVSLYSLHRRFSSVGSQELTRKEGQKLLKRASKHANYYTHEPVLIKFYQLFSKLINS

SEQ ID NO: 3882 - protein, 160 aa, Lactobacillus buchneri
MKTIYDYKETEMSGKTIDLSEFKNKVVVIVNTASKCGLAPQLEGLEELYKKYKNEGLVVLGLPSNQFHQELGSDQEADDYCRIHYGVTFPMTRRVAVNGDGEDPLFTHLKEESGHGKIKWNYTKFLVGKDGTLIHRYAPITKPESMEEAIYTALNQKNVL

SEQ ID NO: 3883 - protein, 853 aa, Lactobacillus buchneri
LNTTYFKATIREITYAWGKFISIVLIILLGSLLYVGIRATGPDLDNSADQYFAHQNLGDLTVTSTLGLNNRDLNLIRADPKVQTAEPSHMVTVKKSPNQVVQVYSYAKSAKLNQLKLASGHLPQKADQIVLDQKAKDYKIGDRYRLPATDGLTTKTFKVVGFVNSPLFVSSTDRGTTNVGSGQVNYFAYAPAAAFNQKAYAAIAVRFNNTAHLTAGTSKYNQQVDHDKARLESKLKQRPAQRRAEMIAPQLKKIDQQLAQLQKQRRKLAAVPSAYQTATTKAAAAKVAAGVKQLTQAKRQLQKTPQATYLYNDRTANVGYQDYFDESKSIAAIAVIFPGFFLFIAVLITFTTISRMIEKNRREIGLMRALGYTKDFISMKYVIYSILAGILGSIAGGVLGTLTLPKFIFSMLSNNNLTHYVGVIPWAFIIEALVAGLIATLGSAAVVLIINLREKPTELMRERAPKAGKRILLERIKPLWNRMNFNQKVSYRNLFRYKTRMIMTIVGIAGCTGLMLAGFGIRDSVNDLIPDQFNQVQHYQGIVTLSDADKQVHDPNIKAQTAAMVQSITVSPTKGTKRNATVTMVAPKTPTKLNDYVSLTSTQTGQSEKLTNQGVIITEKLATDMHAKKGSLLSAKLGNKLLKVKVAGVTKNYAGHYLYMTPKYFNQVSTTTYSSTSRLLKLKSESASQRQKTSRNLLKQSGVMNVTYPRYASSSLGTVGLSSVVLIFIALSAALGLVVLYNLTNVNISERMRELSTIKVLGFYDNEVTAYVARENVVLTLAGIVFGWGIGLILHHFIMIKAQTGAILFPLTVHYPGYIWSAVLTACFSLAVGVITHYKLKHIDMLDSLAASE

SEQ ID NO: 3884 - protein, 283 aa, Lactobacillus buchneri
MKKRRLALLSGLFLLIGLLSACTTSATGTPKIQGASQATPTLFFHGFGSSYHAETHMANAAVKTGVTKSVIRADVSNSGKVTLVGTFKPDDFHPIVEVNYLNSRNPNYHTQGKWAKNVVVKLQQRYGIKKMNMVGHSVGNMAIVFYLLDNAGNTKLPKLEKQVDIAGHFNGILGMDDAPNRMKLKADGEPTKINGHYRELLGLRHDKQLKTLEILNIYGDKNDGTHSDGDVSNASSKSLRYLVPQVKSYQEKRIVGPQAQHSKLHDNPQVDKLLVKFLWGRAS

SEQ ID NO: 3885 - protein, 371 aa, Lactobacillus buchneri
MKLTRTLACCGLFLALTMIFFADPSTAQAKFHIYHQRSSALHKGSLRNLNNKKVHYVKVPKKYYHVANTDVEHTIKSERGKKVSFHTRYILPLPGKNGQHWGNPQSIAMNGKGYMYIVYCPTDLHNKGRIVRFNIKKLDAMGIRLHPKELRDAYHKRHGKYSKTQQKIHKYIKAGPIFTTGHGQSLAYNWKNHGLYMWRDVEKAPRVPINNWGYIQHIKASTLRPDFAIRFHLHSHGTSVPGGHDLTFDHSGNAYFWSFPGWGAYIFKGKIHHKSVHFRLTHQVLKHLPGTRIQSMGYNPVRKRLLMLSDASIASFPAKRLDGHGHLTNGSFEWTQFGPKREFEGIAYDGSSRGNLLVNHCPEVLQADRSY

SEQ ID NO: 3886 - protein, 354 aa, Lactobacillus buchneri
MKLGKLSVGIATAILLSTSLVGTVDAATYVQKSNVISQYSGASLRILNNSKVQFVKANGNYGWSRNPSGSETIKSVHGTKWTLKTKYLLPSTHMALGKSSRDLTNPQAAAFGGKYLFVLYAPHQFHGKGFVVRYNRSTLDHMSLAKAQDSLLKKTAGMKVGPMFDVGHGQSLAYNKKQHSIWMWRDRADMKPTAWSTIQRISMSSLKPNRAIKFHMNNRGAMVPAGHDLTFDNSGNAYWWGISGGHVKIYKGKLGSRSIHVRLAKQLLRKQTGTHQQSMGYNPHNGRLYLVSDDSIQTLPARKLNGRGSLRPSDIKYTRFNSHREFESMIFDSTGHAMLLSNRNPELLRSTTRY

SEQ ID NO: 3887 - protein, 174 aa, Lactobacillus buchneri
MVSTTFTNLSDEKQTKIRKALLKEFTDQPLATAQVAPIVKTAGIARGAFYKYFDDLTDAYKYLYGVAMRDIHSDVNNEVGTEFDPQFYLDQVEAFIKGARDSQYLGLIKMHLMKNESLISQGSIDPNTVSSREWATMILSHEAIKQIMIEPQNESVVMKKFSETLNLLAGKGNA

SEQ ID NO: 3888 - protein, 354 aa, Lactobacillus buchneri
MYLALKEIRHEKLRYGLIIAMVALIAYLIFILTGLAFGLAGENTQAINSWDAKSVVLNKDSNINLSQSTITNAQAKDDKLSDKESVIGSTPVVAKHKGQEKISAQFVGIKKSEFIYKGLKISAGHKARNNHQVVVDEKFKTDGYKLGDKVTLNSVSDKYEIVGFTKNAKLNIAPVIYGSLPTWKHLRGMDRVPIAGSAIVSKNAKYSAHNSQLKTYSMNEFINKLPGYSAQNTTFGFMIGFLMIISLVIIAVFLYILTMQALPTYAVLRAQGIPARALVTTITSQSLILMASGIIIGGLLAALTGSLIPVGVPMAFDIPVLTWISIGLMIMGVIGAAIPAQKIATVDPVSVIGG

SEQ ID NO: 3889 - protein, 231 aa, Lactobacillus buchneri
MSVIELKNINKYFGSGISKVHVLKDVNFAADRGQLILVVGPSGSGKSTFLTIAGGLQTPSSGSVEVEGQAVESLTKAQRDQLRLNQIGFVLQSYNLVPYLKVKEQFEFVDKIKHEGNLDQKELADLLDQLGISQLVNQFPGELSGGQTQRVAIARALYANPDIVLADEPTAALDSEKVAEVGRLFKNLAETRNKAVVVVTHDLRLLDFADKTYEILDGKISLKDKEHVTDR

SEQ ID NO: 3890 - protein, 123 aa, Lactobacillus buchneri
LSNLIELLGIKTVSVSQAEVIISLEVTDSVKQPYGILHGGINSVLAETAASIGANERLDNSHYAVGVDITTQHLLPVFDGKLVATATPLHAGGHLQTWRVAIHNGNRLTSFSTVTLTNVAQKS

SEQ ID NO: 3891 - protein, 273 aa, Lactobacillus buchneri
MTSVKWESVKDYQEIIFERADKIAKITMNRPEKMNAFTPLTIQEMIDAFNICRDDSTIGVIILTGAGDKAFSSGGDQGVRGNGGYVGSDHIARLNVLDLQHLIRIIPKPVIAMVKGWSVGGGNILQLVCDLTIAADNAQFGQTGPKVGSFDAGYGSGYLARVIGHKRAKEVWFLNHFYSAQEAYEMNWINKVVPLSEVESATLDWCNEILQKSPTALRFIKAAMNADTDGLAGLQQLGGDATMLFYTTDEGKEGRDAFNQKRQPDFDQFPKFP

SEQ ID NO: 3892 - protein, 474 aa, Lactobacillus buchneri
MKVDNWILKQAETAPGRLAVDDGNTQLTFLELKQQVSQLAGQLKAASVLDGDRVGIMTKNSLLGYLMAMAVLGSGKTIVWINWRLSDDEIHRQLSDSEPAACLVADDLFRESFDQRFITFSTITDQAAVQITLVPEFRSQEVASIMYTSGTTGRPKGVMQTFGNHLASATASAFNLGVMPGDEWLCSVPIFHISGFSIMMRGLIYGMAVRLVGHFNAELIDYVLKHEPISTISVVPYMLKQLLKYRTADNTPYQANFQRMLLGGGPIDRQTLQQCRQLQVPVVQSYGMTETCSQIIALNSADADKRIGSVGKPLFLTQLTLSQVNQEVLIKTPALTPGYLNRQAAFQDKLNDTGWYRTGDVGHFDDDGFLYIDGRLDDMIISGGENIFPDEVEAVYVNRSDIGEIAVVGQDDAKWGQVPVAFVVSDAPLDQVDLITYGRQKLAHYKVPTRFIRIDKLPTNVSGKVQRFKLKQLL

SEQ ID NO: 3893 - protein, 344 aa, Lactobacillus buchneri
MKRDFIDTNTYTREEIQYLINLGLQIKRDIKNGNYPDLLSHRTLGMIFEESSTRTRVSFETAMTQLGGHAQYLAPGQIHLGSAESESLGDTAIVLSRLVDILMARVAKHSTVEKLAETATVPVLNGMSDYNHPTQEIGDIITMAEHLPAGKKLSDCKVVFVGDATQVCVSLMFIASKMGMKFVQFGPKGYQIKPETLEIGKKNAEVSGGSVEITEDADAAMKDADFVYTDVWYGLYEAPLSYDERMKIFYPKYQVNDDLMAKGTSHTMFMHCLPANRGEEVTDSVIDSPHSIAWDEAENRLTAMRALLVYLMAPRMNYTEKQLDDLNDPKLKSMILNLVDDTTH

SEQ ID NO: 3894 - protein, 471 aa, Lactobacillus buchneri
MQKEKKFRLFDAVLMSVVVVLVVESVAPAAAIGPSQFFWWGILLVFFFLPYGLISAELGTTYDEDGGIYDWVRKAFGRRWGGRAAWLYWINFPIWMASLAVLFTGVIGQVFPTHFGTWTNVLIQLVFIGIVTLISSYPVADSKWILNLAAIAKVIIMVSLGALGIYVAMTKGVASNFTVKTMLPQMDVKSLGYISVILFNFLGFEVVTSMASEMPNPKKQIPQAIIWGGILIAVFYVFAAFGMGVAIPSSELSTSSGLMESILLLIGGNNWFVILIALLFMYTLAANLISWSAGVNYVASYAAKNHDLPKVFGIESKKTGMPTGANLLNGGIAAVLVVISPLIPNQNIFWAFFSLNVVALLGSYLLMFPSFWKLRKIDPDTERPFKVPGNHLMINLMTWIPVALLAITTILSAFPLNGSAEELNTKIPILIGTIITILLGEVCIRAAEKNHPLKKKVKASSHHTEEALSKN

SEQ ID NO: 3895 - protein, 365 aa, Lactobacillus buchneri
MKTLQSSPKKDGYRMPGEFEHHKGVYILWPERPDNWRNGAKPAQHTFVNVAKAISQFEHVTVGVSDAQYANARHMLPDEVEVVEISSDDSWIRDCGPTFVVNDDGDLRGVDWTFNAWGGLVDGLYFPWDKDDRVAQKVTEMEHADRYRLDDFILEGGSIHVDGEGTLITTEECLLSKGRNSQLSKEQIENVLKEYLNLDKVIWLKRGIYLDETNGHVDNIANFVKPGVVALAWTDDQNDPQYEISKENYDILSNATDAKGRKIQVEKLYVPKPVTITKEESEGVDAVDGSLPRREGDRLAASYVNYYTANGGIVFPTFDDPNDAKAQETLQRLYPDRKIVGVPAREILLGGGNIHCITQQVPAGR

SEQ ID NO: 3896 - protein, 319 aa, Lactobacillus buchneri
MAKIVVALGGNAILSKDASAQAQMKAVKKTAKELVKFIKNGDQLIITHGNGPQVGNLLLQQNAADSEANPAMPLDTCGAMTQGSIGYWFQNAMKEELLNNGIDKDVMAIVTQTIVDEDDPAFENPSKPIGPFYKETDLPEIKSLHPDWEIIEDSGRGYRRVVPSPKPLEINEYAAIKKVVDAGIVPIVSGGGGIPVVKKGNRLIGKEAVIDKDFSASKIAQLIDADKLIILTSAGGVYYNYGKPDQVELKEVGIDDIQKHIDANEFAKGSMMPKVQAAVAFVRSTGNPAVIGDLEDVEQIIEGNEGTTIVKDAVPAAVK

SEQ ID NO: 3897 - protein, 362 aa, Lactobacillus buchneri
MKIKKTTPQEDKYNVVPEWRQHQQAYMMWPERTDNWREGAKPAQKVFSEVAAKISRYEPLTMLVSRQQYEHALHALPESVRVVEMSYNDAWMRDVGPTYLVNAQNNVRAVSWQFNAWGGLVDGLYFPWDQDNLVSGKVSDLDRIDYYDADFVLEGSAYQTDGEGTLIATEESVLSEGRNGQVDQADVEAVFKRYLNVTKIIWLSRGYFMDETNGDVDNMVNFVRPGEVALTWTEYQTDPMYEICHEALATLEAATDASGRHFKIHRVQMPKPLLITKAESEGVDPVNGRLPRYEGDRLMATYINCYLANGAVILPIFGDEHDQAAIDQYTKIFPDRKIEPVYARELLLGGGDIHSIVLGVPD

SEQ ID NO: 3898 - protein, 261 aa, Lactobacillus buchneri
MNFFEIIKPYVEKLNKNEYGLLDYVIKNMDKIQNKSIREIAAACYVSTTTFLRFVRKIGFSGYSEFSTVIKYTVLNSDKQEDKAEPFVEEQSKYRNEYLKNIEETVRVLDERKLLKICQVLDHQPKLYFFAKGFSKYSAEYIEYLYTLNGFIVIFPKNHEQRRLAYRNVQLNDVVFVFDYEGEDDELIQIIQNLQSQKEYALLVSITGANNNTIQNMSDENLYLFTDELKVSGVDMTSHVSLIVIMELLLYQFMEYEKSKR

SEQ ID NO: 3899 - protein, 495 aa, Lactobacillus buchneri
MANNSQQELLKTIHQAKPEKLKNVLLKMGSLDPDMAALILAIFNDIPVDLDIDAGFEVDHDTVEADPLPSTNPDTDPQAIEEEIRHVRGVISNQLQIARESDWDWNGMNNLVNFFSDLLGEVIDDTGELKVPFALGFPVALMVVQNQMKVFSEDSLSPMTLEDSVNNVLGVIIDLINESGSHLPVNEREKYLDQALKLFGSPVFKDLEAFRYEFIDDVLGLVTKQTANKVIKASERIMKQSTLWDEDQRKKHHLMLRLHLYLALGDLGVAQEIAIANMDDDDVRKQWFFVLKSRHRYDEAKELALDVPRYLRKEWDELLSNMYQELGETDELIALLRKRLLNHQTAVYQQYKQLLVERHEWQRVYPDLLKQLETKLTRYEYGDILALEQEYSKLFEQLKKYQSAPMIRNYLRQIYPAVKDKMIPLYHDVVLIPQSQKTAANAPKQLEKDLSNFLEISHDATTVQKWVDELKQRLSGQTSFLEGLEIVQTQINTVV

SEQ ID NO: 3900 - protein, 49 aa, Lactobacillus buchneri
MRIHVVMHNKETGEEYLTTKNRRNNPDRLKLMKYSPKLRKRVLFEEKKS

SEQ ID NO: 3901 - protein, 607 aa, Lactobacillus buchneri
MNKLTNYMRLIGVLIVAVIALVLQFGLRLPLYAQIVISTLGSLIALLMFIDMVKTLRSGKFGVDLLAITAVIATIAVGEYWAALIVLLMLTGGDTLEDYAANKANSELQSLLENSPQSAHLLKDDKMVDVKIDQVTVGDRIVVKPGEVIPVDGTITDGVTSVDESSLTGESRPIDKVVGSTVMSGAINGDASFDMIADKTADDSQYQNIIRLVKQAESTPAHFVRMADRYAVPFTLLAYVIAGVAWYLSKDPVRFAEVLVVASPCPLILAAPIALVSGMSRASRNGIIVKSGTIIEKLANAKTFAFDKTGTITKGHLTVSRVFAIAGYTKDQVLALAAGAEQQSSHILARSLVAAIPDQIPTATNVIETTAQGVQATIDQQTIRVGKPAYVSDDPIDPLDQTAVYVSVNGKYVGYVAFSDELRPEAKAVMDSLHQMGATEIMMISGDRKPIAEEIADRVGIDKVYAERLPEEKISVIEKVEKKFRPVVMVGDGVNDAPSLAMADVGIAMGAHGATAASESADAVVLKDDLSLVSKAVKISDDTMNVARQSVLIGIAICTILMLIASFGVIPAIIGALFQEVVDTVTILWALRARAGDKRESSLVPVQ

SEQ ID NO: 3902 - protein, 289 aa, Lactobacillus buchneri
MTELNAANAGTYKFDDQFVVNRLGYGTMQLTGKGTWGPYADPARAADVVTHATELGINFFDTADSYGPWFADRYLAEGLKGAANRDQIFISDKVGQTRQGPGIWTPHGEPNYLRQQVEVSMMTLGIDHEDLVFLHRIDSHFPVAEQVGELKKMQDEGKIRHIGLSQVSVDQLKEAQKYAKIDAVENLYNVSNHKDDDVVDYAQSQGMAFLPWFPLDTGRLIGADSPLSTIAKKYGVSEAQIALAWLLKRSPNILPIPGTSSIQHLEDNVAAANVKLSDEDFEALSQLSK

SEQ ID NO: 3903 - protein, 514 aa, Lactobacillus buchneri
MAVKYYGVMMVNVQGSELLIVNLKNLKPLEHVKKDINLGDDVYQDQPVKYESVNRVSEALTGFIQILNDYGVTNYKLFGSNALHQAINSDFIADQLFLHTGMNIEWLSTSEETYFRNQNISVELTKDKQNDKRTTFLVGITSGNTAITEFKEGKFVDSTSFALGPIKIAEDLQSLRQTAPNSIGLLNDYIDSKLNDFYIGNPASVVSSKVPTKIILLGSLPLQRLVENYEHTKASDTITASDFTGLVDDLVDASDQFLIERLQVDPDYIPLVLPELLLTRRILRLTNASEIGFSDSGVVDGLVNQEALEQGYSKRDFTPEIIRLALNLSKHYDVEPVHRDLVTKFALHLFDQLKPLHQLGRRERILLQVASILHDVGNYVGIHEHYLHSEYIILHSEIIGLSRDDIRVIAAIARYHSSTTPNEDLIHFQHISAESRRLIAKLAAILRLADALDDDRQQKIKKISVSIKESKVVITTFSNANLAYENWIFNTKSQFFTEAYGYKAVLKQRGVKAK

SEQ ID NO: 3904 - protein, 725 aa, Lactobacillus buchneri
MTDKIDFKNPKYYNNRELSWLDFNERVLEEARDKNNPLLERVKFLGITQSNLDEWVMVRVASLAKLVEVKWDGKDSSGRSAEEQLRDVNVKAHEMLVRQYSTLNRSLLPALNQVDIHLLKVGDLTPEQYQFIKGYFHDELYPVLTPMADDSSRPFPFINNDSLNLSLRLNKKDDEEGKTLYATLQVPSIFSRVIKLPGGDNDFILIEDIIKQFVDQLFINYTIKEVSVFRVIRDMDLDVAEEDTSDLLKKVQQQLKLREHGQVIRLEVDSTISSKLRKRLVKELQTAEDSVYEVNGPLDLTFMSKLAGKVIGHDDLKYRPFKPYQPAALDSNHNIFDAIQKHDWLMQHPYDKFDSVVEFIRQASVDSEVLAIKMTLYRVSGDSPIIKYLGRAAQNGKQVTVLVEVKARFDEENNVHWARQLEKMGCHVIYGLVGLKTHSKLSLVVRREENGIRRYVHMGTGNYNDVTAHFYTDLGLLTCNTDIGIDVTNIFNMLSGYSRPPYFHQLHISPNGIREFITERLDEAIKYAKQGKPVHVQMKMNSLSDQDMIAKLYEASHAGVTVDLIIRGICCLKTGIKDVSDHITVHSIVGRFLEHSRIYLFNFDGEQQVYLASADLMTRNLNRRVEQMFPVLQPDLAQRVVSIYTTMWNDNVKTRTLDKNGVYKRVDRRGREPLDSQEFFAAQATRLTEAQQGENRPKSGAQFQPMMSPQNQPDPFNDEDGGDNQ

SEQ ID NO: 3905 - protein, 315 aa, Lactobacillus buchneri
MENLAVIDLGSNSVRMTISRISDDGTYETVAQEKEYVRLSENMGVEKILQPEAIERTISALKNFKTIYSKLDHLNIVAVATAAVRQATNQKQFLKRVKNDIGINLNVISGTREAYYDYVGVSETLPATNAVIIDTGGASAEIVLVQNGKVSNLISIPIGSVTLSSKFDLADDIAATEVFKAMIFVNKIFQSVWWLRNGLNLPIIGLGGSNRTLAKINRRFNNLLDTNDIHGYQLRDDAINETFERIIGMNLDERKKVPGINKERADIIVGGLIPVILLMNYLDSDRIMFSTSGLREGILFERLHDIIQENIKTKE

SEQ ID NO: 3906 - protein, 367 aa, Lactobacillus buchneri
MSQYIHVIYTAAIIFPILAIFITLPILLVNYHKYGAIPKWSIFMLYTFVFYMMCAYFLTILPLPSQSFVAHLTTPTHNFVPFTFVREFIKYNPFSLTHPGTWVAALKAPTVIQPVFNIFLTVPFGFYLHYYFQRSWKQTILFTFCLSLFFELTQLSGLYGIYPRPYRLFDVDDLLLNTTGGIIGAWGASLLGRFLPTKEQVRTRTMALSKNVSPLRRGVALAVDWIIIGLLTNILGIFLIPHWIGIAIGFVIFILVLELSRQQTIGMRLVGIKVIDRNGQTASWSKILIRNLFGYGVISGLYEIVGRLLDMTATAPKAQLTSILHVVLILSFGLLLVFVDLLIDWFSQKHLLFFERLSGTDTASVGK

SEQ ID NO: 3907 - protein, 355 aa, Lactobacillus buchneri
MTLLIPTAIIFIVLVGLFFTYLIKLRNSLYIGTLANLSLLVLLVLLVEIISVLNSQFWGIILGLAVALVGLLVFLGLTLSFIFFFINAFIVWKREGYSLSSSLTLITGIAVIAVDLLFFFNPSVGPKPLQGAVTMFLTLLIGYVLLTVWNTISSMILYRLYFPRKDKDYIIVLGSGLIDGYKVGRLLGNRIETALSFYRSEIKTTGKHPKLIFSGGQGGDELLPEGEAMQKYALEHGIPKVDTLVEDKSINTEQNLAFSRKIIEKDSGRDDNKVIFVSNNYHILRAGVLARKLKFAAFGIGAPTPFYFLPNAVIREHLAFLVMNKRANIAIIVLIALIALGTGLLLYFVPGEPIQ

SEQ ID NO: 3908 - protein, 136 aa, Lactobacillus buchneri
MLSLYLSPGSSSCRRARKWLTDHHIDFVERDISKQTLNADDIKQLLRLSENGTEDLISTRCHSYRKLKVNFDNLTVSQLIDLMVKYPDLLRRPLIFNDEQLQVGFSEENIRSFLPRQTRREMLNDMLAHAEAVGMS

SEQ ID NO: 3909 - protein, 372 aa, Lactobacillus buchneri
MKIAGFGVEEWLNKWEKSATYDISQSTISSMTMQEALALDGQQGASFYQQLDQEKMNYGWIEGSPEFKQEVAKLYAHIDADNILQTNGATGANHLALYALIEPGDHVISEYPSYQQLYDIPKSLGADVDFWHIHEDQNWYPDINELKSLIRPNTKMICLNNANNPTGTLLDKAFLQQVVELARQVGAYVLVDEVYLPLDDPDQFTSIVDLYDKGIATNSLSKTYSMPGIRIGWTASNATVADLFRKYRDYTMICAGVFNDLMATYILKHRDQVLARNRQLVMNNLAIYRDWIDSEPRASVVMPQAVSTSFPKLDVPEDIEAFCIRLLKETGVLLVPGNRFDMPGHVRLGYCADETTLREGLKRLSAFLRQYD

SEQ ID NO: 3910 - protein, 299 aa, Lactobacillus buchneri
MSLTALFKQKTVFSLEVFPPKKDSPTDAILPTLKRLQSLQPDFISVTLGAGGTNHCDGTVAVADLIQNQLNIPAVSHVPGLYQSKDQVLALLDRLDQIHVKNILALRGDRIPGKEPVGDFNHANELVKFVHEQRPDFSIASACYPNCHTEAADFVDDISHLKEKVAAGADHLISQLFFDNQAFYDFKEKTEIAGINVPIEAGIMPCTNKNQIERITQISGVPIPKKFAAIMDRYQDSKEAMLDAGIAFAVDQIIDLVSQGVDGIHLYTMNKSKIAKRIWEETESVFAASNLAKQKANQN

SEQ ID NO: 3911 - protein, 761 aa, Lactobacillus buchneri
MTTTIIGFPRIGHHRELKFATEHYWKHKIDQNELLKTAYQIRKNHWQAQQDAGIDLIPVGDFSFFDGVLDTANLLNIVSDRYKALNLSPLDEYFAQARGYQNGSETVKALPMKKWFNTNYHYIVPEFTKTTDVKLVGDKLFNEVDEALKLGINAKAVITGPYTLLKLSRFLDGTTPNDFVDDLIGAYSQVIEHLNQQGGNWIQIDEPALSFDVNSAEKALFDKLYHGILAAKGSSKILLQNYFGDIRDIYHDVTSLDFDGIGLDFVEGKYNLELVKQNGFPADKVLFAGVVNGKNIWRNHYATTIDLLNNLNTDAKVVLSSSASLLHVPYSAADETKVPSDVKQHLAFAIEKLAEIKELDTIYHDEADGKSALEKNDALFRNVKHPYNKSVHERINNLTDDDYTRLPARSEREKIQKKEFNLPILPTTTIGSFPQTKDVRQNRAKLRHGEITKAEYDKFNEDKIRRIVKIQEKIGLDVLVHGEYERNDMVEYFGEKLAGFVFTQNGWVQSYGTRGVKPPIIWGDISRTAPITVAASVFAKNLTDKPMKGMLTGPVTIFNWSFPREDVTPKESVTQIALALQDEVLDLEKHDIKIIQIDEPALRENLPLRKSNWYSEYLDWAVPAFRLVHSKVQPSTQIHTHMCYSEFGDIIKAIDALDADVISFEASRADFTLIDQLVAAKFQTEVGPGVYDIHSPRIPSEQEIEGLIKQLVAKLPVDKVWINPDCGLKTRSEDESFESLKNIVDATKKVRSEINEPNSVV

SEQ ID NO: 3912 - protein, 157 aa, Lactobacillus buchneri
MAKVESFTLDHTKVKAPYVRLITTETGPNGDVVSNFDLRLTQPNETAVPTAGLHTIEHLLASLLRDRLDGVIDCSPFGCRTGFHLITWGKHSTTEVAEALKGSLDEIANKVEWKDVPGVDKYSCGNYRDHSLFSAKEWSKKILAEGISNDPYERHVI

SEQ ID NO: 3913 - protein, 217 aa, Lactobacillus buchneri
MASTSIQSFYSEDIDSTKDLPQKQKQVLKACLELFAAKGFEATTTADIAEKAGVSQGTVYKRFKTKEQLLQAVVQPLFSQTVPRAAQEFSEDLKRFKYDSLAEFLKPTLKNRLTFASENKQILKILFMQAANDPQLLSELIVPVKAVLTTTIPKVIDKLKERHLLVDWETSRILDYVLSIGAGFGAQIILLDRKVDLDRDIDQAVEFLVKGLSPDNK

SEQ ID NO: 3914 - protein, 389 aa, Lactobacillus buchneri
MRILTITKRIFVEMFRDKRTLALMFIAPLFILSLMYFLFQSNTNTVADIGTYNVSSSLVKTIDNKHIKIHRMDSNVSAKKTIRDKDYAGFIKKTDGHLVVTYQNADQSKTAIIKKSVQMALIKVQIKQLVAATKQSKAGLMKMQAQLRQIKKQLPATLSSRIPTASAPKNVQKPTNLKLTQHYLYGKSNSTFFTTMLPVFLGFMVFFFVFLISGISLLNERNSRTLDRLLATPVKRSEIIYGYLTGYGAVAIIQTAVIVLFCIYVLGISILGSIWVVLLICFALAMVALSMGLFVSTFAASEFQMVQFIPIVVIPQIFFSGLIPVANMAGWLQVIAHIMPLYYGASALTDVIQKQASFSAIVPQFTAILAFLVAFIALNMIGMRKYRKV

SEQ ID NO: 3915 - protein, 245 aa, Lactobacillus buchneri
MDAVVTVTHVDKSFNKKRILHDVNLTASSHEILGLIGPSGAGKTTIIKNIMGMEQPDGGEVTIFGKRMPNRPVLQRIGFMAQDDALYESLTGKENLKFFAQLFGVKKEQLKQRIDYTAGVVNLNQDLDKRVSNYSGGMKRRLSLAISLIQDPDLLILDEPTVGIDPELRRQIWDELRKYAQAGKSIIITTHVMEDAAECDELLMIREGHIITHGSPTSLEKEYDVDNLEQVFLKAGKSNENSNNH

SEQ ID NO: 3916 - protein, 457 aa, Lactobacillus buchneri
MEDKSFGRVESIPKAHRHQSYWDMFATWVGANANNGTWYVGGVIAACGFATASTTLIIVGVITYFLLALSGYMGYKTGLPAMALTRASFGLKGSFLPSVINVVQFIGWAAVNTFIAATSISYILHDVLGWPVYGKPGGLKGLISGIVVMSILHLLSISMGEKSVRIIERIGIVLVFILVIWESIVVFQNVSLSEIVSWHAPSALKMSPGQAVDVLAAFNLAWVTAASDFTRFSKKRSSSTWAPFFGANLGLIWFAMIGIISTIATAITLNHFDANNSDPSTIASKLGLGVLAMLVIIITSTTANAVNLMSAGSALTNMTKRLSLTVSIVLVTLVAVFVTFIPIFYSTFLNVFTAFLDGIGMFLGPEIAIFLTDFYLVAKRKYRVDHFASRTGQYWYTGGINWIAIASWLIAVLAYGYIKTVAVLADSVGATFISMLIAAVIYWVGSRLTSRGQLQED

SEQ ID NO: 3917 - protein, 199 aa, Lactobacillus buchneri
VATFTKQTLSLDDVEPDNEYVNCALTVSNELIRINDVVFDHCQFEQSNFDGSDWGYVEFKGCDFLNATFHKSYFSNCKFTNVQLMGADFSMETLLKKCQFHDANLHYANFSETKMEASFFMDCNLVESSFQAVTVKKELSFNACEINQIDFLDTRMKGIDLSKASFDDLIVNPELIKGLKINPWQAGQIVAMLGVIVVD

SEQ ID NO: 3918 - protein, 271 aa, Lactobacillus buchneri
LSLLLFNHLATALTGYVGLLLVGIFYTGQSAVWRQFKWNLSLLLMIVFFNVLLNQRFGPVLYQFSVGDVSFKLTLPALLYGVVMGLMLVEMLMAFAVLNVILPAPKLVYVLSPVTPKLGLLVVISMNLVKTFSHTLASLAMLQQTRNVQANAGGLLSRIRNAGRLLRILLEDALASGMETARLMDARGFGVGKRTHYWAYHWKASDWAFLSASILIFVWAVVSRIQSAGWSTSVGEFTRGWMSQDLVALSGLGGLLLLPLAAEGVYRAWTN

SEQ ID NO: 3919 - protein, 553 aa, Lactobacillus buchneri
MDKLIETRQLTFTYPDASRPVLQGVDLTINRGEFIVIAGATGSGKTTLINHFKKELLPNGHRSGKVLIKQQAITDLSRLASAKTIGYVGQDPTTQPIMTTVIDELAFGLENIGIKSAEIERRIAELANYLGLDELLHQDMHELSGGQLQLVNLASVLILRPEVLLFDEPTAQLDPLSSRHFFDVLERIHQELGMTIVMTEHNLGTALGLADRMILLQNQRVTFQGQPVVGIPKMMADPDLTAFVPAVSRLFLDNHLETTGLPISVAAGQAAISKHHLEFTAHTDQPRVVESSTTILAAKEISFSFDKQVNVVDHLNLQLPAGDWLSIVGKNGSGKSTLLTMLAGLRVPQHGKITFNNQKVWRIPTAARIQQLSFLSQTPALQFGAETVQEELHQQAAELQLEFPDKQVKMIVDRLHLNDLLDQSPFDLSSGQQQLLGIAIALLANPQLLILDEPTKGLDPTAKQALGQLLTTINQAGTTILMASHDMEFCAAYSLHCAFMFDGHLNTVLPTRSFFSGNFFFTTAINRLLRRQVPDAMLVSDVRLSEGTSEHVE

SEQ ID NO: 3920 - protein, 236 aa, Lactobacillus buchneri
MSNKWRAKVIGQILLVSVLIAVFLGLTLLLKNKHFLLFSFMLLLCSILPAYWRFEREPLKTQTLMFLAILIALAVAGRVPFASLPSVQAASFVIILGGISLGPELGFVTGSTTALVSNMFLGQGPWTPWQMFAWGLMGLTAGLIGRTQLSHRLMPMIIFGGVWGFVYGWIMDLWFALAYVNPLTMKSFILAFTASAGFDLVHCLSNVVLIALLYRSWEKLIDRLNRKYNFLPTKTH

SEQ ID NO: 3921 - protein, 348 aa, Lactobacillus buchneri
MKSIKKLITLSMTGLLLAGAAAPLTNVHAAGAKTASSSYQASKAKASYSYAKKMLAKNRTGFSGKTSYIFSKKAYPTTGAVYGYSDFLLGLKGLGYKFTNAQRTKIADSLVLNRKSTAADLATAIIATRAVGLNPQKLHQTGAKTNLNLVSALYHRSMAKQTVNVQSQALIALSTGSYQRPSNAKFSKASLSNAIVKNQLSNNGWAYNNQTASADSDTTAMAVTALARSKSTSSAVTSAITKGQSYLKDAVYPNGAFGYAYKGKTFPNANSTAEAIIAFSTKQKTVKLVNSVFKSGQTTSPMRAMLSYVRSTGSIKGAATQTLGVGQVNLANAAYRQALAHRSVYSIK

SEQ ID NO: 3922 - protein, 232 aa, Lactobacillus buchneri
MKKAIGIVIGVILVLGMAFGVREVIANQVAQHPRTEKAAKMDSGSQPKATSSSQVSHPAKAKKAKDKGSQAKHQSQAKKASQPRTADSSSSQATSNKPSSSRSKSQTKQAVTTKPKSTSKQSRPKQKASPASTGKAYLKVSGYKKLFYSGNLHITKKTTAFTLLQQTKLKITYTSSPAIYVSAINGLKENDIKVGSGWMYSVNGKYVDKSAGDKLIKPGDKVHWYFTTEGFK

SEQ ID NO: 3923 - protein, 321 aa, Lactobacillus buchneri
MDNNEIWVYVETVGSRIEPTSLQLITKAKAIADGRKVVAVLPEASTIKAENSLQAYGPDRVETLVDDHFTNATDEEIADALFQVLDQNRPNSLLFPATILGRSIAPRLQAKLQTGLTGDCLDIFYENDLLVQVKPTYGDNVMCDIVCPEKRPQMVTVRPNTFRAEKVTDFQTKVVKASFTFHKEGNSQIIATDPIINSSSKLDDAKVVIALGRGAYSAKNIQLAQDLAAKLGGMVGVSRPLTDEDEFTHDDQIGIGGASLSADLLINLGISGAVQYTVGIKNAKKIVSVNIDKDAPIFDESDFAYVGDVTDFLTALTAQVR

SEQ ID NO: 3924 - protein, 257 aa, Lactobacillus buchneri
MKIVVGIKQVPETDSVKIDPNTNNLVRSGIQGIINPFDKNAIEAALQLRDQAGGEVILLSMGPDSYTTSLRDGMAMGADRAVLVSSRAFGGADTLATGYTLAKAIEAIGDVDLVLFGRQSVDADTGQVGPIVAEFLQFPQVTFAETLELDSEKTLVAKRQLDSAVQDIKLTLPAVVTVRKELNTPRYETPVNIKESFEKPITIWTEADLNLDLAKIGQAGSPTKVTKVYAPTKDVKKTVTLSPDPAQAVSELLSQLD

SEQ ID NO: 3925 - protein, 372 aa, Lactobacillus buchneri
MSITNDQTKMLIQMIKEFTANELAPIDMQIDRAGDYPDGLFQKVVNTGLLGITLPREYGGAAFDYQAAAESLEKMATGNASMAVTLEGHFKTIEQFIKYGNKSLNDEYLPSAAKRIFAFSMTEPSGGSNPKGIATRAIKQGDNWVITGDKIMITNGGLAEVYCVLAKTEDDQMAVFVVDKDMPGFKFGKREDFIGLKGVPVGEVVLNHVVVPDNHLLGRIGQGLEIGDNAHADARVLMGAVLAGIMEHELQTAVNYSKERKAMDTPLYQLQVTQEKIADIAIAKENTTALYQKGADNKVANKPYAEVAAMAKSYGSRSAVASGDKALQILGGYGYSHEYPVEHLIRDARAMELAEGTIEKMNLEITNAEIAK

SEQ ID NO: 3926 - protein, 285 aa, Lactobacillus buchneri
VNIQRFIDRRKELGYSQSELAKGICTQATISKFENNGKMISTKILTQLCQRLGLSLNDIFPSEADSDSAVRAELRRAEFDLITTEYDDALGILRSLEIDQIGDKQIQMEYLFIRGYALALSKRDVDEAIFCFDQILNGYDEAHTTVYSPLAYVGMGISYQQAGNFDKAEFYFSKMPERLKTNANKDVDSVWKSLTMLFYTGNFYAARNEIEISNMLLQSLINLSSDRHVTFYVAQAQYQLADNEYSVNGKTQRFSELISDAFAFARFNRNRNLIKQIDLYAKKRV

SEQ ID NO: 3927 - protein, 304 aa, Lactobacillus buchneri
MKSLSQIMSRTLLVTVILTANFAVCSANTTSSLGATIHLTTTPNVHDLGGIRTKNGQHIRQNRLIRSAALTRLNHHDKWLLKKQHVKVILDFRSSGEIKRTPDAKISGVRHLHLSVMSSPNFGVHTTSQYAGQLAAKQPNFMEQFYQKMVLEPHCVKAYRTMFHYLLKQRSGAILYHCTYGKDRTGVATMLILSSLGVPKTTIMKNYLASNHYLKKTTAKEYRQMARYTHNPTVLRNLKRSKTARSAYLNAAYSAIYHCDGTMKHYLHQQMHLSNHDIQQLRKQYLTKREARTQLIVSYVWASL

SEQ ID NO: 3928 - protein, 211 aa, Lactobacillus buchneri
NADHAZREDCTASEMKYVIIFDHPYTLSAANNEPHHRSYSAAVAKQTINYLTAQGHDVDVIDLNHDHFDPVMHAKDLSAWRTRTPINDQVDRYFERLKTADEIIFIFPIWWELMPAMTKGFIDKVFSKNRAVSMHPRVVLEKNPIIRIFTIAGTPTFLYKLKYGNPIMKALATGTFKKIGLKKIKWHNFNAEDESPQKRQADLAHIQKFLS

SEQ ID NO: 3929 - protein, 161 aa, Lactobacillus buchneri
MKKKNAIEQIKNQLEIFRSHDVDREILAAIRQNDRLNAALANGITINDLHIIRAAAAKDGVKISAIVDQVPMTQGAVSKAVNKLAERGLLQKSHHPDNRKDTFVELTAPGETINQIHSDYHRQEETKLAELADSYLKNELEMIAEFVTSLNQIRQNNSKLK

SEQ ID NO: 3930 - protein, 530 aa, Lactobacillus buchneri
MSKEKKSQKEHLIHYANGPSLEEINGTVVVPKGKGFWRTLFGYSGPGALVAVGYMDPGNWSTSITGGQNFEYLLMSVILMSSLIAMLLQYMAAKLGIVTQMDLAQAIRARTSKSLGYVLWILTELAIMATDIAEVIGAAIALYLLFHIPLVISVFITVFDVLLLLLLTKIGFRKIEAIVVCLICVIFVVFAYEVILSDPDWLGVFKGLVPNGETFSSSPQIGGQTPLTGALGIIGATVMPHNLYLHSAVSQTRKVDHSDEEDVARTVRFSTWDSNIQLSMAFLVNSLLLIMGVAVFKSGAVKDPSFFGLFQALSDSSTLSNGVLITVAKSGILSILFAVALLASGQNSTITGTLTGQVIMEGFIHMKMPLWMRRLVTRLISVVPVLICVGMTGRETPIQQHEALNTLMNNSQVFLAFALPFSMLPLLMFTNNSLEMHDRFKNSWIVKILGWFSVIALTTLNMKGLPGQFEAFLGDHPTQSQISMADNASYVVIVLVVALLVWMIWDIHKSNKRFEAAAAEAESKAAEAEK

SEQ ID NO: 3931 - protein, 148 aa, Lactobacillus buchneri
MANTEGGQKFDRILVGVDDSEDAQLAFRYAIREARQSNARLIITSILEDDNVNVFQALSKDFVHGERSALAKHIEDYRQLALRAGVKQVDTVIEEGDPGETIVKRVIPATKADLLIVGSLSKTGVRKYFGSQAAYMAKYSPISVMIVR

SEQ ID NO: 3932 - protein, 449 aa, Lactobacillus buchneri
LELTEKSRRWFIATLLLGTFTMSISQSSLSTAYPTFMRYFDLPASTIAWLTTGFMLIMSVVMPLSPWLMKNFRFKPLYLSLLVNFVVGTLIIIWAPNFLVMMVGRLMEGFSVGVLFPSYQSIILEITPTDHRGSVMGTVGLVMGSALAVGPIISGVLLQFFPWEAIFAFFLIILTVVFLLALKTVISPLKIESTQFDFVSVFMSLGLIGLLYFINEISHMTATSYWNWGILLVSLVLLVLFVRRQLRMPQPLLRLDILSITNFDLGVLLTSLSYMSLITVTIIMPLYYQQILGLTPLWSGLALVPAAAILSWLNRRSGRLADRIGFKPVIMIGFGLFIVGWAGLLLLSGLKNIWIAILCSIVIESGNAFAMMPATTLGANSLTNDLIPHGSSIIATIRQILGSTAIVIATVVLGDRNFNGVFLTFLILEVIAIFLVFKIKDTQQQAGKA

SEQ ID NO: 3933 - protein, 478 aa, Lactobacillus buchneri
NADPMAYRTVNPYNNEVVKEYPFATEDELQSALATGHDLYETMKKQDISERAKILHNVAAKLREHSDELARACTIDMGKLIGESKGEVELVAIIADWFADHGEDLLKPEKIDTIATGDAEIQHHATGVVMMVEPWNFPYYQIMRVFAPNFMVGNPMILKHAANTPTSAKMFADVVAEAGAPKGSLTNLFLSYDQVTEAIDDPRVQGVALTGSERGGTAVAGAAGKALKKNTMELGGMDPFVVLGDANMDDVNDIAWRARIYNTGQVCTSSKRFIVMDNVYDEFVENLKKKFAGLKPGDPMDPKTTLAPMNTEKSKNKLQKQLDDAIAAGAKVVYGNEPIDLPGQFFMPTILTDIDKDNPAYSEEMFGPIAAVYKVHSEQEAIDLANDNPYGLGGIVFAGDADHGAEVASQIETGMVFVNNFMSTLPELPFGGVKLSGYGREMSHIGQMAFVNEQLIVKTDKPNMGNLAGGLVALDPQE

SEQ ID NO: 3934 - protein, 301 aa, Lactobacillus buchneri
MKKYLIIYNGSAGKSDNEAIAKKAQSLLESNGKSVTLSQTKSRDDAVKQAQKSPENYDCLITIGGDGSINTACEGFLKAGQSIPLGIIPGGTINNFARALHIPLNTDQAINNLLDGSPAEVDLGAVGKTPMVSSLTLGRLADIARNVKDDEKKRFGKMIYLVKGFKELFTNRSYKLKITANDRSEVLRAQILLITTTNSVGGFIAFNPDASYDDDYLHVFLLKSFTPMKLLTYLSYFITGNLKNAQGVRYFKTKTVKIDNLSKRDIQARIDGDPAMSLPITVTTKSDFLQVIVPRASHEES

SEQ ID NO: 3935 - protein, 180 aa, Lactobacillus buchneri
NADHPYRPHSPHATASEMTYSRTESIELVNMCMIYNPATQEVLVEDKTDVDWKFGHTFPGGHVEKGESLYDGMVREVFEETGLTVSQLESCGTVEWFNESPAYRRLGFLYRTSHFSGTLKQSEEGQNYWLPLKDLNEANTAESFMKFLQIFTDLHTVDATSPVMNGSLTIIPKDDHSPKA

SEQ ID NO: 3936 - protein, 136 aa, Lactobacillus buchneri
MTDVIRKDVKDRLKNGDYTCSKELTLSMFSGKWKLVILFHLGTDGAYRFNELMRLLPKVTHKVLTNQLREMAEDGLITRHVNAGSQTKVTYEITELGQSLMPIANQMYEWGENRIKALKVTPQFSVNEEVEREAAK

SEQ ID NO: 3937 - protein, 169 aa, Lactobacillus buchneri
MSKVAVIVTNDVEDIEYTSPVEALKNAGHEVVTIENEAGNQIVGKHGTKLTADKGIGDVKPDEFDGLLIPGGFSPDQLRADDRFVNFVKDFLMDDKPTFAICHGPQLFIQTGLTAGRTMTAYLTVRPDLYYAGARVKDQPVVVDRNLVTSRTPDDLDDFNGAMLAILKK

SEQ ID NO: 3938 - protein, 444 aa, Lactobacillus buchneri
MNAANTSFMILSSILVLFMTPGLAFFYGGLVSKRNVVNTMLSVFIMTGVAIVLWIVIGYSLSFSGDIGGVIGTVKNFFMNGVDLTSLTATKIPTGIFSVFEMMFAIITPALFVGAVVGRIKFNFLLVFLILWSIIIYYPMVHLVWSPHGILYGLGVLDFAGGTVVHINAGVTAFVLSAFLGKRVKFGDIPHTHYNLPWVLLGATILWIGWYGFNAGSALGVDNIAAQATITTTMSTGTAMVTWMILDMIISGKPTLVGVCTGTLCGLVGITPACGFVTIAGSFWIGMFSTFASYFFVNYLKDRIGVDDALDAFGCHGVSGIIGSIATGLFATKSVNPIVAHNGAFYGGGWHQITVQIVATLATIIFVTIAASVIIKLLSLVMPMRVDRKEEKLGLDKGEHGEEVDYTVDMSDNLDAYRSDLNLYSKEFRGQLGGLDTNKDPHLH

SEQ ID NO: 3939 - protein, 210 aa, Lactobacillus buchneri
MKIIVIGATGRVGSNVVAKLAKNSADEIYAGARKPEKVPASENVTPFKLDLNNGMDEIKEALPEADAIIFTAGSGGRDLLKIDLHGAVKVMQAAEEKEISRFVMLSSKGSLSPDEFADSPLENYLIAKYYADEWLIHNTNLDYTILQPTALVEKAGSGKVTLGAYSTNENSIDNVADVLIGLVENHAGIKEVIEMSTGNEPIPEAINELN

SEQ ID NO: 3940 - protein, 639 aa, Lactobacillus buchneri
MKFQRYINQHTNQITLITAVLIGVGLLGKVVDSDMVYTVSFIAASIISAVPIVLRAVSALRFKTISIELLVSIAVIGAFIIGEYNESAIVTFLFLFGTFLEDKTLAKTRHSIKDLTEMAPTTAMVVDDDGNTEEIDVDFVDVDDVVLVKAGGQIPVDGEIVDGSGHINEASITGESKLVTKGTGDQVFSGTILDNGTLKVRATKVGDDTTFGKIVELVEDAQDTKSPAEKFIDKFATYYTPAVLIIALIVGLVTKDFRLAITVLVLGCPGALVIGAPVSNVAGIGNGAKNGVLIKGGEVMNTFANVDTLVFDKTGTLTEGKTAVTQFKDYSKDQLALQIAAAVEKQSDHPLAQAVVKFSADHHIPFDDVQVADADTVKGRGVKATANGKNVLIGNLRMMNDENVDLTSEQRHDLENIQDEGSSTVIVAFDGQIQAILGISDVIRQGVKQSLATLKSLGIKKTVMLTGDNLQTANAVAEQIGIDEVHAELLPEQKVEYVKQFQQEGHKVAFVGDGINDSPSLVTADIGIAMGSGTDVAVETSDVVLMSSGLNELIHAYGLSKKTVINTKENIFIAIATVVALLIGLILGFIYMASGMFVHEASILVVIFNAMRLINYQPKTAKLDPDQLSVGEYDLSLKQ

SEQ ID NO: 3941 - protein, 73 aa, Lactobacillus buchneri
MSKAILQLDALSCPSCMQKIKGALEKQDGVENVKVLFNAAKVKTDFDGDKISADKLSDTVTDLGYEVQSMKVK

SEQ ID NO: 3942 - protein, 182 aa, Lactobacillus buchneri
MTTATPEKLFEAEVKQADIDHHTPTAGAMTGHIVANLEVLSNKLQMAKWYVKGMSAQQLKVLFGDLLKQAYDQKDALGTVLIDEALITPSTQKEFTEYTMLEENGQNKYESAEWLVNDFVHDYDTENMFVTRAIKLAEKEDRPVLAQHLIGLLRDNNHNIATLQALLGKTPREGLDEEDDED

SEQ ID NO: 3943 - protein, 325 aa, Lactobacillus buchneri
MKFRTLGKTGYSVSEVSLGTWQLGGKWGTPFDPKDARDTLEEAYDRGVNFFDTADGYQDGQSEKAVGEFVRNHPDVHYTTKIGRKEMPLDIKHFDPTHLDRYVDESLQNMGVDSLDMVLLHCPPMMNYYMPETFFELDKLKQAGKIQNYGVSVERVEEGIKALSYDISAVEIIFNMFRLRPADLFFGLAKKNNVGILARVPLASGLLTGKFTADTKFAPEDHRTTNRHGEQFDKGETFSGVDYLTGVKAAAELKQRLGTDNLAAMALRFILMYDAVSAVIPGASNPTQIERNTTAADLPALTDAQMQIVRDVYDQHIKNPVEYLW

SEQ ID NO: 3944 - protein, 162 aa, Lactobacillus buchneri
MANVVGVAMGSISDWPTMKLACEQLESLGIPYEKHVISAHRMPDELQEFGKTARDKGMKVIIAGAGGAAHLPGMIAANTTLPVIGVPMKTRTLNGVDSLLSIVQMPFGAPVATVSIGEAGAKNAALLAAQILGTTDSAIAKKLADLKETQRVEAKNSEQQFD

SEQ ID NO: 3945 - protein, 377 aa, Lactobacillus buchneri
VSSSSIKTILPPATIGIVGGGQLGQMMALIAKSMGYHVGILDPTPHAPAGQVADFQIVAEYDDVDSLMKLAEQSDVLTYEFENVDEDSLLKAKKVAELPQGVNLLHITGQRLNEKNFIKDCGIPVTKFAAVSDEASLKAAVDEVGYPAILKTVSGGYDGHGQMDINSAADLAEASSLYSKAECILEARQDFIAEASVMVTRDLNGKVITFPLVENRHKNHILHTTIAPGRFSKTVHAKAKQYAETIANQLNLYGVLGIELFVIDDQDVMVNELAPRPHNSGHYTIEACNISQFEAHIRSICGLPIPEIVQEKPAVMRNLLGTDLTLARNLLKEHPEWHFHDYGKAEIRPQRKMGHVTVVGDNIDQLLKSTDILKGEN

SEQ ID NO: 3946 - protein, 243 aa, Lactobacillus buchneri
MTEIVKKDLLYKGKAKEMYTTNDPDTMWVHYMDQVTAFNGKKKVQMAGKGQTNCEISALIFKDLANHGIKNHFIKQIDSNNQLVKRVKIIPLETVVRNFASGSFEKKFAVKHLMKFDKPVQEFFYKSDELDDPFINDFQAETLKVATEDQMNQMRAIALKVNDRLKEIFSEMNIDLVDFKVEFGIDSDNQLILADEISPDSCRLIDRDTQKSLDKDVFRKGLGALVPVYKEILGRLEKVEDVK

SEQ ID NO: 3947 - protein, 87 aa, Lactobacillus buchneri
MALAKVYVNYKKSILNPEAEAVHKALKRLGYGDIEDVKLGKYFELTIADGKSKAEIDKEINEICDKLLANYNMENYHYEIVETEAAQ

SEQ ID NO: 3948 - protein, 227 aa, Lactobacillus buchneri
MKFAVLAFPGSNCEMDLYNAIEDIIKEDVELVSYKNDSLAGFDAVLIPGGFSYGDYLRSGAIARFSPIIPALQDFAKSGRPVLGICNGFQILTEAGLLPGSLQKNVSAKFICKTEPLVVNNDHSMFSSAYQTGQLISLPIAHGDGNYYCDQDTLRELVANDQIVFKYANNPNGSVDNIAGITNKAGNVLGMMPHPERAVEAMLGSDDGKGIFQSIVNHIKSRGVIYE

SEQ ID NO: 3949 - protein, 744 aa, Lactobacillus buchneri
MNSVMDQTTEATPEQIRDNKLYQSMGLTDHEYGLIKDDVLHRLPNYTEVGLFSGMWSEHCSYKNSKPVLKKFFTKGKHVVKGPGEGAGIIDIGDNQGVVFKAESHNHPSAVEPFQGATTGVGGILRDIFSMGARPIASMDSLRFAEPKTDADKYFIQQIVAGISAYGNCIGIPTVGGDTAFDDAYAHNPLINVMSVGLMDLDKIEVGAAAGVGNSIIYVGHKTGRDGINGASFASFQFDSEHESQRSAVQVGDPFEEKLVMEGCLDVINNHSDALVGIQDMGAAGLVSSSAEMGSKAGGNGMELNLDLVPQREAGMSAFELMLSESQERMLLCVKAGHEDEVLNVFKDHGVNAVVIGHVTEGHNYKLLHHGKVVADVPVDSLASQAPVYHRESAVPAHLKNADENQYQPQISNPTETLKDMLGQLTIASKESIYETYDTQVQTNTVVAPGSDAAVVRVRHHDKALAITTDVNGRYLYLNPRVGGAMAVAEAARNIVASGAVPLGITDCLNFGNPEKPDQFYELDQAVMGMSEACEKFEAPVISGNVSLNNEYDNIPVYPTPMVGMVGLIKGLDHITTQDFKQAGDLVYVVGQTEPGFNGSQIQKMQTGKIAGKLFNFDLDYEVKIQKLITAAIQQHLLNSAHDISEGGLITAIAESTFGNQLGVDLSGNLTVADFFSESQSRFVVSVPQEKQADFDKLVGNDAEKLGKVVDDNHLFVQADDGYFDLDVDKAFGIWKGALPCRLK

SEQ ID NO: 3950 - protein, 480 aa, Lactobacillus buchneri
MPSEVKSLNEECGIFGVWGTPDAAKLTYIGLFALQHRGQEGAGITVNNEGHLTTKRGFGLLTDVFDSPNAVDEMTGQAAIGHVRYSTAGSNLLENIQPLPFNFSDTQFALAHNGNLTNAISIRKNLEDRGAIYHSSSDTENLMHLIRLSQEDNLDDQMKEALNIIKGGFAYLVMTKDRLYAALDPNGFRPLVVGQLPNGAYVVCSETCALDAVGAEFKFDVQPGQLIKIDASGITVDKYTDDTQLAICSMEFIYFARPDSDIYGVNVHSARKRMGARLAQEQPVENADMVIGVPNSSLSAAMGYAEESGLPYEMGLVKNQYSARTFIEPTQALREQGVNMKLSAVKGVVRGKNLVLVDDSIVRGTTSRRIVKLLKDAGAASVHLRIASPPLRYPCFYGIDIQHVRELIAANKTIEQMREIFGADSLGFLSVQGVIDSVNLKTDAPNKGLCVAYFDGKYPTPLYDYEEEYDRDQAQLQSMR

SEQ ID NO: 3951 - protein, 338 aa, Lactobacillus buchneri
MDAYKKAGVDINAGYKLVDDIKNLSNNKDLGSFGGLFPLSLGAYQNPVLVSGTDGVGTKLLIAIKANQHKTIGIDLVAMCVNDVLAQGAKPLFFLDYLGVGHLDNEKAKAILAGVVEGVSQAQAKLVGGETAEMPDMYTHGHYDLAGFAVGIADSDKLLSPDNLREGDVLLGLASNGLHSNGFSLVRDILFKQNAYSLNDQLSGCEYDLKRELLRPTKIYVKSVLPVIEQGKIASIAHITGGGLPENVARILPDNLSAEFEYGSWQVPAIMKDLQEIGHLSFDDILHTFNLGLGMVIAVHPDDADAVESQLKAAGETVSRVGKLISGDKQVIIRKDQQ

SEQ ID NO: 3952 - protein, 195 aa, Lactobacillus buchneri
MKSDVKNIAIFASGEGTNFTALTESFKKEHLPLNVKLLVCDHSNVHVLDRAHKESVSTFVINFKDYPNKAAAETVIAQKLEEAQIDFIILAGYMRIIGPTLLAKYEGKIINIHPALLPKFPGRHGIEDAYQAGVDTTGVTVHWVDSGIDSGKIIAQREVPVHKDDQLSDLEQRIHATEHVLYPSVVKQLLERGEI

SEQ ID NO: 3953 - protein, 509 aa, Lactobacillus buchneri
MSKRALLSVSDKSNLVDFAKQLKDLDFEIVSTGGTKKDLEDAGVEVTGVEEVTGFPEMLDGRVKTLHPKIHAGILAKRDDPDHMKQLKDAGITPIDLVAVNLYPFKQTIEKPETTQAEAIEQIDIGGPSMLRAAAKNFAGVLTVVDPADYQPVIDALKAHTDDADFRKHLAAKVFRHTAAYDALISNYLTEEEFPEKLTLTYEKQQSLRYGENSHQKAAFYRKALPSKLSIIPNQLHGKELSYNNIKDANAALNMVAEFDQPTVIAMKHMNPCGVGVADTIEKAWDEAYESDPMSIFGGIIAVNREIDAATAEKMHKIFLEIVIAPSYTDEAFEILAKKKNIRLLKADLSHRDEPDRFEEITVSGGMLIQESDHEIDQIPDFKVVTKVQPTEQQLKALQFGQHVVKHVKSNAVVVTTDTKTLGVGMGQPNRIDSAKIAIQKAMPKDGYENAIMASDAFFPMDDCVEYAAKHDIKAIIQPGGSIKDKDSIAMADKFGIAMVMTGVRHFRH

SEQ ID NO: 3954 - protein, 410 aa, Lactobacillus buchneri
MANVLVIGSGAREHAIAATMLKSPQVTNVYCAPGNPGMKKDNIQIVDIDEMDFPNLVEFAKEHLVDLTFVGPEVPLSKGIVDAFIAARLRVFGPDESAARLESDKTFAKGFMARNNIPTAQFKTFTTFDDAEKYAESLSLPLVVKENGLAAGKGVTIVKDSSDLAATIQHALDKAGEILIEEFLEGEEFSLMLFVGGDKKVVFPISQDHKKIYEGETGPNTGGMGAYSPVPHITQDVLDVTVQKIVNPTMAGLAKEDLEFAGIIYIGCMLTKQGPKVIEYNLRLGDPETQVLLPQLKSDFYQMTSDLIDHQMPKVEWQEGEFYLGVMVSAPGYPTSPKQHIALPDDLPRNIFYAGVTEEDGKLYSSGGRIFTLYNHASTLECAQAKVYAELSRLDLSGFYYRKDIGFRDL

SEQ ID NO: 3955 - protein, 246 aa, Lactobacillus buchneri
MKVIISPAKKMVVNQDDFDVQGMPVYLKQTTVILDALHQLSYDQLKKLWHASDQLTEASYRQLQDIDLYHRLTPAILSFSGIQYQYMAPDLLSEAALTYLQEHLRILSGFYGILKPFDGVAPYRFDMDSRLSIGPAKNMYEFWDDRIYQSLADDQPIINLASQEYAKTVTRFLKLTDRFINITFGHLVDGNIKTRATFAKMARGEMVRFMAEHQVEQISDLKDFDSPNYRFSETDSTADNLVFLRK

SEQ ID NO: 3956 - protein, 292 aa, Lactobacillus buchneri
MKIEEGYMPFKGYKTYYRIVGEKTPGKAPLLLIHGGPGSSHNYFELLDDYAETGRQLIMYDQIGCGKSSIPDDESLYVKETWAEELIALRKYLHLDEVHMLGQSWGGMLEMLYLTHYSQEGVKSVMIDGSPSSIKLWIQEQHRLLKYLSYEDRQAIAEAERTGNFSGPKYAAANDRYMEMYCWDDPDENSPEPLRRPTNGKKASLIAEGPNEFTENGTISDFDVTDDLKNIHVPVLVTNGTDDLCTPLIAKTVYDHIPGAKWHLFANSRHLALLDQHDEFINVLDSWLNEND

SEQ ID NO: 3957 - protein, 232 aa, Lactobacillus buchneri
MKCTSDRESWSCTSKGRSKIVMEKIIAFDMDGTVAETFPVIFDSFRRTVHDYTGKWISNQVILATFGANEVGMLKELIPDYSDEVLESFHENYRRAHLQLRHPFEGIEKLIKELHDRDVITPMITGKGEQSLQVSLDSLGLADAFSPVLSGSPDGSIKAQQFSDVIKQFNATKDDMAYIGDAPTDVVACKQAGIKCYSAAWSINAKHKELEKINPGEVYTSVDQLRDKLIND

SEQ ID NO: 3958 - protein, 416 aa, Lactobacillus buchneri
MENTNAALTHSHTFTKNQKWVIASTSSGFALENMDVLFLSFAMSSMIGQLHLSGGAAGLIGSITNLGMLFGGIMFGLIGDRFGRVKTFTYTIFIFAFATAMMAFANNITLIYILRFLAGIGAGGEYGVGISMIAESFHKNQIGKMTSVAAIGGQIGAILAAITAAIVIPRLGWHALFLVGIVPVVLTYFVRRHLSETEEFVAAKKVEAEKKESTTSAVFKYMFSSPKLAYQSFALMIMTTVQIAGYFGLMNWLPIIVQKQLGLNVSGSSLWMISTIIGMSLGMITFGSILDYFGPRRAFGIFLIASAAMVFTITLAHNTISLLIIGAIVGFFSNGMFGGYGAVISRLYPTEIRSTANNVIVNIGRAVGGFSSVVIGILMDNYSLTVVMGFLSILYVISFITMITLPGLKKMSLKRA

SEQ ID NO: 3959 - protein, 121 aa, Lactobacillus buchneri
LAEKSPKISPYVPNQQDIIYIDFDPSVGHEIRKRRPALVLSNQGYSRMTHLVVVAPITHAMNNSLRESGFLIRVNNEKIDGFVNPLQFFTYDFQSHHAEFVSLLDTPSFVRAKQTITDILN

SEQ ID NO: 3960 - protein, 76 aa, Lactobacillus buchneri
MSVKIRKVGNSNTLTVPNSIKPIAHEFDVFQGRDGVIVYVPKHDNPFHNEAFIESHDLKQQEEFGGKLVGREIPKD

SEQ ID NO: 3961 - protein, 239 aa, Lactobacillus buchneri
MRGPLIVSLDVWNREGLFKIIDQFPTDEGMTVKIGMELFYGEGPTIVKELLNKGFKIFLDLKLQDIPNTVKMGMMQIGRMGVTYTTVHALGGSEMIAAAKEGLELGSEEAGVPTPKLLAVTELTSITEDALENEQNCKLDMVDQVVSLAKLAKRSGADGVITSPLEVSSLKEQVGNDFLYVTPGIRPANFPKDDQSRTATPKQAAEYGSSALVVGRPIIRAEDPVAAYHKMLEEWNYAN

SEQ ID NO: 3962 - protein, 215 aa, Lactobacillus buchneri
MQTNQIIQSLIDHQIVSINLEKPFRYASGILSPIYTDFRLTISIPSLRDMIADGLAENIKENYPDATVIGGVATAGIPHAAWVAERLNLPLIYVRAKPKDHGAGKQIEGRITKDDKVVLIDDLISTGGSVLGAVKAVRNEGVNVIGVASVFTYGLPDADKNFADADTKLVPLLSYADLIAQGHKENKFSDEEYSRLSTWHKAPWDWTKREEANAK

SEQ ID NO: 3963 - protein, 314 aa, Lactobacillus buchneri
MQNNISLAAHIGDYQFDNLLLNAAGVRCSTTDELNKTLDSMAGGCVTKSATPEERAGNESPRMKALPLGSINSMGLPNHGIDYYLKFAEENQGKNGKQVILSIAGLSIDQNIEMLKKVQESSFSGLTELNLSCPNVKGKSQVGYDFDAVRDVLTSTFKFFKKPLGLKLPPYFDFNQFNGIAEVLNDFPITYINVINSIGNGLVVDPETESVVIKPKGGFGGLGGDYVKPTALANVRALRQRLNPEISIIGTGGIKSGMDVFEHVLCGANLVQIGTAFGYEGTPIFERISKELKDIMDKKGYRTLDDFRGKLKTI

SEQ ID NO: 3964 - protein, 841 aa, Lactobacillus buchneri
MPASKLPDHIEVIGGKVNNLKNINVNIPLHKFVAVSGLSGSGKSSLAMGILYSEGARRYLDSLATYTRRRISQVGRANVDSVKHIPSALALRQRPTIPGARSTVGTMTEIFNVLRLMYSRLGSPKCPNGHQVPPTIKIAEAMDVMGDQMGVITCPTCGVKFHAFGAEDFAFNSDGACPECEGLGITKQLDPDRLIGDETKTIRDGAVAAWRTPGRNFMPIVAQAAGVRIDVPYNQLTEKEKEMVLHGQQKHYAIDIPSKNGRVFHMDNALYENAYNAIEDSMKTTKSEIALKRLNRFYCFFTCPMCHGTRMNPNRLGQLIDGMNIAEASHMPLGKLPAFVDRIKQWLPDNMQKLAQNLTTELLNQTQPLIDLGLDYLTMDRAGASLSTGELQRIQLGRTLRTQTTGVLYVLDEPSVGLHPDNVAGLIKIFHQLVDQGNSLVVVDHETAIINAADYIIEIGPGSGVNGGQVIDQGTPAQIRQSQHSLIGPFLTGKAQLVTRKIANDDVFAKGSVTLTINQRFNLNDVTAEFPVNRLIAVTGFSGAGKTTLVLDGLLDAFTAKFHKHSLPSYISKFEPGKMKHIVSVDATPVGKNARSTLATYTNIMDNLRKKFAQLPDAKKHHYTPSYFSYNNKQGACPACGGTGEISLDIQYLPDMVETCPTCKGRRFNQDILNIKWNGKSIADVLDYDVDHAIDLFKDDESILKTLEVLQQMGLGYLHLGEATPSLSGGEAQRLKLTSHMKSRQNDTLFIFDEPTVGLHPLDVHVLLKVFSQLIDQGATVLMITHDLDLMANADYLIDMGPRGGDQGGRIVAKGRPADLVKDPRSLTTKYLAEHFQKFQK

SEQ ID NO: 3965 - protein, 388 aa, Lactobacillus buchneri
MTNATGREQLHKRNLNLVLQQIFNNSIISRIDISHTLNLNKSTVSALYNELDKKGLLQEVGSGQSTNVGGRKPVLVKINEQYGYTISFDLGFRHLHVMGNYLNGEVFYYQRIELGSRDIQKILGMIDHQIKVSMQNDQTKRGLLGIGFSIHGIVQDNQVINSPFIDMKGVDLVGRYSTKYRVPVLLENEANLSGVYERDFNDGKDKNNIIAISIHKGIGAGIILNRQLYRGVNGEAGEIGRSLMFTENFTGSKNDKVEDFCSEDAIIEQVEVQTHQKNLTREDIVQRNRAGDKVVQSELKHFTYAISRVIYNVAISFAPQELYLNSPLIEDIPTLFDDIVDNAQKLGMKIPIRLIPHSGYATLLGCCSLLTHRVLDMDEYNLTFTSQK

SEQ ID NO: 3966 - protein, 221 aa, Lactobacillus buchneri
MVINYVNNLIAGEVAIQSVLNRTTPYHQPHSTIIKGYACVYGGDDRYFNNLFVAETGVSEDDNHIGTAEYDGSPTSMKEYIAAVEQRLPGDVELFETIRQPVYINDNAYLGDADAFSKEQNNIRLRNWDAKLKLTSVDSHIVLQLNVPEELFNTCVPVQKTSSLGKVRLADAVFDNPDGSALTINNGIDKKTGLSKRIIGPFSQLHQGVNQIVLFDDLEPD

SEQ ID NO: 3967 - protein, 433 aa, Lactobacillus buchneri
MAQNENVPEWHGTVLDSEQPKKPIKIGIATGIGALLWLGPYLGVNGVLLPAKVQQIIPNEKAQVVALLASAAMIAATLANIIIGGFSDITRSRFGRRTPWIIAGSVGSLLTLLWFNMVTTVPMMVVAWCSYQVCLNAIVAPLLAFLQDQVAPKNRGTISSIYAFGYVIGQYGGQVVGAQFLSHVGTGIVVMAFLTLLSGPIAAIIVREPSSLGMPKKHFTAGMVVQNFVFPLHQAKDFYLALFGKLLINTATTAIMGYQLYILSDYIQLNTGGQQKYISIINMMLMVTAIIMSITAGPVSDWMKSRKIPVFIAAFLVAVGVAFPMLSNNPWTMVVYGLLAGLGMGIFFAVDQALNLEVLPNPQTAAKDLGILNLANTGSQIIGPIVAAAIVTASHGSYFGIFPVCAGLALVGGIMILFVNEHRDVKVQEENAK

SEQ ID NO: 3968 - protein, 442 aa, Lactobacillus buchneri
MTATQIESTQDSKLVESQLSTTSEKLHNNLEVGIEKRQEIWGFGQTFNELGWQALQSLSEEKRNEILDDLFKPGEGENYRICRIPVGASDYALNWYSLDETPGDYELKDFSIERDKKYLIPYIKAAQKRNPDIVFSASPWSPPTWMKTKPVYNYGILKHDKKTQQAYANYFVKFIQAYETEGIHISQLFPQNEPQRDQKFPSCYWTGEELRDFIKNYLGPTFEKAGLNTDIWLGTINSPLEDTEMTKDETTDYPVITETVLSDPAAYRYIKGITYQWAGKSVLQRTVQAFPELNYFQSESECGNGNNTWTYGEYVFNLFRHYISNGVNAYMYWNSVLQDGESTWGWLQNSMISVDSKTGQTTYNPEYYVMKHYAHYVRPGAHLLSYGGHAAGEATAYENTDGSVIVVMSNSMNHDRDISIDVKGKTYEAHLKEHSFNTFVFS

SEQ ID NO: 3969 - protein, 438 aa, Lactobacillus buchneri
MSYWNVDKIKYVGTGEKKSGLGFQYYNPDEVVGGKKMRDWLRFAVAYWHTFDQRLVDPFGDGTAIRPYDKYTDPMDQALAKVDAAFEFYDKLGVDFLCFHDRDLAPEGDTLRETNRNLDKVVDKIVENQKTSGMKVLWNTSNLFTNPRFVEGAGTSPYADIFAYSAAQLKHSLEIGKRVGSENYVFWGGREGYESLWNTDMKREQEHAAKLFHMAKDYANEIGFDAQMLLEPKPKEPTTHQYDFDAATTIAFMKEYGLDKDFKLNLEGNHANLAGHTYQHEIRVAREAGLLGSLDANQGDKLIGWDIDEYPSNLYETTAAMTEVVENGSIGPRGGLNFDAKPRRSSFEPNDLFYGHIVGMDSFAAGLRVAVAMKNDGVLDDIVKNRYSSFDSGIGADIESGKASMADLENYSLDKTQKDLRDATHSDHLEEIKDTTET

SEQ ID NO: 3970 - protein, 395 aa, Lactobacillus buchneri
MRPIDLANETFFEGDHNVKSHQHILLTAVILIAITGGLVGCSDGSGSHQAADHHASQVATTSSSHATQSAKKVHTHSHHSSTASASQQHQAILNKLVSYTNKESAGPTGDYYWTTGKAHFSHFAGLAAGDYHFSADAQGRSATARAVLTYSEYHLSQGGRQGDPLEPPAWPENKMVSITYGLTGRTYHGYLYNRSHSIGDSLLGAKSYTSNYNFTTGTRPQNVGADQNGGMRAAEEAAENYWEDNPNTHHVIYYQTTPLYKGSETMPRGSIVDVRSSDKSLNTEVVVINDAEGIRIDYQDGSNNAKQYHRRSSTMAYTHHRSTTSTGSSNSHQSATATTTNGGWTIAGSGMVFVSDSDKYYSEVKNPNNYHYESVFQANASGATQASRGNQYARP

SEQ ID NO: 3971 - protein, 245 aa, Lactobacillus buchneri
MSEKVKVTNLVKTFGDNEVLKGINLTVQKNEVVVIIGPSGSGKSTLLRNLNKLEEPTSGSIVIDNVDIARNDVDINAVRENIGMVFQHFNLFKNLSVGENIMLAPVELKKETKDQAAVQAKKLLKTVGLQEKFDATVQSLSGGQQQRVAIARALAMNPDIMLFDEPTSALDPEMVGDVLAVMKDLAKQGMTMVVVTHEMGFAKEVADRVVFVDDGQILEEGTPEQIFEHPQNERLQDFLNKILNV

SEQ ID NO: 3972 - protein, 715 aa, Lactobacillus buchneri
MKRKVLTAFGLLAAFATILFCLALPGSKAQAKTYQIGTDVTYPPFEFANKENKYVGIDIDIIKSIAKEEGFKVNVKPVGFNAAVQSVQSGQLDGIIAGMTITPERKDKFDFGTPYYKTGAVMAVKKGSDITSFKQLKGKKVALKTGTAAADYANSLKKKYGFKTVTFDDSDNMYQDVTTGNSVACFDDQPVLQYGIKHGLKLQIASKPANQGWYGFGVKKGTHKALIKKFNAGLKKIQANGTYDKIVGKYLGNANNSKVKGKTFVIGTDVTFPPFEFANKNNKYVGIDMDLIRAIANEQGFKVKIKALGFNAAVQAVESGQADGVIAGMSITNERKAQFDFSKPYFNSGVVMAVAKNSKIHKLSELKGKRVAVKTGTSGADYANSIKKKYGFKVVTFDDSNNMYQDVSTGNSVACFEDHPVMQYAIKQGTKLKIVTKPALNAPYGFAVKKGHNQALLQAFNQGLADLKASGTYDSIKAKYLGADEIKTAAKTSGNSAEDRTFIGLIKQNKGALWSGLQETLWLTVVSIFFATIFGVLVGLMGVVPNKFSQGTSTTLIYLFRGMPLLVLALFIYTGIPSLTGQKIPAFVAGVVTLTFNEGAYIAAFVKGGIQAVDPGQMEASRSLGLPFGKAMRKVILPQGIRIMVPSFINQFIITLKDTSILSIIGLLELTQTGKIIIARNLEGFKVWTIVAAIYLIIITVLTWLSNWVQRRTKV

SEQ ID NO: 3973 - protein, 390 aa, Lactobacillus buchneri
LKFEESNVLQQLPKQFFAGLVKKVNAKVATGADVINLGQGNPDQPTPDFIVRSMQEQTANPANHKYSQFRGDPELKQAAANFYQREYGVTLDPDKEIAILGGSKIGLVELPLALLNPGDTMLLPDPGYPDYLSGVSLAQVKLELMTLREQDDFLPDYRTIKPEVVDAAKLMYLNYPNNPTGAVATPEFYQQTVNFAKTNHIGVVQDFAYGAIGFDGRKPVSFLQTPGAKEVGIEMNTFSKSYNMAGWRIGFAAGNADMIEAINLIQDHLFVSVFPAIQKAAITALNSDQQSVHELVALYEKRRNQFFKAARAIGWEPYPSGGSFYAWMPVPEGYTSESFADLLLDKAAVAVAPGNGFGQGGEGFVRVGLLIDEPRFTEACQRIAKLHLFD

SEQ ID NO: 3974 - protein, 343 aa, Lactobacillus buchneri
MNRVVKKLTLLAVGLLSFALMIDVAATSADAKTTAAKVVRVTPQKSTAYRAVKGIIYGDKTLTQKLHNAKNYPETIFYATKRVTVRKPNGKTAVYYYVANKSKTITGYIWHGYLTKTQVAMSQKSLMKLINAAPDMNPDETILSLKPVNYETHEAVFDLAYNVFHFSPTSMFKDHQALIYVANPELNQHVQNAMNKWNTALGETVFQMGSQSHYTLKISFGSGTKEGWDGLYDGRQIYIDKAHYHDAKYPLGYIKPSLAAKFTIDQYWDGVLAHELGHTLGLDHTGYQADLMYAATSAGNMIAKYAWQKPVEKSINGLDGTEMATITNRDLNRAKLTKLLGYW

SEQ ID NO: 3975 - protein, 106 aa, Lactobacillus buchneri
MLAESRELIDKYHQYFKRLPNYQYWLVIVDNHFNDRYYFFIYSRKLKTKLVRSHELLALVHDPHKYQQVLSDLKNMSHLSIEYRDTTHLVEPMPEITTDKIHGHNF

SEQ ID NO: 3976 - protein, 430 aa, Lactobacillus buchneri
MQTPLDNPSLLPSHDIMCIDCKSFFASTEAIKRGEHPLSAKIAVMSREESSGGLILAASPYTKKNFGVKLGTRRFEVNDQMDIEMVEPHMADYVALNYRINRIYRQFTDDIHWFPYSIDESFIDVSHSHKLFGSNAQIAKLIQDKVFKATGIVTTIGIGQNPLLAKLALDNAAKKKEPWQAEWDYADVPDTIWQIPDLADMWGIGSHTAVKLNQLGIYTIKELAHADVNLLKKKFGVMGEQLYYHAWGIDYSNLEKRYLPRSDNKGYGNSQVLMRDYTELGDLKTVFGEIADQVATRLRKNNVVAEVVSIFIGMATTDKQGRTHFSAQMHVEPTNSTKSIANAVHYLLESKWDGSAVRNVGVRCNRLSKKRETRFSLFEDPITTLDKEKLEQTIDIIRKKYGYKALIRASSKTKGGTAIDRAGLVGGHQA

SEQ ID NO: 3977 - protein, 270 aa, Lactobacillus buchneri
MDEQATMELTTKENELANKLFNAYETHKPLKESDYDGVVKDEKSAYRVQRRLTQLKQEDVGGYKVSLTSKQTQDMFDSDSPLYGAQVKSHFLQSPVTLHRGELMEPLAEVEMLFTAKEDLSSKDSLEDLMRKTKVAPAVEVPDSRFSDWFPSLSKYMVMSDAAVGGYVVYGDEKDTNLLFDNVDDLANVKCELFHDGKKLKDGASSEVLGNPLKSLHWLVEKLESQGMPLQAGQRVSSGTFLLPESLSNGDWKATFDKGLGAVFLKVAGD

SEQ ID NO: 3978 - protein, 63 aa, Lactobacillus buchneri
MESVISSSNENPGQIQILQTHNFNRHSAIDITTHIFHVTEWSSLYIQLRIHRLNTIYGGNAYG

SEQ ID NO: 3979 - protein, 42 aa, Lactobacillus buchneri
MTIIKFKLKSDEEKRHFPFVIRELLVGVKQFTSLDDYHLRAM

SEQ ID NO: 3980 - protein, 188 aa, Lactobacillus buchneri
MATEKEKFLAGEPYLVMDPELTNDETKARRLCKMMNELDDTAGAEKEALVRKLFGSVGKDPWVQPNFRCDFGYNIHVGDNFICNYDNVILDIAPVTIGNHCMLAPHVQIYAAYHPLDPKQRANFVGLGKPVTLGDDVWVGGGSVILPGVTLGNNVIVGANSTVTKSFGDNLIIAGNPARVIRENPNKE

SEQ ID NO: 3981 - protein, 89 aa, Lactobacillus buchneri
MKAVITVIGHDQIGIVAKVSQRLATLKVNITDISQTLMHGDFTMMLMGEWDDDDVQFEVVKQGLQDLANETGLSINIQRQELFDAIQKL

SEQ ID NO: 3982 - protein, 447 aa, Lactobacillus buchneri
METKQILETIQMISEEKLDIRTITMGISLFDCIDSDGVKARQKIYDKLTTSAKDLVKVADRIESEYGIPIVNKRISVTPISMIAAACHDDNYVAYAQTMEKAAETLGVDLIGGFSALVQKGYQSGDRKLITSMPEALSETQRVCGSVNVGSTRAGINMDAVKQMGQVVKDLSEIDPVSCMSLVVFANAVEDNPFMAGAFHGVGEADKVINVGISGPGVVKRALEQVKGESIDTVSETIKKTAFKVTRMGQFVGNVAAKALNVPFGIVDLSLAPTPSQGDSVAEILEEIGLESVGAPGTTAALALLNDAVKKGGVMACEHVGGLSGAFIPVSEDSGMIKAVEHGNLNLEKLEAMTAVCSVGLDMVAVPGDTPAETISGMIADEAAIGVINNKTTAVRVIPAKGKQVGEQIDFGGIFGYAPVMPVNTNSPAKFVQRGGRIPAPIHSFKN

SEQ ID NO: 3983 - protein, 142 aa, Lactobacillus buchneri
MKLIVESSKPARGAAAYIRMSVFVLERGIAFRDEFDDKDSDSMVYAVLFDDKVPVATCRFETYNDHTLKVGRVATLKEARGHGFGRKVVSALEDKAKQMGFTHSLIHSEMDAVKFYQRLGYEITSDVFYEDGVPCVVVEKDL

SEQ ID NO: 3984 - protein, 166 aa, Lactobacillus buchneri
MSFEKVKQYFDEVGLADRIKVLDESSATVMEAAEALNCEPEHIAKTMSFLIDSHPLLVVLAGDAKVDNKKFKAEFHKRARMIPRDQVEEYIGHQPGGVCPFALNQGVKVYLDVSLQRFEFIYPAAGDTHSAVKLSVDELSKYANADRWVDVGKDWPADPKVSPIRG

SEQ ID NO: 3985 - protein, 462 aa, Lactobacillus buchneri
MSRKEKFAKKPKKKIWIRILVGFVLVLFGGFVGSHFYFQNHFKFTKINDVDVSGLTVAQATKKLNTSHIDEDGNYLVVRDSKINVNSKDVKKLFKHRSSMSAMTSAKLSAKSDVTNKQLNYRLKTLLPKFENRVDQINTGRKQTIDSKVILKNGKIVVQAGQQGSTLDKAKMVKDFKKQAKSSLLISVKMTKDAYVKPNSTQIAKQKKQLANILDNTVTLNTYNKTYKFVAKRWVANGYPTANGTYKFDSTKIKNWVAKFANKVDTLGKSVWITTHQGKRVRVHAGGTYGWKVNQSALTKNIMKNLGRSHSVTMNLKHYAVGTGYGVKGSGKTYVAIDLQRLHEYVYKNGKLMANIPIMSGTLTGGNRTPQGAFYIMYKQRHATLRGKNSDGSKYASPVSYWEPLTNSGVGMHDSPWQPASVYGNPSARAQYHSHGCLNNPPSRMGEVWKNTHTLEPVFIYY

SEQ ID NO: 3986 - protein, 176 aa, Lactobacillus buchneri
VHLYKHVDISNNRNLVYGLNVVAVIAFLGFLWLFGAIVGSMTVNFTESYFVWLIVALLVIVTIHEVLHGILYKVFKPNGKIKIGFKSGMLSVSSPKSLYTKQQFIWIGATPFVVISLVLIAIFLLGWLPGELFLPLAALHGAGCVGDFYLLWLVISSPKHYYISDQENGIDIYSPN

SEQ ID NO: 3987 - protein, 107 aa, Lactobacillus buchneri
MSTNRIVNALSYLSIVFAPFIFPLIVWIVSDNNPDMHSTARHALILHLIPLVLTILTILVVGISGVISEKAAFAGFLFLALIALVILVDLAMFIYNLYLGIKILVQD

SEQ ID NO: 3988 - protein, 156 aa, Lactobacillus buchneri
MNKLLKVAVITAASFIFTIFVNHQPAQAADTYYHVGAIHSSTPTSWRGNWYSYVNGKFCLTQINKYAVTQKYNGKQHTLYKSTWKSYRKLAVAKISGTNRYTFNAYATKAYQSDRGWRKTHRTVEGQKISVLRDYSGGGAFVDLFRSPVYKSYSNH

SEQ ID NO: 3989 - protein, 983 aa, Lactobacillus buchneri
MQKFKEKHLLSLIVWIGLILVAIFTLPNISQLVHDKGTVQLPASVQSEVANKIEKKYEGGKNARTLIAVFNNKHGKLSDEQTLQIQDATNAVKNDPDLHIISVTAPSDNQAAKQQLQSKDSTTQMVMITVPKKDKVRGQTDKILDKIKTPGMRTYVTGSDVLNEDFSTVTEQGLQKTEIIAAIFIFIVLIIVFRSFLIPVISLLTVGVSYLLSLDVVMNLAQRWDFPISNFTQVFLVVVLFGIGTDYNILLYDRFKEEIRKGQGATDAARSARRHAGRTILYSGSSVLIGFAALALAKFSFYRSGVAVAVGVAILLMVLLTLNMFFMSTLGERLFWPSKNLAAHDRSFLWNFLSKFTLSHSFIMVGILIIAALPLLFVGSQKLNFNSADELPNSVQSKAGYNIIQDHYPAGMSGPTTVYIQNKKPLDTQQHLAEIDQLTGYLNSEAGVKSVASVTRPGGTKIDSLYLRSQLESLTNGLNQANQGIKKVQKGLKSANEKLANSNTSESIAQVEKLADGASKLEAGAQQLSQGVTSYTAGVSNLASGSQQLSSGTSSLQSGVGRLSAGSQRLNTGISQVRSQTAKLKALRARMAALQSGSRQLSSGLGRLNSQVAPFSNGLNQITSGASRLNSNSSSLVSGAQSVASGSSQVNSGVQTLNSKMKELQSQMQELQTGLTSANSGLDQVSSGTTTVNKYLKEMQKSYLGNTFYMPAASIKSASFTPSLDAFMSKDRKITKITVVLNSDPSTTKSANRIRTITRDLNAKMKDTSLKNAKVAIGGQSSQTSDLQKIANGDFFRTVVIMLVGIGLALMVVTRSLVQAITIIGTLIVTYMGSLQITKWLSGYLLFQNMLTWNTPFFSFIMLVALGVDYSIFLMMRYRGDAGAIPDVRRRILNSATIIGTVVISAAIILGGTFAALIPSNVLTLIQVAMTVIVGLIILVLTLPIIMSAMVKWTYPYVNDKMYQKSVDKEEKEHPIRRSKDKQ

SEQ ID NO: 3990 - protein, 192 aa, Lactobacillus buchneri
MKYDLTKKPTRGAQRTLESFSTTMIALLSKEPFEKISVNEICAVSNFPRATFYNYFDDKFDLAAYCWYVIAQEIEVDQATELKADRTLITYFDRLYDVFKNNQTLLDNVLQYNDFSGQLVNSFINYFKNKLQEILTKSIDYSKAGLPVELIVDHCSQTVVLVLKWIFLKHHDADKQQAHEYLEKLLNIEHFI

SEQ ID NO: 3991 - protein, 99 aa, Lactobacillus buchneri
MVLTSDEAAATKQELQGNFELSGITLQMAAVDLKSTPEHIQDVLNLKNCQKEEPWILRNYLIKLILLQEKEPYSFSKLIGDPKRYQFLNSRLIDRGELA

SEQ ID NO: 3992 - protein, 237 aa, Lactobacillus buchneri
LKTITSKLILGLGLTLAIGAFTLTPTDTEAKSTMTVTSNQALVADGNSRNYLTTGAAPLYSKVPVYKSTKVVTKAAVLKTLGTTADAGQTYFRGYRAAQTSNGDWYLKVVSFDKTYRGWIFAGTTDPTTNPSDVSGGLKATTTFQESTVPTYFANTTMYFTTPKASTLTYVAPDYTQYKVGRNLNATADFYKDPLTVTKVGTKQNNRDGNATYYYVTDAAHPQVNGWVKQSDVTTSR

SEQ ID NO: 3993 - protein, 617 aa, Lactobacillus buchneri
MEKHEWLFSQVRWLFIVIAFVGMVIGLNTQLVDAKASSLETDFQRAAAKYQVPVDLLKAVAYNESAFDSHNGKPSVAGGYGVMHLTDTTGLTPSGADSKAVKVPNAASLHTLQKAAKLTGHSVSQLKTNSAANIDGGAALLAAYQKSSGKGLTSNIGSWSAAVKKYSQSDFQAAADFFAANVYKILAKGVNHNGAKISPQKVNALKDEAIDTTGESGQTDGPAGLPIEWIPALYKTFDDQGDYGNYDLADRPNDEKINYIVIHNTETSFQEALTLFSTPTYTTANYVVSSVEGTVAEMVRPQNVAWHAGNWYINSHSIGIEHEGYAAVGGYWYTENMYKSSAALVKYLADKYQIPLDRQHIIGHDNVPGLTPAAQKGMHWDPGTYWNWNHYFELMGVDLSKSDGSTDSHIITITPNDKTNLTADSGQKVTDDGVSLPLTGSNFVYLYKQPSFSADLIADKDFSSGQAGTTEKDDWGDKAVYGQQFSKIDQQGDWTEIDYGGQDAWFYNPGGANSTDATGKLVAAKGSKAVPVYGSAYPSDSILKKNKVTGIKPTPIYQLQPGQKYVYGGTVTSDYFNSHFNSNSPKNVIHGTDDYYQIQFNHRIAFVKASDTTLSDD

SEQ ID NO: 3994 - protein, 473 aa, Lactobacillus buchneri
MRIERDCIGEMFVPDNVLYGIHSLRAKHNFPITNEKVDPAIIQSYLQIKKAAALANEQAGTLDKEKSALIMAACNQLLFSNDYSVFIVPAIQGGAGTSTNMNVNEVVAQLAMQLSAQGGKEPLVIKPNDDVNQSQSTNDTYPTAGKMAMLKRLAPLTSAVSSLVDALTDKAAEYSSAIKVGRTQLQDAVPTTFGRTFTAYASMFKRDLSRLKHAQKVLSQVNLGGTAIGTGINATAEYESAIIPILNKYSHLSLHQAADLVDATQNSDAFTTISSAMKSLAADLSKFSNDLRLLSSGPQAGLNELELPKKAAGSSIMPGKVNPIIPEVVNQVAFETIGNDVTVTMAAESGQLELNAFEPIMFKSILTSEQHLTKAIETLVENCVSGIKVNAAYCRKEVEHSSIAATVLSPLLGYEKTTALIKEALATQQSVKALVKQKQLLPDSLVDNLFTPEVLTNVRKVKKEKSAAGSNLN

SEQ ID NO: 3995 - protein, 939 aa, Lactobacillus buchneri
LKNWGDLTMKQNKSTLIDDDAKADPTDLMNQFQTSNGGLSQAEAEKRLEKYGPNTIRQGKRKSEVLIFLENFTSLMAILLWVSGVIAMFAGMLELGIAIWAVNVINGCFSYWQQHAAQKATDSLKKMLPSYVKVRRDGKSQQIKVEQLVPGDIFDIQAGDSIPADARVFNAANLQVDESSLTGESVPVEKHDAYQHGDGEFAQQNIVFAGTICTSGTATALCLATGMDTEFGRIATLTESQKKTVYPLERELNHLTRQLTIIAIMIGVAFFLLAIFFVKYPVTKSFIFALGMIVAFIPEGLLPTVTLSLAQGTQRMAKKHALLKNLSSVETLGQTTVICSDKTGTLTQNQMTINHLWLPSQEYDVTGTGYVTNGQIQLNGHQVDLAGQPDLEKLLINATINNDTEVTEGKAGEKSKILGTPTEAGLVILSRKAEIDAAAERQKFPRLKELPFDSGRKLMSVITKNADGKLVINTKGALGSELNVCDRILDNGHIRPLTADDQAKIMQVNENYAKQGLRTLAFSYRVVDENDPLSQQSLESCTIESAEKQMVFIGLAMMSDPPRPEIFDAVRNCRRANIRIIMVTGDSPTTAKSIATKIGITSDKVRVISGSELDKMSDAELQEAVKGEVIFARVAPEHKFRIVSMCQKNGDVVASTGDGVNDAPALKRADIGIAMGVTGTDVAKDAADMILTDDNFASIVSAIEEGRTVYSNLQKFLLYILTSNVPEAAPSVIFLLTRGLVPLPLTVMQILTVDLGTDLLPALGLGTEKAEPGIMDQPPRPLNSHLLNRSIIWKAFGWYGLIASAISTFAYFFVNHVNGWPQVPLAGSGLVYAEATTITLAAIVFSQIAAAMNCRTQISSVFSIGLFSNHRILLGIVVEVVLVALLMYVPFLQGVFNTGPLNVTEWGFLFCIPVPIFLIEELRKYVVRQIKKRRAKTSV

SEQ ID NO: 3996 - protein, 150 aa, Lactobacillus buchneri
VAEILRPIGAIARALDSIANVEFKRFDLTKGQYLYLARICEHPGIFQDQLAGMIKVDRTTAARAIDKLAAKDFVVKRPDLTNQKIRRLFPTEKGQATYPNILRENQYSNQVALKSITDDEADQLERLLHKVSANIDDDWHYVKKGNLRKY

SEQ ID NO: 3997 - protein, 178 aa, Lactobacillus buchneri
VTIVIRKCTLADLSELQQISRETFADTFGPENSPANVNQYLDESYNLDRLKQELTDPDSDFFFALADGQVAGYLKVNVGNAQTEAMGNHALEVQRIYIKPAFKRQGIGSKLMAQALAVAKDKHRSTVWLGVWEYNLVAQQLYQKFGFKQTGDHVFTLGESRQRDLIMSRTIEGESRHS

SEQ ID NO: 3998 - protein, 238 aa, Lactobacillus buchneri
MKKFILDPKTIELFPDIHIDVMTLHGIDNHVNEKDDPYFQKLLDEGTEAAEQFITVDPFRDNPVVAEWREAFRKFKTKKGARSTIEALLKRVSHGKRFSPIAPLVDIYNSQSLKYGVSVGGENVDAIAGDMHLGEAKGGESFLPYGETEDMPALPGEICYMDDKGAVCRCFNWRENQRTELTEDTTNPIIDIESINEDQSARSDVAIREIQRLCKEYFGVVGQLQQLNAENPEIVIAK

SEQ ID NO: 3999 - protein, 194 aa, Lactobacillus buchneri
MSEEKTKSCVMCGKTIPAYSNFCPYCGAKQPWLEEDEVQNKDVEQFMKWYQKPVGKFISLVAAALVIYFVGSLFTLQDGPGHKTVARELNQYLFNAQDKTPYGKKPSVEADKNKGVTIKVSQNSQAVKELKAGNPDKWNYLVNRSRDRSKAFHKVYANQAYAKFKVIDKHNKKKVLLKVDSGDIKYNIADKYHK

SEQ ID NO: 4000 - protein, 208 aa, Lactobacillus buchneri
MHIDFVKLSKDKPTIGKMTQTKNTTFGEWVEIGSSNLIDNSSIGDYTYTGQYCFIQNSDLKKFISMAAMIRIGPTNHPYDRPAQHIFAYNGGAYGFDHPDTEFLEKRTHLRTTIGNDVWIGHGVIIQAGVTVGDGAVIGSGAVVTKDVEPYTIVGGIPAKPIKDRFLDEIKTDMEEIAWWNWSREDLEKYYLDFRLPVKEFIDKHLPN

SEQ ID NO: 4001 - protein, 392 aa, Lactobacillus buchneri
MFEVKTIDRFDLTDFAGDVFRTSNTDTPDAILVRSSKVDDSLISKRLLLIARSGTGTNTINVDAATANGTAVFNTPGVNANAVKELIIQNLFRCLRPLNGAVQMMQQLKVAPGEDLQAAAEAKRGDFIGEELYGRTLGILGLGTIGQRLADACYHMGMQIIGYNRSFKNLRHVQQLDTIDEVLEQADFVVILLPLTDQTNQLLSTKQFEMMKDSAYLLNFGRGEIVDNQAVVSALNHNEFAGYVCDFPKTELQDHPKITLLPHLGGNTIEALTHSANLILQNLLDFLEYGTVRSSVNFPRVDLPFMSNQRLTFFFHARDTFWVDVAGIMSRYDLPVQEMMGNTMDGYGYTIVNTDLAEITQQQTQTLLNELNQIDGMIRVRLLNNPTQGEWQ

SEQ ID NO: 4002 - protein, 373 aa, Lactobacillus buchneri
MRIKAAVVNKKGGDFEMKDDVELADMQADDLQVHMVASGICHSDEALRKGTAEIGYPIVLGHEGSGIVEKVGPEVKDFKPGDHVVLSFYGCGNCINCLKGIPTQCLNYAANNLSGVRPDGSAHFTENGHQVADMFDQSSFTTTTVVRERNAVKVDKDLDLRQLGPLGCGYVTGSGTVFNTLKPEPGSTIAVFGTGAVGLAAMMAGRISGCTKVIAVDIVPDRLKLAKELGATDTINSKDTDPVKAIQDLTDGYGVDYAVDTTGVKSVMEASIKALAQGGTTATIAVTDQHVDLDTWNDLCVSDRKVVGVNMGDSIPQVDIPRLIKFYKMGLFDFDKTEKFYKFDDINQANADSVSGKTIKPVLVIDEDYKPGK

SEQ ID NO: 4003 - protein, 491 aa, Lactobacillus buchneri
MAQNAVALKHYQMYINGKFMDSKSGNEITVLNPSTGEKISTVPAATREEAKEAIDAAYEAEKSWKKVPAATRGQYLHDVATEIRNEKDHLVEMLQEEQGKIKSLATTEIMFSADYFDYMGSAARTYEGEILQSDNKNENIMIAKQPIGVAAGILPWNFPFFLIARKMGPALVTGNTIVMKPSSDTPNLGLEFAKIVEKVGIPKGVVNIISGRGSVVGDELTKNKKIGIISLTGSVDSGKRVMAGAATHMAKVSLELGGKAPAIVCKDADIDLAVQSIIDSRVDNNGELCNNCERVYVQEDVADEFIKKLSDKMSKITVGNVMKDENVGMGPLINQEALDKVSGMVDRAVQAGGKVTAGGHKLNIENGFYYEPTVITNVKQDSEIVQDEIFGPVLPVLTFKTLDDAIEMANDSDFGLTSSIYTENLDNAMRAANELEDGETYINRFNFEAMNGSHSGWKESGIGGDDGRHGIEEFLNTHVIYLQGHPEKAQG

SEQ ID NO: 4004 - protein, 73 aa, Lactobacillus buchneri
MTPSNIIGGILTCGVGLFLIVAGLMVSKGKWSRMVAGNLFHDDQKSVGRHKKAIGGLFIILGGLCLVFYLVLF

SEQ ID NO: 4005 - protein, 88 aa, Lactobacillus buchneri
MTKYTATISKNGQLVIPAPVRHKLNISAGTKLSIQIDQNNNVVLSKVPEVSDWKKLLANIPDERVELDQEGHYDPDKSPELDDWMRKG

SEQ ID NO: 4006 - protein, 239 aa, Lactobacillus buchneri
MTNFIFVLLPAVLAGIVQGVTGFGSAIVLMVFLPTILPIPQSAGVASLIMSVSNIMLAWRYRHSIKFKRIIWPFVVYASVAFMALQLVNSINVHLLKSMLGGLLVALSLYFLFVKSEGRKHYPIYIAIIFMIVSGFFNGLFGIGGPLTALYFLSLADTKEEYLASIQAFFLIDQLYITSIRFYNGILGLNDVPLILLGIVGGVIGTMIANRITVHMNISMIQKCVFVLIGVSGVFYLVQ

SEQ ID NO: 4007 - protein, 470 aa, Lactobacillus buchneri
MSKQNRYSLIIMIFGAFFGILCSTLMNVALPTFMKVFAISSGTVQWISNGYTLVNAIMIPVSAYLTKKFTFRSLFIFFVSVFLVGTIFGALAPNFFTLIIGRMIQAIGAGMMMPLVNTLAIRYAKPGKKGAVMGIVGLAFNFSPIIGPTLSGVILNYFSWRYLFILVLPFIVIDLVMATIALPKIPTNQEPQFNTEGLMTISFGLLGLLWSFSNVSQFPITSLTVWLPFVVGVVLITMFAVTQGKSDHPFVNLAVFKNSQFTTATLVNSLIVSTMYGNTILLPLLIQTIMGKSAIISGLSLLPGALLTGFMSPISGRLFDRYPVRIIVTTGILIDCFGTMMQAFIDVNASVLMLTMGQTIRQLGLVLILIPIQTQALSYLPNELIADGVAAFNTLRQIAASFGTAIIVATINIASHFFAGHANYQQMGIQAGFTMCLAFLVVALFMSRKLYTKQSPKLHRKSQSNLSHVS

SEQ ID NO: 4008 - protein, 148 aa, Lactobacillus buchneri
MNKGTQLIVTAIASLGFLGAVTTSTQAATWHKGTPTALRGHWKDKTINIGKYFGMKKFDSYESVRVRKSSVNAYLTQSAGWHITDTKWKADGKTAYTIVGRNELNKLHQARFTFKRVGHGYVHVYYDGSNIAAETPFSPNFYRVSKKA

SEQ ID NO: 4009 - protein, 104 aa, Lactobacillus buchneri
LKQTMSVPCTNNEITIMVDSINYQYLALRRASLDVAPLEQVNVTLTDEDVDGHAYYEVAGFSVAQKAQLASVDLVPGDYVVYRAVPGSEPSMVIQLVNKFDQAN

SEQ ID NO: 4010 - protein, 121 aa, Lactobacillus buchneri
MIRDVPRDQWLYNDRGMVKWLGYFLSDHTQDMADKKVDEVPTHRLPEQDPEVIDRVLQDSWQNSKQITLQLNDDGYLNVYNISGIVIGTNGDLIYLQTDKLVTINVNDIRHAKLKEGSKSI

SEQ ID NO: 4011 - protein, 56 aa, Lactobacillus buchneri
LRTVYIFTIIIASIAMFLIDYYVSLPHVLRACTWLGFIVIVGICSYQIMAHWHNNQ

SEQ ID NO: 4012 - protein, 390 aa, Lactobacillus buchneri
  misc_feature (5)..(5): Xaa can be any naturally occurring amino acid
NADHXIDASEMTKYNFLQPTQLRNGVTIKNRIAMSPMTEMSSFEDGSITGDEIDYFRLRAGGPGMIITGCANVNDLGKGFEGELSVAHDNMLPGLSRLANAIKINHTKAILQIFSAGRMSNSRVLRGHQTVSASAVAPQRLGAEPPRALSAEEVEQTIQDFANATQLAIDAGFDGVELHGANTYLIQQFFSPHSNRRTDHWGGSLEKRMNFPLAVVDACAAVIKHSDNPQFILGYRISPEELEKPGIRIADTLALVKELNQKPIDYLHMSLADAWQGSIVDRDDQQPLFEKVQAVLADDLPLMVVGHLASPAQVAKLIDAGVQFAAMGRELIREPKWVQKVEAGDEKAIRYTFSLRDLDELKVTPPLLNFLRTAFKKGFPISTDEKQIRI

SEQ ID NO: 4013 - protein, 152 aa, Lactobacillus buchneri
METLKMIQSRKAVREYSGQVSDDQLHEILVAANASPVGMGRYDDYRLTVIQDPTVLSKMTGIYEAPTVIVVSVKEESASDEISAGAIVHNMELAAEDQGLGANYNMASLESIPSGVVPDGFKPAFALTLGQTNDTFTPREIPLDRIKTNTVK

SEQ ID NO: 4014 - protein, 479 aa, Lactobacillus buchneri
LNKFQTTSSCTAFLAGKNATTDGSTMIARNEDAGGGVNAKRFVVVNPTDQPSEYVSTFNQFRVKLPNNPLRYTETPNADVSDGLWGESGINSDNVAMSSTETEFTNTTMLGLDPLVADGIGEEAMLTCVLPYIHSARAGVQRLGDLVTKFGTCESNGIAFSDSDEVWYFETVGGHHWAAERIPDDAYAVAPNQTGIQEINFDDPDHFMYSDDLKAFADKYHLNKARSGFNFRDIFGEDVQADHYYNTPRVWYGQKMFNPEIHQDPESRTMPFTRVADHLISVEDIAFFLSSHYQGTDFDPYGKTGTEESRLRYRPIGMNRNQEMHILQIRPDFPAEHAAIHWLAEGVNEFNAPVPFFANCTDTPDNFKHTPLRTTTESFYWLNKLVAMLADPFFAEHDLEAMTAVSESRKFGFANGRAAVATADAEFKNIAKDKLPEWHNQVNDKIAHAITENVKDLLHQLLLLRAEKMVPTFEKGGEL

SEQ ID NO: 4015 - protein, 139 aa, Lactobacillus buchneri
MFKKSILLAVTALGLGGFVSVTQSPVSSAASMPGSLSYHKANFNAKIGTNYKSFKLTNHAPNSSYKNIKTTSWKKSGLKAGTKVHVDLYANQGLQFNWYRITKYSTKKATKHTKVQKYWIYGQALVLPKSITNQLALSY

SEQ ID NO: 4016 - protein, 502 aa, Lactobacillus buchneri
MDRKIPNIMGTQHPDNAGVPFFKHNDNAFVSAFREIDEAYQNFSKLDADEYMWDWEGKHADASVIDRLYSEHYEYFQKHPLGKDKYLTFRLPNIWEEKGYSLMQAMTTILSAEDFAYDLGFKERPLFEAILPMTQSADQLISMEDKFASLSHYKSTEFNTGHKDSDTLQMIPLFEGFESQLHAPQILKKYLEMYKDHFGRELSYMRVFLAGSDSALSNGFLNSIIGNKLALTGLAEFEQESGLPIYPIAGTGSTIFRGGLSPMMIDRYLEEFPGLKTATIQSAFRYDYPLDVVEPAIIKLRDGLQKSKFEIIDHDDQDILLEIAKKAAAEYHETLDPLINDLQPVFDAFPKRRDRHQHVGIIGYSRDVDGYKMPRAITFTGALYSVGVPPEFLGTGRILNKLSDKELNTLMKYYPNIKHDYAHVAKYFSKDALDALQAKNPAWKAVDEDIEAVERLFGIQAGPQTPEQEKHAQLAADLVKISDKETKTTLISRQAILRKFLG

SEQ ID NO: 4017 - protein, 141 aa, Lactobacillus buchneri
MQDERWNNPLYQTEAVNDEGLNGHAYVPDGIKVETSSPLNSKPGTNPEQLLGMSLATCLEATLQAVEREHGVPHTAEVHVKVAYIGERAEYQFLVHAQIMVKGVDFETADQFAQEAENRCPVSKLLKNSGNYTAETVTSFD

SEQ ID NO: 4018 - protein, 95 aa, Lactobacillus buchneri
MKVINVELSVKPGMQSDYEAFIDELVDGSRGEAGNVSYDHFKKLHSDTEYEIIEHWQDEKAVEFHNNTPHFQKFLAGVGDFLTKDPVIIRMDYNE

SEQ ID NO: 4019 - protein, 210 aa, Lactobacillus buchneri
MGKPITVTLALMSTLLLSACGTSNSAKKQVNHHFDSQKTAAEYKHDREAEGINLANFNRINIGDITDAAYGSSEDQVLKLFGTPSHVDTVNVNGVTKKTTQYTWKDVSATFPVAKVKVQFLNHKAVGKSYTPAAKRKQRITAKSKINQLGLGTTYQAAINALGTPNGQSIIGQGPMSAKYLLYVTDKKGTAYDLTFTDDKLNNKFKTSIY

SEQ ID NO: 4020 - protein, 258 aa, Lactobacillus buchneri
LANQPLVFDYQAAQGKPENIRHPEGYCPFCDVEHLTNILARDDDRIWLVNKFRTLEDTFQTVVIESSDHLGGPSTYSVEQNRQVFEFAFKCWHQMIVSNKYQSTIMYKNYGPLSGGSLRHPHFQIVGLDNYDVYQNVDISNFTGVEVIHDERCEITLSTQPIIGFVEINIAIEEVGHINDLADAVQVIVKYLLNDYMGGRLSSYNLFFYEMADKFYCKIVPRYATSPYFVGYKIAQVQNEGRLEKIAADISERLSANQ

SEQ ID NO: 4021 - protein, 344 aa, Lactobacillus buchneri
MATIISVSDLAKLPDLQAPVITLNLNLRKLSFDQSEQLRVKNMLKKIQKEVGDDIAPFIADVNDLTREQLPYEGMTVIADHLSKNVYHLIRTSVDEPDYRIEDAIDFLLLLSEAPNQDYTLIELNRDNSKLYQLSNKRVTALDVKEYPANVKEALGEELRGGELNFSARGGNAQYHGHNETTQEKKIDQERYYRVIMDFLKGNVELAQHQFVLMGLSQNINLFKKVNNGLQLADFEVDQSVQNDTTTEIAKLVNTAIDTYNRENTAEAITKIFKDQLFTDFQNIENLLKSREIRHLFVASRNEIKAADPKVYTKINQMIKQALAQDTRVTVVNDDPSVPLVSAV

SEQ ID NO: 4022 - protein, 72 aa, Lactobacillus buchneri
MDIVLAVVWILLATAVFTIVVGAFYLIYKNARGQPSPFKWRQLFVALAVLSLLFTLFGGLISIITNLQYGNP

SEQ ID NO: 4023 - protein, 185 aa, Lactobacillus buchneri
MIKWLPYLLNITGVLVWLKIQSRNLRQLTWCQLFTIVTSIIYILVVSYLTLAPTSYAFVGPQQVSPMMIGSAPINLIPFWSTTADFYQNVVMMLPMGVYLGLLLPKFNLRKVLLTGLGVSLTIESLQFVLDLSVGLSRWVDINDVLTNTFGVIVGWLILKGLMHTIFQRLLSHFAITAFSHQKGK

SEQ ID NO: 4024 - protein, 132 aa, Lactobacillus buchneri
MAKLNQAMKDMIAGELSYISTVDADGNPDVGPKISMRVLDDEHLIYNEMTGGQTQANINNNGKAIVAVANAKALKGFRFGGTAKLYTDGDYFDQAAKWAEGKFPAPKGAGVITIEKIWTLDPGPKAGKIFEE

SEQ ID NO: 4025 - protein, 294 aa, Lactobacillus buchneri
MNQETKFCLSCGKEIPFAASYCPYCGKPQVGLASQSPMPSDASKQRTDVAESKRQLWYKNWMIWAIIVLGVGLVTCIALLNSAKTTVVMRPAASSKTAKTKAKAKKKDPNQVSSNPLIHLSKVGQWKNSEVLGKISMTGLGTKPDTTIQNGPLSVKFKHAEIDKVHANTEDQLDQALTSFNKDSMPKDYTRMKIEYVVTNHSTTTIDFGGIKQIVFSNGYQINFDDDAMADTGSEEELAPNAKRVEYDLVLLSESTTTLKPKSIKIITDESDDSKSLDTVSDGSSFSESISYQA

SEQ ID NO: 4026 - protein, 584 aa, Lactobacillus buchneri
MAETINSGIAALHTLESWGVDHIYGIPGGTINNLMYALDAEKDKITYVHVRHEEVGALAAVADSKLTGHIGVAFGSAGPGATHLYQGAYDAMADKVPVLLIVGQNPQALMNQDFFQEFDENPWFKDAGVYARTVMTAQSLPHILDEAIRRAFAQHGPAIVTIPNDLANKEIPADGYYSSAANFAKPELGTGSDEQVQQALDLIDQAKKPVLYVGQGTYGAADEVMEFAKKFQIPVITTALGKEIIPYDFESLLGSAARVASKPANEALQQTDLMLFVGSNYPFAEAMFKPDVKFIQIDNNPQVLGKRHKTDVAILADAKKTLQKFIDMGQTKEPSDWYAANVDNVTNWHEYNDHMMNRTEGKLRFEPAFKEINRIAEKDAIFSIDVGDVTQNAVRLLKTNGHQPWITSGLFATMGVGLPGSIAAKLSYPDRQVFNLTGDGAAAMVMQDLSTQVGYKLPVINVVFSNEALGFIEDEQEDDSHEWFGISLPQTDFAKVAEAQGMLGITVTSVDQMKPAFDKAVEETKAGKPVLIDVKITNERPIPVEKLTLDPDKFDQKTIDDFKKRYYAEDLVPLSAFLKQHGVK

SEQ ID NO: 4027 - protein, 611 aa, Lactobacillus buchneri
MGKWKSALLVLTGFVTLGAVSTTASAKAKQTPVTVNVVFNVRDRNAMNTYVSQTVDPTSANYHQYLTPQQVADRFGRTNAEISDFNKYFSQYHLKSAAYPGNFVMKVQGSQKNLVKAFKATPAKTNKDWDVTGTKLPGKLSSQVASVLGLFVDNKKTSTKTDKKALKFTHNLIEDDTPIVASSQNQLAKKYGPTKFADRYGVNKLYDQNLHGAGQRIGVIVTYDFNPSDVADYWKQMGVNSDVSRIHKIYTTDNTGGPKPKNNDDVTSQEEASLDVEQAGGVADQAQIDAYVGVSSNGDTTPDVQYLDAFATAIGDNRDKQLTTSSSFGNELNGFGRGGLSETASEFNDAINLVFEQAAIQGTTIFNAAGDSGPYEVANKSTNLPFPTSEYAVQVGGTTLPYTKIIGGQLIQVKKERAWGDSYSQGTVTKPTVFPGGGGGFSTLNPTPAYQLGVPGVNTYNAFNMLKYTKGGYLVNPDPEMISGTHQGRNVPDISGNADEKTGYGVYITYKAGNTQVPIWMNAGGTSFVAPQMAGASAVINSGLKTSAGFWNPQLYKFAVQSDTPFHVLDDATMENTNLYYTGQPGKVYNQATGLGTVDFSKLFTKFNAQQ

SEQ ID NO: 4028 - protein, 163 aa, Lactobacillus buchneri
MKKIFALALTLIAVISLSGCSGQNKSSSDTPSFRKNFLQVKNFQLKITKTAVIPAGETGNEFGKKPIFALWYTIKNTGIHKVSPVSAASVLRAYQPAKSKKQLVAAPLPDQDLAPKYKVAIKKNQSAKGSMAWNLYDTKSPIKIHGVKAGTNQIIGVQTYSIK

SEQ ID NO: 4029 - protein, 394 aa, Lactobacillus buchneri
LKKIVIIDAKRSAIGKLNGSLSSLTAEQLGSKVTRALLKDAGLSGSQVDQVIFGNAIQAGNGQNIARQIELNSQIPESKTAFTVNQVCGSGLQAIHQAQSALLLGEAETVIAGGTESMSNVPYLNMSQRKTTKFGPVTLYDGLQRDGLNDSATDEPMGMTAENVADQYHVSREEQDAFALRSHQLAAQATEQHYFDDEIIPIELNQPKSHAPHIVAQDESIRVDTNLEKLAALRPAFKPNGSVTAGNSAPLNDGAAALIMMTEDRANQLGLSPMAEVLGYAEHGINPEVMGYAPYLAINQLVSQLNMSVNDIDLYEINEAFASQSVAVVRDLGISLDKVNINGGAIALGHPLGDSGARIVTTLLHNLRRTNQEFGVASLCMGGGMGSALAIKLL

SEQ ID NO: 4030 - protein, 528 aa, Lactobacillus buchneri
MNKASSSVNDSDTRSKQQKILSMLGLMTSKVLGENTYAKSSIYSERITRGLRSFLPGPLQPSVSLAEFKMSKPMQMGYLAAAKDLKHVSIDQFNYMSLWATGDDDSSVVNRAAGNQFSEYLSQSQAPEKYVVGYKTAVIQFVRAIAGAGGVVFRINSALQNLDLNQQRTLVNQWFDHVNGYMNGASPFKAINNQTTKPSAADETIATGVAKEISDGFLSNQPVGNDEQPLLGNYSYNEDDFSDEHDLPKMMTDAIGKVSLTEDINLFVNNTLAGMVNSLGSIGLYPLVYAKFTQNNPDLVGAPVTSATDQATVLAKTKAAVEAIGKYLNLPQSGADLAEKLAVLNLSNAGSARNAKHQNYQLRYSRVLENDRPQVNDRGETVKVAYGIFETTHQILQNVFLTPLMVQYTMSRNQLLTQIASGQYTTSRQVIEPSFQAAGTLFDYVDALARFQVDQLIGLVQRGKKDDDGMSAAGSFSAFSHLMRVYPEVKSINPAYAEMSKATKRVYYWLYQSSFKDHLPEDEQIKLN

SEQ ID NO: 4031 - protein, 64 aa, Lactobacillus buchneri
MGNLKNKSDEVIGKVKETVGDVTGNDKLKLKGKAQKTSGKAKDKVEDAKEKASKKVNDALDDKK

SEQ ID NO: 4032 - protein, 193 aa, Lactobacillus buchneri
GNATFAMILYPRTEINMSATYLRQATNADLPEIKKIIEEAKAYLKKQGIDQWQDGYPATEDLEFDVNNGITYVLIIDGQIAGTAALHQGLDVNYLNIHDGEWVNGVHGRYTAIHRIAMSSNFRGQHLSQKMISGLITISGVLGYKDIRIDTHPDNLGMQHVITTNGFTKRGTIYMAEKDREASPRYAYQLVIG

SEQ ID NO: 4033 - protein, 63 aa, Lactobacillus buchneri
MAQDDAAVKTALIIMYVIGVVCLGITFFLLDKVNGKWFTKFSVGLVGVILVMGIILVNVINLN

SEQ ID NO: 4034 - protein, 381 aa, Lactobacillus buchneri
MVKFNTLLVRGGRPNDNSTGAVNVPIYNSSTFRYPKLGADVKWDYERSGNPTRDAVEDVCAKLENGDRGFAFSSGMAAIHAALALFKPGDHLIIGDNIYGGTFRLVNDFLKPRGLEFTEVDTQDADAVAAAFKPNTKGVYFEPVTNPLLKVSSVKQISQIAHQHNALVVVDNTFLTPYLQRPLDLGADVVLHSATKYLGGHSDFTAGMIVTKTKDLSDQIYAIQNTIGAVLAPQEANLLRRGIQTLNIRMDRHIQNAEKIIAYLQSNPKVAKIYYPTVDKASQDYQIISDEAKGAGGVLSFEVQPGLDAAKFVNSLQLIILAVSLGAAESLVEVPAFMSHFEIPKPERLKMGIKDELIRLSVGLEDADDLIADLDQAFQQI

SEQ ID NO: 4035 - protein, 1252 aa, Lactobacillus buchneri
MAFEYTPDQLKAIKDRPAGNVLVSASAGSGKTRVLVDRIIDMVKNQHVDIDQLLVVTFTNAAAKEMRQRLQAALREEFNQAAEAEKGRLLTQIQKVAVADITTMDAYCQKLVGRYYYLLGIDPNFRILADDTEKQLLKDQVWGAVREDLYGNDEDGSFARLTENFSNDRSDDGLADLIYRLDEFANVTDDPDGWLNAVTDFYDLGGKPLYDSDFYQQNVAPKIAEAFTKLKINHQYMIKLAQSGALDKDEKAFTDQLAAIETLQKVVLNCTSFDDVRKSLTGFEFADLPRLTKPQGEQKQFHGQISAINQQTKKDFNAFCNKYFGIDEQANVDLMAAAKQRVAKLISAVKAFRTAYEATKHQRHLMEFIDIEQAAYRILNDDSPQARQVQAKLRDQYYEIMTDEYQDNNRLQDAILNKLAKEGGGNRFMVGDSKQSIYRFRLADPQMFISKQHTYSLADNDNELITLADNFRSTENVDHFVNLIFEQIMDRQVGEIDYSDAKLQFGAKYYPKDVNADVSVLLYSPKKPLSEGEDLPAEQVMDTDEGQVEIIAQKIRQMVDDHERIADGDGDRPVDYGDFAVISPTRGSQITMSSIFKDYGIPAEITGAKSYLKTTEIQVMLSLLSIIDNPYQDIPLVAVLRSPIVGLDENQLAYLRINQKTGNYYESVLKFYRDYPNAEPNKYAQTIYPLIDTLFKQLDHFKNVAKQDGLVALIWEIYKQTGYLDYVGGMPGGYQRQTNLHALYERAFDYEKNGFKGLFRFVLFIERMQARDDDLATAVPNTSDNMVHVMTIHGSKGLQFPIVFLNDIGKQFNQQDTTGRAVLNDHLGIGISYLDTQTREIQEPLQRQAVLDVTKNAGLSEEMRKLYVALTRAEQRLFLVGKVDPGKGGSRKPTLDLQAIVESWQSQTEESAILLPMAERNSAKSYLDWIGPAISRHPDVIKDYGDSRIVNLLADDPSRLSLKFYDNAKVAEGKKQAGRAAVDPRSWIDQQQPVESDSDVNRRQIKAIMNFRYPHQAATRTTAYQSVSEIKRLFDDPDNVQLGNYSLIDSDQLIKPGRYTQPSLATPKFISENGTHKPAPTEVGTATHLVLQQVDLHQQPTKATIVELIANLVKEGILEENVAGEINVDGILRFYASSLGAVVLANPETTYREVPFSLLMKAKNAFKDFDQDDDQPILIHGIIDGYVESEAGVVLFDYKTDRLTPKTTVDTIHERYDGQIRLYATALDQILGRPVTKKYLYLLSSDQLVPVK

SEQ ID NO: 4036 - protein, 1186 aa, Lactobacillus buchneri
VTLQFVLGQAGVDHQSKMIDILRQQKSDNPHDQFFYLVPNHIKFESEVSILKQLGDANQMTTARSDVQVLSFTRLAWFFLRNTPEYQKQRISSAGISMLLYQIIVDNADQLVLFDHEIHNPGFIDQIATQIAEMQAGNVLPEDLLEMLQRPDSTITNDLRDKLHDFSIIYSQYVKRISENYFDSHTVLNLLSSKLQDIDLSGYHFYIDGFSKFTAQECGLVQTLINQSASVTVSLTLDRPYPTELPEQPNIFFQPAKLFHQLYRFAADNRVPYLKAVMADQPRVDEDMQKLEAYWITSSSLGTHQLPDQISPESVQIYQADNLYSELDQVATKIHQMVATGKYRYSDFLILTRHLDAYQNILEPVFTTQQIPYFKDIQQSMADHPLVELLAALFDIYDPNRARNYRYDDVMRFLKSELVLPMIDGKPMAIDDYRQAVSLTDNLVLKNDYADTRWTQKADWQYVWLPDSDEEQTTTKITDQDREISRKINIIRHLVRDLLPSFYKQFFKAKTNQEAAQILYQFLVDAGVVDRLQDWRDAATDEGDINRSNQIEQVWRTFCSLLDECVQILGDKPFVPGDFWSLIYAGFEGADYSQIPSTLDQVSVSESGMVQMNDYRVTFMIGANDDNMPDRLVNENLFGDDDINQLQSNLSDDQYLNDPAEVQMAFEPYLNYLAFMTASDKLIFTYTNKLNDESAVKLSPYVSRIQHFFNLKIVNNPAIPDDEHDVMPYVGTKRGTLHHLIQVIQNHFDIHQDLSAGWAVILQYLQRDPEVNRQTAKLLKSINYTNVPQSLAPEIITDLYGSELNISISQLETFYKNPYEYFLKYGLKLQERPKFELSTASTGTFYHDAMDRIIKQIHAQNIDLASLSDQDVSDLVKETVDRIINDPQNFDYVVLTSSNRMHYISMQLAATIQQMIRALRDQQKLTPMRPQNTELIFGQPNQKQALNGLSFDLADDHQVKVRGRIDRIDSMTTKDKRYFGIVDYKSSDRKFDFNAAYDGTSMQLLTYLDVLKHNLERLNPDDKEVALAGALYLHIYNAVFKPEDLQKVTFDDALLKKHRYNGILVDESGLIDHLDEELDSGYSPIYPIRKTAKGYTGKKSLINPLQLDAFLTHTEKLIVDAAEKIFAGDVRLWPFKQGQTTGMQFTPYKSIMNFDPILPGNQYRPVNSDSIDDIKKKLGEEKSDGI

SEQ ID NO: 4037 - protein, 117 aa, Lactobacillus buchneri
MAIKLEAEQIEQLKNQLEEANRNSHFVIISAVSKKEHSGVNMVTDWNNFLNMKSTNGDNFDFHVIRDILPITTNLVYWAVAQQNLHAVTAQGDQDDQAVDDLEFYTNKVMEENKVRA

SEQ ID NO: 4038 - protein, 190 aa, Lactobacillus buchneri
LKKLLIINQNSPVVSPLNALLKQRSDISVEVYSGNLESANDYAQALPDTNLLFIAVGPNDADLYVEALFEAVDEVQPPISDIVMLSYAGVDDELNESVTYAGVKDPQEFIKQQRYAIKIVDESEIAYSIIRMGQLKDQQASDYELFNEGTPMPAKTVSPKAVAKLAYEMLIEQKLMNHSIGIIDQTPMGE

SEQ ID NO: 4039 - protein, 313 aa, Lactobacillus buchneri
MSQKVKIGQSDVVSTPLGFGTNAVGGHNLFPNLDEEAGMNSVRAALDSGITMLDTAFAYGFGRSEELIGKVLKDYDRSKVVVATKGAQIVNGDQVTISNRPADLEKFVKDSLNRLDTDYLDIFYIHFPDDQTPKAEAIAKLAELKKQGLIKAIGVSNFSLDQLKEANQNHDVDIVEDQYSLVHRDAEKELFPYLEQEQISFVPFFPLASGLLTGKYDGSPVNFPEDDLRSGDPNFSGSRFHAITQSVKNLQPIADNHDATIAQVVLAWYIKNPDITVVIPGAKTPEQVRSNAKAMNVALSDQEYNTIDNAFRF

SEQ ID NO: 4040 - protein, 246 aa, Lactobacillus buchneri
MNRLDGKVAIITGGVSGFGLAAAKLFVQEGAKVTITDVNDSKAEQALNEIGKDKAIFVQQDVSKEADWDPVFQKTIDQFGPVNVLLNNAGILIFDDAETVDMDQWHKILSVDLDGVMLGVKYGIKYMKEKGGSIINLASIASLIGISNLYSYNAAKGGVRLITKSAALYAAEKDYPIRVNSIHPGYAHTPMVDSYPELRQKLESLHPMKRLADPKEIANMALYLASDESSFSTGSEFVVDGGYTAQ

SEQ ID NO: 4041 - protein, 436 aa, Lactobacillus buchneri
MLNSIAKYFEFDERNTNFRKEIIAGITTFVSMVYILFVNPNVLGVSGMDKGAVFTATALASAFGCFMMGFIANYPIAISASLGINAFFAYSVVIGMKVSWQTALAGVFVASVIFMILTALKLREKIIDSIPADLKAAIGGGIGLFIAFIGLSDGGLVTANKDTLVSLGSLHVGTTWLTIFGLLITVVLMSMRIPGAIFIGMVLNAILGMVTGFIPLPHQWVSSIPSLKPTFGVALSHIGDINSVQLVVVVLTFLLVTFFDTAGTLVGLAEQAGFIKNNKIPRIGHALIADSSTMLVGSVLGTSPMGAFVESSAGIAVGGRTGFTAVIVGILFILGTFFSPLLTVITSQVTAPALIIVGILMAQALKSVHWEQFEIAAPAFITLVGMPLTYSIADGIALGFITYPITMIAARRGKEVSAMMYGLAVVFVIFLWILNN

SEQ ID NO: 4042 - protein, 172 aa, Lactobacillus buchneri
MNSKTNLFGISNVRDLTKAAVVSALYIVITMVFAALSFGPIQFRFSEGLNNLAVFNKRYVVAITLGCFISNMMSSLGPLDMVVGTGETLIALLTINIVTRFIKSLPLKLVASVLIGTFYMFIVAAEIAYLGNTAFWPTFWGAYLTTAIGEFVTMTIGAVLVYIISLRYDLNK

SEQ ID NO: 4043 - protein, 366 aa, Lactobacillus buchneri
MTELFASPNTYIQGPGELFKSAGYIEKYGKKVLLLSDPTVLKIVGNDFNDYLQNNGFDVTLAQFEGEASESEINRVTEIGKSNQDQIIIGLGGGKTADSAKAIADNLDIAAMIAPTIASTDAPCSRLSVIYTDDGAFDHYRFYKKNPEIVLLDTKVIAGGPVHLLISGIADALATNVEATDVRAANADNMLGAKQTIVAGAIGQACEDNLFEYADLAIAANKAHVATPALDHVVEANTLLSGLGFESGGLAAAHAIHNGFTALTGDIHHLTHGEKVAYGTLVELILDGSDHARFEKFLKFDLKLGLPTTLADLHLSSASDEDLMKVATQACDENDTMKCMPTDITPEDVFAAIKAVDEYSKDFQNQ

SEQ ID NO: 4044 - protein, 307 aa, Lactobacillus buchneri
MKAFGYDHNGAADVFEEYEVPTPEISDDQILIQTKAFNLNNFEKSMRAGEYKATTHQVIPGRDVAGTVAKLGANVDGFQVGDRVVAHGHGAYAEYAYATAARTVKIPDGVSFAEAAGIVTPGITAYKAVYYFGEVKAGQTVVVRGASGGVGSLAAQLALNLGATVIGIGASKNEAYVKSLGVDEYVSYNKQDPALVLANRADVVINSALNGADSDSDARIVKENGIITTVGGDEPLSNKQFQFKPIMPTKVISDAEALTALLKLMAEDKLSIRIGYQLPFTVAGVIQGHELLSKKHDGRIIVTTETK

SEQ ID NO: 4045 - protein, 219 aa, Lactobacillus buchneri
MILERSNFMDVKQIMKELDKLPMKSEIGDLKELAQIYQLRHSGVNEIGTKLENLDEEYSMNYDHNPIHHMEERMKSVRSLVGKIQRKGYPLNMDTIHHKILDVGGIRVITNYIDDVYRVEDALTQQSDVTLIKRKDYIKDPKPSGYRSLHLVVSVPVFQSNGVFDVPIEVQLRTIGMDMWASLEHKLRYKTDVPEEKVEQHTGNLKEYASELFDIESKM

SEQ ID NO: 4046 - protein, 486 aa, Lactobacillus buchneri
MTIDWSMVFNVIVVINAILAIFTVFREKRDIAAIWAWLLVLVFLPLVGFIAYAFLGRKLPKNRLFKLHKHVQMQLDERLNEQRKQLGHDEKTPADEVVTEAKTAVDMFMTTDQAFLSRQNKVHIFTDGNSLFHKVIGDIEAAKKSIHIEFYTFYNDQIGNEILNLLVKKAREGVEVRVIYDSWGSMGTTRKFFQPLVDAGGKAFPFLNTRSVLLDFRINFRDHRKIIVIDGTTGYTGGFNIGDQYLGRKKKFGNWRDTHIRIIGSGVFGLQARFILDWNATSPRDQIDEDQVEPKYFPVTTTKGNVNMQIVSSGPDSDLQQIKMGYIKLITMAKDYCWIQSPYLIPDDSMMDALRIAAMSGVDVRIMVPSMPDHPFVYRATQYYARQLAEEGVKIYYYGDGFIHAKTMVIDDKISSVGSANLDYRSFKLNFEINAFIYDQKFSADLRDIFLNDIDVSELQTPEKFEEQSLWLKFKQTFSRLLSPIL

SEQ ID NO: 4047 - protein, 49 aa, Lactobacillus buchneri
MDLFNFLIAGLHGVHSIRFIHFIFNEQPLLGIGLIVALVLYMIYRYMNR

SEQ ID NO: 4048 - protein, 370 aa, Lactobacillus buchneri
LNSPSLNSLMKLETAEIEYKKLYVANPYDNFKPVSTWQAFADQYRAKMKNPVKFPDQPLSDIRPRFFESEFFSQPVTHPEQNGNSNSKLIYPPHLNSEIVVFKHLRYLPIMEHTLEFVKISYVLNGHCKFFLNGKTYDLEQGDLVIVPPNLKQAFFCNADDDIVVNIIMRRSSFEDAFSPLLMEQNDISNFFLRMLYRREFSQLVLVHCDNDKEIEHIIFGLYMESQASMHGSQIILNSYVLLLFGQIIRNHADDATILEGNIDEQPVSNIIQYIRVNRKDVNLESLAQHFNLSEGYISRFIKRETGYSFSQLLRDIKMREAAKLLISTKMSIEEIIDKVGYTDVSHFYKNFKKIFGVTPAEYRQKGVGH

SEQ ID NO: 4049 - protein, 881 aa, Lactobacillus buchneri
MSVIVNAKAPYDLQVEHYHGDVLAIRTATPRISWKYDGHVADSDEVELQITRHMPGQAGTVESIVTEPVNNVLFAWPLDPLVSREQVEVKARLVDGDTKGDWSQTLKFDEGILEYWELQSSFVGPSWPEAETDHRHLPLVRNEFTLKDTPVYARLYLSALGLVEGHVNGKAIGKDILTPGWTAYDDRLECWTYDLVGDLKAGQNAFGFYLGDGWYRGRIGFKGGKANVYGDKIGVFAQLEVTYPDGTSEQIFSNSHDGLWKVTKGPITQSDLCEGETYDSHLEKDGFDQPGYDDADWLPVAQIPFDRRKMEFPILPPVRANMVNQPISIKKIREYDGKADWQVDFGQNCTQRIDLHITNAQDGDVIELQHAEVLESDGSLSTRPLRRGQQIDQYISNGSDAHFEARFATHGFRYAEIRGWRGELTADDMQCKVYFSDMLQTGTFESSNENVNRLDDNALWSMRSNFVSLATDCPQRDERLGWTGDISLFSPTAAYFYDVEGFLSSWLQDVSHEQKRLGTVPFYVPFIPFAEWTEPQGIAIWGDSAVRVPWAIYMASGDKEMLAKQYETAKGWIDEVKGYLSEDGVWDRKPAYSLGQLGDWLDPTAPADDPVKAMTEKNLVATAFYANSCDMFVKMGHELGKDDEADEYTKLANHVHLGFKKRFFNDKGIMTSDTQCAYALAIAFGLVDDDPEIKEFAGHRLALLVRRAHGKIGTGFAGTPYILPALTETGHMDEAYQLFLSEECPSWMYQVKMGGTTTWERWDSMLPDGSVNPGVMTSFNHYSLGSVADWIHATVGGLKPTAPAWHQFEVAPRPGGNLTSAKTSHETPFGTAKVEWNYTDGKLSVSVDVPYGATAKVDIPGYDTVELRDGHYENSFDYQAS

SEQ ID NO: 4050 - protein, 418 aa, Lactobacillus buchneri
METKDISYYRPLAYAAGIGSMLGSGIIVGLAATISVWQSGLGLTNGQVGIISGALTFAIAFGSLFGGRIAESIGLIKVFNWINLFYAIGAGIAVFAPNYITLLIGVIITGIASGTDLPISLTVVSRDSPDAKTSAKLVSSTQIFWQAGIFISYIGAFAVSKMTGATGARIVFGLLVIFAIITWLWRTMSSKFKELHDEGTARYEENRKNSKEVATKSVTKILFGENKKFLYFFIAILIFYIGWNLLANTWGQFQTFMMVKANASQSLATGAGIVLNVIALVVSAVFSSIAGSKYRNTGFVIGAVIMFLAMVGMTMGGGSLIAIIVAIGFYNIGSPMAGEALYKVWTQESFPVEVRSSIQGIINGTSRVVCALFAFVTPALVLPGVIKITMWCFAGVVVVSFIAGAIMIRLQRKYGIEK

SEQ ID NO: 4051 - protein, 439 aa, Lactobacillus buchneri
MKSRSRSGWMLTMNASIASYLDASILVTTGIVLAMWKTQFGLNAWWVGALSTLVTLSVALGSAVGGYLSDKFGRVTVFNLDILFVALGTLLVALAPNLPMIVVGLFIAGVASGADLPTSLAVISERTEPDQYGKVIASTEIYWLGGIVLSQGLGFLTADMGYMSSRILFAWLALVALVTWGIRALSPKFHNLETQMVVPVERRASTEEEVAAEKIPFRKLIAMPRYFVPMIGLTGFYLFWNIPANTWGSFLNYFLVTVDGRSQQFSTLCAFFANILGAFVLYGIYMKFADTKYRYIMTRVGLILCILSFVLSAVFGGVWWIFTISYFVYCCANMLHGEPLFKIWSQSLYPVHVRASVTGISYSIVRAVTAVFSFVTPAIMAYSPTLLIWLLVGSLGICWLSAELVMRFIAHHDIPDPVYSSRKLDPKYNQNLAANKETH

SEQ ID NO: 4052 - protein, 243 aa, Lactobacillus buchneri
MSDIYDDAAFFQAYSQMNRSKDGLNAAGEWHELRKLFPDFHGKRVLDLGCGYGWHCRYAADHGASEVVGIDASTKMIQKAKSMTDQAQIHYHVLDMMAMDQLAGSFDVVISSLAVHYIKDYAGLIDLIKAKLIPNGKLIISVEHPIFTAEGHEEWILGDDGRPKYWPVDRYFDESKRATDFLGYPVEKYHRTLTTYLNTLLNRGFNLDQIVEPTPTSKMLAESQEMRDELRRPMMLLIAATLK

SEQ ID NO: 4053 - protein, 261 aa, Lactobacillus buchneri
MKIKIALAQLDITFGDPDKNFAQIEPNVRKSAEQSADIVVFPEMWNTGYDLTRLDQVADKNGQRTQALLGKLAKKYQMTIHGGSVSTEKDGAFYNTTYIFGPDGKLLTTYDKVHLFGLMHEDEYLASGVEEDHFQIKGIDAASVICYDIRFPEWLRTLSLDDSRILFVPAEWPTSRIPQWRRLLAARAIENQSFVVAVNRVGSDPDNPFGGHSGIYNPMGDEIVTLDDQPQLKVFTIDTKETDDARGFMPVFEDRRPELYR

SEQ ID NO: 4054 - protein, 103 aa, Lactobacillus buchneri
VQNQLSHPGGHQLHESNHVFSEEKVIGDIATIANMIMYISYIGEILQNLNGQPTSFIQPFCASINAALWVAYGWVKPKRDWILIVADVPGVIFGLIAAITAIM

SEQ ID NO: 4055 - protein, 112 aa, Lactobacillus buchneri
MEKLVREYIDNQPAARQKKLLQLYEIIQKQMPAGYDEKISYGMPTFHYHKNIIHFANFKNHIGIYPGPKAINVFKDQLEGYKTSIGAIQLPVDQPLPEDLITRIVQFNLDNV

SEQ ID NO: 4056 - protein, 341 aa, Lactobacillus buchneri
MIKQAIEKVVNHEDLTFDESQSVLDEIMNGETSEIETASLLTALTAKNPTIDEIAGAASSMRNHALKFPEAGNVLEIVGTGGDKANTFNISTTSAIVVAAAGTKVAKHGNRAASSKSGAADVFEALGLDINEDPATSFQSLQDNNLCFLFAQEYHKSMKYVAPVRKQLGIRTIFNILGPLANPAHPTSQLLGVYDEDLLEPLANVLKKLGVKNAMVIHGRDGLDEMTVADETAVVELWDGKLTKYVLTPEQFGFKRAARKDLVGGTPEENGQITKDILAGKKGPKRDIVLLNAGSALHLAHPELTIQEGINLAAKTIDEGKAQAELDRLIAFSDKRKDVVA

SEQ ID NO: 4057 - protein, 262 aa, Lactobacillus buchneri
MILDDLVTATHKRLKKHEAQTPLTELKNEVAQMPASVKPDFLDVLNESGLHVIAEVKKASPSKGTIVTDFPYLQIAKSYDAAGADAISVLTEPDYFNGHLNYLKKISQSVSAPTLRKNFTIDPYMIYEAKANGASIILLIVAIVDDQQLRAYRELAERLGMQAIVEAYTADEVTRALKSGAKIIGINNRNLKDFQVDFENSLKLRAMIPEGIPVIAESGIQTQADVEALADAGFNGILMGETLMRANNKQQLIKEFKAATVK

SEQ ID NO: 4058 - protein, 195 aa, Lactobacillus buchneri
MVKVKICGLMEPADIQAVNEAQADFAGFVFAKSRHVVSLATALALQTHLNPNIQKVGVFVNESIADILAIYQAGAIDIAQLHGKSTPEEIAELQRAGLKVIQVFERQAIDPKSTADYLMVDSGKGSGQSLNWQAVPHVDRTMILAGGLTPDNISQAIQIVQPDIVDVSSGVESDGKKDPNKIMNFIKNAKEEYVL

SEQ ID NO: 4059 - protein, 405 aa, Lactobacillus buchneri
MKNLTEAQITKRPGIFADTYGGQYIPETLMTELEKVDKAFHTLKDDPDFQAELHDLLINYANRPSLLYYAKNMTEDLGGAKIYLKREDLNHTGAHKINNVIGQALLAKHLGKKRLIAETGAGQHGVATATIAALFGMDCEIFMGKEDTDRQKLNVYRMELLGAKVHPVTTGSMVLKDAINATLQEWASRSEDTFYVMGSAVGPYPFPEMVKYFQSVISKESKQQLKAKENTLPDMVVACVGGGSNAIGSFADYIDDPSVKLVGVEAAGKGVNSDQTAATIERGSVGIFHGMKSLFLQNEDGQINPVYSISAGLDYPGVGPEHAALAKEGRAQYVGITDDEAVQAFEYIARQEGIVAAIESCHAVAYVEKIAPTMSKDQIIVCTLSGRGDKDVASIAKYKGVDIDE

SEQ ID NO: 4060 - protein, 265 aa, Lactobacillus buchneri
MSNLSAIFKNHKAFIPFVVADDPDFDTTVANIVALAEGGADIVEVGIPFSDPIADGGVIQAADLRAFDAGVRTKTVFEIVEAARKQTDVPIVFLTYLNIVFKYGYDAFCKKCQALGVSGLVIPDMPYESRDDIVPTADKYGIDIIPLIAPTSGHRVEKIAKAASGFIYVVSSLGITGERNEFFNGLKDLVAEIKSYTDVPTAIGFGVHTPEQAKTMAEIADGVIIGSAIVDIVAKQKQNAPEAVKEFTHSIRSAVDQAETKEASV

SEQ ID NO: 4061 - protein, 209 aa, Lactobacillus buchneri
NADPHAZREDCTASELIKIAVILGSIRSKLGESIFKYLQANFPDSDQVTYDWIRLEDFPLEPYHHDETPLSNPITGLKDNEQKWLNRLKADDGFVIMTPEYDHAIPGVLKNALDYVGPEVDHKPVQIVSYSYYSDGGMLAAESFVEILQMLKMMVLPTPVLLWNANDNFTQAGELIKDADNSDHFEARLKEAFHEIAFYTQLLHEHPFK

SEQ ID NO: 4062 - protein, 282 aa, Lactobacillus buchneri
MRAILPNKTEFIPHAPQNEHEIFMAMRTYPDNVKVYHPHGSIDATSVFWHNKLHPNALNFAVYVDPKATEQDVLFQRVYDDIEKLAWKFDDDRMITRDYAPQHPFNQWLTTKHFQLVQTALTATVDLGTLSLNTPIASGTLKTFAEVSSQNSLYQSVLERSMRKYAGKPTFNPAITMPLPDWSALISHRQISTAPFALIQDDQLVAFSFLYGLGDHLVELGQMNATNAQALNELLNRQLQWLQDNYQTLTGEFGMTNRLDMKIFQSLPFKDVNKYETYMRLT

SEQ ID NO: 4063 - protein, 91 aa, Lactobacillus buchneri
LTNSELADLILAAQANKPLNEVLQLPAEADAAYTIKYQRRQAGMTQVELARKIGIEQSQLAKIENGSLKVSLNLLQKAMTVFGRSYIVKAL

SEQ ID NO: 4064 - protein, 57 aa, Lactobacillus buchneri
MTKTELINTLDHLNTVIENYRADSAAISRLLRGFLNWSMARLASENYHLSVRQLAEA

SEQ ID NO: 4065 - protein, 535 aa, Lactobacillus buchneri
MNKKIMSGSFWLSFGSIFSRVLGILYLIPWLYMIGSPEHKNVAMALFNASYNPYGLFIALGTAGFPSAIARRVAIYNGQNKFLNSRQLAKVGSFVMLLSGVVCGAVLWVIAPLIAKNSPVVSTQSAVTSIRVLVPAIVILPSMSSVRGWFQGNQDLKPYGVSQLWEQFVRIVFILVSTYLVIDVFHRSYIEAVYLSVMAAFVGALASYLYLGLYYRKQSAHYAEMAKKSAPFDLTSIKKIFTMIAYESIPFVIVGSGITLSQLIDQLFFKQVMQGVQHFSAEYTQYIYTLFSANPTKITTVVVSLALAVAETTLPLLANSQASKKGDVGDLIFQNVNMLMFVLLPIVTILCGLSYETNGIFFSFSLLGGKYLAANILQSLMLGLAINGLTLLQALHYSKKAMYYLVVGLVAKLLFQIPLVILLQGFGAIISTAIGFGFICLLSYGEIMYEFHVPFGRLKVSVLVNLLFFVIVMALTWGTHQLIVPSRLIPAFLYCVVFGLVALGIYIFMANRTGLSETMFDHKLGYKYFRYKHFQ

SEQ ID NO: 4066 - protein, 87 aa, Lactobacillus buchneri
MSKISIQGSLETKQIVGSYSDVEKKIVADLDSAQVKDGKKPFSKIADEVVIEPYKDGAYSYHAMLTEAAKMYDLSPDIQKNAQVSED

SEQ ID NO: 4067 - protein, 155 aa, Lactobacillus buchneri
MKFSKTLSFLAVTLGVGIIAIEAQPAAAKTTTHAVPTTLQGTWFGKYHDDLFGNVPVKYRLTKYSFRQGSSKASEKADARTYYVNIKKYRQTKSKSYLFKVANKANSHGYWKLTLLSQNQPVYLKHVKHNGKTALKMYYKSSDTHKAQTSYFYHQ

SEQ ID NO: 4068 - protein, 153 aa, Lactobacillus buchneri
MTDTLKLADFFLCFFLISLWFGDFFAKQNVGKTSTYISELLKKDAQGLKLALANAPNLSAEARALTEKKVRVINRWYFLANKTGTMLAILALQQALVIYAKQNWGLVAIEISILVICGLILAADLRVNIVRNQLEKALKPYEDRLWFEYRLRS

SEQ ID NO: 4069 - protein, 44 aa, Lactobacillus buchneri
VTTNEKKLADVQADKNLAEAIKDLPRKRITNKDELEKWLSDEEK

SEQ ID NO: 4070 - protein, 423 aa, Lactobacillus buchneri
MHSYFRSKGYRALMNAAIFNGIGNSLFNIVFIIYAGSLSFKTAAVSIASFITYIPEMINVVLGYYADNTHHKYEWMVLARVNQFTLFIGLALMIGLPGSTLVFGGVLAINVISDCLGTFSGSLELPYFRFLIPNEEMNDAMGFEMATETTLQMVFQGVGAVAIVWLNHNYGLFGAINAATFLIAAIVIWTRRSIFKGIDPKLSVNQPKSATPKQSLLKSLIVTGHFMMSKKVVVVILAFAFVMNTIASGMTGLINVSLLHNQALWLGNYGNSVALVSISMSLGMILGAVIQHDFLANTTVVRLAAYISWMLVFLAATFLTGISIVLIAVVSVITGYLLGKINPRVSAMFIKLIPDDRLGASMGFINMVLLIGAPIGSGFFLTIANLGSQGVFASWLIFGICSFGLAVAAMVCDRKMGRDFVEA

SEQ ID NO: 4071 - protein, 330 aa, Lactobacillus buchneri
MQEPGSLYRQLRKERHLTLQQVADSENSVSFISKFEKGSSQISFNRMMHLLGKINFSVEEFLYLQGRDTIQPIKSTFMSHHPIYLTAPFMTPMVTLLNSLTGDSATSATLPRSIEQYDAKIHQLEDAGNLNWQHYLAILYQIQKVLIQNDASPAGDPKTAFTKLRQLSRPIVTYLYNIDNWSTFEILLFSISHFAMPLQTVHRLSKIAIKRTTSTETFPMMPQMRFELLFGLFSTYINFREMTWAKETLDSIVKLLEKDTDSNFAIMLRFYRGWYDYIDSNGSVGEEMMTDVAVMFKLLNLRQPADLISKIIPQIKRNQRDPEKSMIFLF

SEQ ID NO: 4072 - protein, 307 aa, Lactobacillus buchneri
MSQNVNRGDACALPTQKNDAGFTKKFSTGELPVEPNRYHYVWAKFCPWATPAAMMIDYTGLNKVISKFATDPLRHPGIDDDWFFGKNANDEDPVLHTTRLSQNYKKAVPNFSARPTVPALIDLTTGGVVNDSSRDIMFELGGSWKAYFDQNVPDVYPDDLKPEIDAMNTRIITDITSIPGKISDVDSQAEYDMLFNQYFDRLAQLDRRLADKRFLMGDHITLPDFWLVVSLIRFDVVFYFKSKLNKKRLVDFPNLWRYAKECYQIPAFKQNTDFTAIKQHFFQVSDDPVTSFDRVIPGGPDLSKWED

SEQ ID NO: 4073 - protein, 629 aa, Lactobacillus buchneri
MKTINHWLVGLASLALFVSAAPMTQAASQKKAAGKDPYGIQKILKKLMAKKTMSPNKQVQLDIVLKPQNEDQITNQIYAVNTPGNPDFKNFYTPQHFRDQFGQPASVTGQFKPFLSKYHLKSSTFSNGLIIKVTGKAKDVNKAFSTNLKTATYHSNPVQFSSKKPVMPANLADKVLTVLGVTTFNQGGSGLVSSKAKSKTPKGKMNPKDAPSKFVNHYNLKPLYDKGYQGQGQTVGIITFAGFKKSDAETFWKGEGLDVKPNRLSVKKIASPVYSSTGPTGQLETTLDVEQSGAIAPQANVRVYQANWSDVGLTNAYATAFDENKASSLSMSWGLNEYVTHYLNQKKLLTPVYGQAMSLLMAQGALQGISTFVASGDTGAYGMGVGGTFGPINIPNYSTYADFPSDNPWVTSTGGTTLPFTKNLGGGVKISVDKERAWGADYMYKAYAKHRKLFQTNLSALQMLYSAGGGGISKLYDTPAYQQGVSGVNTFNARQYLSNLMQPSPNPVLVSGTQYGRNYPDVSADADVFTGYQIYTKATGWHTVGGTSAVAPQFNGVTAVINSGKGTRMGFWNPQIYALAQDPEKTPFTVLDSDSNNSNLYYVGQPGKLYNQATGLGTVNFEKLYDSYQ

SEQ ID NO: 4074 - protein, 602 aa, Lactobacillus buchneri
MSKKKWLTAGIAMLSVMTLAACSNGKSSESGAGKHVSMSATYSGPGKATTAGNNSTLKVAEVNDAPFTGISSPTLASNAEDTDAFNPGGNAQGTVDGLWNVGKNWKIVDGGLANQKIDRKAKTVTITLRKDAKWSNGAKVTAKDVEYPYEIIGNKDTTSQQYSSDFAAIKGMAAYHAGKAKTISGITFPDGQNGRTTVIHFSRMSPSMKYAGNSFVWTTVEPYEYFKGIPISKLAASSKVRKNPIFTGPYKLDKVVQGESTSWSPNKYYYGKKPQIKHITIQVVSSNNFVAAFKSKKFDFIAANSAHPSSQYTKIKALKDYGIAGSPALSYGYFGFNVGHMNAKTGLNVMDKNSKMGNKNLRQAMMYALNQDQVYKKFGNGVSWRANTLIPPAFKDVYDAKNPGFQYNMKKAKSLLDKAGYKKHGKWRTDPNGKKLTIYFGVMQSSAATESIYQNDLQQWHKLGLNVKMTGGKPMEMNSFYSTLQKPKQNKIDIFDAAWSTSSEPTPTQMYGVDAPFNMGHFATKKNTELLNSLNNNQAWNSSYRTKQYKKWQKYMNTEAAYAPDNFTLNWSPVNKRVKGYSAAADNNEFWSNLSLTAANPK

SEQ ID NO: 4075 - protein, 317 aa, Lactobacillus buchneri
MKRDIEDATTISKEDLAKLTKEANEEATPSRLKIMWGEFKADKPAMVSLFLLVFFILFVIIASEFIDVPKMMETNIMGYYNKPFTPDYWLGADAGGRSIAKELIVGSRNSISIAIGLTIISSTFGICWGLVSGYYGGLVDLAMQRVYDFMMIIPMLMTIIVIVTIIPHYNAITLTLILSIFYWMGTSRLIRSRTLAESQKDYVAASKTSGTSNFKIIFREIMPNISSLIIVDTTLSFAENIGVETGLSFLGFGLPMGTPSLGTLIANANDPENITQYWWTWLPAAIEIIVLCLSISYIGQVMRRTTNAAQRRGQDQK

SEQ ID NO: 4076 - protein, 319 aa, Lactobacillus buchneri
MWKTILRRVLIMIPELIILSILVFLLAKAMPGDPFTGSINPRADPAQIHHLMEIHGLYDPWYQQYWNWVVHLFHGDLGMSYEYQEPVVDLIQQRGANTLWLALFTMVLTYGIGLPLGMYAAHHEGKLQDTLVRVYTYVTMSIPFFVVLVIGIWIFGYALNWFPTSGSVSAQASGLGGTVLSRLDHIILPGLLGALFGTVNIVQYLRSEVIDAKHSDYVRTARSKGVPMKDIYRHHIFRNSLLPIAAFAGYSITGLLGGSIFTEMVFSYPGMGLLFLNAINFRDYTVITALVLLYGFLNLLGTLLSDIVLSIVDPRVRVE

SEQ ID NO: 4077 - protein, 326 aa, Lactobacillus buchneri
MSLIEINGLKVHYPIRGGFWNRVVDNVKAVDGVTFDIEAGETYGLVGESGSGKSTTAKAIIGLEKATAGTVMYKGKDVTKGENRRKLDYNRDVQMIFQDSLSSLNPRKRIEDVIAEPLRNFEHLDKEEEKLRVLQLLDIVGLDADALYKYPHQFSGGQRQRIGVARAVATHPKLIIADEPVSALDLSVQAQVLNFMKKIQRQFGISYLFISHDLGVVRHMCKNIAIMTRGRIVEVGTRDDIYNNPMHIYTKRLLAAIPETNVNHREEHRKHRLEIEKIYQEQQKTYYDQDGMAFPLVKVSPTHSVALPPELAKEFEQQSENKGVNV

SEQ ID NO: 4078 - protein, 343 aa, Lactobacillus buchneri
VVDTNSDQFLSIKNVSTAFKINGQYYDAVSNVNLEVKHDEILAIVGESGCGKSTLATTIMGLHDPEETQISGEIDFEGTDLLKLDEKGYNQVRGAKIGMIFQDPLSALNPLKRIEDQIQEVMVYHTKMTEKQRHARVIELLNQVGIEDPERTAHQFPHQLSGGMRQRIIIAIAIACKPDLIIADEPTTALDVTIQAQILDVLRDIQRENHAGIILITHDLGVVAETADRVAVMYAGQIVEQGTAAQIFNEPKHPYTRSLLRSMPQRDNENDELYVIKGMVPSLQRMPKDGDRFAPRIPWIPASAHEAHPAMHDIGDNHLVRCTCYKDFYFPDQVKEGAGHESN

SEQ ID NO: 4079 - protein, 216 aa, Lactobacillus buchneri
MTLKVGIIGATGMAGSAITQDAVNRGFEVTGFVRNAEKAKDLLPDAVKLVVKDAFDIQRVDVQDLDVLVDAYATHDMSHAYRHVDLTARLIEFAKGADKPRLFFILGAGSLETGNGHRFVEKLEKLPNSESFIEIPRQQFKEYQLLTNTSNVNWVAVSPSATFKPGDATDYELGRNDLLTNAEGKSEITAGTMAKVINDEIEHPAHHNERFTAVDK

SEQ ID NO: 4080 - protein, 752 aa, Lactobacillus buchneri
MKRTFEVAPWNIVTHDFDSEDKRLQESMTSLGNGYMGMRGFFEEDYSGDTLNGIYLGGVWYPDKTRVGWWKNGYPDYFGKVVNAVNFIKMHVKINGEVIDLAKDQFSDFELNLDMKKALLTRSFTVTKGDAKVAVKFERFLSVAQQELSVQRVTVQNVGSNKVDLVMDSAIDGDVKNEDANYDERFWEVLSTEQGTDSGNVLAETTPNPFGTPRFTSGMEMRNVTDLTAEKVAQPSEKEVVNEFSGALAPNESAQLEKRVIVVTSRDYDTQAALTDAMHQLSDQVAGQSYDDLLTAHEQVWADRWNKSDIVIDGDTEAQQGIRFNLFQLFSTYYGEDSRLNIGPKGFTGEKYGGATYWDTEAFAVPVYLGITDPKVTRNLLMYRYKQLDGAYHNAKQQGLKGALFPMVTFDGIECHNEWEITFEEIHRNGDIAFAIYNYTRYTGDTSYVLNEGSKVLTEISRFWADRVHYSQRNQNYMIHGVTGPDEYENNVDNNWYTNLLAQWTLKYTLEILKEVSPEQAKQLNVSEDEKKHWQDIVDNMYLPYDKDLNIFVQHDGFLDKDLKPVSEIPADQLPLNQNWSWDKILRSPYIKQGDVLQGIWDFIDDFTPEQKKSNFDFYEQYTVHESSLSPAIYSVLAADLHYEDKAVELYERTARLDLDNYNNDTVDGLHITAMTGGWIAVVQGFAGMRVRDGKLHYAPFLPKKWSHYSFRQVFRDRLIEVDVDQDGSHFKLIDGEPITIDVAGKAVELTK

SEQ ID NO: 4081 - protein, 452 aa, Lactobacillus buchneri
MDEQSSAAATKKSGLPKLPASTIWMINFGFLGVQIAFTLQSSQMSRIFQTIGADPNKLGWFFILPPLAGLIVQPIIGYYSDRTWAPKLGGRRLPYLALGTLIAIIVMCLLPNSGSFGFGYASITALVFGAVTVALLDVSSNIAMQPFKMMVGDMVNDDQKSYAYGIQSFLSNGGAVIAAIFPFIFTAFGVANTAEKGVVPQSVVISFYVGAAILLLTSLLTIFKVHEYDPKTYAKYHGITEEANSTGGNWWSLLKKAPKVFWTVTLVQFFCWIAFQYLWTYSAGAIASNVWNTTNAASAGYQAAGNWYGVLAAVQSIAAVIWSYVLAKMPNNHHKLGYSISLALGAVGFISVFFIHTQYILILSFILVGMAWASMNTYPLTMVTNALSGEHMGTYLGLFNGSICLPQIVASLASFGLFPLLGNAQPNMFLLAGIIMALGAASVGFIKETYKA

SEQ ID NO: 4082 - protein, 291 aa, Lactobacillus buchneri
MLLGSVEAGGTKFVCAVGNEDYRILDRTQFPTTTPKETLQKTVDYFKQFKDLKAISISSFGPIELRKNSPKYGYITNTPKKGWANTDFVGRIKEDFDIPISWTTDVNGSAYGEYVMATLFNEKINSLVYYTIGTGVGAGAIINGNFVGDIGHPEMGHVRLKRHPDDLNFKGICPYHGDCLEGLVSGPTFEPRTGKKGQDVPLSDHTWDIMAFYVAQAAIQVTLMMRPAKIVFGGGVVSEGFLKKVREQFNELMNNYVDVGDLDKYIVMPLVKDNGSATVGDFALALKEYNK

SEQ ID NO: 4083 - protein, 333 aa, Lactobacillus buchneri
MKALVFTGKQHMEIQDIDKPEVKPNEVRVDTAYAGVCGTDHALYNGLPGSADAVPPIVFGHENSGVISEVGSDVDGFKVGDRVTVDPNIYCGKCFYCHTGRPELCDNLSAVGVTRNGGLEESFTAPATNVYPIPDNVSLKDAAVIEPISCAVHGIDLLKLTPYQKALVIGDGFMGQLFAQILQSYGVHQVDLAGIIDEKLDLNREKLGVTNTYNTTRDQIPSDYDVVIEAVGLPQTQQQAVEATRKGAQVLMFGVGKPDAHFEMNTYEIYQKQLTVQGSFINPNAFEDSIALLQSGDLNVDAIISNVFDLDEVEPFLQGKTKGVSKAVVKVGD

SEQ ID NO: 4084 - protein, 251 aa, Lactobacillus buchneri
LKNNEETASQVLNGRTISMSKSITFFIISLVINSAGNVLTLVTSAQIHPSYLGSAYWTAAEANLAVAFGWNLFWTFLILGVVITILNAILVGHWDWRRALGNLIFMVPFSALIQVFEDFFLGKYPALFGGFPPAKTPFMIGFYILLNFLGVAMIGTAISIYQRVNLVLHPADDLMQILRFKYFKGNANTAMWASYIPPTLMAILAFAITRQFTNLGIGTIFAFLFQGGITGIADTKVFPHLKHQALDVGKD

SEQ ID NO: 4085 - protein, 129 aa, Lactobacillus buchneri
MAIKDDITGIQHVGIPSVDLDKTIAFYESLGFEQAGLFHNGENRCAFMRFGNLTIETWEGDPTARKAGAINHISLNTPDVEKAFADAKAQGLRMVNDEIQSIPSFWDKGIKFFNILGPNEETIEFCQIL

SEQ ID NO: 4086 - protein, 448 aa, Lactobacillus buchneri
MAHISFDGSKLSKFVHDNELGEMQALVNAADDELRKGTGAGSDFRDWLTLPKDYDKEEFARIQAAAKKIQSDSKVLVVIGIGGSYLGAKMAVDFLNDTFFNYLPDDQRKFPQVMFAGNSLSSSYVYDLINLIGDRDFSVNVISKSGTTTEPSIAFRIFKERLIAKYGEEGAKERIYATTDKAHGALRKEADASGYETFIIPDGIGGRYSVLSPVGLLPIAVSGADIEQLMKGAADASDEYSDPDLTKNEAYQYAAYRNILYRKGFTTELLENYEPNMTYFAEWWKQLMGESEGKDQKGIYPSSANFTTDLHSLGQYIQEGLRNLMETVIKLDKPNHDVDIPKEKDNLDGLGYLEGRTMDYANTEAFHAVVLAHTDGNVPNMAVHIPDETPYTLGYLIYFFEVAVAISGYLNGINPFNQPGVEAYKQNMFALLGKPGFEEKGKELKKRI

SEQ ID NO: 4087 - protein, 314 aa, Lactobacillus buchneri
LEYKVSLDRKTEAMQTFYVKETKDTAGTVTKRDIYALQRSGNDDYLSHCELNSNTGVYEQVDTMELVNFGHGQLLQYFQHNGNDYFWVGTYASQDATQPFPWSQQIGRIQYKPGTSLDYKQTTRLTGLRYARKDKPAFKHAVRVEGALSSKRDKLLILVIDDSSPHRGHFVLYDNEALNTVLDGVEGSTNPSISCNDGKVIKAALKDFVSDKVVSLSYDSSIEGVELADNDAVYFSSSAEGKNRIGISRSAWGSSSSIHKLVDNSNWTSGETEGEAIQLLGDNVLIGITQYPNGDGTGSPRNNSIYRFPKSAFN

SEQ ID NO: 4088 - protein, 279 aa, Lactobacillus buchneri
MNRHLRLLLLMCSLILVLFGLTGQIAHAQDRYRIIDTQHVNTYKTLNSYNNNGVLHVKNQYKHHNVYVWNKKHTKVLYNLKDFPNSWLSALTKQTYLHNGKRSQYYAAFIVTPKGNSSRYGRIWQGYLAKGYNRNYRKLNYLSTVGFTSDQDYLNYIKKSPSQVLARTVLNLFPNTKLSIKLSNLGQFTADPDANDNDPFKQYFTDRINLQKVANYLGPSIHKWTNQQRITKIKQTLISEGYPANKRDAMSDYVIGIYAPNPNRAWEDFVWSINLAKPL

SEQ ID NO: 4089 - protein, 320 aa, Lactobacillus buchneri
MVTIRDIARRLGLSVSTVSRALNDNKRISLKTRRSVKKTADLMGYQPNYNAKNLTNREANTVGVVFPVNNRVVDNIFYVGILRGINAQLNSRNYVLSIAIGDSTEQVIENVKSMITRAQIKHFILLYSHQNDPVIEMLQKENVDFVTIGKPAAGQDWLYVDNDNVQAGFDGTNYLIDHYQCQNPIFVQTHNGWPYEIDRRKGYLAAMKQAGKSPVVLSTQENDELEDQFIRDNPQMDGIVAIDDYSGLQMYHRFKMINPNKNVEVLGYNNSLPSELTDQHFHSVDIHPDEMGQSAVKLLLDKPAEDEQVIDHIIVGHEMV

SEQ ID NO: 4090 - protein, 185 aa, Lactobacillus buchneri
MEMKKHRSLAAILAVVASFALILAGCSSSSNKSSNNNSNKASMQNETQDKSAKQLLTSSDNLWYMNGSINYNSKSGIDAYKFNSKNHTVTIYSVNKMHKTYSEAKQANDLDKQGTLKYTFKNDSADKPVIYMKGKLSDIPMHQTISVKNTVSGKNHQSKLAVTGYKVVRNLDNDPAPQVWVTPKD

SEQ ID NO: 4091 - protein, 596 aa, Lactobacillus buchneri
MKGNKLLRRSIRTFFQNWGAYVSLVIVINLLLGIVVVPIMQYMTGLILEVNRIPYLSYTNAVWLLTQRPLAVMELFILLLVIFAMVFWQFAFLLSGISNIALKQNLSLWGVFKIAIHDMRGLRLGSFLFFIGYFILVLPFSVAYLNSPLLSKATIPVFILDDLEKNPLIAALLTVLGIAVFYLGIRLIQVLPMMIIHHQKGLEAAKNSWQLTSHNTWQYLWRIFVLGIISFASTTLVSYLLYLFQTYLDAQSKMIGFVGAVTNMGLLTVWQRIVASFSVVVFMLILLMVLDESKWHSTAAVVRLPRKRRIGRRAMGALLIGLFLVGDVAFNAVYLQGALLTKPITISHRGVDDGNGVQNTIPALNKTSKEKPDYVEMDLHETRDHQFVVMHDENLWNLAGVNKDPYQLTLSQMTKMKVHENGHTAHIASFNQYLRAAEHDHQKLLVEIKTTHHDSPNMLQLFIKRYENRLLRDHDRIHSLDYHVISGLKKQAPKLFVSYILPYNFSFPQTRANAYTMEETTLNETFVNEAHFHHQQVYAWTVDDEDDMTRMLFLNVDGIITDNLTELKSTINSTFDHPSYAQRLLIYSNELQDEEN

SEQ ID NO: 4092 - protein, 441 aa, Lactobacillus buchneri
MTDKNSVLTEQDFSALHSDFKNAPKSDVLSKIIEQNGINQAAQDPDVQVRLNPVFSVDLQTGSVTNQKQSGRCWLFSLVNTLRHQFAAKYKVKDFNLSQKYLFFWDKIERANIFYDRILATASRPANDREVENYLSFPGDDGGQWAMAAALVQKYGVMPVSDFPETANVENTGAFDTVMNRKLRIDAAKLRSMVKDEKSDEAISAARKQMLSEVYRITAYSFGEPPATVDFAYRDDDKKYHRVSGLTPQQFYDQYFGVDLDDYVVLANSPEKDYNQLYSLPSQNNVVGGKQIAFLNLPMDVLKAATIAQLKDGETVWFGNDVLEQMDRKKGYLDSHLYRYTKLFDVDLEMDKAARLQYHQAEVSHAMTFTGVDLDGETPTKWKVENSWGDKNGEKGYFTMSDDWMDDYVYEVVVHKKYLSDDQKALLKQAPVELPAWDSLA

SEQ ID NO: 4093 - protein, 170 aa, Lactobacillus buchneri
MDRKSVGGKVSSDIFKVVLTAMFIAVTVAISRFFIIPIPMTHGNINLCDAGIFISALLLGPRVGGVVGGASGFLLDLISGYGQYMWFSLIVHGAEGLIVGLIAGKNTDRKWTKLIAVSVGIVIMVIGYFVADSVLYNIYAGYIGIGTNLIQGAVGALIAYLVTPRLKKRI

SEQ ID NO: 4094 - protein, 195 aa, Lactobacillus buchneri
MDLQTIKRDLSAVLTEYFERVTFPENGIFVVGCSTSEISGDWKGTNSRLDVGRAVVSTLEEFLIPRNIHVAIQGCEHINRALLVERKVAERNNLEIVSVVPAMHAGGGTQVAAYERMDDPVEVEHITAFGGIDIGGTEIGMHVKYVQIPVRMTNRRVGAANVVCLSSRPKLIGGSRAKYDFTEANKEDYVLGGSQ

SEQ ID NO: 4095 - protein, 287 aa, Lactobacillus buchneri
MIIIKPSVLIAEDFSAVGRLSATAAIAVFSAFGLQTATLPTELLSTQTEGFGKPTTQNTDSFIRRATGHWNGLDDLQFNSGIVGYVGKISTANLLYDYLSGVSLPDLLIDPVLGDQGKMYAGFEPGYLDAIKRLASIATIITPNITELGLLSGERLRVNASDDRIHQAVTDYREATHSKAKVIVTGVHRDGGIGCVYVKGDQLKWAGSPLIGGHFYGTGDLFSALLVGYLNFNLDFDTAVQKAVIGVYDAVSLTSRTPQHQRKFGLNLTRSLYNVAKFTLGQTGEEV

SEQ ID NO: 4096 - protein, 225 aa, Lactobacillus buchneri
MNFATKTGITTLAQTFIMGSIDAYTFQNFDGSFVSAQTGNLVIFAYELATKGWSTAYIRVPVLLGFLLGAFISQAFKHIQLASDRRFNVLLLFSIILLGILAVAAAFHLSMLNMLFSLGLFSGYELTVFNKIGTTSVNNGIMTGNLKNFANNSYEAIFSHDREALLKAGRFLSGIIMFILGIIFSAYLLHAAGPKVFGAALMINLVLLIIPLFSWRNRQRDETMS

SEQ ID NO: 4097 - protein, 377 aa, Lactobacillus buchneri
MTNIAITTKFPYRYDVVGSLLRTQALKDAHAKYHAGQISTADLQKVQHAETKKIVDKQVELGLKDITDGEFNRSWWHLDFLWGLTGVQKYDYHKSYKFHGSKTRTDNAELSGKVAFNPDHPFFDSFKFLQSITPDGVTPKQTIPSPTMLFRDNRSDNWSKFYDTWDQYLTDVAKVYHETILHFYELGARYVQLDDTTWAFLISKLNETADDAAAHAKYVKLAEDSVKVINQLLTGLPNDLTVTTHICRGNFKSTFLFSGGYDDVAEYLGQLNYDGLFLEYDSEQAGDFSPLGKIWNGDKNKRIVLGLITSKSPELEDKDAVINRIHQASGQVPLENLALSTQCGFASTEKGNKLTEQQQWAKLKLVRDIAREVWDVD

SEQ ID NO: 4098 - protein, 62 aa, Lactobacillus buchneri
MDKIREKYSQATNRHVTHWFGLAIGLVGGLTIDALFSFRTGTFFTFIGIVLGMSGLLDFKQR

SEQ ID NO: 4099 - protein, 390 aa, Lactobacillus buchneri
MTIKYPSTIFKGYAYTFFSFFGITSLWVIYLQMQGLNLVEIGLCESIFHIASFVFEVPSGVLADRFSYRFSLFWGRIASIVSATLMLVAHSFWLFALSFVLGALSYNLQSGTIDALMYDSLVAPQQTQRFPNVISNLNVVIEFSQTAGVVIAGFLVHWHFELTYVAAILIGIFGLITVLLMKEPTVPKSIDLPKQTVKSIIVMAYRTLKTNRQLRGLMIFQAVFDGICTSYYFYFQSLMETHHFSGFMISLLMVISAGMNIVGIKLTPWIQKRLAKPALVSGVSATLVGLLLLTWINWISTLTILFLFSQLLASLIEPIFSSYYNEMIASQQRATLLSVASVLFSASMIFLFPLMGWLVQIQTFSFGFGVIGCLMLVLLLLSQKYFKSAK

SEQ ID NO: 4100 - protein, 431 aa, Lactobacillus buchneri
MDNTQSLEVKYPQVKDLMNETPIFWKNPDYGQPAELPFSKADIFDAVARWDRFAPFIEAAFPETARMHGVIESPLIELTKMKSAWNQAQATALAGSLYLKADSELPISGSIKSRGGIYEVLKFAEHVAMTKGDLKETDNYAILRSPEYKQLFAQYGVMVASTGNLALSVGIAASTFGFKTTVYMSRDAKAWKKAKLRANGVNVVELDTDFSSVIPQARQAAAEDPSIHFIDDEGSADLFIGYAVAAVRLQHQFKQQGIKVDRDHPVIVYLPAGVGGSPSGVTFGLKTIIGPYIHAIFCEPTHVPSVTLGMMTKLNNAISVFDIGLDGKTAADGLAVGRPSRIAGKMMRTLLFGSVTFEDPTIYKYEAQLMDTENITVEPSAAAGFTAIERAITEVPAFNTANATHIVWATGGSMMPESERLVDHDKGEALL

SEQ ID NO: 4101 - protein, 260 aa, Lactobacillus buchneri
MKKVIIAAVAVMGIVLAGCSSKQSTNKPSDTVTIVNHAQKAAHGIKSGNVVLVNKNTQNKKTSTGKFTAKFHLDPMIVQAKLNNATGLVKNYDYFIDGRTVYIHADNSWSKQRLPKKSPLIKSVRRQVSGSAAVKAMQYLKKHLKLTKNQTTDVLSYNGHGKLGSMVAKKLILAEANNSESTKNVLKKVTITKFIYKYTLNKKTYLPTNTHIYMQYQDKSSKKSITEEVTSTYSNVNQVKKFKVPDVIKHNAPSTNQVNE

SEQ ID NO: 4102 - protein, 174 aa, Lactobacillus buchneri
LLENLKLRRSTYLIFIVWGAIAFFLASAIFKYQPLAVSFSINDHRLLQGLLRGILLLAAYVVITIFPTRIAIVIPSFFYFGMLGSYLWQFLMVVLTGNWRGIAMDLLFVISYIVLIYCATMTAFQIINVVQKNRSVYYFSKWFKSVKRVLKAHWLSLLVVTGAYVVLWSMFNLT

SEQ ID NO: 4103 - protein, 288 aa, Lactobacillus buchneri
MKKLLLLALVTFGVFTATSFPVSGNTTAATANSTATNTDSSYIWTKVLSRSTAVAYHAKSKSAVYLWNATHTKRLHNLKNYPNTTWYVKNSVVMQHGNSSHVYYEVYNYGNGADGFIWRNYLTKGVNPSRHASAAKGVISLSAQRSLQFFEDNLTTLASLPQSQFQKLVMDQVAAKLTQSTADTKLDTMAKLLATEDISTRDAAAKAGVTNAKTTNFTVKQVDPKTMTGYYSYWSKYRTTDALKYYAAVVASHVTSLTTNSVNGHYGVYIVPDTTAKTWKPQLTIVTD

SEQ ID NO: 4104 - protein, 407 aa, Lactobacillus buchneri
MNKTLIVAMETYLRQVKSWSFIVLVLSPFILLAISLGIGYTSATSSSDQQRIAVISDQPALRKQFIKANRDDVKASVTTTAAAKKSVGNNNLAGYLVLSADKTKVSGVYHSSDSLGGGMRTKINVFLAQSQQQLNLANAKLSAKQTKSLAVQPAFKQKIQTNHGGANLAKIISFWVLVFMIYMILITYSSVTAQEIASEKGTKVMEIIFSSTKASKYFVGKIIGVFGVILTQIIVYIVGGYGFFQIAMHLDNIKQLISDNQTLVNDVIKNMLGINLLFVFLGVIIYTIISAFSGALVAKAEDAPKAAQPAIYLSMIAFFLTMPFQSNSDALISKILSYVPFFSSYFMPMRIINDNASGLEISISLAILVISIGLLTWYIGQIYEGLILQTDDTSFWKRLRRGLSYQK

SEQ ID NO: 4105 - protein, 298 aa, Lactobacillus buchneri
MLTINHLHKQFGSLTALDDISFDVPDNQITGLIGQNGSGKSTTFHSILNFLKYDGQIRWNSQPIKEADFDAIGYLPEERSLMPKLTIEQQIVYLARLKGKPAKEIRPQIDDWLKKFAVKGKKTDKIKDLSKGNQQKVQLIVTLIHHPKLIILDEPFSGLDPVNADLLKRAILEARDQGAAIIFSSHDMANVEAVCDRLVMLRTGEVVLNGTISEVRDQFGKSEIYVTTDWTEEQLNQLPHVVKVQNIRGSRFLLRLDDPSKGPEVFEKLTDGKYIEEFSQQPPTLDEIFRMKAGISHE

SEQ ID NO: 4106 - protein, 232 aa, Lactobacillus buchneri
MKFSEELVAAGQPILHEIYQHPFVEGIGNGDLPKEALTFYVGQDYNYLNAFIKVYADAIQKSQTRADMAIFAKQIDFILNSEIHPHHNFCNVAGVEYETLQHEPQAPGTYLYNEHMYRAARTGDLIDVVAAMTPCPWTYLEIANRFVKQGKNTDDNVFKPWIDFYADMEDDSDSILPQLFALIDREAEHYDQHHLDVVKEEFLKSCELEWEFWDQAYHQRSWHFVKPMKQYR

SEQ ID NO: 4107 - protein, 125 aa, Lactobacillus buchneri
MKFNWKIALISFSPYIPLIVIYLLIHLYVANDVVALLFTLGVFSAGYIFVHYKYAKTFFSNHPELDLQNFEFNTVANVVLALWIIVMVGLIILRLYPQSPEGYLLAFDLFYSVINGFKSYRRAAK

SEQ ID NO: 4108 - protein, 51 aa, Lactobacillus buchneri
MTFNWKYALFTNAPMFLTLIIYLGMTALRIDPIWLILVVVVVWLAWYTYAS

SEQ ID NO: 4109 - protein, 184 aa, Lactobacillus buchneri
MQKEYELTIGKLKRTLPIIPITDTAAIASFVLLGDAELTRYAAQELAKRINIPFDYLVTLESKGIPLAQELSMITHHPRYFVLRKSVKAYMRNPIAIGMRSITTDYHQQLVLDGCDAEQLRGKRVIIVDDVISTGGSLASAEHLLKKVGANVVQRCSILAEGRATSRDDCVFLNTLPMFAVKNA

SEQ ID NO: 4110 - protein, 749 aa, Lactobacillus buchneri
MQAMKLSSVSLSDEFIKQVKEEVTPHWGELGWVTYKRTYARWLPEKGRTENWDETVKRVVEGNINLDPRLHEDNVDPQVVDDLTEEAKKLYKLIYGLSATPSGRNLWISGTSYQDRNGDALNNCWFIAVRPQSYGHSHILPEYLQPDTPAVSMPYSFMFDQLMKGGGVGFSVTKDNIHKIPLVDKKIDLKVIIDKDSKSYQDSLDMGATDKDEWLKNHSIKDVRYYRLPDTREGWVVANAHLIDMHFNGTNADGKTDLVLDMSDIREKGAKIKGFGGTASGPMPLIEMLIDINSLLNSRVGRHLSSVDATDIGNLIGKTVVAGNVRRSAELALGSADDEDFITMKQDKDKLYHHRWASNNSVAVDSEFDNYGPVADSIQHNGEPGIVNLELSKNYGRKIDGLQKDIDANVEGTNPCGEISLANGEPCNLFEVFPYVASQQGWDLDEAFTLGTRFSKRVTFSNYDWEVSRNVIENNRRIGISMSGIQDWILAKFGNRVVTGYEDAKDPETGEAIKKPIYDPRVVKEVDGLYKAVVRADKDYSDTLGCKPSIKHTTVKPSGTVAKLAGVSEGMHFHYAGYLIQRIRFQDSDPLLPALKACGYHVEPDVYTKSTMVAEFPIRASHADSENFASAGNVSIAEQFATQAFLQTYWSDNAVSCTVTFQPDEGDQIAPLMRQYRFTTKSTSLLPYVGNEFKQAPKEPIDEKTYEDKVMEIHGDVATVFAKQNDNHDKKGIELVDQTDCAGGACPVK

SEQ ID NO: 4111 - protein, 178 aa, Lactobacillus buchneri
MLKIYTKVGDHGKTKQVTGKMVPKYDLQIEALGALDELDSWLGYVISVLSPKSASLAPTIQTIQRNLYELQADITVKRHHNITFDDTKKLEAEIDEIMAKLPAIKAFILPGGNQAGASLQYARALARRAERMVVELNDKQQPLNDEIFEYLNRLSDYLFALARYANYLEGYDEIKSKY

SEQ ID NO: 4112 - protein, 332 aa, Lactobacillus buchneri
MKKILAYNILGYEKEFVLEWAAEHPDVQVDFNDVELHDDTVDLAKGYDGIDYRQRSMLSETPDLYRKLRDFGITQLSLRSAGVDSCNLKWAKENGLTITNVPSYSPEAVAEMTLTHALNLVRHIPQFQSRMAKNDYIVEGLRSRELSEMTIGIIGVGRIGSTVAKIFKRFGARILGNDIHENAAFRDLVTYTSKEDIFKNADLITMHTYMSDENYHMIDKTQFAQMKPSAFFINCSRGPIVNTDALIDALQNHQIAGAGIDVIENETEIFNQSFDGDIPLKEYTKLKAMDNVFLTPHVAFYTDIAVKNMVKQSLDDTLKLITGQTTEHTIHV

SEQ ID NO: 4113 - protein, 293 aa, Lactobacillus buchneri
MNMNDLKYYVSLSTEKNFSKVAQDYSVSQPTISAAIKRLEAAFGSQLLVRGNPHQAITLTTAGEQLLVHANEILYHYRLAVREIENSHRQQLVIGMPPIIETNYFPMVAKQLPVSDLNHIQTVEEGSLSALRDLKSGQLDVSFLGYVDDVTDSELIVDEFDQQPFSILVAKDSPLAKLTEVSFNQLKKESFILFKNNFVHDRVFHTLAQQNHIRPQVIFRSSEAQSIVNMVADGIGVSLLTQAVKINNPNVVALRLTDEAQPVFKIGLAYRQSTVFGNDQQHILTMIRDALGL

SEQ ID NO: 4114 - protein, 539 aa, Lactobacillus buchneri
MTQSILNDPFKNKGTAFTETERQQLGLVGMLPPMVQTLDQQAEQVYQQYQSKSSALEKRVFLMSIFNENRVLFFKTFSQHVAEFMPIVYDPTIATTVEHYSELFVQPQNAAFLSIDDPDSIEESLKNAANGRDIRLLCVTDGEGILGIGDWGTQGVDITVGKLMVYTAAAGIDPSQVLPVVIDAGTNNEGLLKNPLYLGLKQHRVRGQRYDQFIDQFVSAVENQFPDVYLHFEDFGRSNAANILNRYKDDQLVFNDDIQGTGIIVLAGLIGALNISKQKLTDQTYLCFGAGTAGAGITMRVYNEMLAAGLSPEEAKQHFYMVDKQGLLFTDTPDLTPEQKPFARSRSEFANPDSLTDLLSVVKAVHPTIMVGTSTQPGTFTESVVTEMAAHTERPIIFPISNPTKLMEASAADLIKWTDGKGLIATGIPSDNVEYKGVTYQIGQANNALIYPGLGLGAIASAASVLNDAMISAAAHSLGGIVDPTQPGAAVLPPVSKLNQFSDTVATAVAQSAVDQKLNQKPIESVRDAIHQTQWQPEY

SEQ ID NO: 4115 - protein, 203 aa, Lactobacillus buchneri
MTEYRIEEDTLGKVKVPKKALWGPQTERSRHNFPTGPLMPVEVIRALINIKLAAATVNQVQQTLTPEKARLIEKASRQLLSLNDSQLMADFPLHVYQTGSGTQTNMNVNEVIANLCGQLDSKLTILPNDDVNHSQSSNDTFPTAMNIAATLAVLKLKPQVEHLIAVLAKKQEQYWDVVKIGRTHLQDATPITFGQEISAGSAR

SEQ ID NO: 4116 - protein, 257 aa, Lactobacillus buchneri
LTHDLHFLDETSQTLLEVPIGGTAVGTGLNTTPDFASAMVAELSTAYGLPFKTQNQFYGLANHSGITATHGAVRTLAADLLKIANDIRFLASGPRAGYGELSIPANEPGSSIMPGKVNPTQAEAMTMAATRVMGNDTTIEVAASQGNFEMNVYKPVIIFSFLESVELLTGIMTNFTDKMVAGITVNQDRMKQLVDNSLMTVTALSPHIGYHKAAEIAQKAHQDGTKLKVAALALGYVTADDFDKWMKPINMTNNDRK

SEQ ID NO: 4117 - protein, 102 aa, Lactobacillus buchneri
LLFSKIKSISPSELKQLLPNKPVILDVREVDEYQAGHIPAAKNVPLSGLPGNITQVSAPQPWYLICRSGRRSLRAARILRKAGYQVINVSGGMLSWQGPVTR

SEQ ID NO: 4118 - protein, 176 aa, Lactobacillus buchneri
MGKIRINHTVVKALLIYGGFIWLIALLIVLPHFSHLIPATENLGVSRASIIDTTYFAWRVPLTFLIFSLIHTKWSILFPTAWYYAMFAIGALVVIFLFIKGQFWSGSFFLLHTLAFGASIYFFSLVALRTVHNNMYIKSDHYLGRWLGAVKMSVQEYWIELISAYLGFLFLNIFSG

SEQ ID NO: 4119 - protein, 128 aa, Lactobacillus buchneri
MKLKRIKRIVKRDPTVAIGSGVLLYQSYILDYIYNTICKLLDLPPQTLYTYSNFDTLGRAERGGFMSAKRIVFAIIFVILNVVAAYFLVDPFMSIVYRRFQEADFFQIILVLTITLALDIGTFQEVVR

SEQ ID NO: 4120 - protein, 38 aa, Lactobacillus buchneri
MEKQDLASAYRRLKSPSIKIRKRALKIIHEAKANKAHR

SEQ ID NO: 4121 - protein, 89 aa, Lactobacillus buchneri
MAKKSKIAKNKRQEALIEKYASIRRELKKEGNYEALAKLPKDSNPNRLRNRDELDGRPRGYMRKFGMSRLNFRKYAHLGQIPGVHKASW

SEQ ID NO: 4122 - protein, 201 aa, Lactobacillus buchneri
MRFGARLKTERIELGLTQKQVADTMNVSRQTISSWETENSYPDIDSLIQLSDLFHISLDVLLKEDVGMKEYLKKKEALEWIRPIKQVTITIDILFIISMIFIRHGGAAGVFLLLVALLNMLVMVRVKRFEDELNARPTILRWPNLRKIFCLLAIISTIIVLAGWYFHFQLGDNASAVPIGLWGGIIIIELTYRFHRRSHAS

SEQ ID NO: 4123 - protein, 246 aa, Lactobacillus buchneri
  misc_feature (4)..(4): Xaa can be any naturally occurring amino acid
CAAXAMINTERMINALPRTEASESELFIMMNITYMTTFYLSYVFLIVLWLFGRELINFIEHHYTTGMASDLVSLGIKAVIMVGLGLFWISRTNAQLWIDKRKLYNGNFPTVFWIVLAMFIAYLFFLMFSAHRGFYLQHDPFKSGEFLSVTLGAGLIEEFLFRGFFMNFLMKQYGIVTANIIQAILFQISHFPLYYLEGLTLGAWLINIANVLPLGLIFGWMFYRTKNLWPSTILHCVWDSGVTLFV

SEQ ID NO: 4124 - protein, 262 aa, Lactobacillus buchneri
MTSFYDLLKSLTRPKLRIMNRIVLIDVIAIVLTLIYQVYRGDLETDTPLAITLSYSVFVAIVAFVLMSRNSEHIFVSDAYRLIPASDTKLYSVNLLSSFIGMVYAGITQVVLWVIAAIPFWGDFGAQFKKMFHYTMNSDKQNFVRNMILVTIGAILLAIAMTLLLWASITLIHLTGDALTAFLPDSRQKFFRFVLYVVVIVAFLYVFSIIENRVDGVMNHFFNMNGDTIASIYYATIYLLGFTALESVGSVYLLKHWVETDS

SEQ ID NO: 4125 - protein, 237 aa, Lactobacillus buchneri
MTNTIEIKNLNYRRNYRSILEDVNLNIEMGKIVGLLGENGAGKTTLMRLIAGVAKGASGSITVAGTDGVPDKKSAISFSEQLNGFNPSMRIDKIIRFYEDVYPDFSTKKYNEMAGFLQIDEGLRLSALSKGMKEKLIIGLTLSRDTKVYLLDEPFGGIDSMSRKKIIQSIIKWKSDDAVILVSDHYVSEIASILDEVVIIKDRTVYAQKSAEEIRSKYAEGIEHYYESIYEGNDIDD

SEQ ID NO: 4126 - protein, 124 aa, Lactobacillus buchneri
MKFDDKIPIYYQIKNYIYRQIIVGKLAPGDKLPAVRQLAVDLTVNVNTVQRALGELISEKIIEPQRGKGNFVTEDRETIEKLKKLLITEQLQDLYENLRKLNVSDEEIVDYLQDYINKRKQVQS

SEQ ID NO: 4127 - protein, 212 aa, Lactobacillus buchneri
MRVEVQNVSKRIRNTLVLNNVSYNFERRKIYGLVGRNGSGKTMLIRSIAGLLIPTAGKVIVDGEVLHDKFDFPESMGVTIENTTFPKDLTGFQNLVALSKIKRIATTKDIKSAFGKIGLSESDWNTKVANYSLGMRQKLSIAQAIFERPKLLLLDEPTNGLDEESTWLLRKTLKEIADAGSTVILASHDKEDIAYLSDEVIHMDGGKIVNKN

SEQ ID NO: 4128 - protein, 220 aa, Lactobacillus buchneri
MKVIRIAGSLLIVNLTFGFFNELIGFHGIADVPYEFNSIQFAISILLLVCVLGEFTAVLDRNLLSHMTSIISRYHSRRKISWGITNNVFVFVIIQSVTQMVANYMFGGVPIVWSISVLVITFLGWATLLITFLMIVLRYTVAVAYLNTLVIYSGCLFIGHAMFQLKGLREVTGIFAPQFINYSRVILSNNKVVLVAGVIVLSWLVLQFKYLIKNYDFLKG

SEQ ID NO: 4129 - protein, 235 aa, Lactobacillus buchneri
MSISNKRKWMYCALYLSGVGIFLITYWVNNAVLSDHYTFKQNVQMLFETNSGYFANSMFGVIFSNMFVGLIMINNQLSYVHCYRMSRVSRYKQFQRTLTTDSLIFSALYIVVGVFLAQIALGTMIANFSFWILIFETIISTGLFLSIIGEFYRLMTVNRPYYLGMGIVIVTNALISLIFPRLHLWDPLLEINHFTLFFENQLTIMDIVVSVARLSLILILMRMLVKLRIKFEDIL

SEQ ID NO: 4130 - protein, 271 aa, Lactobacillus buchneri
MLLSEISAIISSRRSKRTILICVLIVLLAEFLAWQSNFPGLFQLYPNGIPSKEIINPPTAAFLAGNSSGQFLQIILIWFMPIFIIMITLQRIIERTHGGSNYLLSTRMGTLDKFFVRSELVQFFIFSTFYMILFGCDFVVAIILFHKGTSFMGMEDSAKYSHLLHLEIEHPYVAYILFVIIVSLAFGLFSVVIYVLALSIRKTILVYPISLGLWIFMIALPYSSSYFTQPFIEYDWNEYIGSLISFLLICVVVITIGNVVIRLRSKHVYFK

SEQ ID NO: 4131 - protein, 139 aa, Lactobacillus buchneri
MKKLATYAALSLLSVAAVAPSFMTEVSADVDTVFDFKLGMFKGNGQTEDEYRSNTSKPWMVNMQHDTEKGSNSVATYWIENTGLLNRNVSKSYDIHEGSGEHKYSANSDANGALIALTAQNNNLNANEPEVSGYWNPED

SEQ ID NO: 4132 - protein, 64 aa, Lactobacillus buchneri
MINLGNNLKKIRESSELSQEIIASKLGVSRQAISQWEHGLTYPDIKNLVRLTQIFCCDINELLF

SEQ ID NO: 4133 - protein, 303 aa, Lactobacillus buchneri
MNHYKHITIDERETIFLMRSHGNSLREIATNIQKSCSTVSRELNRNSDGSNYSPSKAQAKYQQRKGNCGRPSLLGQPQVFEVVREHFCEDLWSPEEIANRLAVEKHAVQISTTTIYRGIFKGLFDHLFKSGSPSAVRHLRHRGKSRHNKAYQEKRGKIPIPNKIHDRPREADNRLEIGHWEGDTVLGKSGRACVVTLVDRKSRYLLIGKASQRTAGAVTDTLSHLMKLWPGRSLTITPDRGKEFAKVQCFLKSLARPFTSRIPIPLGNGVPMRTPTVWFANTCPMGPILIQLRTSKSKPMPNN

SEQ ID NO: 4134 - protein, 59 aa, Lactobacillus buchneri
MLIGIAIVFLIIGVTSVFIKLLGKRRTKPTIMQIILLLGLVILILAAIYITFIVLDIHY

SEQ ID NO: 4135 - protein, 221 aa, Lactobacillus buchneri
MMSAVLLSSVAVQDISTVNADSSARSLVASDSTTKFSDTDQASDQNVTVANSNEQWKEFSKECKLLSQQNLPEDQLSAKMQDLLNKYDGAEADIQLNDAGATNEVGLRSITKPASVHEKIVKGGVNDFAGSTSALAKLRTYYGLIQDELVTGGAVVGVISAGLFGAIFGAGAGGILSVRSGSAQSDVKTMINNGKSKGGCRITLTDEFPIASLTSTSQSKL

SEQ ID NO: 4136 - protein, 64 aa, Lactobacillus buchneri
MINLGNKLKEFRQYNELSQEIIACRLGVSRQAISQWEHNLTYPDIENLVRLTQIFDCDINELLF

SEQ ID NO: 4137 - protein, 205 aa, Lactobacillus buchneri
MFNWETFEPDEYSRDKEPSFVDLTTRSYVTAEGHATQHTDDPDFLRLSNAAAEVAKTISGGPGKGIPVEGFKEYRPYPVQAVWTDTGDGEDFKIWIKQPLFINEKDFDAALTQIDFSDFDLGEIKFEHLAEGIEIQTVNTGAVTPDSEALKALENAIQKEGFTRLHGNEHREVYIDGLPVDSSKVVLVRLAIDANGKELPGLVHN

SEQ ID NO: 4138 - protein, 110 aa, Lactobacillus buchneri
MVLGQRIKEEREKLGWTQDRLAEELHVSRQAISKWEVGSAYPDIERLVQLSDLFAVSLDSLIKGDERLQKKIVIGSNHDQMNFWGFMNLNSSVILPVAVLIFVAVIVIFG

SEQ ID NO: 4139 - protein, 298 aa, Lactobacillus buchneri
MTIKNVTVAGSGVLGSQIAFQTAFKGFNVTVYDINEDAINAAKERIKGLRHSYRHDIAATDADFEAGLSRISYTWDLADAVKNADLVIEAIPERLDIKKPFYNKIGEMAPKEAIFTSNSSTLVPSALMEDTGRPSQFLNMHFANQVWLNNTAEIMGSPKTDPKIYDEIVEFARNIGMIPIQLKKEQPGYILNSLLIPLLSAGEELWVKGVADPEMIDKTWMAATGAPMGPFAILDVVGIRTAYNITATQAKSGEDPNAQVLADKLKELLDAGKLGMESSEGFYHYPNPAYKDPDFLKI

SEQ ID NO: 4140 - protein, 180 aa, Lactobacillus buchneri
MIKKQPNTFINFLYVISLLSVASLLIAMGTLALVFVIAGIVYLLIPSARTGIFRDIISGIGGSTNIWVICLSFALLLIILGLITLVSFSVFKLIANVRRNIYFKPINLKYIQGILWGYGGIILTNYCSGVLADTYNINSSSISSDQGGDGTSLLIWFALYVIYVMFKYGIDLQEDSDKIV

SEQ ID NO: 4141 - protein, 67 aa, Lactobacillus buchneri
LIKVNLDRVLLDKQITSKMLAAEINITPANLSILKTGKAKGIRFETLARICKVLDCQPGDILEYVPE

SEQ ID NO: 4142 - protein, 77 aa, Lactobacillus buchneri
MNEFKRKLCDWFLIVTILSVQYQRIILSIAPLIRILKLEVTEMTFGEKIKVERSKQHVTQTEVAEQLYVSRKTVCTV

SEQ ID NO: 4143 - protein, 465 aa, Lactobacillus buchneri
VDSTVNEQNENAKKHPFLVITVVAFMTFMGVLTETSMNVTFPTLMDQFNISLPTVQWVTTGYLLMVALLTITSAFLKRRFTNKQLFVSAALLFIAGDVMCGLAPNYWTLLVGRLVQAGCVGLTGPLMNNIILDVVPAHKLGTYMGMANLIVLVAPALGPTFGGAVVSFASWRMIFWITVPITLVLLLLGIFIIKQYTPTEHYEFDWLRFGVLALAMITLLMGFNIVGQRGFLVKFICYMVVSAASFCLFGWLSKSSHKALFKLSVFKRPVFLFSFLPYVFLQYSNIGLNFMLPSYVQIVNSASAFIAGLILLPGSVLNGLGQPIYGWMLDRFGGKLPLYLGNSLFLVPIVIMMVMGQQMSVLVITILYTVYATGRSMAFGNSMAYGLKHLPKDEQKDANAIYGTGNMLAGSLGTTVIATMMTSVHIYTLSYVQNIVVGSRLAFAMLALLGVVNFFLFRRLFKSSK

SEQ ID NO: 4144 - protein, 170 aa, Lactobacillus buchneri
ASCHDMAINPRTEINMDILKMDATDYWEDFMRRNRTQKTNFETWSFTNRPNSTDMLVEMVVRGQKTAASSWFDFYDADRVVPKAGDYRMLLKRNGDPACIVQLKVVEVVPFKWVSQEHAYLEGEGNRSLKYWRQLHKQLFRKKAKMRGKSFSLESPVICEVFEVIDTPQI

SEQ ID NO: 4145 - protein, 404 aa, Lactobacillus buchneri
MSFRFSERVPKNDSDPVGDILKVAGSPDVISFAGGLPAPELFPIEALKKVTNEVFDESGREALQYSSAIGYPALREQIAQRMNKQGIKATADNIMITTGSQQSIDITAKMFVNPGDTVIVEKPTYLCALDVFRSYGAHIVGVEMDEDGMRMDQLEKAVAANPNTKFIYTIPNFQNPTGRTMSAERREQMIGIANKYDIMVMEDDPYGAIRFAGDDIEPVKFYDNEERVIYLSTFSKILAPGLRLGWIVMNKDLMPKYSVMKQSADVHSDNLTQHIVAKFMAEYNIDEHVNKIRKVYRKRENVMMAAIEKYFPAGVNYSHPQGGLFIWVEVPGDVDTIKLFNTCIKHNVAFVPGEPFYPDKVTPGTFRLNYSNMSEEQIQTGIERLGSAIKETIDQNQTTRVAQH

SEQ ID NO: 4146 - protein, 338 aa, Lactobacillus buchneri
MKYGIIGAGAMGVRYGVMLQENAGVDVDFIDTWEPNVEKIREQGGVTVARDHENRRIVPINIYYPEEYKGHPDVWIVFKKQMQLAEELERDNKAGIFHDDQYVFSAMNGMGHFEKIAKYFPKDNIICGTAMIATRMDGPADIDFMGAEGDEVMHMARYNNEKPDTKTQAIFDDFTNAKLGPVFADEWMGMCMSKVVFNAVTNTLCTMFEMQMGQFIEYPGVRKMSQQLFDEAYDACERAGIYLIATRQEQVDSVISVSKEYKYHFPSMYQDFSKGRPTEVDYINGYIAKIGREHDYVCRTHEFVVQEVHMAEMMRKYHQPQTNVADQNDDTQKAGVRV

SEQ ID NO: 4147 - protein, 59 aa, Lactobacillus buchneri
MRALIGFAGLISMVMCIAAVIFLIMGNRTVAVPLVSVGLVILIVCYAAATYISHSDNKK

SEQ ID NO: 4148 - protein, 175 aa, Lactobacillus buchneri
MLMIRTIRQSDYSNVSNLIRTAFANTANGYRNEAELVDKIRKDPAYQKRLEVVAENGIHLVGYGLLSEIKVVDGAKASTGLVLAPLAVEPGSQKSGVGSLIMGELDNRAINLGYQFTVVTGWPDYYPRFGYQKASDYGIKSPTPVPDDVFMAKPLVDGGLDGVHGMVQYSKAFNM

SEQ ID NO: 4149 - protein, 327 aa, Lactobacillus buchneri
MKLFLKKLPLPICGLILGIASLGNLFKAIGLPVIGNIWGILALVLILLVIAKIGVHFKLSLNDLNDPIIASVAPTFTMSLMIISTFLKSWGLPVLPTAVWTFAVILQFVIMGYFIYRHLLRPTVELDHVYPSWFVTFVGIGVIPVTANNFIPALGTPVLWLSLGLYAILLPIVCIRLLRREFMFEATLPLLTIMAAPASLCLTGYLSMNTNPSWGFALAMVILAQGLYWGTLTKIFKYVRLAFYPSFGAFTFPLVISATALNLFNNSFHLGNGLNSIIGMVANLEITLATFMVVFVVIKYGQFLVKLATQAVAKSKVAASENETTIK

SEQ ID NO: 4150 - protein, 277 aa, Lactobacillus buchneri
MFKFLETFMVVYKTRSFSLAAQQLFITQPTVSNQIKQLELQLHTELFERRSRREIVPTEAANLLYKRAGKILKNWQDVNDQITRLGDKGNEKVLFGISQTVSRILFAKIASALITAVPNLDFDVTVSNSEGVLNQLETYKIDIGIIEKPLVTENISRISIGKDQLVKAGVDNGNWITREPGSGIGYYTEQYFREADVQPAKLIHVNNSGLIRRMVAKGVGQALLSDKDLPTAVPIESLGEHFSRDFYLLVREESSHDNTLNNIQQIINKAMSSPNQD

SEQ ID NO: 4151 - protein, 490 aa, Lactobacillus buchneri
MVKPMNIKAIKDKDKQQAKERFHRILEEAKKKQTQLKKATTNRGQQTNQASQHTDSDRQKSRLKRENKKLQKKVRAIQSEKNAQEQIMQRLKAKNFALNQANDQLEGKVHNAQIKLQEADQLKATDYHTQMQLKQTIDQLNQQIQLLNRRNRSLRTGIRHFIKSSQYQKAQQVKADKQYYKDQLEKTKAHLKSSEKRNTKYQEQLHQYRHYELPGKGKLVRQATTQELINELFARIDEERVGEFLSLLPLFNTIDYYLKTGMANTKIHLWRSELLKDNQQMYGYVHFQDDQPEFIALDGSVFPNPVVKGNKFELNQGDVYRGNYNLTTDQFVINKHYAASTENRDRSAELHQVKKKAAKLSAKGFVERFTIDYPDVKDVLTGKNIEVVSWFKQISYKRVFEPFGVNIDVLDPNERSGDFIYRRIENTDTDLAFILLEGSHHVNSQIYKDRPAANPDKIKILEDAAPKELLKMTYDHFKSLATRTRTLDEN

SEQ ID NO: 4152 - protein, 442 aa, Lactobacillus buchneri
MIVAKFGGSSVADAGQFKKVRAIVEANADRKVIVVSAAGKSDSEAIKVTDLLIEVEKLRDAGEDYMPVYNHIQSRFVGIRDALGLKVGIETDLQKIAKQIPNCSHDYLVSRGEFLTAKLMADFLGYQFIDAARFLVFDQNGVNYGESINRLRDFLSYDDHIVVPGFYGVDEDGLTHLMPRGGSDISGALLANFVDADLYENWTDVSGIKMADPRIINNSRKITELTYEELQELSYMGISVFQEEAIQPAKEKQIPIAILNTNHPEEDGTLVVDSANSNAHQLVTGIAGKKDYVVISIQKYQLNKRLDVMAKVFSVIQKFGVKFDYVPAGTDSVQFLAKRTDVDGKLMAIVNSLKSACDLDSVKLEKNIAMVAAVSSQLSKRPAIAGKILDLLDNSQIKIHLVVQEGSDIKVVFGVANSDYEKTIEKIYRSAAVSATRLKMVI

SEQ ID NO: 4153 - protein, 393 aa, Lactobacillus buchneri
VNIAILGFGTVGSGVYKIIKNAKRQAQNLHVKHILIRKNKKPDLPEMTDSIDEILNDQDVDVVVEVIGGIEPAHQYIVDALKHHKHVITANKAVIAQYMDEFTRVAAQNDAKFYFESSVGGGIPWIQGLERALRVDDVNKIQGIFNGTSNFILDQMHRTGKPFNEVLMEAQQLGYAEADPSADIDGLDVANKLCISVDIAYDLFIKPTEELPIFGIRNITEDDMTHFDKLGMTIKLMGKSHQRGHEFDYMVEPTLYYGDTLEAHTRDNYNLISLIGETIGTLKFMGQGAGQLPTANAVIQDILDIFQGKEHLKREFKSTFKFQPNLTRNNYIVRSEIDCSQLFGDYAPELRGDYLVVHDIPVGEMHQKMRRVLQRDETAFMASLPTKKGGAAK

SEQ ID NO: 4154 - protein, 501 aa, Lactobacillus buchneri
MNKYYTSTRNGSVQISAKQAIKKGFADDKGLFVYPDLEKLQVNFEKLLKLNYQDIARAVLTILLPDFSADEIDESVHAAYQSSFDTQKITPVVPVDNFHILELFHGPTSAFKDVGLQLLPQLMKHVLVDNNKVMILTATSGDTGKAALEGFKGLDNMGIIVFYPDGGVSKIQKLQMITTGGNNTKVAAIEGNFDDAQTNVKRIFNDQALKKSLGDDVSLSSANSINIGRLIPQVVYYFDSYKQLVNDGSIEVGQKVNFTVPTGNFGDVLAGYYAKMLGLPVNKFVVACNENNVLANFFNHGVYDRNRPFFQTVAPSMDIQISSNFERLLYYKSGQDTEYVKQLMDDLEDSGKYEVSKEVLANIQQDFYCGYSTDDDIERSIAEVYEQNGYLMDPHTAAGYKVMRDYQKLDPETPMILLSTASPYKFVNAVANAVLPETSADVQQVMRDLHDATNAPIPDNLRKVWDLPVRHESVIQKDQMTDYVKQKVEEVFYDQDQGTRN

SEQ ID NO: 4155 - protein, 301 aa, Lactobacillus buchneri
MIKIKVPATSANVGVGFDCLGLAVSYYSTITFDKSSEHLVITGSPKEFQNEDNLVYQAFVKGCSFLDKPVPNVQIDIETNVPVARGLGSSSICVVAGLKAASVWYDDAISVDQLLVLATEMEGHPDNVTPAILGGLCVSFLDDQNQPQVIQYHVSDKLHFVAMIPDYEVSTHAARKVLPTSMSYADAIHQVSHCAAMTKALEIGDSHMIHVACDDRMHEPYRAQLIPDYSQAKNIIEQLGGTMYISGSGSTMMAITADEKDADQIAANAKAAFPRWNVRKMAVDSTGVVSEVSERGKVLHR

SEQ ID NO: 4156 - protein, 144 aa, Lactobacillus buchneri
VEKYYIVDSSILPESFDKVIQARQLLESGKVKQVSEAVKVVGISRGTFYKYKDLVFLPEENMMDRKAVISLMLENKRGILSKVLTTISETSASVLTINQNIPIHNIASIVISLDLSHFTGTIDNLLGKIRLVDGASNVQLVSIE

SEQ ID NO: 4157 - protein, 451 aa, Lactobacillus buchneri
MANSQEPNAPKKFHLSQNHHMTIPWKSFTTDESVPAKEAGLRERASIVGRVGIVMLSCGTGAWRVRDAMNTVARVLGLTCSADIGLSSLQFTCFINDHSYSQVLALPNTGVNTDKLNSLEHFVSHFERDFGNATVKQIHANISKIEQRPVQYSPLVSGLAAALACSGFIFLLGGGIPEMVCSFIGAGVGQYFRGSMGKQHITTIASISIAVAIACLTYMFSFKIFEANFQILAQHEAGYIGAMLFVIPGFPFITSFLDISKLDMRSGLERMAYAIMITAVAALVGWLVALLFDFRPENFLPLGLSPLVLMLLRIPASFCGVYGFSIMFNSSQKMAMTAGLIGAVANTLRLEMVDLTSVPPAAAAFIAALVAGLIASLVNRYNGYPRISLTVPSIVIMVPGLYIYRAVYNIGLNQISVGALWLTKAALIIVFLPMGLFVARALMDREWRHFD

SEQ ID NO: 4158 - protein, 304 aa, Lactobacillus buchneri
MKAYGYEKHGDPEVFQEYEVPEPTPAANQVLIRTIAVGLNNRERAERAGGFGSMPSPYIPGRDVVGEIVKVGERVSDLSEGELVMTHTERGYAEFVLGNLDATVVVPDGITPTRAAGLITPGLTAYKAVKYFANVQPDQTVIVKGASGGVGSLAVQIATDIGANVIGIASSHNQDYVESIGATKFVAYDQTDPATELADTGDVVLNTAMNGAGTDDDVAMVKPNGVIASVAHNSPMTDKPLKFAHIHPTDAMSDREALQAVIDLMREGKLDINIGYKLPFNRDGFVKGHQLLEEKHDGRVIIVK

SEQ ID NO: 4159 - protein, 291 aa, Lactobacillus buchneri
MSCLMHKFIGLEVGMMLDIIKAIILGIVEGITEFLPISSTGHLILVNEFIKMSQTTQFTDMFNVVIQLGAIMAVVVLYFHKLNPLSPKKTHVEQHQTWVLWFKVIVAVLPSVVIGLLFNDWMDAHLMNWQVVSAMLLIYGVLFILIENRNANRQPLFSDLNTLSYRTAFIIGMFQLLSLVPGTSRSGATILGGILIGTSRYVATEFSFFLAIPTMFGASLLKVYKYFSHGGAFTGMQTAVLLTGMLVSFVVAYFAIRFLLNYIQHNNFKIFGWYRIILSLIVIGYFGFLAH

SEQ ID NO: 4160 - protein, 252 aa, Lactobacillus buchneri
MAILTLTRAWTRLEEQTTIHVILPNEIQSDRKLQVLWLLHGLGDNGSGFIRKTNLEVLTKYTNLAVITPEMNRSFYMNLHNGLPYWDYLTKQVMPEMRKLLPLSSDRQDNFVGGTSMGGFGALKLAFTHPEWFSAVMPMSPVVDLSELPAMMPDAQGILDGIAPEHYLETLAKQSPSEQLRQLRFFYCIGDQDELKPTNDRFVQYMRNDLKLPVAYHTGAGGHDWLYWQRMLPEMLTWLLKVNLADGQPLES

SEQ ID NO: 4161 - protein, 272 aa, Lactobacillus buchneri
CHADDMAINPRTEINMSIQTILQHRYADIEVEWVRYLNNPFDPERAHDLRVMIRTLRGLIKFLKRRLTPATYTIIDTNLSQAANLFGDLRELDVLIEETGAYAYSHPDKKADYQGLLKILRDNRQHEMAQTLTEGTQSTLKKDLESVQQQLTQLKFTQTTAWHQYIVKELNRRNHKLVALFEKLDFKDYPEVHHVRKRSKTLRYASTYFADFAPNKANKSAKLAKDIQDDTGTITDAHVNYMRLRKLADQLSKNADKQLLRKIADDQLKKFE

SEQ ID NO: 4162 - protein, 176 aa, Lactobacillus buchneri
MELTIKELADELSVSKTAIRKHMDDKFRDTYTIKKGNKILIKDEGVEVLKGQFKNQVETADKQSTKTANQLAVKSDDQQTALLAEQLEDQRKQIDAKDKQIAELHQLLDQSQRLQLDVQNKLKQLESKNTSSIKQTIPESVNEEEPQGDKIPDSYQPSNARFQEAGKKKHWWQFGR

SEQ ID NO: 4163 - protein, 485 aa, Lactobacillus buchneri
MSSISEKMFRKEDPLVYQDKDSHLIRSLTTKDFLALGVGTIVSTSIFTLPGVVAAQHAGPAVALSFLAAAIVAGIVAFAYAEMAAAMPFAGSAYSWINVVFGEFWGWIAGWALLAEYFIAVAFVASGLSANFQGLISPLGFNLPKALSTASTGNNGGLMDLVAIIVIVLVTTLLSRGASQTARVENTLVILKVIAILVFIFVGATAIKSANYTPFIPKYHVNADGSAFGGWQGIYAGVSEIFLAYIGFDSIAANSAEAKNPQKTMPRGILGSLVIAVVLFISVALVLVGMFKYSDYANNAEPVGWALRQSGHALVATVVQAIAVVGMFTALIGMMLAGSRLIYSFGRDGLLPKWLGKLDNNLPNRALIVLTIIAIALGAFFPFTFLAQLISAGTLIAFMFVSLGVYSLRPREGKDIPMPSFKMPLYPVLPALGFLGALGIFWGLDIQAKTYALCWFILGMVIYFAYGMNHSTATIDKKAEHEKDL

SEQ ID NO: 4164 - protein, 450 aa, Lactobacillus buchneri
MGKLDKASKLIDEENKYYARSARINYYNLVIDHAHGATLVDVDGNKYIDLLASASAINVGHTHEKVVKAIADQAQKLIHYTPAYFHHVPGMELSEKLAKIAPGHSPKMVSFGNSGSDANDAIIKFARAYTGRQYIVSYMGSYHGSTYGSQTLSGSSLNMTRKIGPMLPSVVHVPYPDSYRTYPGETEHDVSLRYFNEFKKPFESFLPADETACVLIEPIQGDGGIIKAPEEYMQLVYKFCHEHGILFAIDEVNQGLGRTGKMWAIQQFKDIEPDLMSVGKSLASGMPLSAVIGKKEVMQSLDAPAHLFTTAGNPVCSAASLATLDVIEDEGLVEKSATDGAYAKQRFLEMQQRHPMIGDVRMWGLNGGIELVKDPKTKEPDSDAATKVIYYAFAHGVVIITLAGNILRFQPPLVIPREQLDQALQVLDDAFTAVENGEVTIPKDTGKIGW

SEQ ID NO: 4165 - protein, 42 aa, Lactobacillus buchneri
MGIFHVGDFIFVVITFIIVIAIAVALVYFGVKAYKAFMRHGQ

SEQ ID NO: 4166 - protein, 355 aa, Lactobacillus buchneri
MKKFWKALLLIGSGLLLVVGAYVAYVYLTYHRVPDNVKLKPVNRNSQILQTNHPYKAMTFNIGYAAYPDNYSFFMDGGKYSRAFSKFSVLDDLNGIYQAVKQEDPALMFFQEVDTDGDRSFHVNEVQWLRDRMNGYSSVYAQNYNSAYLFYPLTRPIGKAKSGLLTLAQAKIADSTRYQLPIDTDFNKFMDLDRAISVTHIPVANGHQLAVINLHLSAFTKNAKVRKAQINKLFAKMTTEQQAGNYVIVAGDYNHDMLGNSPAVFKTTSKPMNWTHPFPADQLPKGFRIAKQGLAQAKVPSVRANGTPYRPGKTFTSIIDGFIVSDNVQVNRVHVKSLGFKNSDHNPEVMDFELK

SEQ ID NO: 4167 - protein, 365 aa, Lactobacillus buchneri
MKKSHFWFALLFAGALSIGVGTSSQTVSAKTVNIYLTRHGQTMFNVNGRGQGWADSPLTDTGVSVAHQLGYGLYGLKFKAAYSADNMRTFRTATYALQSSGNGNLKVNWTANLREGGYGSFEGQKYDDVNKITMPLLKPAGTYSGPQDFGKAQQALGKDFWPALQDAYHAAETVDFGKYSDPTLPESLKAESSTQVIDRMNTELTYIAQKAEKTGGNVLVVSSGMSIPEWLSTQKNYTVPGFVNWGNEATMKVTYKNGQFYFPSNVTDKTILYTINKGAALQQLPKNTLKVKKFYLNKNKVSGSTSTGASLVLQNTKGSTLKKANANSNGNFVFKLSKATLNKLKKGMNLKLTSTPKKLSKIYDF

SEQ ID NO: 4168 - protein, 69 aa, Lactobacillus buchneri
MSQSNLEKQEAKLKALNQKIKDEKNKIEQRLGKQISSQANLDHADLSNDNIKFLSQKVAEFLKENQAHN

SEQ ID NO: 4169 - protein, 92 aa, Lactobacillus buchneri
MANQYEKLVEQQARLKQKIELEDFKLRQSKYYESRQDRKARSRRLIQKGALLEKYFQADNLSVEQTEELLKTFADYVDAHKPNKLKNDHPNN

SEQ ID NO: 4170 - protein, 273 aa, Lactobacillus buchneri
MTKTQAYMDKYQFTVAENKRFARTNFTKLVHTNARFEGVNTTLPQTQTIMDGMSVAGVPVEDILTIVNLKRGWQYITDQNASLTLTMEKQINKIVAAEDALVPGELRQGKGGVDLGSEDFFEPPLINEKQEQSFLQKILADPQTTTTNKALTIMYHNMRQQIFWDGNKRTATLSANKIMIDGGAGLINVPLDKWDQWNELIANYYRTNDMARIKQWTYDNGIQGLQIRANLALKSVKDKTSKRIQKQLKDFADQNPEIKPKNDPENKNNRPSY

SEQ ID NO: 4171 - protein, 369 aa, Lactobacillus buchneri
MMDQTNFNYYEADNVYGALFFQFPKVLMYGDQYKHLSSDAKLAYMVLKDRLEYSLRNNWVDEDNHVYFIFTVQELQDLFNCATEKAVKIKKELQAANLLKQIQMGFNPKTKKNEPNRLYLSKLDVKATDVYLRGEYEPKAPKALATSGISKIESPHDFAGTLATSGISKIESPHDFVKDNQKPLATSGISKIESNLYKDFKDIDNNRYNIDTQKLDFSTAQFSPAELEKQNQDLVTHANDFLTDEDSGLPVFLEPEAVQLLSFWCRTPQQMRRFIGIILNAKYRVEKDHQDIGVLIPLDDEELKPLMTKALRRYFNALRSNEKHIKNVENYLYGTMQNLFGVWWNKQAAREYAANHPEEQNTDNERSWN

SEQ ID NO: 4172 - protein, 80 aa, Lactobacillus buchneri
MANKFEKFSSTNNDYQVARDIQQKDALNEKLNWERKVKTSFSIQQKNIDRLDEMVNQLNAKSRSTLLDTIIENAYRDFQE

SEQ ID NO: 4173 - protein, 269 aa, Lactobacillus buchneri
MQVISFMAIKGGVGKTTMAFQFAKFLQTQDQKVLMIDLDAQKSLTGTFENKHFNFSGKPTIADVLEKPSSGLIETQVQDNIAIIPSTSNLEEVADRLASKPNKELLLFMWFVKNAQELNQKYDYIIIDLPPAWNLLSKNGVAVADKIISPMEPSRFGYESHTKVLQSVGTLQDEVVDPVSGKSYITANVFFLGNRIKHNTNSSHEFLSALKHIDNVIGVIPEKELVNASMLAKEGILEYATQNDKLHEQEPFLKLLSDVFSEIQKQGND

SEQ ID NO: 4174 - protein, 194 aa, Lactobacillus buchneri
MAKIGYARVSSKEQHLDRQLAALRGVDKLFTDKLSGANTNRPELQKMLAYIREGDIVMVTELDRLGRNNLDLTKIMNTIQNKGATLDVLNLPSMTGIADPNLRQLMTNLIIELYKYQAESERKRIIERQQQGIALAKQQGKYHGRKPQYTQDDPRLQHAFKLYRAGMSDVDVARNTGIKRTTFIRYRKKFNVNR

SEQ ID NO: 4175 - protein, 94 aa, Lactobacillus buchneri
VNAQSVKNTATAENKGYDAGKKILGIKRHLAVDINGFPQAIHITRANVSDRDGASAMIALHAMHLRQVQNVLVDGGYSGVNFKLDVMSNLQATV

SEQ ID NO: 4176 - protein, 35 aa, Lactobacillus buchneri
MLNYPNNITRQQFEVIRPELENFHQRTKPRQVDLL

SEQ ID NO: 4177 - protein, 340 aa, Lactobacillus buchneri
MTMTNEAVLRAFHNEIEETVPVSFWHHFAPSGFVDGLQDDHHTYDLNVHGHEAYYQALDLDFVKTMLDGYYVDPVLLPDQPKTWTMLREVQPIQADDRWISEQLSLAKAQVQAAQGKLTFYTVFSPLTMFKWSLMDHATAPTDAGDHCLADLYEADSTALKRLLAQIGEDLAKLIRQLPPTGITGIYYSTQSIQDDRVKTADFFHAVIEPVDLAVIEAINDAFALNILHVCGLHGATNDLRLYKDYPLQVVNWATHVDGYSLAEGKKLFGDKPVLGGFGDGTQDILYAGTKAEIQAETRRLIQEAGRTGVIIGADCTVPRDTPLDHIRWVQEAARNFSKQ

SEQ ID NO: 4178 - protein, 689 aa, Lactobacillus buchneri
LKNGTKQYRLGIDIGGTFTDFSLYDTQACTTQEIKVRTDTTNPADGVIEGLKRYAATGVDLGQVDYLIHGMTIGLNTLLQRQGAHLGLLVTKGFRDILNIQRLRLPVPYDFASRLPTPLIPRANVFPITERLDAAGHEREPIDFASVDVAAKSAMARGLSGVVVTFLHSYSAPQHEQAVKSYLNANYPQLDVELSSDISRAIGEYERTILAVINLYIKQSVKTYLTTLTAKVETQGVGNVPLVTKSNSGITSIATAVARPVDTLFSGPAAGILGASQVAKATGNVNAITVDIGGTSADISLIDDGKVALTRRNAINGFPITAPGVELYSIGAGGGSYAWLDQGGMLKVGPSSAGAYPGPAAYGSGDKPTLTDAFITANFLNLADFAGGSISLDAARARTAVGHIATAIGSSIETAASKIIDVVIANMTTELSSILSQRGINPREYSLVSYGGAGPVLANYLADELNLKNVVLPKAPGTLCALGSLYADYLFNDATVYFKHLDAVDAGLEPQLTALAKRGEAWLAQQQQAHVGAVHHTFSINARYVGQTLEIRVPIEEAWLKTPGQFQQEVRARFDALYLRQYNHNSPDKPIELTQLAIQLRGETPKPTLAPPSTTTTVATATTRHIVLNGAALEAQVFQRNQLASGQTFNGPAVVDQPDTTILVLPGWQGRVAADQSLILERSEPNGNE

SEQ ID NO: 4179 - protein, 662 aa, Lactobacillus buchneri
MAMNDAAQLEILRNYFNSVVTNMGNVIERTAFSTYVRESADFATALASPAGEFYAYPTTVGVTIFLGLSLQRALKEVGPLEEGDIVVTNDPYTSNGLATHLVDINVFKPIFYHHQLVSYSWTFVNVSDVGGNVPSSLSPSNTSVFQEGLRIPPLKLYHHGEPDQNVLTLLAANTRTPRLNLGDIDAMVSAVNTGEKALLQIIEKFGEDAVTQGMTDLMGQAEHRAQKVLGTIKDGTYAFSDYLSDDYESDVPIRLAVKTTINHGQIDLDFHDCDPQVRTAFNIMTNGEKNSFLLQGLINFIISRDPFIPINGGIMRPITVHMPKGTLINPAFPAPIGIRHAIAMRMYNVILGSLLQAGVTAIPAAGAGQAAIVVLHNDSTSSPLKNKMAVVEPIGGGGGATSIADGIDGIDHASGFLKNTPIETLEQNMDILVDEYEYRGGTAGAGRFRGGNAIALQYEITQPAAIITARGIERMRFQPWGVFGGQAGEVGKLFRTRSGQRERIPKISVLPVRQDDIITVLSPSGGGYGDPFTREPGAVVTDVNNDLLSAEQAAGQYGVTVTKAADGTWVLDQVATQASRAAHTKAASNQWAFGDYREQYEQRWEPAVSAYLAVALRRRVAPELIPDLKHTLHTHFDAAAHPPTQADIDTFLTEQGYPKRGE

SEQ ID NO: 4180 - protein, 367 aa, Lactobacillus buchneri
MKISGWKKLGLLAASVMLVLAAAGCSTSNKGTTQSKDKTVTVAIYSGDWAKSIQKSAFKSFTKKTGIKVKTVQGADAEWLTKLNANKGKTAPYDLLILQPDSIEKAEKSGLLEALKSSKASNLKDLYPAIQSKLTFGSKEYAAGFSVGQLGLAYRTDLVKNVPTKWSDLWKSEYKGHIALSPLTYSAGLQTLSGLINAEGGNESNAKDVTKVFKRLKTLKASVVSYPDNPGSIQTLLQRGDAWVVPFWDGRIFALQQSGMKLGFSYPKEGAVAAVASWSIAKDSAHKSNAYKLLNYLSSPAVQKKFSDTSYYGMANKNVKYAPKVKSRIKTGNSELKKLKWVDYDVADKKLSQWTTDWTNALGSGSN

SEQ ID NO: 4181 - protein, 364 aa, Lactobacillus buchneri
MAKIVFEHLDYAYAKKNVLTDVNLTINDGEFFSLLGPSGVGKSTLLNLLAGFLSPQRGSIFIDDKDVTRLPPNKRRLGLVFQNYALFPNLTVAGNVAYGLKIAKTPRAEIPQKVTDALALVKLGQYAERMPRELSGGQQQRVAIARALVVEPRVLLLDEPLSNLDAKLRKEMRIVIRELQQRVGITTLLVTHDQSEALSISDRIGVLGDAHLQQVGTPTEVYDQPQNQYVANFIGSTNFITSDAHNGQLNLALKDDTGKQLTLAAAAVAGTGAVAGETTLMIRPENIHLMKEATDATLSGTITELEYLGNAVQGRIQFATGQLTFYRLVDQALPPVHAGDAVNVLVDETAFVAIHHHHLKEAGA

SEQ ID NO: 4182 - protein, 284 aa, Lactobacillus buchneri
MRGQNRTGLLFVPALLFLLVFLVVPLLILIQMAFKSSGNSITIGTQFTLSNFKAIFANETFYGGLFSTLKLSVGVSLICIVLAYFPAIALSKAPGNTRTVLYVILLSPMMTSVVIRVYSWIVILSNNGIINQTLEKLHLIKSPLSLMWNTSSLVIAFVQVLLPYGIIFIANSLSKIDRNVLRASASLGAGPLHTFFHVTLPLTIPGIFSAFTLIFSLTAGSYITPMLIASHQKQVSALTIYQQAMQIMNLPMAAALSVVLLIVVIIVITIATAIERMWEMRVYG

SEQ ID NO: 4183 - protein, 271 aa, Lactobacillus buchneri
MVRQKHIQSNVGLRILFWVITGLIFAFLLLPTVIIILSAFSPTEYATFPPQGFSVKWFRSLFTSPTWMAAIANSLKILVIAVPLVTILGTLAAYGLYVANFRGKSLLQTLILSPIMMPAIILGISFLYLATSTGLLGTYTIMIAGHIIVALPYVFRSVTNVLVGLDPNIQRASTILGASPWHTFSHVIVPNIKSGILSGAIFAAITSLGEVSISLLVSSATTTTVPVQTMTYIDQTFDPSVNAVAVIFILVAVILIAILEKLAQKSNTEVF

SEQ ID NO: 4184 - protein, 188 aa, Lactobacillus buchneri
LSTTCDIPTAKSQPNNIQVSALLAALPDELGIRFGQKEAKHRIVAFLNAACSGSKKWLDANYEMIAKAATNQQVVLQILLWNKPNLELVNGNIAQHYLRINDPRTLIILRDLYAHQDAFKAIREEASVIGYVEKKYHTHHENNQYTIDLIDKLATENGVRVAPTLIVDEKAYVGSASINGTDLASLLA

SEQ ID NO: 4185 - protein, 445 aa, Lactobacillus buchneri
LELTEAEYKTSLATLADYLKIRSVPHSPAGVKAAVDFLQKLITGLGGTVQVLDNKGHVPVLYAHFCADEPAARTLLFYDHYDVLDAGDLDEWASDPFLPEVRDGILYARGTSDNKGSLIQRLTAVAKLRRAHALHCNVTFFIEGEEETGSHHIESTLAAHPALFACDACIWEFGSRDARGNVELFAGVKGLLYVELTCVTADVDIHAMFGGAIEGANDRMIKALATLKNPAGRVRIPHFYDSIAAEMRPRLLMSVDKLPLTRADLQAAYGLRQPLHVGSDAQLRKRLTFAPTLTVSGLAGGYTGPGQKSIVPRLATAKLDIRLARQQDPVEVERQLRQYLAAGGFSDIGITVLEAQPGSGLDDLDDPFLALVAKTAATAYHSNVITYPVSFGTGPFYLFKRYLHVPIVSTGVGWLKENAHGPNESIRLVDYRLGIGHMLAVLASF

SEQ ID NO: 4186 - protein, 297 aa, Lactobacillus buchneri
VNKPHRLAYHAIKVVSQGNHGAVTKLLTVIGVSRQAYHKGLRRQETTWEKHNKQLKTRTQYWFDFHHQGIGAGNLLTNLQADKLIDFPVTLKQVRRVMRELDIRCQVRPKKHKRAKQAEQYLLDNVLKQNFQVTAPNKVWLSDSTELTYGLSGEYKVRLSGVLDLYGRRLLAYNLSATETSAAEIQVFQRAFTAVGKVPSLIHTDRGSAYTSRAFNHFINQFEITRSMSRPGTPYDNAPMERWWNEFKLRWMARHPRAKTYQELITLVESGIEYFNHHNRSAQRNGLTPDEYWSEAA

SEQ ID NO: 4187 - protein, 224 aa, Lactobacillus buchneri
MPRARHTLQEKLALLAEFKQSGLSIGTFTRQHGIHRETLMRWQSRLERDGLAGLTEAHTNNHYSNELKLKAVQAFLAGEGSLLDLATKFGLRSSTQLDNWVSRYNRDKTLTARPSRKRVPTMSRQTTFEERIKIVEYVTKAKHSYTEAADHFQVSYQQVRTWVIKTKSGGYEALVDNRGHRKANHELTELDKANLQIRELKAQLADKELYEAFIKKFQELQRRG

SEQ ID NO: 4188 - protein, 97 aa, Lactobacillus buchneri
LVYRPLFSNLFCFRKVYYNLALTGLSVTAAFFVGIVDVLQVISGYFKWNNPIIKFVQDLNFNILGISLLVLFVITWTAALIFWHAFNLKKRCCHYCY

SEQ ID NO: 4189 - protein, 408 aa, Lactobacillus buchneri
MSIVFGIDVSSRDSSVCVLQSGATREYKITNDTIGFKTLLIDLKEYAEHPQIILEATGVYSRRVTRFLDEYDYDYVLLNPLKAKKEINQGLRRNKTDRNDAYHLALAQDQNQHQPNRKEPDVYHQLQSLSRAYEELTHDIISSKNRLHKYLQLTFPELETIFNNSRGVNYWYLVELFPHCQDVRNLEVSTIAKQIKDFKGYGINRAQKLAIKLKHLADLAYPAVDQDDPERDEVVYYANRLLRLTADRERRSEEMIKLAKTLPNRDLEILMSIPGIAEITAVRILAELGDIRRFSNPNKINAFVGIDPGRYQSGEKDSSLRISKHGNAVARKILYRAIGQIDLAAKTSPCHIADYYERKKQFSQTKGFKKIAIASIHKLLRTIYILIITDQMYDYNVANNNQKDFCRN

SEQ ID NO: 4190 - protein, 150 aa, Lactobacillus buchneri
VFSPQEHQQGLAYLSGQLSLDQLENHHLQRVLKHDGTKQLFLGECKADPTIKNSQIEKIQKQLKKQQAKDDQYRKVNIGHYQPLNYKPVSPSYYLKTAFSNAIMTALYAHDEDYERQRQARGLKETEWEMTKKQRQHQTRNRHEDGGMHL

SEQ ID NO: 4191 - protein, 60 aa, Lactobacillus buchneri
MAEKFSTLAEEIINYQKKNDMPDTALAFNLHISVERLHNIKSMESDPTPDEKRTIEQFVR

SEQ ID NO: 4192 - protein, 104 aa, Lactobacillus buchneri
MRANQFAFAFGIFALIVGIIVDIYGLVTQFGSLDSAQVVLIGSIILAIGLAFLSLPNRWERYAGQLVVGLGLLYYFYIQTNKWWVAVIIAIIAMALMEYGLKHR

SEQ ID NO: 4193 - protein, 217 aa, Lactobacillus buchneri
MNPGMKLLLVMLIALEISFTQSLIVNIILITISFLYILTQHVSMKALFGIIFWPLFPAVGLFVSQWLYGSAGIHFAWILFTRIYAYVFLGATFTLTSSITDLSLTLEQDFHLPSKFAYGVLAAFNLMPKIAEEVRIIKTSALMRGEALHFWSPKLYFKSILSSIQWSQNLAEAMTSHGFVEDYERTHYKVIRITAIDWALFVVLLAAVQVLLFFIKY

SEQ ID NO: 4194 - protein, 476 aa, Lactobacillus buchneri
MTDVSINHFTFHYPQSDVKVLNDINLTFKSHHFSLLSGPSGSGKSTLLYFIAGLYPHFIGIDAVGEIKFGDTNIKDIPREKISQSVAMMFQNPNQQFAMDTVVHEMTFVLENLRIAPDKMDDIINDALEFCGIKRLRSRVINTLSGGEKQRVALACIVAMDPQVIVLDEPFASIDPGSREDLINKLKLLQQEHGKTIILADHDLTSYRGLVDEFYYLDPDTHQISLLDDQQAEHFFKNFESTQQMHKRVEIPTGDDHAIIKLSDFKLDPHASLLLTLNHFDFYKEKTTLITGANGIGKSTLFNALTNLLPYKGTIVFDGKDIQKIRPLPYAKKVTLLFQDAENQFLNITVKEELDLSLANRTNTDYTQADVDDMLSKLDMAGKDERIVYSLSEGQKKKLQIIEMLIMNPPVLLMDEPFKGLDYHSLEVVVGFLNRAKTDFHQTQIIISHQLSGLDTLIDYHAAFEDQNLTYQEVIK

SEQ ID NO: 4195 - protein, 196 aa, Lactobacillus buchneri
MDNKSQATGGKKQSQWTLRNIILIALIAIFTGIIFWGAGFLYTGLTVALTPFGMAPFANDLLMGLWCMAGPLTGFIIRTFGSAFLGEFLGASVEVFLGGQWGAGAFISGLVQGIASELGFTLTGYKRYDWFGLNASIFTTVVLTFAWDMIRNGYDKFSLPLLLGLFVTRYISTFIFAGVLTKMIVKLLDRSKAINL

SEQ ID NO: 4196 - protein, 268 aa, Lactobacillus buchneri
VVKVIASDMDGTFLNDQGTFDEQQFQQQLDQLGDKGMHFISASSNQYQHLLGLFKNVHGPISYVCNNGALVIDERGVIIHEEIIDHLVLKKALDWILSEPSFAGAEVILVGRNGTYCNLPENSDRFQASKYFYENMQSMADLRLVFDSIYKLDITWEEGGVLKRQDEFNHKFSGQLNAISSGMNGLDVMVDGTDKLTGIQMLLQSWGLTLADVAAFGDNGNDFEMVNAAGEGYAMKNSAADLLQKVEQVTAYSNNEQGVQRKIADYLS

SEQ ID NO: 4197 - protein, 311 aa, Lactobacillus buchneri
MCTSLTLETLNQHVLLARTMDFPVKAAWKPVLINQPNYVTALSGTRLIKYPYIGGGRTEENDNILVADGVNTQGLSCAELMFPLKAHYLDNEVDDKLNLTPQDFLPWVLGEHASLKEVKADLDNIALIGKYWMAGKEVFSFHWILTDKSGQTLILEPTVDGLEVIEDSIGVMTNSPTYPEHMARLEKKLKVTNQQALAAKAQQIIMSQDLPKATNTPTTRFLVAAVNKLGTLPSRTQYEARNRLFNVLDEVAIPYKPSMDDHPNFNYTHYISVLDSTDQTYYFRYHDSRQLLSFSLTDLVEEYPNTSRFLA

SEQ ID NO: 4198 - protein, 209 aa, Lactobacillus buchneri
MKSAWNLVGMALWLLLICYFAYIIHDMRARRLRLIVTEKKSFTWRNFWISCSEVAIFLLFLWGMSYTTFFQDVKKLDTNRTTTSYAYKPLIIRYRSDQSDYVTVRNGNGRKPIQNYTYYVNGGKYLVNSMNATVVYGKSNLNVQAETYKWNKEYLDHLDTRYQHAWVATVTTTYKKNFFNGIGLHAGRQADRFSLIRIPDKSFMHVVGD

SEQ ID NO: 4199 - protein, 298 aa, Lactobacillus buchneri
MDLDISNKSLPIFAALDSQVRIKIIRLLSEKKMNVSQISKAIRLSSPITLMHLKKLEDAHIIKTQKKGNQRICSLQIDTINVSFPQQLYIPYENWDIELPIGQFTNFDVQPSCGLAGQKGFIGKVDNPSYFMDPKRYEAGMLWFAKGYVEYQVPNYLKPDQELEMIELSMELSSEFPFSNNRWPSDITISLDGKEIGTWTSPGDFSDIRGRYTPDWVYNDMNQYGMLKSLRVSKHGSFIDGQHSADTTINELDTTKNSWTLRIGVKDNAKHAGGCTIFGNQFGNHDQGIKGRFYFSEN

SEQ ID NO: 4200 - protein, 483 aa, Lactobacillus buchneri
MTIELLPQKKGPQISKYIYGQFSEHLGNGIYGSLYVGKNSDIANVNGMRTDVVDALKKIHVPVLRWPGGLFADTYHWMDGIGPKDDRKKIVNTNWGDVTENNHFGTHEYFELLNQLGADAYINANIGSGTVQEMAEWVEYMTMPGESPMANLRRQNGQEDPWKVKFFGIGNESWGGGGNMRPEYYSDVYRQYQTFLPQYDKDHPIYKVACGPNEDDYNWTDTVMKYAGQYLDGISLHYYTLPKGTWGQSKGDATGFPESEWDSTMTRAKHMDELITKHSTIMDRYDPDKRVNLIVDEWGTWFNVEKGTNPGFLHQQNTIRDAMVAAINLNIFQKHADRVYMANIAQMVNVLQAMILTKGDQMLKTPTYYVFDMYQKHMNGELVEGVGSVPENVTYTASQKDDKLTISICNYDAHEAQNVDFSGLADFKKVKSGKILTADKLDAHNTFDNPDAVVEKDFVGAELKHGTLHLALPAKSVVSVTLK

SEQ ID NO: 4201 - protein, 430 aa, Lactobacillus buchneri
MSKKDEKDLKAGESVPEPTNAKVTNAEQPKFPKLFGLAMLLGPFVWLAPAGNVRNTLLPQYFSQIDPSGKVAAIAIMASVSSIVAAIANILFGGLSDITRTRWGKRKPWILGGTIVESGLICVVANLHDLWAIVVIWGFVAAAENAVAAAMVAQEADRIAPKWRGTISTLYGIGYTAIQVMTMIAAQFLGNPKMGMYVMAGSGFVMGILHVLFAHEGSNLDEPREKFSWRALWLHFSLPTVGARDYWYAVAGKLMMVMGGTIATAYMLYILTDYMHLGQQSAGKTLSEISMINLVFGVIFTAISGPVADRIGRLKAPVALSTLLIGIAQFFPFFDNKPWTILTYAVLAAIGNGVYNAVDGALNLAVLPNAETSGKDMGFINLANTFSQISGTVVASLIVTYLGGYKAIFPASFVIELIGAFLIFRIKSVK

SEQ ID NO: 4202 - protein, 768 aa, Lactobacillus buchneri
LNSSQLVPGTKFGAALNDLFGIFFEDINHAADGGLYAEMVQNRSFEFAPIDNDAYQPTTAWQLSDPTSLKVDDKDPLNTKNRHYLEVNARQDVELTNLGFNQGMYLEAGKKYHFSFFAKTLNGQKDVNVHLTDKAGDDVAVPTVIPVESHQWLKYTLTFVGDRTTTEGRLTLKFEQGTHLLIDMISLFPDDTFNHRQNYVRKDLGEALKALHPKFLRFPGGCLVHDGQLDPDDRGAMYRWKNSIGAVEQRPARRNNWGYNQTLGLGYFEYFELSEDIGAKPLPVLPGGYDPHHDREAPIDQLGEWIDDALDLIEFANGSTDTKWGKIRANLGHPKPFHLEYLAIGNEEVGQAFFDRYPYFHKAIKAKYPDIKLINTAGPFAAGKEFDRGWQSARENHSDLVDEHYYMDPEWFLANQHRYDSYDPKGPKAFLGEYASKANQWYNAVVEASYMIGLERNADKVGLACYAPLFCNVDYENWGTDLIYFDQKEVSPTVNYFVQQLFMKYQGTDNVAYQLKDLPKAKVVDDQPIVGKFFVQGDKARAKFENIVLDDGQQKQKFASQIVDHEEKVELGSTDATNYTITFDVTKTDQDSKGTHFCFGQQESDKWFVWILGGWANTDSMVRVHHGKADSDWTQTTWSMAKGRTYHCKLVVDDRHVQTFIDGQLINDVVITPTVIEPMYTNMTYNRNTNQYYFKAVNVTGQPKEITVDSERFANGSVYQLSGRPDAENHLGANNQIERQNVPFSGHQLILPPYSVSALVSAKQFGTR

SEQ ID NO: 4203 - protein, 425 aa, Lactobacillus buchneri
MLINHHRTFAPVPPKGWNSWDGYGASVREEEVRKNAEYMSKHLKQFGWEYIVVDIQWYEPTANSSRYHDFYPLVMDNYSRLLPDPGRFPSVSGGRGFKPLADYVHSLGLKFGIHIMRGIPRQAVHQATAIKGSDKSAREIARNNICPWNSDMYGVNMDIPEGQIYYNSLMDLYASWGVDFVKCDDIANSQLYDKTHKNEVVALRKAIAQTGRQIVLSLSPGPAPIKNGSFFQRNANMWRITNDFWDEWPLLYNMFDRAEEWAPISRPGNWPDCDMLPLGHIGIRSVDGPGGNRQTRFTHAEQRTMMSLWSLMQSPLIMGGELTDLDDWTKSLLTNSTLLKMDNSISEKFELTRTDQMIVWYARSDHHVYYGIFNISSKPIMVSQAQLKQIGIENDARDVWHNSQLVGSTVTIGSHDVLLTEQLRR

SEQ ID NO: 4204 - protein, 803 aa, Lactobacillus buchneri
MQQNIDQRFVTISDPEIARAQQMTVKYLLALDPKRFLVTFDQVAGIDSGGVTGYQGWERTDGLNFRGHFFGHYLSALSQAILATEDNAIRQQLLDKLRLGVNGLQSAQAAYAKKHPESAGYVSAFREVALDEVEGREVPKDEKENVLVPWYNLHKVLAGLLAVNVNLQNIDPLLSEKALKSAHQFGLYVFKRINQLADPTQMLKIEYGGMNDALYELFDLTDDKRMLTAATYFDETTLFKQLAKGDDVLAGKHANTTIPKLIGALHRYESLHDVKRADQYLSPEEKGSLNMYLKAAVNFWQIVIDDHTYVTGGNSQSEHFHEPGQLFHDAVLEDGATTCETCNTYNMLKLSRELFRVTGDKKYLDYYEQTYTNAILGSQNPNTGMMTYFQPMAAGYTKVYNRPFDEFWCCTGTGIESFTKLGDSYYFRSGDQLYLSLYFSNVLRLDSRNLQMTEQVDRKAGKVHLTVVKIRSQDSAGTINLKLRNPAWLVQSAKLAVDGISQQMDQNADFWEIDNAGPGTTVDLEMPMSLEMVQTKDNPHYLAFKYGPYVLAGQLGKHSINDDRPNGVLVRISTHDHASPSTLTTGMDWHDWQQSLNNQAVVDTETTNTLFKLKLPNTSETITFVPYYQTFETRYGVYFQWQQAGSKEAQRREEQLQALSEYRRKTVGQLDNFDQNNFEFDKHLEQYHSEASNAKGRRFRVAHQDGWFSYQFSLVKAQPGLSLELTLNVEDAGHSIVVGFNDDHKFDQVLTVDQNQPTDSKGFYHVRIPISVTLINQQPDIKLVFRSAAGDTARLFGIRLFNR

SEQ ID NO: 4205 - protein, 626 aa, Lactobacillus buchneri
MKVGIIGAGPRGILLTSQLFNQYKYHSDQKSPLSITLFDPYGIGGRVWRTDQSDELIMNSSADQITLFTDASVTMSSKVYDGPSLFEWAKSVEANRYLDSNGYSSDVIAAAAQLQINGYAPRVLFGAYIKWFYQDLIKQQPTEVSTSLMKSQVMDLTYDTDHHPVIKTNDGTFTFDKVIMSLGQQDNYLSDEEQKLASYAQQNALTYIAPTHPGDADLSDIPAGEPAIIRGLGLSFIDYISELTLGRGGHYMQNEDGSLFYQPSGREPRIIAGSGRGIPYYPKPINEKGYGECDVPKFLTKENIQKNSTDGKISFDKFMELLLLDLKLVFYKLTINDKYPYKSASEFETEFLANDDKQAVLKQFGFAEEDAFDWDYIINPFKDVQAVGTEDYQSVLINWLNGEIDDSLKGSKTGPLAAARDLLRDFRPAFRQMLVDHCFSNQDLVEKFWSQLDSTINFLIMGPPVVRSKELSALIRSGVVTILAPGMQVKGQDGWFVTAAPKRNTDTFRSATLIEARVPKADLDITANPVLESLVDAKLARTHQVKINDQSVGLNAVDVDPSTDQLLDANGAGQPDIYVWGVPLDGLRYVTNAAPRPGVNDTNLQTADRLAAEVLGLPAAGNVEMA

SEQ ID NO: 4206 - protein, 187 aa, Lactobacillus buchneri
MADKKTQGYINVHDVDPDIIVDLKYATSDNFTHQVVYDFDQAISRIDTVKKLGEASKDLKSQGYRIKIWDAYRPTYAQKRLFEVYPDPIWVAEPDPNFSHQKGVTFDLTLTDANGNDIEMPTGFDDFDGLAKRSMKSSWTPAAQKNYDILNEAMEKAGFEGYENEWWDFRDSDKDQFGPLEVDPKDY

SEQ ID NO: 4207 - protein, 215 aa, Lactobacillus buchneri
MTQAITVEESRELDDKTINKIGIPSLVLMERAGLKIYENMLDNKDLDLSNVLILAGTGNNGGDGLVVARLLATHGYQVSILTVGNPDHASEDHLAQARICNYYQIPKVFMNADFNKFTTLVDALFGSGLSRNVGGDFATVIDKANASTAKIHAIDIPSGLNGDTGEVMGTAIKATSTSTVAYPKVGMLKDQAKPYTGKIYVDDIGIYRGNAFENE

SEQ ID NO: 4208 - protein, 109 aa, Lactobacillus buchneri
MSLDYPENMHEFEDKFAIEKARHPETTRDGLMKQVIEDAFQGYLDEAEEGHYDTGKLVGKEIQVIGIGEKLLTTIKPIGESFQADFEKDGNQLMWYLEDQADKVARKFS

SEQ ID NO: 4209 - protein, 171 aa, Lactobacillus buchneri
MKNDILTIMHGWYIALGVVLWLTLVTIFVSKRYLSSSPVNWAKLYLTPILFIVFGIEKIVRFRHLAATLTIFLVIIVLASFFGAHLAYKYQSFFWRENQIKMIGGKYAISLMIMNVIVMMLINFHGWVNPESYETWSYTLTYAITSAIVKGLLIGQSVNMWWHLKVLPKKL

SEQ ID NO: 4210 - protein, 490 aa, Lactobacillus buchneri
MNKQIPKSTIIIAWVVVFGAMAPLLDSTMINIAINKLVNSFNSSVTTLQWTITCYVLATGIAVPFSSWLLNKFDGKHVFMLSEILFGIGSILAAVSPNIQFLIGARLVQGFAGGLIMPLLTTLLVQTAGAAVMGQMMATVGLPMILGPLIGPVIGGIIFNFLSWQWIFWINVPVTLTSLGLIIWKMPNYPAQNKSAKLDLIGTLLLIGSSTSIIYGMVKAAHKANFSNPSTLTFLATGVSLLIVYVIWGAIRGEKAVIPLNLFKHGSFNGSIIGLFIAGTVLNGAMLLLPLFFQNVRHMSVLMASLALIPQGLGMLISRPLTGRLTDSIGAKYVVLVSVFIAFVGTIPFYWITQSTPYWIIAVVLLVRGIGAGGILTPLMADSYSGMRTDQISSATIGSRILQNIGSAFGSALVTTVVTAFSASHVKSFQHQLKTGSLKPASGQLAAFIHQHLVAIRLDAFQQGFLMISLAALLIILPTLLLSNKMKSKE

SEQ ID NO: 4211 - protein, 201 aa, Lactobacillus buchneri
MVQKRRRGAELEQAIYQAALQLLKTKGFLSFNFADVADLANTSKSVIYRRWQTPFSLAIAAIQDKITSENHGRTDDFTLTGHSLREDLLQLLQRFIISMQTFKDFRITELLGEATKEENTTIQQLMSDGNAIDLNALDHILTRAKKRGEIVKTDLPEEIALLPFDWLRFQLFTNQPLTERKLELLVDDVLLPIYQSKSRSD

SEQ ID NO: 4212 - protein, 273 aa, Lactobacillus buchneri
MRIAFSNLNDTMPISCESIGYHWRQYPIYRPNGYRFFHWLQTESSSGTIKIDGQQIHLLPNSGILIRPTVPHSYSADSDAKEWDTAYITFYGPLANYLVNYLEVEDYRVFEDLPENITNFIQSNYRAFINNTIADQANQSVLIYRYLLLLHQMDIVHGQQSKSDPIVNRITSFLESNYQFNITNQSISNITGLSIPYQTNIFRQKYGVTPLQYLFDYRIRQAAYLLVTRRDLQVQEVSEQVGFSDTSRFINAFRNFYGVTPKQYSRTAYQGNN

SEQ ID NO: 4213 - protein, 208 aa, Lactobacillus buchneri
MLKVPDYEFWFVVGSQHLYGEEILGEVRSDTEDIINKLNASGKLPYPIKFKAVATTADEITAVMKEANYTDKVAGVITWMHTYSPAKNWIHGTKLLQKPLLHLATQYLDHIPYDTINFDYMNLNQSAHGDREYGYINARLQKHNKVIYGHWADPEIQQEIADWEDVAVAYNESFNIKVARFGDTMRNVAVTEGDKIQGQIQFGWTVDY

SEQ ID NO: 4214 - protein, 261 aa, Lactobacillus buchneri
LVEEINQVSDTDIDNKYQELQQKYTFVQGDNDAAKYEHSVRYQIREYFGIKHLLDKGGYTAFSTNFEDLFGMEQLPGLAVQLLMAEGYGFAGEGDWKTAALDRLLKIMTHNDRTVFMEDYTLELTKGNEAILGSHMLEVDPTIASDKPRVEVHPLGIGGKDDPARLVFDGIDGDAMDVTISDFGTEFRMIGYGVTAHKPTKKTPYLPIAKQYWTPKMGLKHGATEWIQNGGGHHTVLTFTASEQQIKDLATLFQLPFIDIQ

SEQ ID NO: 4215 - protein, 219 aa, Lactobacillus buchneri
MSITLYFVRHGQTFLNKYNRIQGNCDSPLTQQGIAAAKRAGSRLSRIHFTQAYTSDTMRTINTGKLILQENQEVSPKLQLKPMQALRELNYGYFEGSDENQLWHELGGEEGVDSFEQMILKHSIEEAEDRVASADPYQDAETSAEFWERFSSGIQEIISQATDHDQILVATHGTAIRNLVAHWSNLPVYVPTINGSITKVTWNGSQFLVDYFNNVSQPV

SEQ ID NO: 4216 - protein, 525 aa, Lactobacillus buchneri
MEFTDYEIEKLIIPQDNIFSMLTKDDLKQFLKLYYSAELSVKELLEKYQLNIKIQDVAKNLPKVQDVAVCPYDGNHLLRKMPSRTSQAGSSENSICPKCGHTIFSTARHYPPRECHCDGCLKKKEEEREKFAQMIQQNNEMRTKYEFENLDVESRLYLAVILQKLHATKLTNVGPYSRHLIDERLEDNFGTDSSNLIEKLYTSGVLVLSPLSDFDVFTDVSFDKQTAKFNLTDVAWDVWVQSDLLSDDILLQTLTNPNKGMIMGEAETTNLHRHLVLNELKRLFYFELARLHFEVRNDAERECVSDALKRWSAQFHPSEIYYLIYISVRRANDKRTSGEWGNYKFHQIQFIVNTGDNFIMSYSHRHKPMQQFGYPTNRITPLLETRIFFEQMLIVPNWFNQTIPSEDGALGLEPINSLTSQVLDKMLDQREDAALKIPGIISDAKWFSIRICGVVINDGNVDWLYADQLTAYGYAKQIETTKNQNLNWTERIIIDGSYYIQGFYSFNFLIKLIRALKDGAIAEKN

SEQ ID NO: 4217 - protein, 318 aa, Lactobacillus buchneri
MRYIITGADGKLAGRVAELMLKEVSGEQLTFTCYKIDRVPKDKLKHWKDAGVRVVEADYNDKSSMLKAFEGGDRLYLISGLDVGKRVQQHRDAIDAAIEDGVKHISYTSFVGATEPAYQHIFVTPDHTATENYLESTGIDYTALRNNLYMETFMTMRAMLAFMSNNRWVTTAGEGKATLVYKDDCAKAGVASLLGKGTRKVYNIVGSESISVRQIADMISKRSGQQLEYVPASREEYYDYLAALNIPHDMSGDFSKSPAPFSANDVVDNDKSIADGLLDVKSDDIEELTGAKPKTPEEVIGEFDYIWKDHITNWRQMK

SEQ ID NO: 4218 - protein, 296 aa, Lactobacillus buchneri
LNFQQLQCFVTVSQTLNFSTAATRLHLSQPAVSKNIKQLETELAFELFRRNQHGVSLTVAGQEFSKQMSNVLILTEQAILDSREISEKDQQSLTIGYTNAMIENKLLPKLLRSAHHQLPNLRLSLRSFDLSTGLSNLQSGVFDLILATKDTIGDNPRVKFVPMFQGHFNVVLPIGNRLSEKSKLTFSDLKKSQLIFFNPLQAPPESATLQNTFIQAPEDFHYQTADTLNTAINMVKGGIGLAVLPSFTVDSTESNVTVIPLDYPVILDYGVAYLETNSSSSLLSIVALLKTLIGKV

SEQ ID NO: 4219 - protein, 249 aa, Lactobacillus buchneri
MAELDGKVAIITGGANGIGLETTKLFLQEGAKVVFTDVNADAGKQVEDELNNQNALFIQQDVGDEAEWEKVVKTTLDQFGTIDILFNNAGIYIIGKIADLTVDTWNKLMRINVLGTFLGLKHVLPVMAENNHGSVINASSIAGIAGSAGHILYGASKGAVRTMTKDAAAEYASKNVRVNSIHPGYIKTGMADYASASLGIPENQLGKIFPLGRLGERIEVAQTVVFLASDKASFITGVELPIDGGFLAQ

SEQ ID NO: 4220 - protein, 316 aa, Lactobacillus buchneri
MLIFMTISLVAGFLLSNQSPINADLSRLVKSPFIAGTISFIIGTLFLAILAMSMTGRLFPNGNFIQAQPAWIWLGGLLGSIYLTSNILLFPKIGAIQTTILPIMGQITMGTVTDWLGWFGSDKVAMTAWRLVGILILIVGVLVAVALPSLTNRDIRRFDANVARQDGPTRVIGWQIWAVIVGVLAAMQQAINGHLGTLLHSTSQAAFISFFIGTLLIAAVALMIDKRVPTTRELKTTQPWNWLGGILGGSFLFVTVVAVPQIGAGLTIMMGLIGQIIGSILIQQFGWWRSIKQQMVPAQALGMVLMLIGVGLIKMA

SEQ ID NO: 4221 - protein, 394 aa, Lactobacillus buchneri
MTRGARWRLASALLSISILLTSANAVAGTIPIMAERFPSIPLSQIESLTTIPSLSVLIFVVLSNPIAKRLGNKATVLIGVFIVLIAGLIPTVANSFWLILASRFLLGAGIGLFNAMAYSLISYYYEGTQRQTMMGYEGSVNSLGNILMFVFSSILIGFGWRQVYLYYLIAIPVFILFWWGAPNDRQEKQPQADQEAATPSVGLGELLKGRLMIYALLVLFSMMIAQTVIVKISGLILTGGYGKIADGSIALAFLGVANMIGGTLYGQIFKLIHQLILPVGLLIAAVALFALARSQSLALTYTLTVVAGLSTSLVGPYLFASSAEIAGKGNETLASSILIVGINIGVFLTPYALSGLSHLIGSDQPAPILIAVSVVLAVIGALTFFMKEPDQQSQ

SEQ ID NO: 4222 - protein, 794 aa, Lactobacillus buchneri
MQSVDDQLKQLSPEELIKLTSGANFWESVALPDHQIPSFRMSDGPNGLRYQAGEGDALGINDSAISTCFPTASAVACTWDPDLVAQMGHAIGLEARSLKVDMVLGPGINIKRNPLCGRNFEYFSEDPYLAGMIGAGWIKGLQSEGAAACLKHFAGNNQETDRLLSNSMIDPTALHELYLEAFRIAVESAQPEGVMCSYNQVNGTYSSDNAYLLSKVLRQQWGFKGAVVTDWGALNDKVASLNAGGDLEMPSSHNMFDPQALEALNAGRLKRPALDRAAGNVVRIAEKQRPEFTGDRKDLLTKNGQLAQKIAENAAVLLKNDDHILPIDPSTKLLVIGQMAAETRYQGAGSSHINPPSQTSILQGLTNAGIAYDYAQGYQFTGENNRELATAATDAAKNTQTVVVVAGLPESAESEGFDRPNMKLPNNQNELIEQLAAVNPNVIVLLVAGAPVELPWRTKVKGLINLYLGGQFVGNAAANLLSGKVNPSGKLAESYPITYQDVPSAELYDHNPRSAAYAESVYVGYRYYEKANQPVAFPFGFGLSYTSFEMSRLQLNQHQIEAGQSINVTVDVANTGSRDGAEVVEVYVGNSSDRALKPLKELKAFQKVFLKAGEQQTVTVTLPAQAFSEWDEQQQAWQLPAVSKTIIVKIGSRLEELTAPVEVIGQAITPTDSIPSWYTHPVGKPTIADFTELTGMTVAPPATPQPGQYTPLNTPRELSTHSAIIRKIVSVLKANMTKGISDPNSSEAKFMDAIVMDTPLIRLAQQSSGKLSLSLVHKLVALANRHYIQAIFKN

SEQ ID NO: 4223 - protein, 142 aa, Lactobacillus buchneri
METKLFSNVVMVNADMEDVKGILSNPQQLLQWVPDISTVDQSENGFLIKRSGAALNQSERIRIETNGSKITYISTQGRLEYKLIFSVHAQNHQAVVQEDLYILKDATNQLPVKLLAPIAKHAFYSNLIRLGSFAELIAANNQ

SEQ ID NO: 4224 - protein, 273 aa, Lactobacillus buchneri
MEIGTILKQTRKRQGLSQKELSDGICAQSMLSAVENNQYTPNAQLLIKLCQRLSVSLDQFSLADNFDISPRNTFNQTVEKLCNNHNYLKLKSFLSENSTLEQIETPQQTQAYYYYLGVSQFHTDKKLDDAQNNLEMSVNIAEEKNSLSVLTRLGLITLAILKSKNHLQSSATKLIQRAMQNIGNIKYEENINVIFYLAAFIDYQSGNNAMAVKQVESAITFITNHNSHYMLANCYYLIAQIAKNSGDKDQMLESLQRQKFLTELFHEKVYDKF

SEQ ID NO: 4225 - protein, 118 aa, Lactobacillus buchneri
MNFSILISKVYSKILAVHWCVTIITAMAAIVFYPRLPQIVSTHFGFGVADSPGSKITIFILPVTLIVLGLISAPKWIDQRFADYTIFNTAVKSLMIVIMVLVWVGVGMAFFTYYELAW

SEQ ID NO: 4226 - protein, 381 aa, Lactobacillus buchneri
MAVFSEEQRLQIFKDLIAIQSVNTDEEKVSVYLKNLFEKHGISATIIPVDENRTDLKAEIGTGNPVLGVSGHMDVVSPGDTSKWTSDPFTLTERDGKLYGRGAADMKSGLAAMVIAMIEIHDQGLLKKGRIRLMATMGEEVGELGSRTFADDGSMDDVDALIIGEPSGYRIAYAHKGSMDIRLTSTGKAAHSSMPEHGYNALDPLIDLLHDANHQFRATDKKSAMLGNLAFDTTIFKGGDQVNSIPAKAVADINVRTIPEFDNDVVDKQLDQLVKQQNANGAKIVKETYMSQPSVETTGDKKLIGLAQEIGKQYAEKDIPSGAIPAVTDASNMLRDKPKEFPFIIFGPGSNSVHQVDEFVDKQMYLNFVEIYQKLFTQYLN

SEQ ID NO: 4227 - protein, 641 aa, Lactobacillus buchneri
MKQRKIVIKVVVAMAAAMGLLLGTAASTNVLTEAAETNTAVQDETASGHFGGPDGPDWTRDGNNFNLTGGVLTERIDNQLTSNIRTATVINITGKLYLEGEASRELFSSLNNVTTINGMENVDTAKATNMELMFAEDQALTSIDVSSFDTRKVTDMAAMFANDSSMKSINVANFNTDNVTIMPNMFADMHEVESINGTNFNTQKVTEMTAMFWNDPNLKTVDVSSFQTPNVTSFRAMFADDSSLTSLDLSGFDTQKLLGYSNGTLGLMLRGTSSLTQLTLGPNIQFDKNKTINGASAGLPTLGAPAGSERWQAVAADKGGTVDNPKGATAFLPDELTSLYDQSNANHPTKVETWVPYFKDTLDVKSPINLTVGQSFDPKAGFVSAADGNGEPVTYDQAVAEGKPGGLAVDTSGLDTSKPGTYNVTYSYHMRKAVVKVIVSAAPGVTPNPTPTPNTNGNNSGSSNPAWNPTNPKNPNGTGLPNYADVRNDAVYATKKIYLYQNPTFKKSQRIAAYPKTKRINRPMFVVIDFAKSNGGALRIKVRDVNHGKKTAGKVGYITANPKYVTNVYYQTMPKSNQVKVIATKGVYAYQNANLSGKAKHYRKGARLTVKKLVKHNLTTRYQLSNGHFITGNKKLVIHSR

SEQ ID NO: 4228 - protein, 344 aa, Lactobacillus buchneri
MALPNVTAIEGIEKLDTTQATDMSHMFADDTNLLELDLSTFNTDNVTDMNSMFSGDASLEHLNVYTENVTGMEAMFARDTHLTTLDVSHFKTTSTYDMASMFQDDVRLQELSVNNFNTEKVDDMSAMFSGDLALTNLDLSHFNTENVVRFAYMFAGDQSLTTVNVSKFDTSKAELMTGMFSGETSLTSLDLSNFDTHQTLIHGAWGLSNMLASLTSLTNLKLGPNVVFGPAESIGDPHLIAPAGADNWQAVSSGTPEDPEGPVYSPDGIRGLYEPTNPEHPTEVETFVPEKPFVDQSAISVQPTYSMTTGTKFDASKVFNSITTPEGNVGYITANAKFVTNLYY

SEQ ID NO: 4229 - protein, 438 aa, Lactobacillus buchneri
MTAATPDEVDCQQRQLVCIDDSGYIERVINESDDDFSAVKRDAEQNDRLLTLKSNEYLLPGFIDLHVHAPQWPNAGVALDRPLNEWLDTYTFPMEAKYKDVGFAKRVYDDLVGELLANGTTTVLYFGSVDNPANLELAKACVNHNQRGFIGKVAMDNPDQTPENYRDASAQSAVDDTERFIQQIDRLNQTSPIKQTAVITPRFVPSCTPESLKGLGELAKKYDLPVQSHCSESDWENGYALEHYHKRDAEVLDEYGLLTDKSVMAHGTLLTQADLDTFKARGVAVAHCPISNVYFGNAVLPVSKLLQQQVKIGLGTDISGGYSPSIYQNIRQAVMSSRMLNDGVNSELAPAQRGTNYPPISAKNGFYLATVGGAKSLHLKTGQIKARYLADLQVVKSPLKSFEDESLDQIFEKIMYHASKADVKQVFVQGRLAKTSNN

SEQ ID NO: 4230 - protein, 164 aa, Lactobacillus buchneri
MQPTQLAVNLIKQMPELPTGCEITAVTMMLQYAGQPVDKVTLAHEMPYDDSDWNKGFVGDPFTENGDSIYPPALVGLVTKYAGHAVDLSGKSITQLKQFLAEKQHPIVVWVGQFDGFATHALVMTGFDDQQIYYNDCWTGERTFMSTEGFEQIRLKKMKLAISY

SEQ ID NO: 4231 - protein, 780 aa, Lactobacillus buchneri
MSQLDSSSHYLRNFLLLLFGMLSFLVVGNEFVSANNTGAVADNSSPTGTKVTITKDNYTQFFKNTGLTSYDPSTGKVTFPLSTVQGNPASGSVTIAGKSYPASLGSDGSYYADVNGQKSFIYYNGGGYPFNWARVSGQSYMASNIDLHRSFEFKGMYNLTPGPRSMYGNMGDGVSFMFKTGDPSLLGIGGAGFGVGGLQGAFGFVIDGSPYGDPAASTGHTPTIQMFETTGDNSQINTGQYDGPYDVDFLGTPDTSVSSDEYMGADKELPIDITWDAQTKTLHYKLFKNGSNSDVLSEGSQDFSSYLQKYGYYASFAVSSSNGGIQSSVQLTINSIEYSVIGIVNVDYLLNNQNSDKIIPTQQERGSLTDKAIIKAYPLGVSSDTYRLVKVKAPEGYKLSGDLLTLPFGNGQALFPFSDVLQNLKLYYDKNSNPQEKMSATIKHVDQNNKPIGTDQHITGVFGQAVNIPQESISGYTPDKTNPKQFKFGTLDENGDVAKVITLKYTKNQSPVPPTPNPKPNPNPIPEPSPVPTPSPVPTPQPNPQPTLPNYAATKGEAVYALQKIYMYKDANFHKSLREVKYIQKPRVYRPMFVVTGYSRSDAGALRYKVRDVNHLSKTHGKRGFITANWHFVRPVYYESKHRTLTVINPQGINAYKRSNLTGMIKHYKQGTILHLTKLVHHNLTTRYILSNGNYITGNRKLVNAGKHKQVQLVIVKKPINRYNTVNLRGENRRIKVGTKLRVKNYDYSHAHNMTISGALRYHIAGGYITGSSRYVKIVK

SEQ ID NO: 4232 - protein, 276 aa, Lactobacillus buchneri
MKVVYLNQHSQSNMASSPTPIVLALGFFDGVHKGHQKVIATARKIASQKGYQLAVMTFNRHASRVFNHSQSASFRYLTTLKQKIELVRATHADILYVIDFTKQFAALPPKHFVDQYVIGLNAKVVVAGFDYTFGRGGTTTIDSLAKISGGKVKTVTVNELASDQLKISSTRIRHLVRDGNIQEATRLLGHPYETTGKLIHAQTNGLSIVNPSSRLQQLPESGRYLCEVRVADHLTKMPIKVVHARDNSHGIIYIDRRKFNHLPHVNSLPVKIQWLK

SEQ ID NO: 4233 - protein, 586 aa, Lactobacillus buchneri
MVETISGSDAVLKVLEQWGVKNIYGLPGGSFDSTMNAIHNQKKQINYVQVRHEEAGAIAAAATAKLTGKVGVCFGSAGPGAVHLLNGLYDAKSDGVPVVALVAQVPTGSMNMDFFQAMDEEPIFDDVAVWNRTAMTADALPRMTDEAIRQAYMKHGVAVLTIPKDLGWAQINDTYQPNVKSHQTPVYPSPRPEDVEEAVKLIKEAKSPMIYFGIGAKDAADELKEASEKFKMPLVSSFLAKGILPDDYPAYLGSTGRVAPKPGSEAGFSTDLILWVGNNVPFSIFLFNKHAKVIQIDIQSEKLGERRHNDVSMLADSKVALDAILEAGETRQPSAFYQACLANKENWNSWLDSFKDSDQMPVRPEPIFDVLNRTASNKAVFAVDVGNVDINFDRLINMHDDQKWATSGIYATMGFALPASIAAKLEYPDRDVYSLSGDGGFAMLMEEVMTQVKYGLHIVNIIFTNETLGFIEAEQTDDTHQPLSGVDLPDTNWAEVTKGMGAVSYTVHTKEDMQKALKDAENTDKPVVIDVKLTHEMPLTTQHMFLDTSWQDKDKVAEYVKKYQAQDLKPLSYFLKEAENHQLQTN

SEQ ID NO: 4234 - protein, 134 aa, Lactobacillus buchneri
MDAIRYYSRTGNTEKLANMLGNQLKIEAKSIDTPLTGTVDRLYLGGGIYNLNVDERLKQFARNLDPKQVKEVFLFGTSGSLFTVGKQLTKILDQKHIKVAKDHLYLHGLMPKMGNINQHQQAEIKGFAKETVTE

SEQ ID NO: 4235 - protein, 377 aa, Lactobacillus buchneri
MSRQITGAVIEELNAPFKLETLEVDDQPKAHEVLVHIVASGICHSDEAVRNGSAGDYAYPGVVGHEGAGIVEKVGSSVTTVKEGDHVILSYDYDGTCRHCLTGHPSSCINWGKLNFAGVRPDGSVAFTREDGSPIHNFFNQSSFTTETLVQERNITVIDKDIDLRKVGPLGCGFVTGSGTVFNGLNPKEGTTIAIVGTGAVGSAALMAAKIKGCSKIICVDIHDSRLEMAKELGATDTINSLNEDWVDKVHEITNGEGVDFAIDTTGISAIMHQAITALASGGHLAPIAVTAKTLEFMPWNEITALQKHVDGVLMGDAIPQIGIQTLIDFWQAGEFPFDKLEKFYTFDQVNEANKASNDGSVIKPVMVIDQDYVPGE

SEQ ID NO: 4236 - protein, 414 aa, Lactobacillus buchneri
MIMQQISTKTLNMNVQKDLNFTWSTQAILFCAIIIACIGLNVDSAPVVIGAMLISPLMAPIVGIGYGLGNSNPKLLSKAARLFLIQVTIGIIGATIYFFISPLNTASAQLLARTEPTLWDVLITFFGGFAGVISSAKKDGGNVVPGVAIATALMPPLCTVGYGISHLNASFILGAGYLFLINAFFIALATAAGTIFFRVRSGERLNVSLRQQVLIVIISIIIVIPSSISAYTIVHNSFVDTQLSQFINEKLSNQYIAKQNVDGKNIQISVIGQRLSASQVEQLQHSLKQYHLGDYQLSLTQLTKGNYITPKEFQDYMKQSDTNDTIQTNTNSDDNASLTNVQNDIIKKYPKQISNIFVGQVQDKANHTISLIAIQLSDNGKGKAAEIEKTATKTADNNNVNAVVRMMTSSQQSD

SEQ ID NO: 4237 - protein, 592 aa, Lactobacillus buchneri
LTPEKLLKTKFGYDSFRPGQQTVIDDILAHQNVLTIMPTGGGKSLCYQIPAMLEDGLTLVVSPLIALMKDQVDALNETGIPATFINSSLDFDEIDERFQQARDGEVKLLYVSPERLDSGAFNRLASLPIDLVAVDEAHCISQWGHDFRPSYLALTERLHDLPTKPTIVALTATATPQVADDIKQRLHIKEEVKTGFARDNLAFKVIQNQDSDKYMLDYLKLNAAESGIIYASTRKEVERVTKLLSKHKFSVTMYHGGMTKEQRRKNQDDFLYDRALVMVATNAFGMGIDKSNVRFVIHDSVPGSLEEYYQEAGRAGRDGLPSEAILLFKLKDVQTQHFFIDQSERDEQSKHQAYKKLQIMTQYANTQQCLQQFILNYFGEKDGQPCGRCSNCLDTRESQDITVDTQKVLSCVLRMKERFGKSLVAQVLTGSKVQKVKAFHFNQLSTYGIMKGDSQKNVVSLIDYLTAGGYLMASGGQFPVLKVTAKGAAVLQGETKVTRKISVKATKSVAENDDLFESLRQLRRELAEKQGVPPFVIFSDKTLHEMSAVMPTTDSQMLDVKGVGESKLEKYGEQFMDVILNYQAEPKVGTEV

SEQ ID NO: 4238 - protein, 213 aa, Lactobacillus buchneri
MLTTIMTSILSFIGTNIDDTFVLAVWFSQVDASLRRRDIVIGQFIGFEILVLVSVLAAYGLSFLPTEQVGWLGVVPIVLGIRKWLQYRHQLIETHETAHVKTKLNQELKVERHKSGLRKLFKPEILAVSLITISNGAGNLTVYIPLFTEYTVAELGITVLVFSLMTGLWCYIGYQIANLPIIKDKLERSKQILIPIIFVAIGVYVLIESGVLG

SEQ ID NO: 4239 - protein, 398 aa, Lactobacillus buchneri
LTGDHKVYNKAASLKGAKQLTSSSQLKKLAGSVRSKDTFRVYRMAATRNHRVYYKVVSFEGKYRGWIYGGKAKRDYAGGLERVNTTSEVTLSDQIRQTTYHLKSSGTSSDENVWNDIPWTQYKASLKTKDSTPYAKDDLTVISAKKMTRQYYQTYYYIEDAQHPEFNGWINSNSLEGPATTVTKTVSVPGPTQTVIVPGASTTVTVPAKNSLTINYVTNRYDPSAKTPAVTEGNGQDWPEEPQISKSVQKAYQEKFKSALAEIQNKSEITQADLDALGNGKVFWHEDDAWGDWDVSIRVSYDKLKNVVTINLVWEDVQTTWDKAVNYYLHIGDKFTPWDLIHDFVYEGYFVDTQNYAKFFTVTENTVDTSKAGNYVVKYYMKDYPNNIITVPVTVQSN

SEQ ID NO: 4240 - protein, 481 aa, Lactobacillus buchneri
MADNATSRGKNYSIIAVLGMFSFLTALSGSSTNLAIPKIAIDMDISSSMATWIVQIGLITTAILLVMFGHIGDILSKNVVFLAGGIGFLIGSAITGFAPNFPIILFGRVIQAIGSAMIMANSMGIVTQYFPDKRRAEALAVISMFISVGSISGPGIGGLIISASSWRWIYWINVPLGIVILWLGFKFLPIPKESWAHVRQVTQGANWTGQNLFTLGIIIFFLSGSFFQAGRSKLLTGIIFFAVGGVIALYAFIQDDKANLPWIAPEVIHNRGFMTSITALALVMLVNSVSNILLPFYFQSYNGMSAFYSGLIIMLQSVTMLCTTPFAGYLADRINRELMTVVGLLILMISQVGYAFFPNNLDMWKIIPPIILNGIGMAIFLSPNNALTMGLVDKSLSGIAGSLNSFARTLGMTIGISFGSSLLFFQLPGVKRVTASVGLPFIHAFANVFWTATVISAVALVIVLVRYLGSRRKPAAAKESA

SEQ ID NO: 4241 - protein, 445 aa, Lactobacillus buchneri
MARSRIKPLSFLSVFLLGVDGIVGSGIFLMPSRVYAKVGDLSAGLMMLAGISVLMIALCFANLASKIPGDGGAWLYTYTAFGRFAGFEIGIFTWLLGVITMATEISAFVTSLRSVFPSLNQHGNYLMAALGILAVLTILNLFGPSLMDWVDNISTVAKIGVLVLFVGMGLFFIHPANYANMSAGMSNGSSLFGRINTGFGMVFYMFTGFSFLPIAASKMNHPEKTLPKALISVLLTSATLYMIVQLTAIGVSGSSLANDNVPIAASFYRLAGTVGYDLALVGMLISILGVALSVSFSTPTIASSLASEHQLLPRMLGRQNKRGVPIVSLLLSCGLCALMLFSGNYLFLASAIVFTSFVQYVPTIFAAIKLRNHNKLPQGFRLRGGNLIPIIALLVTAYLIFSFSLELIIAGVLVFLLSAVWYFYDDRDRQVNGLRRDIAEVDKAF

SEQ ID NO: 4242 - protein, 277 aa, Lactobacillus buchneri
MLHRHRKLLITISLLAVIAIVGVIFIKATLSPDKTPTAVTAVKEEVFPNQIFESYKYPYDLRIIHSNTKLYSTPAGTKGSKYLGTVKSNHLTRKIVGQERADLNHRRSEGYISFAQNGHTYWVSAQSVVFRDLNKLKGDDPKIEAAIDAGLKLVGKSKYDYGGGRNLSDIKNRKFDCSSFVRYCFSKAGVTLGNLDSVTTYTLVTMGRPVKFQNMKRGDLFFFTNSRGQVNSHVAIYLGDHLFLHDHGQSDTGGVGISTLNAPGWRNEANGTVRRIE

SEQ ID NO: 4243 - protein, 200 aa, Lactobacillus buchneri
MKTEPIHRTSMWKFKLSAATMTLIPAAVGINYVAKALAEGLKLPVWLGSLGTFLASMLAGPVAGAISGFINNVIYGLTLSPISTVYAITSIGIGIAVGILHANGWFSSARRVFISAIIIAIVSAVISTPLNVIFWGGQTGIAWGDSLFAVMVANHAPVWLASFTDEFVLDILDKVCVAYLAFFIYRQLPQRMVHFFRDDK

SEQ ID NO: 4244 - protein, 264 aa, Lactobacillus buchneri
MMTDQTLISGAPRVKLKWYQVIDPITKLLLILDMTLLSFASTNLLLQAGLILVATLLLLFSKLSSTTFKALGFSLFLIGTMLIIQGLFYSRNQTVLFSVLGVSFYKEGLIYATTLGCRVLVIILTSGFFMVTTSISENAAYLELSGLSYKTVYVLMSVCYILPEMMRNMRKIQQAQKVRGTNPQKTLIQKLKSVLPVLIPLVIKTLDQSMARSISLQLRGFDNPNRTVRTSQRVYRLSRTLHIGLTGLAILLIGWKIWSKINGL

SEQ ID NO: 4245 - protein, 278 aa, Lactobacillus buchneri
MVEDKRIVIENLTTRYPGTEQPQLRQINAEVHTGQVVGIIGNSHSGKSTLCRVLAGVIPKIVSAEIEGDWHMLGRRVSDGWRAYNAMTGVVLQNPAGQLSGLADTVADEIAFDLINQGMAEGLIQKRVVEVATQMGLIEQLNLRPESLSGGQIQRLAIATAIAANPAVLIMDDPTSEMDPLGRRQFFQWLAQVKETNVFIVTSEIDDLCEVGDVVWVLNEGQMVAQGRPGEVFNHLAADWQIPAPTIQQLAQKMDWHLADGRYPVNDAELKEARYVHN

SEQ ID NO: 4246 - protein, 266 aa, Lactobacillus buchneri
MSTIELNHLTFTYPERSFSLDVEDEHFADPMVAIVGQNGAGKSTLFKLLTGLLTPQTGVIKIDGEDFNDLKPVEKLLKVGITFQNPDDQLFNPTVQQEVEWSVAQVMDDHDTITRRALEALKRVGLDDKTAENPYDLSLSERKLLSVATVLAVDPAIYLFDEPMMSLDWESRRKLTAIFHQLADSGHQVVTITHDMDWVAAEFESVYVMEHGKFGFAGSPRDLFSDHELVQRVGLLPPRIMAVAESLGDSRTYLSVNDYWQKNRDI

SEQ ID NO: 4247 - protein, 134 aa, Lactobacillus buchneri
MKKMKWLLLAFASCACLLLLTENPRVDAAGSIPHWYLGNWQAVNGKDVYVGIRRNEVMLQVKNDGVYWKPVTWKKDTQESGVVFGTGMGAKNSKTYFVLVKEKIQKKWYMIMTMKQSKIKPSDLRKHPMIMKRY

SEQ ID NO: 4248 - protein, 253 aa, Lactobacillus buchneri
MLSEFLVVCPLVFLAGFVDAIGGGGGLISLPAYLMVGIPAHFAVGTNKLSSAMGTTVATLEFMRSGYIRVKLAFFSVLAAMVGSSFGANMALHISDYYFRLILLFVLPITALYLLLNRHSLNSRLAEFKPLTWSQFVATILISISLGVWDGFYGPGTGTFLILTLVGIAHLPINLAAGNTKVINLTTNVCALAVFFMNGKVLVWLGLTAGAFSILGNFLGASYYKKYGSAIARPIIIIVLVIFFAKTVWQFLN

SEQ ID NO: 4249 - protein, 535 aa, Lactobacillus buchneri
MDSKNTTKIGLFQLVMLTLGSLIGSGWLFGSWEATKIAGPAAIISWVIGGIVIAAIAYNYVEIGAMFPEAGGMSRYAQYSHGPLLGFIASWANWISLITLIPIEAVAAVQYMSSWPWAWANWTHSFLKDGTITTSGLMVVFMFILVFTLLNFWSVKLLTSFTSLISILKIGVPALTIIMLTISGFYPQNYGHSIHEFMPYGSAPIFAATSAAGIIFSFNAFQTVINMGSEIKKSRKNIGRGIFISLLISGVIYILLQSTYITAIKPSTLAATGWSGFDFNSPFADLAIMLGIRWLSVLLYMDAFVSPVGTGVSFAASTGRALYAMESNQHIPSFIGKINQKYGIPRVAMIVNLVLSMLMVSVFRSWSTLATVISTSTLIAYLTGPVTAVAFRKLAPNFKRPVKLKNLGWMAPLSFVLASLAIYWAMWPTTVEVILVILVGLPFYFYYEYRAGYVDTRKAFYSSMWMIIYLIFISVMSYIGSEQFNGINWIHYPWDFVVIALASLVFYYWGIKTAHVFPDFYQAKELNDTVKLDDD

SEQ ID NO: 4250 - protein, 372 aa, Lactobacillus buchneri
MKISRIALASLISFGVLGGASLNASANHTHYQRILWNKTMAHQKVALKNGKGIIWNKPYKTAKNSKITYRLAHKKGLVMTTLRHMKVKNGSIYYFVKAGKISGWINKKSVKLIKNSAGTKTTIAPNSAPIQSNGTPVPNTPSNTLNTTTSNIPAKNSQNSSSSNVPNSSTTQPTSSNSKTSDSINPITATTKVNSFIYSDNWDGDNPDSNKTNKSLGLLPRGEKVEIIRTDKTKNGTALLVRSKDGVYGYMNQNELNFDSKDIPSYVLNYNSANNVTSVPNVSDKSVSKSDSKETGNVDHSTEATVNQNNLFLYKNSWDHGKTPTDNATKGLIANGTKVYVLNNDKSRDSVLVITNAGETGYINRESLTFNK

SEQ ID NO: 4251 - protein, 188 aa, Lactobacillus buchneri
MPRKLRPNAAVKKVLKIYQQNFMRNQFTAPQNDALHLIFNLGYTVSPDVNESSYGYVKVVNMDTGKSLVLTNLSGNKALLDGGTTIISEPDLDLDTFDYVDYLNSKGDNPDYLAPTVANLKMLRNRLNQLNADFDRLKKLRNDYQEHLTSIDSEYNKKVSSFITIVNQVERMSNKITEEDGKSNDSSK

SEQ ID NO: 4252 - protein, 537 aa, Lactobacillus buchneri
MKVLVIGGIAGGPSFATRLRRINEDAEIIIFERGAAISVASCALPYYLGGLIKDRSAVIERTPEILKQKNNIDVRLFNEVTQINPDDKTVAVNNLQTGDTYTEDYDKLVIATGASPTVPEISGIHDANNAFVLRAVTDADKIKSFIDEKHPKTVTVLGAGSIGIEVSEAFVDNQMDVTIVEQTGHVAAPFDPEITDIVADELKKQGVHVILNESVKEIQDHGHTLILDDGSVHQTDMLFLGTGVKPNSEIAGAAGISLSDDHHIIVDNHLQTNIPDIYAIGDVIETTSLITGKPIPSLLSSAANRQGHLLADMLNGSPLEYKGFISAGVSKFFDLTASFVGFTEQTLQQMGITNYRTVFITPFDRAYFYPNADRVNFKLIYEDKTGKILGGQAVGRNGIDKRIAELSVAITGNLTAFDLPSLEIPYSPPYSSTRDVLNIAGYVAINQLTNQSATIKINDIPDDDLKNAVFLDIREAGKPVTGSIKPTLNIPLSELRERIDEVPKDKKVYITFRKGLGPYNATRVLAGKGINATMIEE

SEQ ID NO: 4253 - protein, 65 aa, Lactobacillus buchneri
MLMSLDKFFVQEMQKNGFDVDFKQLQKIYTSSRKNNAEEIAKRKRIAERERNFMHEAMEQYDVDQ

SEQ ID NO: 4254 - protein, 61 aa, Lactobacillus buchneri
LAGTRQIGYGGLLKQIKQQLKLDDADNGDLVNVDGDKLSEPTEAELIVARWDNQRKNYLIW

SEQ ID NO: 4255 - protein, 227 aa, Lactobacillus buchneri
MEQKQHFSLSNIAPQKLVQTLLTATEQRLISGIVKAGYEAEKKYVSTNAPEWIQIDRAQKLYPELKNMAVEFALRRACDHGVIPFTYKIGTVEQNKNKFLELVSTGDKKVILTVNQTPTDKHASRNAKFRSNLFDQCESKLILFDDEERSTGAIYMELNHGYQTEIPAFTVLGKPNADGKWEARLSLQNNIQLLSKGEEADIQTTAKQMSEFGPDEFNQYKEFKTKG

SEQ ID NO: 4256 - protein, 378 aa, Lactobacillus buchneri
MALVESGRFSQNKLRFLRDLTGESLMQLSNEIGYSTTTISKWEKGNLTPNFKSLIKLSNHFGVNHNFFLTSMEVPDFTGAVFFRKAAVLPKKKVIQAQAKARRFAMVDYLLSKELDLPNFKMPDYAHTSEEFEILSYDDIDNVANKVRNQFSLGDGPISNMTLLVERMGIRVKLEDLDSEKIDAVTGDIKARPYIVLNARRLSSVRLRFNLAHELGHILLHSFYPKSVVRNKSNHRTIESEANHFAGSLLMPDYGIALDMMRTNMSYLIELKKHWKVAIQALIYRGNELGLIPDSQALFLRQTIYRNGWRIKEPLDDEIPLEKPSYMKSAIKFSEATRGNSIDAVSQETGLSLSEVREWGGKLELSQQQTNHPNLHLL

SEQ ID NO: 4257 - protein, 52 aa, Lactobacillus buchneri
MKEHAEFKDGKMYLEYDHGQIIFSDQRTLKIVNDQSMEEFYDLVQFWLVQQA

SEQ ID NO: 4258 - protein, 147 aa, Lactobacillus buchneri
MDARQKVQAVLDSEDSAYQIQKLTGVNSSIIIRLRNHTRLVDNLSLGTVEKLERYFDYHVKHENDDLPHSVQLSHFRHRLINLLQELYQMQQAKAEATNALPDEKAMTVAIEQLFNDVIANKLELEHLETIYSRAFSDSEQLTSPTK

SEQ ID NO: 4259 - protein, 131 aa, Lactobacillus buchneri
MELFRIRFINKIRPDTIEIRYRAVLESHSSDTVFEGHQLFLRSYLDTTILKSGEVALKAIYNIFSATPKDLVLDQVAFEQSHDRSLLQVPTKQFFDQYIIDNGMLDRVVHHQGEDGKPVIDTKLVTELRIG

SEQ ID NO: 4260 - protein, 113 aa, Lactobacillus buchneri
MILSRTKQYLRKNGYFYKKEYIRPLLTPDNIYIFRFGRDRLDNRLIIRYSHKWTGRQRINEIDLRLHKQKHPRIFENESELLNYLEGHLLKHEAKVRAREKEKQHEISDGASK

SEQ ID NO: 4261 - protein, 320 aa, Lactobacillus buchneri
MDWTELSIMTTSEAVEAVANILMAYGATGVSIEDAKDFEKLKPGRYGDHGEIVDPKDLTHIRQGAIVSAYYPNNQHIDDQADQIATRVRGLAKFDLNPGPAEVHLTPVVNQDWQTAWEKYYHPVSISRFITIVPSWEDYQPKSTQEKIVRLDPGMAFGTGTHPTTRLSLQALEMVMQGGESILDVGTGSGVLSIAAKLMGAGEIHAYDVDDIAVESAEKNIQLNPGAKGIRVAANDLLAGIHTQADIVVANILAEIIVPLVPQAWDNLVPGGFFLTSGIIKDKFETVENAMTSQGFQIIETLRMKDWYGVIAQKPKDEDK

SEQ ID NO: 4262 - protein, 246 aa, Lactobacillus buchneri
MQHYFVSQHLTVGQSIELPKTISHHLGRVLRAEVGDRFELVGDDHQVFEAEISRLEGNQVAANIIKPLDHNVELPVAVTIVSGLSKGNKPEWIVQKATELGVAHVIFLPMDWSIVKWDQKATKKITRLNEVALSAAEQSHRNVVPTVAYLSGLDALFQLDFDTQLVAYEESAKQGEETNLVKAVKQTPSGGTMAAVFGPEGGVSPAEVTQLVDHDFVLAGLGPRIMRTETAPLYFLSAVSTLTELI

SEQ ID NO: 4263 - protein, 742 aa, Lactobacillus buchneri
MATKIWTPDDVINKVSEYMNKEHVDEIRKAYQFAKIAHQYQKRQSGEPYITHPTQVAGILADLHMDPETVSAGFLHDVVEDTGATLGDIQELFGHDIALIVDGVTKLSKIKYKSSEERLAENHRKLLLAMCKDIRVMIVKLADRLHNMRTLKSLRPDKQRRIASETLEIYAPIADRLGIGTIKWELEDISLRYLNPQQYYRIVHLMNSRRDQRVDYIEKAIKEVKKAISALGVKAEIYGRPKHIYSVYRKMVEKHKQFSQIYDLLAIRVIVDSIKDCYAVLGAIHSEWKPMPGRFKDYIAMPKANMYQSLHTTVIGPEGKPLEVQIRTEEMHRVAEFGIAAHWAYKEGITNGVKTSQDNNKLNWFKQIIELQEDTDDAADFMDSVKGELFGDHVYVFTPKGDVYELPKGAGPLDMAYMIHTEVGNHTTGARVNGKIVPLDHQVKNGDIVDIITATGSAGPSRDWLKLVHTRRARNKIKQYFRQEDREKNIEDGKNLISRRLREAGFEPNRIMVPDKLTKAAVNMHYQHADDLLAAVGFGDLQPTGVVNRLTEDARAQLKKERQDQAEREVLEGHQTISEDSDSAKKQKKRKSSNGIVIEGVDNLLVRLSHCCTPVPGDEIVGYITKGRGVSIHRVDCPNIKTAEENGERLIEVAWADNPEERTIYDASLAVQGYNRAGLLTNVLTAVNSVTKNVSSVNGQVDNNKMATISLSVGVRNLEQLERLIGAIKNVHDVYLVERKFR

SEQ ID NO: 4264 - protein, 148 aa, Lactobacillus buchneri
MKVVLQRVKEASVSIDGQIHGKIGRGFVLLVGVSDADGEAEVDYLTHKISKLRVFEDDAGKLNLDINAVNGAILSISQFTLYADTKKGNRPSFTKAGEPQHADRVYEQLNERLRQTGLEVQTGVFGADMLVNIQNDGPVTIIFDTDNK

SEQ ID NO: 4265 - protein, 213 aa, Lactobacillus buchneri
MINQLFWDFDGTLFDTYPKMVSAFVQALGDLGIDDVEIDQDQIYVTMRQHDVGTAIRKFSAFYGIDEKQLRKLNRTHQTKLVEDALPFPGVKEVLELAKSMKGRNFLLTHRDDQAKSMLRKFDLLDDFSGFVTSDQNFPRKPQPDSINWLIETNQVDRKKAIMIGDRKLDVAAGHNANIASCLFDPDGTIVDSGNPEIRVTEINELVPWLTNK

SEQ ID NO: 4266 - protein, 280 aa, Lactobacillus buchneri
VKKIWENKSWIVATLTIIITFLVLIVSLESNSVTVKVNQLNIRSGPDVTYSVKAKVQHGQRLQVISRKSNWIKVIYKHRTIGWVASWLVQNSNVQNVSSLSEATIVLDPGHGGSDTGALSMTGQPEKRYTLEVAKRVERLLQARGARVVMTRSSDKTVPLAARPEIANSSSANLFVSFHFDSSDENNVASGYTCYFYHSGDSKHLAESVNQQMKNLPLSSRGVEFGNFLVIRDNSVPAILIEGGYINTKKDFNQIQKPAYQKKLAKDVVDGIANYFKNNH

SEQ ID NO: 4267 - protein, 435 aa, Lactobacillus buchneri
MRYQRPKGTADILPGEAQKWNYVEETARMLFDDYRYQEIRTPMFENFDVFSRTSGDTSDVVTKEMYDFNDKGDRHMSLRPEGTAGVVRAFVENKLYGPEHPRPVKVFYMGSMFRYERPQSGRQREFHQIGVEAFGSNEPELDVEVIAMGMDLLKHFGLSGLRLEINSLGDKASRDAYRQALIDYLDPHFDELSDDSKVRLHKNPLRVLDSKDKRDQEIVKGAPSILDYLNEDSQKHFDKVKHLLESLNIPYVVDPDMVRGLDYYNHTIFEIMVDSKALGEGYTTICAGGRYNGLVEQLGGPEMPGIGFGLGMERLMLLMEAQGVKFPVLDQLDAYVVGIGEQTSVLTLQIVQALRADGFAADRDYLDRKPKAQFKTANKLNAQYTITIGESELEKKTANVKQMRTGTEVSVPLAEIFKDFDEIITKYFTDDEEID

SEQ ID NO: 4268 - protein, 595 aa, Lactobacillus buchneri
MKRTTYAGLVDEQLIGQEVVLKGWVQKRRDLGGLIFIELRDREGIVQLVFSEEFGQDALAVADKLRSEYVVEAKGKVVARDPKEINPKMKTGKIEVDITDAKILATAKTPPFYIQDGINVSEDLKLKYRYLDLRRPEMQKNILLRNRIIQSIHSYFDQNDFIDIETPTLTKSTPEGARDYLVPSRVYPGSFYALPQSPQQFKQLLMGAGFDKYYQIARCYRDEDLRGDRQPEFTQIDMEMSFADQEEIEDVTEGFIAKVMKDAMGIDVQLPFKRMDWDESMARYGTDQPDVRFGMELKDLSDIMKDVDFKVFSGAVKDGGQVKAIAVPGGAEKYSRKDLDKFADYVERFGAKGLAWLKVTDDGFNGPIAKFFKDADLREKILAKAEAKPGDLLLFAADNSRVVANTLAYLRVEIAKEQNMIDESKFAFLWIVNWPLFDWDVDLKRYVAAHHPFTMPNEDDVHYLMNEGEDPHKAYAQSYDIILNGLELGGGSIRIHTRALQEKMFEALGFTKESAEAQFGYFLNALDYGFPPHGGLAIGLDRFVRLLADRDNIRDVIAFPKNSKAVEPLTSAPQPVATKQLEDLGLFVAKPDGEK

SEQ ID NO: 4269 - protein, 291 aa, Lactobacillus buchneri
MDDVSKLMRRHTYVTKISTSFIYAILVSIAVNFFWTPGHIYSSGITGFAQLLNTISTRAFPFEISTGLALFLLNLPLFVLSWRAIGHEFTIFTIITVFLSSFMIQLLKPIPLTHDPIICAIFGGAVNGFGTGLALRNGISTGGLDILGIVIRHRTGNSIGTINIAFNSLIIVSAAVMYGWPYAFYSVLSLIVNARIMDMTYTRQQRMQVMIITTRPNTVIDSVQNHLRRGITIVHNAEGAYQHDAKTILFTVISRYEMGELEEALLESDPNAFASISDSVKILGRFYEPKP

SEQ ID NO: 4270 - protein, 383 aa, Lactobacillus buchneri
LKVVYLWLIKLFSVLNIWRPKNKVVYVMSFDDNVDFIKQLAQRLPQKYVLYVLYRANTEAAATDLAAFGIKTRQFRDGIKFVMDDVSLLMSAKLIICDNYYAFLGGLVKLPFVKIVQIWHADGAIKKFGWEDPTTDKRSRSDKRRFQKVYDHFDEYIVASKAMGQVFVHSYHENFDKMQLLGYPRSDQYLSQDWQHKARERIYRSVPELKNHRVILYAPTYREHQDFKLPKGLGSALAADPTALVVVKLHPVLRDKEVPMRRIGNPKIKFYHELETSDLLAVADTLVTDYSSVAFDFSLLPNAKSIIFFMFDLDRYRSDPGIQDDFLDWLPVEPVYKVEQLRNEILAGTSVNFDKFNAHWNTYNDGQATDRVIARYVKFLGSN

SEQ ID NO: 4271 - protein, 269 aa, Lactobacillus buchneri
LKEVSTLIKEQFQNIGIIFRISKYEDKAEYQSHYLGLIWEYLYPLIQIGIYWLVFGIGLKHGNSTHGVDYLVWMVIGITPWFFMNRASLDASKSIYQRVGMVSKMKFPVSILPTIKIVSNLSAFWTMLVFSIVIGFLYGVTPSIYWIQWIYYFICMIAWLIAFGIFNSTISVLVRDYRILLQSLMRMLFYMSGVLFNFQTDAFPAPFVHILQLNPFFYVVSGFRDGMLGSAWFWQKPTLTIVFWGMILFFLLVGSHLHYKFRSRFVDLI

SEQ ID NO: 4272 - protein, 406 aa, Lactobacillus buchneri
LKRSMINLIKLIARIVLIVMNDGFICMPVKKGTVLFESFNGKDVSDNPFAIYNQLTQDDPTARKRCYFSVKPSEYGRLVKQYPNIQFVKRFTPGWVKYIARADYWVMNSRMPKWWRKNKRTTFIQTWHGTPLKKLGIDIENVEIPGSQTAEYHQEFIDEAARWDYLIAPNQYSHDIFKSAFGYSGKFLDIGYPRNDILYTENNADDIRKIKQTLVGYQPKQVMMYAPTWRDDDFSEKGKYQFTLPFDLAQFFENVDPQTLLVIRPHYLVKDNIDISGFEDRVKILADVDINQLYLITDLLITDYSSVMFDFANLKRPMLFYPYDLAHYRDQLRGFYFQYDQANLPGPMVENQTDFYQKLSEYRQTGAFTDFSDNLTRFNQKFCAWEDGQASKKVSQLILQGGYTNE

SEQ ID NO: 4273 - protein, 306 aa, Lactobacillus buchneri
MSETPFLIGSHVSMNGKDMFLGSAKEAASYGETVFMVYTGAPQNTVRKPIEKLNADAGKQYMSDHGLKAVVVHAPYIINLGNTFKPENFSFGVDFLRQEIQRAQAIGAKEIVLHPGAHVGAGPQKAIDQIAKGLNEVIEENQHVQIALETMAGKGTEVGTSFEQLAEIIDKVSDNDKLSVTFDTCHTSDAGYDIKNDFDGVLNQFDHIIGLDRLKVIHLNDSKNPQGSHKDRHQILGLGTIGFDTLNYIAHHAQLKSVPKIMETPILKDPDNKNVKWNPHGYEVAMLKKQQFNPNIIEDMKARKPY

SEQ ID NO: 4274 - protein, 273 aa, Lactobacillus buchneri
MKTQNIFIISDSSGATAQTIAQTALSQFPDVKAEIRRFPFIQTDSILKGILKIALNKQAMIFHTLVSTELSQMVQDFCRQNGIYDFDCVQTPMAMLSQVTGQQPAHVPGLIHDLNQNYFERISAIEFAVENDDGKNPKGLLEADIVLLGVSRTSKTPLSLYLANQNQRVANLPIGPDLQLPEEVNDIDKDKMFGLLNTPEKLSKIRKQRMISYGLDADTPYSDPAHIKTELAYAKKLYRQIGCLTINVANKSIEETATIILESLNLNTTEFED

SEQ ID NO: 4275 - protein, 63 aa, Lactobacillus buchneri
MAKTVVRKNESLDDALRRFKRTVSKSGTLQEYRKREFYEKPSVKRKLKSEAARKRNNKKKRRF

SEQ ID NO: 4276 - protein, 149 aa, Lactobacillus buchneri
MSVYDKLLSDMKDAMKARDKVRLGVIRGIKAQVMNAKVADGNHDLTEDQINDIIMKEIKQQKESLEEFQKADRKDLAEEQEAKLKIAEEYAPKQLSEAEVEKIVQETISQVGAESMADFGKVMGAIMPKVKGQADGSVINKLVKQQLQS

SEQ ID NO: 4277 - protein, 321 aa, Lactobacillus buchneri
LADTQQVTREFIVSDPNELLQIVGTQDEFITIIEEGMDVSINVFGNSLRVTGQDEPVSITLHILENILSLIQKGININSSDFISAMNMAQNGTLEYFKDLYNEVLIKDAKGKVVRVKTFGQRQYIQAIKHHDVAFGIGPAGTGKTYLAVVMAIAALKKGTVDKIVLTRPAVEAGESLGFLPGDLKEKVDPYLRPIYDALHAILGAEHTERLMDRGTIEIAPLAYMRGRTLDNAFVILDEAQNTTNMQMKMFLTRLGFGSKMIVNGDISQIDLPKHSTSGLITAQKILKDIDQIEFVTFTAKDVVRHPVVAKIITAYEKSGN

SEQ ID NO: 4278 - protein, 161 aa, Lactobacillus buchneri
MDLEIYDKTEKGVSEKDQKLIRDVLEFAGSYIHLADNTEMSVTLVNNDEIHQINKKYRGVDRATDVISFAIEDDDDDDDFPIVMDEELKESIPENIGDIFVSVDKVAEQADYLGHSFERELGFLCVHGFLHLNGYDHMKKADADVMFPLQKEILNAYGLKR

SEQ ID NO: 4279 - protein, 135 aa, Lactobacillus buchneri
MLMDSKDNRKPQLDKNKSFLQSVGHALEGIKRLLLEERNFRIDLVVAIIVLTFAIVMKISINEWLWLFAAFFSVIGSEVLNTVVENVVDLIVGHHFDALAKRAKDVAAGGVLLSALFAVIIGMLIFVPRFIALLN

SEQ ID NO: 4280 - protein, 300 aa, Lactobacillus buchneri
MDNPDFHSGFIAIVGRPNVGKSTFLNRVIGQKIAIMSDKPQTTRNKIQGVYTTKEAQIVFIDTPGIHKPQNKLGDFMMESALSALKEVDAVLFMVNATEHRGAGDNFIIDQLKNVDKPIYLLINKIDEISPDDIMPIIEQYKNALEFKDVYPISALQGNNVPELIDTLIKELPNGPQYYPADEVTDHPERFVISELIREKVLELTRQEIPHSTAVVIESIKTEDSLLRIRATIIVERDGQKGIVIGKGGSMLKKIGTLARKDIENMMGNKVFLELWVKVEPHWRDKANLLNSYGYRKDNY

SEQ ID NO: 4281 - protein, 253 aa, Lactobacillus buchneri
LSKGQRTDFNGILLYTKAYREHDLLIKFLTREFGKKMFLVRGAKRPRFKMRSAILPFTYGLYGGDIKESGLSYILNDKHLVHFQNISEDITKNAYATYIMSLIDLAYPDGEPIATWYDKLLTGLQLIDQGFDEQIITNIFEVQLLNAYGVAPNWVDCTICHRTDLPFDYSEAYGGLLCQNHWNKDPYRMHLDARTIYYLRLFSVVDLSKLTHIKVNDRTKKALREVLDQIYSRSVGVVPKSKHFIDQLGKFKL

SEQ ID NO: 4282 - protein, 308 aa, Lactobacillus buchneri
MTEKLSVQEIILRLQQYWSAQGCMLMQAYDTEKGAGTMSPYTFLRAIGPEPWNAAYVEPSRRPADGRYGENPNRLYQHHQFQVIMKPSPENIQELYLNSLKELGINPLEHDIRFVEDNWENPSMGCAGVGWEVWLDGMEITQFTYFQIVGGLEMDPVASEITYGLERLSSYVQDVNSVFDLNWSDDVKYGDIFKEPEYEHSKYSFEVSDQEMLLTLFNDYEREAKRLLDQDLVHPAYDYILKCSHTFNLLDARGAVSVTERAGYLSRIRNLARSVAKEFVEARKRLGFPLIKDEKKRQALLKDDKEEK

SEQ ID NO: 4283 - protein, 693 aa, Lactobacillus buchneri
MANNFLLEIGLEEIPAHVVTPSIQQLKKRAGDFLKDQRISFAEIKTFSTPRRLALYITDLADKQPDIDKSVKGPAKKIAQDSDGNWTKAAIGFSRGQGATPDDITFKDVKGVEYVFVEKHIAGKSLKEILPGMKDVITAMTFPTMMKWGTYSFEYVRPIKWLVALLNDKVIPFKILDVDTDRMTSGHRFLGKDIELANADEYEEKLTEQYVVTDAAKRKELITKQIIKIAADNNWQINLDPDLLEEVNNLVEWPTAFFGNFDEKYLAIPDEVLITSMKDHQRFFYVTDQDGKLLPHFISVRNGNDYDIQNVVAGNEKVLTARLDDAMFFYQEDQKKSIADYVERLKKVSFHDKISTMYEKMQRVQVISKYLGNLAGLSEQELKDLERAASIYKFDLVTGMVGEFAELQGVMGDKYALLKGEDQAVATAISEHYMPISANGELPKTNVGSILAIADKLDSILTFFAAGMIPSGSNDPYALRRQATGVVRIVADKQLNFDLEQTLNLLIDREDQASVAPKLDMKAQVPAVSDFVKDRIKQYLDDLGVRYDIADAVTSGSHTNILFNIASAKTLQDHKDDTDFKDIIESLTRVQRIAKKGAFKADDLTVDPALFENDSEKALNQAVAAAAKDYTHQSAEEDFGRLAQLKDKINDYFDATMVMAKDEKLKNNHLRQLTMIANMIMYLGDLDKLVVKG

SEQ ID NO: 4284 - protein, 608 aa, Lactobacillus buchneri
MAKIPEDVIEEIRSQVNIVDVVSQFVQLKQSGKNLFGLCPFHEERTPSFSVSEDKQIFHCFSCGRGGNVFKFIMELQNVSFPEAVKKVAEMENISVDEKYFRESGNSQSSPENTQQKALIDLHEQSVKLYHHILTNTKMGQPALDYLHKRGVTDQTIATYQLGYAPAQRLLKPFFDERKVDFQLLRKSGLFSEDQDGNLRDRFVDRVMYPIRNGSGQTIAFSGRLLTTDSDMPKYLNSPETDIFNKRKVLFNLDLARSNIRTGEPAILFEGFMDVITAFQAGIKSGIASMGTSLTEQQIYDIKRITREVVISYDGDTPGQKAIKRAIDSFNEQKSNLVMKIISIPDGMDPDEFIRKKGADDFKQLIDHAQAPVEFELNYLKKQYNLDSEIDQTNYIAEALKLISRVDSGISRDLYLNRLADEFSVAKQLLQQQLAPLIRQPAPAAEPHPYHKQVQVVKQQKHFSLVEKAEMQLMNRMLHYHDIWLKVSNVSGFSFVDEQYQMLYLLAEGYFTKFDDYNVATFSNLISEDSLQSLLVDIDMLELPDNPTNAEIDSYLNILMHRAPVEEKLKKKRAELKQAVKIGDVDKQRALTIEIVKLEQQKRMKQQV

SEQ ID NO: 4285 - protein, 414 aa, Lactobacillus buchneri
MATKKTDDKVTETKTATAKKATAAKKTTASKTSTKAKSTKAKTTKAKTTKKADKPYKKEFDAIVKANKPIGHITYDELEKKIEKPYSLSEKDMEGLLESIEDSGISVVDENGDPDPRAIGAAKKVTKKELSDVSAPTGVKINDPVRMYLKEIGRVSLLSADQEISLAKRIEAGDEEAKQELAEANLRLVVSIAKRYVGRGMQFLDLIQEGNMGLMKAVEKFDYRKGFKFSTYATWWIRQAITRAIADQARTIRIPVHMVETINKLIRIQRQLLQDLGREPLPEEIGAEMDMPTEKVREILKIAQEPVSLETPIGEEDDSHLGDFIEDQDATSPADHAAYELLKEQLESVLDTLTDREENVLRLRFGLDDGRTRTLEEVGKVFGVTRERIRQIEAKALRKLRHPSRSKQLKDFLD

SEQ ID NO: 4286 - protein, 234 aa, Lactobacillus buchneri
MNSTHLSKRLQTVSDHVEPGSRLADIGSDHAYLPIHLAQNHVIDYGVVGEVAKGPLANATSEITKDHLLDILHPRLADGLAAIEPGDDIDAITIAGMGGNLITHILEAGKAKLTGKEKLILQPNVGEPVVRNWLMANQYRIFAEQILKEDGHIYEIITAKKADKPVAYSKLALQFGPFLLQEKSPVFVEKWQEEIGLLKRVIKNMRQATTPDTAKMTAIQSEINLINEVIKVES

SEQ ID NO: 4287 - protein, 371 aa, Lactobacillus buchneri
LKAKQLIERFEQFAPKKLAMEKDPVGLQIGSLNQEIHKVMTTLDVRPEVVDEAIANHVDFIFAHHPVMFHPAHNLDLDDPQNAMYAKIIANHITVYAAHTNLDAADGGMNDWLAEALQLTNLSGMVPAYDESVFRLTVQVPKVYATAVRMSLVDAGAQASAAQYSGYTYEIDGTVYYVPKAGADPTMGTAGEPNEIEDSRLEFEVPERNLHQVLKTLSDVHPLEKPLYNLIRLEDKKHHFTMGRIGDLPHSMSVRELAEDCKQTFGVSGLRVIAHDMAQPIKRVAILGGDGGKFFHLAQQKGADAYVTGDVYYHTGHDMLAADFPVVDPGHHIESICIPKLAELFKQWSDQYHWQLAIYQSTINTDPFTFM

SEQ ID NO: 4288 - protein, 412 aa, Lactobacillus buchneri
MAKYAELIPNFLTFVKINTRSDPQSTSIPSSDRETRFLNQLKDRLTKMGLKDVHTNEQSAYVFATLPGNVDKSVPTVGFISHIDTADFNAENIQPQIVENYDGHSVIKLDEKGEYTLDPKVFPSLKKYAGQTLITTDGSTLLGADDKAGVAEIIAAITYLQAHPEVKHGDIKIAFGPDEEIGTGADHFDVKDFGADVAYTVDGGPLGDLNYETFNAADAKVVIKGTDVHPAEAKGIMVNAIQVGMDFHAALPDFDRPEKTQDREGFFHLYDFQGTVDHTEMGYIIRDHDRDRFEARKRLFKGIANQMNSDFGEDRVKVTIKDQYYNMGEIIKKDPTPVKIAEQAMKNVDVTPHVFPVRGGTDGSKISYMGLPTPNIFAGGENMHGRFEYVSEQTMEKAVDVVLEIAKLYAEK

SEQ ID NO: 4289 - protein, 870 aa, Lactobacillus buchneri
MNPDNLTEAVTQAISQAQQIAATRKQQNITVAHLFKFLVQPGELAREIYSQLGLNLGDLNDELDAEIDAIATVEGSNINYGQSLSSNLYELLQNAEQIKNEFGDTYIAVDTLTIAVMQLHGDKFADYLSQQGITEQKVRNVVEKIRGGQKVTTKNQEDSYQSLEKYGTDLVQAARDNKLGPIIGRDEEILDVIRILSRKTKNNPVLIGAPGVGKTAVVEGLAMRIASNDVPENLKNKTIFQLDMGSLIAGAKYRGEFEERLQAVLKEVKKAEGQIIMFIDEIHNIVGAGKAEGSMDAGNILKPMLARGELHLIGATTIDEYRKYMEKDKALERRFQRVMVHEPSVEDTVTILRGLSESLEIHHGVRIHDNALVAAAKLSDRYITDRYLPDKAIDLVDEASAEIRVEMNSSPTELDQSKRQMMRLEVEEAALKQETDEASKKRLKEVEEELANIKEKVNQLNARWSQEKEAIKKISDKKKQLDQAKNELKQAENTYDLNQAAVLQHGTIPQLEADLKKLEDNDQHSDWLVSESVTANEIAAVVSRETGIPVTKLVEGERKKLLHLADNLHKRVIGQDAAVTAVSDAVIRSRAGLQDPSKPLGSFLFLGPTGVGKTELAKALAEDLFDSENHMVRIDMSEYMEKESVSRLVGAAPGYVGYEEGGQLTEAVRRNPYTIVLFDEIEKAHPDVFNILLQVLDDGRLTDSQGRTIDFKNTILIMTSNLGSDILLEGTDENGVISQKAQQQVNQLLKASFKPEFLNRIDDVITFTPLTKADIEQIVQKLINQLSGRTKAQDIKLSISDEAKRWIANNGYEPQYGARPLQRYVTNVVETPLARMIVADQIKPHSVVHINLDNDQLSFVPEQLPADEQI

SEQ ID NO: 4290 - protein, 293 aa, Lactobacillus buchneri
VPINYQLPTENQTQLAVAYFPADHPKGIVQLIHGALEHKERYYEFCRFLSDHGYVAVISDNRGHGQSVSDDDPWGMMRSLPQLIHDQLLVTQSIKARYPNLPVSLFGHSFGSILARLYLQHHDQEVNAVALTGTTNYIPVVPLGLFIGWVFLKCHSEDAKWSLLSKISGLTPGDHSWLSYNQANIHRVSTDPLMMDEYPVKSLVTLWQGDYSLKRLQKFDCHNPQLPILSLVGSEDKFSGGQKGLADTVATLHEIGYRNVVSLQEPHMKHEVLQETHREVVFERLLQFFDTHQ

SEQ ID NO: 4291 - protein, 68 aa, Lactobacillus buchneri
MKLISSNIVAVLWAYIFGEIIGYIGSALEVRTWDPSQIGIAAAITAFIAVNGIYLISKDSATSSKSKE

SEQ ID NO: 4292 - protein, 1115 aa, Lactobacillus buchneri
VSYVPLQVISSYSLLQSPIRIADLIAEAKDRGYQALALTDLNVMYGAVEFYDACLKAGVKPLIGLTLQLTGLILTDKEYGWVLIAKNQQGYANLLKLSTLKMTIPELTASQLGDYLSDLVLILPPAAEMNDLLLQGRADDAADLIDQVKSLGVDPNALKIGVDYHSSDSLNDMLSKLAADKQVALVADSPVEYLNATDYFSMQVLKNIGAGEKIANVAQLSKQVGPYWLRPATQIEAQYRQIHLADALTQVDQIVADCNVEIKKQQPKLPQFDTPNGIDSGTYLRQLCETGLADRLKKNQIKDATPYHRRLDQELSVIHSMGFDNYFLIVWDVINFAHQTHIITGPGRGSAAGSLVAYTLTITDVDPIKYDLLFERFLNPERVQMPDIDLDIPDDKRDEVIQYVHQKYGHKRVAQIITFGTLAAKQSIRDVGRVFGLNTAQQDQWSKAIPNAFHVTLKDALANSQRLKNLVADSPLNEALYQTAQTLEGLPRHYSTHAAGLVLSDDPLVNLVPLQNGNEGLLMTQYSKDYVESVGLLKMDFLGLRNLSILADALQQVQLTTGKVLDISAVPLDDAKTIQLFANGDTTGIFQFESNGIRNVLRRLHPERFEDIALVNALYRPGPMQNIDEVVKRKTNHEALTYPDDSLKDILQPTYGVIVYQEQVMLVASKMAGFSLGQADILRRAMSKKKLGVMEQMKAQFITGAKQRGYSDSVANKVFDYIERFANYGFNKSHAVAYSKMAYELAYLKVYYPGEFHVALLNSVNNNSVKVKEYLQAAKSMGVKVVGPNINHSEARFTFQDQQIVFGLDSIKGVRHDMVVDLLAERQQNGPFKSFPDFLSRLPGKYRKVELINALIYAGALDVFPFNRSELIAAAPEFISSVELSGNSMSLFKALEPKMPKMPEMPLMDKLEKENAYLGAYLSGHPTERFAPLEQRLNAETTATLSAGMKNIYLILYITKVKIIRTKTGKQMAFLDGNDQVGQTSVTVFPNLFAKTQSWLHKDLVILIKGNVEKVNDLQVVANDIQPAANALMNLKRSKQQSKWYLRIDRDHDKNTMFHKLADLSSQYHGQVPVIVFETETKKTWQLEDKLWLNPSSETKEQLITIFGRNNVVYK

SEQ ID NO: 4293 - protein, 585 aa, Lactobacillus buchneri
MKKTKIVSTLGPASTDVDTITKLIEAGANVFRFNFSHGDHPEHLDRMNKVHEAEKKTGKTVGIMLDTKGAEIRTTVQKDGKIEFHTGDVFRISMDASLEGTKDKIAVTYPGLFDDVHEGGHVLFDDGLLDTVVTKKDDANKELVVTVQNDSTLGSRKGVNAPGVSINLPGITEKDSDDIRFGLDNDIDFISASFVRKAQDVLDIRELLEEKHMEHVQIFPKIESQEGINNFDDIIKVSDGLMVARGDMGVEIPAENVPLVQKTLIKKCNQLGKPVITATQMLDSMQENPRPTRAEASDVANAVFDGTDATMLSGESANGDYPVESVQTMARIDVKAENAFSEFGTPRPEFDSSDVTESIGDSVARVAKELGVHCIVAATRSGYTARMISKYHPDADILAITFDERTRRGLMVNWGVHPILVDEVKSTDEIFELASKKALETGLAKEGDLIIVTAGVPVGESGTTNLMRIQLIGSKLVQGQGVGDKTVIGKAVVAKNAADAKSKVTEGSILVTKSTDKEYLPAIEKASAVVVETGGLTSHAAVVGISMGIPVVVGAADATSKISDGELITVDSHRGVIYHGASSSI

SEQ ID NO: 4294 - protein, 286 aa, Lactobacillus buchneri
MNNIIAQVVTGKVIDENDKDYYVQIEGETFLLDKTELKKPLRIGASFTGFTYENEQHKMQITRNIPDIRRDHYGFATVVKEKFGLGVFVDIGLPNKDVVVSIDELPTVRSLWPQDGDQLLIDLTVDNKNRIWGHLADEEIFAAIAKPAKDDLQNKNLKARAYRLKISGTRLLTEDYNLAFLHPDERLMEPRLGQEVEARVIGMLRDGSVNISTKPRAYQEIGEDAQMILAAIEHTDDKQLAFSDKSTPDSIKDYFGISKGAFKRALGHLLKENLIEQADGHISLKK

SEQ ID NO: 4295 - protein, 296 aa, Lactobacillus buchneri
MMHEQIEDYLHYLRVERGLSDNTIKSYRQDLQEAGAFFDKHAKSIADIDQFVILDYLETLQRQHKARNTVIRVVSTLRRFFQYLVQFHVIVDDPMLKVDSPKKAQTLPDVLTVAQVNQLLSMPDTHKKLGLRDRAILETLYATGLRVSELVNLKLGDLHLPMNLLQTIGKGDKERIIPISDVAIDWLNQYIQSTRVQLLSGRPNSEFLFLNAHGHQLTRQAIWQMIKKYVNQAGIKRHVTPHTLRHSFATHLLENGADLRIVQELLGHSDISTTQIYTHVSHKHLTEVYNKYHPRA

SEQ ID NO: 4296 - protein, 120 aa, Lactobacillus buchneri
MLYQYRKDYEKITMGLFSLVSELQNMDLVAQEMSWYAAKDDRLIYLWRDPSNNWSGLVGIELQGNQLLVHQLVLTPQSVSQGNYNRIFDDLQDLYPKYQIVVGFENRAAWEKWENAINHA

SEQ ID NO: 4297 - protein, 253 aa, Lactobacillus buchneri
MRLIMPEVKQPELHLNDFDGPLEVLLHLIQESKMDIYDIQISRITEQYMQYIYDAQQLNLEIVGEYFVMAAKLMVIKSKMLLPTITDDQPDEQQADPREELVSQLLNYKRYKLVAASMKKREMKRRESFTRSELSVAPTKAELIQPSPFNSGDIMASYVDALKHFKYNQPMSTVIHEWSFTIEGQSQRVRELLNQTDNRISFDKLVANSTQTEEVVTDFLAILEMAKYNEVRLNQATVQSTIEIRKGPGYVDQ

SEQ ID NO: 4298 - protein, 193 aa, Lactobacillus buchneri
LISNLAKIEALLYASGDQGITLRQMSQRTALTVAACRQLLEKIVQKYSQDQDSGLKVFVSDNVYRLGTKEELSELVGDYVNDAKPRVLSEAALETISIIMYNQPITRIEIDQIRGVNSSAILHRLVNQDLIEVTGVKEEVGNPKQYGITNFGLDYFGLKSLKDLPPLPKDEVLDDDTSDSLLTRFNKEIDKEN

SEQ ID NO: 4299 - protein, 242 aa, Lactobacillus buchneri
MNEERLQKVIAHAGVASRRKAEELIAKGHVKVNGEVVKELGTKVTPNDEVKVDEVPISKEAPVYYLLYKPRGVITAVTDDKHRKTVVDILEEVPERIYPVGRLDYDTSGLLLLTNDGDLDNKLTHPKYEVEKTYVAKVKGIVTNDDLKHLRTGVVIEHRKTAKAKTKLIRTNKDSSIVQLTIHEGRNHQVKNMFEKIGHPVEKLSRETYCFLTLKGLQPGDYRPLKPHEVEELKELTGKTNR

SEQ ID NO: 4300 - protein, 194 aa, Lactobacillus buchneri
MENSGKHTQFATTRLVEMSVFAGLSYVLMFLSVPIIPIVPYMRLDLADMPILLGTVLFGPVGGMTIAGLKALLYWVTTGADVINFIGVGSSLVSSLVLIWAYYLADRLFSFTKGWKKAGLVILTMAIALTIIMSLTNWLGVIPLYMNLIGMKLGFPLATVILSGVVPFNFIKGIVVGGVFYLIKNSFLPRLKLR

SEQ ID NO: 4301 - protein, 352 aa, Lactobacillus buchneri
MDLGILMLIFGSDRQFRRVKAIKNTLRGRRTVSNLYWALEYGMLDFIDVLHGADFGEDQPVLTQLSANGLAQADDDFRIQLTAKGVEQQRAYLNQLLPLKHLAVSSRYDVAKFMRRFSFATQIVSEFSYGNNQYYPQSINYFEDQLLKRWFIDHKQDHLPEHFRQLLNSFLSDLHQDELADLFVQSLVGHDFSGLTAEQVAVKRHVPTTIIELQWLQLYGMPLEKVMRAGKTSLFAPLTAGLAKPIISNSAQTTFKMFVRQADRNPHAIATQRHIKLTTVYEHLLEAAILTPVAKFPYRTLISEDLMNQLAAHQPTNVGEWSFQDASQVVNQLAFFQFRLFQIYRSKTTDGH

SEQ ID NO: 4302 - protein, 485 aa, Lactobacillus buchneri
MVIDLKRELKKYFGFDTFRPGQEKILQNLLAHQDTLAILPTGGGKTLLYQMYGAITRQRVMIVSPLISLMQDQVSRLQFLGSKRVVALTSALDFQEKMAILNHLNRYQFIYVSPEMLANDQVQQRLKRLSIGLFVVDEAHCISEWGPDFRPDYLKLGTVREMLGRPLTLMMTATATQPVRRDIIRHMNFRFEDVHQIVLPVNRANIFLSAKIFANQHDKDAALIELVKQLNGPGIIYFSSKSKAEQAANTLTNETNRRVMAYHGGMDSQPRFHIQQQFLAGNLDIVCATSAFGMGIDKDNIRFVIHYHLPANIQSYVQEIGRCGRDQQPGLAILMYEPNDRGLQMGLIDHTIPDESLLRYLYQHPKALATDDQFRVVKYYHDSGDSFEQAKSIFDPARTRRVKELGAMVQYVYTEKCRRDELLKYFDETVPDGERNPAFCCDHDVDFWNRWQDFNRQYLIQPEKSGQNETKGWQQVIDQLFLSKN

SEQ ID NO: 4303 - protein, 209 aa, Lactobacillus buchneri
MNSNDEHKKTDEDQPWNQTFSEDRDENGNLSRVKLRKQSQNHHLITMVLAALIIIVAVVALVYGLVRQSAMGNDSKSAASSSVRVVRQDNAKKKSSSAAKAKSNSTKAKPAVKKEQPKSASKAASTQPKASSSTSSASTVQSSNAQSASSSSTTNKTTAASGHQYATVKAGQGMFRVAYNNGLTTEQLMRMNGLNANSKLYPGQRLRVR

SEQ ID NO: 4304 - protein, 225 aa, Lactobacillus buchneri
MRKNGLQVAIDGPASAGKSTVAKRVAKQFHYIYCDTGAMYRAITLQAIRQGVSFDDVDEIGKIVHASKITFEPSDDGQKVFIDGKEITEAIRQEDVTNSVSAVAAIGEVRKQLSAQQQEIAKDGGIVMDGRDIGTAVLPDAEVKIFLIASVAERAQRRYKENIQKGINTPLDELQLEIEARDYKDSHRKISPLTKAKDAVEIDTTSLSIDQVVSKIADVINKTLK

SEQ ID NO: 4305 - protein, 416 aa, Lactobacillus buchneri
MSENANNDKNDLLNALNSVNEVKVGDVVTGEVLAKDDSQQLIVGIEGSGVEGVVPPRELSSDQNVDDIKQGDKLKLVVTSRIGSDKEGGSFLLSSKRLETRKVWDELAEKSKNDETITAKVSQAVKGGLVVDAGVRGFVPASMISDHYVDDLNQFKGQELELKIIEIDPVENRLILSHKAIVQAEKAEEREKLMQTLHEGDVVEGTVARLTNFGAFVDLGGMDGLVHVSQIAYERVDKPSDVLKVGQTVKVKVLSVDFDRNRISLSIKQTLPEPWDGIEEKAPVGSVLEGTVKRLVDFGAFVEVFPGVEGLVHISQIAHEHIDTPADVLKVGEKIKVKVLDVDTDRKRLALSIKALTDAPEEEAKPKKSNNRPSRSRKSNDRSISNAPEEETGFTLGDIIGDELKKSGNNDDDDNK

SEQ ID NO: 4306 - protein, 435 aa, Lactobacillus buchneri
MALPTVAFIGRPNVGKSTIFNRIAGDRISIVEDTPGVTRDRIYSHGEWLATKFAMIDTGGIQISDAPFATQIKSQAEIAIDEADVIVFIVSGKEGVTAEDEQVAKILYRSDKPVVLAVNKVDNPESREDIYEFYSLGFGDPMPISGVHGLGLGDLLDKVVEKFPKTDEKTDNDDIRFSIIGRPNVGKSSLVNAILGEDRVIVSDIAGTTRDAIDTRFEADGIKFTMVDTAGIRKRGKVYENTERYSVMRAMKAIDQSDVILFVMNAEEGIREQDKKVAGYAHEAGKAIITVVNKWDTLKKTNHTQQDFETLIRNEFQYMSYSPIIFVSAVTKQRIEKLPALIKQVYDNHEKRVQSSALNDVIMGAVAVHPTPTVNGKRLRIYYATQVVTGPPTFVVFVNNPDLMHFSYVRFLENQIRDNFDFTGTPIRIIKRSRK

SEQ ID NO: 4307 - protein, 91 aa, Lactobacillus buchneri
MANKAELVTNVAAATGLTKKDATSAVDAVFESIQASLAKGDKVQLIGFGNFEVRQRAARKGRNPQTGQEIQIPASKVPAFKPGKALKDAVK

SEQ ID NO: 4308 - protein, 417 aa, Lactobacillus buchneri
MSYSKTALDQLEGGQIDDFKKSFQQALDHDSDDLLYSLAEELYSLGFSNYSNTIYEKLFKKYPNDDGLKINLAELAIDDDQDDKALNYLSQVSPQSDEYVRSLMVAADLYQTQGMFEISEQKLLEAQKLAPDEDVIKFALAEFYFTTRNYRKAINLYLALITSGTLEMSSVNLVERLGVSYAEIGKFEQAMGYLEQIKPINMNADVKFELAFTYFNLKEYQKAIKAFEDLRDSDPQYSSLYPYLADAYVNLKRVDEALKAIQEGISIDQFNEKIWQKAGQIAEMANEDDLALTYFQKGHEIAPDDMEILTLLSDWYVAHERYSDNLKLLEGVFEDHVVDAHLAYNLALSYQNTGDIKKAANNYELAADELSDNPDFLKHATLFYREIGKPDLEKQSLKKYLDLVPDDMEMEELWDEM

SEQ ID NO: 4309 - protein, 296 aa, Lactobacillus buchneri
MAQKQSRFKLDISLIDLLVIAAGTAIYSFGIVFFNIYNHLADGGVTGITLILRALFHIDPAYSTILVNVPLFAIGYRYLGKKDMFYTLYGTIALAIFLWIWQRVPIVINIDHDLLLSAIGAGLFGGFGCGIVYRFGGTTGGVDIVARLFERFKGVQMGQTLLTIDVLVLLSSLIYLNVRQMAYTLIYVWIFSMIVNFTQRGAYTARGILIISNESEKISNAIQDELNRGVTFLNAEGGYSHRSKQIVYCVVSPSELHTLKKLVESIDEEAFISIIEVNEAIGEGFTYKRPKRFKLL

SEQ ID NO: 4310 - protein, 403 aa, Lactobacillus buchneri
MAIIVRMVEIPKEFHEALPILQKIESAGYEAYFVGGSVRDTILKRPIHDVDIATSAYPSEVKALFKRTVDTGIEHGTVMILDHGTGYEVTTFRTESGYQDYRRPDHVTFVRSLKEDLKRRDFTINALALAENGQVTDLFGGLSDMRKHIIRAVGDPNERFNEDALRMMRAVRFASQLDFKIEDATLAGIALHSQLLAKIAVERSHTEFVKMMLGSDANHGLKIMIQTNLYQHVPILGEHLDQLRQIADTDFTLTNEVQVWALLAFKFGFNSQQITRFLKRWKTANKIINDVILTVELLFAIQRGQVTNLTLYHAGSENVDNAIAVFADQSKTTGLSERYNRLAIKNKHQLKITGGELIKRGVLKPSPQLGQVLNYLEQNVVADKINNEPEDLVQAAINFLNED

SEQ ID NO: 4311 - protein, 638 aa, Lactobacillus buchneri
METMRVENLAKTYGEKTLFDKLNFIINEHDRIGLIGTNGTGKTSLLNAIAGIDHDSTGDIITSKSYTIGYLKQDPELDESLSIMDAVFSGSQTVYRTIRHYEAALKDYSTHPEDPEAAKRYTKAEARMNEEDAWNAQSDVKTILTQLKITDYNQKISELSGGQRRRVGLAQVLIQAPNLLLLDEPTNHLDFDSIDWLENYLAAYKGSLIVVTHDRYFLDHVANKIWELSFGKLYQYDGNYQDYVQQKATRVQGEIQAEHKTQQLYKQELAWMKTGAKARSTKQQARINRFNDLKENVGTLQLDQDVNISLGQTRLGKEVLKMKDANLTIDGKTILKDFNILVQPNERIGISGENGAGKTSLLNVIAGRLKLDSGIIKVGETVKIAYYTQLTEPIPEDKRVISYLSEIGQQVTDNTGNKISVAELLEEFLFPRFMHGTLIRKLSGGEKRRLYLLKLLMQQPNVLLLDEPTNDLDIATLTVLEDYISKFQGTVITVSHDRYFLDKVADRLLIFKGNGVIEEHRGRFTDYLASLKKAPKSSAKSDSGQSTSQSDSASSSQDAPASNAKTKKKLTYSEKIEYDHIEDDIEKLESQVEDIDKQMQNNGSDYDKLADLQAQKDQLSAEADKKMKRWEYLSEYAE

SEQ ID NO: 4312 - protein, 316 aa, Lactobacillus buchneri
MLEDAYLDLARYVLENGHKKADRTHTGTISTFGYQMRFDLSKGFPLLTTKKVPFGLIKSELLWFLKGDTNIQFLLKHKNHIWDEWAFEKFVASNDYTGPDMTDFSHRAQKDPEFNKVYQEQKKQFCDRIVNDDDFAKKYGDLGLVYGSQWRAWKTSTGGTIDQIQNVIDLIKTHPDSRRMIVSAWNPEDVPTMALPPCHTLFQFYVNDGKLSCQLYQRSGDIFLGVPYNIASYALLTSMIARECGLEVGDFVHTFGDAHIYLNHIDQVEELLSRKPRQAPELWLNPEKKHLDEFEMADIKVKNYDPYPVIKAPVAV

SEQ ID NO: 4313 - protein, 161 aa, Lactobacillus buchneri
MLAFIWAEDANGLIGANGQLPWHLPDDMHYFKETTMGNTIISGSKTFRSYNRPLPGRENIVVSHQTDFPTGVKVIPSIEQLCDLIAQNPDKQYIVTGGANLFAQLRSKVDRLYRTKIEAEFSGDTYMPAIDYSLFELSKSVVGVVDGKNKYPHTFEVFDRK

SEQ ID NO: 4314 - protein, 282 aa, Lactobacillus buchneri
MAKVKIVTDSSAQLTDEELKQYGITIVPLTVMIDDTVYVDRDTITNETFVPQMLAAHDLPKTSQPPVGKFVEAFDRLGEDGSQILCLNMLAAISGTVHAAEQAATISKSDVTVVDSQSTDRGLGFQVLEAAKLAQQGADMDTILARVNQVRINTKLYLCVMTLDNIVKGGRLHPIAGAITNFLNIKLGLQVTDGKLKIISKGRGDKSLKKFFNGIIDEMKNTAAVKSIGVSYVTETEVLKDTVQKLKADFPDASFLERVTSPTISTHTGKGAFALIYYSDPE

SEQ ID NO: 4315 - protein, 334 aa, Lactobacillus buchneri
GDSLLIKELIPASEACYLHYDRLASEVSQNKHVKQTQHHFRWIIGLIGLIVIGAVAFFGYHYFNSAKETLPREVKLTAVGDSLTQGVGDPTNKGGYTHLIRQKVIQKNPNVHLSTANYGISGETTNQINHRVVYSKRLQHSIREADVITITTGGNDLLKFLKANVVGLNKHQLNQKLTGYCQTYQTRVTRLFRNIRHLNRRAPIFVFGIYNPVYVYFPQVNYINDTVAHTNQITNKVIHQQHRMYFVSINKPLTDGQFTTAKSRKTLEEKAAASIIAENHDSPADIEQLLSGQPAQANKYLSNDDHFHPNLKGYQIMTNRLYSQMVKHISWLKE

SEQ ID NO: 4316 - protein, 205 aa, Lactobacillus buchneri
MRKASKQTKSRNPWKIAFISLIGLLVVLVAGMFLAVSLSSSTTKLVNQKSTNQSEPISATINKAQLNQLSNYYLDKLQKGRPSQYHFEVANEGIVYGSLTLLGSNVDYSLTFDPKVMPNGNIELHANKLALGKFPVPISFVLMYVKQNYKLPKWVQLIPKDKTIKLDIIHMNGKNGINYRARTIDLKGQGKFAFEILLPTTDKED

SEQ ID NO: 4317 - protein, 72 aa, Lactobacillus buchneri
MHKTFYQYLMTKRNPGSTDPEAEFANNAFYDQSFPKQEDEFDALSKYLEENASYLPTMEIFDSVWKEYQESF

SEQ ID NO: 4318 - protein, 290 aa, Lactobacillus buchneri
MAVTIQWFPGHMAKAIRQFEENLSLVDVVFEVIDARIPLTSQNPEIRRISADKPHLYIMTKRDLADSQLTNAWLQYFAEHNQPAIAIDAKTKFGINNVISVISPILRDKLQREQDKGMKKRPIRAISVGVPNVGKSTVLNRLVNRRAAQVGNRPGLTKGQQWLKSNDKLELLDTPGILWPKFSSQEVADKLALTGAIKESVYASDDIALFGLKQIRQLHPEGLKDRYHLTDDDLDLSDVDLLLQITKKVGMRDDYERGSNRIIQDFRAGKIGRFTLDDPETVSDDDQANN

SEQ ID NO: 4319 - protein, 257 aa, Lactobacillus buchneri
MTKLTIKDVKQVLSQMSDLADPRLIELKADPRKGVQLAIQSTENRLQKQARALAEFEQRFKYERSFWHQGLQYVAGVDEVGRGPLAGPVVAAAVILPHDFDLVSVNDSKQLTPAQRAELAPLISAEALSVGIGSVDNHGIDELNIYQATRVAMKQAVESLTPQPDEIIVDAMQIPVPIRQTRLIKGDAKSISVSAASIVAKVYRDHLMDEYAKQYPEYDFPHNAGYGTAKHLAALKELGPTPIHRMSFAPVKKFSKK

SEQ ID NO: 4320 - protein, 294 aa, Lactobacillus buchneri
MLLRDFLLRIHLCKGIGIIGKSKIYTWVNQVDWRDDQLPTSGFLAAVAQLNVKNTANFKTSYQQLMRNEDRVDQLVDGEQWLSIADAEYPLQLRESFAPPLVLFYRGDLSLLSQPLLGIVGARDCTSYSVEILKNLIPGRVSNTMAIVSGLAKGVDTLAHQCVIANHGKTIAVIGTGLDVCYPYTNQELQATIAADHLLISEYPNHTKGYRNHFPERNRIIAGLVQSVLVTEAKKHSGSLITANLALQNNRNVLAVPGSIMMPLSVGTNELIAAGAKPVLRELDILEDYFQTRI

SEQ ID NO: 4321 - protein, 708 aa, Lactobacillus buchneri
MATSTKTKPKAKAKSKTKRKSPKKNLVIVESPAKAKTIEKYLGRSYKVVASKGHVRDLPKSKMGVDIDHDYEPHYISIRGKGDTIKELRSAAKKAKKVYLAADPDREGESIAWHLQHILDLDPNEDNRVVFNEITKDAVKESFKHPRNIDMNLVDAQQARRILDRLVGYSISPLLWQKVKKGLSAGRVQSIALWLIIQREKAIKDFTPEEYWSIDSEFKKGRSKFKAAFYGLNGKKKELPNNEAVQKVLQQLDPKGDFDITKVTRRERKRQPQPPFTTSTMQQEANRKLNFRTRKTMMAAQQLYEGINIGKEGSQGLITYMRTDSTRISVIAKHEASQFLHEKYGAEYAATKPIKGKLPEGAQDAHEAIRPTSVFRTPASLKQYLTRDQFRLYQMVWSRFVASQMTPAIMDTMAVTIEQNNVIFKANGSKMKFDGFLKVYGDSKEKDNLLPDLESGDVVKLVKNNPDQHFTQPPARYSEATLIKALEEKGVGRPSTYSPTIDTIQRRYYVKEVGRRFEPTELGEIVNKIIVEYFPDVVNIDFTANLEGKLDQVEEGKENWIKLVDTFYKPFSDEVDSATKNMEKVQIKDEPAGINCEICGAPMVIKMGRYGKFYACSRFPDCRNTKAIVKEIGVICPKCHKGQVIERKSRKNRIFYGCSRYPDCDFVSWDKPIGRDCPKDGHFLVEKRVKGGTQVVCPNGDYEEPAQK

SEQ ID NO: 4322 - protein, 475 aa, Lactobacillus buchneri
MFSSKHSSCTTILVGKKASYDGSTIIARNEDAGDAVNPKKFVVVEPEDQPRNYQSKLTKFSVKLPDNPLRYTSVPDAVPDKGVWGEAGINAHNVAMSATETITTNSRVIGADPFEKDGLGEEDLLTITLPYINSAREGVQRVGKLLEKYGTYESNGILFSDVNEIWYMETAGGHHWVAQRIPDDAYVIAPNQTGIQEIDFDDPDSFMFSKDLRKFAQEHHLNPTSHFNFRKVFGSDTQLDRHYNTPRAWYGQRYFDPESVKDKTPMSNDLPFICHANRKITIEDIKFVLSSHYQDTPYDPFAPGADYKTVPYRPIGINRNQELSILQLRPGIPSAYSAIQWLTFASNPFNTLTPFFTNVVNTPDCYRDTTETLDSHNAYWANRLISLIAADHYQALMQDIEDYQLKEMGYAHERIAQVDQQMAEKEASGSHVVRALGQANARTADHVMKATEDLLTKLVVKASQDLPGSFTREHY

SEQ ID NO: 4323 - protein, 477 aa, Lactobacillus buchneri
MIPYKNFSACTSMIVGKKASIDGSIMIARNEDSKSSWPKNYVIHEHQEFSETPVFSSKDNGFKLTLPKVRFQYSATPEWTDKFGLFEENGFNEFGVAMSATESTYTNQLALGADPLNEDGIGEEAMITVVLPYVKTAREGIARLGQIVEYFGTSESNGILFADKNEAWYMETGGGHNWVAQRIPDDGYAVIANQSAIQDVDFNDPDNFMWSPKIRRFVSENHLNPDPSGKTFNFRKIFGTADLSDTVYNTPRVWYGLKMFSPELNFEPTSQEMPFINQANRKLSLFDVEDFLSSHYQGTPFDPIGEGSEHDKHLYRPISLAKTQEAHILQIRPNMPTPAAGIQWLAMGVAAQSSFVPFYAGANTTPKSYQNASGSYAPNQAYWTYKLAGVLVDPHYVKFGPKLNDTKAKLRVNFQQAVKQADASFQGLSNVELANYLTKVNFANAKMGLDAYNQLISDIITNSTDLSPINFTQDTNL

SEQ ID NO: 4324 - protein, 62 aa, Lactobacillus buchneri
MPIVDIHLIAGRSQDQLKGLVEDVTAAVVKNTGAPAEHVHVILSEMEKNRYSVGGVLKSDEK

SEQ ID NO: 4325 - protein, 502 aa, Lactobacillus buchneri
MNDQQYIMSIDEGTTSTRAILFNNDGDIVGKAQREFHQYFPKSGWVEHDANEIWNAVQSVISEALINADVQPYKVRGIGVTNQRETTVIWDKNTGEPIYHAIVWQSKQTAALADQLKHDGYDDMIHEKTGLIIDSYFSATKIQWILDHVDGARQKAENGDLLFGTIDTWVLWKLTGGKVHATDYTNASRTMLFNIHTLTWDKDILDLLHIPESMLPEVRSSSEIYGYTAGYSFSGVQVPIAGIAGDQQAALFGQMALQRGMIKNTYGTGAFIVMNTGEEPTLSKRGLLTTIAYGINGKVNYALEGSIFVAGSAIQWLRDGMEMVKSSPDSEQMAIDAKSTDGVYVVPAFTGLGAPYWDQDARGAVFGLTRGTTKNQFVRATLESLAYQTRDVVDTMAAETGIDLKSLAVDGGAANNNYLMQFQADILGTPIQRASISETTALGAAYLAGLAVGFWDSIEEIRRTVKSRDAFEPQMDEQTRTKLYTGWQKAVQATIQYHPDEN

SEQ ID NO: 4326 - protein, 275 aa, Lactobacillus buchneri
VITITKKLIALDLDGTTLNNDSLISAKTAQTIRAAAKQGYIVSIVTGRPNRLSETFYDDLKLTTPMINFNGNLGILPHQQWNREYQYTIDKEIVTELLAKSKPLGLSLIAVEGRNMFLANQGLSSGFGFFPSTLATNQVLSRKSLKENPISITVQVEPELKQGLIDFVEHQFGDEVEVSPWGGPNPIVEIATKGVHKSTGLKFLADYYGILQKDIIAFGDEGNDLTMMQYAGTGVAMKNAIDKIKGQADEVTEFTNDEDGVAHYLQDRLDIAVGA

SEQ ID NO: 4327 - protein, 454 aa, Lactobacillus buchneri
MNLPTDFVNKYQQLMGKSEADQFIASFDEPTTPGFRLNPLKASQPTDLDLSEPTEHCRFGYHGQVSGKTIDHQSGAVYSQEPSAMYVGEVAHPNLGERVLDLCAAPGGKTTHLGSYLQNTGLLIANEIDSKRAKALVENVERFGMTNTIVTNTDPDHLAAQLPEFFDRILVDAPCSGEGMFRKDPDAVQYWSVDYPIECAARQRTILAQAVKNLKPGGELIYSTCTFAPEEDEQIIAWLVDTYGFDIQPIKKFAGMDDGQPDWADGNQDLTNCVRIFPHHFNGEGHFIAKLKKPADPEVSKGPRRFRGISRNIEMPSKYQNQLFNQFAKATLKNVHFDKLVVFKDHLYSVPENTPNLSGIKIVRLGLEMGTFKKNRFEPSYGLALALHPDQVSQKITIDLADWQKYVHGDTFQVSPDLKKGWYLLVCQQQPVGFAKVVNGTAKNFFPKGLRFAM

SEQ ID NO: 4328 - protein, 344 aa, Lactobacillus buchneri
MTSQHSHRKDEHVSLAEKFYQPVDSSFAGVRFVNASLPKYRLDDIDLTTQLGPLSLTTPFYIEAMSGGSPRTKEINRRLAVVAKACGLAMAVGSQSVGLSDPEVRDSFSIVRQTNPNGIVLANIGANHSVEDAQKAVEMIAADALELHINVAQELVMPEGDREFHFIDNIQAIVANVGVPVIVKEVGFGMSQATISQLVDLGVKYVNVGGHGGTNFAAIENFRRSSKDMAYLTDWGLSTVESLFEARAFSDRLGIIAAGGVKSPLDVAKCLTLGASAVGVAGYWLHEIIHKSDNEIINDVKEWQYGLKAIMLMLNCRTIADLQRQRLILDPQLLSYLKQRKLAY

SEQ ID NO: 4329 - protein, 361 aa, Lactobacillus buchneri
LIKVKAPGKLYIAGEYAVVETGYPSIIVALDQFVTVEISRSKSYGSIVSKQYREDSVYWRRRGDQMILDNRDNTFNYIISAIQLTEEYAQSLGRQMELYDLRINSDLDSPNGKKYGLGSSAAVTVATVKALCQFYNLPLTKSKLFKLSAIAHLDVQGNGSLGDIAASVYGGWIAYRSFDRSWLMAARMQEDLISLVNKPWPHLKITQLTPPDGLKLIIGWTGSPASTSHLVDKVAVQKSNQHETYTHFLAESKACLDELIDGFKNGSLSVIKEGIARNREILQHLAAFTKVPIETPILKKMCDIAVDHAAAAKSSGAGGGDCGIVVADKDTDVDSMIAHWQENGIQQLALKVHPVIDLDKE

SEQ ID NO: 4330 - protein, 328 aa, Lactobacillus buchneri
MTTSSDKTVTAVAHTNIALIKYWGKQNPELIIPYTGSLSLTLDQFYTQTSVTFNANLDKDQITIDGQPVTGKSGQRVHNFLSIVRQESGIDLNAQVKSTNHVPTAAGLASSASAFAALAAAASKAAGMNLSLTDLSRLARRGSGSACRSIFGGFVEWRKGSDDTNSYAIPVETTHLNDIRIVALTIEKHQKPISSREGMALSVTTSPYYPTWVKVVEADLENIKAAIQDDDFTRFGTISELNAMRMHALTLSADPDFLYFNGDTLTAMNEVKRLRHSGIECYYTIDAGPNIKVICQQANVQTITDTFSNLFGPTKVTVAKPGPGVKYL

SEQ ID NO: 4331 - protein, 325 aa, Lactobacillus buchneri
LKDKATGKSYAKIIWFGEHSVVYEKPAIAIPIYSVDVVATIQRIPTGQQIHCRYFDGPISEMAENLRGVKTLITHLVSLFGAQRLAFDLDIQSKLPAERGMGSSAATAIAIVRAFFDFFEVNLTRSQLLKLADIEEKITHGNPSGLDSATASSNMPIWFIRNKINEQIDFNLPTSSLVIADSGIKGKTSEAVSLVHDNLVDEPESSQPLIDELGKIAETARNALATTDDVLLGKLMTQSQRDLAQLGVSNHTLDTFCQVACDNHALGAKLTGSGLGGCVIALAKNQRDAQQISTALRKAGATQTWIQSFKNYQFSTGEAHDNLVR

SEQ ID NO: 4332 - protein, 945 aa, Lactobacillus buchneri
MNSKTTFAVVDIETTGTDISADNRTIQFSCCLVSNNKIIKTFVTDINPQREVPNRIVQLTGITNERLQKAKTFDQVAAQLYSLLNNTVFVAHNVNFDFPFLNSEFQRVGYPELQIEAIDTVTLSQILLPTLSSYRLQDLSSYFNIEHDHPHTADSDALATAKLLLILLRQIKMLPKMTLEQIISVNPSLPQDTMQVFLDADETNKRQVHAAKLPDQLRISSGLVLRKQDPIVVTDESDKQRLRYPKTKKAKQKLLPDNLESRLEQNKMMNLIYNNYADQQHHAAKTLLIEAPTGIGKSLGYCLPLSYLVSAHKPAVISTSTTYLQFQLQNQTLPMLNEGLPFKVNSVILKGASHYIDLYKFRNLLNVPDNSTQTAFIKAQILVWLTVTTTGDLDELHLNVDQTPFVWKIQHTGVKWLDPNEPFYDDDFLRYNLKKAQNADFLIVNHSYLIKNWQYFKDLPTKPYLLIDETQQFAETAIRNNQERINPLSLTTAINKILADINGTHEDNIKEIVEDDAILDHAIEALDGKLRQAKTLVSTVTTTLFEMVVKGKRLHRNAEFFERLIPINEMKAATAANQEPINRLRALHDSLDGLLATLNAQIDHNAGAYTNHDFLSIYSFFENYNEFNHQLRLLLAIVDVDDQSIEQHVTWVTVNNVKDVNSLTLNRGILKTEDYLRDHVYSAFEPATFTGATIFSSRRSQFIYNLLGISRDDSSIKRLKSDFNPKDQARLYLVTDQDDRQFATNSDNYLQKVADNIEVIYKNEPRQTLVLFNSLNAIERTYRLLQESGFTATHFVLAQGVHGTAAKISKQFIHHEPAILLGANTFWQGVDFPRNLLENLIVAQLPFDTPSDPYNHALYSIERSKGKNPFYSITLPKATLRLRQGMGRLLRTKDDFGTIFILDPRLLSKRYGSTILANLRNDIPVVHGSIDECVLDMVKFFESRN

SEQ ID NO: 4333 - protein, 168 aa, Lactobacillus buchneri
MQRHRRVKKQSYVKISWIVISIILILCFSFFIILHTAERPMTIARGQTETIAKKYAGLTKVDSFYTSNLGKTYYSVSGVDNKNKNVYVIVAKKGGTVNVINSSSGISEQQAKNVIQRQKHPSKLNGIGLTMIKNQPYWVVSYMNAKNHLCFTTISFKNGTIYKSIENI

SEQ ID NO: 4334 - protein, 406 aa, Lactobacillus buchneri
MKFSKRAMQVTPSATVKVSNTAKAMIRKGIDVINLGIGEPDFPTPKIIADAAIDAIRSGKTSFYTPASGLPQLKEAIAERIKQDYGVVYPADQISVTNGAKMALYVLMQVLVDDGTEVLLPRPSWVSYRQQVNLAGGKPVIVETGTDFKITTQSLDTAVTKNAKVLVINSPQNPTGTVYSRDELAAIGQWAVLHNVTLIADDIYGKLVYNQNQFVSLVQISDEVAASTVLVNGVSKAYSMTGWRIGYLAGAPELIGKVNSILSHSTGNPATVSQYAAIAALQSDQSAVETMREAFEQRLNQIYPLVQQIPGFKLAAKPQGAFYLFPNVEAAVDLAGLNDSGELVDQLLAKAHVAVVDGAAFGMPGYLRLSYATSLEDLVTAVERITEFMNQFLEKQVSGGIGIETN

SEQ ID NO: 4335 - protein, 431 aa, Lactobacillus buchneri
LKQINMVDAPKYVNEKVKIGVWLTNKRSSGKIAFLQLRDGTAFFQGVVVKSNVTPEVFELAKEVKQETSMWVTGIIHEDARSKFGYEIEIETIEVLSETHDYPITPKEHGVDFLMDHRHLWLRSSRPHAVMRIRNEVIKATYDFFNDEGFIKIDAPILTGSAPEGTTTLFHTEYFDRDAYLSQSGQLYEEAGAQAFGKVFSFGPTFRAEKSKTRRHLIEFWMIEPEMAFMHQEESLEIQERYIAYLVTRVLENCQMELKTLGRDPEVLKKYTVLPYPRISYDEAITMLKKGGFDLEWGVDFGSPEETYLADQFNQPVFVINYPKAIKPFYMKPHPTRDDVVICADLLAPEGYGEIIGGSERATDYDYLYDQIVKAGLDPKEYSWYLDLRKYGSVPHSGFGLGLERALTWLTGEDHVREAIPFPRLLNRIYP

SEQ ID NO: 4336 - protein, 238 aa, Lactobacillus buchneri
MDDYARNLLNEGQTTVSNYLLKHYHQIGVTNQELFIYLLIKGNHDLVVPMPEMADLQAQTNYSEQQLFNLFHQMIEKKLTKITQVVIEGQQVDAYDFTPMYEKLALVKPTGTSPEASVNEKPKTVSSSDRQAVFQSIEQEFGRTLSPIEMESISQWLDIDHYSPELIQLALKEAVLSQVYNLNYMDRIISTWYKKNLKTPQQVEAAKKNRNSSHSDDISTGYDGPEIPFINLSGNSDK

SEQ ID NO: 4337 - protein, 772 aa, Lactobacillus buchneri
MSQNNPKNSRAEVRRGRQFSNTHKKGPFRRIFKWALILVGVLFLFGAGLFTYYASSAPRITRSALTSDNSTKFYDANGTVISRLGSQNRDYVKSKNIPRTLKRAVVSIEDRRFYKHHGVDPIRIAGAAISNLTGSSLGLQGGSTLTQQLVKLSVFSTAASDRTFKRKAQEAWLAIKVENRYSKSQILEFYINKVYMGNGVYGMQTAAEYYYDKTLNHLTLPEFALLAGMPQSPTLYNPYKYPQYATKRRNEVLDAMVKTKDITESQAQAAKNTSVKAHLSATHAKARTSEKTSKYIDSYLKQTIEELEDKGYKPNSGLKVYTNLDMSAQKKLYQVSNNDPTIAYPNNRFQVGATIVDVNNGKVVAMQGGRKTKVAFGLNRAVQTGRSSGSTAKPIMDYGPAIQYLKYPTYQPVKDTPYVYPGTDKSVYDFDNKYQGTITMRKALVESRNIPAIRTLENVGVPKATGFLKNLGMSFSKPLEIQNGIGLYISSEQLAASYAAFANGGTYYKPYLINKIVQVNGVTHKYHQQGKRAMSPATAFMITNMLKGVMTDSAGSGTAAKVSGLYEAGKTGTTQYPDDYLNKVPAMSTMDSWFSGYTKNYSLAIWTGYDHQFKANSYVTSAQTSIAQEIYKNVMGYISEDKPNTDWTQPSDVVATNRGGTTEYYVAGYPGTVTDNSSNQTTSGYTTEGGSSSSSAVVTQPRENESSSSTESSNESSASTPSEQKPSGDGGNDDSNSSSASSSSTDNGGTTPDNGGGNTNSNDNNGGTDETQ

SEQ ID NO: 4338 - protein, 199 aa, Lactobacillus buchneri
MTIRYPNGNQFHEQPTSSGTHNDSINFSNRGMTLEDEINKSNQYYLRAGIAVIHKKPTPIQIVSVDYPKRSAARIKEAYFRRASTTDYNGVYRGKYIDFDAKETKNKQSFPLKNFHEHQVEHMRQCLQQQGICFAIIKFISDQAVYVLKATDLITYWDAQKSGGRKSIPRKVIEKEGFLIQYRINPLLPYLRAVDSFIE

SEQ ID NO: 4339 - protein, 190 aa, Lactobacillus buchneri
MSRLWVTGYRSYELGIFKDDDPKRKVIDMVLKNEIDQAIVDGMDWLISGGQLGIEQWSLEMALNLKKTYPGEFQTSMMLPFADFGSNWNENNQTKLQTLKARVDFSASVSQKPYQSPQQLRNYQEFMLSHTDQALLIYDLDNPGKSQYDYDQIKRFADNHPYPYKLITFDDLQSAADEYQENLNNSVQDD

SEQ ID NO: 4340 - protein, 126 aa, Lactobacillus buchneri
MENINYTPKDILQKEFKQKMRGYDPNDVDGFLDDIIKDYETFNKELQSLSDENERLKVQVDELNKQIAVSGSQPMPSAGGTAPTRSVPSQPMSSATNMDILKRLSNLERRVFGSQLDNNTNDSHRL

SEQ ID NO: 4341 - protein, 386 aa, Lactobacillus buchneri
MKFNLMATCAAGIEALVGKEMRDLGYDVQVENGRVRFTGNEEDIIKTNLWLRTADRIKIVVDEFDAQTFDELFEQTTAIAWDKLLPMDAAFPVEGRSRNSKLHSVPDSQAIVKKAIVNELSTAYHRHTRLPETGAEFPLEVAINKDHVMLTMDTTGSSLFKRGYRIEKGSAPLKENMAAALVMLTSWYPDMPFLDPFCGSGTIPIEAAMIGRNIAPGFNRDFICEQWPWIDHDMAQKVRDEADAKADYDIELDISASDIDGNMIEISKRNGEEAGLLADIQFKQLAVADFKTDKVNGVIVGNPPYGQRMSDEEHAHELYKQMGKVFNPLTSWSKYFLTSDLDFEKYYGEKATKRRKLYNGSIRTDYFQFWGKKVRDLRKLDQIKSK

SEQ ID NO: 4342 - protein, 370 aa, Lactobacillus buchneri
MVKQVAIIGGGIIGATDAFYLSFLQGNDNIQVTLFDDDTGQATKAASGIISPWLSKRRNKRWYALAKRGAELYPSLVSDAQLSNQAYQQTGTIVTRKNHDDLLALYQEARIKEQHTTAMGRVELLDAKEVKRRMPLLTDAPEGVFVSGGARIDGGHFVSELLERAAANNLDVKNERVSLTANGAINTTAGPKHFDIVIIATGARMHESLQPLGLNVKVRPQKGQLIDLTVKMPHKWRNMPVMMPEGSSDVIPFNGGKLVIGATHENDEGFDLTPQPAARRQLLNNAKVFIKTLTDAQVSDMRVGTRAYTEDFAPFFGAVPTLPNFLIGGGLGSSGLTTGPMIGYLLAQAVFEREIDHWQDYTKPVSQYID

SEQ ID NO: 4343 - protein, 129 aa, Lactobacillus buchneri
MIKLYTDAAVNQHTGHTAIGILIVNNGKQIQLNQVITPTDNHDAEFSAAIAGFQKLIDLQIDPSELIFFYTDSKIVIDSLNKQYAKHFEKHLDKLLGLQNQFATVVNTWIPDKQNMGAHTLALQALHSI

SEQ ID NO: 4344 - protein, 128 aa, Lactobacillus buchneri
MISQKRHFFYQPSPLSSIICWSWTFVVFFIGVIIWLEITHFQWITLFFFVLFAVIVWAEIHFRSIHVYDHKFVVSRITNPHWLTVDLDQISHVQTSKYQLAFVANTKIYSFILPANSVIEIKELISNK

SEQ ID NO: 4345 - protein, 553 aa, Lactobacillus buchneri
MKSDVEISQETVMEPITKIAEKIGIAEDQIEQYGQYKAKINFDPTTEKANGKLILVTSINPTAAGEGKTTVTVGLGDAFNELHKKVVLALREPSLGPVMGMKGGATGGGYAQVVPMDDINLHFTGDFDALTEANNTLAALIDNHIQHGNQLNIDPRQITWKRVMDVNDRELRQVVIGLGGRTSGVPRQDGFDITVASELMAILCLATSLPDLKQRISRMLIGYTYDRQPVTVADLHVQGALTLLLKDAIKPNLVQTIEHTPAFIHGGPFANIAHGCNSILATQAALHFGDYAITEAGFGSDLGAEKFMDIVTPRLKQSPDCVVVVATVRALKLNGGADKHELNTENLEALKKGVVNLKRHVEGMQQYGKPVVVAINKFATDTEDELTYLQNYVTNDLKVTGTIINSWAEGGKGAVDLAKDVIEACERPAEFHELYNDDDSIEDKMAKIVTQIYGGDGIEFSNKAKTALKRIKKLGYDQLPVCMAKTQYSFTDDAKQLGAPENFKIHVSDLQLKLGAGFIVALTGKILTMPGLPTHPAALDMDIDEQGRITGLF

SEQ ID NO: 4346 - protein, 146 aa, Lactobacillus buchneri
LPVLYVIGIIALIAIDQIVKHLVVASLALGDSFSVINGVLSITRINNTGAAWSILSGHQFIFVIIAILAAILVTYFIVRYWSNMPYRIGLGLLLAGTLGNVIDRIMNNHVVDMFQLDFINFPIFNCADMYLTFGILILAIAIIRES

SEQ ID NO: 4347 - protein, 302 aa, Lactobacillus buchneri
LKEYIITNQTGRLDKVISELDSSISRSRAKNLIDDQHLKVNGEPVKPKYQVKSGDKIQVDSVQPTPISLEPENIPLDIVYEDDDVIVVNKPQGMVVHPSPGHPDHTLVNALLYHSPLSTINGEFRPGIVHRIDKDTSGLLMVAKNDKAHQFLSQQLKAQKNLRKYVALVHGRIKEDSGVVNAPIGRSPKDRKKQAVVSDGRSAVTHFEVLERFADYTLVACRLETGRTHQIRVHMKYIGHPIVGDPLYGPRKTIRGNGQFLHAQELGFEHPRTHQLMIFSAPLPPIFEQTLNNLRLNNALGS

SEQ ID NO: 4348 - protein, 177 aa, Lactobacillus buchneri
MGKIILDKMAMQRALTRITYEIVEKNKGVEDLVLIGIKTRGIFLANRIADRLQQLENVSIPVGELDITNYRDDIEHDAMSSDVKMSNNKINFSIEGKRVILVDDVLYTGRTVRAALSAVMDLGRPKSINLAVLVDRGHRELPIRADFVGKNIPSSQKEKIKVYVSEIDDKDAVELIK

SEQ ID NO: 4349 - protein, 363 aa, Lactobacillus buchneri
MTERYLILEDGSAYAGKAFGSLATTTGEIVANSTMNGYQEIISNQIYHNQIIVFTQSSIGNTGLDQNAYESILPSAKGVIVREYENLATDHFKRISLDKYLKQHKIPGIYDVDTREIRHHLQKRGNMKASIVDVADDHAFDQLHATVLTNQQVAQVATPKPFPNPDEGANVVVVDFGLKSGILRELSHRDCNVTVVPWNFSAAQILDLDPDGIVLSTGPGSPENLPKSVLDMITEVQSQAPLFAMGLGHELFALANGAKVSQLTVEHHGSNHPIREIITNEIFFSGQEQGYAVDPKSIDHAKLFITHIDLVNGTVQGLRHRDYPAFSVQFSPDGAPGPKDSVGLFDDFMEIMARRRDSNDDRY

SEQ ID NO: 4350 - protein, 833 aa, Lactobacillus buchneri
MTIDINKVLLLGGGPTNIGHENELDAAAFERLMALKKTGAKIIYVDNNPFSVTTEEIQPANVYVQEVNFQNIVNIIDKENPDAIMATTGGLNGMQIAWQLAESGILASNNISLLGIKPADLRKVMDNQKLRDTLTEINEKVIASKIVADDDEAMDFVREVGFPVIVKPMSSSHDTSRFICNNTDELEDALDVSFKRAYIKRCSIEQSIVGYKEIEMVGIRDESGNKLLVSGMEDMDPIGIHSGDSIIFAPTQTLINEEYQALRSATFRIMDALNVTGTCHVQFAQSRTDANYFVTKVSPFFTRNTILAAKATGYPLTYVSSFLEMGYNLTEIKLPSKYNKFLPFMEPTMDHVVVKIPLWPFRDITDVDQHLNTLMKSVGSTIGIGRTVEEAIIKSMHSSQFSPRDILPSVSTVNDDEVINQLIHPLASRILILMEALRRGFSIDELSELTQIDRFYFYKLNQLLRAQDFVVNNPMSPQSIEIGHKYGFGDGMLAELWQVNISKIQQLNENYQNHVTYKAVEPSAGEMLESTNIFYSSYELENESRPFEEKSALVIGRGGNQLGPNSAADYYTSQILRALHKSGYKTIIMNTNPNAVSLTPQLSDKQYIEPIQLGNILNIINLEKPDVVILPGNRHYLSKQLKQFQNLNIIVLPPDQKVATYNQKYATTAVDLFIEGDEILPVTTISFVGKDQRTDLRFINDYKEPMDKWKSDEAKLIADATNKVDPKEWQGLVQVLYNTTGDSKYEMTGIRPVRITETAFLTKTTGINWINVLVRKYLHTLDMEALREDLKPTEHKRASIMTAHFPFRELQSSRIEGTTKQEVGSSLSFKNFE

SEQ ID NO: 4351 - protein, 568 aa, Lactobacillus buchneri
MSFDGSFTHSMKNELTDLLQTGRISKINQPYPNELILTIRAHGKNQQLLLSANPTYARVQITRVPYVNPSVPTNFTMIVRKHLSGGILSEISQQENDRVLTFTFTARNELGDQTKLDLVVEIMARHSNIILVEQATGKIIDAIKHVGSDVNRYRLLLPGATYIKPPKQDLENPFTMTDFDRVRQLIKDFPNVDVLAENLRKTIQGLGNDTSLALATSLHKDEKVETNFKDFFQKFDSPEPTFSHVAGNKINFTAFPYPGTTKNQTFSTLSELLDAFYASKAQRDRVREQGAVLIQVVKKQLKKNRTKLKKLQRDMKDTENADDYRVKGEILTTYLNKVQRGMTSIELPNYYDENKLITIQLSDQQSPSQNAQRYFKKYQKLKNAVKFVGEQIQLTKQEVDYFENIQSQIELADPQDLVDIKYELEQGHYLRDHEQNKKKKNKRQKINKPEKFVASDGTEILVGKNNLQNEKLTMHTADKRDTWLHTKNIPGSHVIIRSFDPSEKTLAEAANLAAYFSKARGSAKVQVDYTKVKNIRKPNGTKPGYVIYDNQTTLFVTPDESLIDQMRK

SEQ ID NO: 4352 - protein, 137 aa, Lactobacillus buchneri
MKDILVALNSAAKNHRSQIFNITKAMNLTISEWKLLNQVIAGNTTQELLSESTKLDISTLSRQLKRLLEKDMIEKTAVGRDKRQLIYKVTDKGTQASQYVAAEIQKLTDRVFNHWTDEEKNLLKILINRLEKSLDRI

SEQ ID NO: 4353 - protein, 290 aa, Lactobacillus buchneri
MKIAIVTDSTAYLTKEEQAKYNIIEVPIPVIIDGREYKEGVDLTTAEFYDKLKNSQAFPSTSQPPIGEMIDLYNSLAKQGYDTVISIHLASTISGFYSSLTQIAPTIEGINVIPYDSKITVKLMGYMAIQASKMARLGRTPDQILTYLDGLRQTIDELFVVDDLQNLVRGGRLSNASAFIGGILKIKPLLTFDDKSNEIVAFEKIRSRKKALKRVEELFAAAKQKADYPLRALVINGNDPKAGNEWANKIHELYPDMTIEQSYFGPTIGTHLGDKALALAWLRDFDQDNI

SEQ ID NO: 4354 - protein, 50 aa, Lactobacillus buchneri
VNFERKMIGFDLSTICGVVSAFAMLFSSLNNGELLYKEMLHHEVIVIGFS

SEQ ID NO: 4355 - protein, 176 aa, Lactobacillus buchneri
MKSLSLGFRKLRVVDIVVLGIFMSLLLILGRFTVGVQSWRLSFGFVVTAIASMLYGPLWSSTIAALTDIIGTLMSGSVYFPGFTISAILGAAIYGYFFYGKEITWKRVIIAQLIIAVVVNAILNTYWLTILYKTPFWAFLPVRALKELVMTPIQMAILYYMLNSQTMSNIQSRLFK

SEQ ID NO: 4356 - protein, 116 aa, Lactobacillus buchneri
MMYYISLHNMRFHSHIGVLPEEKVVGQNIQIDLKVKVDADPTDDDLKSTVSYADFYPTIAKVIDNNQVDLVETLAQTVIAAIKNIDSRIMTVNVRIRKQGTPIDGVLDDVEIEMEH

SEQ ID NO: 4357 - protein, 353 aa, Lactobacillus buchneri
MEDVYLSLGSNIGNREAFLEQAIEALGSDPRIMIEKQASLYETSPVGGVKQRAFVNTAVKIGTTYEPLTLLKVIHEIESGLHRTRQVHWGPRTVDIDIIFFGNEQIDQPGLSVPHPEAFNRLFVLIPIQELIDEQFPDAEKIATAIKSLQQDDQSIKKITPANNFYTEITSNVTNVLAAIGDDPTRKGLIETPDRVARMYANIFDSIGLEDFQDYKLFDSPESDDSKTVMVKGIPFYSMCEHHMMPFWGKVSVAYVPDNGKIIGLSKIPRLVDFVSHKLSLQEKITDDVLSQMEKILHPKGVAVIVDARHMCIEMRGVKKTGTVTRTTKFTGVFQQNDELRSEFLNSIQVGQI

SEQ ID NO: 4358 - protein, 438 aa, Lactobacillus buchneri
MNDDLTSHFAEFLYNQGDRIGLLKQVLRQLGNPDADYPIIHICGTNGKGSTATMIAAILQQMGKRVGLFTSPFIGDITNSIQINRQAIPTDQFDKYLNRLKQLMTSFGDGQQELSEFEAMFVAAMQYFSDQQVDYVVLECGLGGELDATNAVKTTIYSIFTKIGMDHIGILGNTIEEIATTKSKIIRQGNTTIAAPNQRPEVLAVLKDEASHKAATFLDADAVQIDRQLTKATNVVYQVGHQSGHFQFGLPGDYQLENVRTVLLWLDDFQKKQHLSLDVSQLLTQALGKLDVPGRFETIHAQPTIIIDGAHNVDAITAFVGSVKHSFSSQSKLIITGFLKDKDYVDNVRLLAQIPNATFKLTQPANPERKLDERRLQTVFQNITGKIYPVFSDPIAALKASLKESSNHPDQLILVVGSFYLINPIRDYLIKTRSNSND

SEQ ID NO: 4359 - protein, 283 aa, Lactobacillus buchneri
MTNSNEVHFKGKNFDFNLTETPIIYSILNLTPDSFYDGGVNTSIDQVLDRIETEMGYGAKTFELGGKSSKPHFDDISPDEEWQRVEPYLKAIQKRFPNIVLAIDSNTNSVIERALQSGIQIINDIDGFNSQAKLDLVQQYQPSVVTMFNGRNFDEQPTTLEDTMHSFFTGSINRLEQAGLQRENIVIDPGVGFSDRNTLEFDLIKMRYTKQMRQFGAPIMIAISQKSFAKRLFDAGSDERLIPTLLFEAYMTQLGGRIIRVHNVKETQELIKTYQIFKDILSD

SEQ ID NO: 4360 - protein, 171 aa, Lactobacillus buchneri
DHNTPPYRPHSPHHYDRLASEMNTQKVQTAIELLRANSQGLRDRKSPFHLSASAMVFEGGKGIFIRHPYLHTILLPAGHVEPHEMPIDCAIREFTEETGLVLKTSPNSLIDVNIIDIPANPQKDEGAHQHLDFRYWFSSIEPHTKYRPELPVFQLKRREAPAEFQPYFALI

SEQ ID NO: 4361 - protein, 144 aa, Lactobacillus buchneri
MDNQIITRKMQAEDYPNAYALWQQVPGMNLREFDDSFEEISRLLRFNPNFCFVAETKTDKQIIGSILGATDGRRGTIYHLAVAPGYQNQGLGTQLVNKVIEQLQAVGIHKIFVNVMKDNLAGQSFWQQLKFVKRSDVIRFNKII

SEQ ID NO: 4362 - protein, 280 aa, Lactobacillus buchneri
MVDLKLIHQVQLGILANVAAINSKYHLEYFLTGGSAIGAVRHHGFIPWDDDIDIGLPRTDFEKFLQVAPAELSHRGYFVEENRLDPQYEYDFAKVMADGTRILEHGRELTKAKNGIFIDVFPFDRMPNKRPQQEKQQAKLAMLLEEIRKRFYPDLYQQSITQSKYADYNLSELYDIRLSTMTQYNGHSELPLINMSSPYQYGKELIKPTEIHHLIPMAFENLQVPVLADYDAYLTRLYGDYMKLPPLNKRIQRHVLKVRVDNYQTNTQVESGNSLEGAVS

SEQ ID NO: 4363 - protein, 365 aa, Lactobacillus buchneri
MQSSQYIQQNQQLVQTLPTYINEYYLDKSTVPLSPATLYQYLNEFHRFFTWMIDVGITDVKTVKEIPLSALEHFKKQDMELYKSYLLNRGKQTASHPQAPISHRTVNRSLNALSAFFRYLSEETETADGEPYFYRNVMKKIALVPDSETYQTRANNIKDQLMLGDADVKYVEFIQNDYPKTLTNKRTLSLYQRDRERDVAINALMLGTGIRVSELTNANVSDLNLSKAAIVVRRKGGKYDSVPIASWVLPYLATYLNVRKQRYLATKTTPALFLTKGASQPRRISTATVELLVAKYSQSFNHVRITPHKLRHTLASKLYLETNNEHLVATQLGQSSTNATGLYTHIIDTKQRQALDELHRDKQRH

SEQ ID NO: 4364 - protein, 385 aa, Lactobacillus buchneri
MIKWSNKTIKAFQETLLAWYDQNKRDLPWRQDQDPYHVWVSEIMLQQTQVETVIPYYLRFMNEFPTIEDLAAAPEDKLMKAWEGLGYYSRARNLQKAAQQIVFDYQGQWPTTAKELQELSGIGPYTAGAIASIAFGQPVAAVDGNAFRVFARLLEIDDDVAKPHTRQVFEKIINPIVPKNRPGDFNQAIMDLGASYMTATNYDTSQSPVKDFNQSYLDGIEDHYPVKTKKKRPVRHDYFGVVIHSKAGYLFEKRPSHGILANFWMFPLFDRKNLTDDQPVTESTLIDIIETRLQTDYQLSVALHPVSTPTVVHTFTHQQWKIKLLEGQIAENIDLSYFPGKWIHSSEFDQMTFSKVQSKMWSAYQKTLKSTQSIDESAVDQKTNR

SEQ ID NO: 4365 - protein, 173 aa, Lactobacillus buchneri
MEDTAIFAGGCFWCMVKPFDTIPGINKVVSGYTGGHVPNPTYEQVASHTTGHTEAVKIFFDPEVISYDKLVEIYWHQTDPTDAMGQFQDRGDNYRPVIYVKDEQQRKIAEASKKALAESEQFDSPIVTQIEDAKPFYPAEEEHQEFYKKNPLRYQMEEMGGRENFIKKNWQKN

SEQ ID NO: 4366 - protein, 142 aa, Lactobacillus buchneri
MDKQELKNKLTPEQYDVTQNKGTEAPFSGQYDDFYQAGIYVDVVSGEPLFSSTDKYDAGCGWPSFTKPIDPANIDKHLDTSFGMIREEVKSKQAGSHLGHVFPDGPKDAGGHRFCINSAALKFIPVAELDAKGYSKYKQLFE

SEQ ID NO: 4367 - protein, 308 aa, Lactobacillus buchneri
MSKELVFGHQSPDTDAIVAAKAYSYLQNKLGYDTEAVALGEPNSETAFVLNYFDEPTPRIIKTAKNEVDSVMLVDHNEFQQSVSDIKDLTITHVVDHHRISNFQTDQPLYYRAEPVGCCSTIIVKMFDENKVEIPAQLAGLMLSAIISDTLLLKSPTTTEEDKIAVKTLAEIADIDYEKYGIEMLKAGTNVSAKTDQELIDSDAKSFTMGGKSVRIDQINVVEFSEIDKRKNDIENAMKAEAADKGYDLFLVLITNVLNSDSKMIVVGEPASAVEKAFNSKLSDDTMSLPGVVSRKKQVVPPLTDALS

SEQ ID NO: 4368 - protein, 319 aa, Lactobacillus buchneri
MKTTQENIFASKTLSYFLQLSETMNYTQAAQILGITQPALTQQIKKLEKTMGTELFYSVGKKLRLTDAGVIMLKTTRQIYDLLNDANDQIQQATSSTTGQINLGILASVETKVFEDFALALYQENPDLEVNFHMLTRKEIWESLENNRIDLAIMYLPDESIKNWKPYSSKKIISDDLLFIHHNPSLAKRKRVHLKDVNDRPWVMYPQDYYLNQTLRESFKNQMVDWPKVAARYTMPEQILKFAINSHTNTALPKSYMLNIDLKKLTDDDIWVTELDPKVKFDLNFVYRNRKNEIPRIERFLQKFDEFLAKEDYLARLGK

SEQ ID NO: 4369 - protein, 812 aa, Lactobacillus buchneri
MSKIESLTLEDVMGERFSRYSKSIIQERALPDIRDGLKPVQRRILYAMNKDGNTYDKPFRKSAKSVGNVMGNFHPHGDSSIYEALNRMSQDWKVREPLIEMHGNNGSMDGDPPAAMRYTEARLSKIASEMLRDIEKDTVDWVLNFDDTEYEPTVLPSRFPNLLVNGSTGISAGYATDIPPHNLGEVIDAILYLQKHPDATLDDLMQFVKGPDFPTGAIVQGIDGIKKAYETGHGKIIVRSKTSIEPLKGNKSQIVITEIPYEVNKAQLVKRIDEIRLNKKIEGISEVRDQSDRNGLSIVVELKRDVDSKGILNYLFKNTDLQVSYNFNMVAISHMRPERLSLKKILVAYLEFQQEVIEKRTKYNLKKAQDRQHIVEGLIHALSILDKVIKTIRASKNRKDARDNLVKTYDFSEKQADAIVALQLYRLTNTDVTELENEHQHLADEITKDNKILNSPKELNRVLANELRALAKTYRSARRTEIQAEVSDIKINTDVLIPDEDVIVMVSHDGYIKRSSIRSYKASTTDTGLKDEDYPIFMAELNARDHLFMFTNKGNLIYRPVFELADVKWKDTGEHISQTIGLDADEEIIGTYAFDSLKQPGTFLIATDQGHVKQTGFADMKPGRTYKSHAYTYEKLKTDDERVVAIHYLKTPATAGQMLLISNNGLALRYGIDEVPVNGARTTGVKSMGLRGVDKVTNLQLVSEDDVLAIVTQRGSFKKLAVKEIPATSRARKGVMILRELKNNPHRIVDFCRIESEDQPLEVRTDHRRVHDILPADYSLGGRYSNGSFVIDVDSEGTPVSIRPKFVGLSID

SEQ ID NO: 4370 - protein, 651 aa, Lactobacillus buchneri
MVKQKQKYDDSSIQILEGLDAVRKRPGMYIGSTDSRGLHHLVYEIVDNAVDEVLAGYGDEIDVSIHKDNSITVVDHGRGMPTGMHASGKPTPEVILTMLHAGGKFGQGGYKTSGGLHGVGASVVNALSTWLKVVIVRDGYRYEEDFKNGGHPVGTLKKLGKTRAHSGTTVTFKPDPTIFTSTVYNFSVLSERLRESAFLLKGTKITLTDERTDQEQEDVFHYEEGIKEFVQYLNEDKHTLGDVMYFDGKKDGVEVEVAAQYNDGYSETMLSFVNNVRTKDGGTHEAGLRNAWTKAFNDYARKVGMLKEKDKNLEGSDVREGLSVVLSLRIPEEILQFEGQTKEKLGTPEARSIVDNVVSEKLGYYLMENGEFAQTLVHKALRARQARQAARKARDETRTGKRHKKQERLLSGKLTPAQSKDYSRNELFLVEGDSAGGSAKQGRDRRYQAILPLRGKVLNTERAKLPEIMKNEEINTMIYTIGAGVGADFNIDDANYDKIIIMTDADDDGAHIQILLLTFFYKYMRPMIDNGRVFIALPPLYKLQKGAGKKLKVQYAWTNEELNKVSKDFGKGYSLQRFKGLGEMNADQLWETTMNPDTRTLIRVRIDDAALAEKRVTTLMGDKVEPRRKWIEHNVKFNLEEDGSILDNTSD

SEQ ID NO: 4371 - protein, 212 aa, Lactobacillus buchneri
MNSNIEQIIMLLVLAYLLGSIPSGVWIGKIFFHIDIRRHGSGNIGTTNTYRVLGPIAGSIVMALDISKGAVATLLPTFFHITAISPLIFGLMAILGHTFSIFDKFKGGKAVATSAGMLLAYKPAFFFLAAGIWILVILLTSMVSLASMIGFTLTTIAIFFTHDILLSVMAVILTFFIFYRHRANINRIKNGTESMVPFGLGNRLRKRKDPNE

SEQ ID NO: 4372 - protein, 291 aa, Lactobacillus buchneri
MITLKNQYLTVLINEQGAELTSVKDTDGLEYIWQADPAFWKRHAPILFPIVGRLKDNQYTYAGQTYEMTQHGFARDNQFEVESQLPTKVSLVLRPTEETLAKYPFKFELRIIYELVDHQLNVSLNVINPSQDTLLFSIGAHPGFNIPLVKGEGNFEDSFIRVAPKKSYVQIPLKPPYSDPNDPQAIDLTKPLPLNHELFNSDAIVLSLDRQETTVMLANAQNDHGVSLTVENAPYVGIWSPYPKKAPFACIEPWWGLADTVNADGKLEDKFAINQLAGRHAFAGRYSISFF

SEQ ID NO: 4373 - protein, 470 aa, Lactobacillus buchneri
LTESTQTPKEIVSVLDQYIVGQNEAKKAVAVALRNRYRRMQLSKDMQDEISPKNLLMIGPTGVGKTEIARRLAKIVNAPFVKVEATKFTEVGYVGGDVESMVRDLVENAIQLERADQYKQVHVEAEKQANNRLVKLLAPAKKKENRQNEMQNLMNMFTQMQNGQMPSENQDDQEEVTDDIREKRMSIAEKLKAGLLENDQVEIEMDDPSQQPAGQSTMMNQMGIDLNDTLAGLMPKKKIKRTVPVSEAREILTRQASEELINKADLYHNAIVRAENTGIIFIDEIDKIAPGKSQNSGEVSREGVQRDILPIVEGSQVNTKYGTVNTDHMLFIGSGAFAENKPSDLIPELQGRFPIRVELNDLTKEDFVRILTEPTNSLTKQYIALIGTDNIKVTFTIEAINRIAEIATDVNHNTDNIGARRLHTILEKLLEDILYEGPDMQMGDITITEKYVDDKVGKLAQNKDLSRYIL

SEQ ID NO: 4374 - protein, 180 aa, Lactobacillus buchneri
MPIKFEATTIVAVRHNGHLAMAGDGQVTMGEKVIMKGTAHKVRRIYDNQVVVGFAGSVADAFNLEERFEKKLNQFDGDLKRSAVELAQEWRGDQQLQKLEALLIVMNDKDLLLVSGQGEVIEPDDDILAIGSGGNFALAAATAMKHHAQDMSAREIAEAAIHIAGNIDIFTNQNVISEEL

SEQ ID NO: 4375 - protein, 314 aa, Lactobacillus buchneri
MAESDEDQKNIQWFLKYLQSDRHYSTDTIQAYQQAIAEFTRFLAEIPSERKPLTQVDSFDVEAFLSDLYERKYARNSIAQKVSALKSFYAFLVKNTVIANNPFEYVHLKTNHRRLPRFLYQNEMRALFQGAGQNPNHQLGLRDTAVLETLYATGIRVSECAGIQLNDIDLDNRTILVTGKGNKQRYVPFGEYAQEAIETYLSDARSPIMAKYHQDHPFLFVNHYGRPLTSRGIEYLMDQIVKQSSLTTKIHPHMLRHTFATEMLNNGADMRSVQELLGHSSLSTTQIYTHVTKSHLMNDYKKYFPRNNDSLKSN

SEQ ID NO: 4376 - protein, 120 aa, Lactobacillus buchneri
MRQNQLIDKINAKQLRNDIPDFRAGDSVRVYVKVVEGTRERIQLFEGVVIKRKGSGIQATYTVRKVSNGVGVERIFPLHSPRVDKIEVVRQGHVRRAKLYYLRDLQGKAARIRASLRSRG

SEQ ID NO: 4377 - protein, 266 aa, Lactobacillus buchneri
MRIDVLSLFPEMFAVPMHDSIIGKAIENHIIDLDVTNFREFTTDKHRHVDDYPFGGGAGMLLQAQPILDAYDHTKQTAEAAGYPKGKVILMDPAGKPFKQHDAEELSHDDHLTFICGHYEGYDERIRSIVTDEYSLGDFVLTGGELPSMVMIDAITRLIPGVLGNHQSSVEESFSTGLLEEPQYTRPAEFRGMKVPEVLMNGDHKKIALWNQKEALRRTYLRRPDLIDHHNLTSTQKKLLADVRIEEEEKQAAKDTDKKNTFTDDE

SEQ ID NO: 4378 - protein, 173 aa, Lactobacillus buchneri
MNYYNIGKIVNTQGLKGEVRVISITDFPEKRFKVGNTVFAKLPNKHEQVALTIDGVRKHKGFILLHFKNHPSINDVEYLKPSELKIDEGSLSSDDLKPGEYYYHQIIGLDVVDPNGNPIGQVKEILSPGANDVWVVERDQHKDLLLPKIDSVITNVDLDAGKITADVPEGLDE

SEQ ID NO: 4379 - protein, 82 aa, Lactobacillus buchneri
MTSIDGLINKIISPLVDYPKDIEISHNESDRFMEYHLKLNEEDIGRIIGKHGHVIQTIRTIVYSVPVEGQKKARLIVDDGKQ

SEQ ID NO: 4380 - protein, 91 aa, Lactobacillus buchneri
MSVKIRLKRMGSKKRPYYRIVVADSRSPRDGRFIENVGTYSPLTQPAKITLEEESIMNWLNNGAQPSDTVRNILSDAGIMKKYHEAKYSKK

SEQ ID NO: 4381 - protein, 479 aa, Lactobacillus buchneri
LAFEGLTERLQNAMKTLRGKGKVSQSDLRATMREIRLALLEADVNFQVVRDFVKTVEERANGAKVLEGLNPSQQIVKIVDEELTKTMGEEAVPLNKAEKIPTIIMMSGLQGAGKTTTAGKLALKLKNEQNARPLLIADDIYRPAAIDQLQTVGQQIDVPVFSLGTDVDPVEIAKRGVEQAKQDHNDYVIIDTAGRLQIDEKLMDELSHIKDAVEPNEILLVIDAMTGQNAVATAEGFNKTLDVTGVVLTKLDGDTRGGAALSIRAVTQKPIKFVGQGEKMSDLDVFYPDRMASRILGMGDMLSLIEKTQKEYDEKQAQELSEKIQENTFDFNDFVDQLNQIQKMGPLDEIMKMIPGMANNPQLKNANMDPKDMDHLKAIVYSMTDQERTDPDVLNPSRRRRIARGSGRPIQEVNRMIKQFGQMKTMMNKVSKGNMSGMENMMNSTGMGGKMSKLAMKQFSRKMKKNKKRRLKKKNKKRR

SEQ ID NO: 4382 - protein, 113 aa, Lactobacillus buchneri
MELEKNNYINSLFEFYEPLLTKKQANYIELYYADDYSLGEIAGEYNVSRQAVYDNIRRSEKILQQYEDKLNLYHSFVDRNDKLDHIQAYIQKKYPHDDKLNSMIKNLETTEEQ

SEQ ID NO: 4383 - protein, 446 aa, Lactobacillus buchneri
LGLFDIFKRRSKKDDEKKPTESTEQTEPKPEAPAKDDQSAATSNQTTTDVEESAKATKSPADEPAEKTEKQPTEQPEESNGQQTTKQPDDAQKPTPTVSEPNSSAEQESSTEESDMPAEPEKWVESPEPAESATDSNTQQYEKGLEKSRSSFGQKLNALLANFRHVDESFFDDLEDMLIESDVGFETSMRIADELRDEVKLQNAKKPKDVQNVIVKKLIDMYDQAGNGENSAINMAKSGPTVIMFVGVNGVGKTTTIGKMAKMYKDQGKKVVLAAADTFRAGAIEQLNVWAERDGVDIVKGKAKSDPASVVYDAVVKARKEDYDILMVDTAGRLQNKVNLMNELSKMKKILTREIPEAPHEVLLVLDATTGQNAMTQAKMFKETTDVSGIVLTKLDGTARGGIVLAIRSELHLPVKYVGLGEQVGDLKPFDPNDFVYGLFKGLISE

SEQ ID NO: 4384 - protein, 1183 aa, Lactobacillus buchneri
VQLKSIEIIGFKSFADKTLIKFPGGMTGIVGPNGSGKSNIAESIRWVMGEQSAKNLRGSRMPDVIFSGSADRRSLGMASVTLTLDNSDHFIKSPFDELKLSRKLFRNGDSSYYLNEKQCRLKDITDLFMDTGIGQGSLSIISQGNVEQIFNSKPEERRSIIENVAGVYKYKQHKNTAQKEIDETSDNLNRVEDIISELQSRMAPLEEQSSLATDYLDQKKRLDQFEKQQLILATQKLIAASQQLKHTVSEKSDLVNKIYAQVRRDENDRDKLKANLTQNRAKIDQINEQILTATEQIQSLKSKHQLSAQEKSFKDADLNRISEQIKLTDKQIDDFQVKLTQSVDAGKRLSEKIAAKQADFDKLAEAQKANSVSVIESEIDQLRNQYVDLLQQKTDIKNQITMKTHDEAQLEQQLGSQRQRINKVREDLGQTQAELANKQAALASSQAELTDVSKQLGDLTQLMNTHQQAVDSSQANWLAALKIAEQAKAKAESLKNLHDSYRGFYRGVANLLKRKNQLTGILGPVSDYLTIDQRYVKAIETALGSQAQHVIVEDNRAASSAIRLLTKERLGRVTLLPISTIKSRRLSSTIVHESQEVLGFIGVAADLVSMPDNLNQIKGFLLGTTIIADTLDHAINISKQINQRTRIVTLDGQVVNAGGSLTGGASRHDNQGVLVQKSELAALNQSTAQMDQKLTENERQLQHAKDELAKINASHERGQRKAFEIRQQTATLEDQCHSLEEAVQEKQREFKTLQLALKNAAQSDGTTDTDQLVNRQDAIDKQLRAVNDDLDNKRVQLANVKQSAQKFTTEKQQVREAIVVEQQKLNQLEVDQTGIKKQIATHRQNRDRLIQQRDHLKAELSRQVDAGTLNEQIKTAEANQHALNLTQNKLKATVGEAQDHLDQLNQKIQDEQINLNNAKYELTSAQTAAAKNHQDLDTNFATLETTYQIDQHDLANPDWNWDEKQVASQIKMLRTGIDEIGPVNIGAIQEFKEVSKRFEFLTSQKQDLLDAKDHLTATMRDMDDTITTKFAMAFKQVSQAFSKVFVDMFGGGEAKLVLTDPNDMLDTGIEIMVKPPGKNYRNLNLLSGGEKALTAITLLFAIIKVRPVPFCILDEAEAALDPFNADRFAKYLKRFGDETQFVVITHRKETMIYADQLYGVTMQESGVSKVVTVNLDNLKTEVS

SEQ ID NO: 4385 - protein, 236 aa, Lactobacillus buchneri
LIKGLNEMLKQDFGIHIDDQDLLDEAFTQASYVNEHRGEGLKFYERLEFLGDAVLQLIVSDYIFKRYPKMPQGRLTRLRAAMVNEQSFSTFARECHFNQYIRLGKGEEKAGARDRDSLLCDIFESFVGCLYLDQGQAEVTRFVTKVIFPKLDEGMFAEFFDHKTELQELAQADGPVAIDYELVDEYGPDNDRSFKVNVSIDGKLYGVGIGHSKKGAEQKAAQQALEQFDTEGDNLV

SEQ ID NO: 4386 - protein, 80 aa, Lactobacillus buchneri
MDKDEVFNKIADLVADQFDVDRSKITGDLNFKNDLDADSIDFVEFVLDMEDTFNAEISDEDAEKLNTINEAVDFVMAHQK

SEQ ID NO: 4387 - protein, 347 aa, Lactobacillus buchneri
MKIAVDAMGGDYAPKEVVEGIELARDAYADVEFQLFGQTDQIKKYLKNDDRIQIVQADEVIEMGDEPVKAVRTKKQSSIVLAATAVKEGTADAFFSAGNTGAILAAGLFIVGRIKGIDRPGLTTTLPVIGVKNQDKFVMIDVGANADTKVLNIYQYALMGKYYAQNVNQVENPRIGLLNNGTEADKGDMNHRKVHDLLAADKDINFVGNVESRELLNGAADVVVTDGFTGNAVLKSIEGTALSMLSLIKTTIMDSGTKAKFGALMLKDAFHKIGGSMDYSQYGGAVLLGVKAPVVKTHGSSKADTVKNTIGQIRQIIASNMIPDLNQYVVDHNDELQQIKDSIKSSK

SEQ ID NO: 4388 - protein, 676 aa, Lactobacillus buchneri
LASLSDSVRVLKGVGEKRLTALNKLGINTINDLLTYYPRRYDDLSLKDLRTAVDGQKVTVKGIVISEPTVRFFGRRKSRLGFHLKINDEIYNVTFFNQPWLKKQLELEAQVIIFGTFDRNRNQIQGMKILNGEKSDTYDSIYPSNKEVKQNTIKQLIKLGFDEYQDQLVDVIPESIRTKYRLESFRDTIQNIHFPTSPVAAQKAFRTAKFMEFFLFAMKIQILKQRHRKPDPAAKVAYDPDLVKQFTSQLKFKLTDSQNKVVNEILSDLGKPLEMNRLLQGDVGSGKTVVAAIAILAAISAGKQAAIMAPTEILAEQHANTFAKLFEKFDVNIALLTGATTGLARKAMLPRIADGEVNLIVGTHALFQDQVDYHDLDLAVIDEQHRFGVNQRQALRLKGNSTNMLAMTATPIPRTLAITMYGDMDVSVIDELPKGRKPIKTTWITSAKTDSAIRFVKKQLDAGNQVYVVTPLIEESEAVDMKNAMAIFDRFKAIFEPQYSVGLLHGRMSDEEKDTAMADFKNNQFQVLVATTVIEVGVDVTNANTMLIFDADHFGLAQLHQLRGRVGRGDTQSYCILIADPKNELGKKRMTAVASSTDGFFLSQKDLELRGQGDITGSKQSGMPDFKVADPVGDLNILQVANQEAQSITVHQDWQKQPENVQLSQYLKYNETITTD

SEQ ID NO: 4389 - protein, 570 aa, Lactobacillus buchneri
LLKVTEITNTEFTAMVQAAATKLNKNSDFINSLNVFPVPDGDTGTNMSLSMASGYKYVNKDVKTNVGDLTAALAKGLLMGARGNSGVILSQIFRGFSKSTEGKETLSAQDISDAFVAGTEIAYKSVMKPTEGTILTVVRMAATAGKKAAATTNDVVAVMDAIYQASQSALEKTPDLLPVLKQVGVVDSGGQGLVFVLEAFDDVLNGRNEAESGEYQPNDAEMNQMIKVADQSVQSKLNPEDIVYGYCTQIMVRIGKGREVDHQFDYQTFYDYLAKLGDSLLVINDDDIVKVHVHTEHPGKVLAWGQEFGDLATVKVDNMRLQQETIIEEDEDSQEDASPIQKAESISTQQPTSDTAIISVSSGKGLNQLFESLGVNYIVSGGQTMNPSTEDIVNAIQNTKAKQAIVLPNNKNIFLAAEQAAKVVDIPTVIVHSKTISQGITAMLGFNPENSLEDNQKAMEDNLPTVKSGQVTTAIRETKIDDLDIKKDQFMGIVDGDIATVGDKLIDTAIQMVKKMLDDDSEAITIIYGEGADQAAAEKVQAGILKLDDELEVEIHEGDQPVYPFLISVE

SEQ ID NO: 4390 - protein, 120 aa, Lactobacillus buchneri
MAVKIKTRFGTVDIDNNVIANVVGGAATDNYGVVGMASRNQLRDNVNTILNRENYFKGVVVKQHDNEIEVNVYIIVAYGNKISEVSKNVQAKVKYNLQSMLGVSANSVNVIIQGVQVMND

SEQ ID NO: 4391 - protein, 61 aa, Lactobacillus buchneri
MAKDFINGKRTHFGNKRSHALNSSRRSWKPNLQKVRILVDGKPKKVWISARTLKSGKVTRV

SEQ ID NO: 4392 - protein, 220 aa, Lactobacillus buchneri
MKILNLLVGGPIDLWPDELKNGQIKGDWIGIDRGNLHLIERGIDPLVAIGDFDSLKPAELQLVRDHIKDIRQSIPEKDDTDTQLGLKVALQEHHADRLDIYGATGGRLDHFLANLWMVLEPRFKPYAPKIRMIDKQNTITFFLPGTYQIEKEPDKKYLAFVALTPMDHLTLFDEKYQLNDYQVKHPMSLASNEFVGETARFKFGSGVMCVIQSKDINRYN

SEQ ID NO: 4393 - protein, 217 aa, Lactobacillus buchneri
MIKVAPSILSADYVNLQKDIEKVDQGGAEVLHIDIMDGQFVPALSYGPGWVKAIRPITKMILDVHMMVEQPERFIDQFADAGADIIGVHVEATPHIHRALQMIKNKGVKAEVVINPGTPVSAIKPVLYMVDQVLVMTVNPGFGGQKFLPETVKKIAELDELKKTEGLNFDIEIDGGVNDHTVVGAYQAGATVAVAGSYVFDADDPVSRIKAIKDATK

SEQ ID NO: 4394 - protein, 296 aa, Lactobacillus buchneri
LKQGKIFQSLSGFYDVHSEGKVYRTRARGNFRKRQITPLVGDDVEFQVEDGDKGYILKMLPRKNSLVRPPIANIDQAIVATATTQPEFSSNLLDRQLIALEIANIKPIIYFTKTDLLSEKQLNYFKDLAVAYANIPYDVILPEAAFDENSLNHLRQLFSGKENVIMGQTGAGKSTLLNHLAPDLQLATGEISAALNRGKHTTRKVALLRVNDGYIADTPGFSSYDTLEIDYRQLASYFPEFKRASVKCRFRGCVHVNEPDCEVKKEVASGDIMQSRYENYLQLYTDIKNRKPNYKK

SEQ ID NO: 4395 - protein, 680 aa, Lactobacillus buchneri
MNKGYVLNGRYEIIGRLGEGGMADVYLAEDLILKRKVAVKLLRLDFRDNPKAKKRFQHEAMAATQLDNPHIVGIYDVDEVEGMQYLVMEFVDGEDLKKYIKDNFPIPYAEVVNIMEQICSAVSEAHRHNIIHRDLKPQNILVDKNGYIKITDFGISRAGTEDTMTQTRSIIGSIHYLSPEQIKGQMATARSDIYSLGIILYEILTGKVPFNGDTAVSIAIKHSQTPMPSVRDFDPRIPQAMENVVLKATAKNPDDRYQTVNEMAADLNTSLDKSRANEPKFTVQPPQNPVDEATRVMPFSPLDDTTASADANPAKREEKPAGTSNDKPKPPKKKRRRRWWIIGGIVGLLLIILAFIMIVSANGKTTVPIVSGTLETEAEAKIKAANLTVGSVKYQSSDKIDRHRVISSSPKEETKVKKGTKVNLVVSSGPRRVRVGNYVGQEYDVVKQKLEDEGFTVHRRNAPSSSFGSGRILQQDFESGKRFNPATKTLTFVVSTGVKRITLKDLTGMTKAQVVSYSNKVEINPTFDYVYSDDQPKGRVVRQSPNANESIQQGSNVAVWISRGPKKDSSDELKSFNVKITIPYLDNSSAASSDSTLNESGISSDAASTDSSSGSNENVVLIYLKDHDHSLSTVYKQMVITKDTQVTLPFKLSGNEVGQYKVVRDGRTIMRDNNVTYDSH

SEQ ID NO: 4396 - protein, 249 aa, Lactobacillus buchneri
LQIAYQSSTGKVRDKNEDAVGAFKNQTGLILALITDGIGGNNAGEVASQMVVTHMGAAFETTSISSLDKIETWFENQLAKENTAIIDESNTDTRLHGMGTTIVATLIDGKQSLIANIGDSRGYVYSNGQFTQITEDHSYVNELVKHGDITPDQAKTNPYKNIITKSLGINNDSAADFKPYTAQPGDQILLCTDGLTNMVDDADIEKILSMDEELQTKCDMLVSLANQNGGLDNITVLIAQYDSEVTADE

SEQ ID NO: 4397 - protein, 443 aa, Lactobacillus buchneri
MKYTTNNPRQLAVMTLVRTSNGSYSNLQINAVIQSTSMGPADKGLFTNIVYGVIQHRLTLEYQLRPFLREPEKTETWVKELLYTAMYQLEYLDRVPKRAIFDETIKIAKQMGHDGTRRFVTGILHQMDRQGMPNLDDIQDEKTRLSIEYSVPTWLVEMLDEQLGKPKTASILASLNKAPKQSVRANLAKISQKDLLADLAKDGYDAEPSQVSSEGIIINDGQIIHSDFFTDGLLTIQDESAMLPVESMQISPDDNVLDACSAPGGKTTQIASRLKAGKVFALDIHKNKLKTVQRNATRLGVYKQVETFELDARKVDTKFEDGLFDSILVDAPCSGLGLLRRKPEIRYDKTIADINRLSEIQLQILNAVSAKVKTGGTITYSTCTIVKQENQDVIAKFISENPNFDITKTKTANHLNPDSKMVQIYPDDYDSDGFFVCSLIRKS

SEQ ID NO: 4398 - protein, 314 aa, Lactobacillus buchneri
LTTVVFMGTPQFAVPILQGLLDQKYDILCVVTQPDRPVGRKHRISQSPVKQAAVANHLPVFQPEKLSGSPEMQRVIDFHPDLIVTAAYGQFLPTKMLNAVKIAAVNVHGSLLPKYRGGAPVQYAIMNGDSETGISLIYMVKKMDAGDILAQKAVPIQPDDDTETMFDKLSIVGRDLLLATLPKVIAGDISPVPQDEDQVVFSPNIKPEEEQLDFNQTAFMVNAKVRALRPDPVAYTVINGKRTKIWGAQVVDQTTEMAPGSVVEKTKHQLLLSAGKGTVLSIQELQPAGKPKQQITDYLNGIGQSLKVGQQVIK

SEQ ID NO: 4399 - protein, 799 aa, Lactobacillus buchneri
LQVAQVIVDVPARQTNSPFSYSIPDHLADQIQPGMRVQVPFGNRKITGFVVGLSDSSSFNGKLKPIADLIDLYPVVNSELLNLAEWLADQTYSFKISCLQTMLPGGMRTKNQKKLIAKNEQVCQQYPEIFQGQPEVEYDRQKYNNQVLAEILNLQKAGDIQVEYDLTNHARPIMRKAYRGQLNDAQIADALKTVRKNARGQIQLLNLLKTHQNDTLLVSKWASLGVTSATLKAAEKKGWVTSTLKRHVRNPFLRDVAPSQPFKLQPDQQAAVDSIEQAVVHKKDQVFLLEGVTGSGKTEVYLQSIAHALELGRTALMLVPEITLTPQIVGRIRSRFGDQVAMLHSAMSSGERYDEWQRINQGKAKVVVGVRSAVFAPLSNIGLIIMDEEHDSSYKQADNPRYQTRDVAKWRAAYNNCPVVLGSATPSLESRARAMKGVYTLLKLPHRINQHALPHVSIIDMKTELAKHHSALSTKLADAIQVRLDKHEQVILLLNRRGYSAFLMCRDCGYVPRCPNCDISLTMHKNTHTLNCHYCGHKEPVPTVCPQCHSKRIRFYGMGSEQLEEQVKDMFPTARVLRMDVDTTRKKGSHEAIIDQFGAHKADILLGTQMIAKGLDFPEVTLVGVLNADSALQFPDFRSSERTFELLTQVSGRSGRADKTGEVIIQTFNPDHYAIQLAKTQDYEKFYATEMRVRHDGKYPPYYYTVKLTGNSPSENQTASEMFGIMNFLKKQLSPQAIILGPTPKTITRIDNRYYYQIIIKYRKEPQLKATLDEILVQSQKKQRQGLQIAIDNEPLDFM

SEQ ID NO: 4400 - protein, 403 aa, Lactobacillus buchneri
MFQNKNVAVFVTGSIAVYKSLSLVRLLVKNHNDVHVIMSEAAQKFVTPLAFQTVSKNTVLTSDFDSKDPTIIPHVKTADDADLAIVAPASANTIAKLANGIADNIVTSTLLTMAVPVFVVPAMNTHMLANFATQQNIANLKQAGIQIMEPAEGFLAEGYSGKGRMPEPGEILTWVDESLKLKGGSLAGKSVVVTAGGTREPLDPVRYLTNHSSGKMGFAVANAFKNAGANVTLIAANPLITPPSGVNFIRVETAAELLAEVKQAFVHADILVMAAAVADYRPAKVANKKIKKTADNQTMTLELVRNPDILKEIATIKHPGQLVIGFAAETNDLISNATKKIQSKNLDMIVANDVSQSGIGFNADNNQVTFLFAAGKQIKTNVESKAKVADQLINIIATQMQNQ

SEQ ID NO: 4401 - protein, 70 aa, Lactobacillus buchneri
MLLYPSVDKLLDKIDSRYSLIALSSKRAHELDAGAKPLLDHYKSQKSVGKALEEIAAGVLKIDPKAKDFE

SEQ ID NO: 4402 - protein, 204 aa, Lactobacillus buchneri
MAKRGMLIVLSGPSGVGKGTVRKALFEEPDVDFEYSTSMTTRKPRPGEKNGVDYYFVSKEQFEENIQNGEMLEYAKYVDNYYGTPLKYVNETLESGKDVFLEIEVNGAMQVRANVPDAVFVFLTPPDLMELKHRLVGRGTDKMDVINKRIKKAVGEISMMRNYDYAVLNDQVPLAVDRIKSIIRSERLKVARVMPDYESMLGDK

SEQ ID NO: 4403 - protein, 101 aa, Lactobacillus buchneri
MQNKQSYLSEITKTFRTNYDRFFEIVRNTHQIKQMPTFQLNYFIQQTLENNFPITIEFNDQDNEQTGYLTKLSADRYLLTSDDNHFTRIVKLSEIKAIRKY

SEQ ID NO: 4404 - protein, 567 aa, Lactobacillus buchneri
MLLELSITDFAIIEHLDIDFQAGMTVLTGETGAGKSIIIDAVGLLVGGRGSHDLIRTGASKAVIQGNFILHDDNPTYNVLDDLGIDHSDGNVIIERVIFANGRNSCRVNGIMVNIATLKRIGETIVDIQGQNDHQELMRPERHIQLLDDYAEDELADVLQSYQDQYDQFIKLRDLNQKKHQNEKQWAQRVDMLKFQIKEIEAADLHENEDTDLVAERDRLNNFQKIHDALLASYEGINGDEEASGSIDSIGSAMSSMQDIEDLDPEYKQISDNLSGAFFALQDVASQISDQLSNLEFDQDRLDQVEQRLNTIYQLKHKYGDSVSQILDYLAKIKQELKQMSGDAEASDDLDKQLATLKSDLIQQATKISDIRHRWAKKLEKAVHQQLSDLYMDKTVFEVNIQQNRALNRLGADRVEFYIQTNPGEKMLPLVKSASGGELSRIMLALKTMFAKAAGVTSIIFDEVDTGVSGRVAQAIGNKIYTISQKSQVLCITHLPQVAAMSDHHDFIEKKIADNRTTTTITELTTAQSVAEISRMLSGTAITKLTKEHASELLKLADEEKQKIKAS

SEQ ID NO: 4405 - protein, 152 aa, Lactobacillus buchneri
MRKKERQRLIKQLLTSNNIQRQEDFVSLLDKQGIKVTQATVSRDIKDMQLVKVPSVTGGYRYSLPTQKNIDTEKKLVQSIRDSFVSVDSQDKLVFMKVLPGSGPVISSLMYQMNYSGIFGTLGDDNTVLIIGKTEADAINMRNQINSMLGTE

SEQ ID NO: 4406 - protein, 271 aa, Lactobacillus buchneri
MEKQRVDVLLVTQGLFDTREKAKRAVMAGEILGDNEERLDKPGTKIPVDTDLHLKGKPMPYVSRGGLKLEKALKVFHLNVKGLTVLDIGSSTGGFTDVMLQNGAKLSYALDVGSNQLVWKLREDPRVVVMEHTNFRYSKLADFTHGQPEFASIDVSFISLELILPPLKQIITKNGHVVALIKPQFEAGKANVGKHGIIKDPAVHKMVLEKILNFAVANGYSVQNLDFSPIKGGAGNIEFLVELESDDQPVMSPNVSIEKVIENAYSELKGS

SEQ ID NO: 4407 - protein, 297 aa, Lactobacillus buchneri
MATKLTDFERLWVPKINQILENDIKPDTDQTTLEAAMSYSVNAGGKRLRPLLTLAVLASLGDPIDQTVLKTSCALELMHSYSLIHDDLPAMDNDDLRRGKPTNHVKFGAGMATLAGDGLQPLAFQWLVDNDLDSQTQAELTLALAKAAGPHGMVSGQADDIEFEGTRLSLSGLQKLDRNKTGALIRYAVEAGLIMGRVIPEKRKSLLTFAEKFGEAYQIYDDILDVVGTEAEIGKPVHQDANKNTYPNLVGLAKSYEMLNQTVADAQQALVTAREALSIDTSLLNDFTSYFKNKDEK

SEQ ID NO: 4408 - protein, 88 aa, Lactobacillus buchneri
MPDKQDNQTFEEKMDQLETIVNQLEQGNVSLEESMAKFKAGIQLSEQLQDTLTKAEHTMAKMMDKDGNEVEFEAPKDEKDDSDGNQAN

SEQ ID NO: 4409 - protein, 447 aa, Lactobacillus buchneri
VANDYLTVSALTKYIKRKFDVDPYLTKVYLTGEISNFRLRPNAHQYFSLKDDHAKISAIMFKSAFNRLKFIPEEGMKVLVVGHISVYEPSGSYQIYVEQMEPDGVGQLYQAYEQLKQKLSTEGLFNLPKQQLAKFPKRIAVVTSPSGAVIRDIITTVRRRYPIAQIVLFPALVQGTEASADIVRQIERVNQIGNFDTLIVGRGGGSIEDLWPFNEENVARAIVASKIPVISSVGHETDTTIADLVADVRAATPTAAAELAVPRLDQVLVDLRTTQNRIINATYQVVQQDKQRLKRLRQSTVFTTPQRIYETFAQRLDLLTQRLYNQSDKITGKRKDRFSDLKLRLRLVAPTYTIREEQQKLATLKGRLNRATTQNLKNVSQHYQMLVGSLDHLSPLKILSRGYTYTTDEQGHFIKRVADLSSKTIDVHFSDGIVNASVNQINAKKEK

SEQ ID NO: 4410 - protein, 288 aa, Lactobacillus buchneri
MATIIDGKALAKKLNAQTSERVKQLQNQHGITPGLVVIIVGTDPASQRYVRNKHRTAVRLGIYSIVRELPDTITQDELLKVVQEYNQDPKITGILVQDPLPKQINEKQITRSILPEKDVDGFHPINVGKLYLNDSTKYPVACTPKGVMTMFDEYHIDLKGKNAVMIGRSAIVGKPMAALMLNAGASVSILHLLTKDITEYTKNADVIVSATGSLHTVTKNDVKPGAVIIDVGQNINEEGHLVGDTDYDDLFDKVSYITPVPGGVGPMTIATLMQQTVDLAEWSLERGE

SEQ ID NO: 4411 - protein, 137 aa, Lactobacillus buchneri
VELTRHQIREIAFQTLFALNTNDQTDWKDFFQVLTSGKYGDDYPEYLHQLISGVLEHKSEIDHTIEKYLASSWSLERIARTDLIILEIAIYEMVYVDDMPAKVSINEAIELAKKFSDDRSRKFVNGILSHALEELVK

SEQ ID NO: 4412 - protein, 145 aa, Lactobacillus buchneri
MAEDTNIILHSNDPELGKIEIAPNVLEIIAGVAASQIDGVNRMRGSFSTSVNELLGRRKEHGKGVNLTYTDEELTIDVYVYLNYGVSVPKVALEIQSQVEQQLLFMTGLKVTEVNVHVQGVIPEKTTSTVDPNNPFADNEENGEE

SEQ ID NO: 4413 - protein, 186 aa, Lactobacillus buchneri
MAISTADFKNGLTIEVDNAIWRILSFQHVKPGKGGAFVRSKLKNLRTGAVQEKTFRSGAKMEQAQIDTRKMQYLYADGDQHVFMDMDTYDQISIPAEQIKSELNYLQENMEVQVIQYGNETLGIELPNTVVLEVASTEPGIKGDTASGGSKPATMTTGLTLQVPFFVNQGDKLTINTTDGTYISRA

SEQ ID NO: 4414 - protein, 97 aa, Lactobacillus buchneri
MLAMNLQFFSHHKGGGSTANGRNSAGRRLGTKAADGSSVHSGSIIYRQRGTHIYPGNNVKRGNDDTLFAVVDGVVRFERKGRDKRQVSVYPVAEAAK

SEQ ID NO: 4415 - protein, 111 aa, Lactobacillus buchneri
MIKATIKRYRGHVSGFTITGHADAGEYGQDIVCSAVSVLSITTVNGLQEVIGLDVDVDSDDDNGGYLSVNVPVVSDSKKRIQADAVLNTFANGMADIAESYSKYIKLNTAK

SEQ ID NO: 4416 - protein, 102 aa, Lactobacillus buchneri
MYAVITTGGKQYKVSEGDAIYVEKLDAEEGAKVTFDQVVMVGGDSVKVGTPLVDGASVTGTVEKQGRQKKIIIFRYKPKKGSRSKKGHRQPYTKVVIDSIKA

SEQ ID NO: 4417 - protein, 179 aa, Lactobacillus buchneri
MDLQSLIASSVYLNRQIESKKQLHWSNDGRVKNAFVALDVELAEMANTSEWFKVWKTHRGKHDPNKTPRETLLYEYVDAMDFYLLISNLKNWNHVILNSQDDLDKIKQFKKEDNLDKQYLALKRMLFDAYFDHSGDSFSHSWRLFLKFGLVDFGYTEQEIEQAFKDKNKINEDRQDQDY

SEQ ID NO: 4418 - protein, 313 aa, Lactobacillus buchneri
VSNENTETEKNVLTTTELLNHYTQSIQAGLDNGSKYVNAFTSLNQTQDLDELLTAAVSLTNYQLNSDFVEFPHQFSDEDVQLVFFERLLKLSDHADGLSISNSEHVQKLLAKFSSLGDNTFTFTKSTKNAAGFFFGPTAHNRPLFYLNLKSKEMMFHGSALIDYFVVDLEGLDVSALKDAMNVIMRAAEVLKESFGFKIDFNVLDGVNGEFYEFAAGAIPEPILDELFVKSADNQYILMSGENGGASLTLDNDTQLNVYNAGDEDRPKWGATIHDQDQKESWLNLLLDYPFIKDWYLDNKKQLEILSNKFIFG

SEQ ID NO: 4419 - protein, 293 aa, Lactobacillus buchneri
MDNKIENDPFSQNDSILASALSEKVKYLSDLNDSIKNGNDLKVYELMDPNRFATEVKGEQPDQPETNFFGLATDLKAQLSHHLSDKLIDYLGTTYPFFYYHEYDLGKFNIYFGNWWDHRMFGELDTINVRFNFAEDEYNTLAKSFELEAQNKRVNDDQMRELGQKNEKLTQLIEDQTKRDQRKEEIRKQIKENEEKSPMPWEAGKVKEEHQQLQNALLELTNIDEQASGARSEIKKNENQILALSKEETIYNLEKQNIRASFGSFEAFIENNNNLYAKYLQSLSKESQVTDGE

SEQ ID NO: 4420 - protein, 546 aa, Lactobacillus buchneri
MSNIQLGLKVGLVISAALILTGCSSQKSGSGKLAAKQEFTTAVDSELSTVDLSKTTSVQTFEVLNNIDEGLYRLGKDSKIENALATKTKISNDGLKYTFNLRKGTKWSNGDPVTAKDFVYSWRRTVNPKTASQYGYLFSGIQNADAIQANKKSPNTLGIKADGNYKLVVTLEKKIPYFKLLMGFPLFFPQNQKVVEKFGDNYGTKSADMVYNGPFKLTSWNGTGMTWTLAKNQNYWDKKAVKLDKLHYQVTKDPSTGYNQFKTDKLQYVGLSGVLAKNLKNNKNLVTRETSSCYYLAFNQKKKLFKNLKIREAISMAIDRGQLTKKILGDGSFNSQSFVSKGLSINPKTGKDFTATTAKPDSLTYNSTKAKALWKAGLKELGITKMSFTLLSSDEFAQKQVSEYLQSQLEKNLPGLKVNLRNIPFQTLLSRQKSHNYQVTMGDWYADFADPITFLNILTSGNPSNVPQWSNKQYDKLIKASSTTDAGNADKRFEDMTKAQNILLDNQGITPLYQSASKNLLSSKVKGIIYNTAGATYNYKNVYIVE

SEQ ID NO: 4421 - protein, 447 aa, Lactobacillus buchneri
MATKHDYSKDDIRKMVKDEDVKFLRLMFTDLFGTIKNVEVPITQLEKLLDNKLMFDGSSIEGFVRIEESDMYLYPDLSTWMIFPWSTDRGKIARVICQVYRPNGEPYAADPRNNLIRVLGDMKKAGFTSFNIGPEPEFFLFKMDENGEPTLHLNDKGSYFDMAPMDLGENCRREIVLTLEEMGFDVEAAHHEVAPGQHEIDFKYADALAAADNIQTFKLVVKTVARKYGLYATFMPKPLSGINGSGMHLNMSLFNDKGNTFYDKDGELEISQEAYYFLGGLLKHARSFTAVCNPIVNSYKRLVPGYEAPVYVAWSGSNRSPLIRIPSARGNSTRLELRSVDPTANPYLAIACVLEAGLDGLRNKIEPEHSIDRNIYRMDAEERQKSHITNLPDTLHNALKDLSADETMKKALGEHLYSSFIEAKNLEYDSYRTQVSGWERDQYLEKY

SEQ ID NO: 4422 - protein, 136 aa, Lactobacillus buchneri
MREKELRRSMSVLPIGTVMKLTDLTARQIRYYEQQELIKPLRNEGNRRMYSLNDVDRLLEIKDYLDDGLNISGIKEVYKKQNQLEDERKRNLEKGLTDSDVRKILQDEFLNIGGLKPPSSSFDDPNNLNNLNKLNH

SEQ ID NO: 4423 - protein, 310 aa, Lactobacillus buchneri
MIKLLAIVGPTAVGKTDLSIKLAQKFNAEIISGDSMQVYRHLDIGTAKITQEEMAGVKHHLIDVRNIDERFSVADFVHDASELIEAIHEAGKLPIIVGGTGFYLQALLSGLELGGDQYQNDDLRRQLLAEAKEKGDLALHQRLAKVDPAAARAIPVHNVRRVVRALEVYINTGHRFSDQHNVGSKYDAFVIGLTTDRALLYQRINQRVDQMMAQGLLSEGRWLFDHDGQQFQAGKGIGYRELFPYFQGQSTLEEAIELIKKDSRHYAKRQLTWFRNKTEPQPNWYNLVQRPNQLTEIESDVEKWLDDNNQ

SEQ ID NO: 4424 - protein, 248 aa, Lactobacillus buchneri
VKINTKIIAHRGSKGTRPENTLISFQTAIDDGADGLETDVHFSKDHQLIIMHDETVDRTTNGSGRIVDKNLAEIKHLDAGVRFSSEFKGTTVPTLQEVVELLIKDNFTGIFNLELKTNKIQYPGIEKAVFDYFASIDYPFQLIYSSFNARSLEILNRLDPKLAGAKLFKTAAKQAKTLKKDHLIADFHPDIRWLKRHPFFAPAQNLRPWTVNSTEDMQYCFERNLAAIITDYPARAVQIRSEMREGVE

SEQ ID NO: 4425 - protein, 58 aa, Lactobacillus buchneri
MKQFTNGLIVGVLGTVAAGVGALLTFKKSVVDPIEDEEQKFEDNRKKAMRKSRAAHHG

SEQ ID NO: 4426 - protein, 138 aa, Lactobacillus buchneri
LLIIGAITANLVTTIILIVILLAWGGYTIFQNMRVKQVATYLKNDEFQKGMRKAQVIDLREQKSFKDGHVLGARNMPYSTIKNFYSQLRPDLPVYMYDQGKTISKRAALFLSKKGYKDLYILKSGYQGWNGKEKKSNY

SEQ ID NO: 4427 - protein, 328 aa, Lactobacillus buchneri
LAKKLIGIDLGGTTVKFAFIDTKGNVLTKWRIPTNISEHGSHIVPDMIKSISDQMRKDDYNASDFYGIGMGTPGAVNREKGTVVGAYNLNWDIVQPVGATISANLNLPILIDNDANSAALGEYWKGAGDKAKDVVFITLGTGVGGGVIANGKLVHGINGGAGEVGHITVVPNGYQCTCGKRGCLEQYASATGVVHIAKDMAKKFTGHSRIKELIDGDEDLSSKMVFFLADNGDILANQIVDRVCSYLGLALSHIGNTLNPENIIIGGGVSNAGNTLLQPTTRYFQENAFPSVRDSTRLKLAQLGNDAGIIGAASLALQFRNNQPFGTK

SEQ ID NO: 4428 - protein, 73 aa, Lactobacillus buchneri
MKTLYDVQQLLKKFDIYVYVGKRLWDIEVMALELDHLHDAKLISHDEFIHAKLILTREHRIEEKQESRGKYIG

SEQ ID NO: 4429 - protein, 220 aa, Lactobacillus buchneri
MSNLRNQPYITYGLLIIMVVVFAIMSVMGGTENPVTLVEFGAKYNPLIRAGEYWRLITPMFIHIGFTHILMNGITLYFIGQYVEQLFGHWRFAVIFFVSGIMGNLGSFAFTDSLSAGASTAIFGLFGAFMMLGESFSKNPAIVSMAKTFLLFIVLNIGTDIFVSGIDIAGHLGGLVGGFLVAYVTGVGFSKTSQTKRIISAIMLVVIAFVLFTIGMRAKF

SEQ ID NO: 4430 - protein, 184 aa, Lactobacillus buchneri
MAKSNQLKAALRDQQIARLHDFLQDPQQKPEIQRLYQQLFAEPHFANSETLGITLSMDDELDTQPIIHWALTHDKQVAVPRTLPHRQMTFVLLEPDTVLSETKFGTIEPVGGQVLAKSQLDVLLVPGLAFSKNHFRVGFGGGFYDRFLKGFTGTSIALVTPVQLFDEPVWDVEDFDVKVDKLIY

SEQ ID NO: 4431 - protein, 49 aa, Lactobacillus buchneri
MRVHITMECTECHERTYLSSKNRRNNPDRLELKKYCPRERKVTLHRETK

SEQ ID NO: 4432 - protein, 683 aa, Lactobacillus buchneri
VKIFKKRTKKTNKAKAVSLPFRINIIFIIVGILFVALLTQLAYLQVMYGSKFKAEVNRSDTSVVNGNVQRGMIFDSTGHVLVGNSAHQAIIYTKGVNVLSSDMYKTANRLAQYVTVPTGSLTKRQLADYYLANTDNLAKVEKSIPGISGYSEDAKYDKAVNKVESYPNATFSSALKNAATIFAKMSGAYQLSTVNIKDDNVSTKEVAMVGEHLADMPGVNVGTSWSRNYPNGRSIQGITGTVSNEKSGLPSDRVNELLAQGYSRNDSVGQSYLERQYEPVLRGTKSQTQIILNSDNQIKKEIKKYGGQKGDNLQLTINAKFQKQLQSLVRSAESGAGGNSTGTYAVVMNPNNGAIIGMAGVDRNPKTSKITDNILGTINSSIVMGSVVKGAMVSGALMDHVITPTNSTLTDQPITTGGVKKSSWFNHNGHANIAVDASDALQVSSNSYMMQLAMKEGHFNYVEGGALTMSPNVFNTMRGYFNQFGLGVKTGIDIPGESTGLQGASGYKHIGSALDLSFGNYDAYTTMQVAQYMSTIANGGNRIEPHVVQAIRGTSPDGKLGTVKATVMPKVLNHIDMTQAQRNVVTTGLYRVVHGTNTYKTGGMLDSIKPEISAKTGTAQTFYNGNETVTLSLASYAPSTHPQVVVALAMPNLGVNAESNNMALAKQIYSAYWKTVQSTSTVK

SEQ ID NO: 4433 - protein, 87 aa, Lactobacillus buchneri
LKSGQGDALTTDNGILYGMSIENPGYSVVGGTFTKEPYGIAVDKGQGQMRDAMNNALTKVENSGQYNKLLYKWFHKVHGFDFKGAER

SEQ ID NO: 4434 - protein, 212 aa, Lactobacillus buchneri
MISIFQNYGGELLYGLGQTLLCSIIALVFALIIGSGFAILEVVPNKFFRVIARVYIEVFRNIPLLVITMFFYVVIPMYIVEISGFASGTIGLILYSSAFIAETVRSGIQSVDPGQMEGARANGLSFWQAMRYIVLPQAFRYVIPPLGNQFINLVKNSSVLAFVAGFDLMYQGNVIASDSLQSMSTYLCVGVLYLILTLPLSYYMRYLEKKLA

SEQ ID NO: 4435 - protein, 234 aa, Lactobacillus buchneri
MLTVLGAYSWINIRFLLEGAWVTILVSVCSIILSYIFGVILGIIRYVEIKYLSAIVGFVIDIIRNLPLILIIFFTYFGLPNIGFKPDPIWASVIAMAVFESAMVAEIVRAGIVSIPVGQMEGARSTGMSYWQALRYIILPQAIKNMIPAIVSQFISLVKDTSLATIIVLPDLMNHAQIIYGQNTNYTIPMFLALAVMYFIVCYSLSLLSQYLDHRLGTAKKSGEVEEVVQGAER

SEQ ID NO: 4436 - protein, 228 aa, Lactobacillus buchneri
MTAYVLYQLEWILRLFVAAICGGLVGYERKVRLKTAGIRTHMLVAVGSALFMIISKYGFFDVINHADVSLDPSRIASQVVTGIGFIGAGAIITRNHKIDGLTTAAGLWATAAIGLAIGADMYVIGIAGTLCILVTQTIVRQIRAFKRYPNRSLLRLQVTFNGELASMDELPDRLRAIGSADIRMRIVAYKPDSFSLEVRVKLQHKMDPDEFIRQMSDLVDVRKIEVLD

SEQ ID NO: 4437 - protein, 328 aa, Lactobacillus buchneri
MAATIKDVARAAGVSPATVSRVLSNQKAFYSEKTAQKVRAAVKQLGYRRNTSAVELVTQRSKVIAVLVSSTQTNFSDQILKGIQEQARVHNLSVMIIFAGEGDAEVQAKAIRTVIERSVMGILLVAIDLDPSNDELLENANIPFIFISMTLKNSAFPFISSNDFDIGYQATKYLIGKGHQKIGLAATDLDSFVGHLRYEGYRDAMRDNHLSFDEDWICGGHFTYEDGVNAMEHYGPQTELTAVIASSDLAGIGILNQATNYGMKVPDRLAILTIDGTQLCDIVRPKLSSVTQSFFEMGANGMDMLVSDSFKEFYSMYTPIRIVERQSV

SEQ ID NO: 4438 - protein, 317 aa, Lactobacillus buchneri
MKAIVLRHPGGPSALSYEDVPMPKVKDGWTLLKVKGFGINRSEIFTRNGWSPSVKLPRILGIECVGEVVETTDPKRLKKGQIVVSVMGGMGRAFDGSYAEYTLLPNDHIYAVNTHLAIQDLAAVPETYGTAYGSLLKLHLDEADSLLIRGATSGVGVAAGKLARAMVPSIKLVGSTRHLEKTDELKSVGFDEVVLDQDNQLQATGRQFDRILELVGALTLPNSMQFIQENGITCVTGELGGIWDLTHFEPISQLNGGYLTSFESGALNQRVFDDLFDIINNNHVDVAPTKVFDLKHTADAQAYLDSHDSFGKVVVLP

SEQ ID NO: 4439 - protein, 456 aa, Lactobacillus buchneri
MKEQKEVTLDRDLGLWSALALVIGTIIGAGVFVRQSAVLDDAGSTSMALFAWLAGGILTITAGLTIAEIASQMPETGGLYVYMERIYGKLWGFLSGWMQIIIYGPAMIASLGAYLAILLSDFFGFPSKYNAILAIGTIVLVGILNLFSNRYGATFAIITTICKLVPVAALIIFGLFFGNESAFGQSLVHVHQSAGNFGVAILATLFAFDGWILVANLGGEIKNPRKLLPQAITFGILAVLAIYLLVSYGVYRSVPAEQIHRLGTSAIPYIANQAFGEVGGKILSIGIIISIVGCMNGKIMTFPRIMYAMAKRGQLPFSKTLSYLHPKSHTPIFSTVAELLIVTVMIIFSNADRLSELCIFTVYCFYVMAFVGVFLLRKRNPDQHRVFSTPLFPITPILAIGGSLFVIVSEIMSDLPGVLTSFIFIAVGIPVFYYETKKYRESQAAAAKEESLDNEN

SEQ ID NO: 4440 - protein, 428 aa, Lactobacillus buchneri
MDLQVTLTPVVTIGLNRNTSSFEYSMTELNNLAEANNMKVVETLVQKLDRPDPATYFGKGKIEELTQVVIDDGVDTIVVNDELSPSQIRNIEKNTHSRIIDRTGLILEIFANRAQSREAKLQVELAKLKYQLPRLHTSASQRLDQQTGTSSGAGGATNRGAGESQYELNWRTLEKRITHVNQELKETAKADQTKRKQRDRSEMPTVALVGYTNAGKSTVMNGMINLYGENEDKQVMVKNMLFATLDTSVRKLTLPDQKRFLLSDTVGFVSQLPHQLVQAFKSTLSEAANADLLIQVVDYSDPHRELMMKTTEDTLSEIGVNGVPMIVALNKADKMEVAFPSREGDNLIMSAMDEKSLQELTTMIKEKIFKNYHRLTLLIPFSDGDVVSYLNENTNIETTDYRDDGTVITAELNDVDAKRFEKYLLTTE

SEQ ID NO: 4441 - protein, 540 aa, Lactobacillus buchneri
MRTKSLLKIAGVSLLTAVVLAGCGSKSSDSGAKKQSANWMVAANINTMDVSKMTDLISSQNVNATNEGLLKMTTGNAVVPGVAKNYTVSKDGKTWTFNLRHSKWNDGTPVTAKDFVYSWQRTVNPKTASQYAYIFTNIENADKINAGKLSPSKLGAKAEGDYKLVVHLIKPQSYFKFMVSQSYYFPEEISKVKKYGSSYGTDAQKNGYNGPFVLKGWNGTNDTWKLVKNPKYWNAKAIKLDTLNMQAIKDPNTALNGYQSGKLDFTTLSGTQVKQYKNDKNYHVYKQASIYYLEMNEKKFPMFKNRNIRKAFSLAIDKKQLANKVLADGSQAPKGFVADDMSQRNGKDFADQSYVKSAVAYNLNEAKKYWAKGLKETGKKSVNLTLLSDDTDVAKRSTEFVQSQLTKLPGVKITNQNVPYKTRLSRSASGQFDLVITAWNADYPDPSNFLDILTSKNSYNNGKWSNAKYDALVKKSESTDAANESARWNDMVQAEKVLMNDQGIVPLYQPAISTLMKPKIHGVQFFPTAPQWDWSKITVK

SEQ ID NO: 4442 - protein, 539 aa, Lactobacillus buchneri
MKINSLAKLGGVALVTGLILAGCGSKSSQGTKKQEVSWMTPSAISTMDTSKMIDLYSAQVANGTNEGLLRMAKDNKVDPGVAKSYNVSKDGKTWTFNLRHSKWNDGTPVTAKDFVYAWQRTVKPKTASQYAYIFANIKNAAKINAGKMSPSKLGVKADGDYKFVVTLDQPQSYFKFMVTQPEFFPQNSKTVAKYGSDYGTNSTKNSYNGPFILKGWSGTNDTWKLVKNSKYWDAKKVKLDQVNFQAVKTPSTSLNSFNSGKLDFTTLSGTLAANNKNNKDYVVFPQASTTYMEFNTKKIPALRNVNIRKAMGLAIDKKQMVNKVMQGGDITPKGFVPASMAKHNGKDFADQAYVKAGTDYNLKEAKALFAKGLKQVGKKSLSLTLMGADDDDTKRATEFVQSQLTKLPGLKITNSNIPFKSKLTKMENQQFDIGLSAWIADYPDPSNFLDLMTSNNSYNDGKWSNKQYDALIKKSESTDANNETARWNDMVQAEKILMNQQGLVPLYQQGQAALLKGSVKGVQAFTTSPQYDWSKAYVK

SEQ ID NO: 4443 - protein, 306 aa, Lactobacillus buchneri
MAKYLGKRIFYIILTLFIVSTITFFLMKLMPGTPLTNQAKLTPTQIHQIYKQYGLDKPVWQQYLVYLGGIIHGNFGTSFQFSNQPVSYLISSRLGPSLIIGGQGMVLGVLAGLVVGAVGAIKANTWVDTSATIISILFISIPSFVLAVLLQYYLGLKLRLFPIADWGGFMYTVLPTLALAASPLAETARFMRTEMVDVLSSDYIELAKAKGLNKVGIIYHHALRNSLIPVVTIIGPLAVNIMTGSMVVENIFSIPGIGEQFVKSILTNDYPTIMGLTIVYSAMLCVVLLITDIVYGLIDPRIRINK

SEQ ID NO: 4444 - protein, 342 aa, Lactobacillus buchneri
MADNAKQTSADDFTPIAGADRAKLDDEKIATPSLTFLQDSWRRLRKNKAAMIALVILIILFILAFFSFLFETHNPNATNPNFANLPPKIPGIDINGFNGTIDQSGQRVNAYAQAHAGNHFYILGTDYLGRDLFSRILYGTRISLEIALIASFFDLAFGVVYGITSGWIGGRVDTLMQRIIEIMLSIPNLVVMVLLILVLKPGMTAIILSIAITSWINMARLVRAQTLELKNQEFILAARTLGESSWKIAFKHLLPNLSSVIIINLMFTIPTAIFFEAFLSYIGIGISAPQASLGTLINDGQKNFQFLPYQMWYPAIVLSVLMIAFNILGDGLRDALDPKSRE

SEQ ID NO: 4445 - protein, 365 aa, Lactobacillus buchneri
MENEKDVLEVRNLKINFNTYAGTVQAIRDVSFDLRKGETLAIVGESGSGKTVTTRSIMGLNSPNAVIDSGTIMFKGQDLLKKSRKQMDQIRGRDIAEIFQDPMTSLDPTMKIGKQIAEPLIIHKGMKREKAYAQALEMMKLVGIENAEQRINNYPHQFSGGMRQRIVIAIALVNYPEILIADEPTTALDVTIQAQILDLMKELQAKTNTSIIFITHDLGVVAGMADRVAVMYAGKIVEYGTVDEIFYNPKHPYTWGLLNSMPTMDTSGTELPSIPGTPPDLLDPPVGDAFAARNKYALKIDTEKQPPFFKVSDTHYAATWLLDKRAPKVTPPEPIIERQKHYAELVHQEINKSKGNHVEEQEEQL

SEQ ID NO: 4446 - protein, 320 aa, Lactobacillus buchneri
VIDYSEENKILQVEHLKQYFNIGKPNEVRAVDDITFDVYRGETFGLVGESGSGKTTTGRAIIHLYEPTSGKIVFDGQDVSKLNSKKQKQTFRRDMQMIFQDPYASLNPRMKVKDIVAEGIDINHLAKDDADRSKQVEDLLETVGLNKDHSSRYPHEFSGGQRQRIGIARALAVQPQFIIADEPISALDVSIQAQVVNLLKKLQRERNLTYLFIAHDLSMVKYISDRIGVMHYGRMLEIASSDEIYAHPLHDYTASLLSAVPVPDPEYERARVQIPYDASQEFDGKERSLVEIVPHHWVRASEDEIPMYQKRAQEDSRLKQ

SEQ ID NO: 4447 - protein, 164 aa, Lactobacillus buchneri
MYSIGDVAKIMGISTSAIRFYDRKGLLPFVERDDAGRRKFKPNDLNFLEVIDCLKQSGVPIKDIGHFISLCMQGDGTLKQRYDYLDQEEAALQSSIDRMKSQLAFLRYKKWYYKTSVEAGTESIHFAPGSNVVDPKTKSQYQEALQHCTDLRDLIDLKQSKADN

SEQ ID NO: 4448 - protein, 47 aa, Lactobacillus buchneri
MTNKTWFVTGTSTGFGHSLAAYLAQQENVNLVATARHTDQLGYKEWI

SEQ ID NO: 4449 - protein, 189 aa, Lactobacillus buchneri
VTELEKLDAGEPYYFLDDEVAARKARAAKLCQEFNSIPATEPDKQTAKIKQIFGKTGERVSVQATFNCDNGKNISVGEDFLSNYNLTILDIAPVTMGHNVMIGPNVDIYTVNHPVDALQRRKYMAQGFPVKIGNDVWIGGKASIMPGVTIGSNVVIAGGAVVTNDVPDNAMVGGVPAKLIKKLPPINKD

SEQ ID NO: 4450 - protein, 127 aa, Lactobacillus buchneri
MKINEVSKKFSVAADTLRYWERVGAIPAVSRDQAGYRNYDQEDLNWVSFAMCMRDAGVSVEYLIDYISLFKQGKQTVQARKDLLNEQLASVSERLAKMQASYDKLKYKVDHYEHIDKDYQGKMASTH

SEQ ID NO: 4451 - protein, 398 aa, Lactobacillus buchneri
MKKILPAAIIGLTGILLLTGCGNKKADMQDKTTANPNATKLNHLLSPATAKVPEDSQATTNDQLYSQFYKSKGQWYWKLSSKQDGTIDNSKIKSLSATDQKDVYNFSMVSNQRKSYTLKFNWLNGGHQAYTVNASYHHVNSNFILADANTDTDWQTGAPQAVQGTWATDFANNSGSDAQKLPYTKQFLNITSSAISSFTNEYDTNHRLYNSDTIAKASNVSYKQTGDDTYVLKAYGNDQTPIVYNISVQSNNQIEVNGLTSGSLTMSKSATTEPTTGSQTASSQSPSTTSGSTANQAAPSTNHLTDQQVVNWIWPYVKAKYPNMAVDSTDFTYMPQMRNGQLYVNVLENHNSQAFKKSGVDTGTNPQVASFRVTASGALEQMDATTGDWAVVSNSYGG

SEQ ID NO: 4452 - protein, 64 aa, Lactobacillus buchneri
MIDKLFTEHPYIAAWLVLELIFVLSLFGWTWASSATIADLMVPNFVIPSVACTAISLLTWKTKH

SEQ ID NO: 4453 - protein, 105 aa, Lactobacillus buchneri
MTLKQHQDWLVDFYKRRDWYKYSPFIRLNFLTEEVGELSRAIRAIEIGRDHPGEHDTRDERNYNLHEELADVMDQVLILCDKYQVDPDSLMAFSEAKLKKRFNEQ

SEQ ID NO: 4454 - protein, 217 aa, Lactobacillus buchneri
MTISLYFVRHGQTYLNKYHRIQGVIDSPLTDKGIADAVAAGKRLSQIKFDAAYSSDTSRAIKTGQLILKENPAAIKDPVPTGAFRELNFGYYEGEDDVKTWHTIGGPIGINSFHGLIAEFGIEKAEDMIAAADPYKDAESGETFWKRLKPAIDQVVADADDGDKILLATHGTLIRNVVAKFSDIPVDVSTKNGSVTKVNWDGKSYSVEYFNNVSEDL

SEQ ID NO: 4455 - protein, 764 aa, Lactobacillus buchneri
MADNIKTQEQHHLDHVIDEIHISQKDLEQKIKATKRDVKDINRNFNNDVRLKTETYSGMMETAMSIRQQQQMLSERENRQEHAARELGTLNKLEQNPYFARIDFREGDEKRDETIYIGMASFTDRPDHYLIYDWRAPISSIYYNGGIGNVSYMTPDGEQTVDVKLKRQFQIENSKIKTVFDTEEVVGDQMLLDALSNRSDTKMKSIVTTIQKEQNQIIRDTDSDLLFVQGSAGSGKTAAVLQRVAFLLYQYRGNLHSGQIILFSPNQLFNDYINQVLPELGEQNMVQMTFYQYSSHRLPSVQVETLSERFTEQLDKTAQKLTDVKGSLDYFRAVSAYANHLNKEDMRFRNLMFNGEILIPKEKIAEIYYGFNENYNLRNRLESTKEELMKILNRKIHVEMRKKWVEDAVQNLSKEEIQQFHAEGEEEILNADKEFKFLARRIVIKSFRKVQRQISRNHWLSINNQFVHMLKEMPKILNLADFGISNELWAEEIKATVGRLKKGRLSLADASSYIYLYDLMTGKRGDKDIRYLFIDEVQDYSAFQLAFLKFSFPRARFTLLGDLNQAIFTHENSRKLLGELGSMFPEDKTRVVQLTKSYRSTEQITNFTKHLLTNGENIIPFNRQGDLPHIYVKDGVDAAVEQVKQQSELNLADHETTAIIGKTLKECQELSGKLAELGVKSTLIRTENQRLVKGIIVVPSYLAKGLEFDSVIMWDASTACYPDESDRQLVYTICTRAMHRLTVVAVKSLSPIFETVPQDEYELN

SEQ ID NO: 4456 - protein, 309 aa, Lactobacillus buchneri
MDDLINYYSFTKDEWKHFNNDNEVDLPLTSNELRHIKAFNDQISLQDVADIYKPLVHMIRLQKNNFDQWQTTKARFLRKKVRTVPFIIGISGSVAVGKSTTARVLEELLSNYFTGETIKLITTDGFLYSNAELKQRGIYDKKGFPESYDMRKLIAFLNEVKSGVPVTKSPVYSHQSYDIIPNRFELVDRPDVLIIEGINTLQLPSNEQIYVSDFTDFSIYMDADVHLIEKWYLERFGRLMDTAFQDPDNYYYDYAQGDREEAFDMARRVWDTIDLPNLRANILPTRSRADMIMHKTDNHLIDRLYLRKY

SEQ ID NO: 4457 - protein, 517 aa, Lactobacillus buchneri
LANVDLSSFDKILVLDFGSQYNQLITRRIRDLGVYSELKSHALSAKQIKDMNPKGIVFSGGPNSVYEDGALKVDPDIFKLGIPILGICYGMQIMAYTLNGEVEKASNSEYGHADIQITSDDAVLFKGTPREQPVWMSHGDLVNEVPEGFETVATSRDCPISAMQDVERNLYGIQFHAEVRNTKYGNDILKNFAFNVCHAEANWSMDDFIDLQIQHIREEVGDKKVLLGLSGGVDSSVVGVLLHKAIGKQLTSIFVDHGLLRKNEADQVMDSLVGKFGLNIIKVDAQDRFLSKLKGVTDPEKKRKIIGNEFIQVFNDEASKLHGIDFLAQGTLYTDVVESGTDTAQTIKSHHNVGGLPEDMKFKLIEPLNTLFKDEARAIGEKLGMPETLVWRQPFPGPGLGIRVLGEVTPEKLKIVRDSDWVLRDEIAKAGLDRDIWQYFTVLPGFKSVGVMGDGRTYDYTVAIRAVNSVDGMTADFARIPWDVLQNVSTRIVNEVDGINRVVYDITSKPPATIEWE

SEQ ID NO: 4458 - protein, 287 aa, Lactobacillus buchneri
MNSIWNYWRKLNIKSTELIGVAVGAFIYSMTYNYLLLPSHLGEGGAMGITALLYYAFGVPSYLSNLLINAVLIVIGYKLFEKKTTYLTIWAIAWMTVFLKIPVFYTYHTHELIVPTLLAGALTGISIGLIFRFNGTIAGDTIIGKILNYFFGISLGTGSLIFDLFIVVPFIMIIGFTNTVLTVIYLYVYSVFTNQFLANIGAKKAVLVVSPKYRQIAVTISKELNQEMTIFNGTGYYSDADQHMLYMIAGPRRVTKLVPIIESEDKNALIVIENIRSARGLDMRRIL

SEQ ID NO: 4459 - protein, 721 aa, Lactobacillus buchneri
MRTILTLLKRDLHNIFHSRPVWITLLAFCLIPAIYAVPNIMVSWDPYSKANTSRLPIAVVNDDEGSTVNGKQLNVGKQIVGELKQNHAINWIMTNDWQGNNGLDEGKYYSLIEIPNDFSSKLATLVSTNPEKPNIIYKSNEKLNPAATKITGQAVDTLTEQVRDSFIKISTKAALKEMNAAGAKINTHKPEILQIRSSLLDAINTVKKTNGYLDKANKDSDNVQQYLKTVQGDIPKISRQITDLQNVVNHGRNLTKATKQSLSSAQNDLSNGLNDLQSDNNRINSLVDDLQTGGHASSKSLLNSEINQLKTLNDSTLTGINNALRIADVLNNLLPNNQTTSLIRSLSNAKQRIHDQQRNLTSLKNANQANRSQKSINQLIKQLAKTTDALGNSLTNAGSTFTNTVSQAIDDLNDTLDTQLNGNDEVLSSLRTLLPQLNALTSSGKAISKISVSQVNRIKHRLNGIEDKLNDLNDQTKFINEKNLNKIINLLGENPKISNLLASPITLKQKQLYNMGLFGYGMAPFYTVLSMWVGVLLLTTIVSWKYLIPEDKRFPKANRIQQYVGKGLLYLILSFTQTTFIMLGELVIIGLRPRSLLAMLATAYLATTVFTIIMFTLVYMFGNIGKVFSVLMMIAQLFGTGGVYPLELIPSHLASLAPFLPFTYVIQAFREAIAGPIPSVYWHAMLILAAFGGFFLLMAPLRRVFVKPLSKMENGFHKSQL

SEQ ID NO: 4460 - protein, 229 aa, Lactobacillus buchneri
MKHSVIKWILSLTILGALFAIQPTTASAKTTAAKVTSTQTLTTAPYRAVSGYLYSSAKLTKKVHNADNYPLTTFYASKSANIQRANGNKAVYYYVQNGNGKVAGWIWRGHLVRMINVTRQRQQLNQIIGLIDTLSTNNKDQLISILNLMNHQSTLPDLLTQLNSWIESIQNDPDIAKLNQIFEMIKSDGQTLNYLFSEGINKLYPKIVVIHNLNNRVFALAQGLLDRIN

SEQ ID NO: 4461 - protein, 722 aa, Lactobacillus buchneri
MFKNIKLIYQRDLKAIFKYKAALLTISALCILPCLYTLVNVKAIWNPYTSHEVQKIPVAVVNNDQGTTVQGKQMNLGKQIIAQLKHNNQIGWRFVDSKTAQKKVRAGKYYAEIKIPKTFSADLGSIVTANPKKAHIDYIADTKASPMSYKITEAASKTLLNTIKKQFVYQVNSTIFTYLNVAGKKAGDNESEILNLKDLIINLGDSMELATNTLGDISEASSGLAMVFSELKPVISASQDISINQAIGSSNQQLIRSVNQAVNQSFGNVQTSLNGIQTDAARLRSLTNQLNKQTSAAGRNQATGLASQILSQIKLLRGQITPLIAYLQTINQSQRLSGVSRLISQLNDVKNLLDAQSQQVTQLQRALSSGSTANTGLQQRIASHSYSVASGLNHSLASYNRNVKSELNGIQRNLLSASNHASGVLNNVNDIRSLNEKSLDTIISGNQLVSDSTGDLENQLLQYKGVILQASNQLKLTSDDNIANIISILQNNPKLMGNALAQPFNVKNENIYRVSSFGEAFAPTYMALSIWVGCAMLVAVLHTSAPKYHRFKNLRPREEYIGKMLLFNTLSMIQTMVIVLSTVFILRVHVESLFLMVMIGVVSSLTFSVIVYTMASVFGNLGKALAVMMVAFQLAGSGAIYPIQLNPLFMRIIQPILPFSYSVSGFREAVGGPNVGTVVLDFFVLICMLIAGLIVGLFMKDFFKRVTARLLNDFTKSGIGQP

SEQ ID NO: 4462 - protein, 284 aa, Lactobacillus buchneri
MNLLIALLPALGWGLMPLITGKVGGSPANQIFGIGAGTTIIGLIVFLVTRPAVNMTAFLFAIVCGALWTIGQIGQFISFKRIGVSNTYPLSTVFQLVGNSILGVLIFGDWQGTQSKIIGFIALIIVIAGALLTSVSDEKGGKITFKDATFLLCTTVGYWIYSSFPNIPIIKAQSGTSVFLPEMMGILIGAVIFGLFTDRQSFKQKEQYLNIIAGLLWGVAALSYIYSAQANGNTSAFIWTQLSVIIATFGGITILHEHKSRREMIFTIAGILLIVVGSVATSFA

SEQ ID NO: 4463 - protein, 71 aa, Lactobacillus buchneri
MIFMLLMLFLVGYLVLNVSWLFIKASAWLIILAIGFLILSKLLVVGLIVAAVYGVYLLYQHSQVQPYKNRH

SEQ ID NO: 4464 - protein, 245 aa, Lactobacillus buchneri
LNSDVLVIEQSAPIDAKFIILGGIVIQNTKSQRWVGLISGLILNAFGNALTISANMGSAVWTASAVNYSHWFNLNVGIILFFIGFLNTVTNQVLLRHPDWPRFVGEILYVCFFSYFVNIFAQLFDQIGIGQLPIVIRGILSCLGIIFFCTAISLYQRANILMHPNDDTTNILRFMYLKKSAVAAQLVDFVPPIIAMVISFAVTHNLYAVNVGTIFSILFNGLIIQTADHWVWPTLKHNFKTLGND

SEQ ID NO: 4465 - protein, 191 aa, Lactobacillus buchneri
MKIKTTEQYNRIIQGATAILLTEGLAAFSTTKVAKHIQMAQSNIYVYFKNKDDLLVSVFRYHQKKYIQFLVDRIDLSLPPTDALRNLVSTLDEFHRTNKESLDVIWSIRQSTTLRQLIPKVSDDQIFIAIFQWLKDWQHQGTVRQLPLMYLTNLVFSAIIDYFQLIDSKEMSPNELAIEEIVPPLSALLFV

SEQ ID NO: 4466 - protein, 268 aa, Lactobacillus buchneri
MKKVAIVTGASSGIGLAAAKLLLKQGYYVVGGARHVEQMKVLTELGGKVHELDVTKESSLKAFVAFVLDSYGRVDLLVNSAGYGSFGALEEVTIEEAKHQMDVNLFGLVRLIQLVLPTMRTQKSGRIINISSLAGLMYTQLGGWYHISKHALETMSDILRLEVKPFGVDVVVVEPGNTATGWQKIAVGKLLAATPIHSPYRRVAERLAKTLKDSRATTNDVAAVIVKAAMTRKPKLRYQIRFQEQVTAKLLKLIPDRIQDRLVTRMFS

SEQ ID NO: 4467 - protein, 845 aa, Lactobacillus buchneri
MAEQLTHFYEKFQPSHYNIYLDINRDTKQFSGTSTITGDAKTTAISIHQKFLNIESVQADGKAVSFSKDDDQEAINIDLPTTGVVTLAIQFSAKLTDTMMGIYPSYYEVDGVKKQLIGTQFETTAARQAFPCVDEPEAKATFDLAIKFDEHAGETIISNMPEVRTENGVHYFDTTMRMSTYLIAFGFGEMQKKETTTKSGVKVGVFATKAHKADELDFALDIAKRSIEFYEDFYQTPYPLPHSWQLALPDFSAGAMENWGLVTYREAYLLLDPKNTSFEMKQLVATVIAHELAHQWFGDLVTMKWWDDLWLNESFANMMEYVAIDAIEPDWHIWEVFQTSEAPAALQRDATDGVQSVHVQVENPAEIDSIFDSAIVYAKGARMLVMARALVGDKALREGLKNYFAAHKFHNATGADLWSALGDASGMNVGAIMNSWLEQPGYPVVTAKVQNGQLILSQQQFFIGAGKDVDRKWQIPLNSNYDAVPEIMADKTFTVGDYQQLRQENGKPFFLNVGNNSHFIIQYDETLMADILDHVGDLDAISQLQILQDLRLLADGRQNSYANIVPLLPKFADSHSNIVNAAMYRVANNLKKFVTPKSNEEKALKQFFDRLSAAQLDRLGFAPKADESNDDQLTRPYILSASLYAENADAMAAAHTLFKQNEGNLAGLSADIRVFVLRNEVKNFGSQALFDKLLAAYRQTADASYKQDICAALTSTTDPDLIAKLVGQFENADTIKPQDLRAWFRGVLANDDGQQAAWDWIRKDWQWLEDTVGGDMEFATYITVISGIFHTPQRLAEFKEFFEPKIPTPGLTREIKMDISVIDSRVQLVQAEKADVNAAVSRAVK

SEQ ID NO: 4468 - protein, 307 aa, Lactobacillus buchneri
MSSLRKKGRAIILSILTVILSVSIFGAVKASAATTVIPDISEWQGKLTASKVSNLKSQVSFIINRRQYGANYQDKYATNNTNLYVQYGIPFGEYDYATFTSAASARNEANVFYQNSNKNAKFYVLDYEENDVTSGSSNAAVKAWYDQMRSLTGKKLIFYSYQSFATAHANTARKNFDAQWIANYSSRPTIQTDLWQYTNKKYVPALKESVDASTILNSSKPITWWIGGAQSADTAQPTYFTDVVSSVTTTQKLYLYDSTSFKKANRVVKVQPGTKVNVTAIHKRDSGSYYFETADGRYLTANKNYVQ

SEQ ID NO: 4469 - protein, 272 aa, Lactobacillus buchneri
MKLYKLGGVLLLSLVLVGCSNGNSGKQSSNNESKTDMQNSSSSTTSSDTTSGQSASTASSDSNAQSDGQSYDFSSLTKDLSSKLSDTLLPQNSGLSDSSKNVHIRYNGNSSNSTIYYSIGNDALALNDSSLKAEKPYAVLAKRSYSSASEAQSHVDYTAASEIKGLPKVDLGHGIVGHTQSGAGQQYISWNEGNWSISVHGSPVNNTTPKKLALSSVNMFESYSLPAPDTQGVVKFNVGGSAQVITWQAGSVVYRLQATDPAVAIRMAASMK

SEQ ID NO: 4470 - protein, 164 aa, Lactobacillus buchneri
MSVRFEYATHDELPRIVEIYNEIIPSRLATADLEPVSVASRENWFAEFNHETRPLWVMKVDDQIAGWVGLESFYGRPAYQKTAEISIYIDANYRHQGLGQQAIDFVSGELERLGLDALVAFIFSHNLPSQKLFIHNGFTVWGHLPDVAEMDGQRRSLDILGKHF

SEQ ID NO: 4471 - protein, 147 aa, Lactobacillus buchneri
MIDAKNVTITDSEWEVMRAIWTMGSTTSRELIDAMNELQGWSDSTTKTLLHRLIKKGAVEQIGDSRPFTFKPVVGEKESMSAAADDLFDHMCAMRAGSTIAQVIKTRELSKSDIAELQQILAEKAKDAPEMVQCNCLPGKMTCGEDR

SEQ ID NO: 4472 - protein, 744 aa, Lactobacillus buchneri
MANNKDDMNMDHDMDNMDHSKMNMDHDMGNMDHSKMNMDHDMGNMDHSKMNMDHDMTSMDHSKMQMDHGDMDMSGMDMGGDMMMHGGQMMHMGNLKQKFWVSVVLAIPVLLLAPIMGLDVAVLNFHAPLIEGIAILLFDTALYFYGGSPFLKGAWAEVKSKAPAMMTLITLGISVSYFYSIYAFIANNLMHTATHVMDFSFELATLILIMLLGHWLEMNAVMGAGDAVEKMAALLPKTAHLVTENGETKDVQVSDLQVGQSFQVRSGESIPADGTITNGQSTVNEALVTGESAAVNKNVGDKVIGGATNNNGTLTVEITGTGESGYLSQVMKMVQEAQQSKSKAEDRADLVAKYLFYAALSVGIIAFFAWLPQGLSTGLTRMVTVFVIACPHALGVAIPLVVARSTSIGAQNGLLVRNRQAIEASQHVSHVLLDKTGTLTEGKFTVNALVPAADTDEQSLLSKLAALESNSTHPLAQAIIAAAEEKGIKVQAANNSQNIPGVGISGEIDGQNYTIVNGNYLTKNGISFDNATADQWAAKGNSVSFLLQGQQVLGMVAEGDTIKSGAKELIAGLKQRGITPVMLTGDNQKAAEHVAGLLGLDEFHAGLLPNDKQKIVSEYQAKGNHVIMVGDGVNDAPSLAEANIGVAIGAGTDVAIDSADVILVKSEPSDILHFLDLAKITNRKMVQNLWWGAGYNIIAIPLAAGILAFAGIILDPAVGAAVMAMSTIIVALNAMGLTAEKIRN

SEQ ID NO: 4473 - protein, 1897 aa, Lactobacillus buchneri
MKSSNRGIINQEDVTAKHYKMYKAGKRWMIAGLTVAAFGVGSQLSTVTDASADTTPTTQGNSAGSANAAPEPATATASESAPTATTAPATAQKPAAQPATATTETADQTATADQTATPASQTAQPAPAAETQQSTTAQTPKSQSESTTEPQSQPVNSGQTEAANPGTSQAAQQPAQATATPQAAQPAKAAETDTNQPAAKPSTSNNTTVDKAAETKETGTKETETKAADTKAGETQAPESKATEATPAPAQATTEPTIAEDLSYDQAVNVYNASKKLYEIITNQLDQAKNAYDQQLTVYKDKLAEYNQALEKYQDNQTQYSSEKAAYEKAKAEYEAAKTAYDQKKQDYDQTKALNDKAAADYQAAKDKVEAAVTTHTAQKTTYDSALAKYETARSAYEAARAQYEKGQGTSTDAQFKAIQDHYLQTKADYEKTEAEYQTVKTQYDAAQKQIDDLQPQFKDADQKQKATADQFKAIDAEYQKINQQYQQAHTTFANLEKQFTDAGIDFIAKTDAYNQLKADFDAVKGVHDKLAERYSVAQGAYDTLTTRLAELNDQYLIELKSYQEEMKVWDEAYAKAMAFEKAVAESAPEKTANPILPGLQVTPTAKIVDVGDNGVFDLHFDANGIRTIYTNAEMVVNLPADKGLSFDATDLSQYAIAGVTPTYDAATKTLTYHWDTLESGVAQDLHYVYGTEKDTVINGQTVTVGISFKADEISTPVTLSASQTMAMAYSAMVTNTPANVYTDSYGNEYKNPAQEDQAIWDFSVTIPTAQPKNALLEPGSDVNVYYYLAGEQTYVGMTKGTAENGLIDTAPEISTGELKDGSPATVLKWTIKAGDVADQIAKDQTLKFQVIAKVNKDAANFQWLKTDVGVGFTFQGAQPINQLMNKIAATMVLPHDPTTWNVTGGSWKPMVHYGSKDGFGALADKDLLNPDPQVYSDANAVLEFYDALLPLFLFNDVDPEVPQNERLRDFNYYALHQSIDPREDLETVIIHNFVYLPSNSIKDSKTPSGAVGEWTYFKENPYLSLAVKYEGEGQNQYHTLFDNLPTITSDVEKDKDGNPIFATGGNDGSVGYIYINRQQLLAAGLDPTKNVVELYLYMHKKGMGDIPKNPDTISRESIYQYPDYPYKAYKNDTITITDKNGAQRTILKRDLLKSPEDGGLPAGSWAPHGTYGGVYFKTTVKSGATPGTIVHQMTPKVSWSNARTYVSLQDWVSDANAPEGLWRWLAKDEAEQQASIDEGSGWPGVVWQFLKPSTIEIAAPNKNASRYVTSAIFLDGKATGSVLETGAHQLTLGFVLDKSSLGNLVARDTPFETYTVLPKGVTFDAAASKQSGVIPYGNQYSVIDNFKGSGQQVLKIVWTDISNLTPGKNGATRVIVNIDKSAPKDMVFQNFINVGPDTENYIVSVPAISNATLATSQKIADGSTTGLIDTKTPLITSGNYYILEKDSKLQSNQLVSQSDKDDYHHAVAVETGKQATVKITFTDNTDESLSQLDLLDFLPQAGSIEGVSTSDVRTSTYTAGLTGPVVLPADWTGKVNVYYTTEDQANVLKDLSAVTWQLENSVTDWSKITAFRIMLPGTSGQTINGRPAEGITFNLAVPDKSTFISKYAEAGKQVGVGELNDKLKDEVAYNSYVVGVNQMGYTEPLLAAIKVVNVDEKAKEPAQPILDETRPTNNAEQPVAPVAPVENNGTKVVDVTGPTTPEAGTTVVADYQPNLDQPQEPVAPVAPKKAEDPVTPGGNVDPNKPVTPTPSTPTPGTPTPTPNTPGTPNETNPTPQENVVHEDPTESQEPGMIKTGEKAPEASKKQTAKDPQNSKEQLKVNDPGKVVANDAQAGQAKQATTQAVGQAATEKGTNEGRQAVLPQTGDTETGQAVSIIGMILLAMFGWLGFGKKRERE

SEQ ID NO: 4474 - protein, 380 aa, Lactobacillus buchneri
NADPDEPENDENTISPRPANLDEHYDRGENASEMKSTLFVKPGKVEIEEIDKPTIQADDDVILHIVRACVCGSDLWAYRGLEDKEPNSENSGHEAIAIVDQVGKDITTVQPGDFVIAPFTHGCGHCAACRAGYEGSCQTHSDNFSSGYQAEYVRYQHAEWSLVKIPGKPADYSDGMLNSLLSLADVMATGYHAARVANVKAGDTVVVVGDGAVGLCGVIASQMRGASRIIAMSRHEDRQKLATEFGATDIVPERGDEAVAKVMALINGAGADAVLECVGSELSTETAMKVARPGAIVGRVGLPHTKKTDLSSSFYGNLGIAGGPASVTTYDKSVLLKAVLDGDIHPGKVFTKRFNLDEIDDAYQAMAKREAIKSLVVVQD

SEQ ID NO: 4475 - protein, 390 aa, Lactobacillus buchneri
MIVQYAIIWYLTKETGSATILSIATILGMLPMALLSPFVGPLVDRWNKKALLIVPDVVAAIFAIILSVSGGVFHVFPIWLIFVSLLMRSIAQTFQMPTIQSVMPTMVPDKELTKLNGQLGMVQSANMIIAPALGAFLFAIIPLQYLILLDVLGAILGISILIWVQIPNNEKIDAALHMLHNTKLGVQQLMHNKGLWYITITGAVFTLLYMPAASMYPLMTMKYFQGTVGQAGFIEALYSGGMLVGGAIIGIWGKWSDRMKPVIIAFFLVGIPTGLSGLLPGNQTGFMWFAILNVVEGIATPFFNTLLMAMIQQSYPPQQLGRVLGVLNSLMSLTGPIGLIFAGPLADALGVEMLFVIAGIGTVVCGIFALMIPIMREYDLKLQARLAKED

SEQ ID NO: 4476 - protein, 194 aa, Lactobacillus buchneri
MTLPQLDLKNAKGPKATIKTNHGDIVVQLFPEQAPKTVENFVALAEKGYYNGVIFHRVIPDFMIQGGDPTGTGMGGESSFGGNFADEFSPELFNINGALSMANAGPDTNGSQFFIVSNEHVDDGMISQMKTAGYPEEIIEAYKNGGTPWLDFRHTVFGQVISGMDVVKEISQVEKNAQDKPNEDVVMESVTIDQ

SEQ ID NO: 4477 - protein, 370 aa, Lactobacillus buchneri
MAKFDATFRNEVNVTQPYIQGETEDEVARKYHLDKVVKLGSNENPYAPYYHSKNAMIRSISTLNRYPEDDFVNLIQLLADENGLKPENVALGSGAGNIIETVAKMFINAGDEVLIAKQSYRLYREVSRLMGAKVIEIPLTDDYQFDLDDFQQKITDKTKLIWICNPNNPTGTLTDAAKLEAFMDHLPDNVWVIVDEAYAQFADHLSLANFLRYIGHKRVMVIRTFSKFYGLAGARLGYVLGDPEAIQAYDTVTEPFNTNRTAIAGASAALQFDQIESNKARKKILGDREGLVESLGLLGFRVAPSQANFVFAQLPDGAPDATTVVNALMKNGVIVRDCTPWGYPHHIRVTVGTHAELEFFLSKLTEVLSN

SEQ ID NO: 4478 - protein, 238 aa, Lactobacillus buchneri
MIVITLAIGVVLAFVFFIYISSKPVSYTLTALSLLLAVVSMVFIIKNDHDHYGMKQVTTETSQQIYPIGSKQMQMILYQPIGTANKHQVYIYQKSANAKKKSHTQTTDTTNKVVMTSGTTHMVTQTTRWEYKSDAAKLWFGISGEGHKFVKRHNILYVNKSVQVLSAQQAKALKKMMASKSYQAKLKAQGKAFVTKQVMAAMKKNPTMSAADRAKLVKQATAEFQAQAIKTVLAQIKK

SEQ ID NO: 4479 - protein, 490 aa, Lactobacillus buchneri
VGNAVDKNGKSYNRGLMIIVILVGTFCTVLNQTILSTAFPTIMKAFDVNTSTVQWLTTGFMMVNGIMIPVSAWLSTRFNSKWLYISAMTTFFAGTIVCYIAPNFATLLIGRLIQALGVGVTMPLLQTIMLSIFPPAKRGTAMGLAGIVIGLAPAIGPTLSGWVIDNWTWRDLFGMIIPLMFLVILASFWLVRSVLDTKKTGIDLLSIVMSTIGFGSLLYGFSSVGEDGWGSTIVISTLIVGVVFIALFIWRQLTMKTPFLEFRVYRSVPFTVSAILSSVTMMAMVGVEMVIPLYLQIVKGMSAFHSGLTLLAGALMMGIMSPITGRAVDRFGAKRLSILGMSLLTLGSIPFIFITKSTSTLYIVVFYAIRMFGISMTMMPATTVGMNSLPINLLSHGTAVNNTQRQVAASVGTAVLISILTNVTKSNKPAHSMLTSNPLGYRDHMINATLTGYHAAFAISLLFCILALITAFFLKNRGHSTDYTKNGGED

SEQ ID NO: 4480 - protein, 146 aa, Lactobacillus buchneri
LDKEFQQKLAQIMKENDWHLGIGDVANATGVSQTKLRYWERKGYIESTQGKGQNRKFSYSMLIKVYQMKVLLDQGYTLAVAAQKAESKSHELKLARQVLFDRFEGMTEIDGHPAVDLGYLDDNQDSILYAVVKKDGTKFKVVPTEK

SEQ ID NO: 4481 - protein, 394 aa, Lactobacillus buchneri
MLEKITYKELLSHAFDIPVSVTYWDGKTDNYGDGEPQVKITIKKEIPLKKMTSQPTLVLAEAYMNGDIEIDGSIQELVASAFRADHSFLTNNPFLKHLPKVSHSEKASESDIQKHYDIGNDFYRMWLDKSMTYSCAYFEHDDDTLEEAQLNKDRHILHKLNPVAGNTLLDIGSGWGTLLFMAAEDFDLKATGITLSQEQYDYTKQQIKERHLEGKVDVLLEDYREVKGQFNYVTSVGMFEHVGKENLGLYFQKVHDFLKPEGRALIHGITGQHQGAGVDPFLNKYIFHGGYIPNVAENMTHIMDAGMQMSDLEPLRRHYQKTLEIWYANYMKVIDKVKEKYGVPFSRMWGMYLQASAASFEAGNIDVMQYLLTNSPSGTGLPMTRQYVYQAKGE

SEQ ID NO: 4482 - protein, 292 aa, Lactobacillus buchneri
LNSKKMLGALLLSLAASIWGGMFVVVKVVVETIPPIELVWLRYLIALVCLMLFAVIFHIKWRFNQRDLGIIILIGIIGNAISIVTQETGTWLSNAQTGAVITSATPTFMIIFAWWLLGEKLDAVKIISVTMATLGVIWIVGVHFSGTHVLLGIFSLIIAALTWALMSVLVKKVSGTYNSLQITIMSTFVAFVCLTPFVLSHMDVITRAHYLDPKIGLSLLYLGIVSTALGFVMWNKGLQLMNAASSGLFFLFQPVVGTLLGWLVLGETISWGFVFGTMMIIGSVWVSIRFAK

SEQ ID NO: 4483 - protein, 871 aa, Lactobacillus buchneri
MNLKYTTRNILLMVALSAALTGVVLAMIFTVNQITPFGTHNLLVGDMSAQYVPFLTGFRNALLIGHFSLFSFSLGVGENIFPLITYYLLSPFNLLVLLFPASQLPVAISWIFILKDMTIAATTCWFLSRHFNRIHLLLPFFTLAFSLCGFASANFVNIMWLDGLIYLPLICDGIDQIKAGNQSISLFVWLTAAIVSNYYIGYMLGLFTLIYAVETIIRTNDLHFSWITAISHNRQFITRFIFTEAASVMSSMVVLLPTMLGMLQTAKTSPSTANSLAAAAKPQFGLEIFSQLGLGGQTYDNRLLHAPAIFSSLAIALLVIGYFFHPQIPRNHKLAVSVTAGILSLSMLIGPINLVWHMLNEPSGSPFRYSFLLSFVLISAAYEMVLANPQGLSFKAKLSTPTILAGLLIVGYLDIRLGRHVLTNDYLAVQPNSLNVLIVNLLLTVIFSYLLFTAVHPMQQLLIGTIVCLEMGANFGYTLKSEPLPLQTGYETAYPRVDTIVSKTKTTDNQLYRIDQSHSQLAPIFKETYLGYNDPVLFNYNGIQEYSSTLTESTRQSLKMIGLFSKNQRRISTAGSTAISDMLLGVKYQLNPAGKIEKNASFAGIGFPVTNQFAHLQLTAGTLFTNLERILQRLAPSNQPYLVSESGTNPQRQTIGAREKYTLTIIPKLSGPLYFDTSDKLLDYSAIYVNHTRLKTIPNQLDKQYLVKLGTAKRGVPVTLQLTSKSQNTLHESHFNSLNDSQFSKVDQHLKQSAFTPTYTNDRLVGTAVRPNSQSEWLYTAIPYDPGWTATVNGQPVEPIKVLGNFTALPLTDQSNHIVMSYHVPGLLLGIILSLLGLLAFSWRQFRNLALRKDVSQQAPGDGTPSNGETY

SEQ ID NO: 4484 - protein, 221 aa, Lactobacillus buchneri
MQTSTIKNHPLLFFGWLIFIGITGLVLLQNVQLYFWDRDFLNYLQRFITPDRTSFFKGVALFGSPMITVGLAIIASVFLWQRKMLEEALTTLVVVVTGNAGGLIIKQLTERPRPTTMLTHDSGYSFPSGHVVSAVILLLIVFQFILPLISSVRLRMFFSMMLVFWVALICLSRLYLQVHYPTDVIGAALYGLLWWESAMAVLHHQQFNTQKVIQHNRGQSS

SEQ ID NO: 4485 - protein, 468 aa, Lactobacillus buchneri
LANKQHRTTYQAIRHHFIILLTFFALFTGIAVVLVVGVNLVRQSESQSVELLRSLNRSFIDDKPDWKQWRKNSSINTENTYVRVTDQVHTAKQPELFYSQGAPQFLAAAPTPISKMIHIPVFPALIYAKGYGLFYYRSGVRHGSQKNIRSEIWLSLNPIVQLLTSVILIVLLVSLASLSLGWFVISLIARQLTEPLQTLQEAAKAHSQSINRVETLLPVPESPVEAQQLAISFNDLLSAIIKNNQKEKAFISNASHELRTPIAAIRGHIALVKRRGKAHPEIIDSSLHFIDDESAKMQALVNSLLALSRADKEVVTKSHFDLAVIVNETVEEQRVLLKQPIQVVGEQSAIVHANQTNITQILSALLDNAGKYSPPDAQITVKISKHDHQTVLAVENNGPSIPKADQAHIFDRFYRGDPAHNSHITGNGLGLAIASQLAQLNDVGLRVKSILPHGVSFEVSFSDPDLTK

SEQ ID NO: 4486 - protein, 195 aa, Lactobacillus buchneri
MTNTILLVEDEEALSSYLIPELKFEDYQVLLAKDGQEALQVYDNNRGNLDLIILDWMLPKLDGLEVLRRIRKNDDIPVIMMTARDYVGDKVAGLDSGADDYITKPFEIEELLARIRVVLRHESHHHQQSELYTVEDLTLNTKSRQVSRGNQLIQLTQREYELLLTLIRHGGETLTRDELLDAVWGVRFRRPAKCR

SEQ ID NO: 4487 - protein, 145 aa, Lactobacillus buchneri
MPAIQSETSYEIGEFAEIVGLSAPTIRYYENQGLLKARRTDNGRRYFTEQDIKWVKFLLHLKGTGMSINDLKKYVTWRAEGDQTIPDRLDLLKKTKADFMEEYRQVQHHLQILNDKIDWYEAKESGKDTGKEPFATYLQRLGHHE

SEQ ID NO: 4488 - protein, 138 aa, Lactobacillus buchneri
MVKNENVKNGVIFPAGPKNDAYAKYFVGQSYLQGLVNDPAVNVGVGNVTFEPGCRNNWHIHHDGYQILLVTGGEGWYQEAGKPAQHLVPGDVVVTHDGVKHWHGATKDSWFSHIAITAGTPEWLEPVSDEEYDQLEVQ

SEQ ID NO: 4489 - protein, 105 aa, Lactobacillus buchneri
MAKKQTAGRDALGDFAPKFAELNDDVLFGEVWSRESKLSARDRSMITCASLMSQGLFPQLEAHMKMAKANGVTKDEMVEIITHLAFYAGWPKAWSAFDIAKKIFD

SEQ ID NO: 4490 - protein, 213 aa, Lactobacillus buchneri
LKTVLILGAAGQIPSFLIPQLLKQTDFNLKLYARNATSRLHVTDPKRETVIDGDFNDHDTLNQAMDGVDAVYLNEMRDITSVKNIIQAMDANHVRQFIGATVLGIEDEVKGAFGQWNTSMIESSITKRKTTAKAIEDSDLTYTLLRLAWLYNKDGNTNYELTESGEPFGGTEVTRQAVAQLIIDILNDNSRKFARKSIGVNEPNTKFDKPSFY

SEQ ID NO: 4491 - protein, 465 aa, Lactobacillus buchneri
  misc_feature (8)..(8): Xaa can be any naturally occurring amino acid
NADHPERXIDASEMKVIVVGSSHGGFETVRGILAEKPDTEIQWYEKGDFISFLSCGMQLYLEGVVKDVNAVRYATPEQMRAQGVNVFVHQEVTSINPDEHTVVVHNLDDDSTREEKYDKLVLSAGAVPAKIPVPGGDLKNVYAMRGRDWAIKLKEKTVDPDVQNVTVVGAGYIGIEAAEVFSKAGKHVTLIDILPRPLALYLDQEFTDVLSKTLKDHNIYLATGQTVKSFNGEDGQVTAVKTDQAEYPSDLVIETAGIKPNTDWLKGTLDLTDKGLVKVNDHQETSQPDIYAVGDSTKVPFAPTGKELQIALATNARRQGRIAAKNVLGDDMKMPAVSGSSALSVFDYHFASTGIKEGTSAANGVLSQSVFVTDTTQPPFVPNEAGNQKVYFKLTFDPGNHRILGAQIMSKRDVTANMNAISLAVQAKMTLDDLAYADFFFQPGFDRPWNIMNVAAQKALQTLAK

SEQ ID NO: 4492 - protein, 152 aa, Lactobacillus buchneri
MKVLIELIVSFASTVGFGLVTNVPRRSLLPAGITGSLAWVAYYLVLQVDNGLILPNFTAAIVIGILGNISAVMFRVPVNIIYVPSLVSLVPGGILYLGMRSFTLGNEIRTGQYMFNALTIAIALAVGFVVAEVIFYRIKPFLLRLLAKQRER

SEQ ID NO: 4493 - protein, 270 aa, Lactobacillus buchneri
MQRDFSRGESMDQSISEDELIAVCGKVGKILLTSGAETSRVEGTVEYIGRAAHYDISCHATITALFVGVKNQTKTHLVKVRLGDFNLEKVDEINTMSRKFVTGQIDFAELKRTIDQIDKKVIDFTWPEKVFGAAMVSVAPMLLFKATWADLSLAFFVGIFGYLAAALSSPRIKTPYVAAGLGGFTVGFLAAVLQSLGIATNAGNIIVSALMPLVPGVAITNSFREIIDRNTISGVVRAVDALIIAGSIGAGVVLGVGLSGIIFHLIGGGL

SEQ ID NO: 4494 - protein, 42 aa, Lactobacillus buchneri
MIKLLAIIKNTLDIEEKSNVNAFLKRASFGERSGLQRREDEL

SEQ ID NO: 4495 - protein, 291 aa, Lactobacillus buchneri
MTANAINGFLLAAQKWVNHEVTNPLSILVLNLMPTRVNTERQFLTRFSEIGSDAELTFMYPSSHHFRGTSTDLIQRDYVCLDQIRDAHYDGLIVTGAPIETLPFNQVDYWDELEEIIDWSKDHATECLYECWAAQACLFHDFGVRKHLLLSKLFGVYPAETINAESPIARGFGAGGLLKMPQSRHTGIVLDEDHLPEGLTVDVSAAVTGPIILSADSLHSTYITGHPEYSEGTLALEYYRDLYEQMPIRLPQNYFIDQDSGTVDYSWKNSSIQIYDNWMKIIANKKVGLSI

SEQ ID NO: 4496 - protein, 440 aa, Lactobacillus buchneri
MTEENSHLHFETLQVHAGQTVDETGSRAVPIYQTTSYVFDNPEQAAGRFGLTDPGNIYTRLTNPTTDVVDKRVAALENCTGGVTLATGSAAITAAILNVAGKGDEIVSASTLYGGTFNLFNVTLPKLGIKTHFVDPDDPANFEAPINEHTKALYIESIGNPGINLIDFEAVAKIAHKHGIILIVDNTFGTPYLVRPLDHGADVVVHSATKFIGGHGTTMGGVIVEGGKFDWKESGRYPGFTEPNTQYNGLVFADLGGSAFTTKVRAESLRDLGATISPFNSFLLLQGLESLSLRVERHVENTKKIVNFLDRHPKVAWINYPGLEDSKYHDLAEKYFPKGVGSIFTLGLKGGEKAGKQLIQNLKLFSLLANVADAKSLIIHPASTTHAQLNEEELREAGITPDLIRVSVGVENADDLIADLSQALDKIPEDVQETVGAPKP

SEQ ID NO: 4497 - protein, 342 aa, Lactobacillus buchneri
LQVALVGITGYAGMVLYQLLRRHPEVAGINLYDHKLTENEKLSQMVSAFYTDDTQVQPYDPKTIMVDNQMVFFATSAGVTAQLSQPYIQAGFPVIDLSGDLRLEDASEYQRWYHKPAAPQLAMRQAHYGLADFESAVHQTYVANPGCYATATLLGLAPLVQNDLIDPGSIIVDAKSGTSGAGKNPAQATHFTQANDNLQIYKPNQHQHIPEIMLELQRWNDDVAAIQFMTTLLPITRGIMSTIYAKVKPGVGGAQIDQAYATTYGNKPFVHYIGEHLPDIKQVVGTNNCDIGVVYNPVTQMMVVDSVIDNLLKGAAGQAVQNFNQMFDYEETSGLNLQTFLP

SEQ ID NO: 4498 - protein, 402 aa, Lactobacillus buchneri
MQMTSKTLIEVSQFTWPKGFSADSTHAGFKPDQDDMGWLYSSTPANAAGVYTTNQFQAAPTKLTKQTINLAHQLQAVVMNSGNANSCNGAQGETDALMMQKMTADRLQIDPQLVGIASTGVIGEPLPMDKIKAGISQLKLTQNVGVTKAILTTDTHPKTMTVKCLIDGQEVTTTGFCKGSGMIHPNMATMLGFVTTDAAITGEDLQQLLSTTVDETFNQITVDGDTSTNDMVVVMANGAAGNQPLTKADPDYPTFAAAFKQVLTHLAQEIAGDGEGASKLVEVNVSGAYNHLEGQQVAKAIVGSNLVKAMIFGEDGNWGRIMQAIGQTTAHVDLNGVSVAINDLELVYNSLGTGIDDDKVAATLKQNKVVIDVDLHAGKATGTAWGCDLTYQYVQINASYRS

SEQ ID NO: 4499 - protein, 249 aa, Lactobacillus buchneri
MSQIIVVKVGGHATDQLTEEFFEQLRSWRQMGKQILIVHGGGPQISEWSAQLNLPVAKINGVRVTSPQTLKVTQAVLLGLVQPTLCRQLSAHGLPVVGLNAGGQPVLVGDYLDQAVYGEVGQVIGINREYINHALADGIGVCAPLAMTKSGKNLNVNGDVAAAAVARLLGAEKLYLVTDVPGVMVNSHVIDQLSLQKANQLFEAEIIKSGMQPKIKAAFDALKHGVKEVKITNQLQHSGTSLSVKQLAI

SEQ ID NO: 4500 - protein, 387 aa, Lactobacillus buchneri
MEHVFPTYAQYPMEIVSGHDWHLVDSHHKSYLDFTSGIGVCSFGYSNDWIEQSVINQLGKVWHTSNLYPSSLQDEVAASLCPAGMLAFFCNSGTEANEAAFKLARKATGKGKVLAFNNGFHGRTYGSMSLTGNPDIQTGFKPLVPEVSFADYNDPQALDAINEGLAAVILEVIQGEGGVVNGNGEWLQKVAAKCHDQGVLLIIDEVQTGIGRTGMKFAFQHYDLDPDIITCAKALGNGLPIGAMLGKKELAKAFGPGSHGTTFGGNKIALASAKAVLEQLTPKFLAEVQEKSQAVFAAIHKQISPLTVVDSVSGLGLMIGIHLSAAVKVEDVIGQLQENGLLTLSAKHNTLRLLPPLVMSEADLLAGIDQIAAVLAKVAAVSESQSV

SEQ ID NO: 4501 - protein, 167 aa, Lactobacillus buchneri
LQIVRHFLNYGWSLLGGLVALLLIYFYDGALQFPDWSTKGSLRLVFNLSAWDWYFLLDMLLILPVVRILMRQAFSQESVEFETYKDKALRLHHADVQANHKNRAWSANGVTVNPWEFRYTQTQSYKGAADFGFNIFKNLCLNLLIVLFGPLWLIYALIKRSRHRKSL

SEQ ID NO: 4502 - protein, 110 aa, Lactobacillus buchneri
MGYMFFYGRLDENSVKFAAAPEKLKTRGGSPNQGVAFNNVNNRIYVVSDDVLTSIPVDKLTAGTATPDDVNYSVFQSKREWECLAFDSQGYGHLLALWPAELMKSTAPLN

SEQ ID NO: 4503 - protein, 231 aa, Lactobacillus buchneri
LGVHAATVNTDNQPLAQTSVQKPAESQTAVNDDAQASNGSQSANSTANVSSSNDTASLKAEAVSQTATPKAKKTVSRSTEYRETKTNTKVKKTRRGTKTVKQQVIRKQVVNNTKKGKSANQSANKSNTSNQDDSTNSTQADTTSPVNANNTTAQQNTTQAQPTITPAEAQANQDAQNQNIQLQPQLTQSQISANKGQAIYDITGAFSNIVGQGTAIVNSICEIISTIRNLL

SEQ ID NO: 4504 - protein, 407 aa, Lactobacillus buchneri
MKPIKYKYLYRALSLVGISVMSVLLIGTTGASAHDQSQFNNVTNSQNQTNDDGNNDNDNGNDDNNNNNNHGGGGYIPGGNTSGGSVNNNGDGGISAGGATAGAKSGNGGASATVAINPNNSNSPASKAPNATTSSSTNMTKQGSQNSVEQPSPNNDKAGQSSQSSTPTSQKSGAAVKPDEHSQVESVRSTKVTQPGQFSPENRKKARPYKTTWKKGQRLDKGQRREVGYMKAYYKYYSAQYPDFHYAGGGDCTNWSSQLAHVGGYNKTSRGKETYHIVHGYRCKNPKKWYAGVYRKRGQLIKHKAYSTSWTTVGGFWHYFTHVKKRPHFVTHSLRRVMAHVRVGDVVQFLGRTSEKHNSWFHTVTISKVTKHMVYYTSHDRNVLFKPLVKAGASARISKYRVIRMGI

SEQ ID NO: 4505 - protein, 95 aa, Lactobacillus buchneri
MITSIIVFTVLTSMILLSISPANTVRMTMFLSGHPSYAIKCNPVHDTGLSKAMDANIYTIQDKYAYNRLGMKHVVLFEVHTILIFHTATATYRYF

SEQ ID NO: 4506 - protein, 42 aa, Lactobacillus buchneri
MRHLRYSMVLIEMKQVDGLNRNTRISQEPEMVYEIGHQYPHH

SEQ ID NO: 4507 - protein, 120 aa, Lactobacillus buchneri
METSSRKISQILIGLLFILIGGIAIFLSIFSLGPLPISKSMAAVYWLIFAGGMNVVGGIVCLFTHRHSVLIILAAVLFVVNLIPGIQQVISGNYFLFPIIVVLMVLAIAIGAVGLWDRNK

SEQ ID NO: 4508 - protein, 87 aa, Lactobacillus buchneri
MRFKKPFNNIFKEISDYQVTADRISSWAFDIFLVLFFSIAVNTTLSLLEYWIGLMFTFVLIWLFRPKSRINKEILKLFNRHNNYQAK

SEQ ID NO: 4509 - protein, 79 aa, Lactobacillus buchneri
MPITNRGTAILVYKYPFNPNVGVKMIKTRRGCRFFTKLVLTFTVITVIGLGGMSFSSQILMTFPMSITLVPPRVIDITP

SEQ ID NO: 4510 - protein, 349 aa, Lactobacillus buchneri
LNDQDYMQLAVTEAWKGLGATWTNPRVGAVIVKDGRILARGYHHRFGEPHAEIDAISHLNSLTDAKGATIYVTLEPCSHYGKTPPCADRLVALGFSRVVIGQADPNPIVGGKGIDRLTKHGVVVDNLDDTEMVNEAYNFYYRRKRPMVTLKYAMSLDGKINQAGNNRTRLSGDEAWQDSQRLRQLNQAILVGERTYRVDDPRLTIRSARDETQPLRIILIRDARHLDLNAKLFQSSEPVWILTSHQPTFALPEFVKAFEAPDWSPAAVVKLLSDQGIQSLLVEGGSHVQAAFVAAGLVDKLVAYITPLMIGGTGLSAVTGLGNAHMLRFTSPTIQRLGDDIKLTARRDD

SEQ ID NO: 4511 - protein, 202 aa, Lactobacillus buchneri
MFTGIVQDQGRVARIQRANHQAKLAIQTKLIRQSAFSLGDSVAVNGVCLTISAFEPDGFVADVMPETMLRTNFKDLMVGDSVNLEPALAASDRLDGHFVLGHVDTTATLLARKPDDDSQRLTFLIDQKYQPYIVEKGSVCLNGISLTVVTTTLTTFEVALIPYTMIHTSLGQVAIGDQVNVETDILGKYVVNLAQKGLANYE

SEQ ID NO: 4512 - protein, 405 aa, Lactobacillus buchneri
MNEQIIKRVERALAELKAGKLIIVADSVDREAEGDVIGLAEKVSAKNVNQMVTKARGLLCVPMGAEVAKRLNLGLMIPDSSDAFGTAFTTTLDAKTTSTGISAFDRADTIHQLANGTSTWDDFYHPGHIFPLIARKNGIYERQGHTEAAVDLARLAGASPVAYICEILKKNGKMARRKDLKAIAEGNHLTLLTIDEIIAYRRYRDAQPIQSITTVSLPTRYGDFTLEAFDTGDDSEPTLLISKGHLAGDEPLLTRLHSECLTGDILGSKRCDCGPQLQEALRRIQRNGRGAVLYLRQEGRGIGLANKLKAYALQEQGLDTVQANQHLGLPIDNRNYEIAAAILKRKGVSKVRLMTNNPDKIHQLAEYGIQTTERVSLEVGLTPENKNYLLTKKTKLNHLLSEVGN

SEQ ID NO: 4513 - protein, 158 aa, Lactobacillus buchneri
MNNFTGKLISQHKRIGIVVAQFNELVTSRLLEGCLSQLALLGIPDAAITIVHVPGAIEIPREVKLLGDSNQVDGIIALGAVIRGETAHFDYVCQAATTGLSSLTLNGPVPVMFGVLTTDNTEQALARAGGKAGNKGSECASGLMQVLTVESQIAGMKG

SEQ ID NO: 4514 - protein, 273 aa, Lactobacillus buchneri
MDTLMNFAPWQQALFATLFTWAVTALGSALVFAFKTIRSHALALMYGFAAGVMIAASFWSLLDPAINLAEQQDRIPWLVVGIGFAAGGFFLYLADKIIPGIYLKRARTEGSSRAAVKRAILLVFSITLHNIPEGLAVGVAFGAIGAAGNGEQAAMLLAATTVAIGIGLQNFPEGAAVSIPLRQGGMSRFRAFMYGQASGAVEPIAGVLGALLVASVNSLLPYALSFAAGAMIYVACKELIPEAHARTKEESHWAIFGIMAGFTLMMVLDVALG

SEQ ID NO: 4515 - protein, 219 aa, Lactobacillus buchneri
LTKVTAYMVRHGQTYLNMYNKVQGWIDSPLTEKGIQDAKSAGKRLAKINFAASFTSDSGRAIDTGKIILKANPHNMNIVSYQYPELREQFHGYFEGNDLNQMWQFVGAQVQETTEKEVLTNFGLERARDLIHRADLYNNAENNAMFWERLDHGFDKIRQNTHDGEDILIVSHGMTIRSIVDRYAPKLDLGVATKNGSVTKLIITDDDIDVEYFNNLGEV

SEQ ID NO: 4516 - protein, 541 aa, Lactobacillus buchneri
MITIQNMGLQFSGKKLYEDVNLKFTPGNCYGVIGANGAGKSTFLKLLRGELTPSSGEIHMDKNERISSLSQDHYGFEDQTVMQTVIQGYQHLADVMAEKDALYAKADFSDEDGIKAANLEAEFAEMDGWNAESDASQLLQSLEIPEDLHQQLMSELTEGQKVKVLLARALFGEPDILLLDEPTNGLDVYSIEWLENFLADYPKITIIVSHDRHFLNQTCTMMCDVDFGEIKMYVGNYDFWLQSSQLAAKMRADSNAKKEDKIKELQAFVARFSANASKSKQATSRKKQLDKISLEDIKPSSRKYPFIKFEENRPLGNDLLRVDKLSKSIDGVKILDNVTFTLRPGEKTALVSRNDLATTTLMQILAGELTPDSGEIKWGQTVEMSALMKDFASEFKDNDQRIIDWLRQFAEKGSDDDAFLRGFLGRMLFSGDDVNKEVNVLSGGEKVRCVLSKMMLQKGNTLLMDDPTNHLDLESITALNEALVNFPGSIIFTSHDHEFIQTIANHIIEVSNNGLIDKADTTYDEFINHPDVQKKLSDLYD

SEQ ID NO: 4517 - protein, 976 aa, Lactobacillus buchneri
MKVNKYLLMSLLVISTGGILTFANADSTMTSNDVAHAATTQVADDAVPDGTIVTPMKVVKAPDPADKTDNPTIDPKEHSDIPVTNFYKGSVFHQAPIYVSGKLANPMGTNAKVGSQTISDTQGTINSNDYIQAPNPDETINYAYYTGSNAWMIGWAKDNSKFYLHNVDSDGKLTNTIEVPGPTASDFNPNWTYNAGNVQFSWQNGHIELDLQNNDLYASSSANPLNYLNNVPAKFVDAKGNELAPTQNISGYSGTFVDVNYPTIPGYRLVRVPYMNNAHQFLINNITATTPGDWQFEQSNRYVTIARKVIDDQNTQQMYMIFDYSKIPDFSFTGKAQSKTVTVKATPGGFIAADFSYGMIRTYATASMPLPVGNPLTFVYEPITEYHLTINYLEKGTNKVLADPYKASGAGTYEIDSPEIAGYTADQPVVKGVLGKDDTINVYYTPKDVPPTPTNDSAAVNVNYINEATGDLIQSKKIYGKIGGDYQADGPYQPDKLTVNGDSYTLDKDKLPANIKGQFSDQTPAVNYYYKKDATPVTPTNNSTAVTVNYINEDNNDLIQSKKIYGKNGDTYQADGPYQPDKLTVNGDSYTLDKAKLPDNINGKFTENAPAVNYYYKKDATPVSPTDNSATVTVNYINEETGALIQSKKIYGKINDSYRADGSYQPQTLTVNGQTYTLDTDRLPNNITGIYSDKTPDVNYYYKQKQTPVTPVNPPINPVNPVTPVNPTPTPSPQPTPGTTTDNQSGKIAKKGEVVYSLKKIYLYKDKTFKKADRQFGYVKKPRVFRPMFVVTDYAKSNAGWLRYKVRDVNHLSKTDGWTGYITTNFDYVRPVYYHSSHQTLTVINPRGVNEYLNKNLTGKVKNIKQGTVLHVTGFVKHNLTTRYVLSNGHYITGNRKLVKMGKIKQPQQLKATHFINRYADPNLAKRNGHFKKGTKLVIKRYTFSHEASLIKSGTMRYAVKGGYVTANQKYVKVIK

SEQ ID NO: 4518 - protein, 132 aa, Lactobacillus buchneri
VTQELGTTDLGTYEYVSRVYNENIQLPDYKLPTSVADGTQVFFDTDVIKLSMVIADQRVQKITIVTPKPQSLEYMRVFEGFEFGMEALGTWINTYHRSTLSHGKAADVVNGILASYSTTKDNVLTVSLTRAH

SEQ ID NO: 4519 - protein, 339 aa, Lactobacillus buchneri
MVKIGINGFGRIGRLILRRILEINDPDLEVVAINDLTSPSMLAYLFKYDSTHGTLPYEISSTDDSLVVDGKNYRVYAEKDASNIPWVKENGVDLVLECTGFYTSKEKSQAHLDAGVKKVLISAPAGPMKTIVFNVNDDTLDADDQIISAGSCTTNALAPMAYFLNKEFGLEVGTMTAIHAFTSSQMILDGPKGKKFRPNRTASANTIPHSTGAAKAIGLVIPELEGHLQGHAQRVAVVDGSVCELVSVLNTKVTADQVNDAIKPHTVDNPAFGWNEDEIVSSDIIGDTHGAVYDPTLTEVTSNGDFQVVKTATWFDNEYGFVSNMVRTAKKFAEVSGLN

SEQ ID NO: 4520 - protein, 472 aa, Lactobacillus buchneri
MSNTNEKISRQTYLALLAAALLSFTGILTETSMNVTFPELTKVFNVTLDTVQWITTGYLLMVTIVMATTAFLLKKFKSQSIHLLAAIAFVVGDIMCATSPSFPILMSGRLIQAIATGLSTPLMFHIIFNKIPAGRIGSMTGLAGMVISLAPALGPTYGGTVSSTMSWRMIFWLILPIIVISWYLGSRYIRIDPVGTGGFDVISLIFLAATLFSFVFGVSKAGKYSLLSGQVLIPFVIGFISLAIFIYSDTHGKTQLLDIRILKWLSSSLSAFTYFVLQFVNIGVSFLIPVYCQYVLHSSPFIAGLVLLPGSLVGAAISPYAGHLADSKGYALPIILGLSSMTLGGLIFFGIQAVLTAWIVLLNYTFLRFGFNMGFSNTISNAMLNVPRKYTADVNSLFSMIQQFAGSIGVGIMAAVMAISQNNGTGSLAARSFVGGKYDFLLATLLSAAALIAAVINFRLQKRMKLNIEESD

SEQ ID NO: 4521 - protein, 285 aa, Lactobacillus buchneri
MKTAVITDSASYLDPAVAAQYNITVLPITIIFGTQEYHDGVDITSQEFLKKLAETDKLPTTAQVTMAQMQEAFDTLAAKGYDEAICVNLSSGITSFYENLVAYSHQVTNIKVYPFDSKIASAGEADLCLLAGKMAENGENADVIIPKLEQLRDSIHVSLVVDSLDHLRRTGRISNTSAFFGNMLKIKPILTFDDAGKIVPEAKERTMKQALQHIINSIDQTTFDSPMRISVVDANNPDLSKAWVTAFHEHFPKASVSTYQISPAIAVHTGEKAMGVVWDLDWNQI

SEQ ID NO: 4522 - protein, 620 aa, Lactobacillus buchneri
LIRNKFCTLSTKLAQLILTTVTIGIAFLILGGITSFAATASDNGATIQRTMWLTGEPANGGSPVTLSSVVSSDSPTNYKAPGDVTTPQNGRTVNLDKYKNLLIHYSVENISSQAEKVEAVLFFPNYAPVFSYDSSRANQISFNSEQTDPKFTDGYSYVGGSYTATPISDQTPIAIYMGGPIDPADGAPSAQSLSPTKKLTMVAPVKPNSHFDFNNPIDDSFYNDTYVFGFVSDDTDTQLGDQDLYAKPFKNIVLANEESLPATNYDNYNDLVKAAVANVTALFNDDATKDTTTDPASIVKVTPGTTAGSWNIDYNYSGVSKHITGIKTTDASYIDGKDFKVNYGSNWDSQKFNGLTKHLDQNGQAVTKLSDGVNVTIQLNGKTVNAVDTNNAGAVYDVTYTTGNNAASKTVKVTVGQRGNIPSNNNSNNNNSTTNNNGNSGNSAWNPSNPSNPNGTGLPNYAAVKGSAVYATKGIYMYRSANFKKSQRMATYPKAKRVNRPMFVVLGYDKSNGGALRYKVRDVNHGKKTAGKVGYITANPKYVVNVYYKTMPKSHKITVINKKGIHAYKNVNLTGRAKTFKKGTHVTVKSFEKHNLTTRYKLSNGTYITANKKLVIQGNY

SEQ ID NO: 4523 - protein, 256 aa, Lactobacillus buchneri
MKFISWNVNGLRAAVKHDFAETFKKLDADFFCIQETKMQEGQLELDLPGYQQYFNYAERKGYSGTAIFTKHAPLDVTYGINSDEFNHEGRAITLEYPDFYLVTSYVPNSGAGLKRLDFRMGWNKAFYQYLTELDAKKPVILCGDLNVAHKEIDLKNPQSNHHNAGFTDEERQDFTNLLKAGFMDTFRHFYPDQTDIYSWWSYRFHSRDRNAGWRIDYFVASNRLADEIEDSKILTDVFGSDHCPVELDTKLPRPMI

SEQ ID NO: 4524 - protein, 134 aa, Lactobacillus buchneri
MKQRSKVLMLSIGLGLALSACSAGTPASKKDSVTVYDAHNRQILTTTSQAKIKRVTNLTSQSDRSTVNGQLPAGLRVKYRYLLHQRAHDVNINLYVYANSRNVKMTQIPILHTIVYQLSKQDYEKLSQPETYLK

SEQ ID NO: 4525 - protein, 290 aa, Lactobacillus buchneri
  misc_feature (4)..(4): Xaa can be any naturally occurring amino acid
CAAXAMINTERMINALPRTEASESELFIMMNITYLENSVTRRYWQAAILEVLVFGLLIAIYSIELALGMGEISQIAVQEILLLVIFFALNYYWIKQPVRLAATVNFGKTLLISVPFILVLLYLLLISLAPHSTHTIVMAAVSGIGAGVFEEYLFRGLILGILLKSFPHFSKAKTIWYAVTISSILFGIAHGSNFMSQSVSSTLVQIFGAISIGFLLSALYLRSGSIIVPMLFHAAWDATIVLVSGSTFANVGSSTFSPLATVGELVLFVLIAMFYFRKSKLSEIDLKHFE

SEQ ID NO: 4526 - protein, 272 aa, Lactobacillus buchneri
MTKFRLQFGLFALGVLLTIGATIPVDASTYLSHFSKDQYLMTKKTIHTTNSHYKNIKITIPKGTVFKSSSLTRSRKTKHPYLTINLNRLHWSLRKGVVQSYHNVTTTSGIWAKSSTFKKVHAPAYQSYFKQPYTGTIGGLIWQGTKAFPLRQQYKIENCLRVTDDGYLEYFTGYDYWVKKMPEPHSAAKVEQLVKKGNAYYFYTKSKISGLTMKHVAKKGNHRYRLKITKTDQHMATVNPAQDKKYDESVTISIRYYVGGKKFYVNSQVIEP

SEQ ID NO: 4527 - protein, 269 aa, Lactobacillus buchneri
LKPTTQLIAGALFMLGATFIQTQPAHATVVKNSFLKTQRSISTYNSNKHAKLTLPKGTVVQVAGTKHLHGNKYVDVYVDRLSYNIRKPLLSVKKPTVYSHWIRAKGYNFKQIHKPTYLSYYAAQSDGKKSQGKVRTETGDLWKGTRLPVDYATSAAARLRVTTDGYLEYDASSPFVFKVSPKPTASLKVEKASHPMASGETILTTKSRVKQLPFVKKSKDHYQLTITNAEAGTITVVPNTSKVKKILTNWIFKVGKESWYENNSVTTFK

SEQ ID NO: 4528 - protein, 581 aa, Lactobacillus buchneri
VDDKIEDAYQQWTNQPNLPENLVLDLNKMKNNSDQKKDAFGTVLSFGTAGMRGVLGAGTNRMNIYTVRQAAEGLASFMDTLDEATRKRGVAISFDSRYYSKEFAHESAKVLGYHHIPSFVFDDIRPTPELSFAVRHLNTYAGIMITASHNPKQYNGFKIYGQDGGQMPPKESDLITSYIRKNSDLFAINVTPEQELREAKIMNLIGEAVDQAYLEKVQTVNIDHDLIKNVGANMKFVYSPLHGTGKIIARRALEAAGFKNYVVVPEQTIADPEFPTTPFPNPEFPQAFDLARELGKKVSADVLIASDPDADRLGCAVRQPDGDYTLLSGNQIASVLLNYILAAKKKAGDLPADGTIVKSIVSTDLAPKIAASYGVATNNVLTGFKFIAEAIHHYETEHDHTFLFGFEESFGYLIKPFVRDKDAIQTVLLLAEVAAYYKSQGKTLYDGVQEMFQKYGYYAEKTIAKEFDGLDGKDKMAHIMSELRDNPLTEFNGHKVLSHADYQSSELTDQDGKRTIIDLPKSNVLKYWLDDETWLAVRPSGTEPKVKFYLEVDDKSQGAADQKLAGYVDAVDKMIDKLMNN

SEQ ID NO: 4529 - protein, 341 aa, Lactobacillus buchneri
MATIKDIAHKAGVSITTVSRVLNYDKSLSVSDLTRKKIFEAAEALDYTKKKRSSSTRDTIAIVEWYTEQQELDDLYYLSIRMGVEKQAERDHYKIKRYFAGDPLTAIDDVSGIVAIGKFSDAQIEEMQEVSDNLVFVDFDTLAKGHDCVVTDFDSSTKSVLKYFIENGLKRIGMISGVEYSSDHELKITDHRFDVFKNYLEKRSLYDPANVFVGDYTLQSSYDTVDEALKRSKESFPNALFVSNDAMAVGALKALHENGVKVPDDVSLVSFNDTAVAKYVIPSLTAVKVNTGKMGAVAVRLLGLLDNNLDNDEHTPEKVVVATRLVERESVRKGKPIHEAD

SEQ ID NO: 4530 - protein, 280 aa, Lactobacillus buchneri
MMNQIKLVTDSAAHLSKADLQAYGISVLNPPIIMDGKLLGYVNKISSEKFLQLFDQCSNKPIIGDVSVGEITRLYNELGADGSQILSIHLSDKLSNTYANAKTAASKSTSQVTVVNSQVTAAGLSYQVLEAAKLIAAGKSIPDILPQLTKIRNRTRIFFSVRNNQQIVNNRIIGKLRGFLGKHANTAYMIQFGDNDFDLVAHGSKDESLNEFWQTQMQAMHDECIVKLTILHSGTNARAQFLREMLNDEFPFVPISIVPTNPEMTTFIGRESTGVTYLLG

SEQ ID NO: 4531 - protein, 104 aa, Lactobacillus buchneri
MKGKYEVNQFIGVPLETDDSGQYRIKRDESGDFKLHSWRTGKHTKGKFKQVGQIFITENNLMVGIIKAIPVAFKDRHQYTPLQRFTSEYVSDEVLNAGKKKLEK

SEQ ID NO: 4532 - protein, 119 aa, Lactobacillus buchneri
MRGKRNSKNSVGGTNWGENMIYLKRILKYIGIFIVGVVVLIALISLSPKESVRVRIANAGHPALAVKCNPKLEKGYRDPHYLIPYKQAYLSDDGSYMVNEFAVKRVLVFHYAKQVVPIL

SEQ ID NO: 4533 - protein, 257 aa, Lactobacillus buchneri
MTTFTKDSFSIAGKVALITGGASGLGLNYSIALSMYGADVFIVSRSQKGWDDAKKAVEANGQHVGFLQKDITADGAASEVIQAVLDRFGHLDILVNNAGMQIRNDVLAFKDADWQKVIDLNLNALYYLSHEAAKVMVKQKSGKIINIGSMQSYRAGKFIFPYTASKHAVMGLTKAYADALAPYNIQVNGLAPGYIKTDMTKPLQEDPIRGPEIKGHIPSGEWGVPEELMGPVVFLASQASDYVTGVMLPVDGGYLLR

SEQ ID NO: 4534 - protein, 73 aa, Lactobacillus buchneri
MAEEPGAESPLLNKMMSEAFDWSDQKLPVRDAIWDYYMEKNDHDTLKTEKDVEPYMNMSTDDLKSKAEALLKK

SEQ ID NO: 4535 - protein, 125 aa, Lactobacillus buchneri
MAKISIWQKIINFFTGKKQSAQAPAQVKDGIWYRKEADGNYLLGIDKSVYDLMGKITFADFPNQLDTIEVDDDLLDIEGDKSVETLKSPISGRIVARNKEIGKDIETLNKPDPQVNWIVKVQPAA

SEQ ID NO: 4536 - protein, 340 aa, Lactobacillus buchneri
MYLIDISRNGKPSYDARVNQSLDNYFVNDLKLPGHGFMFYINKPSVIIGRNQNVWAEVDIDYLHEHDIELVRRTSGGGAVYHDMGNFIFENILTDNADDFGDYGHFAEPVLKALRKLNIDVKMRENSSDLILDGKKWSGMTMFKSGQGLAAGGTIMYNLNIENARKVLTEDQMEIQKGLGVRSKRSPIVNLKDFLPDGMTMADFREYLLKEIFEVKSLDDIETYHMTDQDWEVADKRLAETYGTDAWNFGHNPGYYDYADTEFDQGKLGINWTIDDGKLSHLKFNPFFKIDGDLNAIEAALSGKKPSRWNVKRAVKKAGIETVDEERLTDFLMSSFDKSE

SEQ ID NO: 4537 - protein, 428 aa, Lactobacillus buchneri
MMKQQFARPVSVIGTSSLPQRSFDDPKMAGLSPYELWADACHQAMDDAHVKPKDIDKVVYSQFANFITMGGVMAPVGSLEEWAGLAGKPITHIEQACAGGYIAFTEAVNSVASGQYDIVLVAGLENPKHFNSRNQPAYKLKPIKEYDNGWWSPGRVLFDTAYTRFDGVSDNLLTEEQGKHYIKHYGITEGELDDTYNSMAMNLRYNASHNPRALMHERYEDMAKKAGYDDPLEYMRSEHNPKITQYIRKSGSVLHNMEAGAIVVCSADIAKKYSDHPIQVIDDATVSNTTRYPFNFHQMNVDVRDNLYKKHPGIKGSDFDLMITTVMTSGEQLDSAEVFGYLPEGEGYKYELEGKTRFDAEKPINPHGGDISFGHGFGCAGVCMLGEAILQMRGEAGGSQVPKPVNKCLVRGMGGGHTTVGIILEDQN

SEQ ID NO: 4538 - protein, 148 aa, Lactobacillus buchneri
MYPLRPILKTYYDSLEDGKVLGMKCQDCGKVVWPPLPTCQDCGSYNLDWIEMGDEAIIDEIRFEDSSVGGDYTFRKADEFFTEKDPYCVSVGHWPNGSHQFHAALYGVTEENKDDLIAKLPLKAKVHLIQLNGGFKSVGFELEDVEAK

SEQ ID NO: 4539 - protein, 268 aa, Lactobacillus buchneri
MDLEAELGVQLFVRGRHTLTLTSEGDALLEQAIDIVTKFDNIKKTIQPHTNELTGKLTIGYQSFFDTTLMYDVLKSVTKKYPRVTLSLFRGTPLQLRRQLINNQYDAIFGLNTYIDSIPNIKTIELQKNKLQIAVPSTHPLANMKSVDIKRLANDDFIMLNRKISPFIVDYAISLCMKNGFSPHALYYVNDAEQALLHVGSGQGVTFLHSMNKVNNPVESYGVNLLDINGLDNDLNFVLGYKETNTNPITEIFVRELMKVHQQKDGSN

SEQ ID NO: 4540 - protein, 248 aa, Lactobacillus buchneri
MGRLSNKVAVITGGANGIGLATATRFATEGAKVVITDVNDTNRETALKKIGNGAIFIQQDVSKEADWAMVFEKVIDVFGKVDILFNNAGIAAMGDAEHFTAEQWHQIMAVDLDGVAFGIKHAIQNMKTNGGSIINMSSIEGLIGYPNLFAFTAAKGGVRLMTKSAALYCAQQKYNIRVNSVHPGPIHKPEKDNDPKEQKLVSEHLPMLPLGRFGETVEVANLILYLASDESSYSTGSEFLVDGGYTAQ

SEQ ID NO: 4541 - protein, 190 aa, Lactobacillus buchneri
MCGRYMFEPKRNREIARIYELATQAGYQPTTGEVFPSNQTALVIAQQQKIQVVAMKWGFPGFHKGQLIINARSESVTEKKMFAKSFQARRCVYPTSGFFEWTPDKQKYWFNYNDQPEPLYIGGFYNIFEGTPQSILMTTAPNDSVSIIHNRMPLILKKSEIRTWLMDDEFANHFLTRQMPMLMRQKVTSE

SEQ ID NO: 4542 - protein, 130 aa, Lactobacillus buchneri
MSNHPITHYDYHGYTPKQGDLVYINFDPSIGREIKKRRPAIVVSSDAFNLRTGFITICPITSTIRDLPFFINLHGNKLHGQINAAQLRTIDFMAKERHIEFVERAASTDFMQTAKIIMDGLGFESIINNL

SEQ ID NO: 4543 - protein, 73 aa, Lactobacillus buchneri
LKARKQGNTLVLSIPKQFKVAEGTEFMSMQAADGSLIYTPKAPNIYQDPKYATTDLRFIPKDTNDQPVGREEI

SEQ ID NO: 4544 - protein, 2650 aa, Lactobacillus buchneri
MKKRTSFWIQAIGVLTLVLGNFFTAGTALADVISTKEVVVDNAKLIDDKRALVTKSKVGDSANLAFDMTVGGLSQAGTVHFDYNADYFKVKKKQFKFSNGDTKVVVDIDGEESTISWTNAIDKTDLEVILPVKFNRTVNDRELDFVVDDKKIKLPTLTVLDEDEKVKQGETTDQPDGNLQDDDILKQALADEKASDEAQAAREAEEAKQAEAKKEAEVKTEEQAEPKKETEIDENSSQADDIQQPKQSNSEKAETLLKEKREADQKKAEEKSRQAIEENRKAEEQAAVGTQNDPRAVKDNGESKESQTPQTPDVSDLKGAKEAVASDASDGEEPTSNELTRQLPGNGVFGDEGKTDITDAIHAASNPQFFTSINFSYIDKDGNSQNQKVPSVLEQELQLPAILREHKNIEITYLWDIDSIKENTGIDIKDGDYYQFDLKGLKYEYGPSGSFDEYITYGGRTIGRFIMTRDAEDRDTQHAKIIFLPGDLEGVTNIDYKAKIKTEINANAEEISFGESTKGEYPIKVEEDLVSIQKDGVLHTSNGVTDLDMLEWTSTFKVQDGKEANKVTLRDKFGGGYATANDKVSYEFEVKGADGQTVSITKDHDDYDKLVATGPNFQFNAKGLGLERGIIEIKVKMITPVTNFNNRDFKNTIRATDVEIVGVKDPAKTLDVTATITRENGQVKKTAKMDKDGSIKYTVEFTVDPGQTNIVLKDTLNSKRFTFSENIDDYTLIPSVTGWMKGDPKIDGQTLTVEFADVIVPSENEGSKVYKFSYIIKPTADVTDKDYQSISNTVEVNGQKKGNHFGPQINSKNNVSLDWQKMMSSWSIHVNQINRQIDGSFKITEPIEGETLNFLDYKKFYNSFTDTGGLTEEVKKRISFSKHENDQTWDYTIIDGEAYWGKNKDNKAFSVKLSGNQIIITVENLPAGEKSFNLYLKDVPLDKEKILNANYAELEKICNYAGLEYSGSDDASVKTCVNQGGLIRNNISKDGQLDKDFLNNGLINWTTRFNYRQYLGSNEHAALVTDGIDITDEVGPDVIKDATGKLTKRNLQDIQQRLQDTLQISLARINSDGRGVSDSQRLVDDQYEVRVDVDENHKVTFNLKLSEDAYNNIYLDHENGDGERVLGKKVFELKYQSKVLNFKADEEATYEHLKAWTFNNKVTAGWKLNADDETRHTLEAKASVSYADGGHLLDKSGKLLEHNLELDEGDGQTRSVGAVKWNLAINGNGYELRSPVKLTDTLSGGHYHLKTNDDRYKLKIYEAKRSLVNKEVHYTKISDKALIEGHDYDVVYSDTLNTMTINVNNSYKVKTPLLVEYHTVTSKTVGTTYSNEIKLTIASKDFEDKEEIQSSAEVAGQYTTFAANVKKVDATTGAPLEGVKFQLQMKDLDSIWKNVGEPKATDKDGFASFDGLYDKPTYRIIETQGLENYDDRWVSKEFTIKDAQEETEDGNENTYCVTAKNHRTNALKIKKTVTNSLNTNKDDKFEFKVYVINDEGDVDTDFNDDFTYDIDGDESVVNFKEGVSTNLQEIKDGQVITIHGLPQDKTYRVIESANGSYRTTHSLDNLTTVEPDGNGGNETNTFQMMIGKNAPAGIVQFTNDVQTTHFGFSKTIQGPNANADKDKEFDFMLKVLDADNQPDKSFNGTIEGIKHSGGDIPVKFKFVGGVAKEIIYTDGSTVPIKLKTGESYRNIQLPANVKVRVYEKQDTQYTEVHYKVGDGDENEAGDSDEDGWKATGSINATNTMLKFINSQVVNQLEFEKFVAGDMPGGIDSFNFEVAANDDATRNAVKKENYTADIRNATTGKTKNTGKVTFDENGQVTKIKYGTLPPEEITLQDNEKLVILGLPNKATKFKVTETTTGEFITYTRVDGESKNEGNSAEITLNRPDGANSITFENIAPDLVEFGIKKTVSGLIPPVDEDLNFEFKLTVKNPPTSWGEESDPFAYIKSDSNDEESLKFVKDPKTGEFNYELTLKAGQSIRMFIPKGLKIQVTETKAHDYKVSHEFGKHQEDGDTHDVTTEKDMPQLVFNNDSQKTGIEVKKTVKGETAGDEDFNKQFRFRVEGTNENGGKLDGEFTLRKYEVSGKYTDTPVSFNANNIIAFNLKHDQKAQLLGLPIGANIQVTETKESSEGYDPSYKVNENTEKSGNVASEFVTEEGKLGTVIFTNTKFEAETAELKISKHLAGGGIIDADKNKTFQFVIEANASVDGEYDALVNGHDKVKVIFTDGKATVNLKADENILIYGLPSEHNTYTVTETNGSGFHTQYQLNGTRMEDGVKTKEFKLVDKDRVNVDFTNSKDTEKVASLKINKEIAGDGLTTSDHDRDFNFRIYSGVTGEFKATKVDQHGDSHEITVKFADGQSDVLTLKDSESLTVTGLPIDYTYAVGEEYVDGFAPTYQVNGAKVQEGMTTQTFKLVEDQKGTVEFTNTKNGEMELGILSVSKFVNELGDRARKFEFHIEATDGANNPLNGTFKTQVTTNGQVVEGSIQFNGGNGSFTLTHGQSIKFFIPLGAKYEVSEKDYSADGYVTTVTKRTAVVNSPTVTGTATKEDDSIVYHNDLEDDEGELPLPGEEDGDDASSGTLDGNDTTGTSGKSGTLDSPMGIPSSGYTGKSALPQTGEDNNTLLMVIGMFMLVGLLGTATIYYTKRKQEK

SEQ ID NO: 4545 - protein, 342 aa, Lactobacillus buchneri
MKYTVLGAGAMGLRYGVLLQEAGFDVDFVDTWEPQVETVRQQGGVYVSRDGQNKHLVPVNVYYPEEYKGDPDVLIVFTKQYQLADFLKRCSRFFNDKQYVVTCMNGMGHVEKLNQYFPKERLLGGTALIGTVLNKAGDVDFIGPKGAGSMNIANETEKPDEMTHKIVAEFQKAGLNPNLTTNFLGTLMAKVVFNSVINTLCTMFKIRMGEYIQSPVAEKLGVQLIDEAFDVCERAGITLLNTRQEEWETVKYVSTVSNPLHFPSMYQDISKNRQTEVDYINGYIYDLGLKYHYEAKTHDFLRNLVHLAEFAGTFDVDSYMKSVLERDKQNAVKTPEEHVAQA

SEQ ID NO: 4546 - protein, 578 aa, Lactobacillus buchneri
MLKIAKNRISYVAVLGAVLFMTIQVIATLNLPSLTSDIVNNGVAKGDIGYIWKVGLEMAGFSLISILAAVCNVFLAARTSQKLGQNLRSDVYRKVINFSKDEYDQIETSSLITRTTNDVVQIQNVAIIMLRMMLMAPIMLIGASFLAYTKDHQLTTIFLVVLPIMIIFVGLLLYFSVPLFRAMQTKTDKINRIFREGLTGVRVIRAFRQDQFEQDRFEDANRDYTDNAIKVNTIVALAFPVMTLIMSGTNVAIVWFGAKLIGAQSMQVGNLIAFMSYAMQILMSFMMLSMVFVFIPRAQASAKRIQTVLALKSTMKQPEHPVVLDPKATQHDLKFDHVEYRYRQAELPALSDIDFEAHSGQTVAIIGGTGSGKTTLVSLIPRFYDVDKGEIELDGHNINDFSMKDLRDQVSFVPQKATLFTGTIRDNMKYGNPDATDDQIWHALEIARAKDFVEEDPAGLDLQVEQGGDNFSGGQKQRLAIARSLVKQAAVYVFDDSFSALDFKTDADLRAALRADQHIQQSITVIVAQRIATVADADLILVLDNGKLVGKGTHDELRANNKVYQEIIHSQLREEDDK

SEQ ID NO: 4547 - protein, 628 aa, Lactobacillus buchneri
MADKDKAPQPTSNRGHGGRGGFQGVVEKPHNFWGTTRRLLNYMQDRLIGLILVFAFAIISVIFQIRTPKILGEATTEIFKGLMKGNAQQKAGFSVASLPINYEKIVQIILIVIVMYLASAVFSFFQQYIMTRISQNTVYKLRRQMKGKMRLVPIKYYDSHSNGDIMSRAVNDMDNIASTLQQSLTQAVTSFVTFVGTLWMMFTISWKLTLIALVTIPLSLVIVGIVAPRSQKYFAAQQKSLGLLNNQVEENYAGQIVLKSFNKEQDTIDQFEVQNKKYYQAAWKAQFISGIIMPLMIFLNNIGYVFVAVVGGIQVANGTVTLGNVQAFLQYTNQFSQPISQLANLMNTIQSTIASAERVFEVIDEEEMKNTKANRPVETDTDNLVELEHVQFGYTDDELLMKDYNLAVKRGQQVAIVGPTGAGKTTIINLLERFYDVKGGSIRLKGVDTRDLDREDLRSHFAMVLQDTWLFTGSIYDNIKYGREDASKDDIIEAAKAAHVDEFVRKLPKGYDTVLNESASNISQGQRQLITIARAFVADPEILILDEATSSVDTRTEVQIQHAMSQLLENRTSFVVAHRLSTIQNADNIIVMNHGAVVETGTHNELLAKNGFYADLYNSQFSDDVSFD

SEQ ID NO: 4548 - protein, 307 aa, Lactobacillus buchneri
MKKLMSLVIAAASLMVILSGCGKPTLTVSNHHLSANALAVTLKGKSNQKQVDYTVNGGTKQTVKTNSGAFVISVPTKNYQQTVKLSTDGKHQTVTVAKANVIGSYQKMRTTYNQGLTGAALPKKDQQLAQSMAKQGAQLKKEAAELKAGKATSMAAMQAKAQKATALQKQAAELKQTQAKLAPAMKKAKASVKDQLLPANPKDGIHNLIDTNKMTLRVNKSGDKVLGIAMMVPVNNLKHKKDLKPFIMSFSILTNSVGANAKHVLNKFQKAAKAKKSSSTTAPKFHSNGLLFSLGYSTSTLYVFITK

SEQ ID NO: 4549 - protein, 245 aa, Lactobacillus buchneri
MFIDHVHEMFNGIGVPNWVDWFGRPVATIFFFLSVEGFIHTHNQKRYLSRLLVGFWVMQIGNLIIQHFFKLGSFGLINNIFGDLFIGVLTMYGLQTISQGHQNHQAAKIWEGILIIALPLIFAGLTLLTMGQGGNSIAFRIVTLLPSPLIAENGFILYLGPLMYLLRKNRNWQMLAVVAVAILSTGFNFSSMFTTNFQWLMFLAIIPMYLYNGQLGRSMKGFFYAFYPLHIWLLYILAWFMGVRY

SEQ ID NO: 4550 - protein, 267 aa, Lactobacillus buchneri
MRIAFNKPAETMPLYCDSVGYDWNQPPIHRLNGYYAYHWLQTESGAGVINIDHQSISLQANQGILLRPRVAHEYHPTGKEPWKVSFLTFNGTLCDSLSDFLKLADFLVIDTVSPELTSFIPEVLNEFNNNHPIALLDQSVQIYKFIMLLKQNHLLNNHRYQDATITTPILQYIAAHYAEPITNDKLSKATSYSVTYQNRVFKRLYDMTPLEYLTDYRMRKAKELLLTNPTLEIGEIAPKVGFHNPSHFIDQFKKYYKATPSHFRKFI

SEQ ID NO: 4551 - protein, 652 aa, Lactobacillus buchneri
LDAVQKKDRRKNFWSIFNFAFANIGGSAVYMTFGTYFMVYVTSAMFTGVPKAQANKLIAMITGLIFIIRLVEIFIDPIIGNIVDNTNTRWGKFKPWLIGAGTISSLLLALLFSGIFGLSRVSATWFTILFIPIFITFDIFYSFRDVSYWGMVPALTEDSHERSLFTAAANFAGFGQNIVTIIIVPVVTYVTFFFTGKHNEGQPGWTAFGILIAVVGIICSLVVALGTHEKQNALRAVTKKKTSLKEMFWALAHNDQMLWTAFPYLIYGFGNAATAGLMFYLFKYVMDKPGLFWITGLIPTIAGFFTSPLYPIINKWVTRKTIYAVSMCSMILAYILLIVSTDNLVMVVTAMILYYVPQGFIFMAVILTLTDTIEYGQLKNGTRNEAVTLAIRPMLDKMSGAISNAIVGWVAVAAGMTGTATAASMTPGGISLFKLVAFWAALILHVLALFIYVFKVKISEKKHAEIVDELQHKLAVEGISDNSDTETTTSEKAATNSEEANVEVAAPVSGVRVNLADVVDEHDHKGLPGNGIGIQPTEGKIYAPFDGQVVLLFTTKHVIGLRSDDGLEILIHVGLGTVNMRGEGFINHVDSGQSFKKGDLLLEFNRDKIQQAGYKDTVLVLLTQGDKVTQSDYTQEDVVSHGDELVKVQLKK

SEQ ID NO: 4552 - protein, 200 aa, Lactobacillus buchneri
MKEQLLDLAKKRRSIYALGRNINQSEDEIADLIKKNIKWAPTPFNNQTTRAVILFGANHEKLWDIVGKRLKSEVPTEEAYQKTLEKINAFKSAFGTVMYYTDMDVVHRFENDFALYADNFADWAEQAQGNAQFAVWTSLAENGIGANLQHYNPLIDDQVKKAFGIPDSWKLRAQMDFGSIEAPAGEKEFMNDEDRFKVLK

SEQ ID NO: 4553 - protein, 561 aa, Lactobacillus buchneri
MNISKHFNHSMKLTACLGVCLGVLLLANPTYADTSQAQTSSEPTATATASSSTIDSPVPSSDSDSQTTTVDQPNENAKSQTVESSNEQPTAPETDDSSSEQPVPADHSTAETTTTSSSTDNRSDADTATSTTDSPADSSGDTPDVQPNDSQATPADGAQTTTDQSSTTGPSDKDQITIDGINQSTDPAIKQSSNNPLINFLTSITSGIAASVIYPLVASRQGAQFISHFRTLLSPNRWDVSQNWADLDQKYNPDYVKTYYTDAQDWYDNRVQKQTWEVPFADGTGTARATYLKNGDSKKTIIYGQGWTTEPEGMGRISKMFYDMGYNVLMPYTRGQNSSDGEWLTFGDKDKQDWVNWVNKIDQTNGQDSQIVLYGQSLGADTALQYAGQGNLPSSVKATIADCGFSTIPSLIYHLYTGAANSLNSITSKIGWNLNGSIPLVPFDQLLTAMNGINKLVQGFSLDDVSGITAVKNSKLPTLFISTEDDTFIPDTETETMYNLSASTDKKLWVLDGHVGGHASASNAVQDYMKNIEDFLASAMNQSSSSSDDQLNVPATNKVAA

SEQ ID NO: 4554 - protein, 67 aa, Lactobacillus buchneri
MKQGTVKWFNADKGYGFITTDDGDVFVHFSAINKDGFKSLDEGQKVTLDVEDSDRGPQAANVTPIED

SEQ ID NO: 4555 - protein, 680 aa, Lactobacillus buchneri
MNNDIFGTNGFDDIFNDPFFRNAMSDSNGRQQSRQQPIQVQERRPQQKKTLLDEYGTDLTKMAKDGKLDPVIGRDKEIEQMEEVLSRRTKNNPVLIGDAGVGKTAVVEGLAQKIVAGDVSEKLLNKKIISIDVVSLVQGTGIRGQFEERMKKLIDDVSKDKNVILFIDEIHQIIGAGSTGEGDKMDAGNILKPKLARGDFQLIGATTSNEYRDIEKDQALARRFQPIMVNEPSEQDTLTIIKGLAPKYEKFHHVQYTADALKAAVSLSNRYIQDRMNPDKAIDLIDQAGAKVAMGSSLTKDKSTLQQEAEQLEKDKNAASKKEDFEQAAKLRDKLDKVQDQIKNIDSGTKVTTPKVTPEVIQSVVERITGVPVTDVNKNEVNQLNNLDKDLKKEVIGQDKALDAISAAIRRSRVGFTEGNRPIGSFLFVGPTGVGKTQTAKALAKELFGTTKAMFRYDMSEYMDKISASKLIGSAPGYVGYEEGGRLTEQVRRHPYSLILMDEIEKAHPDVLNLLLQILDDGRLSDAQGRTVDFSNTVIIMTSNAGQGEADNKQNVIDRLKPYFKLEFLNRIDDIIQFNSLTKPDLLKILDLMLNDLNQLVDKSRGIHFSVTADAKNKLVDMGYSKELGARPMHRVITKEITDKLTNSYLQNPDVKDFKVVVDKDAIKVEPVAAKQAIAS

SEQ ID NO: 4556 - protein, 140 aa, Lactobacillus buchneri
MAIYNVHTTLRDIGAQTINTAGVHQFVADEPTRFRGTDAGPNPVQYLLGAVGACLGASAASLVHRPGSNIKVEEFEVEVTGETERFADKSSRVKSIHVKLTCHTNLDKEGNDRFIEDTIHLCTVHNTLKDSVEFTFEITD

SEQ ID NO: 4557 - protein, 232 aa, Lactobacillus buchneri
MKTLILISHPQFEDSGTQQFLKTSFYSLDDVKYQVIDELYTATGTIDIEKEQNALRDFDRIVFQFPMYWYSSPASLKRFMDDVFTRNYIVAKRSLKTKELGIVVSLGDAEADFQAGGPEQFTISELLRPFQAFANKAGMTYLKPFVVNQFGYLDPAQKEKLLVDYLEYLSAEMPLSLANREQWLVARLQDTKADKSADLQQAIDLVINSIEDQQNNVESLKQDVKMIRDQEE

SEQ ID NO: 4558 - protein, 59 aa, Lactobacillus buchneri
MSDTTDWLVQQLTQLKEADQSFVNKSIYQAAIALAKEQEKRAQQSQDELDGRIWSPDKW

SEQ ID NO: 4559 - protein, 663 aa, Lactobacillus buchneri
MDMVLLLTIILAAVVFANILARHVSFIPLPFFLILLGILLAVLPVYRNFHLDPSTFALAIIAPMLFNEAQNSSRFWIGRSITNILSLAVGLVLVTVLVVGSGLHAVMTILPLTLCFALLAIVTPTDASAVNSIFEANPIAEEQAGILQHESLFNDAAGIVLFDLSLTAFVSGTFSLKLAVAMFLWEFLGGLLFGSLIGVAIVSARLFLIRYNDDTPIIMVLIQLMSPFLVYLLAEKLALSGILAVVAAGLVQGSERDKLRLTSSRMQLVTSNVWEVVSGALSGIVFVLLGLSLPEVIQALHQSPNPDLNILKLILIGIGVYAVKGTLRLVWSRYMLKRRVKSNHEWRDSLVMALSGANGTITLSLAFSMPNTVNGQPFEFRGIMIFVAAVVILTSLIMPTIFVPIILPSQDRQQPRYRWVKRMIQAAISDLLKEKEHQAEAQVVIDSLQQQLVLDSTPNFHLRRQLMSESHQVELKTVQKMFDDGKISQDELTYYTKFLNLNNFSADEKIWKNVLLRIRFSLHVGRLYKDLNRAQEAFLTAPVALEEVYWREQFEKHGENILPIEEAGFNAVMDFLKTKQGENGVETNMVKRFYRTRHRRINGQDVDMDIVYQMFMRAFHSEYELIQNSLTTGKIDAALAEKLQTRISTDEMTYLQNMELFRD

SEQ ID NO: 4560 - protein, 322 aa, Lactobacillus buchneri
MKYRNLGKQGLKVSELALGSWMTDVSDSAKQDLADQSLKLAYSKGINFFDCADAYSGGAAERFLGKALKEFPRKEIVLSSKVYFPTGPGVNDRGLSRKHIMESIDQSLTNLQTDYLDLYFCHRFDPNTPLAETLTALSDLVDQGKVLYYGVSEWRPVQILEAQLVIQKLGLHPMSVVQPQYNMFDRYIEHELMDVCEKLGLGIVPFSPLSQGLLTGKYRKGHKIPAGSRATYQDQIQALLTDDNLDKVEELIKMANELDTDLATFALAWTMRDPRISSLITGASKPSQLENNLKAVDLEIPEEYFGRIDKLFGFKKFERHIG

SEQ ID NO: 4561 - protein, 119 aa, Lactobacillus buchneri
MVTAAQKLKDLGAANIMIKGSHHKPGQKEVSDYVLLESGKSFWLTGDFFDTDRKNGTGDSLSACIAAELARGNDIETAVRIAKKFVDVAIENEIQVGHKFGPINHWAPGYPDPEQSNNS

SEQ ID NO: 4562 - protein, 129 aa, Lactobacillus buchneri
LTEQYPQALTIAGSDSDGSAGMQADLHTFFRRHIYGTAVMTAAVAGNSYGIHDSVTLPTSFIDQEFKDLADDYHVRASKTGMLADTELIRTVIKNYQKYDFGPLVVDPVITTKHGNMLLEQSAYQTLRD

SEQ ID NO: 4563 - protein, 40 aa, Lactobacillus buchneri
MRICHPHGVQGRRPVNRKKDIKRNKELSDLQHFLKQKPAK

SEQ ID NO: 4564 - protein, 221 aa, Lactobacillus buchneri
MKQNYAVIGLGLFGSSIVNTLLEHDQEVLVIDKSEARVNEFRDRATEAIVADTQNELALNQLGIGNFDNVFVAIGTDLEASIMTTMICEELGVKNLICKAENARHAKVLEKLGADEVIQPERDMGQRIALHVMEPKILNDLKLKGELSVIEFELTNPKLFNKTLKELNLTNRYKISVIALSHADENGAIIPNQSTITKPGDIVTIIGTEKDVEAFEAVATA

SEQ ID NO: 4565 - protein, 477 aa, Lactobacillus buchneri
MPELGAIGGMCDNTDDIIIRNWHFCQVKGTDSLNLKTRLALPQILTLGFLIIILVGTFLLSLPIASKSGHMTGYINAFFTATSATCVTGMTVVNTALHWSVFGKIVILMLVEIGGLGFMTFAVLLFVFMRRKVDLTTRLLTQQSLNLQSFANTSSVVFLVVRISLAIQVLGTALIFIDFYPRYGFAKGLGYSIFHSISAFCNAGFDLYDNSLEQFQTDPYLLFVLTILIISGSLGFLVWKDILFYKEDHHLSLHTKLALTTYLGLIGLSFVVYMLTEGNFGQESHLTMFQRIMNTWFLAVTPRTAGFYTLPVTHITMGGMFFTMILMLIGGTPGSTAGGIKTTTVGILLIRVWSTLRGKRDATFWGRRFSNDNVTRSLSLVFLVAVVLSIATMILTFTETIPKNQGLEYITFDVISAFGTTGFSLGLVAHLSVVGKLIFAALMFMGRVGIFTVMYSLLNSKRPEDAFRYPEENVMIG

SEQ ID NO: 4566 - protein, 413 aa, Lactobacillus buchneri
MLIKNVHIENAEETRDVKIEDGKFVKIAASIQPGDGEQVIDATDKLLLPPFVDPHVHLDATQTAGDPEWNQSGTLFDGIRIWSERKKKLTIDDVKTRAKKALKIQVANGIQFVRSHVDVTDPDLTALKALIEVRDEVADQVELQLVAFPQEGILSYPNGKELMIAAADMGADVIGGIPHFEFTRDYGVESLKFLMKVAESKGKLVDVHCDEIDDPASRNLEVLATLALESGMGDKVTASHTTAMGSYNDAYTYKLFRLLKMSHINFIANPLVNTNLGGRFDTYPKRRGMTRVKELSEDGINVAFGEDDIKDPWYPMGNGNMLDPVEMGIHVGHLMGYDDIMNSYQFITTNGAKAMHITGHYGIQVGKPANCIIMNNDNFYNALNERSEILYSIHNGKILVQTEPKQVKNYFED

SEQ ID NO: 4567 - protein, 272 aa, Lactobacillus buchneri
MFSGLIISILSLTKHAQEPLNIYILTGQLYNRHQQFQALTDDHAAFLNQLVKRENVDSGVTKIDITTQFEADLPKANINTLFTPYSMLRLYSDLVPQFSDRILYLDADVVCRRPFEDFYHQSLAGTDFVGVLDHYGRWFFHHQLRAFDYINSGMLLMNLDMIRQDKLLARCREYCRKWPMIMPDQSAMNKLAKHKAFAPEKYNEQQDVQSDTVFQHFSTRWKLWPIVHTVSVKPWEVDKVHQQLHLHEYDDILAEYQEIMAELDAEGELKTE

SEQ ID NO: 4568 - protein, 38 aa, Lactobacillus buchneri
MTVKTKRTIKISQLVNPHFKKMWSTKCSYIIAKKLFEI

SEQ ID NO: 4569 - protein, 301 aa, Lactobacillus buchneri
MNNQKQAEKDYLSGMKYKDIADKYQVSINTVKSWKKRYGWQRTPNKKGAHKVTKRVHTKPKKGAHKIVDQLETNGQLNEKQKLFCLYYLQRFNATWAYQKAYGAPWNTANVNGPRLLVNASVRAELDNLRMIREQTEAIKADDIVRELQRQAFANIGDYVEAKRVKHLRWMKHYVKQGPYINSSGKHYELLPYIDPETGKQAFYYENEVNFTNKGDTSLLKTLRLDKGEALVETNDKVKALTELLKRYPVPTVMQSAQLRKANAEADIAETKAKEIQKVNQHDDSTIVIDDLEDTDNDGED

SEQ ID NO: 4570 - protein, 101 aa, Lactobacillus buchneri
LTKMFNSGDQRFNKSAIVSMIQDEFSTEINKALRDAVLDTSAVQKKLDNGTIDKGIQQAAEIMAKSLDTISQYDNVNEDYRYFFALTETFGSNITPPYRGE

SEQ ID NO: 4571 - protein, 144 aa, Lactobacillus buchneri
VPKVILKYKKMTPSAMAPHQAYPDDTGLDLYADQTVYFAPFETKRVSLGISIQLTKGYSAEVRPRSGMSIRTPLKCILGTVDPGYRGEIMAIFVNLSNRPNQINKGDKVCQLVIRRDVSVQSIECDKLNESDRGSNGFGSTGRN

SEQ ID NO: 4572 - protein, 95 aa, Lactobacillus buchneri
MRYDELRDYFKQKSPSNDIKMKYIYAQGKLINGVAKYYIDGIEFLIIFSSEAQFASGVMYSSEDINNINSTLQTPFKERLTDDMRHKQERMRERA

SEQ ID NO: 4573 - protein, 70 aa, Lactobacillus buchneri
MSLKDKADSAKDKVSGKAKEVEGKVTGDKAREAEGKGQGILGKAKDKLSDAKETVKDTVDDIKKKADKDK

SEQ ID NO: 4574 - protein, 54 aa, Lactobacillus buchneri
MSDRKHPYTPMQRTSYGYVSKEEQQIDKQLDRDLKRRLRKEGAFNLKKKTGEPG

SEQ ID NO: 4575 - protein, 154 aa, Lactobacillus buchneri
MDSVFGLLDRKQTIKNAKQFLYEYRDWQLEAARFSFSLQSPMMDGMPKAQSDPRHTRQEDKIIKQATAKMECELRLKTIQLMSSIDDQNAFLADLLEYRFINHYTVKKCCERLAEKYDLGYLAERTYNDYQKQALWVFAIVCPRDTLRAKKVRR

SEQ ID NO: 4576 - protein, 59 aa, Lactobacillus buchneri
MALIRSLAVWVIIYASQCWLGYVNKWHLESVDFYIFYAVATLMMVISYVMGRIEDLEEK

SEQ ID NO: 4577 - protein, 80 aa, Lactobacillus buchneri
MLLQETKDYVNDVLLPDYMDGYSDAIDIAMDVLDNIDFFGDSNELCRPTRLARNIAANRKEFTDYVVKAFQDVEADDGFD

SEQ ID NO: 4578 - protein, 54 aa, Lactobacillus buchneri
MSDGMKLLKSRLEKRLKEAASENGGFIDHEAMNGIAGGIMIALYELDHLHDPEI

SEQ ID NO: 4579 - protein, 143 aa, Lactobacillus buchneri
MSKLLELKIRNYEKIIHDHNRANKHFYDELLVLVRRCEERYKSVVKAPDDSPEWQAIVLKQTEQPVLSFRSRKMGDMSAREAAKIHQEAVELYNRGYPTATIAHILGIRVSTAGRTIVNYQHQISSQNTVQSHERTRQLGANK

SEQ ID NO: 4580 - protein, 165 aa, Lactobacillus buchneri
MIKIYQKQPIQAEQFDGSQKMIDEYDIIPAYDKNSENEYWQPVFPCSILMTKEGALSINVGDWIATGVNGEHWPIADDIFKKTYAELPVIPKAVADWIEECKQKHISIGDMLCSERRPEQMRDWMELTPGTYQFDYSRYRKYQELVARAWLDGYQLEAQHDTRTD

SEQ ID NO: 4581 - protein, 142 aa, Lactobacillus buchneri
MSREIKFRGIPLRDADDIYEIADYDGTFVYGYYIKNGDGALIVGDQTEELDDVGLSRWFEDVVPETVGQYTGLKDMNGKEIYEGDIVEATIQGCVQDDKYLVKNMWDPHVWTEELDGYYAVSKMEVKGNVHTNPELLEAQHD

SEQ ID NO: 4582 - protein, 141 aa, Lactobacillus buchneri
MTNYPTGVQEPPKSAIELPRKDNKFNAHKMSIDGHQFDSKAEGAYYLHLKNLKLDFKIHEKFETLPSFDLQNPRKHVRGCTYTPDFSIYEHGNLVSVVDVKGGRATLTRASVLRMKMFMAKYRIPVVIAEYDAKNGIFEEY

SEQ ID NO: 4583 - protein, 242 aa, Lactobacillus buchneri
MDQLIKILNYADGQAVSGRDLHDFLGVKTPYTQWMDRMIEYGFTENVDFAVINKNVNDESAFGNVRKITDHALTLDMAKEIAMIQRTDKGKQARQYFIQVQKSYQQQVSLPQTPDEKIHLLLENSDQVNRQVKQIDTRVTKLEDDQPIAPGEYSYISTRVKRAVNSYIGIHHLVLNQKQRAMLYKDINRGINEVTGIKTRTQLRKKDFDVADEFITNWVPSTATLQILKRLSGVSEGQTELV

SEQ ID NO: 4584 - protein, 81 aa, Lactobacillus buchneri
MYKALELGTGKVIAVGEHKSDVFRHLQASHPSLQKTHSRPAKGASKPLYDFPLKIIQDRMSPEDVALIRYTNLKHPELLEK

SEQ ID NO: 4585 - protein, 285 aa, Lactobacillus buchneri
LNYIQQIRAFDDFKLYKARLSSGEIALWHALMSINNKTGWQEWFTAANSMIVSLSGLSRSGILKDRNVLKQIGLIDFRTNGKKATSYHVCVLYTSDSVQDSKHQSKQNSKHSSKQDSNTLYKLNETKQKQEVVSPAREEFSHATKSFELWQSLWGFPNGIAQQDLWEWIDSFGDDVVCYAIHLAGKKNVSANGADTWLDHTFHNWAHDGVDSLKKAQEAAEKHDQRVSNSRGGYRKPTVKETLPDWANDDQPGTPEPQKQLTLAQKHQLAEQLARLKSNTTSKEG

SEQ ID NO: 4586 - protein, 252 aa, Lactobacillus buchneri
LTQSKSWFWKFEQCEAEALAELKGNWEPQQDDTPLLVGNYLHSYFESPEAHQKFIEEHADELCKYGKPERGIKKQFLDADKMIKALDSDPTFKQIYHGDKEVIVTGTIFGVEWRGKIDCLDLEHHMFYDLKTVDDFHKKHWSPDQRAPVSFAEARGYDMQMAVYKELIKQTFDVECTPLIIAVSKQKVPDKGIFSIPDYLMDYRMEQIKNDQPHIQAVKEGREKPVPCGHCDYCRSGKVLNDVIDIDRITFY

SEQ ID NO: 4587 - protein, 319 aa, Lactobacillus buchneri
MANELTVLQKDLTDQINTKLDDLRKQGLATPKNYNPANALKSAFYAMTNAQGGNLLMNGTKESIANSLIDMVVQGLTPAKDQVYFIPYGNKVTLQRSYFGTQAAIKRLDSVKDIWAEVVHQDDDFEISATDGRLTVSKFKPSFENLDKPIVGVFAVIEKSDGEKVYTVMTKKQIDTSWSQAKTNKVQHKFPGEMAKRTVINRAAKNFLNTSDDSDLLVDAINRTTTNEYDDDRKDVTPEESANKSITDFVKPVESKKPTPKDDVIDVPDEDPVDEFLKKHEEKGDAGKDDHDNETKEDANQESLFENLNDTQAQEAESK

SEQ ID NO: 4588 - protein, 107 aa, Lactobacillus buchneri
MMDMGARKYAYEFELAEWKEQFKDTHGNEMDDSEMYWRIPLRPYGNDQFILDDQDSINRYLRDNYEDAGNNQTYQATVNELQDLEPYTSLEPWSFPVDAFHSKYMEE

SEQ ID NO: 4589 - protein, 50 aa, Lactobacillus buchneri
MDNSDNKKDARQVGLSNVSKLSTYQFFLQIYSTRKLNFLQRAVRKIGGWL

SEQ ID NO: 4590 - protein, 65 aa, Lactobacillus buchneri
MNIKQANGIKAVKYARLRVAGLERAYDQESNPTVKRALLTCLRKEKDKLSDYDVTGHYEEVERHG

SEQ ID NO: 4591 - protein, 40 aa, Lactobacillus buchneri
MYPDSPGEDAYYDELADEFETGTDEELEELKYEYQAGEWD

SEQ ID NO: 4592 - protein, 52 aa, Lactobacillus buchneri
MKNMYKKSTGQVGLSDATKEKLFVCQNILYIKYRPTQTFLQRLLGGIKHVSR

SEQ ID NO: 4593 - protein, 37 aa, Lactobacillus buchneri
MIYELGKFIVYGCLYFGFFAGCYLAYLMVKNPSEWFK

SEQ ID NO: 4594 - protein, 82 aa, Lactobacillus buchneri
MTTKAAIKPAVHSVPETARIVKTSTDNVYDLIKMGYIKPMILGAKMISNIEIDRFLDKYAGVDLKSQIVAYRADPLNWRKRI

SEQ ID NO: 4595 - protein, 194 aa, Lactobacillus buchneri
MKEDGVMQNVFGLQPKAMVGHKLTDFMNANPELSTTELGHFLGVTQSMVSKLRHDKSPLHFDDLANLFKSTEGLLGADEFKISVLNKFTNGFIPPLPNYYYVSTNLAALSNRVITEMGQSMDALKEALDDFSDPSSPNNIKNISDPEQAFAQCYDVLYYLLPLMAIIANTYGMSWIDEGRKRVKEIAQHHERQI

SEQ ID NO: 4596 - protein, 253 aa, Lactobacillus buchneri
MKSNVPQIKFNSQLILTTEQLAEFYETTSDVIKKNFSNNKDKFVEGKHYYLLEGNQLKAFKNQVNNLHLVDKRTSHLYLWTKRGASRHAKMLGTDQAWDVYDELEENYFNSTQQQLPIPKDYPSALRALADSMEENQKLKPAAAYTQKMLANPGLETTSVVAKNYGMSTAKFNQLLHELGIQYRQGKTWLLYAKYQDCGYTHVEPFAYFDQKVGTKKVANTMKWTQLGQKFLYDFLASQHILPQVERLTLLKG

SEQ ID NO: 4597 - protein, 85 aa, Lactobacillus buchneri
MNHEEVKDLVNKASKIAFEKQQPYLDKLAKKAADDLEIKDETDLPTVIAKVVQSSEMLAIGIGQRLSAQTLTEVLDQLDLKKKDS

SEQ ID NO: 4598 - protein, 59 aa, Lactobacillus buchneri
MNKQQVEALTAELRELNKTLQVIASNQERQNISDKDIQKAFETAVMNLSSSNQVDPKLL

SEQ ID NO: 4599 - protein, 74 aa, Lactobacillus buchneri
MKVKVNADALMRQRRQQLGLTGAEVARRMGLKTAQHYWNLEHGKNRLTLEYAFAASKALNVKISFFCTDVKEFV

SEQ ID NO: 4600 - protein, 150 aa, Lactobacillus buchneri
MDEKNKTGLPMRLINLREERNLSKTEVARRLGLSSMQRYANYEYGKNEPDASMLKKIANLYDVSVDYLVGKSERRKYYDLTDKDRDDIGVQVDRMLAGLSSDAETNYYGEPMSPEDKEKMRVAMVAALEAAQVEARKRFTPKKYRKDDKE

SEQ ID NO: 4601 - protein, 146 aa, Lactobacillus buchneri
MAFEHDPIDMAHIIMKKYHTCDPYVLVNKLGYILMYANLGDINYAQRDYFKRITVITLNDQIDEYWQRFVLCHEIGHALLHKGFSTAFYRHTSGYGMVNWAEKEANLFAMQLEIARYDDVALNHMTDYRLLEAMGLDESLARYIKR

SEQ ID NO: 4602 - protein, 303 aa, Lactobacillus buchneri
MKRTIIGIAILLGTLISGCGAQKNKEQSKKAEPITPLKIENISKGKILSNEDGRYEVKMIAPKRSTVEATYVMPNGAVGTEVPVHNLHNGYFIIRERINPKHKKIYISIGAYNKHNKDHNENITIVNNGYSTGNVQQLNNRKEHYKTNSKSVKSSESQSSNPANNNPHTHGLSGLKYQADKYLKKDNSVAFYHPVKVLGYDNTKPYVANIEFKANDESKATMKDGAVSILEGVKKADYKDFSNIKISFTQNVADANGKTLKNIPVLGYSFSRSTLESIDPDNMDSSDLSKVADSHFDKHVEDN

SEQ ID NO: 4603 - protein, 143 aa, Lactobacillus buchneri
MKFKKTLLVGLASLSLGTLGILSVPANASAHTWWDGTPVAIRGHWTTQNVYLKYMGFSNHATFKASAHKVEFAYSASSNITLHDTYWRKTGAHSYTVHGSWYRDGGYDHRITVKKLSSHHLRAYFDGHSITRGSAYPNSFFKK

SEQ ID NO: 4604 - protein, 38 aa, Lactobacillus buchneri
MKIRRSLLLTITAFTLGLGVIRLRQVSWEKASIYTVAK

SEQ ID NO: 4605 - protein, 385 aa, Lactobacillus buchneri
MARGSIRRKDGYYYYSFEVGRKDGKRRRVERSAGTSKATAEKLLRKALSEYENGGQVPVETSMSVEEYLNFWFENYVKTNLKENTQKNYRGILDVHLIPQFGIYRLKNVSPSMIQEYLNQLGESHLAKHTCQIIQTVLRKALKMAVFPYQLVKQNPTIYTQLPKYREDTTVTRKKLKLITMQQYQQIMEITPEASPIYIPIQIAFNTGMRRGEVCGLQWDCVDFDDRTITIKRNMQQYGKDDYKLETPKSQAGYRTIVIGQILIDILKKHKKHQMEERLRYGKYYTNSNFVCTKENGKPVLPNSIKYYCEQIQKKLGFPFSFHSLRHTHATMLLENGANMKEIQARLGHAKITTTMDTYSHVTRKMQNQTADIFEQLMQRHQNGS

SEQ ID NO: 4606 - protein, 612 aa, Lactobacillus buchneri
MDLDKMKNHQKYIRNFSIVAHIDHGKSTLADRILEMTDTVAKRDMKDQLLDNMDLERERGITIKLNAVELTYHAKDGHDYEFHLIDTPGHVDFSYEVSRSLAACEGAVLVVDAAQGVEAQTLANVYLAIDDNLEIVPVINKIDLPSAEPEKVRKEIENVIGLDASDAVLASAKKGIGVPELLEQIVHKIPAPDGDVEGPLKALVFDSVYDDYRGVVLSVRLFEGTVKPGDKIKMMNSGSEYEVTEVGVNSPKPVKRDYLMSGDVGYITASIKDITQTRVGDTVTNALDPADEALPGYREMHPMVYAGLYPTDNAKFDDLREALEKLKLNDAALEFEPEISKALGFGFRCGFLGLLHMDVVQERLEREFNLELITTAPSVTYEVKLTDGESKEVENPSEMPDVSAIKQISEPYVKATIMVPNDYVGPVMELCQRRRGEFDTMEYLDEYRVNVIYHMPLSEIIFDFFDKLKSSTKGYASLDYELEDYKPSDLVKIDILLNGEKVDALSFISHRQFAAPRARDIVGKLKNIIPRQNFEIPVQAAIGAKIIARTNIKAYRKDVTAKLYGGDRTRRMKLLEKQKVGKKRMKAVGKVDIPQEAFMAVLQTDEEEKGDK

SEQ ID NO: 4607 - protein, 382 aa, Lactobacillus buchneri
MAEKDYYDILGVSKDASDDEIKHAYRKLSKKWHPDINKAPDAEAKFKEINEAYETLSDPQKRANYDQYGSADGAGAGFGGGGQGGGFGNFGGSAGGFGFDDIFSQFFGGGQQRADPSAPQQGRDLQYQMTLEFEEAIFGKKTVIKYNREAQCKTCGGTGAKPGTSPVTCSNCGGRGYVTTETNTPLGRMQSRQVCPVCHGTGKEIKEKCPTCGGSGKTDERHELEVNVPAGIDDGQQMRLQGQGEAGDNGGPYGDLYIVFRVKPSKDFTRDGSTIYVDQPITFARAALGGKIKVKTVHGDVELKVPAGTQTGTTFRLKGKGAPRLRGNGNGDERVTVNVVTPKSLNKNQKIALEAFAKASGDNIAGKGGSNFFDKMKDAFDK

SEQ ID NO: 4608 - protein, 623 aa, Lactobacillus buchneri
MASNKIIGIDLGTTNSAVAVLEGSAPKIIPNPEGARTTPSVVAFKDGQPQVGEVAKRQEITNPNTVRSIKSHMGEQGYTVDIEGKKYTPQQISAMILQYIKDFAEDYLGDKVENAVITVPAYFNDAQRQATKDAGKIAGLNVKRIINEPTAAALAYGLDKQEKDEKILVYDLGGGTFDVSILELGDGVFQVLSTNGDTHLGGDDFDQRIIDWLVDGFKKDNGVDLSKDKMALQRLKDAAEKAKKDLSGVTESEISLPFISAGHNGPLHLQTTLTRAKFNELTADLVAKTKVPFDNALKDAKLSTSDIDQVILNGGSTRIPAVQEAVKSWTGKDSNHSINPDEAVALGAAVQGGVITGDVKDVVLLDVTPLSLGIETMGGVFTKLIDRNTTIPTSKSQVFSTAADNQPAVDIHVLQGERPMAADDKTLGQFQLTDIPAAPRGVPQIEVKFDIDKNGIVNVSAKDKGTGKEQKITIKDSSGLSDEEIQKMMKEAKENEEADKQRKESADLNNEVDQLIFQTDKTLKDVKGKVSDDEIKKAEDARDALKKAKEDNNVDEMKSKKDDLNKIVQDLAVKLYQQQAPKDGGAAAGEGAKGGSTDDKSDGKGDDGTVDGDFHEVHDDDKK

SEQ ID NO: 4609 - protein, 202 aa, Lactobacillus buchneri
LAENKDDSVKKNPSGPTQDQSTQPAKAAKKAAKPEKKADQAQSPDANDIKKLKQTVVDLQKKLDTMEDKFLRAEADMRNIETHAKKEQADLIKYDGQQLAHDILPIVDNLQRALKVDVTDESGKQLKQGVSMVYEHFTKALSDNGVEVIDALNKPFDPKFDQAVQTAPADDDHPADTVVQVLQDGYRLKDRVLRPAMVVVAK

SEQ ID NO: 4610 - protein, 345 aa, Lactobacillus buchneri
VLTDRQKDILQIIIRDYTRTGMPVGSKALAEEFPTHVSSATVRNDMAALESKGLITKTHFSSGRVPSIEGYRYYVDNLVQPDPLDEGAEDLIKTSFNSEFNRIDEIVQESAKVLSDLTNYMALTFNPESGDNLKLGGFRLVKLDDRQVMAIIVTNTGHVIDKIFRLANVSSEQLETIVNIINSELVGKPLKDVMDKLKFDIPMLMTKYIQTPEGFLKIFGDMLDEAGRDKVHVDGELNLLKFAERQNVDRLKPLYNLLGTEDSVSKIIDPNSKDVQVRIGGELRNDLLKDYSIITGTYDLKEYGHGVIAVIGPTRMPYSKVIGIVGALREELTKKLLGYYDDDNQ

SEQ ID NO: 4611 - protein, 318 aa, Lactobacillus buchneri
MQISRLHYPLSDDFKVDGPTVVAMGFFDGFHKGHQAVLQRAKTEAEKRGAKLAVLTYDHHPAIVYRKMSPHEQRYLTLNDYKMQLLRDFGVDQVFLVNYSYDFQSQTPEEFINNFLKRFNAVAVVAGFDHTYGDKKVATMANFPKFVKGAFDVITVPSVDINDKKVSSTRIRIELDSGDVDSVTKLLGRPFQTRGVIVHGEERGRLLGYPTANVEHSEYQWLPTIGIYVVTVEIAGKKYLGMASIGKNVTFSDVHPMTVEINLMDFDRNIYGEVVNVNWLSYLRAEIKFQTPEDLIDQLDKDKVATREYLEQHPEILN

SEQ ID NO: 4612 - protein, 301 aa, Lactobacillus buchneri
MDGVIALYKERGMTSHDCISKLRKILHTKKVGHTGTLDPNVDGVLPICIGQATKISELLMQSGKVYRGAITLGVAYDSEDLDGHLIEQVPVKTPLTDEQINAALAQLTGDILQTPPMYSAVKVNGHKLYEYARKGITIDRDPRRIRIDYFKQIKPATYDDAAHTQTIYFEVGCSKGTYVRTLAVDFGKRVGLPSVMSDLTRIKSGGFDISQTSTLAQVKEAVAAEDLSIVLHPLSEALAEYPGYQLDDSRWSIVSHGGFLDQSISPTHAPVVRLDYQQQVKALYRLDEQIGQYRPFRMFLA

SEQ ID NO: 4613 - protein, 117 aa, Lactobacillus buchneri
MAHYRVGRLEQEIQKEVNDILLKRVRDPRVQGVTLTGVEVTGDLQQATIYYSILSDKKEDEETTAKGLEKASGLIRGELGHRLSIYKTPEIKFELDTSVQYGDKIDRLINKLNQDGE

SEQ ID NO: 4614 - protein, 858 aa, Lactobacillus buchneri
MGKKRIYELAKELNVSSKQIVDRGNKQGFDIKNHMSTVDANQERQIRAMFSKGGKQSTGNSQSSHKSSTNNVHSANSKPKEHANAHAQSRPAAHHDSNGSHPVSRNTQQANRNAESNRNNNGHSSVARNTNNTAQRNHSNNNNHSNNQNHSNNSNQSNNHRTNQNNDRRNHQASNNSSNTSTRNTNSHSTGSSTTASNHTSSNNNSNTNRSSNNFSNHNTGSGRFGGSLNRNNNRGGSRKANKKRNKKQRKQKNQRLREVEHHGAPERKNRPLPKVLEYQDGMNAQELGKLLHREPAEIVKKLFMLGVMVNQNQSLDKDTIEILAADYGIEAKQKVHEDLSDLDKIFEKEMENTEHLVSRPPVVTIMGHVDHGKTTLLDHLRHSHITAGEAGGITQAIGAYQVRHGDNLITFLDTPGHAAFTEMRARGANITDITILVVAADDGVMPQTIEAINHAKAAKTPIIVAINKIDKPDANPQHVTDQLMQYGLVPEKLGGDTIFVDISAKFGKNIDELLDMIILEAEVMELKADPDQPAAGSVIEARLDQGKGPVATLLVQQGTLHVGDPIVVGHTFGRVRTMTNERGRDVKKATPSSPVSITGLNEVPEAGDRYVVFDDEKTARAVGEERAKEAQVEERRKTTRVTLDSLFDSLKEGEMKEVDIVIKADVQGSVEALANSLQKIEVEGVKVNIIHSGVGAINESDVALAEASNAIIIGFNVRPTPQAKSQADSDHVDIRLHQVIYNAIDEVESAMKGMLAPTYTEQVTGEVEVRDIFKASKVGTIAGGMVVDGVVQKNSKVRLIRDGVVVYTGELNSLKRFKDDVNEVKQGFELGLTIKDYNDIKVGDVIEAYVMKQVPVK

SEQ ID NO: 4615 - protein, 105 aa, Lactobacillus buchneri
MDNDQAILNFLGLARRASKIVSGQDMLLSQIRSGKIFFLFIAEDTGKATQKKFNDKSNYYHIPVNNSYTKAVLSEAIGMKRTIIGISDRGMAKKLVELTDNNKGE

SEQ ID NO: 4616 - protein, 99 aa, Lactobacillus buchneri
LKKRKIPMRKDIVTGEMAPKKELVRIVRDSDGHVSIDETGKKSGRGAYISINVEIARKAKAEHTFEKVFSTTLDDNFYDDLIAYVDHKQARKELFEDGQ

SEQ ID NO: 4617 - protein, 398 aa, Lactobacillus buchneri
MSKELLGALSALEEEKGIKKEVVIEALEAALVSAYKRNYGQAQNVEVSFDDKKGEMHVYAVKTVVDDVVDDQLQVSLDEALEINKGYELGDEIKFEVTPKNFGRIAAQTAKQVIMQRVREAERENVFDEYSKYEDELVTGTVERQDTRFVYVNLGKVEAVMGSKDQMPNEVYRPQDRIKVYVTKVENATKGPQVFVSRTATGMLKRLFEQEVPEIYDGTVEIVSIAREAGDRAKVAVRSNNSDIDPVGTAVGPRGQRVQTIVNELHGENMDIVEWDEDDASYIANSLNPAEVIDVIFDDDNERACTVIVPDYQLSLAIGKKGQNARLAAKLTGFKIDIKSETEAKEILANKAAAASDDTEADEASDQGDQTEDSTEDAPTDGADVNTNPDESNEDTQD

SEQ ID NO: 4618 - protein, 157 aa, Lactobacillus buchneri
LSNVVETVKQVVEPILEKHSFYLFDVEFVKENKSWYLRVYIDKKGGITIDDCVLVSDELSEKLDAMDPDPIPQAYFLEVSSPGAERPLRNDAELKQAIGEYIHVSLYQNLNGNKTFEGTLKSLDDDKLVLQNDKWGKQDTLEVPRNLIAKARLAIQF

SEQ ID NO: 4619 - protein, 1439 aa, Lactobacillus buchneri
MSLDRNQLFEKLLEQLQWTQANELPYFEDAKIDRLEVHKQSQRWQFDISLPRILPFEVFNDFNARLQSAFKEIADVSLNISAKNDTFTEQLLRQYWQWVVPHSGVTSPLMKELCADKFPSIVDSRVEFVAENDIVKDFMTNTALGPIEDAFQRAGFPDFTIHTIVDESSSQQNIQALKKKNDAANAELVKKANQAIKENAQAHPKSGNGGGKSTIGRRIKDDLPVMKVEEIVEEERSVVVSGYIFDKEIRALRSGRQLLMLKITDYTSSIQVKKFSNKGEEALFEGVNEGDWVKVRGSVQEDNYSHELTLNAYDINPIKTVSRQDTADDDKKRVELHLHTTMSQMDATNNIADFAKQAKHFGQKALAITDHAGVQGFPDAFHAGQKNDIKMLYGVEINLVDDGVPITYNDKHVPLKDATYVVFDTETTGLSAIYDRVIELSAVKMQNSNVIDQFEEFIDPGFHLSERTTNLTSITDEMVHGSKSEEEVFKLFREFCGDAIVVGHNVTFDMGFMNTGYVRHGMHEMQNPIIDTLTLARFLYPNLRGYRLNTLAKKFDVSLEHHHRAIYDAETTGHLNYLFLKDAEDRYGIVYHDQLNDHMTDNDAYRHARPSHAILLAKTQAGLKNMFKIVSLSNVKYFYRVPRVPRTQLEKYRDGLIVGSACSSGEVFTAMMQKGLDEARQKAGFYDYLEVQPKRAYAPLIESGLIADDENLEQILTNMVKLGDELNKPVVATGDVHYLNPQDYIYRKILINSQGGANPLNRQELPDLHFLTTDEMLSDFNFLGPEKAEEIVVDNTNQIADEIEDVHPLKDKLYTPRMEGAEDEIKSRTMDTAHAWYGDPLPKIVSDRLDKELKSIIGNGFSVIYLIAQRLVAKSNKDGYLVGSRGSVGSSLVATLTGITEVNPLPPHYRCPNCQHTEFFTKGEYSSGYDLPHKKCPECGTMMIGDGHNIPFETFLGFTGNKVPDIDLNFSGDYQPIAHNYTKVLFGEKNVFRAGTIGTVADKTAYGYVKAYERDKGEVYRQAEEDRLAKGATGVKRTTGQHPAGIIVVPDYMDIYDFTPIQYPADDQDAAWQTTHFDFHSIHDNILKIDILGHDDPTMIRMLQDLSGIDPKTIPMDDPGVMSIFSSPKILGVTEDQIQSKTGTLGVPEFGTRFVRGMLEQTHPSNYSELLQISGLSHGTDVWMGNADELIKNGTATIANVIGCRDNIMTDLINWGLDSELSFQIMESVRHGRGIPDDWQAEMKKAKIPDWYIQSCLKIKYMFPRAHAAAYILMALRIAYFKVYFPMVYYASYFSVRADDFDIVSMCRGKEAVKNAMRMINDKGMEASTKEKNLLTVLELANEMLERGYHFQMVDLDKSDASQWLIDGDTLIAPFNSVPGLGLNVAKQIVAAREDKPFISKEDLAKRGKVSKTLIDFMTENNVLAGLPDENQLNLFDLM

SEQ ID NO: 4620 - protein, 569 aa, Lactobacillus buchneri
MKQSQMLIPTLKETPKGAEALSHQMLVRGGYIRQISAGMYAYLPLAYRVLNKIETIIRQEMEKTSAHEMLMPDILPADLWKESGRYDTYGPELFKFKNRHETDFILGPTHEETFTALIRDSIKSYKQLPLVLYQIQNKYRDENRPRYGLLRSREFIMKDAYSFATNDEDLDKTYNAMEQAYRNIFDRIGLKYKVIIGDGGAMGGSDSKEFSAMAAVGEDTIVYSDESDYFANLEMAKSKVDDQPSTEPEEDLKKVETPNAKTIAEVAAFLKVSDKQTIKSMLYIADEKPVMVLVRGDYDVNDVKLKNYLGADFLDLATDEQAKTYLGADFGSLGPVGVGEDVRIVADQRVANMKNAVVGADEDGYHYVNANSDRDFRIDDVDDFVVVKEGEKTPDGKGTLKFTRGIEIGHIFKLGTRYSKSLKANVLDENGRAVPVIMGSYGIGVSRLLSAISEQNADENGLVWPKAVAPFDVHIIPINAKKAVQMDLAHQIEAQLTADQLQVLVDDRKERAGVKFADSDLMGIPLRVTIGKKAEEGIVEIKIRKTGETVEVNVTELSDTIKKMLKNLD

SEQ ID NO: 4621 - protein, 424 aa, Lactobacillus buchneri
LITTIIVFIIVFGILVIFHEFGHYITAKRSGILVREFSVGMGPKVFYYRKNSTTFTLRLLPLGGYVRMAGEADDGEDELKPGTPVTLQLNDSGVVTSINTSNKHSLFQGIPLTITDTNLDDNLYVKGYENGDESQVKSYPVDHDATIIEKDGTELQIAPRDVQFQSASLPNRMLTNVAGVFNNLLLAILVYTILGFVQGGVASNTNKVNVMPTDSVARTAGVKSGDRIVEVDGHKTTDWQDLTVQIRSKADKQISVKVQRDGQDKVLTMKPKAQTSGGQKTGFIGITQTMDTSFKAKILSGFTTTWTVAKQLFGALWSMVSGHFSLNDLGGPVAIFATTSQAAKMGLSGVLNFLAFLSLNLAIINLIPIPGLDGGKLILNILEAIRRKPVSQTTETVITLIGFAFLMLLMILVTWNDIERYFLH

SEQ ID NO: 4622 - protein, 262 aa, Lactobacillus buchneri
LRQRVITAVVALLIFIPIIVMGGIWVDIAALALGIVAISEILVMKKKLLISPESIIAYLGVCSLILPDAWTSFLPGHISQNFVFFLFVLMLLLQTVLSRNLFSFDDAGVIVLGMLYIGMGFHYFVAARGVGLTVLLYALFIVWVTDSGAYIFGRMFGKHKLAPRISPNKTWEGSIGGSLAATILCTAFIAFYPIAGHSLLQMFIFTIILSIAGQFGDLIESALKRYYGVKDSGKILPGHGGILDRFDSLLFVLPMLHLLAVI

SEQ ID NO: 4623 - protein, 256 aa, Lactobacillus buchneri
MFNNTQDNQQATPQLKTDNIPAHVAIIMDGNGRWAQKRHLPRIAGHKRGMETVKTITKVASDLGVKVLTLYAFSTENWKRPHDEVSYLMGLPVKFFNDFVPDLVKNNVQVRVMGIKDQLPVQTQKAVNDAIKDTADCTGMILNFALNYGSRLDIRMAVQQIGRQVASGQLDPEQITDQTIDANLMTGFLGNLADPDLLIRTSGEERISNFLLWQIAYSELVFTDVLWPDFDRTVFEQMIMEYQQRDRRFGGIKTSK

SEQ ID NO: 4624 - protein, 151 aa, Lactobacillus buchneri
MADNHNNNNNSDNDEIAVVPGTDEFGKMLFKLNTPVTEDNLGVLDYNGGHLQPVQDGLYAMPAYVNDGFNLFFIVSQLVENDWVIAFSTATIENDHEITDLSEPYTTGKGLNLLGQKSPEDANKLLKYFNTLAEANRGEWRMVERPDGESD

SEQ ID NO: 4625 - protein, 187 aa, Lactobacillus buchneri
MADAQSVLTEAKEKMKNTREVLEHDMGSIRAGHANASLLSGVMVDYYGAPTPLNQIASITIPEARVILITPYDKSALEGIEKGIYEADLGISPANDGTAIRLAVPALTEDRRKEIAKQVKATGEKSKVAIRNVRREAMDTLKRSNKSEDITDDELHRYEDQVQKLTDDAIKGVDGIVADKEQEVMNG

SEQ ID NO: 4626 - protein, 240 aa, Lactobacillus buchneri
MSEVKYNRIILKLSGEALAGDRGFGINPPVIKNVAQEIKDIFNLGVQIGIVVGGGNMWRGEAGAEMGMERAQADYIGMLGTTMNGLALQDNLEHLGVPTRVQTSIEMRQIAEPYIRRKAVRHLEKGRVVIFAAGTGNPYFSTDTTAALRAAEIGADAILMAKNGVDGIYSSDPRTHKDAVKFDTLSYMDILEKGLKVMDSTASSLSMDNHIPLVVFNLNKPGNIRKVVTGDNIGTTVKEK

SEQ ID NO: 4627 - protein, 291 aa, Lactobacillus buchneri
MAKISASQVMDLRKKTGVGMMDAKKALVATEGDFDKAIEVLREKGVAKAEKKSDRVAANGLATIAVKGNTAAIVEINSETDFVASSDPFKELVKRVSDAIVTNKPADVDAAMALQTDKGTVKDDLIETTQVTGEKVTLRRFEVVEKNDDEVFGSYLHNGGLIGALVQLKGADEETAKDVAMHVAATNPEYLNQAEVPADRLAHEKEVLTQEALNEGKPEKIVEKMVEGRLHKFLAEICLEDQDFVKDPDVTVSKYVASKGGSIVKFVRYEVGEGIEKKTQSFEDEVRDQLK

SEQ ID NO: 4628 - protein, 266 aa, Lactobacillus buchneri
MAVISMKQLLEAGVHFGHQTRRWNPKMKDYIFTERNGIYIIDLQKTVKLIDVAYNFMKDEAAKGAVVLFVGTKKQAQDSIAEEATRAGQYYVNNRWLGGTLTNWETIQSRVKRLKDLKKMSTDGTFDILPKKEVSLLIKQEQKLERFLGGIEDMPKIPDVMFIVDPRKEQIAVHEAMKLNIPIVAMVDTNTDPDQIDVVIPSNDDAIRAVRLITSKMADAIIEGRQGEDDVNEKTFEGKDGAKADKKEDSIEDIADAVEGSNDSNK

SEQ ID NO: 4629 - protein, 242 aa, Lactobacillus buchneri
MIKAIVFDIDDTLYDTKPAFVQAFEETFNLNLPEEQMNQIFANYNEQEQLAIAESNSDSDLKLSDEEINYHSLHHTFKKYDLPGLTQESAKAFSEAFETASSSIHLFDGLTTVFNTLTTKFKLGIITNGSNDVQLAKIMKLKLHHWFSREQIITSEDAKAKKPDPLIFTLMNRKFNLRGNEMMYIGSSYFEDIVPAKKAGWETVWYNSHQSPIADPQIIPDQTVKTPEELKDLLMDLAAQMD

SEQ ID NO: 4630 - protein, 332 aa, Lactobacillus buchneri
VKIIAYGIRDDEKPYLDKWSEENPDVEVASTGELLDDSTVDQAKGADGVVTYQQKPYTASVLDKLGSFGIKYLSLRNVGVDNIDADAAKRNGIQVTNVPAYSPEAIAEFTVTQLMRLLRRTNTFDRKQANGDLRWAPDIADELNQMTVGVFATGRIGRAAMRIYKGFGAKVIAYDIYHNPELEKEGVYVDTPEELYAQSDVLSLHAPATKENEHMINDKTIAQMKDGVFILNPARGALVDTDALIRGLDSGKIGGAALDTYENEVGIFNTDFGSFDKIPDERLKNLMKRENVLVSPHIAFYTKRAARNMVYFAMDANKSLINTGKSDKLVEL

SEQ ID NO: 4631 - protein, 90 aa, Lactobacillus buchneri
MEQTDKYYMYVLLCADDTLYTGFSTNVERRFQQHVKGLGAKYTRSHRPIKILFKQQFDSKHAALSAEYAFKQLSRAQKIAHLAQAGIKLE

SEQ ID NO: 4632 - protein, 250 aa, Lactobacillus buchneri
MQVNLHEDERIDQLYSKGIQIIQSKDVFSFSLDAVLLADFVRTTQHRTKQIVDMCAGNGAVGLFLSEKTAAHITMIEIQTRLADMAQRSVELNDLAQQISVVNDDLKNADQYIPKDSVDVVACNPPYFVNYKTSEKNPNRYLAIARHEITTNLNEIVSSAAGLLKMNAKLFMVYRPDRLTDLIVALRSHRLEPKRLQFVRPRIKEDANMVLVEAIKDGKSNGLKVNRDIITYDGDDYTDEVKKMLYGTNR

SEQ ID NO: 4633 - protein, 209 aa, Lactobacillus buchneri
LFYSFMRVLVRILVFIINGNARYEHKERLPKGNYILVGPHRTWFDPIYFALAGSPKKFSFMAKKELFKNPILRWILVHANAFSVDRDNPGPSAIKKPVRILRKSDLSLILFPSGTRHSSQLKSGAAFIAQLSGVPLVPAVYQGPLTFKQLFTRKRVTIAFGEPITIDRKQKLTDDFQKQIETEMQSAFDALDYAVNPNFKYVDVSKKEE

SEQ ID NO: 4634 - protein, 74 aa, Lactobacillus buchneri
LATWIWILIVVLALILGLVGGFYGARKYMEKYLKENPPFSEDQLRQLMIQMGQKPSQKKLNQMMHSMQNQTGKN

SEQ ID NO: 4635 - protein, 94 aa, Lactobacillus buchneri
MNEQEKKELQSKIGDDVFKELIPRINELAHKAKNEGLSEVEKLEQADLRKKYVAHFRENFKKQIEMMKVYDKNGKEVTPGKVREVQRHKGLRDD

SEQ ID NO: 4636 - protein, 212 aa, Lactobacillus buchneri
MSKTTNDPQSKQYQILHFIWERVNEQGYPPTVREIGEAVHLSSTSTVHGHIARLERKGYIVKDPAKPRALEVTSSGLDVLGMQPQQKQIPVLGTVTAGEPILAVQEATDYFPLPPALAHSDQPLFMLQIRGESMINAGILDGDYVVVRKQESADNGDIVIAMTDENEATCKRFFKESDHYRLQPENDTMAPIILTKVSILGKVVSLYRSDIS

SEQ ID NO: 4637 - protein, 388 aa, Lactobacillus buchneri
MTIGIDKMGFFTSDYYLDMADLANARGEDPNKYLIGIGQKDQAVIPPTQDVVTMAANAAAKILSDDDKQAIDMVIFGTETGVDNSKSAAIYVQSLLGISNSARSFEIKQACYGGTAGVQMAFDHIAMHPESKVLVLAADIARYGIGTAGEVTQGGGAVAMLMSQDPQILALDNQSAFHSENIMDFWRPFYRRDAIVDGHYSTDIYIDFFNQTFKDYSAKYQRTLSDFSAVAFHLPFTKMGLKALRTVIDDGAHSQKLLKEFDHSKKYNALVGNLYTGSLYLSLLSLLANSKTLQPGDRIGLFSYGSGAQGEFYSGTIAPEIQPQSLAGQVEQVIANRTRLSVPEYEAMYANGLSNAGGDVTFDAADDDSRFVLLGRQADQLVYRDQQA

SEQ ID NO: 4638 - protein, 83 aa, Lactobacillus buchneri
MLTINVNGNLGNQQVVLSDNSVGTLTGARVFGSALSGNQVVQWTFISTGHQHEGFVYAGPLLEGLVIQSMNGNDTYQIHFTNK

SEQ ID NO: 4639 - protein, 62 aa, Lactobacillus buchneri
MKINIHRSATNKVLAGVIGGLAEHFQWNPTLARVVFVILAFTPFFPGIIAYLLLWILMKAPE

SEQ ID NO: 4640 - protein, 210 aa, Lactobacillus buchneri
VKMLGKQIGYGTLIILGCLALAIFLTVNSVWLFDLNINPLKLAAATGRTASQMHHDYVRIIAYLQVPWIPSLKLDYFFSSAKGLQHFRDVKGLILFNNFVGLILVPTGAYLLHRLNKKSLTWLLMTPIKVVTTVSLVIVALMFVNFDQVFVAFHEVLFRNQDWIFDPNTDPVINMLPDTFFLECFLLFFVLFFGGLAVIYWLGRRSLKQH

SEQ ID NO: 4641 - protein, 257 aa, Lactobacillus buchneri
MTNYKGYFIDLDGTVYAGKKRIPAAKRFIERLQKANIPFLFVTNNSTQLPRDVVKNLADNHDIHVKPENVYTSGMATVDYMNEHRSGDASSVYIVGEMGLKQVILANDYRLEADHPDYVVVGLDSDLTYEKLSEAVLAIRSGSTFIGTNPDTNIPKERGMMPGAGSVVKFVEYATQVEPIMIGKPKARIIESAIKKIGLEQSDVVMVGDNYNTDIKAGINAGVDTLLVYTGLSTKQQVAKESVQPTHQIDSLDDWRL

SEQ ID NO: 4642 - protein, 192 aa, Lactobacillus buchneri
LDRKTLDELVAKQDENRKPLARINRVSETEFLINDHKYELDTNHTDGFDFNEFVRRYNPAFSQYDYIVGDWGYGKLRLRGFFNDDRTETSGPFISALNDWILEDVNFGAAYFVVHNLEARPVIRKSRNNHGNHRSNRSHNSRNRSNHRNHRNHAFEEKKVTAHKPIEKRHNMVVKTEEKSKKHHFIIRESKN

SEQ ID NO: 4643 - protein, 462 aa, Lactobacillus buchneri
MTEKLTILHTNDLHSHFENWPRIRQFITTRRAELQRADSSVITVDLGDAVDRVHPLTEVTNGKANVELLNQIHYDAVTIGNNEGLTNSHEQLDELYNDANFDVILGNLLDQQTKSIPKWAHPSKIITTPQHTRVLLIGLTAPYLLTYPILGWEPLKPETVLPKILADNAGKYDICVLLSHLGLPTDRLLARQFPQLDVIIGSHTHHLLVHGEKVNHSLLAAAEKWGHYIGEITLTIDDSHRIVSSQAKVIKTADLPSKPEDDAEIQEYQQHGEKLLARNKLARIKAPMTTNLIGHSRLVNEGLHAIMEKADTRAAILSSGLFLTDLPQGIVDRNQLHQMLPHAMHVMRVTLDGYNLWRLIKEMEKNKNFLTKFPQKGMGFRGKYFGQLHYGGLRYDQDAGQLFFHEELVSPAKTYQIAMPDHYLFIPFFPTLEIIGHNEILYDENLRDVFGDYLAKHYPLNQ

SEQ ID NO: 4644 - protein, 202 aa, Lactobacillus buchneri
MQFFTADTHFFHERLLGVSEFAPRPFLTVEDMNETIINNWNRRVGKNDVVYHLGDIAILHTRPEKVALEKIFEVLDQLNGRLVLIKGNHDSRALFKYLQQHNHPVGNHQKFEFHDVGVLIKMNHRQYYMTHYPMMMGIVKQIINLHGHIHHYAVPIKENINVGVDTPETDYLKKKPPFGTPFSQAEIEEMVAGKAEDFAKRH

SEQ ID NO: 4645 - protein, 459 aa, Lactobacillus buchneri
VENQEDDNQLSRGLKNRHVQLIALGGTIGTGLFLGAGQSIHLAGPSIILAYGIAGLACFLLMRALGELLVSDVESNSFVFFIKKYLGEKMGFVIGWTYWMCWIAIAMAEVTASGLYVQFWFPDIPIWLTGLVLLLILFIINIVAVSAFGETEFWLAIVKIVAIVALIVIGIVLVAIHFKTPYGHASLMNVVDGGFFANGAKGFVLSFQMVLFSFAGIEMIGMTASETQDPLVTIPKSINEVPTRVLLFYIGSLLALMSIFPWQHVSPTSSPFVQVFAGVGIQSAALIINFVVLTAAISACNSSLFTTGRMLFSLTYNGKSKFSRKVGRLSARQIPFNAILFSTLVIAVIVLLSIMMPGDVFSFISSVATTCFLFVWGMIVLAHIKYRKQVKKTGSQKSLKFKMPLFPISDYFVLIFMAFVAVVLTMKTDTLIALIGSVVWLIGLFIFKSLTDKVKEVEK

SEQ ID NO: 4646 - protein, 399 aa, Lactobacillus buchneri
MGKSIAINAGSSTLKYKLFQMPEETVLSSGAIDRIGLGASDISIKYGDGKKFKDTQDIDNHEQAIQLVLDKLLSLDIIKDYSEITGVGHRIVAGGELFPDSVVIDDEVIKKIESLTEFAPLHEPAALLGIKAFKKILPDIISVAVFDTSFHTTLPEVNYMYSLPYEYYQKYQVRKYGAHGTSYRYVSARAAALLGKPLKDLKLIVLHLGAGASIDAIKDGKSFDTSMGFSPVAGITMATRSGDVDPSALQYVMQKAGIKNMDDMVDILNHKSGLVGLSGVSADMREIEGVMKTNHRAMLAREIFKNRIIRYIGSYIAEMGGIDALVFTAGIGENDIMIRQEVTDKLGYFGIKVDPEKNNIRGEERDLSAAGSTVKTLLIPTDEELMIVRDIERLRKTQK

SEQ ID NO: 4647 - protein, 336 aa, Lactobacillus buchneri
LRVLAQGKIEQLFDILNRSTELIQKAKDQSYLDSFIETLGFIQSDDEEDDELTEADTKKLTNIYADFNPDDFTAETFRKAIQMAVLKAIRVDTIQANYQLTPDTIANVIGYIIAGIFHDRKELSILDPAMGTANLLTAIYHQLQTSIGVTPTISGIENDDAMFELAADSVELQKIHAELFHEDTIQNVLAPVVDVVVSDLPIGYYPIDANAKGFATHSDTGHSYVHHLLIEFGMKHVLPGGFGFFLVPSQLFQTSEAKQLLKWMQGKVYLQGLLNLPKELFANAAAQKAILILQNAGDGAKQVDPVMLGEFPSFKDQQAFTKFLTEIDDWEQTDLL

SEQ ID NO: 4648 - protein, 89 aa, Lactobacillus buchneri
MLLSIMAKSVQLIQNYRSRIDKYKRGSLTVVAVIFVGILMSCLMFQLAAYKQELGSINRITEHERQMRRQFLEKPLKKDVHPKRTSGHE

SEQ ID NO: 4649 - protein, 147 aa, Lactobacillus buchneri
MKQKLSVSKVDTRPGYLLIEGLITLVIGVFAIWTIMTMIVYAGNEKKQNVINFHSYLSIIESDRYRFEIKQCQPSKCVMYSPVTKKTYRIERYENMVRLAGAYKGHVPSLTNVQWVRWTKSRGCLRTDVTFDNGQKCSAYSKLPFKD

SEQ ID NO: 4650 - protein, 61 aa, Lactobacillus buchneri
MWKGTNKRAFTVIDSLIGLTIICTFSLFYIQTTHQMNETITNAEKVMTIERQKYEAEIVRE

SEQ ID NO: 4651 - protein, 151 aa, Lactobacillus buchneri
MKCKNREGFTVIELVVYLGVVLGVLMINLMLIKVVQSGNPSEALFWRSFQSAWTRMTLNAKAENISYRISIRDKDVIFFPMKVKKTHYDEVNEERISVPPSIHVRSQRSMIAHDDGFASPTKIIWLDSDGNVKYNQKIQMGWSGYHVERNK

SEQ ID NO: 4652 - protein, 104 aa, Lactobacillus buchneri
MKKRVKKMREGFTLIEMTIVLFIISLLILIIIPNLSNQRKHAQSVHSSAMTEVVQAQIDAYFSQHPTAKSVSFPDLTKGGYLTAKQVKQAKDEGLKITHNEVQK

SEQ ID NO: 4653 - protein, 286 aa, Lactobacillus buchneri
VVIGSLKSGREFSESVRPLIETQAYHQLLIAEKHGQLSDILNELANFDRLRLKQLKKIKAMLVYPLFLCLILGTLILMIRVYVLPQIQDLMPTANHQQPVTYWQQLIRLSPIPILIGIIGSTVHWSRQDAITQAQMIVKIPVVGKLFRKYIAYYLASNLATLLKNGLSVKEIYATLSEFKEGSLIHLLGERLHATLLSGGSLRKLVDRHNFIPNEIIKFMSSGNTIPEMANSMTAYSRLMFDEMILTTDKLIGFIQPAMFVVIGVTIVSTYFQLLIPIYNSVKGMY

SEQ ID NO: 4654 - protein, 323 aa, Lactobacillus buchneri
MEISQQVNGLLNEAIKTQASDLYFLPEGDEYLVKIRNANEVVVWDKIGYLQARRMMNYCKYIADMALSEQRRPQIGSMDWHFGDNQYFLRLSSVGNFTGLESLVIRIIYQLDDVHAAFFDEKQVQLISEMSRKRGLIVFSGPTGSGKTTTIYNLVNQMVSDQFVMTIEDPIEIREPRFLQLQVNHDAGMDYTDLIKVGLRHRPDVFIVGEIRDAMTAEAAIKAALSGHLVYTTVHAQDPVGVIDRLKQLGISDEFIAQALTGVAYQRLIPTTDGKQRAMLMGHDYSELVNMNTYDWGEWQDGLKTAVKAKLVTPETAQRFEFG

SEQ ID NO: 4655 - protein, 243 aa, Lactobacillus buchneri
MSGHSKWHNIQGRKNAQDAKRGKIFQKISRDLYQAAKKGDPDPENNPQLRLVMEKARAANMPKDNVQRAIDKASGIGGAKFEEITYEGYGPGGTAIMVSALTDNKNRTAAAIRSAFTHHGGTLGTSGSVSYMFDRKGYIVILRDGLDTDEDTMLMDALDAGADDMKTSDDEFEIFTDPKSMDDVRDALQEKGYDLDTAEVRLFPENTTEVPEDKISQYTGLIDELAENDDVQDVYEAATLPEE

SEQ ID NO: 4656 - protein, 333 aa, Lactobacillus buchneri
MDKQTITIYDVAREASVSMATVSRVVNGNANVKPATRKKVLDVIEKLDYRPNAVARGLASKKTTTVGVIVPDVTNMYFASLARGIDDVATMYKYNIILTNSDSNNEKEVKVLNTLLSKQVDGIIFMGNEINDKLREEFKRTKTPIVFAGSVDEEDLYARVNIDYVAAVQEEVKNLIDRGNRRVAFVCGPLEQAINGKFRLKGYKQALKSAGIPYDEKLVFETDDTYKTGTLLQPALMAVNATAAMVTDDELAAGIMNGMSDADVKVPDDFEIITSNDTKLTEMVRPKMSSITQPLYDIGAVAMRLLTKLMHNEPVDEKNVLLPYGLMKRESTK

SEQ ID NO: 4657 - protein, 366 aa, Lactobacillus buchneri
MNKIEQIQRWLADNGQDIALITDPKTIQYLTGFYSDPVERVLLMAIFKDQEPFIFGPALESEAIKDTGFSSPVYGYLDHEDPWVMIADQIHARNTDDSHFAIEKSQLQVERLEALQQVLPNADFSANLTPLIEQMRLIKSADEIEKLKIAGKWDDFALQTGFEAVQVGKTEDQIAADLQYALMKNGIMELSFPSLVQAGPHAAEPHGATSENKVQNNQLVLFDLGTVWDGYISDASRTIAVGKPDEKSMDIYQVCLEAQLAAQEAAKPGITAEELDKIARDVITKAGYGEYFIHRLGHGMGMSEHEFPSIMAGNKMELQPGMCFSIEPGIYIPNVAGVRIEDCVHITEDGCEPFTQTTKELRYIEQ

SEQ ID NO: 4658 - protein, 154 aa, Lactobacillus buchneri
MGKKLAFGLFAGALGAGLYAAYQKLDEAKKAQLKRDARQKADELRDRAVDYAFYANDAVSDLKDVIHDEMQNTKGTVNDAKTQFADKAKSFGTDQAADDDDADDNQDDIVVDAKDAFQDTGIPKAADDLDSQSDQDDGDNEIPITDDSDNNDHK

SEQ ID NO: 4659 - protein, 138 aa, Lactobacillus buchneri
MTAGQIAGLIAATAFLLLVIFIGLFLMKVSRTISEVNRTIKTMTSNVDVIAKQTDNIMATSNDLLKDVDDKLNIVTPVFQAAADLGESVSSLNTATQNLTKRVKDTGKKGVSAGLAGKFGKSAWNMYRNRHGSKDTTK

SEQ ID NO: 4660 - protein, 293 aa, Lactobacillus buchneri
MINTLKFTVLAINWQKHLNMVDWDQLAMTILEKVGLLILFSLLFLLFRRIGKGLINHFFKRYRRKYQNTVAEKRIKTFHTLTLNILNYCLWFFWIYSILSTVGVPVGTLVASAGIFSLAIGLGAQGFVTDIVSGFFILLEKEIEVGEYVQIGTIRGTVTAVGLRTTQVVGDDGTLNFIPNRTITTIANMSRNNMTAMIQVGIFPQTPVDKVTQIIRQVNEEQIPHYPDIIGDPKILGTISLPNGKLVVQVNITTKNGSQYEVAHNFLAFYLAAINEAGIQLPASPTMVNGQAN

SEQ ID NO: 4661 - protein, 177 aa, Lactobacillus buchneri
MIDKPIETVMRESHRDILIPADLVATVNQDNDLQHVFMVLTKVKYAKIPVLDNDNHFMGLVSLPMITELMMQDTGITSRPLESVKVKQIMQKDVPTIYERDNLEAILRYLVDENFLVYVDSENHFKGIITRRELFKEINYLAHNFNKHYIALPVYNHKSKNETKHAKIQGSKGLINR

SEQ ID NO: 4662 - protein, 171 aa, Lactobacillus buchneri
MKIVVVSDSHGDRAIIQELVNKYAGQVDAIFHCGDSELPADDPLVSQLRIVQGNMDFAEFPDHLVQEISGKRILLTHGHHQNVNGGMLNLELYARSLSADIVLFGHTHQLGAVFDDQMLFVNPGSIAYPRGQYAGLGGTYAIISMDQRNYTVQYYNRQFEPVANLELRFPF

SEQ ID NO: 4663 - protein, 199 aa, Lactobacillus buchneri
VKRPESIVIASQNAHKIIEFEDAFKPTGITIKSLKHFENVPTIAETGTTFEENATLKATGIMNFTHQAVIADDSGLVVKALNGQPGVHSARYAGDHDDDANNDKLLKEMQNKTDRTAYFESVLVYLTPEGDKVVANGRIDGEILRERRGNNDFGYDPLFYVPSQQRTLAEMSTHDKNLISHRGNAIRNLIRKLLGLWDS

SEQ ID NO: 4664 - protein, 264 aa, Lactobacillus buchneri
LDNRPIGVMDSGVGGLTVLKEITKILPNESYIFIGDQANLPYGQKSSETVRKLTKRIADYLVEQNIKMFVIACNTATAAAYEYLKKVLPIPVIGVIEPGAQMAVKASKSGQIGVIATNGTVRSGDYQRLIKQANRSAVVSSLGCPEFVTMVEEGLAGTVEAQVAVNNRLAWFMDKPIDTLVMGCTHFPILKNEIQNVMGNAVTLIDPGVATAQQVKADLAAHDGFAPDQKQRVRRFYTTGNPADFAKVADKLLGTPISAVKLDI

SEQ ID NO: 4665 - protein, 172 aa, Lactobacillus buchneri
MDNEVYKHFMTDDTMRDLLGQELIRDSLIPEILGKDAHEISYWAGKHLARNHRLATYEDLETFFKQFKFGDLKLLKRSGNQISWKLSGKIVAQRLNAFDDPDFYLESGFIAQSCQYILNQQAEAELEKANVNKGFVLLSTYLSPDKPTDGQEASAIFEIVQPDPDDNSKPDD

SEQ ID NO: 4666 - protein, 103 aa, Lactobacillus buchneri
MLKETTDQTFEKDTAEGVTLTDVWATWCGPCRMQTPVIEELAEEMDNVKFTKMDADKNPETLSKFGIMSIPTLLVKKDGKVVDTIVGYHPKAQVKKVLDQYAG

SEQ ID NO: 4667 - protein, 788 aa, Lactobacillus buchneri
MNEKVLETLEYGKIKEQLAKYLTTDRGRQIVDLLTPSPSFETVSQRLAQTADGADIVRLKGEIPIPKLADIAPYMKRLRIENASLSGTELSHITKLLRAVQVVTEFFRGLAAEEVTLKSVPSIVDRLTLMPEVTKRMVASVDEDGRILDGASSQLRSIRRTIAATQSNIRSKMGKFIKGSDAKYLSEPIITVRDGRFVLPIKAEYKQRFGGIIHDQSASGQTLYVEPNNVVEMNNQLRRDQLAERAEVRRILAELTNLIRPHRNELLANMDLVGQLDFVNAKAKFAHATGSVMPKVSPKNVINLRKARHPLIPRDQVVANDIELGDQYNTIIVTGPNTGGKTITIKTVGLLQLMGQSGLFITANEDSQIGVFDNVFADIGDEQSIEANLSTFSSHMDNIISILKQTSKDSLVLLDELGAGTDPKEGAALAMAIIDAFHQIGGELIATTHYPELKAFAYNRQGIINASMEFDVETLQPTYRFLLGIPGQSNALNIASKLGMPEAIIDQARAFTDSENQDINNMIEELTAQTKRAHDEADELDQQLKESTRLQHDLQDKFTKYESQKERLVEQAKQQANQVVEEAKKKADRIIDDLHQKQAQVGKVAVKENELIDAKGALNQLESAPSLTKNKVLRKEKAKHDFHPGDDVLVKSYGQQGTLLRKDKNHTWDVQIGILKMQIEESDLEKATPAKQDKNQYQTHVSRTRSTGMSPTLDLRGHRYEEAMTEVDRYIDSALLAGYPSVTIIHGKGTGALRKGVTEYLKRNPRVKSFGYSAPNAGGDGSTVVKLK

SEQ ID NO: 4668 - protein, 172 aa, Lactobacillus buchneri
MIFTIGIILILIFGFFRGLHRGFVNEVLSLIGFLAATIVSIVGTSPIADFINQAIFKNGGNQTAELIIKWVIFAFLFGFVWRIVRLLSDLLSPITRLPLLHQLNALLGAAADLLIKYLFIFILLNFLLMFPDQSIQEQYQQSDVSQWIVKKTPILSDKMIQIWNQHSSEVNV

SEQ ID NO: 4669 - protein, 80 aa, Lactobacillus buchneri
MSSNEKRRFKTTIDGKDYVLVGKGSVDHMQAVSDLLNEQLKQLHEAMPTATDEQRAILIAFNAISKQFDVEESAHSKEVH

SEQ ID NO: 4670 - protein, 108 aa, Lactobacillus buchneri
MADQEPVQQQITLVDENGDETLYDVLFTFKSEDFDRSYILIYPDGKGEDEEVEIQAYALPKGDDPSDPQGGELQAIETDKEWDMIESVLNTFLGKDGDDQDDDSNDNQ

SEQ ID NO: 4671 - protein, 144 aa, Lactobacillus buchneri
MRLMGLDVGSKTVGVAVSDELGWTSQGVEIIRIDEDNKEFGLDRVSELVKKYQVDGFVVGLPKNMNNSLGPRAEASQQYGKRLEDKFNLPVDFEDERLTTVEAQRMLTEEADVSRAKRKKVIDKLAAGLILQNYLDSNGKLTKI

SEQ ID NO: 4672 - protein, 93 aa, Lactobacillus buchneri
MSSLDKTMFFNFNEGQPKDVRETLLTVYAALEEKGYNPYNQIVGYLISGDPAYIPRNLDARNLIRRHERDEIIEELVRFYLDNHPTETKKGEK

SEQ ID NO: 4673 - protein, 880 aa, Lactobacillus buchneri
MKQLSSGQIRQMYLDFFQEKGHTIEPSASLIPVDDPTLLWINSGVATMKKYFDGSVVPKNPRMTSSQKSIRTNDIENVGKTPRHHTLFEMLGNFSVGDYFKKEAITWAYELLTSPKWFGWDPDKLYMTVYPKDKDAKMYWEKVGVAPDHIIEIEDNFWDIGQGPSGPDSEIFYDRGKDFDNLAPDDPENYPGGENDRWLEVWNIVFSQFNHTPQDTYEPLPRKNIDTGMGLERVVSIFQHARTNFETDLFLPMIRKTEELSDNKKYDTNKKDNEAFRIIADHARAITVAIGDGALPSNVGRGYVIRRLIRRAIVNGQRLGINEAFLYKLVPVVGQTLESYYPDVLKQKDYIAKVVRSEEDRFNETLTDGLKLFNQVVKDAKANHQTTIDGPTAFKLYDTYGFPVELTEEEANDAGLSVDKPGFEVEMQKQKDRARKARSGAKSMGVQRDLLIEIKDPSEYVGYDTLDVDHAELLEIVENEKLVDHSKGGSVEVIFDRTPFYAEMGGQVADRGVVLDEEGDKVADVVDVQHAPNGQNLHTLKTQEPLEKGKTYHLIVDKLFHSRVEKNHTATHLLDQSLRNVLGGHTQQAGSLVEPNYLRFDFNHFGQVTDEDLQKVEDMVNRQIFNEIDVNTVVTDPKTGKKMGAIALFSEKYGDKVRVVSIGDFSVEFCGGTHVNNTRDIGLFKIVSESGVGAGVRRIEAVTAKDAFKLLNDHEKELKQIAGDLKVTQIKDTPKRVDQLLGEIKDLTQKQQSLEAKLAGQQAQNVFADKKTAGKYSIITGIIKDAGMDQLRQLADTWRSKHLSDVLVLGTGSGDKANLIVAVADEQIKAGIKAGDLIKSIAGNIKGGGGGRPNMAQAGGKDPAGLDKAMSAAVDWLANK

SEQ ID NO: 4674 - protein, 486 aa, Lactobacillus buchneri
  misc_feature (6)..(6): Xaa can be any naturally occurring amino acid
DEADBXATPDEPENDENTRNAHELICASECSHBMSNFSEFNLKPFLLDAVKELNFSHPTPVQEKVMPVIMQGRDVVGQSATGSGKTHAFLLPIFNQLDPAKDEVQAVITTPSRELAYQIIDAAKQLAKHSPEPISTGAYIGGTDKARQEKKIQHEQPQLVVGTPGRIWDLIQNGGLDVHTASQLVIDEADMTLDMGFLDVVDNIAASFGKHVQMMVFSATIPQKINVFLKKYMVNPFIEEIPVSTIISPTIDNWLISTKGQDKNQLIYKLLTIGEPYLVLIFANTRKRVEELTEYLKGQGLKVAMIHGGLKPRERKQIMKRVKNLEFQFVVATDLAARGIDIEGVSDVINDDIPTEDLEFFIHRVGRTGRNGMSGTSITLYSPDEEKEVEELEDMGIHFQPKALKNGEIVDSYDRNRRKTHRKKHDKLDPTMIGMIKKKKKKIKPGYKRRIKNTIARKDEMDRRVAKREEARAKRKQRKNSSSRYQ

SEQ ID NO: 4675 - protein, 315 aa, Lactobacillus buchneri
MSIQDQILSEIKKFKTIIIHRHKRPDPDAIGSQMGLAQLIKGSFPDKTVLCAGKQYDSFAWLGTTDEIADEQYKDALVIVVDTANQPRVDDERYTTGKELIKIDHHPNDDQFGHIMWVEPDSSSTSELIYDFYDANRDQLTLPDEGARLLYAGIVGDTGRFMYPSTSPHTLAVASKLAEYQFSTSEVNKIEDEIDIPLARLSAYVYENLNILDSGAAYLVLSNKVLEPFKLGDESTSAVVPLPGKIKQVVSWAIFVEQKDGSFRIRLRSKGPEINELAKQYGGGGHPLASGAVVEDEAHIKEFVSDLNDLVAKNK

SEQ ID NO: 4676 - protein, 350 aa, Lactobacillus buchneri
MDAFYASIEERKDPTLKSQPLIVAKDPRKTGGRGVVATANYKARQFGVHSAMSVMKALELCPQAVFRFSGFDLYRSVSNQIHEIFHEYTEVIEYVALDEAYLDVTHNKKHLTDPIQVARMIQNEIWDATHLTCSVGVSYNKFLAKEASDYAKPVGITVIEQRDALEFLSRLPIEKFRGVGKKTVPKMHELNINNGQDLIQWSQMDLIKHFGKFGYVLYQRARGIDDRPVEYQRVRKSIGKERTFGPAIDTQTEVDDELQRIAAMVVKAMDDKKKHGKTLVLKIRYADFSTFTKRVTMDNYLKNSPEEYFTLANDLLVDMPDISKGVRLLGITITNLDDLTYENIVLHLFD

SEQ ID NO: 4677 - protein, 126 aa, Lactobacillus buchneri
MIVVLFAVMYFLMIRPQRKQQQKRRDQLSKIKEGDQVITIGRLHGVVDEINEAEKTVTLDCDGIYLVFDLSAIASVKQPAVAAPAANNDTTTTANDDHKDDAASSKSDQDATEDSDTKDETKSEDK

SEQ ID NO: 4678 - protein, 380 aa, Lactobacillus buchneri
MQPAISYRLIKKEKHTGARLGEITTLHGTFKTPMFMPVGTQATVKTLAPEELEQMGSTIILANTYHLWLRPGEDIVKEAGGLHKFMNWHKGILTDSGGFQVFSLAKNRDITEEGVTFKNEINGSKMFLSPEKAIQIENDLGPDIMMSLDECPPFFESYDYVKKSVERTSRWAERGLKAHRNPDWQGLFGIVQGAGFEDLRKQSARDLVSLDFPGYSIGGLSVGESKQEMNRILESTSPLLPENKPRYLMGVGATDSLIDGVIRGIDMFDCVLPTRIARNGTVMTSHGRLVVKNAKYARDFTPLDDQCDCYTCRNYTRAYIRHLMKTDESFGMRLCSYHNLYYLIHLMKRVQQAIVDDNLLDLRAEVFEQYGYNKPNPKNF

SEQ ID NO: 4679 - protein, 346 aa, Lactobacillus buchneri
LKTNYTLEDFDYDLPHELIAQTPIKDRDESRLLVLDKETGEMQDRHFYNIIDYLNPGDALVMNDSKVMPARIYGVKADTGGHMEVLLLHNIEGDRWETLMKPAKKAKVGTVINFGDGQLKAVVTKELDHGGREIEFKYDGIFIEILERLGETPLPPYIKEKLDDPDRYQTVYAKEMGSAAAPTAGLHWTKDLLKKVEDKGVHLVYLTLHVGLGTFRPVDEENIEDHKMHSEFYRLSDQAAATLNSVRDNGGKIVATGTTSIRTLETVGTKFDGQIRPDSGWTDIFIKPGYQWRVVDSFITNFHLPKSTLVMLVASFTGRENILNAYQHAIDEKYRFFSFGDAMYIH

SEQ ID NO: 4680 - protein, 342 aa, Lactobacillus buchneri
LANEKDDRLVSPENVDADENSIEKSLRPRVLSEYIGQDDVKNELRVYIKAAKQREESLDHVLLYGPPGLGKTTLAMVIANEMGVNIRTTSGPAIDKPGDLLSLLNELQPGDVLFIDEIHRLPKVVEEMLYSAMEDFFVDIIVGQGSGAHPIHFPLPPFTLIGATTQAGMLSAPLRDRFGIVEHMNYYNATDLEDIVRRTADIFQIDIEDSGAHEIALRSRGTPRVANRLLKRVRDFAQVSDKDQVDLAIVRYALAKLKVDDLGLDATDLKLLTTMIKYYDGGPVGLNTLAANIGEETDTIAEMYEPYLLQIGLIKRTARGRIVTPKGYAHLSYPMPPQDERN

SEQ ID NO: 4681 - protein, 199 aa, Lactobacillus buchneri
MFEFLEGTVVDITPTHIVLLVGGVGYLINTADPYRFNVDEKKVIRVYIYQSVSDTAILLFGFATIEDKQIFEKLISVSGIGPKSALAILAGNDRDGLITAINNEDVKFLTKFPGVGKKTARQIILDMQGKLDDIATNGASLAQPLGSPEKSPELADALSALEALGYGAKQIAAIEPDLVKQADLSTDEYLSLGLKLLMH

SEQ ID NO: 4682 - protein, 643 aa, Lactobacillus buchneri
VIDLNEIHKLPTILSNQIAAGEVVERPASVVKELVENSIDAKSSEIDVTVENSGLKLIKVVDDGNGIDSSQVQTAFLRHATSKISEQRDLFRVRTLGFRGEALPSISSVANVRMKTSTGSIGTEVEYKGGKLVTQKASESRKGTTVEVASLFYNTPARLKYLSSPNTELSKISDIVNRLALSHPEIAFSFISNGRELLRTSGRGDLRQVLGAIYGVKTVSKMAAIKGNDLDIKVSGYVSLPELTRSSRNYISLILNGRFIRNFPLTKAVIAGYGSKLMIGRFPIAVIKIDADPALIDVNVHPTKQEVRISDEPMIGKLIANAIYDMLRDKQLIPDATRDFKQPVQAAPRQFDVSTATQAQTNPPLFAVDTPTTPSISQPEVTPVVVKTRDDLASSQVAQFDDFLKNEPSGLPAFEGTQPKTIDNHQSSTKPEQSELVVETGFPHLDYIGQIHGTYLVAETADNMYLVDQHAAQERINYEFYRKQIGEVSDDQQKLLVPIVLDYSTSDFLMISDRLDLLDKLGIHLEPFGQNSFIVREHPMWFKAGQEEDTIKEMIDWILSDHKISVAAFREKTAIMMSCKRAIKANHHLDELQAKALLKRLPECENPYNCPHGRPVLVKFTNEDIEKMFKRIQDPHHTDQEII

SEQ ID NO: 4683 - protein, 862 aa, Lactobacillus buchneri
LAKKELTPMMVQYQKIKDQYPDAFLFYRLGDFYEMFNEDAIKGSQLLELTLTNRSRNAANPVPMCGVPHKAVQNYIDILVDQGYKVAICEQMEDPRLAKGMVKREVIQLVTPGTQVDVGSENAKSNNYLTAVVDDQKNHEFAFSYADLSTGELKVAKLTTQAEFVNELVSLQTKEIVVDTDLPESIQDTIQKLGILISHQSVLPVNASVSYLSQDVDDDLMKRVVKLLLDYIQATQKRSLQHLKRAVIYEPSDFLELDHNSQYNLELIRNIRTGKKAGTLLWLLDQTKTAMGGRKLKQWIERPLVNRKLINQRHDAVAVLLDHYFERNQLQDELIKVYDLERLAGRISFGSVNGRDLIQLKASLKQVPKIKYILEQIADKSFEAMLKNLVPLDDVVDEIDSAIVEEPPISVTDGGVIKDGYNQQLDTYRDATNNGQKWLAELEAKERKITGINNLKVGFNHVFGYYIEVTKVNLDKIPANRYQRKQTLANAERFSTPELKEKEALILEAQEQSKTLEYKLFVKIRDDIKKSIKRIQDLADAVASIDVLQSFAAVSEEYRFVRPTLTTHHVVEVKDGRHPVVEKVLGHQQYVPNDVNLGEDTSILLITGPNMSGKSTYMRQMALCVIMNQMGCFVPAKQAKLPVFDKIFTRIGAADDLISGQSTFMVEMKEANDAIENATPNSLILFDEIGRGTATYDGMALAQAIIEYVHNNIGAKTLFSTHYHELTVLDESLKRLQNVHVGATESNGELVFLHKIQPGPADKSYGIHVAKLAGLPEGLLHRANDILTNLEQQADKEHQTASAPKQAPQQAPEQQTSLFPLEQIDDKQAEVVSQLKKLDLMGKTPMQVMNQVYKWQQKINGD

SEQ ID NO: 4684 - protein, 264 aa, Lactobacillus buchneri
MRILFIGDVVGDKGVSMIGNYLPRLKQDLKPQVTIVNGENATSMGRGITLSIYKQLMSDGVDVVTLGNHAWSNNEILDFIDDTKRLIRPYNFPKRTTPGKGYTMVNVNGKQLAVLNFQGRVFMDNLDDPFELADELVEEIRKTTNCIFMDFHAEATSEKLAIARYLDGRISAVVGTHTHVQTNDARILQGKTAFLTDAGMTGPADGMLGMQPDSVIQRFLDQRPARFKVMETGRGIISGCFVDIDDKTGHATHIETVSMTDDQI

SEQ ID NO: 4685 - protein, 526 aa, Lactobacillus buchneri
MTMAGIILAIIAIIVVGFVGILSFVIGKSAQKKIHEKDLDSANGSAKNILTEAQKKAETVVKEATLSAQEKNHRYRSSVEKELKTRRAEIQKQEDRLLQREEALDRKDTAFERRESSLNRKEQKINREQQNLVTQQEEANSLIAKRQAEVEKVAALTQEEARDLILKETSEKLADEKARMVKESYYQAQTEADENAKNLIIEAIQQSSADVVSETTVSVVSLPNEDMKGRIIGREGRNIRTFETLTGIDLIIDDTPQAVVLSGFDPIRREVAKMTLEKLIKDGRIHPARIEEMVEKSRKELDERIQEIGEETLFDLGIHSMSPDMIKLVGQLNFKIDHGQNLLSHSIEVAKLAGAFAAELGEDVTLAKRAGLLHDIGKAANNGVEGSHVQVGVDFAKKYHESPVVIDAIKGYEEGHNPETIISELVAVAEKIAISRPGAHSESLESFVHRLDSLEKITDSFNEVQKSYAIQAGREIRVIAKPEDITDTQAIVLARQIKQKIETEMKYPGHIKVTVIREVRSVEYAR

SEQ ID NO: 4686 - protein, 379 aa, Lactobacillus buchneri
MADQRKVALDKALKNIEKEFGKGSIMRMGDKADTQISTIPSGSLALDDALGVGGYPRGRIVEIYGPESSGKTTVALHAVAEVQKRGGTAAYIDAENALDPVYATHLGVNIDDLLLSQPDTGEQGLQITDALVTSGAIDIVVIDSVAALVPRAEIEGEMGDAHVGLQARLMSQALRKLSGTISKTKTIAIFINQIREKVGVMFGNPETTPGGRALKFYATIRLEIRRAEQIKDGTNIIGNRVRIKVVKNKVAPPFKRAEVDIMYGKGISQSGELVDMAVEKDIINKSGSWYSYGEERIGQGRENAKTYLEEHQDMYDEVMKKVRAAYDIPDETDSDTSDDKASSDKKTDKKADKKDSKKESATGSSKETKTDSIDLDIGK

SEQ ID NO: 4687 - protein, 157 aa, Lactobacillus buchneri
MTLEETLVNELLSRHITITAAESLTAGEFQSTLGNVPGVSEVFEGGFVTYSNQVKEQLLQIPSEVIDENGVVSEPTAIWMANQARSIMNKDLGVSFTGVAGPDTLEGDPAGTVWIGIAYGTQHTYAKQFHFTGDRNQIRAAAVKAGLEMALDMIHRY

SEQ ID NO: 4688 - protein, 193 aa, Lactobacillus buchneri
MNLPNKLTLFRIILIPFFILILAVPIFSGSVVWAGTTISMTRLWATIIFVVASLTDFLDGQIARRNHLVTNFGKFADPLADKMLVMTAFLFLVGLGDVPAWVAAIIVCRELAVTGLRLIIVENEGQVIAAAWPGKIKTTTQMLAIILLFLNNVLFDAVNIPMGLILLYICLFFTIYSGIDYFVKNRSVFSDSF

SEQ ID NO: 4689 - protein, 356 aa, Lactobacillus buchneri
MSDEKDNLTIGKKLHDARVAKGYTLDDLQKNTKIQKRYLIAIEDNDFDALPGDFYVRAFVKQYADSVGLDGSELLSQFDTKLPDTEDPEYVDRVNDDNPETRSAQRKVEERNDKLRRYIPIISVSVVVLIILIAIWVAAARSTRNTAKTQIETSKVSVSGDKSSSSKASSSKKAKTTKKAKGITFKKVTASGSNLTYRVTGTSGTTPLKISVTGSGSAWTSVSADGTSLWQASLTSGNSHTISLPSSTNTVTINTGNAEATRITVGGKKLTLAAPLNGGSTQVRVVTLQFGKSSSSASTSSSSSSATTGASTTNSTTGTSGTTGTSSTTGTDTTGNTNATTGSTGTNNNTGTTNGY

SEQ ID NO: 4690 - protein, 430 aa, Lactobacillus buchneri
MELIDYPNYNEKLFVQTLSNGLTVYLQPKAGFNKTTAVLGVNYGSIDSQFMLNGEKVVQPAGIAHFLEHKMFDKKDYDVFELFNKTGARSNAFTSFTKTNYLFSTAESVKENLDILLDFVQIPYFTQAKVQREKGIIDQEINMYQNDPDNQAYFKTIASLYPNSVLANDIAGDIQTVDKITLEDVELAYRTFYRPENMSLFITGKLDPSEVMNWIEDNQRRKSTPAPISLQRRLTLPEASKETVLHTKMDVSRPKITLGLRGSDQVPTGRDGLKYEIAISVMFDLFLSENSVEYDKLYHDEIIDDTFSWEFENERGFHFAVINGDTDKPLELINRLKQIIADIPTKIGHLQTEFQLQKNELFGNYIEMMDSEEAISGQFDGFIGEPVTIYDEVEILKSLTLEDVFEAAHSFLDQATVQEVMIQNSDQPKG

SEQ ID NO: 4691 - protein, 422 aa, Lactobacillus buchneri
VKYEIAKGISLTTIPTTKFKNNKLVMNFTFPAQHQNYAKLALLAELLENCSAQYNSELLVSRQLSKMYGASFGVTVLRYGNQHTLQVSITFPNDKYLPPKSELTSEILAFLKEMIEDPFIEGDQFNQAYFQIHQGNMVHYLDSIQDNKEFFSTLELQRLYYPNDPDHGHFLMGSHQEMSQISAQELYTFYRWVLNSAKITILAGGDLVDDQLVTGFKEFTSFTDRMPEDYQLRVVPAPISKVQQGTKVIAGSQSVLSMAYELPIYFGDDDYFAAVIFNQLFGGSSRSLLFTNVREKNSLAYDIHSGYNSLVGMVTVQAGIDFKDEDRVIQMVADQLQQTSDGQYSDELLDGVKQALINQHRSEADHLGSLIEKQYLQQMMGFSLSDTKWEQQVASVTRSQIAQVAKRLTLRAIYQLNSRGDA

SEQ ID NO: 4692 - protein, 287 aa, Lactobacillus buchneri
MLKSLKRLLLITSLLLVTIGLSGCGVRYVSRQGSQENPDTWSTVSKQKRIVVGLDDSFVPMGFQTKSGKIVGYDVDLARAVFKQYGIKVDFQPIDWSMNVTELRNGTIDLIWNGFSINPQRAKKITFSEPYLINDQVLVSKKNQHINSFADMKGKVAGVQSGSAGAMDIDNQPKLLKDKIKGHEPILYDTFTDAFIDLNANRIQGLLIDSIYAGYYLEHQPNQSSFKSIPSEFPKEEYGVGMRKGDTVLKRKIDQGLNRLAKNGELHKINMKWFGTDRDSPLIKNAK

SEQ ID NO: 4693 - protein, 211 aa, Lactobacillus buchneri
MLEIKNLTKRFGSRTIIDDLSMTVKDNEIMAIVGPSGAGKTTLLRCITGLESVNTGEFYWNGTQFDPTNTTQKDTIIGVVFQDYQLFPNLTVLGNITLAPTMVKKETMADVKKYARELLSRLGLEGKENLYPYQLSGGQKQRVAIVRALAMRPKILCYDEPTSALDPALRDEVAQIILDLKKQEMTQIVVTHDMDFAKNVADEIQQVKQIQ

SEQ ID NO: 4694 - protein, 214 aa, Lactobacillus buchneri
MIQYIQEILPALLSGTKMTLSIFFWTLICSIPLGALVGLGLIQKFKPLTWLLNFYVWIMRGTPLLLQLIFVFYGLPIVHIVFQRYDAAMFAFILNYTAYFGEIFRGGFQSVPKGQFESAKVLRLSYGQTIRKIVIPQVFKIVLPSIGNEVINLVKDSSLVYVIGLGDLLRAGNVATARDVTLLPLILVGIIYLALTAVCTIVLKLIEKRENVWR

SEQ ID NO: 4695 - protein, 268 aa, Lactobacillus buchneri
MGKAYVITSGKGGVGKTTSSANIGTALAMLGKKVVLLDLDIGLRNLDVVLGLDNRIMYDIVDVAAGRAKLSQALVKDKRFDDLLYLLPAAQNTDKTALNEDQVREIVDELKPDFDFILIDCPAGIEQGFMNAIAGADSAIIVTTPEISAVRDADRVVGLLEQHPLQEQPHLIINRIRQHMMKDGSVMDVDEITHHLGVELLGIVFDDDAVITTSNNGEPVVLQAENPAGQGYRDIARRLVGESVPLMEIKDEQQPSFWQKVSHWFRKG

SEQ ID NO: 4696 - protein, 227 aa, Lactobacillus buchneri
MQDAAVLKGTKDGYEIILDENANLKDIFSSLRKLLDNLKTQTASTNPQTIAFDIYTGMRLWPAADRSELEKIFSDYSTFSVHKITSDVITKEESNRILEQSSVHIVDRVIRNGQEVHIQGDVLFLGTVHEGGKLFVGGNIFVLGNVQGIIQAGAPDLEDKMIIGDVHNAQQVRIGEQFEIVADMKREMDSGTVIYVNDLHVLDYGKVENLKQINPKFYNQIGGVING

SEQ ID NO: 4697 - protein, 174 aa, Lactobacillus buchneri
VKRKVPIAVYFVIGQFIAFFLDGSISQTMSGILFKYPNTMVPYLTVLWLILAAFFGNGKKLHLYTWSAVIGFIFDMYYTGLLGVYVFIFPLVVYLCQLVYQILPPNFMSGFLVYFLGITVLVSLGYMANVFIGETDSSVAQFLVNTLAPTLALNLVLLTIVYFPVEALYRTHRQ

SEQ ID NO: 4698 - protein, 282 aa, Lactobacillus buchneri
MQKFFSSRKLVIVVICLIVSFGLMSLSVAIRDKRSTPPLVQQFGNDIVGFADRIVAAPMNGIHHGFVSTKNLLNTYQENQRLKSKVDQLTQTQVKDQVLSRENKQLKRQLNVGSTLTGYEKINAAVITRTPSSWASQVIINKGQASGIKKDMPVIAGPGLIGTVAEVNKTNSKVVLISNTAENSNRFAIQVLGDNSKVVNGIITSYDSAANRIIMGNITSNAKLSVGNRVTTSGLGGVIPKGIYVGTVSKVTQDDYGLAKKVYIKPAANLNDIEVVSVAIRD

SEQ ID NO: 4699 - protein, 335 aa, Lactobacillus buchneri
VFGFGEKNIGIDLGTANTIVYVEGKGIVLREPSVVAKSTKTGEVIAVGAEARAMIGRTPASIQAVRPMKDGVIADYDTTVAMMKYFIQKALGHSSGKPYVMVCVPTGITAVEKRAVIDATRVAGARDAYVIEEPFAAAIGAGLPVMDPTGSMVVDIGGGTTDVATISLGGIVSSRSVRMAGDKLNEAIAQYVRQKYNLLIGERTSEQLKIDIGSASAKEAKEIKAVPVRGRDLVTGLPTTVEISGTDVNKAINESVLAIIATIKETLEETSPEIAADVIDHGIVLTGGGALLRNITDVIAEATQVPVSIASDPLDCVAIGTGESLKSINVMKKKQ

SEQ ID NO: 4700 - protein, 443 aa, Lactobacillus buchneri
MINTYDEALAFIHGRTKFKKIPTLKRMRRFLDELGAPDKHVNAIHIAGTNGKGSTLAFLRNLFQAEGKTVGSFTSPFLIKFNERISVDGVGISDDEILRLTQEIYPTIAKLDAELPEGGPTEFEIVTAMMFKYFAEGHADIVLIEVGLGGLYDSTNVIIPKVSVITSIGWDHMHILGDTLPKIAFQKAGIIKPGVPVVVGGVDPEPLKVIVNLAEQKQSPIQILGQNFKVNDRGEHNWVQQFDFSSADFQLHDLKTALIGDYQTHNAALAIQAYIDYHQLTKRSVDVRNIQKGIAATRWAGRFEKISAKPTIVLDGAHNISAVSLIVDTLQNDFPQGHIYILMGILADKQADKMVDKMATVQNASIILTQFAGPGKRLAANPEKLESQLKTQPENVSAIDDWQDAIRELRRKLAPDDMLLITGSLYFISDARKFLLNADHNFK

SEQ ID NO: 4701 - protein, 886 aa, Lactobacillus buchneri
MSDKLHEMSTKYDPTAVEKGRYDEWLDEGVFTPSGDKKAKPFSIVLPPPNVTGKLHLGHAWDTTLQDMIIRRKRMQGYDTLWLPGMDHAGIATQAKVEAKLRKQGISRYDLGREKFVEKVWEWKDDFARTIKEQWAKLGLSLDYSRERFTLDKGLSKAVRKVFVTLYNKGLIYRGEYIINWDPQARTALSDIEVIHKDDKGAFYHVKYPFTDGTTFNGKDYIEIATTRPETMMGDTAVAVNPSDERYKDIVGKKVRVPLINREVPIIADQYVDPDFGTGMVKITPAHDPNDFKVGNRHNLQRINTMNEDASMNENAGKYKGMDRFEARKAMVKDLQDEGLMLSIDPIVHSVGHSERTGVQVEARLSTQWFVKMKPLAEQAIKNQDTNDKVNFFPDRFEGTFEQWMENVHDWVISRQLWWGHQIPAWYNKQTGETYVGMEAPKDAENWEQDPDVLDTWFSSALWPFSTMGWPDETEDMKRYFPTDTLVTGYDIIFFWVSRMIFQSLEFTHERPFKDVLLHGLIRDSQGRKMSKSLGNGIDPMDVIDKYGADALRWFLSIGGTPGQDLKFSYDKMDSAWNFINKIWNASRYVIMNLDGIDKPELPDKSEWQLSDKWILSRLNATVNHVSDLFEKYNFGEADRYLYDFIWNDFCDWYIEMSKEALNSDDEKLKKNTQNILAYVLDQTLRLLQPIMPFVTEYIWQMMPHVGKSLVTADYPVDHKEFDDPTSEHQMQSLIDLITAVRNIRNEANAPLSSPIDMLIQTDNQTLKSIFESNRDYIDRFCHTQELQIGKDIEAPKLSMSAVITDATVFVPLAELVDLKDEQARVQKDVDKFEAEVARSDKKLANKRFVENAPDAVVAEEKAKQADYQSKLDAAKDRLQQISSEM

SEQ ID NO: 4702 - protein, 169 aa, Lactobacillus buchneri
MKITINGKEESMFGNPPEVGEQLPKFKLEDADGNKVKTADIIGRITLLSTVPDIDTPVCSVETRKFNQEADKFPDVQFLTVSNNTIEQQKNWCAAQGVANLQMLSDENLSLGYAMKLYLPNFGALARTIFIIDATGKIIYRQIVPEIGNEPDYDDALNALKKVAQRIDD

SEQ ID NO: 4703 - protein, 405 aa, Lactobacillus buchneri
MHYTEIMVRYGELSTKGKNKKDFIKQLGKNVRAVLHPFPKLEVKPQRDRLHVALNGEDDQQVIESLKGVFGIENFYPSVRLEKDMAIIKQTALEMVKEQYHDGATFKINTRRQDKHFEYDTNQINNQLGDYILENVPGITVDVKHPDISIRVEIRMNGAFLSSEKIHGAGGLPVGTGGRATMMLSGGIDSPVATYLAMKRGVKIDMIHFYSPPYTGEQALNKAKQLTSVLGKYSGNIQFIQVPFTEIQETIKEKVPEGYLMTIQRRMMLRIAAQITQNRHCTGVFTGEALGQVASQTLESMMAINDVTTMPVLRPLVSMDKTEIIKISKQIKTYDLSILPFEDCCTIFTPPAPKTRPDLAKSRKFEQYIDVEGLMKKAIDNIEITDIKPGEEFLNQNQDVFAELL

SEQ ID NO: 4704 - protein, 381 aa, Lactobacillus buchneri
MIYFDNSATTKVLPEVLDTYNKVSEQIWGNPSSLHNFGEQAFNLLEQSRKQIADLLNVHPDEIYFTSGGTEGDNWVIKGTAIEKREFGKHLITTSVEHAAVRNSFEQLKQLGYDVTYLPVDDEGRISIADLKAAIRPDTTLVSIMAVNNEIGTIQPIKEAGELLKNYPKIHFHVDAVQGLGKGIQDQIFNDRTDFAAFSGHKFHAPRGTGFIYGRRGRRIAPLMNGGGQEKNQRSGTENLPGIAAMAKAIRLVLEKEPSAIDTERQIKQLIMDHISQFDKVTIFSKNDDTFAPHILCFAIKGVRGETIVHAFEKQGIYISTTSACSSKDHTESGTLNAMQVPDDIATSAVRISLGDHNTLDEAKQFVKVFDQLYEEFDKLS

SEQ ID NO: 4705 - protein, 578 aa, Lactobacillus buchneri
MLTLLIGIIVLVGAGYLGFVFYQRRTIKMATDVYENKRDLNKIPLDDEFALAKKMNLTGESHKKYDQLYNKYQHYKNQMLPNIDEGIAAVKEDGKGINFLKTKSDWQSANQAIADADATLKEIQAGLAQLYDLNKQHKLALEELEKKYKRLREDILNKNESFGPSIDSLEKMLSDIEGTFDEFTQLTKSGDPNSAEEVLSDLNNSTDKLESYMGRIPKLYQLLSKEFVEQVDEITSGYKELKGKQYNFPNDKFDETLKGISDQIKVNTNKLKTLEVDSVEKATQDIADRIDKLYDAIEKEFQARPKVEKNTKIIGQYIEHVRKQNSDLQLRLETLNKSYILNHQEIENNHQFDQQIATIEKKYQDEVNAMQNGTAVYSTIDADQTHMIKELGQIESEQKDLFSATVKLPEQEQAARNALAKFDLAMRNTKRRIDNHNLPGLSNDYQDAFTAVIREINHLDDAMNQPQIDVDDISKQLTIIQSDMDTLDEKTNQLIDDATLAEQTMQYANRFIGSNSEIAAASKTAQMYFDQKYDYEQSLNIISKALEKQSSGMFAKIKDDYFNAKKHLKTEKTDEDES

SEQ ID NO: 4706 - protein, 154 aa, Lactobacillus buchneri
MQNVTNLVNQQLDSLLENETDLISNMANATALLQVSLEDINWVGFYRYVPANDELILGPFQGNVACMHIKNGDGVCGTALKQKHSLRVADVHQFAGHIACDANSNSELVVPLFKDGKALGVLDIDSPSLDRFSSEDEQVLNQFADIFVKHVDLQ

SEQ ID NO: 4707 - protein, 203 aa, Lactobacillus buchneri
MSRYTGPSWRISRRLGISLSGTGKELSRRPYAPGDHGQGRRSKLSEYGLQLHEKQKLRYMYGLTERQFSNLFVRAGKIREGKHGVNFMILLEERLDNMVYRLGLATTRRQARQLVNHGHITVDGKRVDIPSYEVQPGQVISVREKSKDLQVIKDAVEAVVGRPQYVSFDADKLEGSLVRLPQREELDADIDESLIVEYYNKLG

SEQ ID NO: 4708 - protein, 425 aa, Lactobacillus buchneri
MQQPLAYRMRPTKLEEIVGQQDLVGPGKIIDRMVRAKMLSSMILYGPPGTGKTSIASAIAGSTKYAFRVLNAATDTKKDLQVVAEEAKMSGTVVLLLDEIHRLDKTKQDFLLPLLESGSIILIGATTENPYININPAIRSRTQIFEVHPLTATDIQKALNRALNDKEKGLGNYPVSITKEALNFLATATNGDLRSSLNALELAVKSTPKNDHGKIAVTQAIVEECLQRKALNSDKNGDAHYDVISAFQKSIRGSDTDAALHYAGRLIESGDLVSIMRRLLVIAYEDVGLANPSACQRTVAAVDAARQLGLPEARIPLANAIIELCLSPKSNSAMAAIDGALSDIRSGNYGDVPLHLKDAHYQGAKKLGRGVTYKYPHDFPNDWVRQQYLPDKIKNAQYYHPKENGRIETAFKEQYAKLRKSAGHK

SEQ ID NO: 4709 - protein, 97 aa, Lactobacillus buchneri
MIINILVALAVLIALYIGYYLLSHLHKTMFNISVQDDPRLKGAAKNGGIMFIILAALGVLALIIQNDILILVVLLWMTAHGLVVEFAILNVINHKQR

SEQ ID NO: 4710 - protein, 160 aa, Lactobacillus buchneri
MLQQQYKQILVPVDGSYEAELAFKKGVAVAIRNNASLHLVHVVDTRAFQNISSFDTSMVEQVTDTAKETLDKYIEDAKKAGLNDVDYSIEYGAPKTVIARDIPQNLNIDLIMIGATGLNAVERLLIGSVTEYVTRTAVCDVLVVRTDLDNKPAVNPSKHV

SEQ ID NO: 4711 - protein, 303 aa, Lactobacillus buchneri
MTMVITGALIKKARKDKGMSQVQLAEGICTQATISSIENQNTCSSVDILVNLCQKLDLKITDVAKNTRYGDKVFSYIEDDMRNHLYADANRQIGRIDCKKLNTRYMLGKYHCYRGFIELYINDDIDEAIFNFNLQLTQYSADEFTFYQAWSNLGIGLAYQKLGKLDRAEGFIDSSAKILAKVKKAGKHDMIVIVDLYVDIIAAYAELGKYDRALPLIHEILHELTEQDLIYKVDVLAELESKCLYAKGQVVQATMKQFAAMFIAELRGNTELAEKILKRNQSHIVEMVKNELAKSEGHPTFVK

SEQ ID NO: 4712 - protein, 192 aa, Lactobacillus buchneri
MVKRCPWATTSPELLVYHDTIWGRVQKDPQKLFKALCLETMQAGLSFSTILKFESGMDEVFHHFSLDYLAKCDQSDVERFCQDRRIIRNHAKVSAIIANAKVIQPNPKMLVEATWGPVNGVSLDHLLKAAPDPKMYQKFTEKFVKAFKNMGLQRIGLITVYSYLQAVGVVNDHLITCDFHEELPAKNEEKSS

SEQ ID NO: 4713 - protein, 505 aa, Lactobacillus buchneri
MGNNETKLYDYLTGALIVLILLLRRFLDTYQSFATVVFCSLTMFLLLVGLFYYGIVQTVHKTILSRTWSLLALLGSGVYLFVLLVPLGLFGFSNFIKFSVPISGDQFTWLTVNRYPLALTAIVGYFGLLLVGIYFSHFALNLLAADGDYPIQALKQTVKLMTLKKYAQKLCLLFLMLVGICLLIVGLGWLNRLLPNSFLFFLSQGTIDVVAPFVEIVVIGRLLGIQFARLTGKGLIAGVGGCLIIFSALFAGINPAFSVRPVGHPTIIVHRGVINHNAQGNTITALKRNSHYHFPFVEMDIQETKDHHFICAHDNDVPIPGHGDQEINRLNLAEITKFHHVDMFGDYLRTANRLKQPLIIELKVTNSSDPQMGTRFAQQFASQLTVLPHRVHSVGYPFLRQIKQRIPQINVGLVTMLNFGNIGKYKVDFYTLQHLTANPFLISSVGRTGRPVYSWTDDSQLSMMRMEMLGITGQVTDQALRLQKLRVNYQKDRWILLLNSLQNYL

SEQ ID NO: 4714 - protein, 376 aa, Lactobacillus buchneri
MEKHKKQHIGLIFGGNSSEHDVSKRSAHNIYDAMDKERYDVSLFLMTKNGYFLDHEASSRVFDGEPEDEVAKQELAKLDLKNPLARIINLAEESDIDVFFPIIHGNLGEDGTIQGLLRLLHKPYVGTAILGSAMSFDKDITKKIVKLAGVPTTRYEVITPLTAEQYSYESLSDELGQTLFIKPANQGSSVGIHKVENAEEYSEGIRDAFRYDSKVLIEEAIEGPEELEISILGNDHPIASKIGAIRVPKDDAFYTYDNKFVDASQVKFDVPVDISEELAQQITEMGLTTYRALGLKGMARIDYLVSKDDKPYMSEVNTLPGFTNISLYPQLFAASGISYSELIDRLIQLAIDEFERQSKILYDFKPLPPRDQNINK

SEQ ID NO: 4715 - protein, 201 aa, Lactobacillus buchneri
VTAAFGLYMFVISTLSYENFKFLIQNGISRETFFNAQVIVNGLLILIGNTFNLVYQYAVLMPLGHARDTNIYMSSYAGYFNNPIVAFLFNFIFSGLLLIVGALSGMVIGNFLTLFSKFVQRIILIATPVIGYITVMYTASRVILDRNFQMTWVANFAKFVLGWRATGAYDPFPMIVSMLIVSVILLLITRYLFSKKQLKRE

SEQ ID NO: 4716 - protein, 161 aa, Lactobacillus buchneri
MESNYKTILVPVDGSNQSEDALAKGAQFAKNNDAHLDVLHVLSTQQYGYNYGGMVDGDVINNLVEDTTDYLNKLVDRIKKESGLDDISIHIRFGNPKTVISMEFPRDHKSDLIIIGATGMSRLQRVLEGSVSSFVDRNAKCDVMVIRTNTENKPYIPFPKD

SEQ ID NO: 4717 - protein, 169 aa, Lactobacillus buchneri
MDIQVPLTKGLLADKYSKYAAKNDMLDGEPIVSFPIQISNVPKGAQSLALTLLDWDAVPVSGFPWIHWIAANIAPDVTEIPENNSQQLRVPMIQGRNSTAGGLIGNTNQTTAWHYNGPNPPDKVHNYHLSVFALDTQLPLKDGFWLNELQDAMRGHILETAEFIVPSKP

SEQ ID NO: 4718 - protein, 204 aa, Lactobacillus buchneri
LNRHDDEPQYKKYDFNSEENRRRQRRKQYSGWWFALLILIIGIVLALSINWFVTSGNHRQGSSTNSISKTIKKSEKELSGNSKKGSLTTQVEKNRVNAFSSKLKDAQQNGLNPKERQQFQQTINEEQNQSVKSQEQNLLNGVKSDKPAKPQKAPDQFSSTHTFASVQDAKNWANATKQQWLKAGYVNYTITSNGQGYYVLRFIK

SEQ ID NO: 4719 - protein, 151 aa, Lactobacillus buchneri
MDRNEVKTFPELTTQELFQIYKLRVAVFVVEQKCYYQEVDDDDLTAYHLMFKDDQNNITAYARVIPEENATVARIGRVVVDPNHRGGGLGRELVQTALDRIPTLMPKTGKIVLAGQEYLNGFYKSFGFKNVSDVYLEDGIPHIDMEMQLQD

SEQ ID NO: 4720 - protein, 452 aa, Lactobacillus buchneri
MADKNEFHDDRAILDIHDMPKFFPWIGLSLQHMFSMFGSTVIVPLLVGLSPSIALFASGVGTLLHIMITQRKIPAYMGSSFAFITPMLALMKTTGYPGIAQGVIGVGIVYMIVAAIIWAVGSDWVDHILPPIVVGPIVMVIGLSLAGSAAQDAMMKNGKYSLLYFMIALATLFLAIIFNMLFKGFIGLIPVLLAIVCGYLISVFCGIVDLNAIASAPWFKIPAFDIPGIDYKFHIDWAAILAITPIAFVTMTEHMGHIMVLDELTGRDFFKDPGLNRTLAGDGAASLFAGLVGAPAMTSYGENIGVMAITKIHSVYVLMGAAMFAILFAFVNKLNVLIMQMPMPVIGGISFLLFGTIATAGIQVMVENKVDMGLKRNLMIASTVMVIGVGNAYLQLGKFQFTGLAFATIIGIVLNLVLPQKAASEREHEQQLADKAAEEEKQRLLHQRHLHK

SEQ ID NO: 4721 - protein, 68 aa, Lactobacillus buchneri
MEQAQPAQLKYKHASTAADFNAAKQIFLEYSKSLGFDLGFQDFNDELNELATRYNQPKGDLILAYVND

SEQ ID NO: 4722 - protein, 93 aa, Lactobacillus buchneri
GNATFAMILYPRTEINMKRLYVRDDFRKLGIGQELVARILASAERLGYQAIRLDTLKSMTGALKIYHAAGFKPIDPYRFNPLDGAEYLELDFK

SEQ ID NO: 4723 - protein, 252 aa, Lactobacillus buchneri
LILLYSILYDKNWDYLINHLSRLLVGGRTLNLYTSTFWFVNVYLLSITAVTLLISTVKSRIGQLTIVGLGLFVSTCYDKIDWLNLYSYQTMPWNLDIVLIAAFFTYVGYLFFHTNWHWIEKPLPIGLLVGASLAIIGLYLNQKFSFEFSMKSHLIQSSEPKILMLATIPLIFSFGVMGLSALTSKLSIGLLLSTIGKHTMIIMYLHGALLDIAEQAGIENVAVKVVIALVIPMLLALLKQPVVRRNSVYLQG

SEQ ID NO: 4724 - protein, 204 aa, Lactobacillus buchneri
LKLSDRQNQIVDIVKQKDPITSRQIAAELGLSMPTIRSDLRLLTAFNILEAKPKVGYTYNDSQAKPLSYHKLYAEPIANILQKPTEIREDATLTEAVNTLFIEDVGSLYVIGDRQELVGLISRKDLLRATLNNTNASLTLASTVMTRMPNIFTVTPDMSVLQTGQLLLDRKVDSLPVVDKDQPTKVVGKITKNRIFQHFITSVD

SEQ ID NO: 4725 - protein, 884 aa, Lactobacillus buchneri
MKYIYRFEEGNKDMRRLLGGKGANLAQMTSLGFPVPSGFTISTEACQAFYDNGNQLNDDTLEQIDQALDQLSTKVGKRFNSPDNPLLVSVRSGAAISMPGMMDTILNIGLNDQTVKTLAAITDNERFAYDSYRRLLAMFGNVVYEIPEDIFDQILEDIKITNHYDSDLDLTVADLHTIVGKFKELYIAEAGKEFPQDPKVQLLAAVNAVFESWNNHRAQVYRWENHIASDLGTAVNVQMMVFGNAGEDSGTGVAFTRNPATGENKLFGEYLLNAQGEDVVAGIRTPQPISTLADTMPDLYNEFVATAKKLEIHYRDMQDLEFTIEHGTLYMLQARNGKRTPTAAVKIAVDLVEEGLISRTEALLRINPDSIGAILYPEFDEEALQQSQPAASGLPASPGAASGQIYFTAESAKAAHDDLEQKVILVRQDTSPEDIEGMVISEAIVTSRGGMTSHAAVVARGMGTPATVGVNDLQVDYQNGVATIAGTELHEGDWLSVDGTNGNLYFGQIQTNDSKVNDDLSTILDWSKQEGDLGVYANADTPADFAQALKFGADGIGLTRTEHMFFKPERLLEMRRLIIAEDAEERKAPLAELLQMQQGDFYELFRLSEGRSVTIRLLDPPLHEFLPHDAKEIAQVSDQLGIDPEYLVRRVDALKEINPMLGHRGDRLAVTFPDIYEMQVRAIIGAALELHTQGLEIQPHIMIPLTGSKAEMSWVRDIVVNQVESLFNEQGTRLKYTVGTMMEIPRACLTADKVAEVSDFFSFGTNDLTQLTYGFSRDDVGSFMPEYIEKGLLKADPFQTVDVDGVGELMKMAVEKGRFTKPNLPIGVCGEVGGDPKSIEFFESINVSYVSCSPYRVPVARLAAAQAKIKMSKKQDVIANFVKS

SEQ ID NO: 4726 - protein, 189 aa, Lactobacillus buchneri
MADINKRELLGKFFGFLHGTQRFARHQERPYHLRGQNRVLVILSKEGTLIQSQLAEIMDIRPSSMTELLSKLEERGLITRTPDENDKRVTNVAITDEGKKAIEDDDSTDDMLDQIFAGLSDEELAQLNELLSKLNTSLKEKLPDHDDEPGWGHHFPHRGFGGGPHGHHGFGGPHGDPRGHGPMGFAPRD

SEQ ID NO: 4727 - protein, 462 aa, Lactobacillus buchneri
VKARHLSTFFIFFFGALGGLLFGFDTGIISGASPLIESNFNLGTEQTGFIVSSVLIGSSVGALSIGSLSDRFGRKRLLVLASILFLIGSGLSMFAQGFVSMVIARIILGFAVGSASALTPAYLAELADAPHRGSLGTMFQLMITLGILLAYVSNLGFLHHNLLGLRDWRWMLGSALIPALMLFVGSIILPESPRYLVEKGRIDEARDVLHELRAKTDEDPDKELAGIQEVANQPKGGLKELFTFARPAVIVAILLMLLQQLVGINSVIYFLPQVFIKGFGFPESNAIWISVGIGIVNFLCTILAYNIMDRFNRRTILLFGSIVMALSIGILSILNFTLKVQDAAVPTMILIGIYIFGFAVSWGPICWLMIGEIFPLNVRGVGTSIGSAANWIGNFIVSQFFLELLHMFNNNVGGPFAVFTFFAIVSIFFVIYMVPETRGKTLEQIEMDMRKNAALKSAAQNK

SEQ ID NO: 4728 - protein, 448 aa, Lactobacillus buchneri
MSEKLVTETEQNEAVEGLKRLVSKPSVNDPATVSKTTPFGQGIDDALTEVLKIAEENGFKTFKDPEGHYGYAEIGSGEKIFGIIGHMDVVPAGDPNDWDSDPFTATIKGGYIYGRGTQDDKGPSMAAMFAVKALVDRGYKFNCRIRFIFGTDEETLWRGIAVYNQKESPIDFGIAPDAEFPLIYAEKGLEQSYLVGPGMDDLSLDLENAFNAVPAKAPYNGPKLDEVKASLDKHGFKYEDHGTDGITVVGKAVHAMNAPQGTNAVLRLAIALDDVFDSPVLDFFGKKFQEDATGTNLLGDVEDEASGHLTMNISSLKIDQKETRMQVDMRIPVTVDHDELIEKLKKAAEPYDLHYEAFDYVAPLYVPTDSDLVKTLMSTYKDLTGDDTQPQISGGATFARTMNNCVAYGAMLPGTPDFMHQVNENWELKSMYKAMDIYAEAIKRLCTD

SEQ ID NO: 4729 - protein, 506 aa, Lactobacillus buchneri
MQNQQSTPKKRRFKMPSAYTILFLIIIFVAILTWIIPAGQYSTDKAGNIIAHTYKAVASNPQGIWDVFSAPIYGMVGNDTTEGAISVSLFILVIGGFLGVVNQTKALDDGIATVVSKYKGKEKVLIPLLMILFALGGSTYGMAEETIAFYPLLIPVMIGVGFDSLVAVAIVLVGSQVGCLASTVNPFATGVASQTLHISPGDGIISRAVLFVIVVAISILFVYRYAAKIEKDPSRSYVFEQREEDLKRFALNHEDQPGTKMTGRQKAVLWMFGLTFLVMIMGLIPWDQINKNWTFFTSFTKWVQDVPFLGSLVGSNLVPFGSWYFTEITTLFFLMAIVVMFVFHMKESTFIESFLAGMSDFMGVAIVVAVARGIQVVMNDGNITATVLHWGEMGLSNLGSVVFIILAYIFYIPMSFLIPSTSGLAAATMGIIGPMGKFAGVDPSLVVTAYQSASGWVNLITPTSGVVMGALTIAHVNITTWWKFMFKLMVYLFLATAIFLGVMALL

SEQ ID NO: 4730 - protein, 257 aa, Lactobacillus buchneri
MTEPIFELNDIVVTVNHGTPEQINIMDHVNLSVFPGDFITILGSNGAGKSTLFNVIGGNLPVTSGQILLNGKDITSMSVEKRTRFLSRVFQDPKMGTAPRMTVAENLLLSEKRGQRRGFAPRHLKTHMDKFKQITSVMNNGLEHRLNTATGKLSGGQRQALSFLMATIKRPDILLLDEHTAALDPQTSQELMTATNDQITRNHLTCLMITHHLDDALKYGNRLIVLDNGRITYDISGDEKDNLTKEELLSFFNDIEE

SEQ ID NO: 4731 - protein, 299 aa, Lactobacillus buchneri
MSIIVSAIGQGLTWGIVGIGLFLTFRILDFPDMTVEGTFPMGAAACVAAIYSGASPLVATLIAFVAGMLAGLVTGFLYTKGKIPVLLAGILVMTAAYSVNLRIMGRANLSLFDKPTMLKNHFLESLPPYFDSVVLGIVVVAIVTALIVYFLQTNLGQAFIATGDNPNMARSLGISTDAMQIMGLGVSNGLIGLGGALVAQNNGFADVNMGIGVIVVALASIIIGEVVFGDLTMNQRLIAVTIGSILYRFVILLVLKLGFNANDLNLISAIVLALFMMFPVLEKRFRIRHTLAKGMTKHD

SEQ ID NO: 4732 - protein, 333 aa, Lactobacillus buchneri
MKKKYLISGVVLIFVVILGVAFFQGQQKQKPQAKPTVGILQLMSHPALDAIHKGIIHGLEEEGYKPGKNIKIDFQNAQNDQSNLKTMSTKFANEDADLSIGIATPSAQALANTITHKPVILGAITDPKGAGLVKNNEKPGGNITGVSDQAPLKEQLNLIKQFMPKMKTLGIIYTSSDDSAVAQYKMFVKLCKQENVRLKAYSIANTNDLTQVAEQAVRSVDAIYVPTDNTIAGAMQTLVGAANNAKVPVFPAVDTMVKQGGVATYGIDQYQLGVATGKMSAQILKGKKKPSTTPIKFFRHGKLIINEKQANKLGIKIPANLLKEAQQKGELIK

SEQ ID NO: 4733 - protein, 389 aa, Lactobacillus buchneri
MKKIVKLVGVMLAFVVFAVVASPQPAQAAHDNYRVKTLKTYQNYSNYTEDVAFHAKAKTKASVWNNQEFDNNIKANAFYKKGYKLANHKTTTWFVEKKVRIYHKLKSATYYYVANRLGNMQGYVRTNALTPGFSPYGYQIISTKWYNKYDYFHVKDSYKAKNVYVWNYTHTKKRANLKDYPGAVFQKTHTVVMRHNGKDTKYVYLSGTLNGTTKSTRGYIAESAITGGLNPDHTGMNYVNMRYFVNNTDFNQYLQTGKNQKLAREIIKLFPNSQPDLGLSKIAAYNYDSFDNDIDGDPSPISTTGYTDIKTFPAIQKWLYTNHNASNATKIAGVKKLLNAEGYTDSKRASLSGYKLGIHIINNIVMPSGESGDLASRYGYVFILGRVDN

SEQ ID NO: 4734 - protein, 343 aa, Lactobacillus buchneri
MTKKILVTGGNGFLGLRIISQLLTKGYDVRTTLRSLDKQSLVLDTLAANNIANVNQLDFVQADLSRDEGWQEAMNGITDVMSVASPVFFGNTKDKNAAMRPAIDGITRIIGAAQNAGVERLVMTANFGGVGFSNLDKNSITDENDWTNPDQKGLSLYEKSKLLAEKEAWKLVNESDNSMALTTINPVAILGPAMNGHISGSFGILENLMNGSMKRIPNIPLNIVDVRDVADLHIRAMENPNAAGERFIATADGQITMPEMAAIIRQHYPQLENKVADKILPNWMVRVGSLFNQQAKEGQLLLDMNRNVSNQKARKLLGWQPIGSIEETILATLQSMDKFGLLK

SEQ ID NO: 4735 - protein, 157 aa, Lactobacillus buchneri
VQDIKLKRDDEMTYSIKEVAEKTGLSIYTLRYYDKQGLLPFVSRNEAGYREFTDSDLNFIHTICCLKNTDMKIKDIKKYIGYCMQGAASIDNRKRLLLKHRQEVLAKQRLLADNLKEIDYKLHVYTDPNSQAIIDREVAYVQDEKAQNHLADPFAVK

SEQ ID NO: 4736 - protein, 132 aa, Lactobacillus buchneri
MNADKLKRVKKKYKQSGHHKLQTRIFKTNDPRLRLFDFDYGVVMGLTSNTEGLSNVEMSDAIGYNSSQLGYDVYRMPDGQFLIDGVEKDQVFSQHDGCPVLLLAPPTLPEKSRIALANKIFEHRNEGPHPFY

SEQ ID NO: 4737 - protein, 1399 aa, Lactobacillus buchneri
CRISPRASSCIATEDENDNCLEASECASMKVNNYHIGLDIGTSSIGWVAIGKDGKPLRVKGKTAIGARLFQEGNPAADRRMFRTTRRRLSRRKWRLKLLEEIFDPYITPVDSTFFARLKQSNLSPKDSRKEFKGSMLFPDLTDMQYHKNYPTIYHLRHALMTQDKKFDIRMVYLAIHHIVKYRGNFLNSTPVDSFKASKVDFVDQFKKLNELYAAINPEESFKINLANSEDIGHQFLDPSIRKFDKKKQIPKIVPVMMNDKVTDRLNGKIASEIIHAILGYKAKLDVVLQCTPVDSKPWALKFDDEDIDAKLEKILPEMDENQQSIVAILQNLYSQVTLNQIVPNGMSLSESMIEKYNDHHDHLKLYKKLIDQLADPKKKAVLKKAYSQYVGDDGKVIEQAEFWSSVKKNLDNSELSKQIMDLIDAEKFMPKQRTSQNGVIPHQLHQRELDEIIEHQSKYYPWLVEINPNKHDLHLAKYKIEQLVAFRVPYYVGPMITPKDQAESAETVFSWMERKGTETGQITPWNFDEKVDRKASANRFIKRMTTKDTYLIGEDVLPDESLLYEKFKVLNELNMVRVNGKLLKVADKQAIFQDLFENYKHVSVKKLQNYIKAKTGLPSDPEISGLSDPEHFNNSLGTYNDFKKLFGSKVDEPDLQDDFEKIVEWSTVFEDKKILREKLNEITWLSDQQKDVLESSRYQGWGRLSKKLLTGIVNDQGERIIDKLWNTNKNFMQIQSDDDFAKRIHEANADQMQAVDVEDVLADAYTSPQNKKAIRQVVKVVDDIQKAMGGVAPKYISIEFTRSEDRNPRRTISRQRQLENTLKDTAKSLAKSINPELLSELDNAAKSKKGLTDRLYLYFTQLGKDIYTGEPINIDELNKYDIDHILPQAFIKDNSLDNRVLVLTAVNNGKSDNVPLRMFGAKMGHFWKQLAEAGLISKRKLKNLQTDPDTISKYAMHGFIRRQLVETSQVIKLVANILGDKYRNDDTKIIEITARMNHQMRDEFGFIKNREINDYHHAFDAYLTAFLGRYLYHRYIKLRPYFVYGDFKKFREDKVTMRNFNFLHDLTDDTQEKIADAETGEVIWDRENSIQQLKDVYHYKFMLISHEVYTLRGAMFNQTVYPASDAGKRKLIPVKADRPVNVYGGYSGSADAYMAIVRIHNKKGDKYRVVGVPMRALDRLDAAKNVSDADFDRALKDVLAPQLTKTKKSRKTGEITQVIEDFEIVLGKVMYRQLMIDGDKKFMLGSSTYQYNAKQLVLSDQSVKTLASKGRLDPLQESMDYNNVYTEILDKVNQYFSLYDMNKFRHKLNLGFSKFISFPNHNVLDGNTKVSSGKREILQEILNGLHANPTFGNLKDVGITTPFGQLQQPNGILLSDETKIRYQSPTGLFERTVSLKDL

SEQ ID NO: 4738 - protein, 329 aa, Lactobacillus buchneri
CRISPRASSCIATEDENDNCLEASECASMGWRSVVISQHAKMSYSSRNMIVQTMDGINQVPIEDIDLLLVSTTQAVITTALISELVKSQVKIIFTDNANEPVCETVGYYPNRRDVDLIKKQFCWDEKRQQFLWTRIVASKIVNQVNVLSIYGVENSDLIAELDKLEIDDITNREAVVARKYFPLLFDNKFSRRDFSPVNAALNYGYSILLSNVNREIVSNGYLTYLGIHHHSNDNQFNLGSDLMEPFRPVIDYWLANQNFKELTPDVKFGLADLLNLEMKFNGKEMLFRNIISEHVRNCLKYLSGETDEIQIEVELKNEVPNNAINGNV

SEQ ID NO: 4739 - protein, 137 aa, Lactobacillus buchneri
CRISPRASSCIATEDENDRIBNCLEASECASMRYRIMRLMVMFDLPVETSENRRNYRKFRKALINEGFLMIQFSVYVRVCVNKKSADFMEKRIAAIAPPEGLIQSLIMTEKQYNDMHFIAGKPKEDVRNSSERTIIL

SEQ ID NO: 4740 - protein, 223 aa, Lactobacillus buchneri
MKISYAGHQEIELNSKYLTVIATNNPTVYHDLVVGLGSFSDKIKVFDDNFESVEVKDAIDWQGDVGLSDGVSDKYNSGIFKQLEAVLTDDQRKSITDINNQLYTVVQQCLFMIDLPLEVTYDWDLKRLFKYCKIHFNADTMLNPYAIIESIIKIHLECGLKSAVGLTNVAHYLNQQQLIDLSKLTSSAGISTLLVEFTDMKSQELYTNCDFYYIDEDFVDWHL

SEQ ID NO: 4741 - protein, 374 aa, Lactobacillus buchneri
GDSLLIKELIPASEACYLHYDRLASEMINFFNRHIKLFFAAFVVASISFGIYSHPTADKASVQVEYTTQTHPHAFALKKNAKLYTDVHLAKSVSAKKFLKTAWYRSQAAKLICGGKSKIVYRISSSNQKYKFWVLNSAVTDITSKSYNVKLASAGNKYAGEKIGVFGDSIPAGWDGYHFYLNSSYPDWTAKYLGTNTAVENFACPSGRIVGNRYAYLGTTLVPQDLSAAIKAHRNDIKKMNVIFVHIGTNDYTNYSGSGSLKNVMRHLRYNIKMIQKLNPSAKIYGILPISRFDANGMNRDNMSDMYGYTYHDLRAAEARLYKSMGAKVVNFQQIAPNIITNSNKDVTLKDHEIHPTAQTAQKLGYALAKSIVK

SEQ ID NO: 4742 - protein, 236 aa, Lactobacillus buchneri
MNFKQVVFDKDKEIKLDIYDADSDVALPGIVVIPGGSYKTFKERDAARVALTFLTKGYQAFVVEYPVNEKKNYQDAKQSISMAFDYITDHAKDLNVDTDKLGVIGFSAGGQLAAAYSNQKDTKAKFAILGYPVLTQALDEKIGIHSEDVTKQVTKNTPPTFLFGARSDGLAPYIDHIYPYTEALFKNDVNFEVHEFATGGHGFSLANQFVGVVNRDRTDEHFAKWFPLCLEWLQSL

SEQ ID NO: 4743 - protein, 199 aa, Lactobacillus buchneri
MEFEDRMREFILSFLDTQPNHVDLKTVQKLIDYGKNNKYTAPMLLTQLNQMDDAHEKILTVTFDVDFIDGVKLFNNHATKWLTDKGKAYIQELKRAQSKAETIDFPKDDTQTESTEFDGYLSQLMSVGKSMKSQSERLTLQEFALELRHLLTDTKKLDKGALNKFKPFVDRNWNELSTPMTPILVELSRRFLIENSYDD

SEQ ID NO: 4744 - protein, 296 aa, Lactobacillus buchneri
MDLDISQDSLEVYKALASPVRIQIIQTLSSKRMSVQELSKKLKLSSTIILMHLSKLEDAGIIGFEREGHSKISYLKVDNINVHFPTTIYPAFAEYETQVPVGQFTDYSVTPSCGLAGKNDYIGKVDNPKYFMSPERIKAGMIWWTNGFVEYQFPNYLEEKDKLEMLDLSMELGSEFPFSNNVWPSDITFYINDVEIGTWTSPGDFSDIRGKYTPAWVPDNVNQYGQLKVVRITDHGSYLDGQPFTDVSIDDIDWKKPTFTVRFAIKDSAKHKGGCTIFGQGFGNYDQDIQMKLFHS

SEQ ID NO: 4745 - protein, 321 aa, Lactobacillus buchneri
LTVYTNPLIVQRADPYIYKHTDGYYYFTASVPAYNLIEIRRAKTLEGLAHAAPRTIWRKHESGPMSQLIWAPEIHYIDGKWFIYFAAAETTALDKNGMFQHRMFCIECDNADPMRSEDDWFEHGQVKTGMDSFSLDATCFEANNKLYYVWAQKDPDIKGNSNLYIAEMENPWTLKTKPVMLSKPEFDWETIGFWVNEGPAVIHRNGRFFLTYSASATDEHYAMGMLSIPDDQDLLDASNWTKSKKPVFQSDMATHQYGPGHNSFTVGEDGKTDILVYHCRDYTEIKGDPLYDPNRHTKVQPFTWNEDGTPNFGKPVPYNYD

SEQ ID NO: 4746 - protein, 423 aa, Lactobacillus buchneri
MDNSAKMPEKKEKKDFWGFPFTHFTYFFNWQIINGYLTLWLEQVAHLNGAEAGVVFSMMAGMSLLFQPAFGVISDKLLFKKNLIITIAIAAIFIGPYFQWLFIPFAHISNMFAAVITGIFLSFIFNGGVSVIEQYVQRASLANGFEYGHSRMGGSLAGMCASFLGGQLFIWKPYSIFWACTVSAIILTGLLIFSDKVHLENASAAGNTSDKIDWGQIGKIFKIKNFWYLSIFYIGASAIYDVFDQQFIIFFKTFFNTAAQGTQAYSYMTTAQIGLEFLLMFPMPWIINRIGSRNGLIAYGCILAIRIIGSALSPSLIWVIVLRLLAGLEMPLVLVSIMKYIAGAFDIGVYATVYALASNFAKQISVFIFSSVAGNLYDAIGFHQTYLILGAIVAVVTVFAAFALKKENPVQAGERDESGKPKE

SEQ ID NO: 4747 - protein, 522 aa, Lactobacillus buchneri
MPTFINGKIFTGIDQTTFVSAMTIEDGHVTWVGESSDITDPNAIDLHAKTVLPGLIDVHTHPKYIADALHGVACTPPNVNSIKDMQAALRQSPAFGKGPDTWIEGWGFDETKLAEHRTPTVDDLDEISTTQPIFVYRSDCHSSIGNSKALELAGITATTPDPVGGFIGHFDDGRPNGYMKEVAATQLLIKAKSAQSYQGDVDNMANSSRHYLQNGIVAIGEMMGRIRPYDSLKLYQDAVKAGFKPKSSIYYVYDEVASNANLKPTNDDQLRIAGIKVFMDGSISGETAYNQQPYPSGQNGVCLTDATKLKQAVTYAKQQHLQVAIHAMGDAAIQLILDVTDKMQPWLSDRPSIRIEHASILSNQMLKQINMATMNYALVTQPIFFFAEDESYRHYLSPQQFNEAYRVKSMMNTKAEFALSSDAPCTPWAEPDSPFVNIYAAVTRTAVNGDVVNPEEAIPVPDAVLAYTNWPARIGGFSENGQLTPGYAGDFVVLDRDIFSVPHEELKDIRVAETWMGGEQVY

SEQ ID NO: 4748 - protein, 394 aa, Lactobacillus buchneri
MESLESHTLNAFSKNIELTDHQKAVLKQIDAFSRQHLKEDGHAVFVLMGDAGTGKSLILNQLFTELAQVVDDAYFLVNHPELLKVYRELAGQTPHMLKKYYQRPTSFINQMHKQGKQVNLTVVDEAHLLLSKPDHYNNYYGDNQLQDIINLSRVTIVVFDPHQVLRTKSFWNNARLEKLIAPYPHDLVHLKQQFRMQAGPKLMDWLDHFIDGDVIPAIPSDVGDYDFRIFADAEKMFQTIIKKNNQYGLSRMTSTSGYPSTLDGGKHLVNEGNFHLPWDQYNFTSTPWAEQPQTIDEVGSIYTVQGFDLNYIGIIIGPPFYLTADNRLGVDPSKVTDVEIFKHRSDMSEKDYEESKVELLRNSLNVLLRRGIKGMYLHAHDPRLERYLEEMMPK

SEQ ID NO: 4749 - protein, 118 aa, Lactobacillus buchneri
MKKRTIIILAVLVVLGAIGGIWYHHNYARIFYYGQVGKLERTENSPGNNPDVHYYLIKAYNDKGQGKTLEVGSVDGKYFVKGHYIKIGYSRSKNVVDYEGIPYSQVPKAAKEKLNHSN

SEQ ID NO: 4750 - protein, 258 aa, Lactobacillus buchneri
  misc_feature (4)..(4): Xaa can be any naturally occurring amino acid
CAAXAMINTERMINALPRTEASESELFIMMNITYMNPTRYLITKSPQILKFVGFLATYIVAESVFEIAGQYIKDPLSARHLLGLALVLIAGALALIGWRYGKQLAANNPRHFGRRHPTAKRIAQLLWIFILMTAIQILWQWLIANHVLTTPSNQQAVEAAEVKMPMWNIFFGGILAPIFEELIFRGIFMNYFFNKDNRLNNLLAVIVSGSLFGFAHEMSFDLTWIMYSALGCCLSFAYMHFRDIRYSIALHMMNNLIP

SEQ ID NO: 4751 - protein, 117 aa, Lactobacillus buchneri
MNIREIEYITIPVSNLEVSLRFYHEVFDLQIVDLPNGDKGADMHKMFLDFHEEDKVDNPISFGLIAKDKMADIKAHLINYFVDIVSEPTEKTKVRRNVNSITILDPDKNRIEVNEFR

SEQ ID NO: 4752 - protein, 522 aa, Lactobacillus buchneri
LPLLSVSNLSMSFAEKDLYKDAEFTLEKGEHMGVVGQNGVGKSTLIKIITGSELPLSGDIKWQKNIKIGYLDQYADVEEDLTLIDFLRTAFADLYKTSDQLNELYNTYAKTADDKLLERAGKLQDILDSSDFYNIDTRIEQTITGLGLDNIGRDHLVGQMSGGQRSKIILAKMLLADPDVILLDEPTNYLDTAQIDWLIDYLNGFSGSALVVSHDYDFLEKITNCIINVAFGKITKYRGSFKQAMRQRAEREEFQQREYDKQQVEIEKAERFIRKNKAGSKSTMAKSREKKLAHMDKIDPPSTNIKASFNFPYEETGSHEALTVDHLSVGYNKPLLKPVTFTISMGEKFGFAGFNGVGKSTLIKSILGQLPAKGGTAKFSPSSHISYFSQELEWDNNRMTPMQIISDKFPKLNQRAIRTKLAKCGLDAANAIKPIGELSGGEQTKVKLAMMEFTPTNFLIMDEPTNHLDEETKEALKRALDRFPGNLIIVSHESSFYDGLVDKVLNVEQLSLKEKPVIREES

SEQ ID NO: 4753 - protein, 533 aa, Lactobacillus buchneri
VGTLAACSSQTKSKDNSKLVRTANLSANYSIVTLDISKAQGFDNAGNLYDSLLYMNKNHKPVPALASRYRVSNDGKTYTFTIRKNAKFSNGDPITADSFVYSWQRTLNPKTKSTHAYLFDGVKNAEKVNFGKLPLSALGVAAPNKRTFVVHLDRPIAYFTKLMTYQAFSPQDKKIVDKYGASYGQAANKAVFSGPYVIKKWAPQSNTWTFKKNPNYWDKKHVKMNTIHMNYVTDPQTSLSLYQAHKLDFTILIGDQVTHYKNSADLYHGPYSYMNYLVYNQKIKNPTLRKAFNNVDIRKAVSLTIDRSQIANNLLKGESLKPTGFVTKYLAYDPANNKDFASQQYGGEGVAYNPKLAKDYWNKGLKQIGQKKLAFNLMVANSDNVKKVSEFIKSSAEKQLPGLTINLQTVPQEVQYARGVSGDFEAYITGRGADIADPTAFLQPMMSKNSMNYGSWHNAKFDQLISQSIYTNNANPSIRWNKMLAAEKIIMQDQGATPLFQNYNLYLKRPYLHGITHNTTGSQWNYKYMYIKK

SEQ ID NO: 4754 - protein, 337 aa, Lactobacillus buchneri
LKDPTVEQAFPEYLQTTAKFSDALVYFYHPQTPIVICGVHQNVFAEVNMAYLQAHGIDLVRRGSGGGAVYVDPGNLTYVFIDTEPTVQHPHFRKYAQPVVKALQSLGVNAESDSRNDLTVDGRKFSGMSASKIGHRVSYGGTLMIDVDIEAASSVLKPSRAKLRAKGVQSVHSRVTNLREHFDAAHRTVSIDQVQQTILTQVFQTTDLAQVPTYRLTEKDWQAIVSLAHTKYGSKTWIFGAGNQHQYYRDGYFNGIGTVGIGFSIQDNHVVDSKIYGDFLQPNSNLHAITERLDGTEFNLSALTEAFARADLTTSIGPIPSKRLAEIMLDRLHDEQF

SEQ ID NO: 4755 - protein, 391 aa, Lactobacillus buchneri
MKIISVDIFQLQWFGLMPAWHPVVIRINTDAGISGFGEAGLAYGSGSLGAVGSLKDLVHRVIGQDPLRNEAIWNELYQDTFWGKGGGVVFYSAVSAIDTALWDIKGKYFHTPVYQLLGGQTRNRIRAYASQIQFGWGKHVEFLATPKDYAQAAEKAVQEGYTALKVDPFMMQADGTFGVHDQQLLTQAQIQMYYDRIAAVRQAVGENVDIILECHARLNVDSAIKFAAKVEPLSIYYMEEPNSPRNPQLTKEIRNKVSIPLASGERLVTRYGFKPFLDERSLSVIQPDVGICGGITEAKKISDMAAIDDVSVQLHVCGSPIATAAALQLEAVSPNALIHEYHEISLKQPNIDSGKYHDMPENGWFTIPDRPGIGQELSTQAMKEAITETIQ

SEQ ID NO: 4756 - protein, 647 aa, Lactobacillus buchneri
MKTSRLIYISFLTTLLFGIGGIAVKADTIDSAGSKIEKVTMQQNQTITLTDDDVSIEDGIITDVENEDLARQLLQGGHLVVPATLQGETVTGIGPDAFSTDNLSTVGNIDEAGVGIPEYRGIKAVTFEAPNQIKTIDYNAFYGNQLTSIDLPGVTTIGDESFTGNELTSVSLPNVQTVGKWAFTNNKLTRVDLPKATQLATGAFSENRLTSISLGQADIEMSARAFGDQFQIPTGPDENHLVLVSKDLLPVDVVTKDPLTWAALTKTINASFKIAGVEQINPDHVDVDVLANDTDVTVAKVKNDQNKRQMTDLPKPADTPNQFTVIMHYEAQQNDGLGENATNPEPIHRLGGYDLGAFVKVVKQPEIPVVPPVKPSQPRPTNPQTTPTPNRSSESIGAAESPTTAVSQPGAIPTPDHPLAQKNQAVYAVKTISLYKDKDMQSRDRIATYTKKPRINRPMFVVTKQVKASNGQIVYAVRDVNHHSKTAGKTGYITSDWAFVRPVYYQSNHQQLTVINPTGVNEYTHKSLTGKVKNLKQGTKLKVKGFIKYHLTTRYLLSNGHYVTGNRKLVTAEKYQQPKKVKIVKATYLYSNTNFDKHVKQLKMGTILKVNKVVYAHPYSLRVTGSQRFQVKGGYVTASPKYVHVSY

SEQ ID NO: 4757 - protein, 247 aa, Lactobacillus buchneri
MLSIIYLVLMSLLAGVLTGIVGMASLTLYPVLLSVGVAPITANATITVAQVGGGLGTVTSSLRELHGHWKQAFQIAILNTLGGVLGALILIHSTNSGFKKLVPVFIMLAGILILTPKRHGKSAFDSRIITAVSWVSTFLVGIYTGYFGAASGLLMIAVLSKIVHENYAIYNSMRNFASFMNNIVAATMFIFTIPIDWAVIIPLLLGLFTGGYIGPIIVRYIPSKVIKTAVGIFAVVLAIILGYQAYL

SEQ ID NO: 4758 - protein, 339 aa, Lactobacillus buchneri
LVWAYVTYIAIDILYLGINIPITSMLPSLTANPQERVRFSTVRQVLATTGATLISIMVLPAVSLLGQGNDKKGFLITAILVAILTAFLLLLTFKNTRERVHPRHQEKLSLKESARALKGNWPWMIISLMYFFFWIGMQTKLQVTVYFFKYNMHNADLASFMLGLQALSLVVIVFTPFLTRHFGKKGTMVIGLGLCVISQLVLGVGAKMMNVPILAGATILGYFGNGFFAGLLPVMLADTVDYGEWKNGVRAEGLVTSFSGIASNLGMGMGGVVTGFLLSMNGYVANHAQTAQALNAIEMNFVWVPFIGFGIGLILMYFYKFDKMQPQIEADLKARHEAA

SEQ ID NO: 4759 - protein, 133 aa, Lactobacillus buchneri
MKMTQTLPAGSQSLTNDEHITNKERLSYGASDFACNIANGMVGTYLMYYYTDVFGLAAGAIGTLFFIARIVDAISGPTWGIMIDRTHTRWGKSRPLLLMVLHSIRHLLHSGILVRPTRTTGQVGLGIRHLYCN

SEQ ID NO: 4760 - protein, 492 aa, Lactobacillus buchneri
MKLNNQAMLITYPDSLGNNIKDLQKVLSTYLDGVVGGVHLLPFFPSSGDRGFAPMDYTKVDEKFGNWDDVKKLSESYYLMFDFMVNHISKQSKYFKDFQANHNQSAYRDLFIHWNEFWPKGRPTQEDIDLIYKRKPKAPVQTVKFADGQTEDVWNTFGEDQIDLNVNSKVTKQFIKDTLNFLMDHGASIIRLDAFAYAIKKLGTNDFFVEPEIWDLLKEISDITNPRETTLLPEIHENYHIVRKITDHDYFSYDFALPIVTLYSLYSGKADRLAGWLKNSPMKQFTTLDTHDGIGVVDAKDILSDDELDYTKAEMYKVGANVKKVYSSTAYHNLDVYQINTTYYSALGDNDHAYLLARAIQVFAPGIPQVYYVGLLAGKNDLGLLEKTKEGRNINRHYYSLDEVAEETKRPVVKALFDLLRFRNQSSAFDLEGGIDVQQNGDNEIVVTRRSEDGQTSATLSANLQTQAFTITETNSDGETKEILTSNLSAVK

SEQ ID NO: 4761 - protein, 117 aa, Lactobacillus buchneri
MNPNHRTVNVANEQADPQSVLSFYKRLIALRLSDPILLTGKYHLIDTHDHQLYVYVRESGHQGYLIITNLSDTPASYQITSDYRNLELILTNSSAEQNPATMKLQPWSAYLYKYERK

SEQ ID NO: 4762 - protein, 427 aa, Lactobacillus buchneri
LINNQQNPTWWRNAVGYQIYPKSFYDSNNDGIGDLPGIIEKIPYIKSLGVNFVWLSPFFASPNVDNGYDVSDYEDIDPQYGTLDDTFNMIQQFHQNDIRVVFDLVINHTSDQHHWFQEAKKSVDNPYHDFYIWRKPVAEKEPNNWVSLFGGSAWTYNPATDEYYYHLFAKQQPDLNWENPKVHEAVKQIIDWWAKHGVDGFRLDAISHLKKNQSFADVQDQEAAMNNVPGIDKFLSELSADFKHDHLMTVGEAGGVPVTRAQEWVNSKTGYFDMIFQFDHVSFWEKFTVGQIDVAMLRKALTNWQNGLEGIGWNALFLENHDLPRAVSYFGNDGNLRQQSAMALAMMYFLMKGTPFIYQGQELGMSNVDFDNIDQYRDLDSKRFYQEELAKGATKDETLFKLQKKSRDNARTPMQWTSTGGFSNHQP

SEQ ID NO: 4763 - protein, 328 aa, Lactobacillus buchneri
MQPKLADVAKLAGVSVTTVSRVINERGYLSAATKEKVFSAMQQLNYQPSLAARVLQGKQFKLVGLIFASLENPLIAQVVEEIENRLFARGYKAIICNSMDNPEKEQQYLKMLMANQVDGIITGSHNEGIKEYKMSGLPIVSYDRYFQTKIPTVSSDNQAGGELAARTMIEKGSKKFMVVSGSLEKRAPNNRRLTGFEQIAKEHGCPVQMVAFPFNSTPTIRRATLREKLLADQPDGIFCTDDQTALLCIQEARRAGMRVPEDVQVIGYDGSDYVQEYHPELSTIVQPVEDIADLLVRLLFSRLQKNDDQLLDKYVLPIKLLQRDSLRK

SEQ ID NO: 4764 - protein, 503 aa, Lactobacillus buchneri
MTECVLGVDLGTSSVKVTAVSRTGEIIAQEGMDFPLQQPQPGYAEQDPEDWVSAATVSIVRLILKDKLTPDQIVGISYSGQMHGLVLLDDNNEVLRPAMLWNDTRSTQQRQEIMAKMGSRFVDITHNKPLEGFTLPKLLWVKENQPEIFQNAKTMLLPKDYLRFRMTGQLAIDYSDATGTVMFDVDKQQWSKEILDAFDIPETICPPLVRSIDETGNINEWYAEYSGLSTHTKTFGGGADNACGAVGAGIDGPTKVLSSIGTSGVILKYEPEKETNYDGVIQYEDHAIPNAYYSMGVTLAAGFSLSWFKKTFAENEDFTAVVDSAAKSTVGANGLLFAPYIVGERAPYADADIRGSFIGIDGIHQRHDFVRAVLEGIIFSFRDILDLYEAKGNQFETVISIGGGAKSPLWQQIQANIFNVKVVSLQNEQGPGLGAAMLAAVGLGWYHDIPECAKTFIQFKDVFLPEPDNVEKYRQLHQIYRKIYPSTKEITHELVDFRRDHQR

SEQ ID NO: 4765 - protein, 127 aa, Lactobacillus buchneri
MDIKLIVAIITITMALVFYTIGVFSERKSDALKLRHLLLFGLGLVFDTTGTTIMSSIANTSGAATPVLHLATGLAAIALMAFHFLWAGYVLWLGSEKSKRNFHKFSLLVWLFWLIPYVAGLVMGMSN

SEQ ID NO: 4766 - protein, 466 aa, Lactobacillus buchneri
MQKTEVTENADGTRRSLSNRNVQMIAIGGTIGTGLFLGSGTTISKTGPSILLVYLVLGIFFFLMMRAIGEMLYSDPSQHTFVSFITRYLGPTVGHFTGWTYWLGLSFCAMAEITAISTYVQFWFPNIPSWLIQIVFLGTLAAVNLIAAKVFGEAEFWFALIKIIAIVALIATGVFMMFTHSTTPLGHASVQNIFHNFSMFPHGGLSFISAFPMVFFAFQGIEFVSITIGEAETPHRIIKKAVNETLLKILIFYFGALIVIMGIIPWTHLTPASSPFVQVFKLAGFPAAAAVINFVVLTSASSSLNSFIFSAGRHFYQLATETPKDSFMNRHFAKISKNGVPAAAIGFSALCLLITPLMSLTNATASVFTIVAGSSNDMYILVYALAMMAHRKYRESSDFLPNGFKMPWYNFTSPLTIAFFAIIFVTLFFIPQDIIGAVGAIIWTVVFGGVTYLHQRSLAVAEAQND

SEQ ID NO: 4767 - protein, 148 aa, Lactobacillus buchneri
MDKLDRKILNIIQEDGRASIKSIAEKCFISAPSASVRLQNLENHGFINGYTANVNYEKLGYLIKAFVRIDVSYVEMPKFVDFISKIPNVVECNYITGDASVQLKVFYKTMTELNEFNASLKEFGYSHTNVAFTTNIGPRPLKLPEDDE

SEQ ID NO: 4768 - protein, 408 aa, Lactobacillus buchneri
MMKSKTPQWKKNMWALWFGNFATGAGASMSMPFLPLFISEMGNFPKWQLTLYAGLAFSGVFLSQAIVSPMWGNLADKTGRKPMLLRAAIGMTISATLTGLSPNVWFLIIIRFIQGTFSGYINNAYALIASEVPTEDSGKTMGTLTTGNVGGQLIGPIIGGYLSGIFGYRLPFYMFGFMMFLASLSTWFFVKEDFTPIKKGAKTGMKDAFRGIAHKRVVWAMIISSMLVMAATTSINPIISLFVKELMHSHGNVAFTSGVIAALPGIATIFAAPYLGRLGDHIGPERILLAGLIFSAVVFFPMFFVTTVVMLGVLRFLIGIANAALLPITQTVMTLEAPARSVSRIFSYNQSFQAMGAVVGPMLASGVAGILDYRYVFLMTTLLVLINIVVVVVAYKKDHVKVVDVSNS

SEQ ID NO: 4769 - protein, 691 aa, Lactobacillus buchneri
MINKLVRLVGISVLMLLAGFTVLSLGNAQVDANSVIYNGANPQMTPTIGGGTSGTGGTPAGLEHYVYVTVGNEKSNYSSNGALQDGTNGRQSVIDYQKYKDAGSPEIIEHMYLKNTNADGTKDISFQRAFRYPENIPLNQIGRPIVEEQKEDLKPDVTSNSDEAKQKVNFWANGAHMANAYVTLAPGQWVDISMPLKITNLDSINYQKGTAFQVYEGEQYWTGGTNLVVRLAEQIDPDTYSDFQKGQYLITYLDKDGYYQQAKDIQSLMPKFDLARDITFSSLNTPFGTSDSSLWTGGTYFVDGNKMVATDEKGQSLNFLDMLYSHGYAPVWRNGRLLTYESFNAYEGSNTPGNPDYFKYMRDVLGHNGIGGINWQVVKVLVADNATVNRGAKWAPLDHVTLFDPKQEKNGSASEVPVTKDNVKIASDNGRINADGTLDTSTPGVYNVTYTYEAVYSDSVRRTISKTIQVTVPGNPNGGGGQAPSSNTSDNNANPTNNNGGNNAWNPTNPTDSNGTGLPNYAAVKGAAVYATKRIYLYQHPTFKKSQRLATYPKVARTARPMFVVIGYARSSNGALRYKVRDVNHGKKMAGKIGYITANRKFVVNVYYQSLKGSHNIIVISKKGIHAYKHVNLTGKFKTYKRWTPLKVKRLVHHNLTTRYQLKNGDYVTANKKLVFQIDGHLVVVRGYQTK

SEQ ID NO: 4770 - protein, 435 aa, Lactobacillus buchneri
MILSFKKSLYLGLAAIAVVAAVELTTTDASAKSYARITSNQVMQTAPQNRNVTTNGTNALYTKAGTLRGARMIASKYTLQRYGSSKLSSQYFRAYRVATTNRGAVYYKVVSFNGVYRGWIYGGRVNGTFAGGLNPANTMANANLPLQKTGYKLTNPQKYTLWVDPKWSRYKAKQVDMSSYSANDTFTITDAAVKTREQYLYYKVIDDKNSAIVGWVYSGGVAAPNSQQATKDNSVKINYVNPAGQSVGAYTWIIQKTDLKAGANMTDGAKLGDILQNSTQLSDVATKNVPTGYKISATQSPTNQPANVTVGSEDYLVYVDPIKANFLSPVAYYLTNTGQQISPSQLVGNTYPILTDAQMTIFSSQTQGIVPAKVFDNALFADPNKLASLTGVSVKNADGTMTTPIYYFNKQATIAANTTARYGDTLKLYYTLPQR

SEQ ID NO: 4771 - protein, 274 aa, Lactobacillus buchneri
MSILTDTYELNNGIKIPKVGFGTWQIPGGQDTYDAVSTALQAGYRHIDTAKAYRNEKSVGEAILDSDVDRENVFVTSKLPAATKSYDGAIADFRSTMKALNLSYLDLYLIHAPWPWGERGSTNYDEANVEVWKAMQDIYASGEVKAIGVSNFNVHDLQNILAHADVQPMVDQIRYFVGYTEPETTQFAKDNDILVEAYSPLATGGILENLDIKKIADRYGVSVAQLAIKFVLQNDVLPLPKATHKNHIENNTQLDFTISAEDMKLLNGLTATDM

SEQ ID NO: 4772 - protein, 213 aa, Lactobacillus buchneri
MANVLILGANGQIAKLVEKQLLDETDHQLTLFLRQANRITVADPKRETVIEGDATNRQAIIKALDGIDIVYANLSGKNIEDQAKAVVGAIDRTNVQRLIWISTLGIYDEVPGAFGKWNHQQLDGGYLEPYTAAAKVVENSDLDYTIIRPAWLSNKDIVSYETTEKGEPFKGTEVSRKSIADLVVKLINHPSQAIRHSLGVNQPNTDGDKPSWY

SEQ ID NO: 4773 - protein, 237 aa, Lactobacillus buchneri
MNLKTILYATGAAMGIFTTSAVTGATANAAVTPTPQSQQASKTNTNSQTANGNKTQSNNQSKSNTDQVAKKTDQNKAATITPAKTQTTPAKTGNQTTTPAKSNSSSNQQANNSTPAKTTTPAKTTNSTATATTFDQRAPRLTGSAYKSENAGFKPTVQNKHANKNVTVKYSINTYESDGSASSKPFQIKIYKDGSLYKTINASSGTATGSFSAPKGTYTLRVYTSQSTHYTGGLSVE

SEQ ID NO: 4774 - protein, 440 aa, Lactobacillus buchneri
LKSSAEWSTRWPERISYGLSDAADNLIFQMMTTYLLFFYTDVYGLTPSAVAILFVVARVADVVESFIIGIMIDHTHSRFGKSRPFFLWYSVPYVAFAILTFVTPNFSYGGKLIWAYVTYLGLGFLYTAVNLPITSILPTMSQNTRELTLLGVIRQFFGSSVQIIVAVFTLPLVWLFGHGNQQMGFLGTIIVFGIISLFLIINTFVHVRERFSNPHIAHQPVKVVLNMLAHNQPWIIMSIVIFMYWLVTAIKNQTTIYYFKYTLGNEGLVPWANGFTLAALIGVLMIIRLTDHQSKKKTMLHGILIALTGQAIIAAGVYGKWLLVLFAGVFINSIGNGIIIGLVSIMIADTIRYGASMGIQAEGILASTDDFGVNFGLGIGGLITAGLFHVSGYVANQSQNAATLSMINWNYVWIPLVIYAGMYLVLSLYDEQRIIDAIEK

SEQ ID NO: 4775 - protein, 256 aa, Lactobacillus buchneri
MNHLIVTPTALFFAVALVAVAFFISLKEKIGLEKDLVTGVIRAVIQLTIVGYVLTYIISVNRAWLTLLMVAIIVFNAAWNARGRAKGIPHAFVISLLAIAVATGVTIGLLVLAKAIAFVPSQIVPVSGMIASNAMVAIGLAYRSLNSQFHDQRQGLLERLALGATRYQTAITVVREAIRTGMSPTIDSAKTVGIVSLPGMMSGLIFAGVDPTKAIMYQIMVTFMLMAATSIGSTISCYLAYPQFFNANMQLRTPHS

SEQ ID NO: 4776 - protein, 216 aa, Lactobacillus buchneri
MVEAIFNIQNVGLTVSQRTLLANISFKVAPGEFVTITGPSGSGKSTLLLLLATLLTPTEGQIIFSGQPQQEYETTAYRRMVSYCYQQPSLFGETVEDNLAFPFQIRQKPVNHDRMIKALADVNLPADMLTKNITELSGGEKQRVALIRNLIFTPKVLLLDEITTGLDAATKDTVHQVMANFTKQGVTIITVTHDESELAAADRLITIVDGRMEVTA

SEQ ID NO: 4777 - protein, 268 aa, Lactobacillus buchneri
MKSSSQLLSIIALTLGLVSAAVFGGNAKAAKTMTVNYVSTSGQTLRAPITYTRISNGINAFGTTYTYTTSGYPATKSGYVKTIKGYLPHKIQQNYTYASMPSSLTVKYIKESTLARKVDTQYMKQINAYRLTKGLKAFKHRSSLKAKTIVRSKELWTKLSHVRPNGQSYNASGSGYAECMAVLPTYFTPYGITTYNSGQGAILVYNSNGYVSYKKTAQTASHELLTCDAEHRDTELNNWATYSEVAFSFHADGSAKMAQLFELAGAKE

SEQ ID NO: 4778 - protein, 203 aa, Lactobacillus buchneri
VFHYSKSRLIGISDGIFAVVLTIMVLDIKTPISTAQGPMLDLIKHLVIYFVSFGIVSQYWVYHQELFSRIEHTTSLITITNIYYLCFISLTPFATSWLNDDFGHQLPTMAYSVIIILVNLTQAIMFHEVIEIGEADGIKMSAHDREEYRSAQIMLGFSLLYLLISYFAPQYFLIVVIIGIALRTTVTTSARIINFIRTRRITK

SEQ ID NO: 4779 - protein, 626 aa, Lactobacillus buchneri
MRVLGKRSFITRFQQVCMAVVAFFAVLTGLGFSTTSTASAATPSKDILRPTLAITGDDVNGKQQTIASIQSVADPTTTHALLNVDKYSNIYARYSVTNDLGYSLPVWNFVHLPWLFDHTANNPKSLVFDPSRGNPEMKSIGFASDLKEPMMESWSYSQDSRYVLQYTPSEDLTSIFYGGMTDTSSVWPIQMAANARVEMTVPLKLAPDFDFNPSRVARFRSEMQFYTDNTSVDKVVKNEITLQITRTLDVADFESDTYATLTNADKFKGINHTFDADGKEQPDKTKADAKITPTDQKGVYDVAYTYDGVTKKVKATVKDQSTIEAGDFTIAHGSNWDTQKFNGIKSLTDANGNKVKSPGNVKITNIKDAAGKDVDKVDTNAAEKTYTITYTNGGASQSVKVTIGKRASVVTPPARNTGSTSSTVKVPGRPVTDNSKASGGNTAGNTQTSTNQQPANNSQPEIQSSPGVAKKGAAVYAKKTIYLYKGVNFKKADRLVKYHKAQRVDRPMFVVTGYDRSSKGALRYKVRDVNHTKKSDGKIGYITANTKYVVNVYYQTMPKKNQLTVISKKGVHAYKNVNLTGKTKTYKNGTHLRVKKIVKYHLTTRYQLTNGDYITANKKLIIQGNH

SEQ ID NO: 4780 - protein, 1072 aa, Lactobacillus buchneri
MDSRISNSSNLKFRTKHRRIWKILTGMVTTIAVACGLGFMHASADDVTNVIQRTDEFNISKVNPLQYTYVHESLSHLGGWQGAAYAAAIPNDAKGTDPKTGNSYVSEWMPDPGLEYFIWQAAFADKYKTAESFFANFSKNDLKDLESLYSEMGPQNAGTDSNPKPSQYYMALMGMNSLEGLQYATKLKQINLDPNVSVSAVTYGTATKNGNLWDISALKNLNQLQSVMIQMFSINDISALANKPNLTNLSLNYNQIADLSPLATNKGNKGLNLKTGFNHQHILLEPVTLRGSAATAAQTSFTTPSFIIKDLESANLPVKAFDIKSEKSDYPSLYPSTSDGGNINPTTLTWTNFLPDKTNLYGSLSSHWTDPNSDFEGWIMVPYQFNQTVGNVFVNYQLLQSNGNQLQLAPTSTMAGNVGDAYNIGNNPNTAYTLNKLMGEDKRVAIGVFDGTGLYADFKANNGKANAVGQSGTYTDLPQTRTIVFASDSSTVTINYEDQDGNKLQDSTAVTGKTNTVFTLPTIPSTITKDDQVYTLKGLKEGQTVPAKFDFMDMSLTYVYEVKPTESKPVTVRYVDKDNMPHEIGPQKVLTGKRDDTFNVNSDDYKLTIPGYTFAGILGDATGKFGDNAQTIYMQYTKNPAQPKSVTIRYVDIDNMPHEIGPEKVITGKIGDNYNTTEAQYKLAIDGYTFVDIQGNATGQISEQGQTVYYRYKRDQAKNEAKPIIIRYVDADNMPHEIAPTRTVAGIIGDKYDVRDNMYKLSINGYTFKDIQGDATGTFDTTGHTVYYRYTKDKATPVTPPVNPPVTPVTPTPTPQPTPQPTPQPKSEPTSQETVTAPNEAGKIAKKGEAVYSLKKIYLYRHADFKKGERLASYAKKPRVNRPMFVVSDYAKSKNGALRYVVKDVNHHAKSDGMKGYITARYAYVRPVYYHSKHQVLTIINPTGVNEYTNRNLTGKIKNFKQGTQLKVKGFVKHNLTTRYLLSNGHYITGNRKLVFASKLVQPTKIKVKRSIYLYNNVNLNKRLKHIKAGTVLKVKKWDYSHQYSTTTFGAKRYLVSGGYVTANGHFVKVVK

SEQ ID NO: 4781 - protein, 701 aa, Lactobacillus buchneri
LDFSLKDPFKAVTQLGLPKPLNQSTMNRDQLIDAWYRLLNTRNKYGQLLIDYIAGKGYYQQFLNDSDFKIPLFFNGKAQAVFNTDKLIREVIYVESSLDSDHDGKRDLLKTNIIRPAETNEGYQAPVIFTADPYAQGMNEKWSEKFSLDNKRPLKRKQPNHLTYQDVEAQPSNVTPPKPRKINGQTTKTGETFTKFWSYSLNDYFLARGFAVVYSSGIGTKDSDGFRTTGTKAETLSATAVIEWLNGKRAAFTNRSDQIAIDAWWTSGNVGMTGRSYLGTLATAAAFTGVDGLKISIVEAGLSDYYPYYRENGLVVAPDGDDADVLAEWTFSRQRTAGDYAQIKDAWLKHLKQMTHDQEHDTGSFNQFWDARNITKYNHTKADMLLVHGLNDWNVKTGQVWNSRNKLKTRDITQKLILHQGQHEYLNNFRSFDYTDLVNLWLSNKLFGIQNRVDDVMPDVIVQDNAHAETWHDYPDWGGSESTKRTFSLASLNNINGNLSFSDQLPKQVFEHYTQHLNDWRNDLYSRQGTAMDNHCIRLLSDPLTHDLTIDGQPRISLVAQTSSIVGQISVALVDYGEAQRLTEVPQTLVSQKILQGYHWRKDDLKEFLPQTDPTDFKRITEAHINMQNRQNSYRVDDVQPRTNYELRFAFQPTFWHLLKGHQLGLVIYASDLVYTVHGNQAITYTLNLNDSTLEVPVLKS

SEQ ID NO: 4782 - protein, 97 aa, Lactobacillus buchneri
MKINQFGYVPTNHQQIINELTEIHFLNPTNLKISDPMELYRNFLLEYFSQHASLTTRLEKIHNLMATETIDAATFTKATGPGPLKRSIILASNYLDS

SEQ ID NO: 4783 - protein, 449 aa, Lactobacillus buchneri
MKKLKSRLDAFSDAVIAIILTIMVLDLTPVLRDNLNDYLFLSKQIGIYIISFAFVANMWYQHATLFNDIDDMSYRIMLYDFIFLIPLSLTPLATNMMASNTTRIPVMAYGLLLFLVSASFRLLARSVMHFEYTDKSKMRQLYRKIYGRHNQYYLIFNAVLIVLAYFFPQVVLWFYLPYPIVYMILSSRDRQQMYDASQLTTEQRQEYLKLPQNAINQFREMVQDQAATGTDGTTSNASHPQHGFSGWLDHPVATDSAGHSVNPHAPSNNPDSVEVRKERQAQWEEFAKQIRDGSKKYRDAAEQIRKEQRNTNREAVKQAARQAEQQQDQRKHDAEAAAKEAEIQREAREKASKQAAKETERQQEADKESAKQAAKDIERQAKAKRRAAHEEDKILEHQKRTQRRAERRDAKHEVKQKKLQAKAQSYEPGQNSKPTDHDADQSDQEKHEE

SEQ ID NO: 4784 - protein, 64 aa, Lactobacillus buchneri
MFPYLGLKASTNQAQIDERLKYHPEVFEFFTTDQDVTPSGLNHLKAMIEHVKAAGVDRMSCTTR

SEQ ID NO: 4785 - protein, 209 aa, Lactobacillus buchneri
MKINGQHNEVAVDRLSNPDAYHFLMQSSENLIQLAIQTNTQVLIHGAYNSPVSDILSNYPSIDSARKVVFSRLDHFKSLGGDHVMFENSISPLFDYGDPEIENLIIEHQYRLCYDTSHGFIVLHGDNSKLKASMAHLRDQVVHYHFVDSMGQFHDSLELGKGAIDWQPLKSVVNPDATDIFEINLKDQMNSQEMRASYQYLKASWQTSG

SEQ ID NO: 4786 - protein, 188 aa, Lactobacillus buchneri
VKFKNVFAFIIVSVFIVMALAAAQHSFAVRKAATPSDSQTTTQSVYWKAPSEDKAYPEWSKMSKPWIYVSVKQQKVFIHGNGKVQYIMNCSTGIPSSPTPRGTFHIQKERGYSFYNKRSHEGAHYWVSWLDHGVYLFHSVPTNAHGQYVVSEAEKLGTPASHGCVRLSIADAKWMYQTVPFGTKVVVH

SEQ ID NO: 4787 - protein, 213 aa, Lactobacillus buchneri
MTLHTILTPEWIHEAKLIAAENPRLEGFVPSEGGLHPRILLLGEAPGDKEVKIGRPFMGPSGKELDRWLASLGLTREDIYITGVVNSRPFSIGKTGRKSDRRPNQKEVKRSAAMFDWELSHFPDVLLVPMGNASLQRLLGTKAKIGDLHGQLLERPIQKYNQQTDSFELSKEKHQIFPLYHPSYSKRFKNMKPVVDADSQKLKQLLEQQSNRH

SEQ ID NO: 4788 - protein, 168 aa, Lactobacillus buchneri
MMAKPLNGVDLYHSLFGTEIHDPRVLFEMLTVNVFQPGLNWRVAASKIPVFDKVFKHFDVHEIAKFDEMDLEALEADPEMIRNPRKIRAVVQNAQATLKLQPEFKDLADYLWSFEPKDDVVRGSLQRDSHGLGAELAKDMKKRGFTFVGPTTMELLLIGSGILKHEHD

SEQ ID NO: 4789 - protein, 102 aa, Lactobacillus buchneri
MAQKIDDSKYLWQATVDDSHTRIGLNDLARGEIGEISFAAFPKNLSEVAEGDVILSFEGAKAVTEVHSPRAGKVAKINTALIDHPEYLDDSDQDKNWIVELY

SEQ ID NO: 4790 - protein, 130 aa, Lactobacillus buchneri
MPRSKYRAEEKLDFITKFQQEDLSIEKFISKYSVSVSRPTFSHWLDCYTRDGLDGLKESKKWQHYSTELKQQVVIDYLSGKGSFRSIANKYGLRSKRQVEVWVSKYNGIEKLTATPSRKPGPDNDTENHV

SEQ ID NO: 4791 - protein, 103 aa, Lactobacillus buchneri
MTRKTTFDERVKITEYALAHDRNYNETAAKFQVSYQQVRSWVLKVDQGGFPALKDHRGHHKAPSELDEVDKLKLEVRRLKAELNDKKAIEAFAKKLLALKRKP

SEQ ID NO: 4792 - protein, 251 aa, Lactobacillus buchneri
MLEEKIKVLDSENRHTFGSRQLAFNLNLDPEVTEHIGRRRVTRLMRKLGIECCVRRKRHNRMKQSEQHIKDNVLNQEFDQAKQPDQVWLSDFTQLAYGSHGEYSVKLSGVLDVYSGYLVAHHISATETKEAAIETFEKAFKVAGNPSPLVHTDRGSAYVSGDFNDFMFQHNVRRSMSRPGTPYDNSMMERYWNEFKVCWIRTHPRPTTYQELESLIESGINYFNSERRSAKRNGLTPEEYRNKAISKQVTA

SEQ ID NO: 4793 - protein, 454 aa, Lactobacillus buchneri
MSGEMLGSLYNQNGYSTARMRNIWSDQNRVKVICQVETAVAYAMAKNGKIPDKAYQEIQAKLVPENIDRVQLKIESARAGHFLAGFVTVCQSLFDDDSGQYIHYGAASEDVEDTAFVLQLKESDRVLKDYLDQLGSVLYDLCERYKSTVTAAVAHKTYASPTTLGFKLGIVLNELDYLMRKLDSLAPFTFAGSLAGADGTSSMLGDDYDQIEQDFCDRLGLSKPEMYWHTQRERFTEYCHVETMIAQALGRLGKNLLYMSQTIVGEFQETYAPGRQGSTVVPTVRNPYMVEAVVNLATVIRNEMGLMYDTMSVDGEKDTTVWRDLYVALPEMTMYLSGQLNYAINILKFGQFNAQRMRQNLSADDGTMYSGSLMMALAKHMGRENAHRLLVKLRDQADREHATLRDLFYADPTIAKYLSSDDLDTLMRPDGHLNNAISKTEQILKLYMHCGLSS

SEQ ID NO: 4794 - protein, 357 aa, Lactobacillus buchneri
LKGLRIIIFVDLSDPNSQRHLRDPGVSGSLSTFFITSPKFTDTIFHFSQPAAASVVLGVNQDAYSEVNLDYIKTHDIRLARRGAGGGAVYVDPGNLTYAFIDNDDGTNYLNFKKYATPAIHVLHKLGVDAEMTGRNDLTVDGKKFSGMSSLKIGNRFSCGGTLMIDVDLDQAAEALTPPKTKLASKGIKSVHSRVTNIRQYFLPQYRQITFDEMRRLLLQEVFQTTDLTTIPTYTMSEEDWLQVEQIAQNKFTDPDFIMGTKRDDDFFHGNHFDGLGTVEISFSVDDGIVTHARIFGDFNQANGHLKVIEDKLIGTPFKKDNLEEAFRTTNLSANIGPISAAEMADLMLNPNFQEVN

SEQ ID NO: 4795 - protein, 102 aa, Lactobacillus buchneri
MTDKADDSKYLWEEKTSERHTRIGLNDLARSEIGQVTFAEFPEKMTELSVGDPMLSFEGAKAVTEIHSPMSGKVAKVNSDLIEHPELLNEDNRDRTWIVELF

SEQ ID NO: 4796 - protein, 435 aa, Lactobacillus buchneri
LTQRAKIALIEIPGLDLNQSDLDRSVSCSQHISTTVPRGLGDPHVSVNFRATPPIMGYNAIRQSQGPVALFFEFFCNRLLQSEELIIIRYVDISSGKDYLNRPIITDSLSKFFITSPKFTEPIFYFSRPPQASVVIGLNQDVYSEVNLNFIRDQKIQLSRRFAGGGAVFVDPGNLTYVFIDNDDGSNYGDFKRYAQPVISTLKKLGVDAKMTGRNDLTVDGKKVSGMSALKIGDRFLCGGTLMADVDLAKAAKALTPPKVKLQSKGIKSVHSRVTNIRQYFDPKYKNITFEELEKRILLTVFRVTDIRDVPTYTMTDDDWKDVLKIADQAYTGDDFVMGTKPNDDYFRGRHFDGVGTVEISFSVKNDVVTHAKIYGDFNNPNGDLAAIENHITNVPFAKDSLEEAFRISNLEANIGKITPPDMADLMLKEKYDLK

SEQ ID NO: 4797 - protein, 281 aa, Lactobacillus buchneri
MRELNIGGSTVPAIGLGTWHMGDSASTRADEIKAIQDGIAAGARVIDTAEMYGNGRSERLVGEAIKDMQRDDLFIIDKVLPSNASASRMEHSLDTSLKLVGTDYFDLYLYHWRGAVPLSETIATLQQLQQKGKIKHWGVSNFDISDMEELMDLPNADQVAANEDLYNLGSRGIEYSLLPWMRQRHIPLIAYTPVAAGDARGRLTNDPVVKQIADNHSATAWQIILAWAIRDGNTLAIPQSGDPKHAVDNVKAADITLTDNELAQLDVEFPKPTSKQPLDMR

SEQ ID NO: 4798 - protein, 482 aa, Lactobacillus buchneri
MTSNQQHLNPLSIIYFIFRHSWDTLLLLIIGSGPITRWSTAIGIAPLLGFSVLVLLIILWHTVRYLCFTFEIDSDMLTINSGIFVKRHTHIPYTRIQTIQHTQWFFLVPFHLEKLQIETAGHDEHGPEAVLPLVNERVRAEIERQRTGNAEPAPAAEHLTEQLKPIPEHADYEINPHELNIFALTSLGVFPIIGAGFAVYGKIQEAIPQKLIDSLTAKLIHQSAIILGAIGLLIVIISIAGSYLTIVQKYYRFRLNSTNDQLKTEQGLFQRNSVTIPIARIQALRIKQNVIRQWCHISTVQALAASSAGDDEKSNDLMILPVVKTDRVFDTLHPFVNWAPTHFSQLDHLAKRAYWYFIRNATLISLVIVLPCLYLFKLWGLLSLPVVVIAALMGWYSAANTGWKIVNDQLILQDGHFFTRSQYVIPHKNIQSFLFVQSIWMTHTKLAHIRVNVRHGNGNQLIEIRYLPEAVGQQIFEWLKIR

SEQ ID NO: 4799 - protein, 159 aa, Lactobacillus buchneri
MNESNHLPAQIKTVWRISAIFNTLLSAGVGVAGVIIHYFFNYQWLLYAAGFFFVVAIIDFVVEMSLVPYRYSFWLYTLSDDAVELRSGFIFRKLVSIPIARVQDVTLSAGPILQSQKLQEVRITTASTSHKIDGVKPEVGEQLRKQIMKLAVEVRNNDV

SEQ ID NO: 4800 - protein, 403 aa, Lactobacillus buchneri
LSKKVRNAIIVLIFGNFLVCIGMSLIFPVMPFIKNELHLSATDMGIMNSLFAIAQLVASPIVGQISDKIGRKPILVAGLLLYMVSEILFAMTNWLWMFDISRTIGGLSAAMVVPTTNALAADLTTPRQRARVIGLLSAAFSGGLILGPGIGGILAKFDYKTPFWFAAGLGFLSMLSLWLMLPNEKEIEKIAANHQVPAQSRPPKRASWTQAKKLFAGPMGLLFLLILISSFGLVGFESIYSLYVNEVFGFTMGNIALVLTLNGLTSLTFQALLFDRLVVWLTEKRLIRYCFLLSFLGTGWIILAHSKLEVIIATLIVFTAYDLIRPAITTLLTKASATKQGLINGVNMSLTSVGNIVGPIVSGALLDASYHLPYLVVIVFLFISWIMTYWIRDHFSVDLTETN

SEQ ID NO: 4801 - protein, 257 aa, Lactobacillus buchneri
MAKQVALVTGAGQGIGEAIATRLHDDGFNVAVVDLNIDNANKVAKKLSPDGSEAIGIKADVSDRDSVIAAVNKAVNEFGDFNVIVNNAGLGPTTPIDTITPDQFKLVYGVNVGGVLWGIQAAHQAFKKLGHGGKIINATSQAGVVGNPNLALYSGTKFAVRGITQVAARDLAEEGITANAYAPGIVKTPMMFDIAHQVGKNAGKDDEWGMQTFAKDIALKRLSEPEDVAAAVSFLAGKDSNYVTGQTLIVDGGMQFQ

SEQ ID NO: 4802 - protein, 194 aa, Lactobacillus buchneri
MIRGSIDRFKSIYFKKAVEYLIVMAIVWIIVLIYAKNFMDTGSLVHHFTNGIDKTAPSKTNFLPLFFWNFAGAAVVIALGVIPLPIYWYYVLQNAYSVGLVISIVGSPFLMFVGGVLPHGIFEISAQVIAAAISARLAWYGMNKFLKRKREDIKYIELLKQTLTDTLVLVMPLLFVAAIVETYITPIFIKMIMP

SEQ ID NO: 4803 - protein, 297 aa, Lactobacillus buchneri
LDGLQSTIKLNNGVEMPRLGLGVWKTSNNDSRDAVITAIKHGYRAIDTAREYGNEPGTGEGIREGMQQAGLKREDMFVTTKLYNGEQGDYDKVSKVLDKQLSDLGLDYVDLYLIHWPVDATYLESYHALERLYKEGKVRAIGVSNFDNDRMSKLLEESEIVPAINQMEFNPTQQEKDILNFDSSHGIQLEAWSPLGAGKALKNPVIDELAKKYSRSAAQIILRWEWQRDIVTVVKSVHEKRIVENSDIFDFKLSDEDVQRINQLDENKRDLWYDDFTWHNPNGRYGNEIEKVPDIQK

SEQ ID NO: 4804 - protein, 306 aa, Lactobacillus buchneri
MENQLILDVQGLKKSFGKVQALTDVNLQLHRGEVLGFIGPNGAGKSTTIRVILGLIKESGGSATVFGEDAWKDSVKIHKNLAYVPGDVYLWPNLTGGQTIDMLLHMSGQTHTAKTDELIKEFKLDTSKKNRTYSKGNRQKIALIAAFSTDVDLYIFDEPTSGLDPLNELIFQQRVAELKDHGKSVLLSSHILSEVEKMCDTIAIIREGKVIETGSLESMQHLTRNVVAITTASPMDGLDKAKGVHQLNFKNDQHTIAEFTVDSDEIGAVMDLLTKSSIVQLKTTPPTLEDLFLRYYHSDAGQKVGE

SEQ ID NO: 4805 - protein, 535 aa, Lactobacillus buchneri
MAQYTQTLTLLKANLKRDWLKITIWLAALVGVFVAVAAKFEGIYGTSKQIAAIGSTLRSKAMVALIGSVPDGQLTTALIFASEMAVFWGLFIIIFNYSLAVSASCGQEESGLTEMVLGGHPVGRLAPLLAAALELLIANGLFALITGIGTMIADMPGSDTNGTWLSAVAIAAVGWAFGMIALIFAQLVADSHNVSMYNYAFLGIAYLIRMMADVSKPDYTWISPLGWLEKTEIYANNNWWPVLMLLALGILAFAAAVALNSNRDIDAGVIHVNPGSEKSHFLRGPATLLVWNQKSLTIFWIVGMAILGASYGSVFNSISKIFNTSPTIQKVLGQSGIRHIEQTQVLSFVGLLGIIFSLLAVIAGVMIVNHLITEERRGYLQMVMTKPQSRPYLLGVYVAFGLILAALLLFVALISAMAAGNVVMTHPIAFKYFWQTFVANLPSIALFMALMVGLIGVYPRLRTLVWAYLGLSFLITYFGNLMDLPKWTLKISPFYWTKKVPIDAINTTPLIWMLVIAAILIMVGFVGYKNRDLES

SEQ ID NO: 4806 - protein, 215 aa, Lactobacillus buchneri
MVKRLPRDPKKEHAILNAAVVQFGKDGFNASTDKIAEAAGVSKGSVFRYFDNKKKLYVAAVKQAMATLVETVDLSVWTDSDDLVTMIINATKYKTELSHQFPNEFALLTRVYAQDNLIPQKVRQEVFAIFTKWQAEVEDTVVTRVVDKMTIRKDLDKGQVKKYLTLVLGTISAEVQKELEEHPEMKRIEDMGDLIATVKNYLEMAEFGVVESRRD

SEQ ID NO: 4807 - protein, 142 aa, Lactobacillus buchneri
MKSNPNQSHQLLHASLALLCLALLTVGIWATVLLVLTTKINLALILVLGGGWVVLFCTVFGIVILWRLIQRPQQVVLAVHRLQWLLGIITVIIATTSLTFAYIWAKSGDAPGLIFIGLFLSAMPFACWVLVSVWQTTLNSPK

SEQ ID NO: 4808 - protein, 207 aa, Lactobacillus buchneri
VVITIKKSLLTLSVVAGFLGFTGVAASASTYTVKSGDTLAEIAAKHNSSVDTLVKQNKIADKNLIMVGQKLEIGKSAKKTTAKKVNKKHFKTSTSIKKGSAHAAVVTSQSGSDNSTNDATSSATTTPAAFQSQGVIYQDGKKWTYYTGAAFADGTTNHGGYDADGYLIVAAPSNVPFGTHVQTPLGEGVVHDRGTAIVGNHYDLVMP

SEQ ID NO: 4809 - protein, 216 aa, Lactobacillus buchneri
MVKQGRFARSSKMKQIKAIRKRMHQPAGRTIHPDQFQDFVLVRYGLTLKKRLTGIDKETVQRFIQELLVVTPIDQTWQLNQILRDTLRSIGNKVPYQFYRIVTNNWPEIQHFLQREIPAVPLANRILVTNPVSDSQLQEIVSAELAGNTMIEMVHENPAMEKMITDEPYTTLQTNLLSDGKIDWQKVAAVFTPVHFNPNIAEDAGTKQWLEALIKE

SEQ ID NO: 4810 - protein, 223 aa, Lactobacillus buchneri
MDLQQALECVNLVPMFQSLPEDQKTEVAKLVVQHHYPKGTIIYLAGDKVGHFMILEAGQVKLSQVAANGKEQLLKVLQPGDFDGEAALFNGDQRNMAATALVDSNVCQIEQDAFQKLLQKSPQLSVSLLATMSQQINSLQEEKTLSSTADMAGKLAKYLVETGAALDENPFKLPLKKKDIATYLGTTPETISRTFKQLTSKGLIEAKGSQVKIIDEDGLDMLV

SEQ ID NO: 4811 - protein, 536 aa, Lactobacillus buchneri
MDESRVRNEIVSGNISLGIELGSTRIKAVLVSDDFQTIASGDYLWENELDNGIWTYPLEKVWDGIQTSYANLALEVHDKFGVDIKKIGSIGVSAMMHGYMAFDKNDEILVPFRTWRNNITGDAAEALTKLFNFNIPERWSIAHLYQAILNDEKHVKDVDFITTLAGYVTWKLSGEKVIGVGDASGIFPIDESTVNYNKEMADKFSSLPDVKKYPWNLLDILPTVLPAGKKAGELTDEGAKLLDQSGTLQGGSLIAPPEGDAGTGMVATNSVKKRTGNISAGTSAFSMVVLDSPMKAVHRDIDMVTTPDGAPVAMVHTNNSSSDINAWVGLFGEFAKALGLQLKPDDLYGTLFAESVKGDQDAGGLVNFAYLSGENITRMPEGRPLFVRKPDSKLNLANFIKEQIYSAFAPLKIGMDILLREEHIKTNVLVAQGGIFKTPVVAQQVLADALNTPIAVMENAGEGGPWGMAVLALFCVNRKNGEALEDYLANRVFKDSTTATLYPEEASVQGYDKFIDNYKAALPVEAEAVKSMKMKN

SEQ ID NO: 4812 - protein, 242 aa, Lactobacillus buchneri
MLEDLKKEVYDANMRLPQLGLVTFTWGNVSAIDRDKGLFVIKPSGVEYDKMKPSDMVVVDLDGKVVEGDMNPSSDTPTHTYLYNHFPNIGGIVHTHSPWAVSFAAAKMDIPAVSTTHADTFYGDIPCAPALTKKQIEEAYELNTGKVIVDEFERRGVDPDAVPAVLVSQHGPFAWGPTADKAVYNAKVLEVSAEISYHALQLTRDETHVPQYLLDKHYYRKHGKNAYYGQNNAKSKSHAEHE

SEQ ID NO: 4813 - protein, 244 aa, Lactobacillus buchneri
LAENPLITISIPAYNLGSYLSKTLDSILNQTYQNFEVILVDDASTDHTPDTMAKYADKDQRIHTHYFQSHEGVSKARNYAIDNAKGDIIVFVDGDDLLEPQYLEVMARGLADPSVDLVAVGYNWGWRGGSGTGNQFREVSKTNAYASINRRGGDFGGYTWNKGFKMSIIRDHQIQFDESLDLAEDLLFTADYIFVSHRFLFYPGALYTKVSRSNSIIHSATWEMRSKEQVVRRHIDEMARKMQP

SEQ ID NO: 4814 - protein, 434 aa, Lactobacillus buchneri
LPSFTKSRQQKLNKLILFMMTLVSILTMSAISVSAKSANQQKFQAKEAYVMDAETGQVLYQKNGNTKRPIASLSKLMTLYLTKKAIDNHQITWNQKVPVDDQLRRMSKSYEVGGFRIKRSKEYTVRDLYKAALIASSNPSAIALGKLVGGGNNTEFIKMMNEQAHAWGIDATFVSSSGLDNTDLSKYHYQVPHTTSKAQNMVSAKAISTVAAKVLAIFPTITQWSKQPSMKVGTQVLVNSNRLLPGSAFYHKSTHVDGLKTGFTVNAGLCITVTYWHDGRHLIATIIDSNTLYTSMNKLISTVNQQYQPTKVALKSHAFSIDGHQLTATPKDPEAVIWQRKGTDGSHVTNYSATKTALPITKGQPIGNAIVKLADNSSTAVVPMLAATSIKQPAKKVKHATHKPSLLKRIFGFVGSIFGGIYRLFVDFVKFMTP

SEQ ID NO: 4815 - protein, 286 aa, Lactobacillus buchneri
VKNYQIVQISDTHLTPQNAQPANNQQIDPMLKLMQVFHDIEATQVHPDMIVISGDLIHEGKAVDYRQFKTLVDREQVRFGVPIQVLLGNHDRTSAFYTGYLDKPVQPRYYYSLSDNGWDFYFLDTKCGDLEPGYLDEQQLRWLKEKLGESNRPALIFMHHPLLGAPLENMKYSILQNGDQLQSILKGSQVKAIFTGHVHFANMFIKNGILNVSADSTAYHINCSNPKRHLISEGTGYNVITLSDQQTSVEQRPLLLGNTTIKAFNIPSTDFVDPQIVAQEMKRVFR

SEQ ID NO: 4816 - protein, 220 aa, Lactobacillus buchneri
MDKQPVEPIGPYERLLSGSLLVMAAGVLDSYTYLQDGGVFAGLQTGNLILTGLRIGRGDYASIGQALVSLVMFAVGVAIIRVIQYHYPSERAVTRKRVTLVFEILILIVVSLIAGRVSILVTTGLLALAAASQLQEFRRMKNAPFTPLMMTGNVRTLSESVLDFVAQGDMKALKKAGDIVTIIGSFFIGALLNGYLIQFFHGQTILIAAVILLATILFAK

SEQ ID NO: 4817 - protein, 177 aa, Lactobacillus buchneri
MFIDQVNDHISLKLPAATDANGILDLINSNRMQLAEWLPWAKGMVAVSDEQKFLQYGIEKMARGDFWFTIILVDNEPAGMIDLHEFSHENQRAQIGYWLADQYQGMGVMTLCLAHVEQIAFTELGLNRLELIADVKNNKSRAVATRRGFHEDGILKEYLLYNGQFHDVAMYSKLKSE

SEQ ID NO: 4818 - protein, 381 aa, Lactobacillus buchneri
LNERHTLELPDALKAQLGVKSGEQVEVRIGADELKISTPRPVEVKKRRWGMMILTFVMSCVFLGYFMVRKIYQVSLVGSESVATMVLLLTTLSGLMSFMVVFVRLKRQSGSAVEAVSWRNLPTVALAFALISFMLMAGLFWIAGRLFKGASFDLVTSTALFALMTSVEIQAINSLVPQLSSRLLTNIFIAVIVSGVILAMISNQNLYWWKHNLSFLGTNKAVDSWEFNLALFFSGLILLALVDYLFASLKRIFPKSRQLLVLRILLTLLAIDLGMVGAFPNNLEIHSLHTRLAGYLIFLILGLIFGIRWLLPDISTDFQHISWMIAAALLAGEILFQVVGYLSLTAFEIMAFLLAFSWLVMLFERLNDYLEPIQNQRYVIK

SEQ ID NO: 4819 - protein, 210 aa, Lactobacillus buchneri
MFQMKANKANQAPMARYMRNQFHFLGLKTPQRKAASKAFIQASKTVPVAKMMEEIAELYDRDEREYQYVAIDVADANVKRLSFKDVKTLTKYIQVKSWWDTVDTWRKVFGDFVVLHPDEKRAVFDLFYQHDNFWMRRVAILLQLLEKDTLDTELLAKAIEYDIDTDEFFIQKAIGWALRNYSKFNPAWVRRFVAEHHLSKLAVREGTKYL

SEQ ID NO: 4820 - protein, 62 aa, Lactobacillus buchneri
MDENLKITLIGLLTLVFGTIFASILASIGFTNMILGLSSFLVAAIIVVTGFRFTDHHLASKH

SEQ ID NO: 4821 - protein, 504 aa, Lactobacillus buchneri
MGTIQIKNLSFRYDGMLTNLFDQLNLNIDESWKLGLIGRNGRGKTTFLKLLLGKYTYQGELNSSVDFNYFPQRIPDPTQLTKHVLLKIAGLDDSELWRIQVEMDKLQLTDSVLGRPFETLSPGERTKALLAVMFTDNQTFQLIDEPTNHLDIEGREVVADYLKHKRGFIVVSHDRHFIDQVIDHVLSIDRAKIQLFAGNYETWAAEYQRENQSELAEKHHLQKEIGRLKATANTMERWAGHAEGQKQKSRQSDQHANIDKGFVSHKAAKVMKRSKNTLRRTEKDIEVKQSLLKNVDEVAPLKLNSIQPPQKYLLQVEDLQVQRAGTILNQPLSFDLKRGQRLILFGPNGMGKTTIVKVIMGDKELLAGGTVNKPASLRISYLSQNFEDLNGSIQSYADQFGIELNDLLNTLRKLGFERAAFDEDLKDLSMGQKRKVSLARSLCEPASLYIWDEPLNYLDVITRKQIQDLILRKQPSMLIIDHDEAFIEAVKTAPLLKITPIDSQ

SEQ ID NO: 4822 - protein, 245 aa, Lactobacillus buchneri
MPKHSLKKHSVNRSLLLSLGAIIVVGLLMVTVGKVSQGNNSHSTATRSAKQIKKAKIAKLNAKIHLTKREKKIASHYKLTKLETRTASKTYITAIGDSVMIDVKPDVKRVFHHSAVSGSVGRQFYSLPGIVRHLKATGHLSKYIVINLGINGPPTQHDINSVLKTLGKKRQVFWINTRVPRHWQNTTNRMIAKTAKKHSNVHLVNWYQASRGHKGWYASDRVHLDLTGEKYYTRTLAKRVSEILN

SEQ ID NO: 4823 - protein, 182 aa, Lactobacillus buchneri
MTIYMFHGYTSNANDHWFPWLENRVETELHRPFKKLNFPDSDHPVEQAWDQYCDANIDPEDGMTLVGHSLGCIQVLHYLDQHDIHNVNVLLVSGFDEPIWTLPELDSFTEHPVDYTGILPKIRKVAVISAINDDSVPYPYTLTLARHLHAKFVLMPSGHHFTDTGKDKQLPIVFEELKQLIK

SEQ ID NO: 4824 - protein, 219 aa, Lactobacillus buchneri
MAKITDTMREQSEPLWEASFNHPFIKQLSGGSLPQQTFRYYLKQDRYYLQNFAALHGKIADQMDDPDIKEFLYAGAKGFNDSEKEVRTEFFQELNITQKEIDQTEIAPNAYSYVTHMYHELNEGTPSRAAAALLPCYWLYNEIGQRLIKAGSPIKIYQQFIETYDSPAFTTATDKMKTIVDQLGEAADAEEQEQMQTAFLRSSYFELHFWEMAYKHEQW

SEQ ID NO: 4825 - protein, 276 aa, Lactobacillus buchneri
MSQHKKYPRKSRGKRRNTGLKTIFALAIILVGMWLGVDQQPSNLASMVNNLTSSLFHSNKSVESDQLAKLDYHSGDPSCIFVNHNKAQLDPNSWKTNKVIYSDLDNFNRTSTGNLAYLEPRNVVSDDNRVRQYVEPTAWHQKFLDGQPIINRGHLIAYSISGGISSSGQYNPTDTSGDQNNPKNLFTQTSFSNQRVQTIFESKIRESLRRGNKVIFFAKPIFRGNELMARGIHLEAISTDRTLNFNVYLFNVQPGIQFDYATGRSRVDRTMKVPEP

SEQ ID NO: 4826 - protein, 317 aa, Lactobacillus buchneri
MKTVKIGNTNFEASAVALGIMRMAGMETADAAKTLEAAVDAGINFIDSADIYGDGQSETKFKEALKASGISRDKLFIQSKGGIILDPARSHDGLVFGQRYDFSKQHLIDSVDGILQRMGIDYLDSFLLHRPDPLMEADDIADAFDTLQREGKVRHFGVSNFNPQQVEMVQSWISQRLLINQLQFNVVHSGMVKEGMHVNMIDDASIMRDGGIMEYSRRKNMTIQAWSPFNYGLFAGMYINDPKFKKLNDKLEELGKKYGVSKNAIATAWILRHPAKVQVLLGTMNPEHIKDSAAGADVELTKQEWYDLFFAAGNDLP

SEQ ID NO: 4827 - protein, 203 aa, Lactobacillus buchneri
LSENTITELINQYGYLGIAFLIAIENIFPPIPSELVLVFTGYLTVTSKMTIWGSILAATAGALIGAIALYGVGRLLSVQQIEKLVSGRFGKIMRLKPADIEKAARYFNNHGGKAILLGRCIPVVRSLISIPAGMTGYPFNRFCLLTTTGTLIWNTILILIGHFAGRAWDQILGMIDQWLMIILVVIVVIVGCYLYYRFSRKAD

SEQ ID NO: 4828 - protein, 938 aa, Lactobacillus buchneri
MKWYSHEAETILQELDTSRIHGLSEAQAQQRLAEFGPNELAKEEREPAWKMLLKSFKEPLIIILLIAIGLALASAAYDFFVSGDSGHAMASVYEAIAIVLIVIINSGLTFHQTRTAQKSLDALSDMRQHYMKILRDNNWTSVAANHLVPGDIVSVKSGDFIEGDLRWLKTSELQINESHLTGESDAIQKNTVSLPEDTELADRTNMGYSGSMVVNGNGIGVVVATGMATELGKISGLMQQVDDQKTPIEKSVHGLSKKLMIIAAVIIAVTIGYDLVKQLIQVGSISMDSFGGISATAIAIAVASIPDAMPVVLSTVLTIGAKMMASQKGLVKSLSSVETLGSTTYIASDKTGTLTKNEMAVTRFLANGQVYNVEGNGYTPIGDFIRDDGTPSDSKDYQRFLEVAVLNNEAEIKPDTKQNWRPFGNPTDVSLVVLGAKDNVKRDVLLEDKGDRDIDIVRILPFDSTRKMMTVVIKENGRYYSLTKGAPDVIKPLTKSALIDGQPVPIASVAANIEKTMLAFAKDALRTISITQREICKEDALNASSAELERELTFLGLVGIIDPPREEVKASVRKLTQASVNVVMITGDHAMTAKAIAKQLGIIDSDDARVITGRDLEEMDDQQLADVVLDTRVYARVTPEHKQRIIKQLQAHEQVVGMTGDGINDAPALKAADIGIAMGINGTEVTKDAADLILLDDKFTTIEKSVESGRTIFANILNFMRHELTTNVAEVLSLLLGVFLITSSIGNITEVTPTLTALMVLWVNMISDSLPSFALGYDEAESDVMQQRPRDTKQSILANGMLRRVLFRGGVMGAMVFLAFIWAASQGYTVAQSQTIAFLTLVFGQLWHVYDARSVNTLFDRNPFSNSRLTLAVGFAATSSILVTLMPFFNNVMGTAPLTMTMYVLIILISAVPTFVISGIKKFMGRNRTESVAVTQAN

SEQ ID NO: 4829 - protein, 155 aa, Lactobacillus buchneri
MEPHFNKITKFGYEQIESEIRELENSRPAKIKSLADARALGDLSENAEYSAAKRDLRHLESRLRFLRKQLQYAQVYTPSNNDTVEVGKTVKFEFLDDHSTETYEIVGTPEVDIDHGKISIASPIGSALLNHHSGDIVTVSAPQVTYKIKIISISI

SEQ ID NO: 4830 - protein, 116 aa, Lactobacillus buchneri
MRLKKIIIALMTALTFYGTMNVAASTEIAEAKTTKVYKSNLSKANQKAKNWIAYHESRGSYHARNGRYIGRYQLSASYLHGNYSKNNQEKVADHYVSQRYGSWVNAKKHWKAYGWY

SEQ ID NO: 4831 - protein, 32 aa, Lactobacillus buchneri
MVHYSGYNFEGSSNSINKQKERPNNEQVLFIV

SEQ ID NO: 4832 - protein, 434 aa, Lactobacillus buchneri
MENVSVPGKKSPVRNAILGFQHLLAMYSGDILVPLLIGGALGFNAAQMTYLVSMDIFMCGVATLLQIRRTQITGIGLPVVLGCAVEYVAPLQSIGKNFGLGYMYGGIIVAGLFIILIAKPFAHMRKYFPLVVTGSLITLIGFTLMPVAFQNIGGGDATAKAFGNPTHLFLGFFTALVIIVLNIWAKGFLKQISILIGILVGSIVAILMGTVDFAAVGQAHWAQLPQFFYFGVPKFEWSSIATLILAAFTCMIESTGVYFALSDITGRKLEDRDLEHGYRSEGIAAILGGVFNTFPYSTFSQNVGIVQLSGIKKLTPIYYSAFMLMILGLIPKFGAIATLIPASVLGGAMLVMFGMVGAQGIKMLSQVKLNNKNLLIIAVSIGLGLGVTTQPNLFQYLPATVQVIMSNGMVVGSFTAVILNILLNHTALSKKVEE

SEQ ID NO: 4833 - protein, 310 aa, Lactobacillus buchneri
MNSKLLSFLEEIKAQGNMSKAAQALFVTQPYISRVIKNAEVNFGVKLIDRSSHPIQLTYAGERLLAFLQEENRLRANLDREMTHLSQFKYGHLTIASNEVVTNDLYKPVLVRFYNKYPNIHAQITRMTSRDAEKRLLSGTLDFFIGHALQSHKVEYKPIAQLPLVLIIPETSKLYDPDKVFLNYEDLDLTKLSGEEFIGTPQEDNYQRLVTSFLNDIGVSAEISVEVPDLHLASDLALEHVGAIITPEPFANPRRLTDEQKKHINVIEIPTDVLTANFGISFIKNKQTSEPVTDLLNIISEYVEEYVPKR

SEQ ID NO: 4834 - protein, 771 aa, Lactobacillus buchneri
LRIEQSPEFQIHLQTLRSKEELFLETIYNVGNGHFGVRDSNPLQGNNHDYIGSPGLFINGFFDYEEVAYGEKYRGYPDNNQVINRLFDPRFIRIKVGNEDSLTDHFKVENIDKNLDMQTGLLHELFSVTTPGNRNFNLVVESFASLSKLNVYGVRYSVIPTNFSDEIEVIKVHDYVNQTVHQQDEDVRVSTDLGQMQLDFIPDNGQPSYLVTTFRSQQGAIITYQASENFAPNPPIEYFRDDNHHYGYRSKYYAKPGSAKDFEFLFAIGDIHPLVNANMYSDQYLSSLNNYINDTTFKSELMASAQVWQTFWLHSDVEIDGDPALQLCVRFNLFELNQSAGRDALTSIPAKGLTGNGYGGHFFWDTEIFMLPFFTYTQPEVAKDLLMFRYHTLQIAKEQASDFGLGKGAMYPWRTINGYESSAYWLAGQAQFHINADIAFAVEQYYEITSDDDFIRDYGFEIILETARFWMEYGNYAELDGKRQFVLNRVTGPDEYSALVDNNYYTNVLAQSNLRLAVKYVRKFKGDDGILSRLHVTDDEIDAMEKAANAMYLPYDKEKNVKLQFQNFEQLPKMDISAIDQSMFPLLLHYHPLMLYRHQVNKQADTIMVDFMFPEGNTLDQLKADYEFYEPITTHDSSLSKAIYAIIAARIGKDQQAYNFFSQAVQTDLMDVHHNTKNGIHAGSLGAAWEGIMYGFAGIVNNATSFSLEPHLPSTWNCLKFKVHLYGNEFKFTIYQDSVEVELLSGEGTDITVYSHRKHLTPDNNRETWQY

SEQ ID NO: 4835 - protein, 162 aa, Lactobacillus buchneri
MKKEARQSKIEQIINQYTITTQDELMEKLKVAGISVTQATLSRDIREMQIVKQPDSSGNSRYMIFKSGNQNEIERMYRMINGTVTDIRQIQFVNVIHTQPSYANPLAAVIDDLHMENVSGTLAGYDTIVTFSPSVDSAREINDLFTKHANPDLLVSSIQDGE

SEQ ID NO: 4836 - protein, 1033 aa, Lactobacillus buchneri
MEPRIDTRRKSFQFRTYLIYSIAFLLVCLATYTIPWLAGKTLIWNVDGIAQHFPIMAQFQRMLQGTAHQAMSGWSWNLGAGADQLTTFAFYIIGDPFSYLIALFPAAKLELGFQVLILLRLYCVGLSFLAWANERDFSTHSKLIGTLIYTFSGYNFYVSMHHPFFLIPMILFPLLAMGIEKVLHKQNWLPLAVAVALALISNFYFAYMLAIGTFVYLLTRYFNIRHNHPEQLKNGRIIYGLVQGVVTGLLTAGVILIPTLLAVFQSTRIAYHAKFANGLILYPLKYYLAMPNQLITSTTTKDYWLVLNFCGLTFLGAVYVLRHFKRYRSLATIITLTIIALMLPQFSAVANAMSTPSNRWLFLIVLPMSLATMILVDQLKNLTQNDLRWLIGASAGLIVLVWITKGFTLKLPQNDLVSYGLLLSFLLLFACQTSLKISPKHVGTILVGLVFINVISAGQGWFSPNNSKNINSNLASGSAEQWLHKYYDGAQNGLAKNGGFYRTTTIHNYYPHRTAGNNIPMVLGTHDLGAYYSIQNGSLFQFSRSLDNSQAVVNSVLGEADGRTTLLNLLGVKYMFAKTDIVKKPQAIPYGFHYVRGKNGKIVDFPEQPVSGLSNHSGTILLKSNLALPLVYTQKYVISAANYRNMSPLQREQAMLSGAVVEKPVDGVSMTEPQNNIQNVPYTTRLFDEHIANNPVKAVLDRLRISPNARYRDTAKKYKTTLPANKVRIWEKATGINPNAKPLQSVLAKNHRIVAENQAANANGLHLMDNDAQGRHLSYQLNINQPEKYRHSELYLVIDGISHTTHSTADRLNSLTADSIIDGTPVSKLQKIDRIRTALQHPDLGAYTLSVQAPNNFTYVRQLPENNLSDYEDRQHIVLNLGYANKLQKSMTIHFNGVKQLKFKSVKLMAVPFNRQYNTRIQQLQKAGLTSQKVTNNSVSGYTDATERTRVLTTSIPYSTGWHLKIDGQAGDIFKVNHGFVGARIPVGRHFVSLKYQTPGLALGKLVTAVGIIWWLAFLIGAIGRRIYRQFAK

SEQ ID NO: 4837 - protein, 410 aa, Lactobacillus buchneri
MTSPIHVTSEIGKLKTVLLKRPGREIENFTPDMMPRLLFDDIPYLPIAQKEHDYFADTLRDNGVEVLYLEKLAAEALDAAGDKVRNDFLEQMLTESGYATGTIHDALKEYLGSMNNQDMVNKIMEGIRKNEVDFVPTDLVSAAETENYEFYMDPMPNLYFTRDPSACIGEGLSINHMTFPARQRESLFNEIVIKYHPRFADKGVHVWRDRNHDTRIEGGDELVLNDHVMAIGVSQRTSADAIQDIAKSLFKEGHFDTVIAIKIPHNHAMMHLDTVFTMINYDQFTVHPGILGEGGHIDTWTITPGKNGDLNLDHRTDLKQVLKDALKLDDLDLIPTGNGDPIIAGREQWNDGSNTLAIAPGVVVTYNRNYVSNDLLRKHGLKVLEVISSELSRGRGGPRCMSCPIVREDI

SEQ ID NO: 4838 - protein, 343 aa, Lactobacillus buchneri
MTKDFKQNVFQGRSVLAEKDFTAAELEYLIDFGLHLKALKKAGVPHHYLEGKNIALLFEKSSTRTRSAFTTAAIDLGAHPEYLGSGDIQLGKKESTSDTAKVLGSMFDGIEFRGFKQSDAEILARDSGVPVWNGLTDEWHPTQMLADFMTVKENFGKLQGLTLTFMGDGRNNVANSLLVTGAILGVNIHIVSPKELFPTDEIQSIAKGFAEKSGAKLLITDDLDEGMKGSNIVYTDVWVSMGESNWEERVKLLTPYQVNMEALKKTGTPDDQLIFMHCLPAFHNTETEYGKDIEKKYGITEMEVTDEVFTSKYARQFEEAENRMHSIKAMMAATLGNLFIPRV

SEQ ID NO: 4839 - protein, 313 aa, Lactobacillus buchneri
MGRKIVVALGGNAILSKDASAAAQQQALRDTAEHLVKFIENGDQLIISHGNGPQVGNLLLQQAGGSTSDNPEMPLDSCVAMTQGSIGYWMQNAMDQVIKEKGLDKTVATVVTQVEVSADDPAFANPTKPIGPFMSEEDADLAKKQNPDFSFVEDAGRGYRRVVPSPKPIGVVETKAVNALVDAGIVPISVGGGGVPVVSDGSRLAGKEAVIDKDFASEKLAELVGADALIILTAVPNIFVNFNKPDQKKLEHVSVADLHQYIGEKQFAPGSMLPKVQAAIDFVEATGNEAVVTALDNIEGFINDGSGTIISAK

SEQ ID NO: 4840 - protein, 233 aa, Lactobacillus buchneri
MILKNKSDYEYYAKKLRRHPEFSPLSDKYINQLIDEMTVKTYHRGQILFDQGDTRDRFYYLIDGVCKSFHWDKDGGEQLYLYIRPEKAFPYIGLFEDDRYAYTVQTMSEVKLAEFPMPIYEEILRENPELMVNAVKEMSQIINTSETQLQRMVTTSAKCRVWNAILFIGQQIGDYQEDETILVPYPITLVELSKVSGTTRETTSQMVQQLVAENKVQYNRKYFKILEIDDDSY

SEQ ID NO: 4841 - protein, 475 aa, Lactobacillus buchneri
MKEHDGKLGLLELIGLVVGSIIGGGVFNLMHDMAVGAGAGAIIIGWVITAIGMVMLALTFQNLTMKRPDLDAGVYSYAEAGFGKYMGFNSAWGYWLSAWLGNVGYATLLMSAVAYFLPVFGDGQNIWSIIAASFILWACHFMILRGVESASFVNTIITIAKLIPIFLFIIIVLFAFKMNMFTSDFWFTPSGKFEFGSVMAQAKSTMLVTVWVFIGIEGAVVFSGRARKRSDVGKATVLGIITVILIYMLITLLSFGVMSRAGLAHLTQPAMAELLQSLVGKWGAMVVNGGLIISVVGAWLSWTMFAGQLPYEAAKEGSFPKMFAKENKNGAPITSLTVTNICVEIFMFSYLITASAYNFFYSIASAAILIPYAFSAFYQLKYSFLEDHGKGRTGNIIVGIISSLYACWLLFAAGANFLLLMSLLFAAGIPVFWILQKKDNHAEKVFGPIEMLLAIFIVLAAIYAIYGLIVGQITF

SEQ ID NO: 4842 - protein, 259 aa, Lactobacillus buchneri
MVLTFIFLIIAGFAAGLLASVAGLASLVSYPALLAVGLPPVIANVTNTTALIFSGIGATASSLKELRGHWKKLTLYVILSLIGSIGGSVLLLIAPASSFEKVVPFFILFAGILLFMSGRKKDVSTAKLKQAHQTPTKHFWVSLISLTGIVLVGAYTGYFGAAGGVIFLAILSIITDDRFTVVNAMKNVIAFGGNLIATVIFIFKSRIDWLLVIPLGFGLLIGGYTGPIIVRHSNIHLLRILISLAAFGLAGYLFVTAYF

SEQ ID NO: 4843 - protein, 218 aa, Lactobacillus buchneri
MTQLFFDFDGTIADSEAGILKSLKYAVDKMKLPELTHDQYLKFIGPALKTSLQKFYPELSEADQMQALKYYADYYRSEGMFQLDLYPGIVQELQVLNEQGYGVNIASAKPEDLIHELTDQLDLTQYFTGRFGAGTDEKTRMTKTAVLKYALEQTHANANDSIMIGDRDTDMLGGYHNQVKTLGVTYGFGDVAELLGAHANTLVDKPEQIQGGVEKLIS

SEQ ID NO: 4844 - protein, 113 aa, Lactobacillus buchneri
MMHKVVFHIDELDKWDHTLSNISNLLDYGRVNKEEYHIVVLVNGDAIKGYLDEHLRNAVEQFSREGVRFHACNNSMNSHSIKENQLPANVEIVAAGVADLVSLQEQGFAYIKP

SEQ ID NO: 4845 - protein, 472 aa, Lactobacillus buchneri
MADTSKTFTRTTTGLHYDLSKININKSIHELIDDGKKIRDRISFDQLGKFVPVKRNVVEGISHVEEKMIGDLMPLRHKRLAASAFAFFRGTDELMAFDLSKQTSTNIPVVISGDAHLGNFGFYASPERKLLFDLNDFDESTIGSWDWDLRRLLVSIVLQGEQLGLDSDQINEIMQGAVETYQQILSQCFDDHSAMERYYFSTEVESFLQSEDSDHKLPKVWRKIRDSAEQRNSGKVVKKFTTLDSRGHLVFKENAPRTVHVSDRRFNEIREHLRSYTRSVSPDVTVLLSQFHISDIVRHSVGVGSFGTRCYLVLLTAIDGSHLVLQIKEALQTRRFRGFDVTTPFSQSKPDNGERIVTCQQILQRASDPLLGFYHNDDTGRSFYVRQFWDMKESINLDKLDADDFATYAKICGLLLARGHAQSPTAAIVHGYVGTKKKLVSALINWANEYSKQVHEDYQEFLDSLDADETRE

SEQ ID NO: 4846 - protein, 191 aa, Lactobacillus buchneri
MKKLYWESIEVNNQKFFFTVTEKGLNFVSSPGKYLSELFDFYPDRYDDQFMYDDSVTADYLTEFTDYFDQKRQDFDLPLDLENIGTDLQHQVWAEIQKIPYGQTVTYKQLAENIGKPKAIRPVAHAVAMNPDLIVIPCHRVVRSSGDIGEYRGGKETKKALLELEKKPIEKHALISKLPLPKLSQLGKSDL

SEQ ID NO: 4847 - protein, 283 aa, Lactobacillus buchneri
MLTNKQKKKLLKKKHPTTQPAESNYIAQMLKFRDQFAAYPQVKFLINNVIESDHLIKQGLLPQDLPELMLPDDIQDQIFKDINGRFKPGDPKGDQLWNELSDALPKLDKQLRSFRDYLESQYGMWAYISAPFIKDLADYIGDSPVLEVMAGNGYISKGLNDLGVKVFPTDSLEWVDENQTGKHQLIRVEKLDALAAIAKYQSQVKYVIMSWSPDKQTIDVDVLNAIRKADNDLELIVIGEKNGATDSKAFWQQAHFIKPETAKQLNRHHQPFDLIKDQIYLVD

SEQ ID NO: 4848 - protein, 135 aa, Lactobacillus buchneri
MFPERLRALRKGQQLTLEELARAINKDSPTDKEHESTGSQIGNWERGIRTPNYIEIQRLAKFFDATMDYLTGLSENNTYDLARLFISDKTLQFNGQDLSSKDRYEIYQLISGYVHGRSNAPHDQGPRTEQGELDL

SEQ ID NO: 4849 - protein, 314 aa, Lactobacillus buchneri
MKRKTKVFIGLASAVVIICGGLFGAGMYFYNVAVVPAPKSFLSKTEPIKPGNSRYPAYKWYQGADKQHWFEMSATRHLKLDANYISADKTTKKTIIIAHGFMSNKNRMFDYAYLFHNLGYNVLLPDARGHGDSQGNYIGYGWPDRLDYVKWVKKVIHHTGQKSEIAIFGTSMGGATTMMVSGVKGLPTQVKAFIEDCGYTDVYSEIAYQAKEMYHLPKFPLVDIVSGINHVKNGYSFKKASALNQVAKNKRPMLFIHGAKDQFVPTKMVYPLYRADKGPKQLLIVPGAAHSRSFSTHPKLYTDTVKKFLNRYLN

SEQ ID NO: 4850 - protein, 532 aa, Lactobacillus buchneri
LLLIIILGILAAIVGVACGVQLQKRHFQQEIQNAKATAEKLLNNANEDAKKQSAKIIADGKQQTIDYQDSIEEELDSYQADNVTRQTRIQQRETGLKQTESRLDQLHSKLAEESHEINQQKAEIEQLHHTANDLSQERLKTLQERGSISLAEAKQQILDELKTALKREKDIELKYQDDEAQVNAPKMAKILADDAIQRGPVDMPREHIEHSVQINDNNTKQKLIGREASNIRYIESLTGTDLVFDPDDPHLLHVVTQDPLRREVAKTVITNLAVTKQINPQSIEHQVETAQLDLMNELRRTGEKVVGSLHIGWMHPDLLKIVGRLKYRTSYGQNVLNHSIEVADISGMLAAELGLNVKIAKRAGLLHDIGKAIDREVDGTHVELGVKIAETYGEDPQVINSIASHHGDVEVTTPIAHLVAAGDSISGGRPGARSESVEEYVNRLKNLERIASSKQGVKESYAIQAGREIRIVVDPKKLDDQQNQQLANEVKDEIENELTYPGKIKVTSIRDFKAVAYVGAEKKKVHKRLKKA

SEQ ID NO: 4851 - protein, 520 aa, Lactobacillus buchneri
MKITLLATSDTHGFIEPTNYVDSGLDKPFGIEKACSTIKNYQKTHPDEKIIVLDNGDFLEGSPMAYYVAKRADKQDQEAFFTAYNQVGYQLGTIGNHEFDYGLDYLNYMMKNSDRHFVCANIVDNNNEPLLADPYTIMDVAGVKIGFLGLTTTSTKKWKNVNDLNDFNLISELDACRRYVPEMRKKADVVVVVYHGGFERDHTGNWNDINPGENRGYDILKNISGIDALISGHQHRKIASQLFNVPIVQPGSRGQYVAKISIETKNHTVTRSDAELLNVKDSEPDQTIKSTVTDLSKHLEAWLDKPLSRIKGSLTFDDPFKARIHESAFIELIQKIQMDKMGTDLSATALYNNEAHGFEDPITMRNIITNYVYPNTLVASKITGADLRGALEVTAQYFTVRHGDVVVNEKFVFPKERFYNYDMYEGIDYTLNISKPVGHRVTRLKYHGKDVQDDQVLTIALNRYRASGGGHYPMYTSDKIVKSSDMTISHVIMEYLQKHPVIEATVNHNFEIISDSEKRN

SEQ ID NO: 4852 - protein, 662 aa, Lactobacillus buchneri
MLVFYSLTLLIVAAIIANILYTIFPSLPLTFYQIGCGFLLSLLPFFQNYSLEPEIFMLMVIAPLMFNDGQNTSASYFRHSIRQILNLAVILAVVTAVIIGLVAHLLLPLIPLALCFAVAAIVTPTDSVAFKSITKDIELPTNVSGALENESLFNDASGIVIFNLALASFISGDFSFAQGLTRFLISFFGGLVVGAVAGLIFVKIQTLLVNKSMDTASVIVPFSIMTPIAIYLFSEELGCSGILAVVAAGIIYGINQSRLKLTSTSVRLVTNATWGVITSLLNGVVFVLLGVTLPKVIKRMIPYSNTLIIKLVFDALAIYLVMLLIRYIWMRTNLFGVQDKVPTTREALVSAIGGVHGTITLAMALSIPLTSLGQPFPFRDQLIYIATIVILLSLIVPTITLPLLCPKKQVEDQGQFNQYRGEMVNYAISQVKQDSTIALLDRNYVIDMLNSQKNNPEVDRKQVQEIMAGAQQVSVQAVVDLAAEGKIDQKIANLFSRRMITAPSNHLGFWTRVKYIFKYQLRRFKSRKKTKQIKQRIQAAIPKQNRQQIHDQRQQTNLLIKDAMFTSANSYLDQIEDDQNSNAVNFVRSSYSFRQSRSAGDTQTSDRNSLLIKSFQYEYAYVADAFKAGKISRSLSDQLSQSISTDQMAYMEQGSGTDFLLA

SEQ ID NO: 4853 - protein, 131 aa, Lactobacillus buchneri
MLNLYVAQSSASSRKARAWLKSHHIDFKERNINSNPLNADEVKQILRLTENGSEDIISTRSNIYKKLNLDLDNLTVSQLVDLVVKYPDLIKRPIIFDDHRLEVGFNEEEIRRFLPRSVREAELRELESQIS

SEQ ID NO: 4854 - protein, 267 aa, Lactobacillus buchneri
LIKMVALDLDGTLLTSDKTISKGNEQALKAIHDAGVKVVLCTGRPINAIWRFIEQLGLTEDTDYTITFNGALVVHNNDKAELAKSGIEKADLVPLHNFVKAENAPLDILDFQQVYPMTDLKPSMYQQQFKGNIDFVPRAFSDLSTTDEYSKAIVSDKPELLDQYQSAIDDTLRSHYHIVRSQPQIMEFLAAGMDKVVGLKALLAHFDMDFSNLMAFGDAENDLGMIKNAEIGVVMENGQDPVKQAGDVITGNNDADGVAQYVNHYFH

SEQ ID NO: 4855 - protein, 415 aa, Lactobacillus buchneri
MKQRQGIMTLIFAAVLSIGLLGGFTSTADVSAKQTVKVVKVQKVATKAYRATKGYMYNSPKLTKKIHNLKNYPKTTFYSKKRVTIKTTNNKTAYYTYVANKSGKIKGYVYSKYLKLYQPTKTTSTSSSNSQSDNSISTPQVISKSSLSSLIAASPDLDPTGELLSLTSADYKTYQSVFNKNFNVGNYADEGVFTDDQASIYVKSPTLQPYVQKAIDKWNTALGTTVFTLGTAQNHSLTLGFGNGQSEGWDGVFDGDSVQVDYYDFHDRTYPYGPMPLSSSQTIQIKLSTDDTDVDGAAEGMAATRVKQSAATHRDTSAHYLTTTVSGTPTELLENYWVGVITHELGHALGLDHTPYFQDIMAAPASTEDGQSQENAKYDWTTYKDSDNVQGGALTATLSQRDIDRAKLTKLLGYW

SEQ ID NO: 4856 - protein, 318 aa, Lactobacillus buchneri
MAQKKMILDLDTGIDDAMAIAYAVADPDVDLIGIIGSYGNVYVEDGVQNSLKILELLGATDVPVYQGLSHSSESDHFDRMPVSAQIHGENGIGDVQLPDPKRQPEKGDAIDFFIDAVKQYGKDLILVPTGPLTNLDAAIKKAPEITKEIGNITIMGGAVTVPGNVTNVAEANIQQDATAADHVFRKAPLTQVGLDVTLRTLLTYKETQKWRDLHTKSGEAFADIVDYYIKAYEVTSPDLHGCALHDPFAVGVAINPSFVQTIDLNMYVTTDEKYYGRTTGDPARLDDPNTNVKVAVNADVPAYLDAFMTHLTGLFSKH

SEQ ID NO: 4857 - protein, 360 aa, Lactobacillus buchneri
MKKSVKTIGSHFFSLVWTGVRRNYDNLDDNIAKHLGESEPNSPVEIHLSRMFSEVFKRHSRDEADRLFIVGTKTTTPSLRKVSSRPVTPWFFTRVFLVLAVSFVMLMALLFVFKSNKVIPGIIFIGSLAVPFSLLMMFFEINVYQNISVRQTMVIFLVGGILSLIVTMTFYLILPIRTEVSIESALIVGIVEELAKCVVIILFINTYKANYIFNGVLIGAAIGAGFSVFESSGYVSEYGLATIFTRSFQAIGTHAIWAAIIGGAVILGKTRKKQFTVRDFFTKPKFFIFFLVVICLHTFWDWDIPNTGIGVSLLQELIDIAIGWFLIFVMIDAGLREVKTLQGQQIIIHRSKQKKFVNKR

SEQ ID NO: 4858 - protein, 343 aa, Lactobacillus buchneri
NADPREDCTASEMTEVDSFYDITIIGGGPAGMFAGFYAGLRNAKTQIIESLAEMGGQVTALYPEKTILDVGGYPNIKARTLVDELEKQLSGSDTAVKLNQTVIDVQQIDGGYQVTTNQEVTKTKSIIIATGVGAFNPRKVAVDNSEDFEGKSLFYSVKHLDQFRDQTVLVAGGGDSAIDEALLLHGVAKKVYLLHRRDKFRALEHNVERLIQSTIEPVTPYLIKGLTQLDNGQVEVEAKKMKTEEIKKLTVDKIVVNYGFIAQDDALNKWQAHPEINRGTIEVQPSSKTNLQNVFAIGDVSKYEGKQPLIATAFGEAPIAVNSIMKSLYPDRRGPIHSTSIRK

SEQ ID NO: 4859 - protein, 753 aa, Lactobacillus buchneri
MFEHGAIEVHDAYQNNLKHVDLKIPKYAITVFAGLSGSGKSSLVFDTIAAASRRELNETFPSFTQQYLPKYGQPHVKSIEYLPVAIVIEQKRIGKNARSTLSTYTGIYSLLRLLFSRAGQPFVGYSDTFSFNLPQGMCQKCQGLGYVDDIDANALIDPEKSLNQGAITFVSFGPNTWRWRRYTDSGLFDNDKPLKDYTKKEMDTLLYAPQQTLKDAPAAWHRTALYEGLIPRIRRSIIGKKEAQHHKEALAKIVTRRPCPECHGTRLRPEVLTCKINGKNIADVLAMDLVHALKFLHEIKVPLVTDVIREVATKIQSLIDIGLGYLTLDRSTETLSGGETQRIKIAKFLTSSLVDMVYILDEPSVGLHPHDIQLIKNALINLKNKGNTIMVVEHNPELMPIADYVVEIGPKAGRGGGQVTFTGTYDQLLNGHTMTGEYLKQPLTYRKPRPFKSTIPLQNVTTHNLKDVSVDIPLGVETVISGVAGSGKSSLVDALRPKLHEPYIDLAQGAIGTNIRSTPVTYLDILDDIRKIFAKVSGASTSLFSYNGKGACPRCKGKGVTITNMAFMDPVVQKCEMCDGKRYNNEALSYLYQGKNISEVLNMPIESAIDFFKDTTKIYDKLINMQKVGLDYLTLGQPLTTLSGGELQRLKLAVQLNQTGTIYLLDEPTAGLHMKDVAKLIKLFDELVAAGNTLIIVEHNLEVISKADWLIDVGPDAGIYGGRILFSGLPKDSQQESQSRTGQALKQYNLDRK

SEQ ID NO: 4860 - protein, 262 aa, Lactobacillus buchneri
MKQATKNMPILLYNILVVSLALVSFVLAVLALVTKITLNEGPYRVIFGLIWLFFLIDYLIRFKRAKSKKDFLISNLFDLIALIPSHPIFIFFRIARIYSIVRYYNLLWRFGLSGKLTNALHKFLYDTGFIYLLSISLVILIFSSLIFASFEHDSLQNSLWWAISTATTVGYGDITPKTDGGKIISAVLMLGGIGFIGLLTSTITDFFTSQDKHNDETDALKDLTKQVTRLSRQVNQLQKELKKEAGPKKLPTAKNHQKNRRS

SEQ ID NO: 4861 - protein, 714 aa, Lactobacillus buchneri
LKYINWVLEKCSTRKGFIILLIVCFWAKTMLAYFVDLGLGITNPFQFLIVLINPLATTTLLLSIALYFKKSRFFYPLAILISILNTVLLYLNVIYFREFTDFMTVSTMTGYSKVNQGLSGSSLALTNFHDIFYWIDLVVIILLLVLRKIKIDPRPLNRRIGLAVTSFSVLFFVVNLSLAEMDRPQLLTRTFDRAYIVKYLGLDAFTVYDGLKSQHNNDLRATATKSELNDVLKFTRKHYAKPNKKFYGIAKGKNVIVIHLESFQQFLIGKKINGQEVTPFLNKLYKSKSSYAFKNFFHQVGQGKTSDAENMLETSTYGLPQGSLFAQLGSDNTFQAAPAILNQRRGYTSAVFHGNIASFWNRNNVYKNMGYQYFFDASYYNTTGDRSLGYGLKDKLLFRDSVKYLQNLQQPFYVKYITVTNHFPYDLDKEDTNFKTTNTGDDVVDNYFLTAHYLDQAVHEFYNYLRKTGLLKHSLILLYGDHYGISNSENTNLAKALGKNPDDWDDFDNAQLQRVPLIIDVPGQKNGFVSKKYAGEIDVLPTLMHLLGISSKRYVQFGTDILSKQHDQVVAFRNQDWVSPAFTSLSGGIYSNKTGQLLKLTKRQQAQVKKDKERVQTELSLSDSLNEKNLLRFYHPKGFKAIDPRNYNYADLYQKEKRIEKRLGKKSTSIYSKNGDKSTWKEYFTDAPEIHHKTTDSNRIKITNPDANNNDSSR

SEQ ID NO: 4862 - protein, 219 aa, Lactobacillus buchneri
MSKFNLYMVRHGQTYFNIYNKLQGWSNSPLTEKGIQNAVDTGEKLKDTKFAAAYCSDTTRAEQTAQTILDENDASDIDAPITSMFFREEFYGYFEGNDMSQAWYLAGAPHGLPTFRDIVEKYSIGKAKDYLKEADPFHQAENNQEYWKRLDQGFDLIKQNPEIKDGDNVLLISHGNTLLSVVERYGNGQFDVTERPANGSLTKLTVDGDDIHVVAFNQQ

SEQ ID NO: 4863 - protein, 149 aa, Lactobacillus buchneri
LEIKLTDQLDQIYQDARTIRHHVFVEEQGIAETDEFDGTDSDAIHFVGYVNGEPVVTARTTVTKKGVHIQRVATEKAARHQAYAKQLLEYLLDQPMFEDAPMFYLGAQKTAIGFYQTLGFEKYGEPFEEVGIPHVNMRRTHSAADHHDR

SEQ ID NO: 4864 - protein, 410 aa, Lactobacillus buchneri
MDQLMARSMKAYQSKFARVIQDTLALLFPIMLLGSFAEVLKYSFLTPSGFVATVFGVTKWLPAARQISQLLGLIVHCTVDMIALYGAYGITYCTVKAYGRQTSAMSGAIGLLAFLMAAYQPHSHGRLLFNSTLMGQGLLIALIIGYIVGRIIVAFEKRRALRSYQIIWPLLLVVVFSIVVNVVVSLTRSPEVQSFISSTALHAVQASALSYVIGMGLLTDLLSWMAVGGPFSASPTFTDPAALTNLNHALKTGSAFNAPFKYTDVTLFHSFANFGGNGAVLAMIIAILVFSKRQRFLTVSKWSIFPALFNNNYAMMLGIPIVYNPIFLIPFLLAPLVNMLVAASFLALKWIPAAVYPVPSGTPGPLIGFLGTNGNWLALILGAVLIFVDVLIYMPFVKLYDRLDRNRGEQ

SEQ ID NO: 4865 - protein, 290 aa, Lactobacillus buchneri
MMKRTVKIWLWSLLAVLLSVGLIIASLQWSHQNVSELTRHHNSQLSPVIMIPGSSATENRFDGLVSEINHNRTNPHSLLKVKITNDDKLHFTGRLRPGDNEPFIVVGFQNNKDGYSNIKQQARQFNVIFHTLVSRLNFNNFKAIGHSNGGLIYTVFLENYFDQYSNDVRMTKLMTIGSPFNFNERSIDNKTQMLSDFIKNRNKLPNNLSVYSVAGTKNYTSDGLVPLVSVAAGRYVFQGAVRHFTTITVSGSNAQHSDLPENKQIVDLINRYILHSTRVPRARQNEPRLH

SEQ ID NO: 4866 - protein, 367 aa, Lactobacillus buchneri
MDRKIKSPSTPDMGDYLKVFACAAVMLQIILGQALQTHPTVNIQIGIGICYNFIKFTAPAFITGILYTTMRVTHDTNLSYRGYLQQMWHASFIPTIAWTLVYLLIMPNVQQVEHYHTIGDFAWQFINGNAAPHLWYNSMMLQFIILMPLFWWLANWCGHNQQRGRLVLLLTSVVQLVWLIFYDTQVFHGPHAKDWYLLDRLFVSFLLYAVVGTLAWQYRQVAHRWLQKHGLITVFALGSFVWINYELFAFKFPVQLTNAPYYKPSMTIYDLSIISLIAALGDSELTRKLPVTHLIHRLANFAYPAFLSNVFWNQLLWRTFGQGLMSRQPVLGIFSVYIGTWLLSFASAITIHQSWSWLNRHFRRRLM

SEQ ID NO: 4867 - protein, 163 aa, Lactobacillus buchneri
MKLHTKILLTLVAFFTLSFAGFQDAQASKAADTDVSYSAVYKVAKQNLGKPYVYGATGPSAFDCSGFTSYVYKKAASVTLPRTAQAQYNAGQKVSYKNLQKGDLVFFGWSAASISHVGLYIGNGKMIDAQNRGVITETVKAPWWNYVGSAHIVNFDSDDATDD

SEQ ID NO: 4868 - protein, 903 aa, Lactobacillus buchneri
MKETIAKLHKNRLFTLLVWLIITFIAIITAPNVTDTLQSYSQPTFSKDSQPAQAQQLRNDWGYNLGKASTINVVYTNPNGKITAKQQTKIDNALNKLKAHQSFYSIKKIVTINTNVAGKQQLLSKDGSTQIASLDIDAKSSTLRVLTNELVGEVQVPGLKSYVTSPEIVRDVNNEKTAQVTNIILITLFVVSMLIVGIYFRSLFAPVISFITLFAAFTTSFSISTALAKHFNFAFTQYTPLEIGIATVVIGTIWNIYIYRKLRSVLALQREARYATQQTIADLRFPITIVGSALAIIFACCGFINYDQLQSLWVLGITYVVLMLAVLTLNAVFLAALGESIFWPSSAPLSAMKSHFWNRATDFSLWQPIAAFLVVLYLTLPFIYFYHTSLNFSPMTNLTQTNQAVKGAHVLQAHFSQGKATPITIYLKNDQPLDNEKYLQHLDQLTTKLQHTKGVSAAYSLTQPSGMPIEKYYVSNQLESIGLNAKQATGQLSQASNGIETSGSNLNLSGLKQQVKDMQSLVKKSNQIVEDSSSLASQVNSVAANSSVAVQQGASRRVRMYQQKINELNQSLQSVSSGISQLNAEGSVIQNYGQNSANNLESYSQQISQVQKQLKQVSSQVNSSTDQLNNIYDYLNGLQKSGAANVYYITKAQLVDTDFLQTMLNYTSQDKKITTIQVVMNNAPSSKTNLKQVKMLEAQVGLQLRGTPLSSDQVAFTGEPITQSINQSKLNHHFITLLAIVIIGILVTVFVVSRSILQPLYWTVAFIMSAITGFQLTYLTMHYVTGTNQFDWQVPILAISILTAIAAWQIIALGLSFRYTELSLLEWIRPTMASYGKIVRYILLVVIALAIGLTFGASFAMIETALIVIYTVCVYYLILPMIVTSMGKLAVTLPNKDNLLKNK

SEQ ID NO: 4869 - protein, 326 aa, Lactobacillus buchneri
VCTSIFQIGQEDGAHVLSRTMDWPQLGAHPVFVPRNYGWHSVYDDKRYVTKYATLGSGHQHAKRIDMSDGVNEFGLAVQKLTFTNGSQLVETPGENKIHLAPFELSFFLLSNYRSVKDIEDHIEEIELMADKYSLMKYGHSELHFAACDPTGRIVVIEPVTTPIEIIENPLGILTNSNHFDRQIDKLNKYLDFTPDFVNGTVPLNTPRVTTGNVSGKSIPPGSYSPGSRFIRAAYLKERIDIPQNENEAVDNCWHLLDSVNVPKSKEHQPTYSVYRAAVCCESRNYYYQPYHAKSVAKIQLTDDLIKSNEVKFFKVADQITFNELN

SEQ ID NO: 4870 - protein, 206 aa, Lactobacillus buchneri
LRKQSWRVIVILLVTFAVLIVGVSLRGQLSHHAQRNSVPTLVQKRPDHFSTRQKRSFINRVGTPAVKLYLKNRQVLPSVVIAQAILESQFGTSELTTTANNLFGIKGTYHGQSVQFYTREVENGKSIKVLAQFRKYPNLASSIADHNQLVSEKFIKAKNILSYRKSTRLLQANGYATDPHYAAKLNRLIVKYQLSRYDLKAINERV

SEQ ID NO: 4871 - protein, 254 aa, Lactobacillus buchneri
LLNWVSNLYGPFFDPHNWETVITSGSDWLIILSLVTIECLLSVDNAVVLAAQTQALPTKVQREKSLFYGLWGAYLFRFLIIGVGTYLIHFWEIKVIGSLYLFYLVYQFFRKTKIVRTKKLAGSKRHGISLFWSVVAQIEFMDVVFSIDSVLASLAISSNPVIVLLGGMIGILAMRGVAEVIMKLMGIIPELQPMAYVLIAIIALKLFLSIPAIDIEIPATAFGGIVIAAVIITLIIHYVRKKRRINDEHGNNAE

SEQ ID NO: 4872 - protein, 109 aa, Lactobacillus buchneri
MSTEITPNNLAAETNNPLTVIDFWAPWCGPCKILDPILADLEADYGDQIHFGRMNVDGNQEIAEKYHVLSVPSLVIFKNGKAAEKVSGIYPKDKLRKYFDQKISEVQSI

SEQ ID NO: 4873 - protein, 129 aa, Lactobacillus buchneri
MSTKSKLTIISILTYCAFIILAFFTNILSPAKIGITWTIFWYIAAAGIIYYLWFKNLVFQRVMHYSKALHLTQTDLAKMLPNLKESQVVPDPAKRAIIAPIFNFPLQGLDILNAKLTPMAKQKGIKPFR

SEQ ID NO: 4874 - protein, 184 aa, Lactobacillus buchneri
VKFSVETIDRKDYAAVRGIIADSYQNDGPNTDGDEVDMVDRLRGSESYHDQFEVVAKDHDHRVVGHALMVPAEVRSATGKFPIVSIVEIGVLHGYRNDGIGQEMVIELETRARLAGYHAVSAIDHSDFFFKNNYVPADNFNILPTVAVDFNDNLIKPLFDGALYQKGGKIYYPEEFFGIRSTNY

SEQ ID NO: 4875 - protein, 465 aa, Lactobacillus buchneri
MENDVKEPTISLTEGIVVLLMMLLIMGFSVIKLQISPQIPILFVILLLIAWAKVRRFSWDSVNQGIINGISTGIIPMFIFILIGALISSWIAAGVIPSLMVYGFHLISAEWFLPSVFLVCTIVGTAIGSAFTVVSTIGIAFLGMGLTMGINPAMIAGAVISGAIFGDKTSPLSDSTNLAAAVVGADLFSHIRNLMWSTIPAFFTSLIVFFLIGRTNAQLNTASIDRTINVLTQHFSISLWAFVPIVLMFLCAWRKIPAIPTLFINILVAVGMLYVEQPKTKIQAVVNTLTNGYVSHTGNKNVDQLLTRGGIASMMATIALIISALALGGLLMKFGVIDAVMGPLSRKLQSNGSLILAVILSGIGVNVFVGEQYLSVILPGNAFKSTFDKAKLAPVALSRALEDGGTVINYLIPWGVAGVFAANTLQVSTISYLPFAIFSLSSPIFSIISGFTGIGLKHLKMHENG

SEQ ID NO: 4876 - protein, 204 aa, Lactobacillus buchneri
LKKVLSMIFATSAAAIGLFFAGSAYASASTVVTVKSGDTVWGISQQYNSSVKAIESANNLQDANVIQVGQQLTIPSADTASNTQGSAHAATATTQQTQSYSQPAQTQTNQAQTSQASTSTSTATSGSVAEQAAQLMEQKTGVSASTWMAISYRESRNNPTAQNPSSTAHGLYQSLYTTSNDWREQVNDAARIYHSQGMGAWALN

SEQ ID NO: 4877 - protein, 106 aa, Lactobacillus buchneri
MDNLFDVLQMVRFNHLAFDSSQVVITDVEGKPNGILTDLFRDVVNKVNLFIDLSEAHDAGDVVASLKAHTPLPSDVLDEYGKILREPLVGINFAPQKGQIELLVRG

SEQ ID NO: 4878 - protein, 323 aa, Lactobacillus buchneri
MEVFDYEDIQLIPNKNIIKSRSEADTSVKFGPKTFKIPVVPANMETVIDDDLAVWLAQNGYFYIMHRFQPEKREGFIKMMHSKDLYASISVGIKPEEYEFIDKLVADNEKPEYITIDVAHGHSDYVIQMIHYIKEQLPDSFLIAGNLGTPEAVREIENAGADATKIGVGPGKACITKLKTGFGTGGWQLAALRLCSKAARKPMIADGGIRYNGDIAKSVRFGASMVMIGSLFAGHEETPGNLISIDGKKYKQYWGSASERQKGAYRNVEGRQMLVPYRGHISDTLNEMQQDLQSSISYAGGRKLNDITKVDYVIVKNSIMNGD

SEQ ID NO: 4879 - protein, 426 aa, Lactobacillus buchneri
MSSIVIVGSQWGDEGKGKITDFFGQSADIIARYQGGDNAGHTIVFNGNSYHLQLIPSGIFDQEKYSVIGNGVVVNPKSLINEMDNLKKDGISTDNLRISNRAQVIMPYHILFDGLQEQKKDSKIGTTNKGIGPAYMDKYERIGIRIADLLDKDIFEEKLRSNLQVKNELLTKIYDHEPLEFEPIFNEYNEYADRIRPYVVDASYIINNALDNHKNVLFEGAQGVMLDVDHGTYPFVTSSNPSAGGAAVGTGVGPNRIDHVIGVCKAYTSRVGEGPFPTELHDEIGDHIREVGHEYGVVTKRPRRIGWFDSVVLRHSARVSGYTHLALNCLDILTGIKTLKICVAYELNGKKIDHYPATLKELDACKPVYDELPGWDEDITKCKTFDELPTNAQNYLNHVQKAVGVPYATFSVGPDREQTNVVEKVW

SEQ ID NO: 4880 - protein, 431 aa, Lactobacillus buchneri
MIDRYSLPEMSNIWSLQNQYASWLKVEIAIDEAWSKLGKIPAEDVEKIKKNAKFDVDGIAEIEAVTHHDIVAFTRDVSKSLGPEKKWIHYGVTSTDVVDTAWGVRIKQANEIIRKDIDAFIDVIAKQAKKYKDTVMIGRTHGVQAEPTTFGLKLARWYSEMNRNKRRFATASKELEAGQISGAVGTFANVPPFVEQYVCDSLGLRAQEITSQILPRDLHADYISTLALIATSLEEFATEIRGLQRSEIHEVEEHFDAGQKGSSAMPHKKNPIGSENICGLARVVRGHMVTAYEDVALWHERDISHSSAERIIIPDTLTLLDYMLHRFTRILDRLTVFPERMKSNMGLTYGLIYSQRVMLKLIDAGMTREQAYDLVQPLTKQSWDKGIQFRDLVEGDKKITDALSEDQINDAFDYHYHIRHVGEIFARVGLE

SEQ ID NO: 4881 - protein, 317 aa, Lactobacillus buchneri
MKAAIINDFTRGPEYGDFPDPKVEDGEVEVHVLAAAVSQLARARANGTHYSAASTLPIVPGVDAVGETADGEHVYFNSSNNVYGTLAEKAVVNRRALFPIDNTADPAVVAATANPAMSSFMAIKERLGEDKIRGKRVLVLGATGASGQLAIPISISFGATEVIGVGRNPEKLAKLSQFGVTSTIKLTDNDDQLKADLAKIGDVDVVLDYLWGDIAATMITDMIAQRQDPQHTLTWVQIGSMAGQSSPLKGSLFRSIDFHLIGSGFGSFTAANLADDMPALLKMITDGKIAVPLTAFPLSQIAEKWNDYGDNRLVFLP

SEQ ID NO: 4882 - protein, 89 aa, Lactobacillus buchneri
MRKYQPKYQSRFKKHYQNMIRANRYTEADFKTVEEQILSGQPVAEKYDDHVIKSRKPQRALFIKGSWLLIYEIVGKTVRFLDTGRHGEI

SEQ ID NO: 4883 - protein, 285 aa, Lactobacillus buchneri
MSFMAKRFIKKFRAENYKKSVAHSFLKPNQKINIFRQSADQYKIRPVKNGQLVTIQPIQNPTSQILYFHGGAFTVPMNEDQLEMITKIATESNSLIQVADFPLLPKHSADEILQFAQAAFDLVIESELPTFIVADSAGAKIALQLLVDNPGKAAGSSFISPWLDTKLTSPAIAERADEDILLDLPTLQEIGRWFDQGATPEKWVDYTDAAQLKGVGPVQIFYGENEMLVPCDLQFIEALQNAEGANPEVIAFKDGYHDYTLWFKLSETKKTFKRIAEFIKDQRGA

SEQ ID NO: 4884 - protein, 218 aa, Lactobacillus buchneri
MAKMKDFKQRLYYLGLSIIINSAGNALAISSNLGSAVWTGSAVNLSKWVNIPLGTTLFIYGIIVTLSNQLLLGSFDRRRFFSNLLYTVPFSYLVALFTFIFNSLGVPAMDFYVRLILDIIGLYCVAMAVSMYARANLIMHPNDDLAYIIRFKYIHGSAVLSQWLSYIPPVVIISASYLFTGKLYAIGFGTIFALLFQGTMMKWSDTHAFPKLKHHVDL

SEQ ID NO: 4885 - protein, 206 aa, Lactobacillus buchneri
VEREYSEVEAEKHFENNRLWFRRFQTTRSFRKLTKPERAAAGYITQAFVGLAYKYQLRSPRQYSAKSVKEVVMDLFPEKIAATNVFFTSVIPVMHRYFVFLGVQHKISNAKTLIKALESIKVRQLLDGHRDASNWDAHKKLGMQVLMGYKQDVDPKKVSAYEEDYNMGVPLRFCFDFSVNRPPKNIILLTEKLRKKFENVMYENNK

SEQ ID NO: 4886 - protein, 59 aa, Lactobacillus buchneri
MWVYRQAEFVWLSRNSRTESTRLSSAPTSIENTLRRPAESLPSPVGDAPDPCYTSQKDQ

SEQ ID NO: 4887 - protein, 68 aa, Lactobacillus buchneri
MLTIATKEISNELMNAYKNKKLVRIQTGDGTLTGSVAAVNDDQAFIERPAKGVTVVKLGSIDHVQVLN

SEQ ID NO: 4888 - protein, 79 aa, Lactobacillus buchneri
MTERQMIQEILNTVDVIYSFVNTDDDKKEYEIVINRQDGDNRPLENVNKEIKHYFTDANFSYDEELNDNGDDIHVQVKR

SEQ ID NO: 4889 - protein, 503 aa, Lactobacillus buchneri
MLTDRPKYVLSIDQGTTSTRAMIFDHSGRKVIEASKPVKQAIPHNGWVETDPNEIWTSVLNVISSAFIDAGIHPEDIEGIGIVNQRETTLIWDKETGEPIYNAIGWQSKQTAALARKLKNDGYSGMIHKKTGLIIDSYFSATKVRWILDHIDGAQERAEKGELMFGTVDTWLVWKLSGGEYHVTDYSNASRTMLFNIHTLQWDDDILKLLNIPKAMLPEVKTSSELYGTTKNYQFYGIEVPIAGIAGDQSAALIGQLAFEPGMIKNTYGDGAFIMMNTGSKPEISDDNLLTTIAYNFNGKVTYALEGSIFAAGTALSWLADSLQLIDNVPESRQAAMNSEDDDEVYVVPAFNGLGAPYWEQDVRGAVFGLTRGTTKDDFVKATLQSIAYGTKDIIQTMEKDTSMHIPELMADGGASRNSYLMQFQADILNIPIQRAADENTTAFGAAILAGLAVGFWKDIDEIKSLQEPGRTFTPNMEDSRRQKLYRGWQAAVQATRGYRVKI

SEQ ID NO: 4890 - protein, 148 aa, Lactobacillus buchneri
MQNPFGNGNNDDNNQNDPNNPTGLPIPPNFATVVNKENGQIRIAKVGPSFTALLFNLWVPIFRSDWYNLLCMAGVEIIAGMALSLGMGQPFQVAYTLGSYGLGIVWMLIYNMMYFKHLFNIGFVPADERSKELLSNANYWKEPKDKNE

SEQ ID NO: 4891 - protein, 461 aa, Lactobacillus buchneri
MYNDNNTVHVNEGEQLTIEIKRMGINGEGIGYYERKLVFVPGALPTEKVIVEVTNDLNNFIRAKLVEILTKSKDRIQPVDDYANDVGGFELENLAYPKQLEFKRDVVRQSLEKYQPTGYRRFKLLPTIGMDDPTHYRNKATFQIRHDENGNTIAGLYKARSHDVVDLKTSALQYPLTMKVMRAIVTMIDELGIPAYDEEKNAGIIKTVVVRAAIATDQVQVTFITQSKKLLKKHQLLERIKAELPEVVSVMQNVNPGRTSLIWGDEMIHLAGRETITEVLNGLKFDLSARAFLQANPEMTSVLYDEAFKALDLKGNEKLVDAYSGVGTIGLSVAKQVREVLGMDTIAEAVQDANANSVRNGIFNCLYEVGEAEELLPEWVDDGWTPTALIVDPPRTGLADSLIDTILDIVPKKFVYISCNPSTLAQDLVKLTEKYNVEYIQSVDLMPQTSRCECVVKFKKK

SEQ ID NO: 4892 - protein, 282 aa, Lactobacillus buchneri
MSLTDTYTLYNGVKIPQVGFGTWQSANGDEAYHAVLAALNAGYRHIDTAAAYGNEESVGQAIKDSGVPREDLFVTTKLWNADHGYEKTKEAFGRSLEKLGLDYVNLYLIHWPNPVAFRDNWQEANAESWRAMEEFYAAGTAKAIGVSNFRPKHLDALLETAKVKPMVNQMFINPSDMQPAVVEYNDDHDILTEAYSPLGTGEIFKIPELATIGRKYDKTPAQVVLRWSLQHGFLPLPKSIHEKYIKENADIFDFNLSNTDMKTIDGFHGQAGLATDPDTATW

SEQ ID NO: 4893 - protein, 176 aa, Lactobacillus buchneri
GNATFAMILYPRTEINMVKIRPIKQQDDFELAKIIRTILKSYGLDIPGTAYFDKELDHLSSFYDQKDDREYFVAVDDAGNVLGGNGIAEFDHANHVAELQKLYLTDSARGHHLSYRLLDTAVGFAKGAGYQTVYLETHHALKEAIHLYTEYGFTDLGHPLNNGEHSSMDKFFVLHI

SEQ ID NO: 4894 - protein, 286 aa, Lactobacillus buchneri
MDQRVAIVTGASSGIGMQIAKNLYRNGMEVYALARRVYAMNELDDLGIHTMHLDVTDHDEIDRVVSEIVAKTGRIDVLVNNAGIGSFGSVEEVTLTEGEYEFKVNVFGLVKMIQAVLPIMRKQHSGRIINMSSMAGKIGNMLLGSWYIGSKFAVEGISDSLRQELKPFGIDVAIIEPGAIQSEWKDGAMDRMMDASGSGPYAKLARRSAAFFAISYKFAAAPRVVARAVDRAVFSRRPKTRYAIGTGAKPAMLMKRFMPDKCLDAFFEALNKYAQQVVNRETGQNR

SEQ ID NO: 4895 - protein, 262 aa, Lactobacillus buchneri
MKIDLLGTLRKKNPIAFNISNFVTVQDVANGINALGASPIMSEEKNEAEPMVQMADSVTVNLGAFTEGQLEQISAVTTFANQYKKPIIIDPVAVGAVDYRKERCNELLDQIDVAVIRGNAGEIAALADVEWNAKGIDAGEGSGDLEEIAKKLAKKRNCVVVESGKTDIITDGEAVVRIYNETDLFKLHVGSGDMLSSTIGCFCGVEHDYFEAAQTATAVFDVAGEVVAKSMPKPLAGSFGVQLIDELHLIDTKTVEKYANFE

SEQ ID NO: 4896 - protein, 271 aa, Lactobacillus buchneri
MVNETVQTLTIAGTDSGGGAGVMADIKTMQMRHVFSAAVIVAVTAQNTIGVQDFMPIPKKLIDEQFASVADDLKIRACKTGMLADVATVEAVVENLKKYDLGTLTVDPVMVAKGGARLLSEDAIKTVREQLLPLADILTPNLPEAEELTGMKIEDKDQMIDAAKKLQDLGVKNVLIKGGHQTESKESSDFILLESGKSFWVSSPRIDTVRTHGTGDTLSSCITAEIAKGADVETAIRIGKKYVQATIANGIQVGHGHGPLNHWATFEGDGD

SEQ ID NO: 4897 - protein, 218 aa, Lactobacillus buchneri
MGMQFEPGMLRAYFIAGTQDVKDKSKTLQEIAKQAMEAGITAFQYREKGPGSLSGAKRDEMAADLREMCSDYEIPFIVDDDVDLAIKTHADGIHVGQKDERVTKVIEAVGQSMFVGLSCDTQEQVNIANHIDGISYLGSGPVFPTGSKADADPVIGVDGLAKLVQASQLPVVAIGGITEQNIVELPQTGVAGVSVISMIAQSDDIFRTVKVMNETFEK

SEQ ID NO: 4898 - protein, 163 aa, Lactobacillus buchneri
MKKSTTTIILTLIFVGTIGLSGVVSHHREDASASNPSEVAQPFRGAWYGNQSNIYFGKHSVKIHSDQTSYDRSGSYFVFGPTSTTDWKAFGTPNTSDVNLARVTSKDVAGFVQPVLETYKGKVSGPGPYQVSYYTRNNTDVMKTMTGEVNHLPHATVEGFNME

SEQ ID NO: 4899 - protein, 524 aa, Lactobacillus buchneri
MKGHFKLALAAAFLFVSAGIFGVAAPTASADVIANPGTAGSIPQVNAGNVLKDYDENSLNVVNNSTPQGNTSKKYTKYSLDPTGYNYGNSYNTIAGSSQSNTFKTKFFLPDGFNVSNYQHGNFQSVTLDGDGNIYFIESNGTNTNQGAIVKFNMAKLQQLGVGSDVLLLWRAFDYFNPYTTDGQAHNDEYNQVNAQLQGAFDKVQTLTTTLNQNKSWQNNQNNWKKNAQKWYYYWKNKKAKYTKISKSYKYSYNTRAKAKKTVKTATSKMATWMKSYQSHKAKIAKYNTKINSIQSQIDTYQGQIDDAKAQNPDMFKYVDIAQTAQLSPEVDIGHGQTLSYNPQNKHIYLAEDNTLTDLASRDDNNTVLEMDPDTLKPIREYNFKMYHGDSANLQLHTLAFDSKGNAYWGRKLNGGYMFFYGRLDENGVSFQASSSMVGKRGGSTNQGVAVNPANNRLYFVSDDILTSVPTSGVQSGNFSADDIHYQAFDSGREFESLAFDQDGYGYLLALWPPELMQSTNPLN

SEQ ID NO: 4900 - protein, 219 aa, Lactobacillus buchneri
MKRTIILLLTMFTVTLTFGLSHPVVAETTDDTPQINTAIEYVKRVKTTTQQTESSAQGSVMATNDSNTTPAKYRWADTTITYKIDTGSAYYQNVWQQAINKWNDTNIVHLIAASQDPDIMLAVDNTDNLDYAGMTTVKYYQKQKNNLFLLAPSTSTIYANNCSLFTYTTTERVHVGEHELGHALGLQHSEDMDSIMYPTVADNDITSADIAGLAQAYAE

SEQ ID NO: 4901 - protein, 116 aa, Lactobacillus buchneri
LLYMNIHLISWILLMITAILAFVLKDKLSMIFMMITRVLYIPILVSGFMLALYRVPRDPVLGSLKVILGLAVIALLEIGFARKSHHNLASNIVWTLVVVFALTSVLGLYLADWYFF

SEQ ID NO: 4902 - protein, 214 aa, Lactobacillus buchneri
MDGLNYTQEFVLCVLNQKPKLSAFKDRKVAACLLLSEIVELLRAGAMELTPVNRMVVAQVTKAPADYLVPLTEDIKKRQPESVNNYVRDAVLSVRKRRVTKIAEAICDSLVKAGYLEVDHKTYYDNQTLTDRILTQLYQDAIAKKEPSEKNSMLAILLVNSGLVHQIFPKQEAETIELRLKEVMKSDQYHLISDVTKRINKDLAGIIDAVSFAR

SEQ ID NO: 4903 - protein, 124 aa, Lactobacillus buchneri
MTINEMLAEIKSYQAKLHLADDYLFNIVEFDPDEIKAYYAGTAPESAYQQTLTQIKRLYLLSLTPAELLKRINEVRESAGVSEADAFKVMAIDDDKLADFKAGNLPTMNYVTALNALQAQYSHK

SEQ ID NO: 4904 - protein, 309 aa, Lactobacillus buchneri
LNNQSTNGGYLFVFFTGTEDSPSAEQLYFALSPDGLHWTDINHGQPVLTSTIGERGVRDPFIMRRQDGHFTIMATDLSIYHRGGWGQAKATTTGSKDLIFWDSADLVNWSAPRAIQMVGENTGCVWAPEAIYDPAHEAYFVFWSSPNQQTHKMEIWRAYTKDFQHFESTATYAVAKNPKNDLIDMTMVKAGGQFVRASRDGTIPIEQSPSLNGNWQHVTALQDLDLGIQGDTVEGPEIVWLADQQKWCIYVDQFHNGRGYLPILTSDLTSSNPTDWEVAPDYDFGQLKKRHGSIMALTPQEYANLAAKY

SEQ ID NO: 4905 - protein, 134 aa, Lactobacillus buchneri
MQFNREYAKLAINQIESAYRKGDILRRPGRHGYGPHSEKTEAYLRDHGITFQKALKDAVQALSTSKLTRFRGPSPSYFPGQSGGVVYDFLGPLYDSNMYIKFSLVVRNDQQFIIFESFHESDRNDFGNFIELNV

SEQ ID NO: 4906 - protein, 176 aa, Lactobacillus buchneri
MNPVKVNSVITEYDPISDQKIKYQKIQISESVTVRNISFNSPHYYLVEEGMDIHDPQNFEVPFDNPDVNLRADYQVYREKAGFLQPKEIKKIREHLRLSLREVSAILGISYSTLSEIENGLVLHSQIQDTLLRMLEHTYTLSTIVEQHKGLIINSHGLKAYQRIIDKLNAEKNWDS

SEQ ID NO: 4907 - protein, 146 aa, Lactobacillus buchneri
LAENDNWQLMGVRLDGLSFDRSNFNPQKGPQINAETRLALPNDPADKSTMSVVQVVSTFKLYDDELAKSYFTATIAGVYQVPGSLTDNDAIQKTIDDDKNLRDSFAQPVVDYLIATLADLSLKAFGTPTILKREQLIDTLFGAKQQ

SEQ ID NO: 4908 - protein, 646 aa, Lactobacillus buchneri
MSYLELHNIKKSYYLANQEFPVLTGIDLSFNQGEFVSIVGESGGGKTTLMNIIGGLDSNYAGDVVLNGKSLRHDTAKQLDAYRRQTIGFIFQNFDLISHLTVFNNVMVSLQMTKLSHKQQEARARQLLEQVGLKDHMKKYPNQLSGGQKQRVAIARALASDPEIIIADEPTGALDSQNTQEILALLDQIAKDGKLVITVTHSETVANHGTRIVRLADGKISEDTTLKPGYEKSQANELATHTLRFGATLKMALENMRYNLKRNLLIVFGAAIGIFSVIVMLGLGNGVQGYINHEIYSQVNPNAVQVTKNVSADASTDPSKINVTTKDKNRFKDIKNVKSIDDGYFVQGGTQLRRGHKTASISFMQTHNKTMLTKSIAKGHAPKNGEIMLTKEYAEKLNKKHPYSLIGKRVTFYQNTLNKKKRPVMLTKSLKVSGIAKANTGSTSVTYSTMKSLYSSKGIKIQPNFVTIEIAGNVKNVKPVENKIKAYKNDKKKAAYQITGVGGFVDTLNTYITLAVNVLATIAGISLLVSAIMIIVVLYISVSERTKEIGILRALGSSKGSIRNLFFSEAFFIGLFSSALAIALAELLQVVANNIAQRGINYSIMQITPGNVIFGFVVAIVISLLAALAPAASAARLDPIESLSYE

SEQ ID NO: 4909 - protein, 83 aa, Lactobacillus buchneri
MAKVKVRKIGNSLGVLLPKESGVHEGDELEYAQEGDKIILDTQEAQNARVREIVENSFKDFETGNVLTEDDMVRIFGKYGWHK

SEQ ID NO: 4910 - protein, 104 aa, Lactobacillus buchneri
MDPYELSFSNDFQISLKQTIATWESIGIDASKIQTFVSDINTAVASLKVFPNRFANVDEKYRIPVPTRQIIIGDHYAILYRVKEATHTVEIGPIYNLKQMGITF

SEQ ID NO: 4911 - protein, 288 aa, Lactobacillus buchneri
MSEKIAILADSGSDVPAELLKQYDNIEVAPMLVTMAGEEYRDNVDITPEEFYARLGQADQFPKTAAPTQGSVEAHVASLKERGFNRIIGITVSAHLSTTFGIFTNVARENTDIKMDVINTRNIGIGSGLFAVYAEEMIDSGQTFDETIKFLKQSVEDSRTFFYIPSLKYLRAGGRIGRVAGLIGSVLNIKPVIATDSEGIYFPVAKARSEQKAISKMVQLVSDIIASHKSVRVGVANGADVPLQEKVYDRLHSAFPQLRIYRGSVSPALGVHTGPGLVGVGVQVGEGE

SEQ ID NO: 4912 - protein, 171 aa, Lactobacillus buchneri
MPKTTTELQIRLPMWEELPAFSLHLDQLLDLTNEYLEPIIGDKITKTMLHNYFKAKILVPPVKKKYQRTQLAGAIVVGLLKNIFTLNEVKAGLITLLGNGTPKTGYNNFVVMFNEQAAKAGKELSDPTSLELASAGQPTLMQYDAVQSILFWLSAKNRLHEMMDQQDRDGA

SEQ ID NO: 4913 - protein, 672 aa, Lactobacillus buchneri
LNSNHKMLLREFSIGAAVLAAVALSTPTLTTKASIPNNQNMSTLNSSTSAQSGHYTEDNSEDNYQFDWSLSDDGTLTLSNASFVFGGNNSPINSHISNQLPADVVSAVKKIVLTGSPVASGNIQYLFCNFANVDNIDVHNLNVSGVTSMQALFCENQKLDSVNISSWDTSNVSNMATMFWEDPITTITGLNDLKTGQVTDMHELFATSNSADNSKVTQLAQSFINTADVHNVKNFEGLFDNSNMTNLDISSWHMDAATDTSNMFGDYQIAVPSPLASYTGSKMTTLTLGPDDKFVPVSEPTAVVAPTFNPFGSTQTYVPINLPSGTTINMPVDKSGNWQAVGSGTVTNPQGATWTSADFDTKYAPTATPRPAKETYVWKHTAPKLNINLKSPVTLKQGAKFDADSYFVSLTDAGENAISAPITSLKDAEALGMTISGADKVNTKVPGTYNVTFKLGSQSATLKVTIPGSSSNGGNSSNSSSSTTPTNTTPSTNNSWNPTTPSQATGNTGLPNYAAVKGDAVYATKAIYMYSSPTFTKHNRIAKYTKKARANRPMFVVTGYDKSNNGALRYKVRDVNKGSKTYGKTGYVTANNNYVGGAYYQTMPKNKKLTVIAKHGINSYRSASLTGKSKHYKKGARLHVKKLVKHNLTTRYQLTNGHYVTGNKKFVIQGNY

SEQ ID NO: 4914 - protein, 138 aa, Lactobacillus buchneri
MQTYGLLFVIAIGCFGLALICFSLISGDQDPMKPHAPEEPRLYEGATPQFDVEVEPGTYQYDPMTGETNIPKNEFDLYMLYTIDNVDKRHLRLTPADQALTDKLKSPAGHWDQFPRAVQHMPALWTIAGHGLVLLRIK

SEQ ID NO: 4915 - protein, 437 aa, Lactobacillus buchneri
MNNLKIMGALAGAFAIGTMILTTQADAAKKVKVTSNVPITATKVTNRNVAITGKNKIYNKAGVLKHAKAVTSTKQIKQLGNSQRSKDFFNVYRMATTNKGQVYYKVVSFEGKWRGWIYGGKTKADYQGGIRSVQTTKDVQLPDDVKNAKFTLENPGVSGTNNSWTAIPWSQYGARLKTTDSSPYANDELRVTAAKQLTRQYYGTFYYVVDDTHPEFSGWLNSSSLKAVATPPTNTTTVTNYVQSPPEVVTNTVTNTVTKTVEVPAKNPLTINYNVYELGTSQNQAVSNQILKMYQDQYASPLSELTKNPDTAASKLKDLGDGQTLKSNDPTPMNYASIAVSFDKDKNVITITLNWVQPIIVASDALFHAGDDYDPESYLWSVTDGTGVSYPRGDWLDRVQISTDVNNNLHGTFHTTYTFKLMDGMTATTTATVTVMK

SEQ ID NO: 4916 - protein, 237 aa, Lactobacillus buchneri
MSLSQDILFEAQPYLIANEKHPFVQGIIKGELSPEQLRYYDKQDIAFEYNEVAVINALINNSTTTDQALLFHKRQDMQLHMLDDWLKREPESMPHDWESLKQTTIQPINQLYRQHMASTIQTHSVLQILPSFAAGEWMYVELGKFVATQTRVKEEPFQSFLSMSGDDFLGPKGYIQQFFDIIDHEAESATPREQEQAKQTFLKSCLLEWYFWDAAYKLITWDDWKKNALGGKGGVTL

SEQ ID NO: 4917 - protein, 86 aa, Lactobacillus buchneri
LAVDMKNKTISTRVNEKIAEKAKQNLANVGITVSEYLRLALISAAEDGVSDLLNSPEAMQAKFEAEHGQTLNIGSVEDYKRWSEKL

SEQ ID NO: 4918 - protein, 102 aa, Lactobacillus buchneri
VTQLQIKATGQYVRSLKRLKKKHYPVELIEDCLRAILNKDHDTLIKIHDHPLVGQWRGYREFHPARIGKASSQLDKWVVVYQIDSDELVLILIETGNHNVLK

SEQ ID NO: 4919 - protein, 182 aa, Lactobacillus buchneri
LKFTKFILSFAVAGAIMGGVATTASADTYNNTNATYNQQASTNYYNPNAGTPKATVNSNDSRADAVVSLAKQLATQNIPYVWGGESLQGMDCSGLTDYVYQKAAGISLGHYTVTQESHVTKEAVSEAQPGDLLFWGDEGATHHVAIYIGNNQFVAAPQPGQNVDVETISSAFMPSFAGHVNG

SEQ ID NO: 4920 - protein, 96 aa, Lactobacillus buchneri
MEKSRFKVLAETGIMSRPATRLVMAAQEYTSDVTLTYNDRTVNLKSIMGVMSLGIPQDSYIEIEINGDDEKEAMAGIEDYLQKEGIVEKVTMDADA

SEQ ID NO: 4921 - protein, 640 aa, Lactobacillus buchneri
LRGKQIVITALSSLLVLGTGLAISADQAKAAEKKSVVNVTFKPSDENELTDYVYNTVDPTSSQYHQYLTPSAFADKFGQSDSYIQAFQDYLAKYHVQAQAFPGNLSMKLTGTSTNLQKAFKAKYVPAKKKGYHPTTSYKLPGQLSDKVVAVIGLYSTNPNKKTKKTTKTATKAKKTTKKSATHSDTTTLSTTDAKPNIKYTGNAFSKKYGAAKFAKAYQVDDLYDQGLEGSGQRIGIINDSDVRDADMLTYWKQAGVNDDISRVHHIYTVATQAQAQADLNKSISAAQMEATLDAQSASAIAPEAQIDLYTAVQYGTKTTLTSAFYNNFMTAVSDNNDKQITTSMAPAFETKSNWPDPSASLSQYSHAFNLLLEQAAVQGITVFKASGDRGPYALSGAKENHIMSTSPYEVEVGGTTLPYQKIIDGNLISVNKERAWGDTYSRPAYDTKYSSFAGGGGGFSDINPTPRYQIGVPGVNTFRAMNYLTFKNGKYSITKNPHVITGTKTGRNLPDVAGNADPLTGYASIVSGPKYTFNPETKKATKANGILWRIDGGTSFTAPQMAAANAVMNSGRQTPIGFWNPQIYKYAQESDSPFNVLDDADFNDNLYYTGQPGKLYNQATGLGTINFDKLYNKFNNTNN

SEQ ID NO: 4922 - protein, 138 aa, Lactobacillus buchneri
MQNEDHSKIDRKQLAEIVPDLTNVISDPDGTFSVFDWGHGEIIGVIQHHQDYPDTALEEVLTGAVPSGLGYSYDPVDETHFQVDGKDRRLEKGIIASRNAAVLVAPDVPEGILDYLGIDMINTLQIPGVHYEYPDILD

SEQ ID NO: 4923 - protein, 161 aa, Lactobacillus buchneri
MKMATEQEALDLLARVGVHYRRVDHPAIWTMDDPNAPKGLPEVKNLLLKDRKSDQFYLYLVDNHRVDFKSLAEQLGLGHSRLKFASEKELESLLGVVSGMVTPLALVHDTDDQVKVLINKSLQTMPEISAHPNVNTATILMSYADLVKVLAAMGKVPTMIE

SEQ ID NO: 4924 - protein, 178 aa, Lactobacillus buchneri
MKRNNKQIELYQDAFDFLLDGDHELVVYGVLKKLHIRRDNPYYEDLVQEGMMAFVEKYIQAINLKKEPGSYLLFIYQGVYWYILDCLRKEMRHRAGIEEPTDEKDLMLELEDKKKSVGFYDAHIISDELRNQLSQEEARYLTLAYDYGMNISEIARECHASRTTVYKWRRGVINQFQK

SEQ ID NO: 4925 - protein, 82 aa, Lactobacillus buchneri
MQKDWMKSNVTYTLVNEDHKKGVKHSFAYVTQNVTAEKVAAFGKILESLIDGNITDAAVSSTDHVELSDAPKAPAAPQAPQA

SEQ ID NO: 4926 - protein, 75 aa, Lactobacillus buchneri
MRKLELVFKTSDEKLKTLSINYANGELNGDTVNKAMTEIAKLKMFDRDGIDPYATPIAAQYRKTEIDKLFDTRGE

SEQ ID NO: 4927 - protein, 62 aa, Lactobacillus buchneri
MGNFPVVGLFVHRLLNVEVKELTYKKLLTNACMMLNGGTCVTELLQLFQLKVISTIMLRYQL

SEQ ID NO: 4928 - protein, 338 aa, Lactobacillus buchneri
MKSSLKKSLFVGLAALGFVAVAGSANANTASAKSYAKVTSNKTLTTDATTRNVNVNGTNALYTKAGTLKGAKTVATKSTLAALKDSKQGQKNWRAYRVATTNRGSVYYKVVSFDGAYRGWIYGGKSTGAFGGGVAQYNTTTDPQASTDTSSSVNSSASINTQGQTTGLSATQKAATYKIANPGTSNDGTEVTYTYPAWTQYKKGRVITDSTPYKDATFKVTDQTTRTREGDLWVKIEATDAANSKANGWILYSGLKQATPATPAENFNADTSVKIAYRDATTGKTLDKTNTWTTASTGTKQGNAVNALVNSAGYNLTQYLVNTGAPSGYTFKNLFRVS

SEQ ID NO: 4929 - protein, 98 aa, Lactobacillus buchneri
MLALHADHLKNVRSVLVDGGYTGTNFAIDVKTNLKATVQVAKRNELHNFTVMPQRWIIERSFSWLDKCRRLWKNCERHLNTSLQMVVLAFLALLLKRL

SEQ ID NO: 4930 - protein, 102 aa, Lactobacillus buchneri
MTNYLNQISRSQFEMIRPELETARKRTAPRTQDLYQVFNALLYLLKTGCQWRQLPHDFPKWSTVYYYYRIWSAKGPGFQESLLEQVLKKLSLPYDPNRIARR

SEQ ID NO: 4931 - protein, 177 aa, Lactobacillus buchneri
LTVDVTPTAAQTKVALYYETTSGSAISPLTANDFAYGYPAMTADQQAKALPDTKTNPATFNVSNYFDDYDLGGNNNAQFINQFRSATNAYTAAPGQLTDPTTGRTTGLSKTGFFGQPLNNGTQRYFYVFDGAATKANNADQQTKGATVKVVMQRFVTTLQLPAQQSNANANTDYIAK

SEQ ID NO: 4932 - protein, 100 aa, Lactobacillus buchneri
MTVLNTPLISVSELKKSPTKAFQRAKWNQTGVFVIKHDQMLGVLLSLRDYDKIMKEIDELRWKVYNAGIEHNMNNNVPYLYTDYEFLGPTANPNPFFHTD

SEQ ID NO: 4933 - protein, 397 aa, Lactobacillus buchneri
MNKRFYITTAITAALGIAAIMAPASAATTTPTTPTSTSSSSTKSKSTNDTTKKTIPAASIVSTEDYDQPLPYHLKGGYVYTTSGLNKTLGSAKDFAKVTWYTYKKAVIDRSAQGKGNSVWYYVKSGSGKQNGWVWRGNLQDISEGTFDIAMKNSDYFKSDKLITMGDSITAGYDGYETLDAGYPTWLARYLNVKVDNAAYNGAFLCDAGDMSTPGDLTTTVEDTNFAKYNVATIAYGTNDYGHTDSTIDQIKNTLDTNIKKMKAENKSLIIYGILPITRYDNNQNSDDVVGQGGYTMNELRSAEAEVYQQNDVPYLNWQDVDPNLITDANHIDRFNDGRLHPAAKTYQLMARDIANFMIDNFPKDQIKKTTSTKKTTTTSKTTATKKTTSTKTAADY

SEQ ID NO: 4934 - protein, 357 aa, Lactobacillus buchneri
MNIKVKCRLTLLFSLMVFGGLGMNTQVNAATDDSTTAAPQIQSVSKADSSVTVNPAEGTSSNVSVDESSDSAAAKIDDSKVNKDSGSSVTTTYGDAKDNQVKANSDSDKDAAKGDSSTAASDTSTDVSQDSSAQKDSSSDQNATSDSSSPTDDAIDTDTDMADVTEDTDSSKVVKPASAKADADADKSSTDAQPTTAASDADAPDDSPAVLESLTQDASKADQAPETLVVPDQPIIESQNVHNDIVGDTFADKVTKSDPKAVKEATAIANNKTKLLTFNAFSDKIYRHVLKTAQKPGTVTTTSGHKVTLTTPVKHVKYTEHDSTGVSETLPVMATLAIIGVAGITFIAFDPLRFLFK

SEQ ID NO: 4935 - protein, 276 aa, Lactobacillus buchneri
MNFRRVIVLDLASLGVGEASDANRFESVGADTLGHIATLEGTDFQLPTLSRLGLGNIRYSDPVVGLPPVEEPIGFFGKIRSQSRENSQLSGLREMFDFQTPTRTTSVIDGIVGLLGVHSILISNYQSYLSNQNQAEVIPVNTDEGGLEQLHQQVIAPNNGLLYFRALGLSEHAQTGNRKGCIDSLKLVDQHLARLMRELYSTDLLIITSSYANDPAMDVTPTREYLPLIAYTSSLPEGKALGIRRTLADIGASIGEIFGLEVSNESIGSSFLGELK

SEQ ID NO: 4936 - protein, 425 aa, Lactobacillus buchneri
MQLSYLLVNILGVAVYLGIAFLFSNNKKGINWRSVGVVLVINLVLAWILTSFSWGRDAVKAAADGFNWLVQVAYQGINFALPNWVTPQFGGTAKSMNFVTSALLPILMIVPLFDTLTYIGVLPWIIKWVGRGLSFVTGAPKFESFFAVEMMFLGNTEALAVSSLQLKQMSAKRNLTLALMSMSCVTASIIGAYTQMVPGQFVLTAVPLNVLNALIITSLLNPVKVTPEEDTVAKMGGSGSSEAAVEAGDVQANGKREPYFSFLGDSILGAGRLILIIAANVIAFVALAALIDKILALFNPWLSLEHILGIIMFPFAWLMGLDVSQAFQFAQFMGMKLVTNEFVVMGKIAGTIHNLSIFPAHYQAQLTVFITSFANFSTTGMIIGAFKGLVDKEKNDLISKNVGTMLLSGILVSLMSAGIVGLFVW

SEQ ID NO: 4937 - protein, 437 aa, Lactobacillus buchneri
LDKLQREEEAANRLPLREAIRDKATVKREIIAGITGFFAISYIIIVNPMILKDAGIPTDLSVFATIISSLIGCLIMGFWANAPVILTPGMGVNAFFTYTVVVAMGLSWQEALAISIVSSIIYVIIAFTKLSEILAKGIPETLKAGITAGIGLFLVEIGLEKAQLIQQGKNSILALGDLTKPATLLALFGLLLTLFLFVRNVTGGFFIGILVTSVVGILFGIKDQASPSVGIGDITRYSGIVAKGNFDNALTIPFVLAVFSMTMILVFESMGLLEGIMPNPGKFKKAFQASSVTSFLSGILGTSPTVAAAESASAIESGGRTGLTSIVAGLMFAVSLFFIPLLAFVPQAAIAPVIIITGALMMNQLSRINMFDFSDWFPAFLIVVLIPFTSSISTGLAFGFVAYPILKIAAGRQHELTVATYVLGFLFLCDLVLSALL

SEQ ID NO: 4938 - protein, 304 aa, Lactobacillus buchneri
MTIKIIMDTDPGIDDAAALTMALNDPEIDLKLITSVAGNVTVDKTTKNAQKIVRFFNKKVPVAAGAKQPLIKEFEDAARIHGESGMPGYDFPEDLPKPLDVSAVEALRETIMSSDEKITLVPTGSYTNVALLFSEYPEVKDHIERIVAMGGSLGKGNMTSAAEFNVFTDPDAARIMYNSGIPITMVGLDITMKALITPDSLSKLEHMNETGKMLHDIIIHDGDNSAEGIAMHDVNTIFYLLHPEAITTKKMWIDIVTDGPAIGETVGDIRGAYHDGKTNANVCVDIDAEAFNKWFLDEVSKINK

SEQ ID NO: 4939 - protein, 428 aa, Lactobacillus buchneri
LSKITDYDSKLIESLFIKYAKVNTRSDANSHTVPTTVGQVKLAKMVEKDLHDLGIKDAKYEPENSYVLGSLPSNSDKDLSAIGFIAHLDTADYNAENIQPQVHPNYDGGEIVLNAEKQIVLSPKEFPLLKHYVGQRVITTDGTTLLGADDKAGVAAIFGALKYFLTHPDVEHGEVKVAFGPDEEIGRGAKRFPAKEFGTEFAYTLDNGQPGQIEAETFNASEAKIDIRGTAVHPGDAYGLMVNAVTLANEIVSALPKDEVPEKSRDHQGFILVTDMTATVGEAHLNLIIREFDTQKYYRNLALLHQIVDGINDRYDSPRVSLKINEQYQNIGDTVKQHPYIVNLALNVYHQLGITPNITPFRGGTDGNAITAKGIPTPNLFNGGDNFHGPYEYVSTEAMTKTAQVVSEIVQEHVREYGHRDESPVKLN

SEQ ID NO: 4940 - protein, 245 aa, Lactobacillus buchneri
MNNDQFKKALLDKGIEVTDQQMDQFDAYFKLLVAVNEHVNLTTITEKPEVYLKHFYDSITPAFFVSQIKTAPLSICDVGAGAGFPSLPLKILFPQLKVTIVDSLNKRINFLTTLVKELNLTGVELFHARAEEFGGKKSEHREQYDLVTARAVARLTVLSELCLPLAKVGGKMVALKAAKAEGELSDAQPAIQLLGGQVSGDFEFSLPVSDEERHIIVIDKVKETPKKYPRKPGTPNREPLDQIKR

SEQ ID NO: 4941 - protein, 254 aa, Lactobacillus buchneri
MTYVIALANQKGGVGKTTTAVNLGAGMASMGKKILLVDADAQGNATSGVGVSKADITKDIYDVLVNEEPMAETIVHTSHEGLDIVPATIQLSGAEIELTPQMARETRLKAALDAVKDQYDFVLIDCPPSLGLITINAFTASDSILIPVQSEYYALEGLSQLLNTIQLVKKHFNPNLKIEGVLLTMFDARTNLGEQVNTEVRKFFKDEVYDTIIPRNVRLSEAPSYGLPIMDYDPKSKGAEKYMNLAKEVLANHG

SEQ ID NO: 4942 - protein, 294 aa, Lactobacillus buchneri
MANKKKLTGLGKGIEALFQDNNVDTSKEDVVDLKVSTIKPNPYQPRHRFDQKALEDLALSIKNSGVFQPIIVRQPDPEVDSFELLTGERRLRASKIAKQETIPAIIRSVNEEQMMEIAVMENLQREDLTTLEEAEAYNMLMSRLDLTQAQVAARLGKSRPYIANYLRILGLPTEVKKMLEDKKLSMGQARTLLSVNNKQELIKLARKSVNESLTVRQLEQAAAKINGNKPAKKKKAPRKSPFVRASEGQLQEKFGTSVSIVNSSRKKGKGKIEIEYTSTDDLNRILEMFGVDLD

SEQ ID NO: 4943 - protein, 61 aa, Lactobacillus buchneri
MYDLNDLVEMKKPHPCGTNRWQIIRMGADIKIQCTGCGHIVMMPRREFDHKLKKILEKAEK

SEQ ID NO: 4944 - protein, 366 aa, Lactobacillus buchneri
MSLTAGIVGLPNVGKSTLFNAITKAGAEMANYPFATIDPNVGMVEVPDKRLDRIQELIPAKKVVPTTFEFTDIAGIVKGASKGEGLGNKFLENIRQVDAIVHVVRAFDDDNITTVSGKVDPLDDIDTINLELGIADLDSVNKRLGKVQRAAKGNDKEAKAELAVLEKIKPVLEDGGSVRSIDFDEDEQKIVKGLFLLTSKPVLYVANIAEDDMADPENSKYFPEIKEFAAKEGAEAIAVAAGPEEEIAQLDDDEKAEFLEAEGVKEPGLNRLIRASYKLLGLQTFFTAGGKETRAWTFKKGTKAPQAAGIIHSDFERGFIRAEVMAFDDLDKLETPAAVKEAGKLRLEGKDYVMQDGDIVEFRFNV

SEQ ID NO: 4945 - protein, 247 aa, Lactobacillus buchneri
VSSNDDTQRNANSKARQKNAQVHQDRDHAAKIVHSQFDNIGLTKRNAEYMFKFNQALGATKLSADKKNEAVQTMVQELLEGQKSGKTARNMWGTVDQKIETTVHPPARPADPRRDYWKNAGYNAVLFLTIFFLMYGVLWFLPTKGGQHSPMMGITGILISAAVAGLGIPIVTMMFTPGVKHRFSIWIRIILVVLFLIVWMGIFTLSSILPPVLNPVLNPIVYIVLGVLSGVAAFFVKRRFNITGGVF

SEQ ID NO: 4946 - protein, 383 aa, Lactobacillus buchneri
MVSWDEKFGKKGLTFDDVLLIPAASDVLPNDVDLSVQLADNLKLNVPFLSAGMDTVTESKMAIALAKLGGMGVVHKNLSIEDQAAEIAKVKAVKKTADTPKAAVDDNDALLVAAAVGVSSDTFDRASALLKAGADAIVIDTAHGHSAGVLRKIAEIRDHYPHTTLIAGNVATAAGTEALFQAGVDVVKVGIGPGSICTTRVVAGVGVPQITAVYDAASVARKWGKAIIADGGIQYSGDIVKALAAGGSAVMLGSVFSGTDEAPGEVFEDHGKKYKSYRGMGSVAAMEQQHGSADRYFQGGVSEANKLVPEGIEGETEYKGSINDIVFQMVGGLRSGMGYTGSATIKDLNDSAQFVQITNAGLRESHPHDVNITKEAPNYKPED

SEQ ID NO: 4947 - protein, 272 aa, Lactobacillus buchneri
MILLATLIIKAGGIPLDSQNILERPFITITNLIWSFDHATNRVNILLVKRDNDPYNNYWALPETFMRSQESAEETALRLVREKIGMDLSGSHTEQLATFTNPLRTPGDRALSLGYMTFLPDKPQLKAGYGASDARWFTMGYTDKTYTFSDSDHIFQSTDCPVQRTYYAEFGGTNADPDKHLAFDHEWILKVACERIRNKLDYQPNILLILGRQFTLKDARRVYSPFLKLRVEQIDNSNFKKSHQDLFTDIGSSEINGPGRPARLYKLAHLRA

SEQ ID NO: 4948 - protein, 475 aa, Lactobacillus buchneri
MSNLSMLTDLYEFSMANGYRQTITDEQGVFDVFFRKVPDNGSFVIAAGLEQAVKALQNFHFDDSDIEYLRSLNLFQENFLTYLKDFKFDCQVSAIPEGTPVFPREPLLTIRGPLLQTQLFETMILNILNHQSLIATKARRITYSADGRPVMEFGARRAQGPDSATYGARAAVIGGCSSTSNVLAAEAFGIPAAGTMAHAWIESFPDELTSFEKWAEVYPDNAALLVDTYDVLKSGVPNAIKVFKELKANGHKPVGIRIDSGDISQLSKAARKMLDDAGLPEVKITASNALDEHVVASLLNEGAPLDNFGIGEKLITSASSPVLSGVYKLAAVIENGKMIPKIKVSASREKVTLPGLKQVYRLYQPGTDKAFADVIALSDESLDQPITVVKANPLATKREQRIEKFDAKPLQNEVLAGTDLKMAFPSVFDIQKYSKQKLTEIPAATQRLVNPDEFPIYVTTKLAALQESLLEADAQ

SEQ ID NO: 4949 - protein, 589 aa, Lactobacillus buchneri
MYYSNGNYEAFAKPKKPAGVANKSAYLIGSGLASLAAAVFLVRDAQMPGENIHVLEELSLPGGSMDGIYNPDKGYIVRGGREMEQHFETLWDLFRSIPSLENPDVSVLDEFYWLNKDDPSFSHARAIEKRGQRIPTDGKFTLSRKAVEEIAKLVMTPEDQLDNLKINDVFSDDFFKSNFWLDWSTMFAFEPWASAAEMRRYLMRFVHHVGTLPNMSSLKFTKYNQYESLIKPMVKYLEDRGVSFQFNTTVENVIVDTTDGKKTATKLEIIEDGVEKGIDLTPNDFVFITNGSITESTTYGDNDHPAAKEHAVGAAWTLWENLAKQDPAFGHPKKFYQNIPPANWVISATTTFTDDRIVPYIERITKKDPHSGQLVTSGPVSIRDSNWLMGLTVSRQPHFAQQKPNELVVWTYGLFSDLPGNYVQKKIADCSGIEICEEFLYHIGVPVDQIEEIAQSANTIPAHMPYITSYFMPRQAGDRPLVVPAGSTNLAFIGNFAETKRDTVFTTEYSVRTAMEAVYQLLNVDRGVPEVFDSSFDIRSILSSVYYLNDEKSLLELPLTPPEKMVIQRLLKHVKGTYLEEILKDQKLI

SEQ ID NO: 4950 - protein, 75 aa, Lactobacillus buchneri
MKARSVICGGLLFAVGVAAGMHVDHWAHEMHHMHHHGHGPHMGPGHFHDQPFEDIGDLPYVRETRTDGGGLRNEV

SEQ ID NO: 4951 - protein, 172 aa, Lactobacillus buchneri
LGKTIRQLSEELRLSKQAINQRINSINGFRSKHTHKVKNHLEIDNQGVKMLANFDKQKRQERQPNRQAENDKDKNIDHILLKQLDVKDQQIANLQQALDQQQKLQIATVAENHRLKEHVQKLSGLLEPSSATQQQSNDKDDTLSNSDNSRHIKDKKYKNKPNKSWWHFWKTK

SEQ ID NO: 4952 - protein, 476 aa, Lactobacillus buchneri
VNDKNEIIKKPSDESGNQLKVVSNFEIFLKQLGLPSDNILASDEDKQIVANNIQSLILNIPPSQRENASYLAKFVSSVAIGRFDSALNDLWNEVVNQLRKSVVLYGIDIFFDTAVPNKDRDDYSKEEDLSSIKDRTLLDVCLKLEILSDIVYKKLVYILDMRNNIGGSHPNNGTINAYELLGWLQVSVQEVISVKPSEGAIKVKKFVSNLKKQTSEFSETDVQVIKLSLSRLSTVLSGNLLKTLFGMYTDPKISNEVKINIIKFAPTIWNLATNQVKYDLGAKLETFSINLETERDSFGQQFFASVGGNKYKTPTRRSLEISNISADLLTAHFSWDNYMGETPKARQLMSYIDDSSNIPIERQEDLIKTLLICRIGKEVNYLHGVSDGGRPYYNKFFKLLNSDQIRIMLKLIQDQDILINLSTTIRRENFLEILEMLPKSLTDERVQETLDYLKQGSLSFDKKIRDSRFKDLVKGF

SEQ ID NO: 4953 - protein, 118 aa, Lactobacillus buchneri
MKKLRFKPRATFNADLKRLASLDKSIIDEVRAAIDLLLEQQQLPPEFEDHELNRRMSGYNEFHLRDTPKNKTPSETNDVLVVYTIDTDELVLIGIRVGSHDRLFPGQNRSKRYRKNDE

SEQ ID NO: 4954 - protein, 92 aa, Lactobacillus buchneri
MTLALTQSDFRANLKKYLDQVNDEDETVYIARSNSRAVAIVSQEKMDWLERALKAKEGSLEYAIARDQLIKRHVLPDDEIVESNDDYWGQFK

SEQ ID NO: 4955 - protein, 195 aa, Lactobacillus buchneri
MQQVVLPIKDSNVLKEVQDTLLNNFKAGRRNYTVFQVGKATLLRVSDVMRLKQADIFNPDGSIKQNAFIHDRKTGKPNTLYLKPVQTELLLYRQWLLDHQLDSEWLFPSIQHPERHITEKQFYKIMSKVGDLLGINYLGTHTMRKTGAYRVYTQSNYNIGLVMNLLNHSSEAMTLAYLGLDQASTETMLDKIDFC

SEQ ID NO: 4956 - protein, 119 aa, Lactobacillus buchneri
MDLDFETNKYDLFDDWHQNKTKQAFTQKLQQQAQIEKTQLPQLLSREDLKIRWQMNSRQSVHQVASKPDFPQPVFAFNHGKTPLYLATEIQIFEINHPWVITPGARLAYSHWILRNVID

SEQ ID NO: 4957 - protein, 59 aa, Lactobacillus buchneri
MSKKIWIVIFRYLLAIGLFLAYSAIFDNQDHDLIRSTLVFAICLGLAIIPFSHKTKSKK

SEQ ID NO: 4958 - protein, 193 aa, Lactobacillus buchneri
MKYGYARVSTTDQKLANQIELLKLAGAEKIFQEKFTGTTTERPEFQKLLRALKTGDTLIVTKLDRFARNTREALAIIQELFKENVKVNILNMGLIDNTPTGQLVFTIFSAFAQFERDMIVTRTQEGKLYAKQHDPLFREGRPKTYSDEQIRFAYELRKQGMTYKMIERKTGISKRTQQRRFKLIEKPSDTSKI

SEQ ID NO: 4959 - protein, 823 aa, Lactobacillus buchneri
MAKKILIIGGVAGGATAATRLRRLNEDDEIILFDKGEYISFANCGLPYYIGGTIKERDSLMVQTVEGMEKQYGLDVRNFSDVTKIDPEKNTVTVHNTQSGETYDESFDELIISTGAKPIVPKIKGLADAKNTFTLRNIPDMDQIKKYIADHNVQTATIIGGGFIGLEMMENFKQLGLNVQLVEMSSQVMPNLDFEMAQQLHSQINLHNVNLYLNDGLAEFQNDGKKLILQSGKELETDMTILSIGITPANDLAKDAKIELGFKNAIKVNKQLQTNYPNIYAIGDVIQVNNLVDGSETNIPLAWPANRQGRLVADIINGIPAEYPGTQGTSVAKVFELTAASTGDNEKTLQRQNIPYHVIHIHPNSSAGYYPGASPINLKLLYNDDKQILGAQAVGTKGVEKRIDVISTAMRFGAKVDELSSIELSYAPPYSSAKDPVNMLGYVADNEINHRTKTIEWDQVDRLVDEKATIIDVRNDFELTTGKIPSSKLIPLNQLRDRLNELPKDKTIYVYCQVGLRGYNASRVLANDGFDVVNIDGGFKTYKIAKYEIKNKPFSKNKVKTSSGSSSNNLKTLQVDACGLQCPGPILKVKQHMDKMDDGQKMVVKASDFGFSADIESWAKNTGNKVLSNDIDGDTVVATVQKGQGASTPVKQDPELAAELALNDGQLHETKEGATMVVFDGDLDKALASLIIATGAAAMGKKVTMFFTFWGLNVLKKNKVKKHGVAKMFDMMLPSGADKLPLSTMNMGGLGSKMIKSVMKKNNVDPLPVMIRKANDLGIKFVACTMSMGLMGVKKEELYSFVEYGGVATYLGDTENSNLNLFI

SEQ ID NO: 4960 - protein, 91 aa, Lactobacillus buchneri
MDTVRSEEETKKVINRLSRAEGQIRGIQKMINDDKDCMDVMTQLSAVRSSIDRVMGMVVANNLKDCVENPEGDPAAQSKKLKQAINMIIKK

SEQ ID NO: 4961 - protein, 174 aa, Lactobacillus buchneri
MSKYTLEFKMKIVNEYLEGNYSYKDLASMNGLNHSIIVRWVQRAKINGMSALASKKAKRSFSGQDKVNILDYMLTNGLSFNETGAHFDVEPSLIYQWKRKFDEHGIDALQAKRGRPSKQMIKKKAIPKNKLDALKQENLELKQQLQTAKMELAVSKKLEALAIKKRRRKNNLPK

SEQ ID NO: 4962 - protein, 232 aa, Lactobacillus buchneri
MHVELLKMQFTYDDDTVRKIMRSMDLMPTCYWIRSGKFSSYRGEQGKVAKNIVREKYVIKQKKSFKFVVEQPYDVLTTDVTQINILGTKLYLSAVIDMYSKEVLAFDIRNSPNAAQVIACLDQLKEVLPEDVTPVLHSDQGTLYQLDGYQNKLKEIGLSQSMSRKGNCLDNAPMESFFSLAKREFIWRKNFKSVEEFKQAFAKYISRFNNVRISRKSKGLTPVEIRNQALTA

SEQ ID NO: 4963 - protein, 132 aa, Lactobacillus buchneri
LCKRIKRFLNCIELGNELTTEIIATLVQKQDLDEVFRHHLEIAINQLLQTELAAFLGYERHSYAGINTRNNRNGSYERSFDTKYGQLNLTIPRDRNGIFHNHILPAYGRHSDSLETTVIQLYTKGITTTEIA

SEQ ID NO: 4964 - protein, 704 aa, Lactobacillus buchneri
MANFYENDPFFNNDMDDVFNQLFRRMDNQNSERARYLVNGKSLTPDEFAQYRATGKLPQNNKTIEVSKDGKQAVKKGGILEKLGTNLTEQARDGLLDPVIGRENEIQETAEILSRRTKNNPILVGDAGVGKTAVVEGLAQAIVAGKVPETIQDKEIYSIDLSSLEAGTQYRGSFEENIKQLVKEVKAAGNIILFFDEIHQIIGTGATGGEDGGKGLADIIKPALSRGELTVIGATTQDEYRNTILKNAALARRFNEVVINEPTAADTLRILQGVKKLYEKHHHVVLPDDVLKAAVDYSIQYIPQRTLPDKAIDLIDMTAAHLAAKNSQTDVETLDQRVKKLEAAKEAAVKSEDFKKAADIKKSIEETKQKIKETDQKEKITATIDDVAQSVERLTGIPVSDMGANDIEHLKNLDKRLKSKVIGQDEAVEMVAKAIRRNRAGFSEGDQPIGSFLFVGPTGVGKTELAKQLALDMFGNENAIIRLDMSEYADRTAVSKLIGTSAGYVGYEDNANTLTERVRRNPYSIVLLDEIEKADPQVLTLLLQVMDDGRLTDGQGNVISFKNTIIIATSNAGFGNEALSGDKQRDQSLMDKLAPFFRPEFLNRFNGIVEFSHLTKQDLSQIVDLMLADVQKTLAKKSIKLEVTKAAKDWLMEQGYDEAMGARPLRRVIEQQIRDKVTDFYLDHLDVKNLKADLVDGEIVISAA

SEQ ID NO: 4965 - protein, 43 aa, Lactobacillus buchneri
MKTNKVTKFLFRRQIIGLAEMYLFLFAAFLVLPFLFSAISEAV

SEQ ID NO: 4966 - protein, 293 aa, Lactobacillus buchneri
MSVLEVSHVSKSFGSKHVLSDINLSFDGNKIYGLLGRNGAGKSTLLSIITDRIFADSGEVKIDSEDVSDNDSKLGLMYLMSEANLYADGWKLTQILKDSESLYGGFNHELADHLIKEFGLDINQKFGKLSTGYNSIFKLILALCLPVKYVLLDEPVLGLDANHRELFYSELIQSYSDNPRTFIVSTHLIEEVANIISDVIVLDQGRVILNQPVEDVLAKTHSVVGPEKDVEQYTKGLNVIGHDMMGTIRANYVYGDLDDRILPDTVQLSNFDLQKLFIFLTNQYEGSAKNEDK

SEQ ID NO: 4967 - protein, 122 aa, Lactobacillus buchneri
MKFEFNSSEPIYRQVAEQIEDAIASGGFAEGDQIPSTTEISKEFHINPATVLKGMNIVAAKNLIEKRRGLGMFVQAGARQRILAEKRNGFFDEFVENLVREAQNLDISEDELLNLVKRGYQQ

SEQ ID NO: 4968 - protein, 608 aa, Lactobacillus buchneri
MLFKISISGIKARWKDYLVLFSGMIITTAIFYMFEAISTNDKFTTSSAVGQNAKIVFIFGSILLAIITLVYVFYANNFLMSMREHDYGLFMMLGAKSGVISKLIILETIAIGLISTVVGIVIGIGFTQVLSHFLASLIHMSLTNFSAFYMPAVIATIILFAILFLVAGFLNARTFTKTSALQLLRSGQQSDWQQPKALTLGVQAILGVVLLAGGYYAMYDIQKLKVMSIPIALITIVLGTYFVFNSFFVMLLQAFQRSNMSTKGLNSFTLAQLKFRIRDYTKILSVVSLLFALSLGAITVGTGFQHMVPKLASGNGYYSVAITNPNQEMRSLVGQIQDKSTVTYQQKVDPTTKRVYYRSDQLQRQPLKYAAFVSRKTLASKAFTAKISQFKRSDSLAYQELWGLQVPTIKAYQIKVVSSQAFNQINAKTNQLLLVRANDMDAAATPLTKITNIQSTQYGYRNGEQVGGSFTMYQSLKSVFGSLEFMGIFLGIAFLAMLASCLMFKILSGAASDKIRFDMLNKIGTRRSVLNHSIVVQILGLFALPGILGIVDVAFGLQMFAKSGLLMGGAYQTFGLTTVGFLVLYLIYFALTVLIYSRIVVPKTKVER

SEQ ID NO: 4969 - protein, 250 aa, Lactobacillus buchneri
MTTKIVQTEDLHKTYDKDSAKPYEALKGISLSVNEGEFVGIMGASGSGKTTLLNILATLDQPTSGSVEIDGQDVTHLTANQMADFRSKKLGFIFQDFNLLETLTAQENIALPLSLQNAKAATIQTAVKEAASKLGIDDLLSKYPTQLSGGQKQRVAAARALVSNPSIIFGDEPTGALDSTNARELLDTLTNINQQGVSILLVTHDPFSASFCKRILFIKDGKIGDEVDAGDKPRNEFYQEILEKLGTFEQ

SEQ ID NO: 4970 - protein, 314 aa, Lactobacillus buchneri
SPFHDMAINBANDFAMILYPRTEINLKEKNVFHVNGYVGLIIALILLGVGGYLLWIGGEGSSIGSIVFGTIIIVLDLLFASSLTIIQPNEAKVLTFFGRYIGTIRTSGLFMTVPLTSKQTISLRVRNFNSSIIKVNDSKGNPVEIAAVIVYKVVDSAKAIFSVEDYEQFVEIQSESAIRHIASQYPYDSFDDSTDKLTLRGNATEVSVALQKELQDRLDVAGLQIIETRLTHLAYATEIANAMLQRQQATAILSARKIIVQGAVAISEDAVSQLQKDLGSSITDEQRMKMINNVLVSIITERGTQNVINTDNLD

SEQ ID NO: 4971 - protein, 276 aa, Lactobacillus buchneri
MKKKLLSLFAVVFTAFLLVGCSSSSNSSKKTTTLKIGASAVPHAQILRHVAPELKKEGVNLKITTFQDYTMPNKALANGELDANYFQHVPFLKLWNKQNHGTLVNAGGVHLEPIAVFSKKVKRLQDLKKGATIIVSSNVPDYGRILQIFKDAGLITLKKGIDITSANFSDIASNPRHLKFKHSYEPKLLPTIYKNGEGDAVVINANYAVGAGLNPIKQSIAIEKRNSPYVNIIATRKGDQNKPAIKKVVKVLQSTKTQKWILHHYKGAVLPEKNVK

SEQ ID NO: 4972 - protein, 231 aa, Lactobacillus buchneri
MANSTGFKSYFQFHNVDWGSMMSATWETVWMTLLSMVAIVILGIILGLILYETRNKPGIGYRILNWLVGLFVNIFRSIPFIILIILLLPITMKLAGTIIGPRAALPSLIISAAPFYARMVESYFREVDSGVLEAAESMGATTWEIITKVLLPESKPALIAGATVTTISLIGYTAMAGAIGAGGLGNLAYQDGFQASNNTVTLVATVIICLFVFVVQFVGDVFVKITDKRTL

SEQ ID NO: 4973 - protein, 344 aa, Lactobacillus buchneri
LIRFKDVSKQYSTKDGGLTAVNDVNIEINDGEIFGIVGYSGAGKSTLVRMLDGLEAPSTGEIDINGTDVSKLHGSQLRKQRQKIGMIFQHFNLLWSRTVLDNIALPLEIAKVPKAKRKQRAEELIKLVGLEGREHSYPSELSGGQKQRVGIARALANEPTILISDEATSALDPDTTNEVLDLLLKINKEMNLTILLITHEMHAIAKVCERVAVMDSGKVVETGSVFEVFRHPQQEITKKFVSEEFTPQQSDNTMTLDELVKKYPDGQIIRLIFHGPQAELPIVSDVVKRFPELTISIISGAIHQTQEGALGSLDLQFVGDDNQINDALEYLKKMRVGTEVIHHG

SEQ ID NO: 4974 - protein, 98 aa, Lactobacillus buchneri
MMDTKYYWTEENNGEVTVGLTEAGKNELGNITFVSLPKVGAQLTTSDTLLNVEADKAVSDIPSPVAGKVTAVNSNAVNDPSVLNGTDKATSWIAKIKK

SEQ ID NO: 4975 - protein, 400 aa, Lactobacillus buchneri
LDSSRRTSKDDQSRIDWGIIFCVLMLALIGLASIYVAATHDSSSTSVMRQVVSQLVWYVIGIIAVVIIMQFDSEQLWKVAPITYWLGIALLASVLVLYSRTYYINTGAKSWFSLFGLTFQPSEVMKPAYILMMGRVIVQHNDNYPIRTVRSDFLLIGKMLLWTVPVAVLLKLQNDFGTMLVFFAILGGLIIVSGVTWRIILPAVITIFGFAGTILALVIPESGRHLLEKFGFQAYQFARVDTWLNPSADTSNQGYQLWQSMKAIGSGGIFGTGFNQSHVYVPVRESDMIFSVIGENFGFIGSCILILLYFLLIYQMIKVTFDTRNVFYAYISTGVIMMILFHVFENVGMSIGLLPLTGIPLPFVSAGGSALIGNMIGIGLIMSMQYHNKSYMFGEDKEFS

SEQ ID NO: 4976 - protein, 74 aa, Lactobacillus buchneri
MSKANKSINVEIKDRTDQNGESISELFIGKKLIGSIKQLSETKFQAVNTHDEAFHVKTFDEGVTQLIKDFHLHH

SEQ ID NO: 4977 - protein, 91 aa, Lactobacillus buchneri
VKNILISLVHGYQRFISPLFPPTCRYYPTCSSYMVTALKKHGAFKGAVMGIARILRCHPFVKGGYDPVPDHFTIFRNKDARDEYRKSMHLK

SEQ ID NO: 4978 - protein, 336 aa, Lactobacillus buchneri
MAKDIGIDLGTANVLIYVAGKGIVLNEPSVVAVDTRTGKVLAVGSEAYRMVGRTPSNIRAIRPLKDGVISDFDITEEMLTYFINKLDVKGFMSKPKIMICAPTNVTEIERNAIMQAAEKAGGGQVYLEEEPKVAAVGAGMDIFQPRGNMVIDMGGGTSDIAIISLGDIVASKSIRVAGDKMNTEIASYIKQKHNLIIGEHTAEKIKIEIGTAKKDDSDVKTLEVRGRDAVSGMPRAVTIDSNEIAEAINDTVQLIISGAKEVLEVIPPELASDIVDRGIMLTGGGALLRNIDQVIADALTVPVIISENPLDNVAKGAGILLEHYIKNPKLKAKDQK

SEQ ID NO: 4979 - protein, 436 aa, Lactobacillus buchneri
VEKIIVHGGKPLRGTVHIDGAKNAVLPIQAATILAGEGKTVISNVPLLSDVYTMNKVLRFLNVKVDFDEANNEITFDASKDISSEAPFEYVSKMRASIVVMGPLLARLGHAKVALPGGCAIGSRPIDLHLKGFEALGARIEQHDGYVEAYAPDGLTGAEIYLDFPSVGATQNIMMAATLAKGKTVIQNAAREPEIVDLANVLNKMGAKVVGAGTEQIRVEGVPELHGTDHAVVQDRIEAGTFMIAAAVTRGNVMIDGAIPEHNKPLILKMREMGVTINESDDGIQVIGHDNLKPVDVKTMPHPGFPTDMQPQMTILQLTANGSSSMTETVFENRFMHMEELRRMNAQYTISGRTVIMDGPTDFNGAEVAATDLRAAASLVIAGLAASGYTTVTNLQYLDRGYHDFHKKLANLGAEIKRVNVEDDSIVLNQSLKNRS

SEQ ID NO: 4980 - protein, 76 aa, Lactobacillus buchneri
MNTIGIQALITLITYILFIAMAFWTVQEIHIERYIPLRAMPGKLLIVLVSIAIGYACSSFFLSVIFNIQNLMYLIK

SEQ ID NO: 4981 - protein, 138 aa, Lactobacillus buchneri
LADNSVITVSIVTPDGKVYEHTASMIVVSTQSGQLGIMANHVPIIATLDVDETRVKYDDKEDDIAVNGGFIEFSNNVATIVADSAETQNDIDIARAEKAKKNAQQRIAEARQRQDKAALDRAQVALRRAINRINVAGK

SEQ ID NO: 4982 - protein, 478 aa, Lactobacillus buchneri
MSSTGKVIQVIGPVVDVEFSLDDKLPEINTALAIHVSEDKNLIVEVALDLGDGVVRTIAMDGTDGLRRGMDVENTESSISVPVGKDTLGRVFNVLGDPIDGGPEFGPDAERWPIHRDAPKYDQLNPSTEILETGIKVIDLLEPYTRGGKVGLFGGAGVGKTVLIQELIHNIAQGHNGISVFTGVGERTREGNDMYYEMKGSGVLEKTAMVYGQMNEPPGARMRVALTGLTIAEYFRDEEGQDVLLFIDNIFRFTQAGSEVSALLGRIPSAVGYQPTLATEMGQLQERITSTKKGAITSIQAVYVPADDYTDPAPATTFAHLDATTNLERSLTQQGIYPAVDPLASTSSALDPAIVGQEHYEVATEVQHVLQRYRELQDIISILGMDELSDEEKTVVNRARRIQFFLSQSFSVAEQFTGLPGKYVSVQDTVKGFKEILEGKYDDIPEDAFRNCGPIEDVVEKAKAMKQESDNEKQRAAN

SEQ ID NO: 4983 - protein, 303 aa, Lactobacillus buchneri
MGASLNDVKHRITSTKKTRQITNAMEMVSQAKLNQIQKHTVSYAEYASQIKSVVLHLAQSHILDGLNKSSGHSADQDQSKTKRSAYLIITSDRGMVGSYNSNVIREANEFIEKHSGSNDYQILAVGGTGSDFYKKRGDNVSYEYRGVSDVPTFNEVRQIVKMVTSMYDKGQFDELYVCYEHFVNRLISRFRAEKMLPIDDEAIASAASQDIEVKPMSAEYDVEPSEKEVLDVVLPQYSESLVYGAILDAKTSEHASSSTAMKSASDNADDLISSLELQYNRARQAAITTEITEITGGQEALSH

SEQ ID NO: 4984 - protein, 518 aa, Lactobacillus buchneri
MSIKAEEISALIKQQLQGYKNELDVQETGIVTYVGDGIARAHGLENALSGELLDFGHGVYGMVQNLETNDVGIMILGDDTNIREGDSVKRTGRIMEVPVGDEMIGRVVNSLGEPIDGKGPIKADDHKAIEHKAPGVMDRQSVFEPLQTGIKAIDSLIPIGRGQRELIIGDRKTGKTSIAIDTILNQKGQNMKCIYVAIGQKQSTVRTAVSTLEKYGAMDYTTVISAGPSEPASLLYIAPYAGATMGEYFMHKGQHVLIIYDDLSKQADAYRELSLILRRPPGREAYPGDIFYTHSRLLERAAKLSDKLGGGSMTAMPIVETQAGDVSAYIPTNVISITDGQIFLDADSFYSGVRPAVDAGTSVSRVGGDAQVKAMKKVSGTLRLDLASYHELESFAQFGSDLDEATQSKLNRGARTVEVLKQPLHSPISVEKQVVILYCLTHGFLDKIAIDDILRYQTEIFDYFDQNHKDLLEDIAKTGQLPDTSKMDAAIKDFEQTFQPSKHDDQQSNDDQSAASND

SEQ ID NO: 4985 - protein, 180 aa, Lactobacillus buchneri
MTLDDMSASKKYAKAMFEVLSDSNELESGYADLLELRKIFAANPRLIEILDDIRVSDDEKKSLLAPITQNASDFINNFLKVVASYRRFPQVLSIIDQFQKVYEDDKKIVRAQVVSATPLDDDQLDRLATAFEKRVGAVKAIFDTKVDKSLIGGIVIRSSDVIIDGSVQTRINKVKELLLN

SEQ ID NO: 4986 - protein, 169 aa, Lactobacillus buchneri
MFSYSVVGAQLYVGDMLFVMITFLVLMWLVKIVAWKPITKMMQDRSDKIVNDIDSAKESRTKAAELAQKRQAELDKTRDDANTIINTAKQNGQRQQEQIVEDARNEASNLKSSAEKDIEQERQEALANSRKDVASLSVEIASKIISKELNEDDQKGLVDSYIEGLGKQK

SEQ ID NO: 4987 - protein, 70 aa, Lactobacillus buchneri
MGAIAAGIAMAGAAIGGAVGDGILISKMLEGMARQPELSGQLRSNMFIGVGLVEAMPIIAFVVALLVMNK

SEQ ID NO: 4988 - protein, 236 aa, Lactobacillus buchneri
VEGAASTFEFLGLTFNVGNLISILLAACVVFVLVYALSRHLTIKPGKAQNVLEYAVDFTNGIVRSSISGETSRTLGLWGFTLFMFIIIANLQGLFLHIDISGVTYVKSPTSDPVVTMTLSLMTLTLAQFLGIRQLGYKGHFQNYLKPFVFFLPINLFEEFTNFLTLGLRLFGNILSGEMLLGIILGMSHGGAVMWVVSFILELAWTGFSVFIGCIQAYVFVTLSSVYISRKLELED

SEQ ID NO: 4989 - protein, 209 aa, Lactobacillus buchneri
MGKFQVMDHPLIQHKLSMIRDKNCGTKEFREIVNEIATLMAFEVSRDMPLEDVDIETPEGIAHAKQISGKKVAIVPILRAGIGMVDGMLDLIPAAKVGHIGMYRDEKTLEPHEYFVKLPSDIGQRQIFVVDPMLATGGSSIMAIDALKKRGASNIKFVCLVAAPEGVKALQKAHPDVDIYTAALDEKLNDKGYIVPGLGDAGDRLFGTK

SEQ ID NO: 4990 - protein, 413 aa, Lactobacillus buchneri
LNYDYKQQDPELWDAIANEENRQEHNIELIASENIVSNAVRAAQGSVLTNKYAEGYPGRRYYGGCEYIDVVEQLAIDRAKELFGAEYANVQPHSGSQANQEVYAAFLKPGDRILGMGLDAGGHLSHGAKVSFSGKLYDSFSYGLDPKTQLIDYDEVARIAQIVQPKLIIAGASAYSRIIDWQKFRDIADSVGAYLMVDMAHIAGLVAVGLHPSPVPVADVVTTTTHKTLRGPRGGLILAKEKYAKKLNSAVFPGSQGGPLEHVIAGKAAAFYEDLQPAFKEYGEQIIKNAKAMADVFQNSKSVSVLTGGTDNHLMTLNLTQTSLNGKELQNLLDTVHITTNKESIPNDPLPPSKTSGLRLGTPAITTRGFKEDDAKAVANLILQVIDKPNDDQNLKDVAAKVEQLTAAHPINQ

SEQ ID NO: 4991 - protein, 340 aa, Lactobacillus buchneri
METLILKQQQLDQAADFIRQGELVAFPTETVYGLGADATNETAVKKVYAAKGRPSDNPLIVTVSDIAMVEKYTQPFSDDAKALMAKFWPGSLTMIFKLKPNALSKAVTGGLDTAAFRFPKNQATLDLISKAGVPIVGPSANTSGKPSPTTAQHVYHDLNGKIAAIVDDGPTTVGVESTILDMSVATPSILRPGAVTKEDIEAVIHRPVIDELHHVGAKQTPKAPGMKYKHYAPNAQVYIVDPDDDWHDVVAWIKQHPQPIGVMAFDDVIKTINWPDNVDVISLGNDARTAAHDLFAELRDFDNHPAYKIIFTQGIDPKGIGEAYMNRLNKSAGQMHFKQL

SEQ ID NO: 4992 - protein, 282 aa, Lactobacillus buchneri
MNNQENVTYFEARKWASFRIKESNDIDMYDVDFLLEKLFKMSATDLLIHYHTQMPDKQWQVFQDAIGQLLKGVPPQYIVGEADFYGLSLKVTPDVLIPRVETEELVDWILAENSDSELKVLDIGTGSGAIAIALKHSRPHWQVFASDISLPAIEVARQNAIANHTAIHFMASDVFAAIDESFDVIVSNPPYIAKDEQTYMDASVIKSEPDLALYAKDQGLAIYKQIAADAESHLTSKGRLYLEIGFQQQSAVTEIFQAAMPNARVIAKHDVSGHQRMIQVKK

SEQ ID NO: 4993 - protein, 360 aa, Lactobacillus buchneri
MDEIFDKLQSVVDRYDELNELISDPEVIADTQKFMKLSKEEADLRDTVAAFKKYQKVSKQLDDDKEMLREKIDDDLEAMVKDEITSLTDEKDKLEDQMKVMLLPKDPNDDKNIIMEIHGAAGGDEGSLFAADLFSMYSKYAERQGWKVEIIDKNETEVGGFKEIVLMITGDKVYSKLKYENGAHRVQRVPVTESAGRVHTSTATVGVMPEEEDVDIDIDPKDIRVDVYRSSGAGGQHINKTSSAVRMTHLPTGIVVAMQDERSQQQNRQKAMKILKARVYDYYAQQEQDQYNAERKSAIGTGDRSERIRTYNYPQNRVTDHRIGLTLNKLDRIMNGELDEIIDALIVSDQAKKLENLTNE

SEQ ID NO: 4994 - protein, 221 aa, Lactobacillus buchneri
MRVLANFLIIIDFQNFFCIMEEKLLRKKVDILAQLFYRYGAMNSGKTIEIIKVAHNYEEQNKSVIIMTSALDTREKQGMIESRIGLERKAEPIREDTNVFDLVQELNPHASCILIDEAQFLKKKHVMELARIVDELNVPVMAFGLKNDFQNNLFEGSKYLLLYADKIEEMKTICWFCGKKAIMNLRFHNGEPVYEGEQIQMGGNESYYPVCRKHYYNPPIK

SEQ ID NO: 4995 - protein, 448 aa, Lactobacillus buchneri
MSLKSSIATAAGKSSYWFLHTFFKGGSSLPGKITKRLDPEILATLGRDYDVIVITGTNGKTLTTALTVQVLKEKYDNILTNPTGSNMEQGIITTFLHAPKSKGKRPLAVLEVDEANVIMVTKYIKPKAFVFTNIFRDQMDRYGEIYTTYNKILNGVALAPNATIIANGDAPIFHSKQLPNPIVYYGFDNQKDGDIKATPNTDGVLCPQCQHVLHYHFISYSNLGKYFCPNCGFERPELNFALNKINDLTPKSSTFEIDGEPIKIGIGGVYNIYNALAAYSVGRFMGVSPAQTKKAFEKGKQIFGRQEEINVDGKLVTLILVKNPVGLNQVIDMISTDKDPFTFIGLLNANYADGIDTSWIWDGDFERLPKMNIKQFITGGERYKDITYRLQVAGVDPKKHLVEPDLDKVVEMIPKAPTKKVYILATYTAMLHLRKVFAAKGFIKGGMD

SEQ ID NO: 4996 - protein, 234 aa, Lactobacillus buchneri
MTYSLNVCHLYGDLMNTYGDLGNILVLKYLANKMGVDLTSEVVSLDQPFDPDKYDIVVFGGGQDFEQSIISKDIQTKKQALTDFIEDNGSVVAICGGYQLLGHYYIGANGEKLMGIGALDHYTDKQKDHRFIGNVVIENEETGEKYHGFENHQGITFLGRGERPLGKVLEGHGNNGQDKTEGAIYKNVYCTYFHGPILARNNDIAKHVLMNALKRKYPDADLTAQENLKVGATF

SEQ ID NO: 4997 - protein, 338 aa, Lactobacillus buchneri
MDYPNTVTRIHQFVDAGIVPGVSYGIIDRDGLQTDVFGQQELLPERLPLHSGELYDLASLTKVIGTTNLILRLLASGKISLDDSLTKYFPQWQSPQVTIRHLLTHTSDIVGYIPNRNQLPKSELMPALLALKSGSDIGKVVHYQDYNFIFLGWIASRVMGEPVQQLISEFVLRPLELNQATFTPDQVNNVVPTELIPSKGLIRGTVHDPKARILGPDCGSAGLFAPLSDLIHFSKWLLGDIRYPNFLPADWVDQLFVDQTPGHMKNRSFGWILRHYNGHPYILHTGYTGTLIVVDRYSHKALVFLSNRVHPDPSNQLFLPYRSQLIRTFVKENEIAHQ

SEQ ID NO: 4998 - protein, 109 aa, Lactobacillus buchneri
VASNSDTIYHVLSYIKAHPDKVFTKPDTYDNVVEMYLDDTVKLGNPEIYFPEQKLEVNRMSSDFLSMYSDLLDYFHEMTQVKDANYHELWITTSHLVDQHKYLVDLSFE

SEQ ID NO: 4999 - protein, 207 aa, Lactobacillus buchneri
LISTMFDVITKLSSYAMVIFFAMFVYFKTTGKHGKYPYGKYALISLVLMAVFGTLFFNSPKGKEVIKKGNAEQAERTEKTVKKPARKSTQNTETAVKKELNTTNTLLFDHQVKLHASQTALTVTVTDKSDTTESFRLTTIGILKAIKKTDYDRYDQFTIIFNRNVGNGRKRTIVKTMVTKQTLRKLDLNKLETNQLKSKADDYYEIK

SEQ ID NO: 5000 - protein, 116 aa, Lactobacillus buchneri
MKYQDVTNYVIEKYHVHPEYLWKKYPSFAVLRHKENRKWFGLVMQVEKSQLGLDGQGKEDILDVKLDPKEVEFRQTSLGFLPAYHMNKTNWLAIRLNQVDPKQIHDLIEASYQLTQ

SEQ ID NO: 5001 - protein, 166 aa, Lactobacillus buchneri
MDQFTLVKETLDKMGIPYEIVEHPAAHTTEEADEFIKGKEGVRTKTMFMTNKKKTEFYLLVMDDAKRLDFHEFQDLTNTKQIKMASAESLKEQMGLEPGIVSIFGLINNQEKNIHVYFDRAILDEKTMTFHPNVNTRTIFVASKDVLKFVKEMGYDYQILDLESFD

SEQ ID NO: 5002 - protein, 730 aa, Lactobacillus buchneri
MFAQDGNLTSVDVSSFRTPNVITMSGLFFGDWKLEQVDLSNFDFSQLKNTDHMFGGDYVLTNITFPHSKASKIDNMLDMFYGNHSLKTLDLSDFDMTNVTAIGSMFSEDTLLSNLKLGPTFKNSALATLPPHQKGDEIPIDPLKDATGPGWQAVGANGTVNNPQGELYPTLEDFVAKRPAEDETYVWQQDTTPINQYMLNLTNSSASVYEGLQAKNWDPTSVIQLATHNGTDDKNAVTITDANGQPVTQATIAALAPGTYSLTYQNGDQKQPFTLTIKADQASLKTTDIDLYLNQAFTEDALKSKILAVNSDGQALPYTYTIKDATGKTVSLDDVKSKVGQYTVDIVTNQLLSGHEPLEGKLTINVTDSSTLNLKYGKLTIPVNQAWKPADAFDNAKDASGKDLAFKDILVTAKDSSGKIISDLSNLYKTPGVYTIHYSNGSASKDVQLTVTQPTPTPSPLPTPQPVPNPQPSPTPNPINPVTPTQPTVPTQPTNPKLPDYAGTKGAAVAAINNVYLYRTVNFTKGQRIAKYIKKPRIYRPMFVVTGYARSTSGKMRYKVRDVNHLSKTAGKTGYITGNWRYVRPIYYATLHKHITVISPAGVNAYKHKDLTGKVRSYQQGTILKVKGIVKHNLTTRYILTNGRYVTANRKLVNMGRHRTVKKVRAKTTIHRYQNVNLSGRPHTIKKGQIIKVSNYDYSRGHNLQKHGALRYRVAGGYITGNSKYVRIIR

SEQ ID NO: 5003 - protein, 432 aa, Lactobacillus buchneri
MKRYRAYRLSLGWQILIGLLLGVFFGVIFYKNNTAITAMQNIGTMFINLIQMIVLPIVVSCLTVGIASMGDIKKLGRVGLKTIIYFELMTTIAIALGMVVANVLHPGTLIDIHSLHGSDISQYMATAKTAQHTGIWGTLLGIIPTNIFKSLANGDMMPVIFFSVFFGLGIAAIGEKGQILIDGLNAVAEVMFKVTNWVMHAAPIGVCALIGVALAEMGIGALIPLGYFVAIAYATMVAFILIIMGIVAKIFGFSIFDLLLVIKDEIVLAFSTASSEAVLPKMIEKMDKFGSSQGIVSFVIPTGYTFNLDGSAIYQSIAALFLAQAYHINLSIGQQITLLVVLMITSKGMAGVPGASFVVLLATISTIGVPVTGLTFIAGIDRIVDMGRTAVNVVGNSLATVVIGKSEKEFDEEKSKKYIASFKKKKPVEEAG

SEQ ID NO: 5004 - protein, 504 aa, Lactobacillus buchneri
MSERKVYTDYFFDEPAYNTHDGGFVPLEEPKTPQQPLKIPELLKPDKETDTDMYYTVIAQTGEAQLMPGKKTKTWGYNTDLLGKTILFKKGKMIHITLKNELPELTTFHWHGLNVPGPITDGGCHAPVYPGESTQIDFKCDQVAATLWLHAHPCPATAEHVWKGLATAVVVKDDVEAALPFPRNYGVDDIPVILQDRRFHEDNQWDYMADYDPDGVQGPTAMINGTINPYFDVTTQRLRLRFLDGANRREWRLHFSDNLKFTQIASDGGILPEPVDFTHLMLTCAERAEVIVDFGQYKPGDEVTLFCDDVPIMRFRIHEFAPDNTTLPDHLVDIPDPDVTPGAPVHKVVMSGMDEEVMMNGKKFDMQRIDDKQKLGNVEYWDISNTNDMSNGMVHPYHMHGTQFRVVSRNGHAPYPNENGLKDTVGVNPGETVRLKVWFNHLGVFMNHCHIIEHEDGGMMAQFEVYDPDHPKQYKLMDMDTLMNAFAKERGVKVEDLNIPGMDM

SEQ ID NO: 5005 - protein, 114 aa, Lactobacillus buchneri
VADVVSFDKLDETATNQAVEDFIDFYLRWFKKNDLEILAEYKIDYYLADINHYIFENKSFTPEQMRKDLLEQRGNDLKHVISVINPEYDENGSLKAGSWDQWYQAKFEKVPDRD

SEQ ID NO: 5006 - protein, 81 aa, Lactobacillus buchneri
MAKGKTEKSKKKQSSKKLQYKTDVDVHQMVINKSVMSLKVPTILAQKEAQGLLTKAIDDGITPYYLKQETIERLGGISHHE

SEQ ID NO: 5007 - protein, 415 aa, Lactobacillus buchneri
LKHISITAQIGIGMIGGALLGLAFGPKIAGIQLLGNIFLRLIQMAVVLLIFGAVIEALGSLKSDQLGRLGGKTAMWFLITTLIAAVLGLAIGYAVNPGSGIKLASVSTSATVAKAGTSFSQTVLDFFPTNIFDALAKGNVIQVIIFAILFGIVLNRANTDGKFNQVLSFVKQMNQLTVKLVMLVMKLAPIGIAALMAWVTATSGIKVILPLLKFLTAFGLGSIAFLIVLFSFISWYAKVPLRGLVRGFSRIILVAFTTTSSAISLPIEMEDAENRLGVEKSISQLVLPLGMALNSNGLAMYLSLSCLTLTQLYGMSVSPMSMVKIVLLSVIACLGTVVVPGGGLVALTIVVPTLGLPLQSIAILAGIDWFSGMFRTVLNVVGDTTTAIAVASDEKLLNRDLYKLHVDKMAPKNNL

SEQ ID NO: 5008 - protein, 406 aa, Lactobacillus buchneri
MTTTQLTELAHRLATINQFKTNEAGQNRLVYSPTWVEAQRQVIKWGLELGFQVNVDDFGTAYLDMPGTTEPEAVIATGSHIDTVAQGGQYDGLYGVLGGLQAIENLVTEFGRPQKTLRLISFSEEEGSRFPDTFTGSKHYTGQQVDLTMKDPAGIQFDDARQQAVTKLMLAGVHHQLPDLPDTFTELHIEQGPRLIDHGLQIGLVTGIVGQRRYTVTVKGIANHAGTTPMNDRADALQHAVDLIVTLREQARRLNPDLTFTVGEMHISPNTSNVIPGLVTFTVDCRNSDEAVLDQFERLLQQTVTAPGNPQITSSADRWAKSDVTLLDRQLLENNQAIANQLGFKSIQLASGAGHDSQIMAKHTRTTMIFVPSINGISHAPAENTSQEDLLRGVELLAASLHQQAY

SEQ ID NO: 5009 - protein, 258 aa, Lactobacillus buchneri
MANEKDELMIGGHAFTSRFILGSGKYSYDLIDSAINNAKAQIITMALRRNKTGKENILNYIPEGITILPNTSGSTNAEEAIRTARIARELSGSNFIKLEVVPDKKYLMPDNYETLKATEVLANEGFIVMPYMLPDLNVAHQLVDAGAATVMPLGAPIGTNKGLSTKDLIQILIDEIDLPIIVDAGIGRPSQAAEAMEMGAAAVMANTSMATAGNIPLMAEAFKLAVEAGRKAYLAKPGRVIEHGAVASSPLTGVSAVK

SEQ ID NO: 5010 - protein, 215 aa, Lactobacillus buchneri
MQEPEIQGMSYDDVYLGMKERNVKGSTDKLAAAHITIAGAGGLGSNIAIALTRIGVGHLTLIDFDTVELSNLNRQQFKLSQVDMPKVVALKQNLQEFNPFVEINIHQTKVTHDNVKELFQDADIITEAFDNPAAKAMLLDAASEFYPDKPIVMGTGMAGIHSSNTITTKHPRKNLYIAGDGESMGAEGLMAPRVMIAAGHEANMITRLILGDTEI

SEQ ID NO: 5011 - protein, 65 aa, Lactobacillus buchneri
MVMVNGEQESGMVGQTITEFLKQREAPIENIVVEQNGKIVHRSEFDTTKIADNDKLELISFVGGG

SEQ ID NO: 5012 - protein, 210 aa, Lactobacillus buchneri
VKLTNRPLYLVTDHTGLTDEQFFGAIEAGVQNGVGLVQLRQKEGSSRKIFELALKVKAITDRYKIPLIIDDRLDIAQAVDAAGVHLGQSDLPVDIARRILGPKKIIGATAKTLKQAKAAEEMGADYLGTGAIFPTTTHVKTVHTTVETLGKIKRLVDIPVYAIGGLKADNVEAIDGAHVDGVAVVSAIMKAADPASATRELRDAVEEAIG

SEQ ID NO: 5013 - protein, 58 aa, Lactobacillus buchneri
MKKILLSSSAFINQRITDTFLSMLDKMVLAAPSFKFKISKQKGQNRAFWNGWLESAGD

SEQ ID NO: 5014 - protein, 163 aa, Lactobacillus buchneri
MNKSALIVIDLQNGLNKVFNFPELVAKINRKIDAYHQANLPVVFMQHVDDELVYGTDSWQIVSGTHRLETDRVFLKYHSDSFYETVLESYLRHQTVNTLDVCGLQTEYCIDTAIRVGHDRGFRMITTSGLNSTFDTDDLTAQQIIKHHEGIWDGSFAEVQAPI

SEQ ID NO: 5015 - protein, 160 aa, Lactobacillus buchneri
MVPNIQLIQVPITDTETILVMYKAAFKQLFMKYHDVNTSPYLEQKSNLVKKMRDPRSTYYYIKTSKHVVGLVRVIVSDSGQEARISPLSILPEFQGNGFGSSTLLQLEGLYSRVKIWSVDTIVQEQHLLAFYTHCGYQTTHESVYHIQPGMDLVQLVKKA

SEQ ID NO: 5016 - protein, 651 aa, Lactobacillus buchneri
MSDFIIISMKGRSIMKSWVQFAVLCMSVSAVGIGGRSAHAKGTQVISKVYGAVTSAPLLKPSPVKSSSSTTIDIVLKPTNTQELYKQAMAVNTPGDSQFRNYLTPSGIRNAYGQSKSVTNSWKAYLSKHHLSTFVYDNGIILSVSGKAKYIDKLFKVDMNHATYHSNPLQFGKSAPRFPAQLQKSVYTVLGMGDHNRKFVIPDADVQMIDKTKRVPNNMYDLQSFAKDYNAKPLYQQGLTGKGQTVGIIAFGNVVKSNVFHFWKSQGASTNKNRLSVESVPTSVFKNGFVSKDESETTMDAEYAGAVAPQANVKVYLENSPLATFTNTINAYSTVFNENKVGSVSNSWGIGPNSISQMLVKRRVLTPKYLQVLNLVLAQGALQGISNFTASGDTGALINTLRGVSGNQGLLDRATTDSDPISSSPWITSCGGTIPASTHTIKTPLNLGKVTIPKERAWGSDWAWNSLKSQDGNTTTVLKSIHGFGGSGGGFSHLEATPSYQQGVPGVNTFNAREYISNLAQPVFDTPLMHGTDTGRNYPDVSANAGGLNGYLMYQKEKGESPWTGGAGTSIVAPQYAGMTALINSEQGRPRMGFWNAEIYRLAQQSDSPFHPLNDTTDNSNLFYTGQPGTVYNQASGLGTTDFAKLAEVYK

SEQ ID NO: 5017 - protein, 358 aa, Lactobacillus buchneri
MTIKPWKSRYELAKTLIDERHLQNTNVEEIESTLKKMNYFQLINGLENDLLSQKVPKRFRTETFDDFKRLYKFNKQLESAIFSLIEDFEDQLKTSLAHNFSANHCRTLNDTMQYTNKNNYYNIKNDYQYPFTRYQYKYTYENFDKFELFKPNFIDKLIRNNDFIDPKFYQDPNYVQPPGVTPYHKNNQVAVPLWVTVQTLDFGTLIKMTHYLKPADMTGILSDFNFKPSSRFAFLSALDVIKELRNKCAHGFLIERFSTPEYIKLNRNLVAKLSLDPYHKGGNSVFPSRLKLFDSLKVLGMFVDLRPLGKIFKSLIYQNNKNFSKNSYDLNSRILQDIGAPSYKALKAACVDSVSNRW

SEQ ID NO: 5018 - protein, 350 aa, Lactobacillus buchneri
MSMVDVDKLQFGLETFGDIVRGEDGELLTAGQSIRQIVKEGELADKLGVDVFGIGEHHRPDYSVSSPEIVLGALASVTDRIKLATAVTVLSSDDPVRVYERFATLEGLSQGRAQVMLGRGSFTESFPLFGYDLTDYDDLFNEKLEMYSQLIKEKPITWDGKFTQSLKDQDVYPKTDYNGIETYIGIGGSPESIIRTARYGYKVILAIIGGQADRFVPYLNLYKKAAEKYNMPVQPVAVHSHGFIADDENQAVEVAWKNIKANFDRIGLTRGWAPMSREQFDGETKVGSFYVGNPEHVAQRMARTINLMNLGRFDLVYGAGNQTAAQRERMIELYATTVIPRVKEILSEEG

SEQ ID NO: 5019 - protein, 259 aa, Lactobacillus buchneri
  misc_feature (5)..(5): Xaa can be any naturally occurring amino acid
NADPXIDREDCTASECENZYMEFDEPENDENTMAEIKNVGILGAGKVGIVLAQLALKAGYHVRISGSGSVEKIAMTIETLVPGAVPATNQGVVAKSDLIILAIPLSRYKNIKSKLLKGKLVIDAMNYWWETDGIREEVLDPSSTSSEQVQQYFNKSTVVKTFNHMGYHNLQEEAKPAGADNRKALFVTGDNQAAVDQVAEFVDSMGFDTVVHYNIADGIMTEPGSELFGASLTKADLQNVIDHFDETAFGKKIKAGEQG

SEQ ID NO: 5020 - protein, 611 aa, Lactobacillus buchneri
MTKLNRTNSKVHYKMYKAGKHWLYASLLTVGLMAGGAFGASSVEADANDNQAPATTTTAATTQPSTDTQAAAQTSSADNSTATTDNSQTPAQSQNTGATTTSDASQTSGATTTTPDASQTSGTTTTTTTADDQGTDQTPTADPTTTGTNDSTQTTGTDQDNNQPATTTTNDPSATGTDNDATTTDPSNQTSDQPDQNAADDQNKASDPTTTDDPNTATTENTDATADSAKTATTTDPTDSSTTADQTASLAQTPIDTQSLADPNSSDFWEQVFQLATIIPQAIAGAAISAPAILGGGTISLYPINSSSEPIVIPGRVLQFLTGGLWSSPWDIWNALKDGLGINSGSTATSAPITNSNQSEMTNLAAASVSGQSIVGDIGQLFHSVVTTILGELQYPILSDVPGIILWVTPSTPNQPTGPNQPTEPNQPTQPNQPTQPNQPTQPNQPTQPNQPTQPNQPTQPNQPTQPNQPTQPNQPTQPNQPNKPNKPNRPNQPNKPNKPNRPNQPNKPNKPTQSNRPNTPNKPSRPNQPNQPTKSTHSNWPTKPNHSTGTTTNRTSRNSRDITGKTPIEKASVLPQTGDKQQNWLSILGDVSLAVIVISGAMIFKRRKRD

SEQ ID NO: 5021 - protein, 494 aa, Lactobacillus buchneri
MITHYFLTSQIDENTSAIEIAEIQRLHLFSKLKVPATIVTRNRNRGSNRVLQQLIDNHQVINLYQYFTELPNQAEPIPKAEDVLHDFTNIPIENDLGYKDGKLRVRVNEQNGWINNIDYLDQFGFTDRRDLYDFNQRVSSEYFDDHAKLITRVFYQKDGHIVMTEYYRGGPGNQPVLTLIHLRHNGRLWQFDNQDALMGYFLDCLAADDSNATFYSDREDVAIPAFKLMTKPAKRYLILHSIFTQNAKRDGELFPYFQQAIDLKDKLSGIIVSTQQEASDIQSRFPMVQTTVIPVSYLDDQLIHQSESFSDRIPGKVIAVARITPLKQLSHIIQAIILVHQHLPFVTLDIYGYENVNDFQEGNKLRQLVKTSGAESYITFKGYVHDLASVYQHADLLTLTSSYEGFAMAILEALGYGCPVLSYDINYGPAEMIQDKHNGELITAGDERELYRRLLHLLTHREILQRYGQNAPASVEKYSASHVQQMWHNFIQNQ

SEQ ID NO: 5022 - protein, 87 aa, Lactobacillus buchneri
MNNLKIANTKTHKTGNSVSVTLPKSTGFSSNEPVVIEKVDEDTLIIRRAHSHKNPWISGAYNNVDFRSQIDEIGFNVGNESRKGREL

SEQ ID NO: 5023 - protein, 121 aa, Lactobacillus buchneri
MSTSFPEQGDIIVLDFEPHSGHEMGGHTTGHPRRPAVVVSNAQYNRLTGFVVVMPIMHGTGQIQKGFEPILDPSSRTNGYIVTWQTPNYDYVARNGAIIGQVPDKLRKRLCALAVDIVAAN

SEQ ID NO: 5024 - protein, 477 aa, Lactobacillus buchneri
MADQKANIGVVGMAVMGKNLALNIESRGYTVGIFNRTGSKTEAVMKDHGDKKLVPSYKIEDFVKSLETPRRIILMVKAGKPTDAVIDELLPLLDKGDVLIDGGNTNFHDTMARNARLDKSGINFIGMGVSGGELGALQGPSLMPGGQKEAYDLVEPILKQIAAKAPADGEPCVTYIGPNGAGHYVKMVHNGIEYGDEELIDESYNILRNLAGYSVDELADIFKDWNKGELDSYLIEITADILTHKDDIGDDKTKPIVDMILDRGANKGTGKWSSQDALEVGVDQSVITEAVYARYISMIKNERVAASKVLPKPEGKVDFDKKEIVEKVREALYFGKVMSYAQGFAQLKAASEQYKWDIKLGEMAKIWRAGCIIRARFLQNITDAYDKNPDLQNLLLDPYFTDIAKKYQESARDVVALATKAGVPVPSLAAAVSYYDSYRSEVVPANLLQAQRDYFGAHTYERVDRPGSFHYTWYEEQ

SEQ ID NO: 5025 - protein, 492 aa, Lactobacillus buchneri
LPTERRSLIMLFGATGDLATRKLYPAMLKLFEKGNIRDHFAVIGTSRYKFDDEKYREMVIKSVSKESTNKKQIADFASHFYFVTHNVTDLEHYSVLKNKANELDKKYELNGNRVFYISMAPNFFGTVAKNLKAQHLLSEGNGFNRLVIEKPFGRDFESAKQLNDDLSNAFEEDQIFRIDHYLGKEMIQNIEAIRFGNTIFEALWNNRYIDNIQVTLAEKLGVEERAGYYDNSGALRDMVQNHIMQIVSLLAMEQPVAFKDTDIRAEKVKALRSLRVYNVAEASSNFVRGQYAAVGNDKEYREEDGVPKDSNTETFVAGKLLFDNYRWSGTPFYIRTGKKLADKFTRVDVVFKKPLVDIFAFPQSGSAPLSANVLTIFIEPNQGFSLMVNAKNSEQGFHTEPVQLQYLEDSKRTRETPQPYERLIHDVLKGDGTNFASWPEVASAWKFVDQIRRVWDIQQPMFPNYIPGSMGPVSADELLARDHREWVYKLNK

SEQ ID NO: 5026 - protein, 242 aa, Lactobacillus buchneri
MKKFKFIAFFAVLASFLIGFSVNASASSPSLKVNNIYTTSKAVTGTATKGVAIIVRNTNKTTIASTTADSSTGKFSAELHTSVKANQKLYVYARKSSTSYFYRIMTVKTPKTATATTTTGSSTKSTSSKINISEPTGRWQSGNNNGYSVVTNFSQKGGLNQGLYKNGKYQKKLINFANYKVTTYSKTFWGITYRERGSKTYHKFYLRFTDNTHFIIVNKANHAIKVQYGNTPLHYYKFALVK

SEQ ID NO: 5027 - protein, 204 aa, Lactobacillus buchneri
MMNEDQRMLAGKLSNPRDPELLARQRLAHRLVKQYNDTFDDEREKRADLLKQLLPNSSERIYLQGPIFVDYGTHIKIGDHFYGNTNITFLDTGMITIGDNVLFGPNISLVTPMHPLRYQDRNFAANNDLPGKEYSKPITIEDNCWLASNVTVIGGVTIGNGSVIGAGSVVTRDIPADSLAVGNPCRVLRKITDQDDIRLKKELF

SEQ ID NO: 5028 - protein, 394 aa, Lactobacillus buchneri
LIKQRSEIRFNSVIVYSLILNAGAAFMWPLVTVYLHNYLHKSLTLAGMVLLAMSCCMMLGNYLGGYLFDRWSPYKATIIGSLISTTAIVTLVFFHGWPMFGIMLLFVGFGDGACLTLLNSYAASIKTRSTRDIFNILYIGQNVGIVIGTLMVGFLLKHGVTLVFTVTAAFYAALVLITILEFNVHVDRRAPGKPVKPGAPVEAKVGGMILAICGVVLSVYLAYALWESVLPVHMTSLHIPFENYSLLWTLNGLMIVIGQPFVNRIGTHFKLSTQTYVGVAIFAASFVWLIFARDYTAFVLVMIVTTIGEMIGFPGIPAWIDSLSTPQQRGKFQGLYNLFMSCGRAVGPLIGGIVLDFASYKELFSLAAGLIIIFVVILWAMNRRRTRQRLVETK

SEQ ID NO: 5029 - protein, 149 aa, Lactobacillus buchneri
VSPIKILFISIEGNTRSFVKNLTSYATGMHDQDPANPLVVSKEISEQTDFADETEPFFAFVPTYLDGGNGIDNGVKELMTNALGEYIAYDDNAKLCHGIVGSGNKNFNEQYCLTAKRYASQFNKPFLADYELRGTGRDVERIYKLLAQS

SEQ ID NO: 5030 - protein, 1038 aa, Lactobacillus buchneri
VKKLWQKTPTWITYTVLFTALICVLVGCLFLTGRSMIWELDGMAQHYPILVQLRHMILSFLHNPSGGFTHWAWNISLGSDQLTNLAYYVIGDPFNYLIALFPKSQIENVFALLVFLRMYFSGLSFMLWASLYQFKKSSRIIGSIAYAFNGYALATALHHPFFILPLIFFPLLCYGIDRVLHNKSWLPLIFAVFLVFLSNFYFAWILGFGSIAYVILRMLSLRKWPDFTPLKSFGKLVLSAVIGLGMAAIVFLPTIILATGSTRLNDNFANGMTFFPLQYYLDIPGAILPTGRAMNFWLVIGISGLSYLGLVYMLRHFKRYLWQNVALITMFIGILLPAVGAIMNAISTPSNRWVFLVNILFGFATMVFIEHISDFTKQDIAWFGWASIGLIVLVWAFGGFLMNLQPHDFIVYGFLLLTVIVVMGCVVFDWKRSTKVILVSTVFMLNLSANIIGIYSPHSSKLALQQLNRGLATRFSNDYFSGAQKYLKKMPGFFRVSMNPRYHYNTHIQNLANYSNTNTDFPINSGLNDTSVYLTLQNGYLGKFSQSVGNSQFSMNTPIAQGDYRTAFNNLLGVKYMFAKANTKNPPVVPYGYKPVRDKNGQIKVFPAKARTDAVQAIENMYGTTIYKSNNALPLVYTQYNTVSPSAYDKMSAVDRERVMTQGAVVNKSKYNTHPLNYQSPKKNIDYTVKMDTSKIVYNGRQLTKYRLGIINKANSDQLVDQPHEQVSLGANLQKTKDLLATNRSIIETNHYKNINGLKEMTSDVVGNPIDYTLKVKNPKATKNTELFLVLSGIKQTDGTPAEHRQWMANQFLLDNKLYSRMGKMDEYRHSILKPTFGGYIFNAFAKDHQNGYNQYDNNNLSNYRQISNIVLNLGYSTHQRKNIDLNFNQVKNIKFKSAKLVAMPFNKTYDTQMQKLKQTKPANLKVNGNHVSGTTNNQRSGTMVTSIPYSTGWKLTIDGKPTKTFVVNKGFVGANLPAGQHQIKLDYTTPGIKVGKLVSGISWLAFIILLGFAIIGKFLPERTGQQHKPKHGKSQSN

SEQ ID NO: 5031 - protein, 462 aa, Lactobacillus buchneri
LDDSQILTNLIIVIVTFLFAAFFVASEFALVQTRTSALEERKKNLEEAKGNKAKGLKKLDREIHMVTNLNEYLSTTQVGVSLAGIILGYLGESFVVTILVDVMEIHNSPIDPTAAHAVGAVLGIIILTYLEVVLTEIIPKNISIDMPMQVLSFISTPLHYFHVIFYPFVWLLNISANGIVKMLGLKVANENDESFSQAEILNLSRNAVKSGALEQNDYLYMQRAFQLNDKVAKDIMIDRTQLVVIDITTTVKEAVQVYLQQKFSRIPVVANGDKDKILGYVYNYDLIRQSQVDPTIKIDRLLRDISTTPEMTPITDVLHQMIQKRTPIVVVVDEYGGTSGIITDKDIYEELFGTVRDEIDPSITDYIFKQPNGTYQVNGKLTTHDFERYFDADFPEFTNSDAVTLAGYFLDNYPDIKAGDVISFENFDFKIVDYENSFINWFEVTKHKVVPKPDDDDDHHDN

SEQ ID NO: 5032 - protein, 121 aa, Lactobacillus buchneri
MAEKVKESAAEKKADAEERDNDKDLKYTDEQIKKAVDLINEQGYVTKKDIPEMDDDDWSKGFADKIDNVFKDSDKDPYIYYEKFDYAGGEIDTIIWNMDVIKTRDDALKKLADVMGQKIVR

SEQ ID NO: 5033 - protein, 310 aa, Lactobacillus buchneri
MALGQLTNQIVLMFVLMLIGVLINKVGFMHTQTSNDLTNILLYIVSPCLIIGAFEQTYSAARMKQLMLVCVGICFFYIIEILIAKFSFGRISNINLQRITKYGSIYSNAGFMGIPLTSALFGNTGVFFAVASLAGFNIFSWTHGVSLFKTTKKHPDHWQNFREIIINPNIIAIFVGLVIFLLSFQLPTPVDRVIHYVSSINTPLSMIVIGNSLGNIRISRQLIDWHLWLAIFFRNLLFPIVAMFILQALTVSGVALDTTVLMAACPTAGLVVLFTLQAYGDASPAVALMSLSTILSLATIPLVFALMMAF

SEQ ID NO: 5034 - protein, 202 aa, Lactobacillus buchneri
MSTEEQRMLSGKLYNVYGKDLAKKYAQKDHLLHQINFAEEGTDVQKLFRQLLGRTGNNVYFEPPFFCDFGGNITVGDDVYCNTNGVFLDSGKITIGSRVLIGPRVNLFAAGHPIDAGVRNQWLGFAKPITIGDDVWIGGNATLNPGVTIGSNVVIGSGSVVTHDIPANSVAAGNPCRVIRPITAADKAEWENQETEYRESLK

SEQ ID NO: 5035 - protein, 284 aa, Lactobacillus buchneri
MSMEIMFQPDKSTYQLADGHQMPKLGFGTYKIDNPELMDQTIATAYDSGYRMFDTAQLYRNEKQLGDAIKKVARREDVFIIDKVMEMNQGHDLTINSTDFSLQQLGTDYVDLLLIHWPVAEHFFETWQAMEELKKQGKAKSIGVSNFTRSQLELLKTQANEMPVVNQIETHPYLTQQPLIDFDKKMSIVTQAWSPLGRGIVLDNPMLNKMAKHHGKTPAQIILRWDLQRGISIIPKSKTPARVKENTQLDFELSPDEMSMIDVMNKNQRTGNEPELVYELGHQY

SEQ ID NO: 5036 - protein, 792 aa, Lactobacillus buchneri
MADGNSQQVDPEVGLSDAQVEQLIKDGHKNTGEESLTRSVSDILRDNTFTLFNLINVILGALVFYTGSYKNLLFLGIAIFNTAIGIIQEIRSKRQVDKMVLLAEGKINVIRNGEDLQVHSNDIVLGDIIQLGRGDQIPVDGIVVRSRGIEVDESPITGESVTISKNIGDPLTSGTYLVGGSGKMQVTTVGADTFVNHLSNEAKQGEDASSILLNTINRIIKVLTYVIIPLGIILFVAKLYGGTGINRAILGAAAAMIGMIPEGLVLLTSMTLAVSAMHLARKKTLVRDLPAIETLARVDVICLDKTGTITSGDLKFVEAIPMMKNVSAAEVEKVVAGITYGTGDANETANAIKDAVDDPELKTEKIIPFSSDRKWSGVGLSDGHDYVFGAPQFIFEHLDEQVQAVITQNARKGYRVLAVAQVDDLDPRKPLDAPKLIGLVLISDVIRPNAANTFEYFRNQDVNIKVISGDDPTTVSTIAQQAGIQDAANSVDMTTVKDEDDFGEIAANNTVFGRVTPDQKKRLIAGLQSKKHTVAMTGDGVNDLLALRQADCGIAMASGSESTKSIADFVLINSNFDAMIDVLKEGRRVINNIERVASMYLIKTMYSVALSFIFVFFATGYPFEPIQLTPITSLMVGIPSFFLALEPNFNKITNQFMKQVLIISTPAAICIVGYVMLIEIIGQLFGLQYEFTSTLCVLLTGAICWLALVMVSRPLNRLKIGMDILVLVAFLTIIIFFNNIFSLVSFFNKDIWLYAIPLIATAYPLYMFMQGVIATVLDKREKRRLRKQAEGK

SEQ ID NO: 5037 - protein, 175 aa, Lactobacillus buchneri
MAYNEEQYEQWEQKLKQVELPLWADLPKFELYMDQLVALVNETLGPIGIDKVTPAMINNYVKNKAIMAPVKRKYQTMQVADLILISLLKPAFSLETIRHGIDQVTANIYPQQAYDTFIKRLLFSFKNMDSRNSRALEEKNLNDKLMQVAVNVIIDRIQSEKLLAIIQKPLTKVTK

SEQ ID NO: 5038 - protein, 872 aa, Lactobacillus buchneri
MIDNKVKETKAAKTNTTDVDTVINGLVSKAQKALEIMDSFDQEKVDHITHQMVMAGQDKHMDLALMAYEETGRGVAEDKAIKNMYATEEVWHSIRDHKTVGVIKDDKERQLITVAEPLGVLAGITPVTNPTSTTLFKSIISMKTRNPIIFSFHPQALKSSIAAAKIVRDAAIAAGAPEGCIQWIEEPSIEATTKLINHPGVASTLATGGPGMVKAAYSTGKPALGVGPGNGPVYIEKTANILRAVNDLVLSKTFDNGMICATENSAVIDSDIYAEVKKELVKNGVFFVDKKDHDKLAEAMFNPKTGSVKGPIAGKSAKGIAKLAGIKVPDNTKVLAAEITGVGPKYPLSAEKLSPVISIYKAKNHEEGFKLCDELLHFGGMGHTAGIQTLDDDLALEFGKQMKAARVLVNTPGGFGGIGNLYNEMTPSLTLGTGSWGANSISHNVTDYDLLNIKTIAKRRNNMQWIKLPRVYFEKTSVRYLMDMPGINKVFIVTSPEMVEFGYVDKVLDELKRRPNPIEYSLFSGVEPDPTTDTVEKGVRQMNAFKPDTIIALGGGSPLDAAKNMWLFYEDPKTSFFGAKQKFIDIRKRAYRFNKPKKAQMIAIPTTSGTGSEVTPFAVITDSKTHVKYPLADYALTPDVAIVDPQFVETVPKGNIAASGLDTLCHGIESFVSTMASDYTRPLSLQAIKLVFDNLADSYNGNMHAKEEMHNAATLAGMAFGNAFLGINHSIAHKLGGEFGLTHGIAIAITMPHVIRYNAKLPEKIAVWPKYEYFRANKDYAEIARYVGIQGKNDDELIEGLVQRIIKLAHEVGVTLSLKAWGVDKAKFDAAVDRLAVLAYEDQCTTANPKEPLIADLKQLMIDDYEGTNVEK

SEQ ID NO: 5039 - protein, 765 aa, Lactobacillus buchneri
MKKKQFIYWVSLVVGMFLVFVGGENFAQADTAADVDSAITTGVKLTAQKDTLDAWDAMILATSDNGITDAQAQNAYQDIITTNGFLSGTVQDPSGVSDVAGVIGLRALGNDPANVEKKDLVGQVINDPLAKIAKPSLYTLVNDLEALSTGSYGKASETARATLTKQILEDRDSASGIWTASWGNVDLTARAIQSLSMNMDQPGVPAAIQKAVSVIENDYYQQNGGFGNQSNKEDQYNNVTMVNALAVAGVDVYTSLNGKSDYQAPVQRLLDQKDISADSNSMLLQQATYTLEQAKFTKDGGQGWIFNFAQNPTFRARELAKLNAAATTKRQAVNNDSQSSATDKATAISTINQTLENYITKINADTTDEAAIADRAVGVAEINNVKVVDSSAASSSSGTTITNNYTTIINSAPSSSSSSVASSSSSAVPVTKPTTTKKAKSAKGSVVYALTTVKLYKSTDFNKRQLTKIYKKQARINRPMFLVLKQTTNKQGHAIYRVKDLKSRKIGYMLSASKYLTGAYYSAKVTRIKVLNPRGINEYSNRQLSGRKKHVKKNRSLNVEKVVDYGHTSRLQLTSGRYVSANKRLVLATKIAKTSGQNTDAAGTPVATTPSPTTSTSSSSSTTTTTPTPSVPTTTPTGSNNASSSSTNTSGTTNDNSNPDTNTNTETVTVSVNANGSVLASGSITLSKGATALDALNALASQHSMSITTVGSGITAYVKGINGYNAGPAGTMTGWLYSINGNQPNTSIGAYVVANGDRISLNYNK

SEQ ID NO: 5040 - protein, 348 aa, Lactobacillus buchneri
MNQLTKNILASISAVVMTVTLTANAGAASIHKASTSTIHRRTALTYTYAKKMLKENKTGLSGKTSSIFSRKLYSETGASSGYSDFLLGLKGNHYQFTTGEKNLLRKNLVIKSNSTAATLANAVMAVQAMGMNAQNYKPYGHKTGINLVSRLYRSSVAKQTASSQAETLIAVSMSNHFKRPSNAKFSKASLSSRLVKVQLNNNGWTYNNAQGAKDADTTSMVLTGLSRGKSATGSVESSIKKGQQFLYSLAQSNGAFGYTFNGKTTPNANSTAEAIIALANGSSTKKYVNSTAMHAGQKATPLYAMLTYVNKTGSIKNATSQLYGVGQVNLAVAAYKAALKGQSVYSIQ

SEQ ID NO: 5041 - protein, 201 aa, Lactobacillus buchneri
LGNTRSNLKTQLFSIATAYRKNFFVIVWAVAAVVFFLGTRFQFGASEIQVMPSIQSLIGAIPSITAQELVSDTRLILPLLLLSLIPTYILSSVWLSLAGALNVAGLGSLVTSSFQIASSGVRWYLATAYVIDLLLLMMLHLLLFVMIAEISDFYGQNRSRVHWWTFFATWFASLTHTYLRYWQLFWGILILRVIFSILINI

SEQ ID NO: 5042 - protein, 213 aa, Lactobacillus buchneri
MIIGLRQIRGFVQKELGYETTGHDYTHIERVVSLAKLILKGEDADESLVIIAAYLHDVSDDKVTTNPAAKRKAIADELIGVGYDEAFVKQVFEIIDNMSYSANLKTHHHLSIEGQIVQDADRLDAIGAIGIARTFYFGGHFGEIMYNPRIMPRTGMDKAEYRKRGTVINHFYEKLFKLKDQMNTPTAKKIAEHRQQVMQDFVGEFVDEWNGTK

SEQ ID NO: 5043 - protein, 244 aa, Lactobacillus buchneri
MLKDILTNIGLVLGLMIGVPFLFIYLLSSINHGTKQRIANQFGIGGQIGFGFLGIIIHEASHLLVALIFGHHIDQFRLLRVPSADNDTLGYVHHTWNKRNLYQNMGNLFIGVAPIFGCCLSVLLLAKYFVPEVYQSLMTTAEQPLSQLVVVLPTFNWLSMGLFLIIAANICIGGFDLSPADFENSKQGFWQAVICLTLLAIIISLTPLQATLFSLLIRLTVIIVVISLFNLLISVVMNLIFRFI

SEQ ID NO: 5044 - protein, 166 aa, Lactobacillus buchneri
MSKKKKNKVHKTLVEQILDKHKIPFEQMEFPTHKEGDVEQISVDHVDTDEHQIFKTLVFSGKTTGPVVGVVPVDEHLDEKKLAKVSGNKKVNLVPLKDLLKTTGYQHGANTPIGIWEKFHYPIYVDQEAKEMGEIIVSSGQIGRSVKVDSQQMVDLIGGKFADIKE

SEQ ID NO: 5045 - protein, 243 aa, Lactobacillus buchneri
MADLVYRNIMKDLKERIQANEFASKKLPDERSLSESYGVSRSSIKRALNVLANQGIIFKKRGSGTFINPLYQKNQTIFQYEGSNLGVTDSFKSDGQTPKIKLLDFKVVPASEELQTELFLNPGEFVYEIKRLRSFDDKPFMIELGYIPIRVAPELNSERVEGSIFNYFEDATGNSVTKSFMTITADPSTKEDQQLLGLKPVEPVGVMEGIFFLDDGTPFEVSNMRIHYKYLNYNTFVNLDEDK

SEQ ID NO: 5046 - protein, 471 aa, Lactobacillus buchneri
MARQVNQQNQWWIFTAVVLLSFMSTLTSSIVNIALPVMSRAMAVPTAQVTWVASSYLIVTCMFLLPFGKLGDVLGKARVFKIGTVIFTIASLFCGINLGFVWILIMRAIQALGASMTLSTNAGIITETFSKEQRGLALGSFGSVVALGSIAGPGLGGLILTCLPWNYIFWVNVPVGIVAIILGQIVLPKAEATAAGRIDTWGMLVLIFMAGSLFMGLILGQQAGFMSLIFLSLMIATIILLIMFINLEKRAADPVMNFHLFSNIDFSLSLLATILVYGINFVVNIIEPIYLEQNRFITTDLAGLILISFPIIQIIVSPFAGWLSDRFGSHRIAAISLAMLIISQAGLASVNHTTPLLILCLWLGFVGLGNGLFQAPTNVLVMNSVSKDQLGVASGLLGFSRNTGMTVGAIFANILLFTGISMNLGHSTNDYPVAQPGAFIFGMRFTFWITTAIFVLLFIVQIVVNFKRKNA

SEQ ID NO: 5047 - protein, 795 aa, Lactobacillus buchneri
MTVDYDSKEYLELVDKYWRAANYLSVGQLFLRDNPLLKRPLEAKDVKVKPIGHWGTIVSQNLIYAELNRVINKYDLNMFYIEGSGHGGQVMVSNSYLDGSYSDIYPNISQDEKGMAKLFKQFSFPGGVASHAAPETPGSIHEGGELGYSLSHGTGAILDNPDVIAAVEIGDGESETGPLAASWFSDKFINPITDGAVLPIINMNGFKISNPTILSRMSDEDLTSYFKGMGWDPYFVEATADTDHAKVEEEFAKTLDHVIEEIKSIQKNARENETPDNVKLPNWPMIIFRSPKGWTGPKKDLDGNPIEGSFRAHQVPIPVAAGSMEHKDLLIDWLKSYKPEELFDENGTVKPEIRAVAPKGDKRMSVNPITNGGIKPEPLKLPDVRDFEVKFDRGVTQKQDMIEWSNWLEKVAELNPTSFRGFGPDETKSNRLYSLLDDSKRQWMEDIHEPFDEDLSNHGRVIDSQLSEHQAEGWLEGYVLTGRHGFFATYESFGRVVDSMLTQHFKWLRKASEQYWRKQYPSLNFVDTSTVFQQDHNGYTHQDPGMLTHLAEKKPEFIREYLPADANELLAVGDVAFRTYEKINLIVTSKHPRRQWYTMDEAQNLVKNGLGYIDWASTDQGQEPDVVFAAAGSEPNLEALAAISILNKEFPEMKIRFINVVDLLKLRSPKVDPRGLSDEEFDNLFTTDKPVIFAFHGFEDLIKDIFFDRHNHNLHVHGYRENGDITTPFDMRVLNQLDRFDLAKEAVQDIPAYTVKGGYFIQRMNDMVDKHNAYIRQEGTDLPEVVDWKWEGLKK

SEQ ID NO: 5048 - protein, 1107 aa, Lactobacillus buchneri
PIIITYPEPRTEINASEPRECRSRMINIRKLIGLLTITGTLGVVSITSSNPVLAKQNPKTTAVKKATTQPANQNALAKGNVPKLWSQGYQGQGMVVAVIDSGVQNNQEFQLSSNTAAKISKSQAQKFIAQRGYGKYISPKIPFAYDYVNNNNDDSSADSVSGFHGLMVAGVAAANGVARRNKAKFVQGVAPEAQILNLKVYGGFSDESPNDVARAIYDAVDLGADVINMSLGIGVGNESLDDQEQAAVKYATDHGVFVAVAGSNYGHAGSITTDYNEQSNSTITTYEPANSGTISDPAISPFATTVGDENTKQGDKSEMDSFSAWGPTPDFKLKPDVSAPGQQIAVLDQNNHFTTNTGTSFASPYIAGSAALLMQKFKKYQPTLTGAKLVKAVKVALMNAAQPMANDKFKGELISPRLQGAGQVNVNNAANLKASATDPSGNQGSISLKTVGQTTKFNVALTNQISEPLTYHINTTNGPFTESRKTNNHNVGPVHDTAIPGATLQSANDTVTVDPGKTQLVPFTLDLGSQANLNSVAEGYLTFENADSNQNLTVPYFGYYGDPTDEQVVDKPANQADSIFNGGYLMDTQDMPLGLSDRTSLASWLNTLKDPDELRDDMPEKIQSDKVAFSPNGDGHSDAISPYVFTTQNLQNVTAEITDASGKVIRTVDNETNTQKSIEEGGSGYIDDLTLSPSMRLNPKALNWNGMTYDQSTGKMAVVPDGQYHYVLQTTNFNNGAKQQQQYSLPVKVDTVAPKITKATYRDGRLAVNYSDVGVGFTSISTLAVQIGHQSAGVSLNNSGQSNTGSLVYKLSASKQHALKQAKGKLKMTLADVAGNQTKRSIKVSPKTYNHVQTSSTPGSKLVWTLKTDDLESTMSHDKYAVTTRFSPTKGITFKGLKDNDFTLINAASKVYDPQTHQLTIAGKVANPKSRLTILRSPNQNAKINQVKISKTGSFKFEMPINPTTQQGIGYILKVPKKHQWTTAKGTLVVITDTTAPTLNLSMPDNVSETSQNHYQLTTSNDQFTISGTVNDNVDGYRLLINGNNLFHEQNNAGWVNHQDLGANPNPHGPHQFTQTFNLNQGTNIFQVSAVDETGNQITKTITVTRE

SEQ ID NO: 5049 - protein, 489 aa, Lactobacillus buchneri
MTETHLSSYSATELSELIRQGKLDRVALVQELIDTVEQNNPKLNAVTTLWGDRAKKMASQFNDTGQPFAGVPILLKGLGQSFKGEPDTGSSMLLKDYKANITNNFVQAFLKAGLIPVGETNAPEFGFKNVTDSRLYGDAHNPWNTDYQPGGSSGGSAAAVGADWLPIAGGNDGGGSIRIPSSFSGTIGLKPTRGRVPTGPGEWRGWQGASINFAITRDMNDTARLLDAISTVQMAAPFQVPLPAASFTETLNSLPKTLTIAYSTESPVGTPVSDEAKQAVMDAVQFLTDEGYDLIPADAPIDGVGLMKSYYLMNAGETATMFANMHLKDDVIKENVEPLTWALGYAGRAVTAVQYSQALTFWDNIVSDMDAFQQEFDLYLTPTTAHQAPRIDQPLVSAENLTKMKHIEELNPEEQMQLIWDQWLPALTLSPFTQLANISGQPAISLPTYVGENGLPLGIQFMARKGREDLLLQMGKFFEDNQQFHLLKD

SEQ ID NO: 5050 - protein, 304 aa, Lactobacillus buchneri
MKDIQWRFNETVPEAMNGRPLKALLSNYWQLPKHLVYSIRHAERVLVDGHYQPVNFPVKAGSQVQLTFVPADFARPFPNVAADSAATVAILYEDQNLIVMDKRRGDKTHPNQPGEVGATINHLAAYLATEKTVPYMIHRLDQETSGAIIFGKNPVVVPILVANIANKQIKRTYLAWVEGTDIPDEGTINLPIGRDPDDKRKRKINGPHAAPALTRYRVLRKQSGYALVQISLETGRTHQIRVHFAALGHPLVGDPLYNSSNGSPFLMLHSWKVDLLMPFTKQRKLIEAPIPSHFIKFEQELSRR

SEQ ID NO: 5051 - protein, 156 aa, Lactobacillus buchneri
MQQQKYENVLVPVDGSKATEKVLNRAIEVARDNDAHLDILNILEVNQFNQTYGSAVSGDVVFKLTENTDDQLKKYQKKAEDAGVKSVDIHIRFGNPKPIIAREFPKDHNNDVIVIGSTGLSAVERLIIGSVTSYVTRTAKCDVLIVRPKDKVTPNK

SEQ ID NO: 5052 - protein, 336 aa, Lactobacillus buchneri
MYYYVMKSNDIRRNLATEQYLMNEIKFDEPLLLFYIEGPCIIVGRNQNTLEEINKKYVDEHGIVVTRRLSGGGAVYQDLGNLCFSFVVDSDSEEFGDFKSFVQPIVDALHDMGAKSVEVSGRNDILVDGKKFSGNAMYTKGGKTFSHGTLMLDVDLSVIPKALDVPEDKIKSKGIKSVSSRVTNLKPYLSPKYQDLTTPEFRDRLLKELFHVDDLDQIKDKEYHLTDDDQKGIDKIFDDYYNNWDWVYGNSPEFTVKKRQHFTNGTIDARLQVDDGKVSNVKFFGDYFGPQDSTEVADKLKGVRFERKDFEDALKDVDLNQYFTGISRDDFFDMLF

SEQ ID NO: 5053 - protein, 145 aa, Lactobacillus buchneri
MKKEEKQTIFWAIISLVVFLAVTWLMTLPFMALKAPATTGEALQVTWIAIAFYAATLILAALRVKISYYLLAVVIAIYSVGFVGMISTMFLNSDATILVKLFVSAVAAFGIVVNVYWYILAFRLRAALQHDTFQRRINKQKGLRR

SEQ ID NO: 5054 - protein, 159 aa, Lactobacillus buchneri
VTNLEKDAASFVDDLVNEKIEGKSFTKKLDDIMKDPAKVMQPVYDYVEGQLNLGKLAYGEVKASDEDVAIRLETNLINLPFQDAKVISKMMQDQETLPVNVYLVISSPWVNKSSLRIDEVASADDYVGNVANYLDQMNNWVAEHLDMVKENLEKQPEEK

SEQ ID NO: 5055 - protein, 316 aa, Lactobacillus buchneri
MTNQMNAVVINDYGDRDQLTETQMPIPNIKDDQLLVKVVSIGVNPIDWKTRKGLRKARYPFDFPIILGQEMAGVVSKIGAKVTGFKVGDAVIGYGTPSNRGTYAEFYAIDADQAAHKPITVSFQEAAGLGLAGTTAWQALFDAGHLKVGQTVLILAGSGGVGSMAIQLAKHIGAHVITTTSAANDNYVRGLGADKVIDYKTQDFAKVSPEVDLVFDTLGGQNQLDAFKVVKPGGRIISIVETTDQAEELSQKYGVSFEKINAHPDKDVITTLSNKLGAGKLKVSIATQLKFNAENVREMHKLSETGHIVGKLILNV

SEQ ID NO: 5056 - protein, 118 aa, Lactobacillus buchneri
MKLTITDAALAQLKKVFPANSKLLLSFDDGVGPFSKVGVCSLDTSYDVIAVDKDAKVPDYDTKLSANSGDWYFKGYSKIYLDEDMKLDYKNNQVVLSGESGIMDSNIELKDLTKQSVE

SEQ ID NO: 5057 - protein, 192 aa, Lactobacillus buchneri
LKKNRLEAFTDAIVPIIMTVLVLELNPPEKLSWHGFWGIREELMSYAISFFLLAIVWGNHHHMFLLVKSIDGFVIWSNTVLLFFLSFVPFTTAIVDNDPNSLFGSQLYTLLFICINLSWNLLRVSLVRANKSVKPLVASLKRDPKSIYTLVAFIAVFLISFYWHEFGMIGTFIVMLLWVMPYRKIEDAAKRI

SEQ ID NO: 5058 - protein, 468 aa, Lactobacillus buchneri
MSLLARIFRREQLDRYLETDKKFIKTMSAFDLIALGIGAVIGTGIFILPGTVAATKAGPGIIISFIVAAIVCSTAAMCYAEFASALPVAGSAYSYGNLVFGEIIGWILGWALILEYVLAVAAVSSAWGAYFQSFLAGFHIGFPKAISGPFVPSQGTYGNLIAIIIVVLISWMLNQGMRSSVRLNNIIVVVKIGIILLFIVVGLFYIKPSNWHPFLPFGWHSAHGGVLGGAAAVFFAYLGFDAVSSSAAEVKNPKKNMPIGIIGTLIVATILYVGVSIVLTGMVSYTKLNVSDPVAFALQFVHLNWVAGIISLGALAGMFTMMVTMIYSSSRLIYSIGRDGLLPKFLGKLDKKGSPRNSMITITITIAFMGGFVPLEQLTNLVNIGTLIAFLFVSFGIIPLRRNKEIQNHHGYQVPWYPVLPIVSGLLCMLMLSQLQAETWIASGIWFAFGLVLYFSYGIRHSQLGKNN

SEQ ID NO: 5059 - protein, 397 aa, Lactobacillus buchneri
MPAKEMNLKWLIIGAMFSSVGMSFVWPLTSVYLHDRLGVSLTLIGVVLLFNSLASVLGSYLGGYLYDRKNPYHLLIGGVAATTLTLILLVFFHGWPAFGIILFFNGISGGWNVAVVNSIGTSIQSQDSRYVFNMLYFAQNLGIVIGTSLVGFIYSISVTLMFVVATALFVVFLLIVLLKFKPAANKSRKKVSDTEKTTWSSKNLPKPNAIMLFAFFLSLFIIWIMYQQWVSNLSVYMTGIGIPLRNYSFLWTINGGVIVISQIIINWISRYHENMIFEVFLGVFLMSMSFVVLIFAKTYPFFVLAMVTLTIGEATALPTIPALVNTLTPVEAKGRYQGLIQSWASAGRALGPLFGGLIIEMSSYTALFIIATSAVLLVLMGLIVLWNTLHKNLVMYR

SEQ ID NO: 5060 - protein, 141 aa, Lactobacillus buchneri
MAVDGSLYHTEVVNEHGLVGESFVRGNEGLALGVSSSLINSPGTNPEQFIGFALSTCFNATIGLVERGHNLKPDTVIHTAVDNLKDTTGYKFVVRCQILFHELDNEQAQQMVDEALDTCPVAKLLKANENVTFEVVDKFSF

SEQ ID NO: 5061 - protein, 164 aa, Lactobacillus buchneri
LSHSIIKSALKPLLLLAALFAFAVSAYTSANTASASSSDQSYSKVLKVAKKHLGASYVYGAVGPTHFDCSGFTKYVYKHSIQKSIPRTAQAQYNGTKKVSKSNIKKGDLVYFGGSKHSISHVGMYIGNGKMIDSQNRGVITEKVYSPWWHVVGFSRPATLSYDD

SEQ ID NO: 5062 - protein, 301 aa, Lactobacillus buchneri
MTLKFKKIAGLLMGALAAFTFATNASAAKTKIADVSQYQGSINWSKASKQLKFAIIRVQHGDTGDADFRIDTQKDINANGAYKYKVPFGQYGYAEFSSVADAKKEAKDFYKRSSSKARFYVLDNEHRKGKGSEQSYVNAWLAQMRKLTNKPLVYYSYQNYVNVHKINYSKFDGSWIANYSAKPNVSTDLWQYTSKGSLSGISGNVDLSKVVDSSTVNSWLKTSSADAAKPTYFTSLPSDKEVTASKNIYQYHDVNFKTRVSKITAGKKLSVKSITRSNGGAYRFQLTNGNYITANKAYVTD

SEQ ID NO: 5063 - protein, 864 aa, Lactobacillus buchneri
MLSQRGRQTKRSFYILAVLIPILLVSALFVVIGIAPFGSHNLLVSDLSTQYLQFFAELKHQLAHFSFSGYSFLMSIGDSLVPIYAYYLLSPLNLIIMLFGTAQLPIAIDLIIWVKLILCSISMSVFLAKKYQNYDLMAVYGGLAYGLCGFVAMYFYDLMWLDALIWLPVMVYGLEKLYYHGKPALYVVSLIMIIFTNFYMGYIICIFNVLYMAYLLKKNQPYSLPFFQNLKANWQKISWFIWYSLLAGMSVAVILIPTAIAMMATGKKDLLAANFLVKGTFGLSFPVNLGVGGNDFAGRLVHNPSFFTGSLFIIGAIVYFFSKLVSQRDKQAAGILIGGIFVGMWFLPLNTIWHMMQQPAGFPFRMVFLFSFAIIMVTYEGYLQGMFAEEKLLIRSAVGLGAAILIGYIFANIEGQKLMEFRFDIPQLSVRNIIFAFVVGLIFLTTIAMIGVGRQRGTSRIFLGVVLAFELSLNFMIATDGAPLGNQKAFERTYAQSTRLIGSVEKRYQSDDGFYRFLIIDKPFRDLFKVPYSGYNDSFLYRNHGISSYSSTLNAHTHHVLGDLGFSTRNIRRIDMLGGTAITNYFFGLKYYDVLGRYGNHLTVRKRTSGLGFMANRQIEDLKLKRGQAFDNLNDFVQATAGNQRQYVYAPTIISSAKFVHRDYFEYKVKFWANTTGPHYLYIPRVRLINVSFYINGQKLSKLYSGLGTEMIPMGYMQKGQISTLTIHSTKELHHVAGDLGGIDLAKLRQVENYQDNHKFKLQNPSLLNEHGAHFKGHVTVGKRAQTLVLTIPFDKGWQAKVDGHQRPIKKVAGGLVGVRVTPGKHQIAFNYHIRGLLAGALLTIVGLLGLTGTAIWRRLKSNM

SEQ ID NO: 5064 - protein, 327 aa, Lactobacillus buchneri
  misc_feature (20)..(20): Xaa can be any naturally occurring amino acid
NADPDEPENDENTDECARBXYLATINGMQIGMIGLGKMGLNLVKNMIRNGNEVVAFDLDEANIKLAQEAGATPASSNADLVSKLDAPRTVWIMVPAGKPTDSTVTELVGLLSKGDYLIDGGNSFYQDSIRHGKIAEDKDINFFDCGTSGGKNGALNGGNFMIGGTSAEAFEHIKPLFDGISQKDGYLYTGKPGSGHYLKMVHNGIEYGMMEAIGEGYDVLDHSPYDYDNEAVAKVWVNGSVIRGWLMELAQEAFANDANLDQISGKMFSSGEGKWTVQEALKQGIPVPVITDALFARNRSMEQDTFTGKVVSALRHGFGGHAMDMKK

SEQ ID NO: 5065 - protein, 328 aa, Lactobacillus buchneri
MLDTILNTLMKPTKLEKEQLKSLEFHNDLPIDVYDTTLSEQEKTPIISDALFKNKSIYVSKHNRYAPYPTHAHTFLEINYMLRGSCDEVVEGQQIHLEQGDVLLLDVGCKHSVGYLGTNDLLINVLFRDKEINLDLLSDLRSSKSVLYEFLLNRRIGDDSPIHYLVFGHEDESEVQETLDRIIEEYYLQRDFADTIISSYLSILIAQLVRNYKVDMNKPMSKSQEIAVQMLKEINGNYKDTSLEKLSAKYDYNRNYLSNLFKKEVGDTFSNVLTKQRLINANILIKSTTLPVSKIIKEVGIKNRTFFYKKYISYYKMAPGSSRKENSN

SEQ ID NO: 5066 - protein, 504 aa, Lactobacillus buchneri
MAKQSKVYTPRKITVWRGIGYGIVDFVGGGSMTIIGAWMLFFYTSYCNLTAVQGASIIGAARVADAICSLLMGSLTDNFYKTKLGQRFGRRHFFLLIGSPLMLLYITLWIAGMNYWYYFATYMIFEVISSAMMIPYETLPNEMTDDYNQRTKLSSARMFISAGATFLATFIPGQLFAIMGQHSPIPFLVNGTLFAIIFAIGVYVCYAVTWEKPVTPQMRAELEKDSVNEGSLLHRFWGLLCDYGSTLRIKSFRKHLLIYLFSFTGKDTFNTVFAYFCIYCLGLSATVAANMLSLSLIGLVVTIVAGFGMVKYGPKFLYEVGYGLMLLMLVGYYLIFQLHVTNHVILILFFISLFYQIGRATLEFTPWNVFPFIPDLDEIVTKRRRAGVFAAVMSFTRKSTVAVATIAVGFILDSNGFAKNAASQSPQAQHAIAAILLFGTGGLIILALLEALTFKLNKQTHQIVLEEITRLRNGGKKADVEPKVAQTVTDLTGVPYDKVWPDDK

SEQ ID NO: 5067 - protein, 908 aa, Lactobacillus buchneri
MTNNQQELLIPTHLNVNLLRFPYNVDKSPRFSWWDHSNISNSQQTAYQVVISKRLHQLANQEYIFDTGWVQSSENTGVAIPQIERVLDAGELYYWQVRIKDNFNNISDFSQPEKFISTDKPQVEPIHGIWADRGPKSDNELPKLGNVVFIRSPRFDLNLVDVDTAVITAFSRGNEPLFIQGFDLLVNGTNVGVGSAHRQVHYQGTDKTGIYYNKYDVTEELINGENVISVMATAKSNRKAFWCKLEVYLTDGTKKKIIVTDKNWHVLDGSTAFGDYGVKIRSLYFGMVSENVDLCYYPQGWSEVEYNDDNWPAAWVNPQSMVSDEEVFIPYRSENTRRFETHEPSKKVIKLGDQDYLVDLGKEIIGSLKVNLQSPLNQRVTILMGEQLQDDGHVRHHLAAGPDYVENWTFVKGQNQFTTLQVKNFRYIELVGFQGNLNENDINGWAIEQPFESQESAFDSDNDLLNREYEMSKYTIKATNQDVYVDSQARERRPYEGDLLVNGNTSFVVSSKYSLNRHSMDYLIDNPTWPEDYKLYSIEMAWQDYLYTGNDEFLKNRYTDLTYKLNRGKNEESFDGASQDFKGSLKNTKGVDNFDEEVGLVTNDGLIDWPIPERDGFVEGEYNTPFNAIFYGAYLSMSKIADVVGHHTDADHYRSRAARIKKELINRMYDPETGRFYDSMNKDLSINKHTSHHATAYALCYGVYADQQMADKMSRFVANDGKFVGSIYFIYFMLKGLIDSGHADEAVRLLTNPDDRKDQKTFAAILNTLKATIAPEAWSNHYKPNMTMSHPWGATPGLTIVQGIMGINPTKPGFENFSVKIRPGSLHRVSVETPSAKGIIKATLTVGTDEQIVTVHVPMNAKGTVMLPDGSHLMTIQDRNGTDLEGMLTKAGQIVLGSGNYQISYRTN

SEQ ID NO: 5068 - protein, 440 aa, Lactobacillus buchneri
MKNLGRYWNLSVSAGLGSMLGSGIIVGLASTITVWQMGLNLTNGQVGIISGALTFAIAFGSIFGSRFADKVGIVAIFDWVNFLYAIGAGICVFANGYLMLLAGVVICGVASGTDLPVSLTVISRDAPNQKMASEMVASTQIFWQVGQFVSTGAAFVVSTMSVTGGRIVFGFFAITALILWVWRTFTKGIRVLHKEAAERLAAKEAQLDEKPTEKASVIQVLFRSSRSKIYIRLFAAIAIYYIFWNFVANTFGQFTTFMFVKAGASQTLSTGIGLGLHIAALFILGFYVTIAGSAKRNTWFTLGVIFALIAMGGLAIFGATSIALIVAFMLVWGVGSMLSGEAIYKVWTQESFPEEIRASIQGFINGVSRFLCGILAMFTPLLVLPSTIKMTMWGFVGIVAIFGLAGFTMIHYEKKYNMINGDEASKAAAAKEADNTAAAK

SEQ ID NO: 5069 - protein, 446 aa, Lactobacillus buchneri
MHKKFTLAILAAGLLTGSIVSIQSAPTASAKTKITTNKTFKKTSFLTNTPKSVYVWNGSYTKKLANLKNYPHTNLYSTKRVTIRTSSYYGSYYYVKSANHKIKGYVWHGSLVPGSYIKGGGYRYPTKHVLMSSTPYNKKDWSTSSDIGQTGRIFGVMNATSMKPYLKVPTTSQQKQVINFLKKKNQNVPKMIENRVSRGVRISMMKLYISGQAVELPMIETYPYHYWMDVNSFYPVLQLSKLPNRAKPIKTYSDAKTVTTVFGSRTYDFEDPTAQSTSNMEEGPITKVYGNGYGPNHDLSLVDCRDRLRYVTTKNIISISNNQPTLRDGIWYVAPSYQFVSIGGHEQKLRNLIDTSKSTDYRYVTPNGFTQYKYENNSWNPKFGLSFDFQKNGDVKVTIHQLSGTLNHPKTVGDPQTIATLTGANADAEMMTYLNHSAGWYDQYLQ

SEQ ID NO: 5070 - protein, 220 aa, Lactobacillus buchneri
MLDNMRSDAYNEIKYRIIHFDYVPGQKISEKLISQELNLGRTPVREAIIRIEREGLIEVIPQSGTYITKIDMADAKNARFVRSCIEPKIMVDAAVNISDEAIATIQKNLDQQQQTALKNEPDNFFDLDQEFHHAFYKVVDKDTVWNWLQINNTQLNRFRRLRLKETELDWDTLTNQHTAIFNAVKNKDIDDLSFLVTQHLHLMLLEKQKVVDAYPDYFKN

SEQ ID NO: 5071 - protein, 557 aa, Lactobacillus buchneri
  misc_feature (5)..(5): Xaa can be any naturally occurring amino acid
NADPXIDREDCTASEMVKITDDYLNNQQEFADAGIKVPTYDIKQKTGATKWVHFGGGNLFRAFHAAIADRLLESGDLDAGVVVAETHDKDVVQDAYKKFNDKILRVITHEDGNFEKELFASVADALFFDQSNPDGWNKLFKIFENPALQLATFSITEKGYNLWDSKGNLLPAIEDDIKNGPEAPKNNMASLTALMFARFKAGKYPMALLSTDNFSQNGEKLEKSVLTIAEGWEENGLVPEAFVDYLKDDHKVSFPLSMIDRITPNPSEAVSEKLKADGFEDYQIFHTPGHTNIAAFTNTEEVHYLVIEDDFPNGRPALDKVAGVTLTDRDTVNDADEMKVTTCLNPLHTALAVNGSLLGFDSIAKEVSDPDMLNLIKQIGYVEGLPVVKDPKVINPKTFIDQLVNKRLPNPYIPDMPQRIAADTSQKLSIRYGVTIQHYIDDPKRDPKDLHFIPLVLATWCRYLMAIDDQGKPFEPSRDPLLSELQPKVQDIKLGEKTDVHAHLKDILSNQKIFGHDLYEIGLGDVVEGYFTSQISGVGAVRKTLEDTLSKYAKQIN

SEQ ID NO: 5072 - protein, 474 aa, Lactobacillus buchneri
MSLLNDDFLLTTPMAKKLFHDHAEKMPIIDFHCHLDPKEIYENKNYKNISRIWINEGNFGDHYKWRLMRANGVPEDLITGDGDDYQKFLAWAGTIEKALGNPLFEWTHLELRRFFGINDVFNTKTAPAIWEKANQLLATDDFKPRNLIKRSNVQVVCTTDDPASDLKYHKLLKKEEDQNGFKVLPAMRPDKAFNLTDDGYGDYLDQLAKVSGKKITSFKSLVGALRQRFQYFESLGGRLSDHGLNFFHFVKASDDEMNEIIDKARNNKQLTKTEIDQYQTMLVEALMHLNKEFNWTMQFHMNVIRNANKPMLKSFGTDGGFDSMGTQPDLAQEFMKLLMDAQEEDQIPKMIIYSLNPNDWMELATGMGDFQQDGVQKLQLGAAWWFNDTFSGMKKQLTIMAEESLLPNFVGMLTDSRSFLSYPRHEYFRRVLCNVIGEWAERGQAPDDEDYLGKIVEDISYNNAHDQFHFFDQD

SEQ ID NO: 5073 - protein, 330 aa, Lactobacillus buchneri
MEYNIAVVNSNSFGQVFTEHWKELEGIGTVKRFMLPTDIDGKLLAEKLHGFNVIIASVTPFFNKEFFDNKDELLLISRHGIGFNNVDLHAAKEHGTQVAIVPQKVERNSVAENELANLMALVRQVVPSSERERAGRYEDRAQFMGNEFSGKTFGVIGCGNIGSRVAELFSIFGGPVLVNDPHPATEPEWFTNNNVERVDLETLLSRCDYISLNASLDDTSLHMINSKTIKSLKKGAYICNNARGALVEEDAISAAIKSGQLSGYAADAMEVEPVKADHPFLKNDRILVTPHTSAYTYECLHGMGEKCVSDVKAIVAGKRPGRELTHNLDD

SEQ ID NO: 5074 - protein, 514 aa, Lactobacillus buchneri
MDYIIGIDVGTTSTKALIYDTDGNIYGKANKGYPLYQDTPDMAEEDPDEIFNATVSAMQEVVAKANITDGKVIAISWSAQQHSLIALDKDFKPLTRSLTWADNRSQKYAAEYKQNGRGMEMYKRTGLPIHPMGPFYKLLYFKNERPEIFDQAAYWVGIKEYIIWKYTGVLKEEVSMAAATGLLNMNSAQWDEEALKETGLTERQLPELVDTTDKFQGIKSEYAKVIGIDKDVYFVMGATDGALSTIGVGAIQTGVLAINIGTSAAVRTFVDKPRVDPKARLYCYPVMKGKYLVGGPINNGGIVLNWAHDSLFGGEVEAAKLLHIDSYDMLSKIAATVPAGSDGLIFHPYLGGERAPLWDANARGSFFGLNRKHTRAHMIRAVMEGIMYNLYSVTLALKEVTGEPKAVLAAGGFARSTLWTQMMADIFEHNIVIPESYESGSLAAMFLAKMALGLEDNLEDIKKYMGKETVYEPNEDVFKRYRTLMPIYLRLSRDLSKEYEGIAEYQREFSDTDE

SEQ ID NO: 5075 - protein, 389 aa, Lactobacillus buchneri
MSKVLIVNAGSSSLKFKLFEMPQEKVLADGEVERLNMPGSKVKIKYGDGEVYKAEEDKIDYERSAGIMLNNLKDLGVIDHLRDIDAIGNRVVAGSDIFDKVVKIDDDSLSQIVELGDIAPIHNPVEAEYIEIIRRILPDTDQYAIFDSAFFKDVPEVNSIYGIPYELTQKFTIRRYGEHGINHGFITQEAEKALGNDHAKLVTLHLGSGASVAAEKDGKCYDTSMGFTPMNGLVMGTRSGDVDPALVPFFMKKMGASAEEVIDMFNKRSGLLGVSGVSSDMRDLEDSDDDRAKLALDMFVNRTVKYAASYITELGGVDAIVFSGGIGEHDKWVREQVVKKLEIFGIKLDGDLNEQQKPGDLGTKDSSARILLIPANEELAMVRDVAAAL

SEQ ID NO: 5076 - protein, 295 aa, Lactobacillus buchneri
  misc_feature (4)..(4): Xaa can be any naturally occurring amino acid
CAAXAMINTERMINALPRTEASESELFIMMNITYVILLIIKSRRSWIEQIVMAIFFLIVYVIEMLAFQHTAPIVFSTIQLVYGLIVFAFVYLEVGTYKVTTTRLKLTTNLKVWFAIFAATVIGMLLLEELPATVVTTLTTRHVVVNTLIALTAGFFEESLVRGLVFSAFLQNAKNHRRSLKFTKAAIYSSLVFGGLHMMNMSQDNIEGVVQQVVYTVVLGLLLVVIRVTTNTLIWPIALHFLIDWQPDIASGAVPDATNWLVIIGVFGVILVASVIYLVKFDREYEKQQSLSTIG

SEQ ID NO: 5077 - protein, 338 aa, Lactobacillus buchneri
MNTKKELFDKLDGQDIEKFTITNDHNVSVSAITFGATLEEFNVPGPDGKPTNILVSVPSSEELMKNQYFCQAIGRTAGRITNGTFKIKGQEYHVDSNEGTTTLHGGPHGFNTQIWDGSFDGDTIVFTKHIDSSEDSFPGNIDVKITFSLNNDNELTATYSAKSDADTLFNPTQHMYFNLSEGDSINGQSLQINADKYLELNKDKTPTGKKVAVDDTPYDFRDNQNLKVGIADMKAEVGHSYDEVFEINDHQDDEPVATLSDPESGRSVSISSKRNALVVFTPDDLTGTNYLRGKGGPYMAIALEAQNLPDTPNHADFGDVILPAGEEKTYSIKYKVEF

SEQ ID NO: 5078 - protein, 57 aa, Lactobacillus buchneri
MTTILYVLSGITDLLIIAFIFMAMYEFARKDQTKPNHHFGIWAIVCVFITFGLLMLT

SEQ ID NO: 5079 - protein, 360 aa, Lactobacillus buchneri
METKYVMVKKNIKSHIINGKYKINDKIPTESELMAMYKVSRYTVRRAVGDLEHEGYIYRVQGGGMYVNDWINNKVSSDRSNQNVGVVTTHIANYIFPSIISGIDQVISDEGLSILIGNTHDEYEKERHNLLNMLDNDVVGFIIEPTRSTLDNPNLDVYQMIVDSGKPAVFINAHYPQLNFPYVETNDTDAEKTLVDYLLDHGHERVLGVFQVDDLQGVHRMNGFIKSYQTHPNVSTSGDIMMYRSSDDIHDVLDKIKTRVQVEMNALPTAIVCYNDQLAIEVIGMLSKEGIQVPDQISVAGFDDYQISQYIDPTLTTMDHPKRKMGHTAAQLLLDMLDGKDGSSKILDSDLIVRASTKSI

SEQ ID NO: 5080 - protein, 439 aa, Lactobacillus buchneri
LLFGYDIASVSGAILFIEKQLHLGPWQQGWVVSSVLIGAIIGALATSKFLDTYGRRKLLIWASVIFFIGALTSGFAPDFWVLVSTRVVLGIGVGITSALIPAYLHELAPKSMHGAVATMFQLMIMIGILLAYILNYSFAHLYTGWRWMLGFAALPAFILFFGALFLPESPRFLVKIGKTDEAREVLMDTNKHDAKAVDVALTEIEETAKAPVGGWKELFGKGVRPALITGLGVAIFQQVIGSNSVIFYAPTIFTDVGWGVIAALLAHIGIGVVNVIVTVVAMLLMDKVDRKKMLEFGAAGMGLSLVVMYAVLKFDNGSHVAAIVSALALTVYIAFYATTWAPVTWVLIGEVFPLNIRGLGTSLCSATNWAADMVVSLTFPMMLSSWGLDNAFLFYAVICGIAIWVCHSKFLETRGKSLEEIELDLHKAAGEDVASNVTK

SEQ ID NO: 5081 - protein, 474 aa, Lactobacillus buchneri
MLQVPDYEFWFVTGSQHLYGEEQLKSVEKDARDMVDKLNASGKLPYPIVFKMVATTADSITQLMKDVNYNDKVAGIITWMHTFSPAKNWIRGTKLLQKPLLHLATQYLDHIPYDTIDFDYMNLNQSAHGDREYGFINARLRKNNKIVYGYWGDPEVQDEIADWENVAVAYDESFKIKVARFGDNMRNVAVTEGDKVEAQIQFGWTVDYYALGDLVESVNAVSESDIDAKYKELQDKYEFVQGDNDKDKYEHSVRYQIREYFGIKNFLDKGNYSAFTTNFEDLYGLEQLPGLAAQLLMADGYGFGAEGDWKTSALDRLVKIMTHNQATAFMEDYTLELQKGQEAILGSHMLEVDPGIASDKPRVEVHPLDIGGKADPARLVFSGRAGDAMDITISDFGNEYRMIGYAVEGNKAPKETPHLPVAKQMWTPKVGLKAGATQWIHDGGGHHTVLTFSASETQIQDLAQMFGLPFEDIK

SEQ ID NO: 5082 - protein, 185 aa, Lactobacillus buchneri
MRSEKEKMLAGERYLNTDDELAADRHRNRLLVDKFNRVARQDPEQGSQLIKQIFHQTGEKVDIQSPFQCDYGYTVSVGENFFANYGCTFIDVGKITIGKNAMLGPNTSIYSVNHPLGAKERIANYEYPGNVTIGDNLWVGGNTTIVPGVTLGDNVVVAAGAVVTKSFGDNVLIGGNPARILKHLN

SEQ ID NO: 5083 - protein, 290 aa, Lactobacillus buchneri
MSMEIMSKENIGSRIKLADGHTMPQEGLGVYRMTDEDELIKSVKSAYDDGYRLFDTAQMYGNEAAVGKAIKDLDVARDDIFVTTKVAEENQGYDQTIASVEESLKKLQLDYVDLLLVHWPIHTHFFETWRAFESLKEQGLVKSIGTSNYGMLHLQYLATKANEMPVVNQLEVHPYLSQQAMIDFDRENHIVTQAWAPLGRGRIFDDPVIVRIANQHGKSAAQVILRWHFQRGDSFIPKSVHPERIKQNADIYDFELSEDEMKQVDRLNRNTRISQEPEMVYEIGHQYPHH

SEQ ID NO: 5084 - protein, 158 aa, Lactobacillus buchneri
MNRFTKLLISLLSVMLMTICLGESTIASANSKVQDGVPPVLQGKYWAVTIRGSKNVQPTHEYFYTTKDGFVAKHTKDGNFTAKWMIYRQMEDNDYILNGSDTKDLSMAYWIFIEPNKNWTKIKIGYTHLPINQSLKHYPSYYCRSTATRVSKVTAILH

SEQ ID NO: 5085 - protein, 64 aa, Lactobacillus buchneri
MFPTNQSTLIDDRATERATKDFLMNYQRWQFQLNKAILLLQQPQLDNRQLVQRRYQKALKECHL

SEQ ID NO: 5086 - protein, 171 aa, Lactobacillus buchneri
MATINEIAKELNVSRVRVYQIIAKLPEDLQPNKVNGHYRIENKDVKSIKEYFTNSSLKLKQDNNGENEYKIANKALENEVQTLKEQLTNKDEHIKDLTQLLDQSQRLQLDVQNKLNKLENKDIKASESTSKSDKNESNINTNQESKSPSMDTREANNEKHSNFWSRLFAPK

SEQ ID NO: 5087 - protein, 140 aa, Lactobacillus buchneri
VKKLFVSILFVISLFTLFIVSPNNASAKNLKYGFRTATLPTHYLGIWDNHLYGHRYVLMYVKNRHTIYYKDDYETNKSITWNEKNGFLHFIVAKNKSLDKSSKRFYMYNPKENFGALYTKHGHVYVGEGSSNLKMHRLKK

SEQ ID NO: 5088 - protein, 262 aa, Lactobacillus buchneri
MKKIILTALALGALAGGVGFSNNQSTLSVQASTTYTWGKTKTYPNPQPFYYAGKSSVYLWSKYHTTKLHNLKNYPKTTWYLSKSVQMKHNGKSAIYYAVTSGNGKVSGYVWRGYLTKGINPIVTNSTKAAESAIMDLFTGATHDSQLQTIANKNVSIDSYNDYQSMLDPSEQNRFVLLSIAGPSNSTVSKELINGELSYKDYAKEQITNALTNFDQRDTDEYNLIKGKSLADFNDWKIAVKALPITSAAYGGAFILLIAPAS

SEQ ID NO: 5089 - protein, 198 aa, Lactobacillus buchneri
VTRLALLNHATLDGSSYGTLERVEGALSSDRATLLIAGLDTNGTSHFTLYDNEALNNAMDKVDANHGYVRLDEATSMLSTGVTTPYYSIANFRSVLTSSSVQGYDLSNGYAVDVSSGQAASDDHPNQDTPGVTKFAWGHTTGTQVELRNTNWADQNVETEGIQIGSSDLYIGISYHDLPYATKTLENRIYTADKSFWD

SEQ ID NO: 5090 - protein, 167 aa, Lactobacillus buchneri
MKKALTTGLLLFILPLGLFGCSNQSNNSSSESSSSTKTEQSSSTTSSTTNSASTSTTITHAKRAVKVRYEKANFTTTLDREYREEYLYQNVPGTVDSNKVYSWDNLNVSENTKVHVNQKAIATFKDDDDNEYDHEDFYRITLGNQSGKQYWVGDDVLQNDHENDYND

SEQ ID NO: 5091 - protein, 144 aa, Lactobacillus buchneri
MKQFKIFMFALAIVFGIQLAALPAKADASTSTTTPKALRGTWYEYRGSGKFNVIKITTHSFTTNGKSYTPSKKDDRKLQVSKWGSWYLFNKSKSSKKDLGQYKTTKKLIGGSYKKVLIKYHGIGTYHVFPNHKYEHKYSYTVLD

SEQ ID NO: 5092 - protein, 426 aa, Lactobacillus buchneri
MQIIEDSLDQLLKQVAIRTNAVANREEVEKSVREIIANVIKDGDQAVKMYEQKFDNVELESLKVTQREIDDAYEATDDTVIKALELAKANITSFHQMEVEDSFIDAKKKGVIRGEKIAPLAAVGLYVPGGTAAYPSSILMNVIPAKIAGVSRIVMVTPPQKDGLNKAVLAAAKIAGVDEIYTVGGAQAIASLAYGTETVPRVDKITGPGNVFVATAKKQVFGQVDIDMIAGPSEIGVIAGSQAVPSQVAADLLSQAEHDKLARPILVTDDRSLAEAVSKEMDRQVDLLPRKEIAKAAMENEGFIAVVDDIDDAFTLMNAVAPEHLEVQLPDAIEYLNQIKNAGSVFLGFSASEPLGDYLAGPNHILPTGGTARFFSPLGVQDFVKRTQFVSYTRDALKKEKDAITTLARVEGLEAHARAIESRFDD

SEQ ID NO: 5093 - protein, 216 aa, Lactobacillus buchneri
MNELMAKRRHQQIIYEVLNAVTHGVSFFVAIWLSILLVNKALRDGLSMGAIVSLIIYSATVLSLYLASTLLHCFVFTKAKRVFQILDHSNIFILIAGTYTPYCVIFVHNWAGNILLASVWVLAIGGIISHVVFHGRFQKTETTIYVVMGWLCMFLGKALYDNLSTNGFWLLVAGGVTFTVGALIYSIPRVPGMHLIWHFFVMGGTLTMFLSIFFNI

SEQ ID NO: 5094 - protein, 157 aa, Lactobacillus buchneri
MTKDNFTKKLAAMTMPHFEDLPNLDLYMDQVIDEVNQYLAPITHTEITKSMINSYVKKGLVDRPTKKRYSRVHLAKILVVSLLKPILSLDTIDQAMKIALKLDSAPKAYDQFIDLFNQELTDVDADHLSAKQYQSMAIKSLLYKLVVDDLIQTSKQA

SEQ ID NO: 5095 - protein, 266 aa, Lactobacillus buchneri
MDRKALKLDSKSLLNAHFKFFFLLFLPVFILEFVGGYIYAPKEELYDINGEPIWTGAQTFGMILILLGSLVAIGVAFICIDAMRQKLTYDQPLQKSMTILNNVDYFLGTIVIYIIEQVLIILWMILLIIPGLIKAVAYSQALYIYRDAVDRGEKISYLDAITRSRQLMDGHKWDYFVMALSFIGWGLLVGITLGIAAIWVQPYMQLSFANFYRELVDEHEAQVHQEADRINVTPAATSGNQPTTTNDSSHQSDNESNDDSDNSSNQ

SEQ ID NO: 5096 - protein, 343 aa, Lactobacillus buchneri
MRVTTFGEIMLRLTVPDNQKLVQATSFNANYGGAEANVAVSLALLGDQAAFITKLPNNEIGDTAISKLKAFCVDTSRIRRGGSRIGLYFLQQGVGQRASDVIYDRATSAFATSEAADYPWNQLLDQTDVFYISGITAALSAELQAVLLSAVEFCHHHDIQVVYDANFRGKLWTSAQAVAFNKRILPFVDVCLVHDEDIEQAFGIKAFQAANRQAIDQKATFQQAMTSLTDKYPNIQTVASILRNIQRPQSSQWMGIMNHQGRFYESPIYDVEILPEVAGGDAFGAAIVHGIGHNFNPQYQLDYAMAAAVLKLTIPGDFNLSSDAEIKAAMISNNGKGKNPVNR

SEQ ID NO: 5097 - protein, 357 aa, Lactobacillus buchneri
LKMGFRWFGEQNDPVQLAEIRQIPGVSQAVTALYDVPVGQVWPKDRIAQLKQAVTSAGLGFEVIESVNVHDDIKTGQSGRDQYIENYQQTIKNLAEAGVKVICYNFMPVFDWLRTDLTYQLPDGSNAMAYQPEMLPDDPNELIHQIMSGSKGFEMPGWEPERLAHVQQLFAKYRHVDADQLRANLKYFLDAIMPTCEKYDVRMAMHPDDPPFLLFGLPRIYKNRDDMLKIEQLYESPYNAFTICTGSLGENPQNDVPAIIREFVQKDRAPFIHARNIRFMNQTKTAFHESAHLSSAGSLDMYEIVKALADNDYEGYLRPDHGRNIWGEQGRPGYGLYDRALGVTYLNGLWEAIRKNQ

SEQ ID NO: 5098 - protein, 221 aa, Lactobacillus buchneri
MESLQDKAYNAIYTKIMNLDLYPGQQVSDKQFEEEIGVSRTPVREAMLRLRRDDMLYSLPQSGTYVTRIDLKKSLDARYARQLLESDIAKSIGSTVSDDQIDQLSAVVEEQQTASKRDQIQRFFQMDNHFHQKIYEFANKQNIWNWLISFSTDLNRYRLLRVYDANLPMNRLTQEHRDIINAFSDHDAAKVHQLVYSHLNLMLSEQQSVLDKFPDYFTNIN

SEQ ID NO: 5099 - protein, 396 aa, Lactobacillus buchneri
MKMNQFLRLALVTCATTITIGMGLWGQTPTVNASSSSYKTVSTTAIKKTPYHKSSTKGAVYNASHTKKVANLKTYPYTTWYATAKVTLKHGSSKALYYKVKNGSGTVSGIVWHKYLKAGTSPFGLKYAKSAVALDVNTNNNVWTKNANTARPIASLSKLMTLYLVRQKISQGKGTWSSKVTTSNAGLKKLGKSNVFGGFKFNHNSYTVRQLYLAGLIESSNNAAIALGQWVAGGSTPAYNKKFIGMMNNQAKEWGLKHSSFVSASGMEQNSLAPYGYSIGASKNANYVSASDIAQISRHFVVDYNDILTDASVKSMKVDGQTLHNYNNLLPGRKYYQKSLNVDGLKTGYTDPAGYCFVGTGRKSGHDRIITVVLHDENEFTETRSLMNYVYNQNLA

SEQ ID NO: 5100 - protein, 85 aa, Lactobacillus buchneri
MENESNYDLYTRLSPRCWSEALVAKAAENELKYRAIHGDGEARMLLELHQLEPAKKPLFGHAVHSRAEKMRSYKFIYTLHLKFGH

SEQ ID NO: 5101 - protein, 244 aa, Lactobacillus buchneri
MGKLDNKVAIITGASQGMGASHAKMFVNEGAKVAITDINAEKGNALADELGDNVIFIKQDVSSEDDWKNVIDETVKKFGKLDILVNNAGISFNKPLSDITLDDYMKIFKINQLSVFLGMKYAAEAMKKNGSGSIVNISSMNGLVGGAIGYTDTKFAVRGMTKAAALQLAGSHIRVNSVHPGVISTPMIHQGDSEEVIKQFAKSIPLQRVAEPEEVSKMVLFLASDDASYSTGSEFVIDGGMTAM

SEQ ID NO: 5102 - protein, 323 aa, Lactobacillus buchneri
MRAAYITQNGEAKDIKIGELPKPEITNDEVLIKVNAVAVNHVDTFVRSGSFKTDTNFPFVIGRDAVGQVEEVGADVTGFSKGNWVWTNSMGYAGRQGVTSEYAAIPAARLFHVPEHVEPTQLVAAVHSAATAAIVLTKVFGAVSGASILVEGAAGHVGTKFVQMAHIMGLKVVTTSNTSDFDLLDRLGSDQCLNYDKSLKKQLSKAETQKVDYVVDTSGQVQLQDNLRALKPGGKVCLITAPKSNQFSFDVRQFYTQSKTISGFVISNAPLDQIQDAAKFINRLMADGYLLEDPVLEKSYEDAAWAHKKLEKNAKKKKILLKF

SEQ ID NO: 5103 - protein, 79 aa, Lactobacillus buchneri
MTTIYVDPSKKKEQIVKLSDGTFGLMKAEKQKSGIGYEFDFTSHMHPSFRIPHAPVNGDEETVHSIDGEQQFKIQWLSK

SEQ ID NO: 5104 - protein, 133 aa, Lactobacillus buchneri
MKQYTNQYFDGERPLFAETNADISGTTFGTGESPLKESRNIHLTDSIFTYKYPLWYSKHVKVDHSILETMARSGIWYTHDIEINDSAIQAPKIFRRCSDITLNNDHFSDAKETLWNCQNIKINNVQANGDYLA

SEQ ID NO: 5105 - protein, 155 aa, Lactobacillus buchneri
MNSENISVDHLNLIGNYVFDGAKNVEVHHSTLVSKDAFWNCENVKIVDSTINGEYLAWNTKNLTLINCTIESDQGLCYIDHLTMRNCRLLRTDLAFEYCSDIDAEINSNIMSVKNPISGTIHARSIGEVMIDPTKVDPSKTTIITDNKTSKKETA

SEQ ID NO: 5106 - protein, 390 aa, Lactobacillus buchneri
MYDFTSMISRRNTDSVKWDVKPNELPMWVADMDFKVAPEILDAMRQKVDFGIFGYEEPHTDYFDAVAHWYQTEHHATIKRDWMFFSTGVVPTISSAVRRVTNVGDNVLVQAPVYNIFYNSIVNNGRHVLSSDLVYDQKAHQYQIDWDDLDTKLAEPLTTMMILCNPHNPIGKVWTKAELVKINQLCLKHSVTLLSDEIHGDLVFKGADYTPVFSLPSDLLQNVIVCVSPSKTFNVAALHAATVIVPNEALRSKVNRGINTDELGEPNLLAIPGTIAAYTKAGDWVHELRNQIRANYEMVVKFCQANIHEIVVVPSTATYLVWIDVSQLTDDSAKLATFIRTQTGLYLSAGDVYGGDGNHFLRMNIASPKTMVEDGLNRLQQGIKEFKAAN

SEQ ID NO: 5107 - protein, 218 aa, Lactobacillus buchneri
MENKFNLTLKQNRFLTKKNLVNMVYSNSKFEGVNTTLPQTKTIIDGMSVAGVSIDDIQIIINLKKGLEFVLSHSEPFRLDICRQINRIVAAEDALVPGQIRTGSVQIGGVQYVPPVPEASNVKSAIQEIMGDDQTATEKALQIMYEIMRQQIFWDGNKRTAILSANYILINAGAGIVNINENQLETFNTLLANYDETGDLQAIMQWTYDNCLYGIEFQ

SEQ ID NO: 5108 - protein, 185 aa, Lactobacillus buchneri
MTKTYKAEITSLNGDKIGTHPTGEATFTIDGDTLTVEITMDHTSPNTQHWMHFHGFPDGKDAQPATIAQDTNHDGYVDLPETEPVSGTTMVPFNDAPEKMDIPTDTYPTSDADGHFHYTKTVPLAEISEKFKEVFNDDDLHLEKRVVYIHGVPQSMDLPDTIQGAVGKYDQHTTLPIAVGKIVEA

SEQ ID NO: 5109 - protein, 314 aa, Lactobacillus buchneri
MMADKVLVPAQLHPDGKRYLREHGLEVVELMRANAENILKNGKDAAALILFLDPVGENVISQMPNLKIIARHGVGYDSVDLDASANHGVWVTNTPNANAATVAETTLAEIMDVSKHITKNSMEMRDGNFAYPLAHLGFDLEGKTLGILGYGKIGRLVAKKASALGMRILIHNRTPRESPYGEFVALDTLVKSADILTLHLAANSQTRHVIGRKQLAEMKPTSVLINLGRGALVDTAALIDALKSGSISGAALDVFDEEPLPMNSELFKLNNVLLTPHIGSSTVESFSRMATDAASEVVRVLNGQQPQWPVNQPH

SEQ ID NO: 5110 - protein, 150 aa, Lactobacillus buchneri
MATGYIGRIRKRVGHMPLILNTAAGILLNDQHQVLLNLRTDSHNWSLPGGYMEFGETYAQTCVREYQEDSGVKVEIVRPLGLFDQGIFTYPNGDQVQTIDRLFLVRKVGGQLLSAETDETIRLDYFDFDDLPPLLNQQTEKMLAFAKENA

SEQ ID NO: 5111 - protein, 116 aa, Lactobacillus buchneri
MTNTDWKASLKSPKAFNDFIINYFKDHKELTGNYETPSYYEYYTVTLNSEKGLVITLVSSINPTVNADAPTIPFKDVETISVEEFRQLILNKKFADMHTSLADVFQTVAGVPGSTK

SEQ ID NO: 5112 - protein, 485 aa, Lactobacillus buchneri
MNHSNIGHRNRGVILIAVFIATFMTSVEVTIVTTALPSIISELHGLAYQSWIMSAYLLTTAITTPIYGKLADTLGRRKVFQWGVTVFTIGSLLSGLSPSILFLIVARAIQGIGAGAVMPLTFTIIADIFSFEQRANVLALNNTAWGLSALVGPLIGGFLVDHLSWHWVFFVNVPLGIIVALLIWLGYQENIELKNQLIIDWLGIIWLAISLVSLLLGIQALDTLPLVAGSLLVVTIVATWLFLRHEKHFADPLISPKMFHSKTFTIQIITATILSGVLIGYQMYFPIWLQSLYRVSATTAGLVVTSSSIMWLVASFFVGKLIARFVPKQIAVTLIGVMLLSYLSLIFASQAFPVWAFYVIAMINGIGMGIVVSMNTILSQHLVPNEMVGSATSVLTLGRSLGQTVMAGVYGAILNLVIRLQLHGGITFSRVNNVISSKGAAVVANRSLIDPIILTALHMVFVGVVAMLVVVLVINILDPNKKIIR

SEQ ID NO: 5113 - protein, 164 aa, Lactobacillus buchneri
LKLHYQPARMDELAAIMVIEEAGFSPAEAATKTAMAERIRLYPDTFIVATDEANQVVGYIVGPAFSQRYLTDELFEQAHANRRDDPYQTVLSLAVHPDFRGHGIGSQLLAELAQVAKAQGRVAITLTCLADLIPFYESNDYQNEGISASSHAGETWYNLVYPLQ

SEQ ID NO: 5114 - protein, 275 aa, Lactobacillus buchneri
MKKRSFILAAVASATFALTVPLTLNMPQSPITYAKSTQRIAGKTVAKAIKSTPDLNPTSSVRKYPAYIYDKYWQVFDRWYNVQPMSAQGIFKNHTAKVYVANQSLKSYTYAAMQNWNKALKTKAFKLGTKADHTITVGFKNAGTGQGSWDGYYITSKLYINYNFFDNTKYLPAVYKAETGHALPSADQPNSADYQALYDTYWKSVITHELGHSLGLDHTPYSNDIMEADSGTKSGDAKYSWSQSKVVNDDYAIFQDKLSSRDINRAKLTKVLGYW

SEQ ID NO: 5115 - protein, 275 aa, Lactobacillus buchneri
  misc_feature (4)..(4): Xaa can be any naturally occurring amino acid
CAAXAMINTERMINALPRTEASESELFIMMNITYLAALFLVLLMGVDFSVRGAGPLVRGGARLIFALVVAGIVFYVLGTMKIFQTKIKLGTFAKIWGFIFGICLGGLFLLISILGHTALMMHAKTVVADTMMALSAGIFEEFLCRGLLFSAFLSAFKQTKYKFTEAALASGIFFGLFHFMNLISGQGFLPTLQQATYAFVIGAIFASIRLTTNTLTWVVLIHALIDWQPGISVTHTVSSLASWLVFLAVWGTILVVTVIFLISFDISSKRQLSLS

SEQ ID NO: 5116 - protein, 264 aa, Lactobacillus buchneri
MTNLVIKKDVEYDSVNHQLTDIYYDGEKAQSKGAIIDIHGGGWFRGNKSKDEDSSIRFVEAGYLVVTPAYRITPAAFYPAPLEDMDHLYEWLKKSDLPFNHDHIGAFGSSAGGNMTVELAIKYGIPIASLSGILDIDKWLSEHEDVVAAEGDTSGFNSTASSNINQTGANDPFYKWFVTNYFNGRTDQYTEATPVHRVTDQTGQMYLANSLNEFVPTSGVLDMAQALTKHQIPYRTRMLTGSRHAKGYLDDVWDDVVGFFAQTL

SEQ ID NO: 5117 - protein, 173 aa, Lactobacillus buchneri
MIWLVIFMIFWEVGLYILYFAPWNAFPFIPDLATLVTGRNRAGLFASVMTFVNQISVGVAGVVAGYLLDFAYFRESASGAVLQPQSAINMIIFIVSGGVGLMIVLAMLFVGRFHLSKKTFMVLSAELVRLQKGGSMSDVDPHTKAVCEDLTGVKYDSIEVWKKDDQPQNKSRG

SEQ ID NO: 5118 - protein, 646 aa, Lactobacillus buchneri
MINTVKALSKYNDEVILTLKRKLFNEQIKDNPLRSKADVKAALVDILAPAMEVLAQQKRKGRFRMSDSGAVYLQDKTEVEGFMRLLWGLGPFFSDKKRVYERPDWYELVTQGILAGTDPDDPDYWGGDLGDYDQVFVEMGALTAFLYETKDYFWDNLTVKKQKTIVKWMDQVNHKVIPKTNWLFFRAMVNQFITDSGYMDNSELIDADYAITNKHYLGHGWSYDGYVNQIDNYIPFAYQFFTILTVGLAHTDNKQSQLLKERAQKFVPSYANWFAADGAALPYGRSLDYRFAQAAFWAAYAYAHVDMPEGYSLGDIKHLLLNNLRWWFQQNIFQTDGLIPIGYAYPNMNFAEGYNGPASAYWALKTFIFFALPDDDPFWTTKESDDFKFEALKKQPEPRMLIAHSQNGLEVQSFTAGQHSHEHAHGEAKYEKYVYSTTFGFSTPKGSVLLKQGAYDNTLAVAESENFWQTAFKYDDYAIHDNYVYSDWKPYDDVEIKNFVVPAMPWHVRVHEVNTGRELHLAEGSFSAPDSGAPDEYEMKTGVDNAIFYHSRVGITGLVGLSKELTTELSTPEPNTNLYFNKTKIPLQTGVLAPGKYTLISLYLGDRELESLDDDGNIVIPEVKLDGNKLTISFNDHTVSASFDEF

SEQ ID NO: 5119 - protein, 319 aa, Lactobacillus buchneri
MDNTNKQLHLVYGDGGLGVGGANFHYIFNYTRGGMESMVVDGREWMYREPKPTFWRATTDNDRGNGFSKQAVQWYGADMFASADKVDIKINDQLIEFPSAPRNNQYSNHEYADKVEVIYHFATLTIPSTDVEVHYTVTGDGVISIHAHYAGNDQLPDLPVFGMRFILPTAATGYEYAGLSGETYPDRMAGGIPGEYRIDGLPVTNYMVPQDCGVHMKTDWVTVTRNATKVSSDHSDTPFSIKFENDGTPFAFSCLPYTAEELENATHQEELPLPRRTVVSILGAVRGVGGIDSWGRDVEEQYHIPAGKDIDFGFKITKA

SEQ ID NO: 5120 - protein, 629 aa, Lactobacillus buchneri
MEPDIKWLDDPETFRVGMLPAHSDHQFYQSADEIRNDHSSYVQSLNGQWQFAYAKDPMHRIKNFYAADFESGDFDAIQVPQHIEFAGYDDFHYINTMYPWEGKIYRRPAYALDQNDQEAGQFSEAVDNPVGHYIKKFTLNSAFKDKKVRVRFDGVEKAMYVWLNGHFLGYAEDSFTPSEFDLTPYLQDGKNTLAVEVFKLSTATWLEDQDMFRFFGIFRDVSLIAQPEAHIEDLSIKPTLSDNLKDGTLNVTTKMTVNKSGATAKVSVTDADGNELYADSQPVDDAITLSDVSFKNVHLYDNHDPYLYQLTIEIDDQDGNVLEIVPYKFGFRKIEINQDKVITLNGKRLVINGVNRHEWDCHSGRVVSVDDMKADIRTFKQNNINAVRTCHYPDHTLWYHLCDINGIYVMAENNLESHGTWQKLGAVEPSYNVPGSVPQWKAAVIDRARNNYEMLKNHASILFWSLGNESYAGDDIAAMEQFYKQADPTRLVHYEGVVQNRKYEDVISDVESRMYASPDEIQDYLDHNPKKPFLLCEYMHDMGNSLGGMKSYIDLIDKYPMYAGGFIWDFIDQAIEVNDEVTGQKVLRYGGDFDDRMSDYEFSGDGLMFADRTEKPAMQEVKYYYGQHK

SEQ ID NO: 5121 - protein, 126 aa, Lactobacillus buchneri
MSVNSEDWKQALQSKDAFADFIYDYFKDHKDLTGNYETPSYYEYYVVTLDSKEGLIITLKTGLNQNTGDINAPLPFKDVEHISVEDFRQLVLNKKFEDQSESLTDVFSKMLASEPNARFNRGQDGK

SEQ ID NO: 5122 - protein, 430 aa, Lactobacillus buchneri
MAKKDEEKDAVKTTVGVVTNAKIKDEQQPKLPWMISSAMFLAPLCWYGPIGSTRSVLIPQLFAQLDPAHKVWAVGILATIASITGAVTNLLFGALSDVTRTRFGKRKPYIVLGTIAIAISLVLIANMKSIVAIIAIWIVAAAAENAIAAAIYPQISDRVAPKWRGTVSTFYGVGFTIAQQGFALLAAQFLGNVKFGIYFMAGCTVILALIHELLIQEKGNLDEPKVKFDKDSLKKYFFFPTHDARDFYLALFGKFFMVVGSTIVTTFLLFIFTDYIGQSTGQAGTSISIFSSIMLFIGVFFALVGGPLADKLGRVKAPVVIATFALGAAALFPLFVKEPWAMFAYAVIAAFGNGLYNSVDGALNMDVLPSSDTAGKDLGLINLANTLGQMLGAMVASAIVEAFGYGAIFIFAIGMELIGGIAIAMIKRVK

SEQ ID NO: 5123 - protein, 335 aa, Lactobacillus buchneri
MFWGQLGSRRALIFTISLPNQYQAKTLPFYTKSVTLEVARLTMLGGFYMKEQNESFAASALSEGAIPAAGEATNTFSVSQPALRTLKSVKEHEIHLQGAFNVRDMGGYPTKDGLVVKSHLLLRSARLNALTSADVNTLINTYNLGVDFDLRRPEEVSELPDRFLPGVKYINDSVDTRETYYYHINAENNRKHYRTYVTSEHARKVYHNLFMALLEKPMGKSLLWHCASGKDRTGVAASLILYVLGVDSRTIFKDYVASNDFLKPRIDARIARLKEKGATRSEIKFAKVDGGVDLSYLKAAIDEVKRDYGSVADFITNGLHITKEQQARLQEMYLA

SEQ ID NO: 5124 - protein, 102 aa, Lactobacillus buchneri
MPNYPSNITRQQFEVIRSELENFCQRTKPRQVDLYDVFCAILYILKTGAQWRALPHDFPKWQTVYTYFRLWSRQPTPAEPSLLDQVLKKLSLPYDPSRIVRR

SEQ ID NO: 5125 - protein, 331 aa, Lactobacillus buchneri
MAIFHMSFSNISAGKGRSAIASAAYRSGEKLFDDQEGRHYFYARSVMPESFILTPKNAPEWASDREQLWNEVETKDRKLNSRYAKEFNVALPVELSESEQKELLTKYVQENFVDEGMVADVAIHRDHPDNPHAHVMLTNRPFNPDGTWGQKTKTEYILDSHGNKTKTPAGNVRNRKIWLVDWDKKEKIIEWRHNWAASVNQVLEQKNIPDRISEKSFVEQGIADTPMQHEGINSKRHKRKAFNQQVKNYRKAKASYKNNQEKVINRGHLDSLSKHFSFNEKRVVKELSHELKTYISLENLDDKRRMLFNWKNSTLIKHAVGEDVTKKLFEI

SEQ ID NO: 5126 - protein, 69 aa, Lactobacillus buchneri
MSQSNLEKQEAKLKALNQKIKDEKNKIEQRLGKQIISQANLDYANLSNDQIKFLAKQFSEFLKVKSVDH

SEQ ID NO: 5127 - protein, 92 aa, Lactobacillus buchneri
MPNQYEKLIEKQARLKQKIEREDFKLRQSKYYENRQARKARSRRLIQKGALLEKYFQANNLSVEQTEELLKTFADYVNAHKPDKLKNDQPNN

SEQ ID NO: 5128 - protein, 226 aa, Lactobacillus buchneri
LIDKPQYIIVAGINGAGKSTLYDTFPSLFDKTKRINADELLRQMGGDWHKDSDNLKAMKEEIKQLHYALDHQQSIHVETTLAGRGKAQLNLIDKAHKNGFEVTLLYVALRDENLAIQRVNERVQKGGHGVPVATIKKRYQQSKHNLPLVAFKSDKVMIYDNSEKFTSVYAREKGQVFKNDLRHFPWINQNITYPEKVQKQLQNFADQNPEVKPKNDPENKNDRPSY

SEQ ID NO: 5129 - protein, 63 aa, Lactobacillus buchneri
MNMKDTIRINDFFEIAKETDLKDLLDKSLHEPDPEKRKVYDALYTYFLDKRQDEVIKRKDFVR

SEQ ID NO: 5130 - protein, 49 aa, Lactobacillus buchneri
MTVDSWFSNYVSENINIDSEKSTGARNSRNWLTSNIKYLSLKLESMKTD

SEQ ID NO: 5131 - protein, 194 aa, Lactobacillus buchneri
MAKIGYARVSSKEQHLDRQLAALKGVDKLFSDKLSGVNTKRPELRKMLAYIREGDIVMVTELDRLGRNNHDLTKIMNSIQNKGATLDVLNLPSMTGIADPNLRQLMTNLIIELYKYQAESERKRIIERQQQGIALAKQQGKYHGRKPQYTQDDPRLQHAFKLYQTGMSDVDVARNTGIKRTTFIRYRKKFNVQR

SEQ ID NO: 5132 - protein, 338 aa, Lactobacillus buchneri
MTNIKRTISKAYQQLSNFDRVRIETLLNQGFSQARIARELNRSRSTISREITRGSVLQRIPGHKVALIYFADTAAYLHAQRRERCRPKTMLEKNPEFYAACAAAIKQRPRVHSVDSFVHTFKREHADEVVPSTPTVYRDIEAGRFELRTHDLPRKPSLRIKRSHSHTRTNKTKLGTSIDERPIEVQDRRQGGHWEGDLVKGKRVDSEPALLVLTERTSRFEIIIKLANYKASTCKVGLQSIIDDYGAEYFTTITFDNGSEFAQLDSVEGTDVYFAHPYSPWERGTNENQNGLLREFIPKGRSLHHYDIIDIQSFQDALNSRPRRILGYRSAAELMPEL

SEQ ID NO: 5133 - protein, 303 aa, Lactobacillus buchneri
MLIHSISELIGHTPLIDLQINIPNHSHIYAKLEMFNPGGSIKDRLGQYMIQDAINRGQVTEGVTTIIEPTAGNTGIGVALAAQQHHLPTILVVPEKFSFEKQQLMKALGAKLINTPSDQGIKGAIEKAEALHDQTPNSFVPMQFKNPANPDTYYHTLAPELLDDLNDPIDAFVAGAGSGGTFAGVARYLKEQNPATQTIVVEPEGSILNGGPAHPHRTEGIGVEFVPPFFKDVQIDKTLTIADADAFHQVKELAKKQGLFIGSSSGAALAASLKVAKALPENSTIVTIFPDSSERYMSENIYD

SEQ ID NO: 5134 - protein, 394 aa, Lactobacillus buchneri
MEFDTKLIHGGISEDKATGAVSVPIYMASTFHQQKIGENQYEYSRSGNPTREAVEKLIAELEGGTAGFAFASGSAAIDTVFSMFSAGDHFVIGNDVYGGTFRLIDAVLKRFGMTFTVVDTRDLAAVEEAITPNTKAIYLETPTNPLLRVTDIAAVAKIAKSHQILSIIDNTFSSPYVQRPLEQGVDIVLHSASKYLGGHSDVIAGLVVTKDDQLAEKIGYLQNAIGGILAPQESWLLQRGIKTLSLRMRAHLANAEAVFNYLSNQPLVSKIYYPGDPNNPDYEVAKKQMHGFGAMISFELQDGLDPKQFVEQLHVITLAESLGALESLIEIPALMTHGSIPRDIRLKNGIKDELIRLSVGVEDQKDLLADLQRGFNELKRSKKNVSDSKVHSQA

SEQ ID NO: 5135 - protein, 185 aa, Lactobacillus buchneri
MFQTARSILKRDPAAHSLLEVLLTYPGIRALFWYRIAHFMAFHRLYTIAGFLSQHAAKVTGISISPEAKIGKRVFIDHGIGVVIGATAVIEDDVTILHGVTLGARRAVEGRRHPYVKKGAFIGANAQLLGTITIGAFSKVGAGAIVLNNVADKTTVVGNPARTVNKLPAKVINVTFTTNTSTTKN

SEQ ID NO: 5136 - protein, 106 aa, Lactobacillus buchneri
MPDYPSNISRAQFALIQPDLENFRKHTRPRRYDLYDVFNAILYSLTTGCQWRELPQDFPEWHTVYRYYDMWRDKPDPTADSLLERLLKKLLLPIVLHRADRPERRL

SEQ ID NO: 5137 - protein, 156 aa, Lactobacillus buchneri
VIVDAQSVKTTDLTKNSGYDGGKKISGIKRHMAVDINGLPQAILVTRANVSDRSGALAMLSLASQNLELVQHVMVDGGYTGNDFADQVKLILNAKTTVAKRNELHMFTVLPQRWIVERSWSWLDKCRRLWKNCERALNSSLQMVVLAFLKIVLKRY

SEQ ID NO: 5138 - protein, 139 aa, Lactobacillus buchneri
LHRAIDSNGLTMDFELRKHRDYTASYHFLKRLLTTNGRPDRLVTDQYRATLKAVKHLIKQDYLSKSAHQCSKYRNNLIEQDHRFIKRHCVRSASFQSIRTASATLSGVEIVHAIRKRTRRELSLIGFSVVDELEALLAA

SEQ ID NO: 5139 - protein, 608 aa, Lactobacillus buchneri
MKKNWQLMMVLAVSAIALVFAFVLKQPLIAQGLITVMGSIIALIMFWGMVKKIRSGNFGVDLLAITAVVATLAVGQYWAAMIVLLMLTGGDALESYAATKASSELKQLLENAPTTAHRMVDGHVEDVDVEAVQVGETILVKPQEVVPVDGTVLAGESLVDEASLTGESKPVAKNAGSDIMSGTVNGDAALTVKVTQRAEDSQYQGIIKLVKESEARPAHFVRMADRYAVPFTLIAYVIAGLGWFFSGDPVRFAQVLVVASPCPLILAAPIAMVSGMSRNSRNGIIVKSGTTLEKLSEAKTFAFDKTGTVTRGILKVATILPQAGFSQDQLLKLAASAEGQSTHILARSLADAVPTADRLPATDVSETTSFGVNATVDGRKVKVGKAEFAGTKATVDTTAVYVNVDGQYAGAITFSDQIRPEAKETMTKLHELNDAKLIMISGDQQSIADKVAAQVGIDQVYAEQLPQQKIEVLDNVPKDGRPVVMVGDGVNDAPSLAIADVGIAMGAHGATAASESADAVVLRDDLAKVAAATLIAKETMVIAKQAVLIGIAICTGLMLIASFGVIPTIIGAMLQEVVDTVTILYALRARNGLHRQALVYPVRENKRA

SEQ ID NO: 5140 - protein, 271 aa, Lactobacillus buchneri
LLDVSTSGYYAWRRALPKRNAKERQYRQRIKHFFDQGQGTYGPKRICGLLRKNGNKASYHRVARLMADGGLYSTLRCRHPKSLTDSRLARQGDYPNLVKHQSFKPFEALSSDITQTTTSEGKAYICQIRDLTSNLVLAHQISNHMDTDLVLATLKQAHQRWALPETCIFHSDRGSQYTAKAVTKLVNQYHWQRSFSALGIPGDNAWSESFFAIMKKELIYQIQFKDINDLRAQVFAYIETFYNRVRVQARLDYLAPVAWLSLYDQASQKVA

SEQ ID NO: 5141 - protein, 93 aa, Lactobacillus buchneri
MTYSRNRYDQDFKKNAVRLSFNSSKPVKIIASELGVPESALYRWRKLYTEDGKQTPFASLEAENRSLKRENAELALERDMLKKAAAYFASLQK

SEQ ID NO: 5142 - protein, 153 aa, Lactobacillus buchneri
MDETYIKIKGQWNYLYRAIDDQGLTLDFQLRKKRDFNSAYHFLKRLLKTYGLPHRLVTDQYGATLKAIKKLTREGCLHKGVHQCSKYRNNLIEQDHRFIKRQQVRSASYQSTRTAARTLYGIETMHAIHKESRKKPGLFGFSAYQEVDQLLAA

SEQ ID NO: 5143 - protein, 196 aa, Lactobacillus buchneri
MTTVILAEKPSQARSYVQAFQKSTKKQGYYTVSDPVLPENTLVTYGLGHLVELATPDKYDQKYQQWALSNLPIFPDKYKFVVSASKKDQFKVVKDLLKKADTIIVATDSGREGSNIAWSIMIQAQIDVKKKTIKRLWLNSLEKDAIITGFKNLGDWHKDYLAYKEAQTRQISDWLIGMNGSPLYTLLLRQKVLVQS

SEQ ID NO: 5144 - protein, 358 aa, Lactobacillus buchneri
LTINQQESSLKKADELLNKVVDRTTKKLYPELNFEQTTQAERRELIKETDSEQTVFKGSELNERLMNIRDDLLAQQLLAFTKRPYVGWKLLIQQEKEVKIELKYTLMIHDDNLESLEHVDQGLLEKYSPTEQQKITRAVKDLRTIMAVKQVIQTQYHEVLKRAFPKGDLDGLPLTKQEQAYTAVMYYDPTLKPLKVETMEQWQSNPPQVFSTQEHQLGLAYLSGQLSLDQLENHHLQRVLKHDGTKQLFFGECKVDPTIKNSQIEKIQKQLREQQDKDDQYRKANIGHYQPLNYKPVSPDYYLKTAFSNAIMTALYARDEDYQRQKQAQGLKETEWEMTKKQRQHQTRNRHEDGGMHL

SEQ ID NO: 5145 - protein, 150 aa, Lactobacillus buchneri
VFSPQEHQQGLAYLSGQLSLDQLENHHLQRVLKHDGTKQLFFGECKADPTIKNSQIEKIQMQLKEQQAKDDQYRKANIGHYQPLNYKPVSPDYYLKTAFSDAIMTVLYARDEDYQRQKQERGLKETEWEMTKKQRQHQTRNRHEDWGMHL

SEQ ID NO: 5146 - protein, 171 aa, Lactobacillus buchneri
MVYQRDQVNKTFKPKPYFELNAEILANQQKFVAKLDPYQRFKDETGLITFMQAKHVQKGSQAGLIKGIQNQAKKRASPQLFSLSSLQSAMNKRYHASASQTLAAIQNLYEAKFLSYPRTDCAYITDEEFEYLMANLTKYLGLVSKPVALTNTTPNKRYVDGKKLKNTMPLL

SEQ ID NO: 5147 - protein, 156 aa, Lactobacillus buchneri
MIKVVSTKDQLATLPKIQHQVYDLVLRTTLAMFADPYEYEETTIITQVGDANFKATGKVPTKQGWQALFDDHKADQQEAATLPLVHQGDQVQANLQTPQKETTPPVPFTEGTLITAMKTAGKTLDDEAAQAILKDVQGIGTIFLVTLIASIGLSIN

SEQ ID NO: 5148 - protein, 231 aa, Lactobacillus buchneri
LTNTILLVEDEEALSSYLIPELQFEDYQVLLARDGVEALSLYDNNRGNLDLIILDWMLPKLDGLEVLRRIRKGDDIPIIMMTARGYVGDKVAGLDSGADDYITKPFEIEELLARIRVILRHQRHRPRVTNLYTVEDLTLNTKARQVTRGNQLIQLTQREYELLLVLIKHTGETLTRNELLDAVWGVDFEGQPNVVDVYIRYLRNKVDRKYPKQLIHTVRGIGYVLSGNYQE

SEQ ID NO: 5149 - protein, 476 aa, Lactobacillus buchneri
VRQSKNRTTFQAIRLNFTIIFTLFAIFTGASVVTMVGVNLVHQEQTQSVELLNGLNRSFIEDKPDWNQWRKNSSINTQNTYVRVTDQSRSKTNPKVFYSKGAKQFLSKKPEKLSHTLHLPFFPAIIYTPGYGISYYRSGIRAGAQKDIRSEIWMSLTPIVNTLLSVMLVVLCVLIIGLVLGWFVISVVAKRLTQSLQLLQTTAQSHSQSVTNIETLLPVPDSPIEVRELATSFNQLLAAIIENNKKEKAFISNASHELRTPIAAIRGHVSLVKRRGQAHPEIVNRSLDFIDDESAKMQSLVNSLLALSRADKEVVSKTSFDLGSVVNETVEEQRAVLSQPIQVTGDPTATVVANQTDASQIISIILDNAGKYAPKDAQITVTINQGHPTTSLSIQNTGPSIPDIDKKHIFDRFYRGDHAHSNQVIGNGLGLSIASQLAALNDIQMTVTDVKPHGANFNLLFSHPSSADENDSKSQT

SEQ ID NO: 5150 - protein, 223 aa, Lactobacillus buchneri
VQPSILIKHPYLWLGWSVFILLALSVSFELPQLFFADQNTLNYLSRFISLPRTHFFDVIAFTGKPAVTLLAATILIAVLWQHKQIWESLTALTMVLSGNAVGLLIKLMIQRPRPTSLITPATGYSFPSGHVISSVILAIVIFKFGIQLIPAIRLRLSLSMLLIFWLGLVALSRLYLQVHYPSDVLGGALFAFLWCETVMVGFQHEFAKVDQLVKDKGGIDHES

SEQ ID NO: 5151 - protein, 861 aa, Lactobacillus buchneri
MNHDDRLKSGMIMGSGFLLSLTVIGVVMAVNQVTPFGSQNLLIGDMGAQYAPFLTGLRHILTTGNFSWFSFSVGIGENIFPLVAYYLLSPFNFLVTLVSASQVPTAITWILMLKIATISLTMSFYLLRHFHRASWMIPFLGLAFSLCGFVSADFINIMWLDGLIYLPLICHGIDQVKAGHRPHQLFAWLTIAIISNYYIGYMIGIFTVIYTFMLLIWDKSPKVSGIQMITTNRPFLKQVGITEFFSILTAMVVLLPAALGMLQTAKAVPTVANRFIDNFKPQFGLEIFSQIGMGSTGYTNRIYHAPAIFSSIVVAILFVSYFMHPRISHQKKIGTWFAFGLLLISMLVGPLNVAWHMFNEPFGSPFRYSFLVSFVMIIAAYDTWLANPIHLPRFAKWLAPTIVSAALIIGFIVIRIGTVTSRNAYLSLQPNSLKVLAVNLGTVLVLSLLMFLGHRQFATMTIGGLMMLEIGGNLSYAIRSDPLGNQSTYARSYNAEAAQLSSATNSQTSLYRLNVTDDKLSASILEYLGYNDPVAFSFNGIQEYSSTLHEQTRQSLKELGFFSKNERRIDNAGVTAASEMLLGVKYNLSAASGVQSNPTYVGMGFPVTTNFINFKLKPGNLFPNLNSVLRRLNPTPNSYLLPDKIQQRSISHSTIPGLVHADYTITPVQSGPIYLTTQSSTFRVSFITVNGRQISLIPNKLHKKYIVKLGTVAASKPVHIVIGGASPRTLQGLQIRRLNVSSLLQTANHLRAEAFQPTYHGDVLQGTLRRSTISQRWAYIAVPDDPGWSATVDNRPVTIRKVLGNFMAVPLSRTTNHIALTYHVPGLSTGIELSIVGLLGYGLFSMVAIKPGKHTKRKGRD

SEQ ID NO: 5152 - protein, 351 aa, Lactobacillus buchneri
MATPSLNRSTQLNPRIEWIDIAKAYGIIAIVLGHILTGTPIAHFLYWWHVPLFFILSGIFIKPLNNRHAWHRFFLRRVRNELILYSLMGVLLIWGYTLIHHESHTFLVNHLVDLIYGGRTLNFYTSTFWFINAYILTTIVITILVSVIHSRIIAGALVTSGLFLGASYNQVTWMHINGFAMTPWSADTVLITAFYSYVGYVLFHTNQSWIEDPKAISGIIVMAMTLILIHLNSGFTFRLSLKSHLIQSSLPNAMALIIIPTILALGVMVGALITSKLPFKFGLPLIGRHTLAIMYGHKMILDVCGLIGIKNPLFQLLLGICIPVIIVVACEKIRSLDGHLLNRNSGHGYLK

SEQ ID NO: 5153 - protein, 133 aa, Lactobacillus buchneri
LSQESAYIQFAWLSFSVSDPEHLCDGTPLKEAVAYFNNQPQISAIGVNCTSMNNIEATIQTIAPNTDKPIIVYPNNGDIYDPKTKTWKPNPQAATFADLTPKWLAAGAKIIGGCCRTTPNDIKKVAKAIRPTM

SEQ ID NO: 5154 - protein, 105 aa, Lactobacillus buchneri
MKKVLLICESGISSNFLAKSARPFIELYDAKIELIPTNIDNADTYLGDPIDLVLVAPQASYHKKELELFDRATQIKTIPDEIYGWANGEKLVKFIMAQLSPIGAA

SEQ ID NO: 5155 - protein, 102 aa, Lactobacillus buchneri
MTDEQLNGIAMKMLTYSGKAKSILSDLMDHLNSSSHDSDIDAQLNEAHQWLVQAHQQQNLVIAEAETVGYSLLFTHAQDTLMNTETIEFVIRKSIAAFTNHS

SEQ ID NO: 5156 - protein, 497 aa, Lactobacillus buchneri
MQQQDQTDQERRADASFFGQPRGLSTLFFTEMWERFSYYGMRAILLYYMYYSVTKGGLGFDKPLAASVMSIYGSLVYLTSVIGGFVSDRILGSRRTVFYGGVLIMFGHIALSLPMGAPALFTSIVLITIGTGLLKPNISEMVGGLYTEYDTRRDSGFTIFVFGINLGSFIAPLLVSWLGFNVNFHLGFSLAAIGMFFGLLQYIRGGKKHLPSASLYPSDPLEPNDAKKLTIRVGLGVVVFGLILLLMQVMGALSLSSFITLLSIIAVATPIIYFVVIISSKKISSTERSRVVAYIPLFIAAAIFWAIEEQGSVVLALFAGTQTNNNVGGIFNISPGWFQSLNPLFIMLYTPFFAWMWIKLGKKQPSSPSKFSLGLGIAGLSYLFMVIPVALFGAQAKVSPLWLLGSWAIVEIAELLISPIGLSVTTKLAPKAFESQMMSMWFLADSAGQAVNSQIVKYYTPDNEINYFLIVGLVAIVAGVLLAFLVKPIKRLMEGVN

SEQ ID NO: 5157 - protein, 273 aa, Lactobacillus buchneri
MVKIAVTSDNHLDLNKVTLADTIKQQATFLQDQGVDDYLIAGDLFNDFQKSVDYVQQLSAAVDPIRVFFIAGNHDMIKGVSYDELENGQWPGYLNNQFFDVPQTDYRIIGMNGWYDYTFAVNEDKTEDEFHRWKMAYWIDGLISQPMSDPEREQIVLSELTQQLQNAQSAGKKVILMTHFVPNQHFIHYTNDFRFWNMANAMMGSLHFQKLIENYQVERVVFGHIHQRLVPIRLKATTYYNAAVGYHNHRHNEWQTNDFISEWAKQLKMFQIF

SEQ ID NO: 5158 - protein, 265 aa, Lactobacillus buchneri
MKIGFIGVGAMAQAIIQGLLKAEFVPAQDILVHSAHQDHYEKYAAQYGLTPKESNTAVVDGSDLVVLAVVPAVVTDVVAEIRGALSAKKTLISIVSGVSLDRLEELTDYNLPILRSLPNINSEFGQGMTAVAANENLTGDRKAQAISLYQATGSVLELKESQFSVFSAISGSAVAYVDFFIDSLSRAGVKYGFTKEMATQIAAQTTLGSAHSLMASKKSPAEMIDKVSSPGGDTIAGILAMEEAGFLPSVIKGIDATIAKSTGNH

SEQ ID NO: 5159 - protein, 377 aa, Lactobacillus buchneri
MSTVLIHAKIYTGKRIIQDGYIRFGQTILNVGPITNFEQQPSDRIIDASQRTIVPGFIDVHTHGGYGADSMNLDPQVISRIVNLMAHEGVTGVFLTTMTQSADAIAKSMQTIKMAAETNPRILGIHLEGPFISPKYHGAQPTEKIQKLDVDKITRWNTLSGGLVKILTYAPEMRVDPTAVSYCREHGIQMAVGHSDATYQLLNQALPPHVTHLFNAQRGLHQREIGVVGYAMLSQAKVELICDGFHVVPEAVQIAYQTIGPDRLELITDSMEAKGQPDGMYQLGGQPVNVFRGRATLANGHLAGSVLKFADAFKNMIQFTDCSIASAVKMTSTNQAEEFHLKGKGFIENGYDADLNLFDNHLDLMATYSYGKLVNKN

SEQ ID NO: 5160 - protein, 234 aa, Lactobacillus buchneri
VGLPIYIQIHNEIKRNIEANRWKIGDRIPSERELSTDFGVSRMTLRQAIQTLVDEGILERRVGSGTFVANQKVQEKMSGVTGFTDLMLAQGKKPSSKTISYHTMEPSLSEMEKLHISQEQAVLRMERIRYGDDIPICFEVATVPENIVEGLEKSEVTSSLYRTLEQKKNLQIGKAQQTVSAMLASERIAEYLNIKRGDAILRLRQITSLQDGRPFEYVRTQYVGDRFEFYLEKE

SEQ ID NO: 5161 - protein, 120 aa, Lactobacillus buchneri
MKKVSPKFWTYFLIIYVGVGIIVNLLHHQAAIQDTQYGMLGIFALAYVTSYLRMPRLNFYVIYFVLSMVILRQIGGYRDWTSWIIFAFMSAVMAWVTDWIRSGYAQRYDRPKKKNQKKQS

SEQ ID NO: 5162 - protein, 251 aa, Lactobacillus buchneri
MNNQSPTQPVDILGIPFENTTEKDFQAILHNVINQHQNTFVVTANPEIVMYAKANPDYEKLITTADYIVPDGIGIIMGAKMLKTPLKERVTGYDLFVHLLEWGNANQKSAYFVGAQPAVIRKLKKVVQENYPFLTIAGTHDGYFGDDRNIVHDIKRTQPDMVFVATGYPKQEAFINKNRRAADALWIGIGGSFDVLAGTVKRAPKAWQKMHLEWLYRVVKEPSRFGRLMVLPKYLWQIVKQKYSRKSRRAQ

SEQ ID NO: 5163 - protein, 485 aa, Lactobacillus buchneri
MSEDDNLTLHTDFYEINMMATYFEKHMENRKAVFEVFFRKLPFGNGYAVFAGLEHIISYIENLQFTDDDIDYLREVTDYPDSFLEYLRNFEFKGTIKSAYEGDIVFANEPILQVEGSLCECQLVETAILNMVNYQTLIATKASRIRTVVGDDPLMEFGTRRAQEVSAALWGTRATIIGGFNATSNVLAGKKFGIPISGTHAHSLVESFGNDYDAFNAYAQTHHDCVFLVDTYDTLKSGVPSAIRVANEMGDKINFAGVRLDSGDMAYLSKRVREVLDNAGYPNTKIYASNDLDETTIASLKMQHAKIDVWGVGTKVITAFDQPALGAVYKMVSVEDADGKMTDTIKISGNAEKVSTPGKKQVWRITDSKDGKSEGDYVTLADEDPRKEKSIFMFHPNYTYINKTVDNFDAMPLLKPIFQDGKLVYDQPNLKQIVHYAEKELASLWPEYKRELNPQKYPVDLSQKCWDNKRDIIEKIRNYIQDINY

SEQ ID NO: 5164 - protein, 275 aa, Lactobacillus buchneri
MRAKQQEIIDALKVKPTIDPKAEIRRSVDFLKDYLKKFSFLKTLVLGISGGQDSTLAGKLAQLTISELRDETGDPDYQFIAVRLPYGVQADESDALEAIKWMDADVVARVDIKPAVDAAVASVEANDIEVADFNKGNIKARQRMIAQYAIAGAKSGAVVGTDHAAEAVTGFYTKFGDGAADITPLWRLDKEQGKQLLKLLGAPEHLYQKTPTADLEDNRPALPDEVALGVTYQDIDAYLEGREVSEKAAETIESWYDKTQHKRHTPINVYDTFWK

SEQ ID NO: 5165 - protein, 887 aa, Lactobacillus buchneri
MTQEKKMFYQRTVDDVMSQMKAHPTGLSDQEVKDRREQFGANRLTSKRRTTLIEKFISQFKDLMIIILIIAAIIAGFAGETVDAAIILAVVILNAVFGVFQESKAENAIDSLKEMSAPMATVLRNNQPMSIKSEDIVPGDIVLLEAGDVVPADVRLIEANSLKIEEAALTGESVPVNKQVDPIVEDDLPLGDRKDLGFMNSNVTSGRATGVVIGTGMNTEVGKIAHMLNTTEETTTPLQENLKSLGKMLTVLILVIAVIVFAVGMWRGQESLINMLLTAISLAVAAIPEGLPAIVTVTLALGTQQMARHRALIRKLPAVETLGSTDVIASDKTGTLTQNKMTVEKVFLNEKLQDSADTHLTLNDRLAQIMVLNNDTKYQENELAGDPTETALVSFYLHQDQPVQKFVNSHRRLAEIPFDSERKLMSTYNQMDDGQILMTMKGAPDQLLERVTKIQDGDNVRDITDDDKRLISVTNHDLATQALRVLAFAYRLVDTVPTELTSAAQEHDMIFVGLIGMIDPERPEVAQAVAEAKSAGIKSIMITGDHQDTAQAIAKRLGILGRGDNPGGKVINGAQLDEMSDDQFNREVADISVYARVAPEHKVRIVKAWQKQGKVVAMTGDGVNDAPALKTADIGVGMGITGTEVSKEASDMVLADDNFATIVTAVKAGRKVFANIQKSLQYLLSANLGEVLTLFVMTMMGWQILAPVQILWINLVTDTFPAIALGVEPAEPGIMKRKPRGRTSNFLSGGIMSNILYQGFFEGFITLCVYAFAITNPVHASDALAHADALTMAYATLGLIQLFHAFNSKTIHESIFRIGMFKNKFFNWALLGSAVLLIMTIVIPGFNEMFHVTELTASQWLVVVFGGFMIVVVSEVVKYIQRHISHK

SEQ ID NO: 5166 - protein, 143 aa, Lactobacillus buchneri
LKPQDMQRYAKTVSDVIDETSKNGEDLNADYETLRKAIDNQTVADLTSDQLAGIQAHFQSGTDKYQDNVNKLEQVAVPVKLLGKHKLLVRHYEDYANACQAMTDSIDPQASTVDVDKFNQAEKDQENSIAKVSSTTTRIMGEI

SEQ ID NO: 5167 - protein, 722 aa, Lactobacillus buchneri
MDNTLAHKIQQDLPKIREKQIVETLKMLDEGDTVPFIARYRKERTSNLDEVQIRDIQDAAHRIQTLDKRKQEVIKIIDEQNALTPELKKQIEAASVLQQVEDLYLPYKQKRRTKATIAKEHGLEPLAKSAMSFAPDLKQQAAQYVDPDKELPDVDAVFAGVHEIIAEDAGDRADFREWVRQNTQQYGQLVVKVKRGGKELDEEGTYQQYYDFNQPIKSIPSFRTLAINRGEKEKVLSVKIEVNEAPIMWHLKANTVGSHQGFAADVVTDAIEDAYHRFIGPAIEREIRKQLTEVAADHAIDIFGKNLYNLLMQAPLKGKIVMGFDPAYRTGCKLAVVDQNGKYLDKTVIYPHKPASEAKRKAAKGLFIDFINQNHVEMIAIGNGTASRESEQFVADAIKEIKTPIYYVIVNEAGASVYSASQVARDEFPDFSVEQRSAVSIARRIQDPLAELVKIDPQAIGVGQYQHDVPQKQLGEQLDTVVETAVNRVGVNLNTASPDLLVHISGLTKTTSGNIVKFRNENGEFSARSDLKQVPRLGPKAFEQSVGFLRIIGGKNPLDNTDIHPESYSAAKSLLKKHGLTINQLGEPAVSSALSQLNLAQEVESIGVGVATLKDIIKGLETPGRDLRDEMPAPLLRKDVLTMEDLKPGMKLQGTVRNVVDFGVFVDIGVKQDGLVHISKMSRTFVKDPSKVASVGDIVTVWIDSVDLDRHRIQLTMVDPEG

SEQ ID NO: 5168 - protein, 155 aa, Lactobacillus buchneri
MTDQELQQLVEHISLQYFAKPFTHRAYFNARLKTTGGRYHLNDHNIDINPKMDDGADHAVLIGIIKHELCHYHLHLAGYSAKHNTKQFKQLLKAVGGSRYAPRVQSTRVQTRYIYRCEDCGLEYHRRRRINLVKYVCGRCRGKLHLISQTRQIGA

SEQ ID NO: 5169 - protein, 292 aa, Lactobacillus buchneri
MAKIIIRVPATTTNLGSGVDSVGLALQLYYTVIVEEKTDEWKVNHALGHDIPTDEHNLIVQTILKVDSDIHPHQLTVISDVPIAHGLGSSTTAVVAGIKIANKLGDLGLSIEDQINLGTKIEGHPESVAAAMLGNLVVSTYDGETVTAATLPVPDVSALMYIRPDGVSEVESRKKLPKQIDYDVAVHASSQENVFIALVAQGKWEQAVKLIENDHLHEPYRKELVPEIDQIRSTAHKLDIFGTYLSGAGPTVATLGKKAALTQLRIDLAQQNLNGSLRLLQIDTEGATVRGE

SEQ ID NO: 5170 - protein, 205 aa, Lactobacillus buchneri
MKYFIFDVDGTLIDTEKMYMLPLHKTLLENGYDFSYEDVVKLFGITSMDTVRILGVKNPVDIRDQWFAKIKDYTQYAHVYDGIEDVVKKLHADPTIKTAIATSKVEAEFHRDVTKFGLDQYFDAFVFSNEIKKGKPAPDMILKGIEKLDADPAATIYIGDTKFDLQAAHAANVQFALAGWRTKKTADFADTDYDLKTPADLLTIQ

SEQ ID NO: 5171 - protein, 153 aa, Lactobacillus buchneri
EIIABCMPNENTMISILVVSHGNFAKSLVTTAEMIAGKQEQVGWVSLAANDGVDSLSDKVASALADFPEDTPTLILADLWGGSPFNAAAQFAAKNPQSIALVAGVNLPILLEAYMARNSTLSELVNKINEIADDSIRQFEVSTDNDDDLGDDL

SEQ ID NO: 5172 - protein, 179 aa, Lactobacillus buchneri
EIIABCMPNENTMTMDIRLARVDSRLLHGQVATFWTRAVTPNRIMVVSDSVAKDPLRKTLITQVAPPGVKANVVTVNKMIRAYFDSRFDSFNTLLLTETVADMLKLAEGGIDFSKIGINIGSIAYNDGMTMLTDAISMNGDIAKQIRTLANDFHLDVYAQKIPAEKKENLLTLLDKKGF

SEQ ID NO: 5173 - protein, 267 aa, Lactobacillus buchneri
MSLVSTSLVLLVAFVVGMDGILDEWQVYQPMIACTLIGLAIGNVGVGIMLGAILQMITIGWINIGASVAPDIALPAVVSALLVCGPAALSIKHGIALAVPFAVVGQLLNVTIRKSIVKFIHTADQAAENGQIQQIDRIHLLSLGIQGLRVLIPTGLVMLISPQLIHQLMQQIPAGITNGIAISIGMVSAVGFANLINMMVSRSLWIWFIVGFLIAIFTKINLFILAGLGLVAAISFVWLKSRRHGSTGGDGEGKDDLDDFDKELDDL

SEQ ID NO: 5174 - protein, 283 aa, Lactobacillus buchneri
MANNQNMIHDSHQPIHLRQIDFFRTFWRSGTEQGSWNFERMQNLGFAYIMAPAIKRLYPDMNQRKAALKRHLGFFNTAPIMQSLITGVVLSMEEQRANGADISDDTINAVKTAMMGPMGGFGDPVWLGTIRPVLSAFAASLVLSGYGMMGPILFFIAWNVLRLVFRYMTQMAGYRRGADIINLFNTGIIKYVGSATSMFGVFMMGVIVARWVTVDFASVRGLFGSSTISQFVDTMINGGLNVIAPVALTLVCVWLIRRRISPIWIILGLFVIGVLGYYAGVLV

SEQ ID NO: 5175 - protein, 364 aa, Lactobacillus buchneri
MPSDKDNNNDFEPVYSRRSDKKPHYKKKNHRRRRIIGWSIFFVLLIALGGGLVWGYGAYKSAKSTFKKTYDSTNVTKARNVSSVIQQGKPLSILLLGTDTGALGRHDTGRTDTMIVASVNAKKKTIHLTSIARDTKVVVPGDTQPYEKINAAYTIGGAGTAVKTVQNLLDIPVDFYAIINMGGLEKMVNAVGGVDVTPPLTFQYGAANVVKGKKIHLNGRQALDYSRMRDDDPRGDYGRQARQRQIIKKLVMKGLNITSLPRYKSILSSLSGNMKTDMTFDDMIAIRAKYGDATHHIKSQTLQGENAMIDGLSYQVVPQNELLRVSNDIRTSLGLAKSTKLQTSQTDTDDGQGATQSSSTYNGY

SEQ ID NO: 5176 - protein, 314 aa, Lactobacillus buchneri
MEVFYNAVSGVLIILIMIALGFVLARNDWFDGKMTSMIARLVTQVALPAYMISTIMEKFTAKKLLTTLPDLFFPIVSMLSLYIVSIFVVKFAKIPKMHSGLFMSMFSNSNTVFVGLPVNMALFGKSSLPFVLVYYMANTTFFWTLGVYLIQKDGKGEASFNWKQTLKKVFSPPLLGFMVGVVLVLMHVTLPDFLMQDFNYIGNLTIPLSMIFIGISINIVDLTNVHFDRSNFLILFGRFMLAPIIMSLLVIPTPMPVMMKQVFIMQSAMPIMTNAPVVSRLYHADSEYASIMVAETTLLSLIMIPVLMVLVEKL

SEQ ID NO: 5177 - protein, 223 aa, Lactobacillus buchneri
VPTLVIMRHGESQANRDNIFTGWSDVPLTDKGVRQAHSAGKVIAKSQIQFDDVHTSFLKRAIITTNIVLDEIGQNFIPEHKSWRLNERHYGGLRGKNKLKVKERVGAKQLKIWRRSFTVVPPLLTKRDEDPRYERYGVQIPLGESLEMAQQRLIPYWVDQIAPNLLDNKNQLIVAHGSTLRALIKFLENISDEEIPNVEVPNGKPIRYDFDEQLNIISKSFME

SEQ ID NO: 5178 - protein, 444 aa, Lactobacillus buchneri
LTAEINLDQISKYQKNLDNRKDSKVIERAVTHQGILESSEDFTAEGKMSPVFSIDLSTGKVADQKQSGRCWMFAALNTMRIHLMNTYKVPDDFELSQNYTNFWDKFEKANYFLENVLKTADQPLDSRKVAWLMATPQQDGGQWDMLCALIEKYGIVPKSAMPETFNSNRSSQLNKFLNLKLRHDAVALRELVADKASEAKIAETKDNMMSEVYRMLTYALGEPATKFDFEYRDKDKNYHFDAGITPQEFFKKYVNLNLEDYVSLINSPTDDKPFNKTYTIEMLGNVVNGRPVKHLNLEMSELKKLAIKQLQNGESVWFGSDVGQSSNTKKGIMDTSLYAPDELFDSDLSMSKAERLDYGESLMTHAMVITGVDLVDGQPTKWKVENSWGEKVGTKGYFVMSDDWMNEFVYQFVINKKYLTDEQLEAQKQEPTVLKPWDPMGALA

SEQ ID NO: 5179 - protein, 227 aa, Lactobacillus buchneri
MKHQDELKQSVGKAAVKFIEDGMTVGLGTGSTVKFMVDALGERVKSEHLSIVGVPTSERTREQANSLGIKTKGLDEIDHIDLTIDGADEINRTFQGIKGGGAAHLWEKIVAINSDKNMWIVDSSKMVDELGSFPLPLEVIPYGSHQLLKRLDAKGYHPKFRMNGDQYVKTDSNNYVIDLHLGQIERPHHLALELDQMTGIVEHGLFLDLVNTVIVGREDGPQTIQAR

SEQ ID NO: 5180 - protein, 179 aa, Lactobacillus buchneri
MKRGFEIVSKYADENLSLPYRTTENAAGYDFESAADMVIPSIWKLNFLKVLWALKHEKTVREDSIAEAKKVLKPFLIPTGIKSYMQPDEVLVIANRSSNPLKRGLVIPNGIGVIDSDYYNNRSNEGEIFVQILNFGITDIKIKKGERIAQGIFLPYLLADQDDQRKKQTRSGGFGSSGQ

SEQ ID NO: 5181 - protein, 457 aa, Lactobacillus buchneri
LAKVKTQFVCQNCGYISPRYLGRCPNCNEWNTLVEETITPKNSTMATQSLRRNGIHDNKPESINKVEFHKDIRFKTDMEELNRVLGGGVVPGSLILIGGDPGIGKSTLMLQVSGQLSKSGKILYVSGEESASQIKMRADRLGVNGENLYVYPETDMDVIKDTINEMKPDAVVIDSVQTMQIPELQSATGSVAQIREVTADLMNIAKGQGITVFVVGHVTKGGAIAGPKILEHMVDTVLYFEGDLHHSYRILRTVKNRFGSTNELGVFEMRTDGLREVKNPSEIFLEERLKDATGSAIVVSMEGTRPILVEIQALVTASVFGNAQRTATGLDRNRVSLIMAVLEKRAGLMLQNQDAYLKAAGGVKLDEPAIDLAIAVSIASSYKNRGTSPTECYVGELGLTGEVRRVTRIEQRVAEAQKLGFKRVLVPANNLQGWNPPTGISVVGVSTLAQALKLALG

SEQ ID NO: 5182 - protein, 419 aa, Lactobacillus buchneri
TRAMDMAINCNTAININGPRTEINPRECRSRLKRKRIVRIVFTLAGAAIGASYFPMIWLIFQVRYGTLFNNTATNAVVGAIIFYFISLLTGNYILKAVDRVEVRLTKQSPLSLFFGTLGLIIGLVVAILISIVFFRTRTFFLNTMIPTILMLVLGYFGFRIGNTQSDRWRKMFQSRRKSETAKAGDEKIIDKPVDKNYHHYKILDTNILIDGRIYDVVKTGFIEGTLLVPKFVLYELQYIADSSDSVKRVRGRRGLDILNKLQNEDLIPIEIYEKDYEDIPEVDSKLIQLAKDVDGVIITNDFNLNKVIQFQNVQVFNINALANSLRQKILPGQKLNVMVVKNGTERQQGVAYLDDGTMVVVEDGRYFLNDHIDVVVTSAIQTDAGKMVFARPEHSTKNITDKPDQNKGNGKNGSNNKK

SEQ ID NO: 5183 - protein, 497 aa, Lactobacillus buchneri
LANNAIRVRYAPSPTGHLHIGNARTAIFNYLFARHNKGKFIIRIEDTDTKRNVADGEKSQLDNLKWLGLDWDEGPDVGGDYGPYRQSERKDIYTPLIQQLIDEGKAYESYRTEEQLTADRDAQKARGEMPHYEYEYEGMTEDQKAQAIADAKAKGLKPVIRFRVPKNHEYAWDDIVKGKVSFNSDTIGGDFVIRKRDGMPTYNFAVVCDDHLMKISHVFRGDDHVANTPKQLMIYEAFGWQAPRFGHMSLIISADTGKKLSKRDESVLQFIEQYRKLGYLPDAMFNFILLLGWSPVGEDEIFTKKEFIKMYDETRLSKSPAKFDSKKLEWINNQYVKEADNSTIMDLALRQLIAGGNIPENPDSKTIEWARQLIMLYKREMSYMAQINDMASVFFQEPEQIDGDALAEISNETAPVVLKEFLERIQKLDIFDSVEIFKVIKAIQKDTKIKGRQLWMPIRIAVTHEMHGPELPESVELVGKQKAIAHIKETLAQIDKA

SEQ ID NO: 5184 - protein, 468 aa, Lactobacillus buchneri
MLQIFNTLTRKKEKFEPITPGVVKMYVCGPTVYNYIHIGNARSAIAFDTVRRYLEYRGYQVKYVSNFTDVDDKMINAARQNHTTVGAIADKYINAFMQDTAALNISSNVIHPRATKNIPEIIDFVKTLVDKGYAYDVDGDVYFRARKFKSYGALPHINVDQLEIGASQHVNPEEMAKKEDPIDFALWKKSKGDEISWDSPWGKGRPGWHIECSVMSTKYLGKTIDIHGGGEDLIFPHHENERAQSEANTGQTFVKYWMHNGFVTIGDDNEKMSKSLGNFITVHDLLKNLDGQVIRLLMSTTHYRRPIQYSDASVKEASSNLKKLQTAFNNLEYRLHNADEGDDPKTDQEVRQIVADFTDAMDDDFNVQNGIAAVYELAKFANTYSERETVFKLSLQFIINTLRQLSGVFGIKLEQSELKDDEIWSLIHEREQARHDKDFIRSDEIREELKARGIVLEDTPQGTRFRKE

SEQ ID NO: 5185 - protein, 136 aa, Lactobacillus buchneri
MIDNFSQLNGIALAYMGDAAYEVFIRRHLIAQGLTKPKRLQHVATNYVSAKAQAALIDLMKTDGLLNETEWDYFKRGRNANSHTHAKNTDVITYRISTGFEAVFGYLSLSDQTDRMKEIANWCIEQVESGNLKHEE

SEQ ID NO: 5186 - protein, 266 aa, Lactobacillus buchneri
MKNDNRSQDHRSDDSQDQPEEFVIGRHPVVAALKSENPVNKLFIQSGIKDDDNIISEIMKLAHKKRLVISKVPKQKLDKLSNNQNHQGVVLSIAAFKYATIDDLFANAKKQAVEPFFVILDNIEDPHNLGSIIRTADAAGVSGIIIPKHRAVGLTATVSKTSAGAIERVPVARVTNLSATIKELKQRGMWVFGTDVSGTDYRRWDAKGSIAVIIGNEGKGISPLLKKQVDEMLTIPMVGDIQSLNASVAASILIYQGFNSRHPLSK

SEQ ID NO: 5187 - protein, 177 aa, Lactobacillus buchneri
MKEDLLIVDAYNMIGNWPHLNKLKQANRLEDARDQLLAELSEYKKYRDINMIVVFDAMYVPGNSKSFRKFDMEIVWTSKDQTADSYIEALAHRKQNRFTQVIVATSDQAEQWTIFAAGALRIPARELLRDVQRAKQEVDTEARKMTDQGQVFRHTPFDAKQLLELEKLRDKMIHDGQ

SEQ ID NO: 5188 - protein, 185 aa, Lactobacillus buchneri
MLPNNRLELIRQTAKRNEEAFAQLFHQYYPIVRKYKRQYYINGYDKDDLDQEARMVLFRSACRFEAARKVSFGTFFSHNLRNRLFDLIRTNNAQKRVPVEPLTSFEANEYFYAAKIADNSASSPIDAVIVDDALRKLYSSCSPLEKRAFNLMLSENGYADLDPKAQRGIINAFERCRRKFDGEIN

SEQ ID NO: 5189 - protein, 49 aa, Lactobacillus buchneri
MAQRKVALACSVCGSRNYTIPANPNRTKRLELNKFCKYCGKYTLHKETR

SEQ ID NO: 5190 - protein, 58 aa, Lactobacillus buchneri
LRLINFFKKVAQEMKVVTWPNASQTRTDTSTVIGTSIIMAIFLGLVDWIVQWALQFLA

SEQ ID NO: 5191 - protein, 182 aa, Lactobacillus buchneri
MVESAEKQWYVLHTYSGYENKVKMNLDSRKESMGMQDYIFRTVVPEQEEHEVKNGKDKVKMDKTFPGYVLVEMIMTDQAWYIVRNTPGVTGFVGSHGQGSKPTPLLPDEVDLVLKRIGMSSRHEDLDVNIGDTVKIVDGAFTGLDGKVTEVDNEKQRLKVNIEMFGRETSTDLDFNQIDTTL

SEQ ID NO: 5192 - protein, 282 aa, Lactobacillus buchneri
MVWMAGLIIVLLIAMVVVGRLIRLGTPNQVGNDSDPANGIEAIPTLFIPGYFGNRLSFGRLINRLTRQYGANKSMVIKVDRHGKIHVSGHLAKSKVLIQVLFADKSSRPRQQAVWLSEVLEVLNTRYGVEEINLVGHSMGCITIFWFLTHQSKMTPVSVEHVVAIAGPFNDSEIARSTDKVDAYPLNAKGPTKRMPIYRALSQRVFAIPRDIKVLNIAGRISNTQQNDGEVSVNSAFSLRYLLQDPAAQYHELVIRGKRATHRLLHENAIVDQEIAKFLWNQ

SEQ ID NO: 5193 - protein, 141 aa, Lactobacillus buchneri
VAKKVANIVKLQIPAGKATPAPPVGPALGQAGINIMGFTKEFNARTADQAGMIIPVVITVYEDRSFDFITKTPPAAVLLKKAAGVQKGSGEPNTNKVATVTKDQVKEIAETKMKDLNAADVEAAMRMVEGTARSMGFTVEG

SEQ ID NO: 5194 - protein, 235 aa, Lactobacillus buchneri
MARKRGKNYKAALEKVDAEKAYPIKDAVELIKDIDFAKFDSTVEIVFKLNVDTKQADQQLRGAVVLPNGTGKEQTVVVFAKGDNAKAAQDAGADFVGDADLVQKIQDGWLDFDVAIATPDMMAQVGRLGRVLGPKGLMPNPKTGTVTMDVAKAVKESKAGKVTYRTDRDGNVAVPVGKASFDTDKLVGNLKTIEDVIVKARPASVRGVYVNNVSISTTFGPGVKVDLDSFSSVEA

SEQ ID NO: 5195 - protein, 170 aa, Lactobacillus buchneri
VSEQTVAIKAKKVASVTEELKNASSIVIINYRGLTVAEVTDLRQQLRDEGVKMEVIKNKVMDRAAAEAGFDDLKPTFNGPTAVVFSSEDPVAGPKIVHNFAKTNDKLKLKGGVIDGEVASLEEITAYAALPSREELLSTLANILQAPVRNFAYGVKAIADKKQSDDGDAA

SEQ ID NO: 5196 - protein, 121 aa, Lactobacillus buchneri
MAFDKDNIIDQLKDASISDLNDLVKSIEDEFGVSAAAPVAAAGAAGGDSATKDSYDVELTESGDQKVKAIKAIRDITGLGLKDAKGLVDKVPSIIKEGASEDEANKIKEQLEAVGGTVTLK

SEQ ID NO: 5197 - protein, 862 aa, Lactobacillus buchneri
MTRVKEFIDKRMTMIKLIFVFSVLIFVIRQLAKIIREVNGEQFKTVLASQSRGALLIMLVAGFISILPMLVYDYSIVQFLPTKFSPGYIVKSGWVVNTFTNLLGFGGLLGASLRAHFYGKGATRKQILYAISKVALFLISGLSLLCLVSLIMIFGFGIGTEFAHYWIWLLGGAVYFPGVMIFTQVTNSQFFSDLSTKQELVMTAGSFLEWGSALGFFILIGYLMNLPVDLRLVVPIFVVANVAGVVSMIPGGLGSFDIFVIIGLGFIGVARSDALVWILLYRLFYYLLPFIVGTGLFIHDTGSKLNTFLDDLPRLLFQRIAQVFLTGFMYFSGIMMLLFATVPNVVVVNKLYVKLLPYSIFFVSHMMNIIVAFLLIGLASGIWTRTKKAYAPTVFVLIISIFNTWFNEAFTWRMVLLFVIILITLRLSKAVLYRDRMANSWGVFLFNGSIFIITFAIYTLIGIAANRNLHLHFDKAYLFPSAGAWLVGFVGLLIALAVLVGMNAYLTAGHPEWLTQRFDADRVKAVIDKFGGNEDSHLAFLRDKQIYFYSKDGEDQVFFMFKKIADKLLIMGEPVGNRAQFADAIDDFVKEADKSDLKLVFYEIDEELTMSLHETGFDFIKTGEDGLVDLDQFTLSGKRHRGERALMHKFDREGYQFEILQPPFSDELLATLRKISDEWLDNKAEKGFSLGFFDEYYLQQAPIAVMKDHAGKIVAFANLMPDGNKVVTSIDLMRSSADAPSGIMDGILINLYEISHDKGYKYFDLGMSPFSNVGTSRFSFTQERIVHLIYQYGYKLYSFEGLRSYKDKYVDKWESKYIAYYRRSGLVYAVLQIILVVNQPRNKKPAGLSKALWYIMDANQPK

SEQ ID NO: 5198 - protein, 388 aa, Lactobacillus buchneri
MISDDVQKLFNDKFGYDSSKVFFSPGRINLIGEHTDYNGGHVFPCAISMGIYAAYGERQDNKIRMFSGNVSDAGIVEVSLDNLAYNKEDGWTNYPKGMLVQILEHGYKIGHGFDLAVYGNLPDGAGLSSSASIELLTAEIVNDVFSLGIDELDLVKYGQLVENKYIGVNSGIMDQFAIGMGKKDQAILLDTNTLKYDYVPAKLGDRVIVIMNTKKHRELQDSKYNERRAECEEALKRLQVGLPIKSLGDLSESEFDENSYLINDDVLIRRARHAVFENQRTLQAKDALVNNDLETFGKLVNASHVSLHYDYEVTGKELDTLAETAWKQPGVVGARMTGAGFGGCAIAIVDRDQVDAFTKNVGEVYEKEIGHPAEFYIAEISDGPKEIK

SEQ ID NO: 5199 - protein, 334 aa, Lactobacillus buchneri
MAILVLGGAGYIGSHTVDRLIENGYDVAVVDNLVTGHKAAINPKARFYEGDVRDKDFMNQVFDKEEIEGVIHFAAFSVVPESMEKPLKYFDNNTGGMISLLEVMNAHNVKKIVFSSTAATYGEPKQIPIKETDPQVPTNPYGESKLAMEKIMHWSDVAYGIKFVALRYFNVAGAKPDGSIGEDHHPETHLVPIILQVAAGERDELTIFGDDYDTPDGTNVRDYVHVLDLADAHILALKYLQAGHDSDAFNLGSSTGFSNKQMLDAARDVTGKPIPAKMGPRRAGDPSTLIAASDKARKILGWKPQFDDVHEIIKTAWNWKETHPKGYDDRKGNQ

SEQ ID NO: 5200 - protein, 488 aa, Lactobacillus buchneri
MSQSAVEKFVDLIIKSDSPYSDVDRIYVTNLIFRLIGDGFGEPTEDSSAVDLANDLVDLAIEHGKVEDSITNREILEDQLMDLLTPIPSTLNQIFWNKYQQSPDAATDYFYHMSQDNDYIKTRAIAKNISYETKTDYGNLEITINLSKPEKDPKAIAAAGRAKSTSYPVGPLAIENEGYLGRLGYPARSNHRVIRMMINGEPWGFQYSPYAYFGEHAIFLNQKHVPMSIDQRTFVNLVDIIKQFPHYFVGSNADLPIVGGSLLAQDHYQGGRHTFPMMKAKIDRPVDLGIDGLSAGIVKWPMATIRLVSKDANKVVNAANRIAETWKNYSDESVDIRAYTDGTRHHTVTPIARMNDDQFEMDIVLRDNQTSDKYPDGIFHPHQDVQHIKKENIGLIEVMGRAILPARLKTEMKEVEKYVLGEDNQIADYHKPWADELMKRDHFTKDNVEEVVDQEVGKVFGRVLEDAGVYKWDDKGQAAFDRFIEQLK

SEQ ID NO: 5201 - protein, 331 aa, Lactobacillus buchneri
MKFIVYNVRDDEIPFIEKWGKDHGIEVKYTTTTLNQETVEEAAGFDGISCLQTIQYSAELFESFKRLGIKYLSLRNVGVDNIDLPAAKANGVKITNVPAYSPESIAEFAVMMSLYLSRKVGYMRQQLDQKHEFHFSPNFMGRLISEQTVGVIGTGRIGQAAIKLFKGLGAKVIAYDKYPLKNTDNSFVYAKSLEQIYQESDIISIHMPATDDNYHQFNHEVFEQMKDTAILINTARGSIVDTDDLIFALQSGEIAGAGIDTIENESADLQDSRSTKKVNDPDVLKMALMPNVLITPHSAFHTSEAVKNMIDISLGNLETMVNGKTPKDLVD

SEQ ID NO: 5202 - protein, 318 aa, Lactobacillus buchneri
MTENYKAINWNAIDDQIDKATWEKLTEQFWLDTRIPLSNDLSDWRTLDQDHQWVVGHVFGGLTLLDTLQSQEGMASLRKDVQTQHETAVLNNIQFMESVHAKSYSSIFSTLNTPDQIDEIFDWSDSEEFLQNKALKIRDIYANEPDPLKKKVASVFLETFLFYSGFYTPLWYLGHNKIPNVAEIIKLILRDESVHGTYIGYKFQIGYNQLPKEKQEDMKNWIYDFLYKLYGNEEKYTHILYDQTGWTEDVLTFIRYNANKALMNLGQNPLFPDTAEDVNPVVMNGISTSTANHDFFSQVGNGYLLGNVESMKDSDYDI

SEQ ID NO: 5203 - protein, 721 aa, Lactobacillus buchneri
MSLHNLKDVTYFDLNNEINIPVNGQIPLQKDKEALEAFLKENVQPNLMKFDSLSDRFDYLIKNNYYEADFIHKYQLSFIEKLYQYLNDQDFHFKSFMAAYKFYAQYALKTNDNDLYLESFLDRVAANALFFADGDEQLAMDLADEIVHQRYQPATPSFLNAGRENRGEFVSCFLIQTTDDMNTIGRTINSALQLSRIGGGVGINLSNLREAGAPIKHIEGAASGVVPVMKLLEDSFSYSNQLGQRQGAGVVYLSVFHPDIIEFLGAKKENADEKIRLKTLSLGVTVPDKFYQLIKADADMYLFSPYDVEREYGVPFSYVDITKEYDNLVANDKISKKKIKARDLETEISKLQQESGYPYIINIDTANRSNPIAGRIVMSNLCSEILQVQTPSTVDNQQHYIKMGKDISCNLGSTNINNMMAGDDFGHSVESMVRALTFVTDHSNIDVVPSIQKGNKESHSIGLGGMGLHSFLAKHHMYYGSPESIEFTSVYFMLLNYWSLVASNKIAKERKETFVNFENSKYADGSYFDKYLDGSFAPKSAEVKALFKDDWIPTKEDWENLKESVMKDGLYHQNRLAVAPNGSISYINDTTASLHPIINRIEERQESKIGKIYYPAPYLSNDTMPYYTSAYDMDMRKVIDIYAAAQQHIDQGMALTLFMRSTIPEGLYEWKNGRTDKMTTRDLNILRNYAYKKGVKSIYYIRTFTDDQQEVGSNECESCVI

SEQ ID NO: 5204 - protein, 76 aa, Lactobacillus buchneri
MAKITLYSKNNCMQCKMTKRYLSEHNVQFEEHNINEQPQYIDYLKQRGFMAVPVVDVDGKQAFSGFRPDQLQSIAG

SEQ ID NO: 5205 - protein, 203 aa, Lactobacillus buchneri
MSEQSFYYSKNPNVKSDPITWNFALLGNNLVFTSDNGVFSKHTVDYGSRVLVNHINYDLIPDGKLLDMGTGYGPIGISIAKAFPDRQIDMVDVNEVALALAKKNADANRVDNVHIFESNIYEAITDQYAAIVTNPPVRAGKKVVDAMISGAVDHLVDGGTLTVVLQKKQGAPSAKKLMTKLFGDCQILKRDKGYYILQSIKKS

SEQ ID NO: 5206 - protein, 165 aa, Lactobacillus buchneri
MFQADSRFMKAALVEATKAYLIGEVPIGAVVVHDGTIVGRGHNLREHLNDGTAHAEILAIQEACRTLRSWRLIDCDLYVTIEPCLMCAGAIINSRIENVCFGSRDPKAGATRSLYAVLEDSRLNHQVNVVEGLYADAASRIMKDFFKAARKKRKNKAGNSESFKL

SEQ ID NO: 5207 - protein, 600 aa, Lactobacillus buchneri
MSYQALYRVWRPQRFDEIVGQSIITRTLKNALITKQTSHAYLFTGPRGTGKTSAAKIFAKAVNCHYLKDGEPCNQCETCKAINEGSLNDVIEIDAASNNGVEEIRDIRDKAKYAPTQADYKVYIIDEVHMLSTGAFNALLKTLEEPPANVIFILATTEPHKIPATIISRTQKFDFKRIKPQDILERMEYILDQKKVEYDDKALKLIAKAAEGGMRDALSILDQAMSYGDNKITYENALLVTGSVTNELLTTYMQQVVKKDTKSALITIQKILDEGKDASRFIEDLTSYCQDILLYQQDPGIVEEMELGIIDDQFKALSGQISDQAIYQMINELNAISNSLRFTAHPDVYLEVLTVKITHLDATNQPKAVSAPQSQQSAKTAVPPEVNAEIQQLTQQVAELKAEVADLKRESTPQSPTVSTPEPAKVSEAHSMDNHIELAKIYPILGKATRKQLNQFKSVWPDLMDALSVTQRAVMHVSSPVAASAGGVIVAFEYPFLYQKAQGDTDLKDALENNLDRIVGKAPQIVFVPENQWPDIRREYLASHKDKIKKTGSQSKEANDPKAEPADDDPEPSKEEPDSQPVVKKAAELFGTDILDIKDD

SEQ ID NO: 5208 - protein, 103 aa, Lactobacillus buchneri
MMNGMNMNKMMKQMKKMQKQLGEEQENLKQQEFKGVAPDNMVEVTFGGDKKMKDIQIKPEAIDPDDPEMLGDLVLAAVNDGLSKVDKATESTMGKYTKGIPGM

SEQ ID NO: 5209 - protein, 199 aa, Lactobacillus buchneri
MQYPEAIAKLIDSYMKLPGIGSKTATRLAFYTVDMNEDDVKAFSKALVATKNDLHYCSICGNLTDEDPCEICRDKTRDQSTILVVEEPKDVMVMEKVQEYHGLYHVLHGVLSPIEGKGPEDLNISSLIKRLQQNKAVKEVIVATNATPEGEATAMYLSKLIKPAGIKVTRLAHGLSVGSDIEYADEVTLFKAVQGRTEI

SEQ ID NO: 5210 - protein, 88 aa, Lactobacillus buchneri
MFFNRLRRQNVKREYDDRLLELINNLKEEWDHAAQTQEAVADSDMEMEQETALARQKYFFIYKEARIRKIKNYQIQPSVISYDHDNFE

SEQ ID NO: 5211 - protein, 216 aa, Lactobacillus buchneri
LNGKFITFEGPDGAGKTSVMNRVIEVFNQEIGDQLLVTREPGGNKISEEIRKVILDRENTEMDYRTEALLYAAARRQHLVETILPALKQNKLVLCDRYVDSSVAYQGAGRQIGMAQVAKMNEFATEKLLPFKTIYFDIPVDVGLDRIAEHRDRSKIDRLDVETNEFHKRVHEGYMKVRDENADRFISIDATQPINRVVNDTIKIIHQIASEYFKES

SEQ ID NO: 5212 - protein, 108 aa, Lactobacillus buchneri
MKLVIAIVQDKDANKLRSVFVAHDIIATRFSTTGSFLRAGNTTYLVAVDDSKVDLTLKLIKETCSARQQFMTPPVSLNGDTAEHTFPIEVQVGGATVMILPIEDFKQF

SEQ ID NO: 5213 - protein, 336 aa, Lactobacillus buchneri
MEHDIVNVAQTKQPTIFTQFMNLIKNNELSHAYLFTGEDGAGQFSVAMGVAMRLFCTNVQNGMPCGKCAECVRIMNHDHPDVVITEPDGQSIKVDQIRHVKSEFTKSAMEGSKKVFIISEAEKMTTGAANSLLKFIEEPTGNVVSFLISQNRNLVLPTIISRTQVVEFPSLSKKQMVQELQNSGVKPSEVNLMISITNSLDQIKELSKDDWFASMQRLLEKWFTYLVKENNMAMPFIQMSLMPLITNKDRQRIVISMMLSLFDDVLEMKYGTLADDRVKYPAILAQTKLAANQWNNDQLLTMLDELLDMNSRMAVNVNFQNIIEALTLKILAIGQS

SEQ ID NO: 5214 - protein, 110 aa, Lactobacillus buchneri
VDSQNLYDELKEMDTQLSASAENFSHLHESLIGLMEKNAELEIENQHLRDRINEITEKMDNNSPRLSKSRKNLEKLYNEGFHVCSSYYGKRRENGEDCIFCTDIIYGKRD

SEQ ID NO: 5215 - protein, 291 aa, Lactobacillus buchneri
VDTQKSFDTLSEYGTLYLVPTPIGNLDDMTFRAVKILQSADLIAAEDTRNTQKLLNHFDVQTKQISFHEHNTAERIPELISKLKQGITIAQVSDAGMPSISDPGHELVVACIREHINVVPLPGANAGITALIASGLLPQPFYFYGFLSRKPKEQRAEIDELRNREETMIFYEAPHRLKKTLKNLLTQLGGDRQAALCRELTKKHEEFIRGTLDQVNEWANSTEIRGEFVIIVSGNAHPQTQGDDPLAGMSVDQQVDFYIENGLSVNEAIKKVAKDHHLKKQVIYNQYHDIK

SEQ ID NO: 5216 - protein, 257 aa, Lactobacillus buchneri
MPAHSFSELHTIPFYECNVNNRISIPMLINILILASEHQNENLGLDQTYLIDHYGVGWVVTSYSIHITHLPRKDSVVKMTTRGTSYNRYFAFREFWLHDQAGNELVKVESIWVLMNEQTRKITPIDETIIAPYQSEKVKRVPRLARPERIEATDDVSAKEYQVRWSDIDFNGHVNNSRYPEWMLDSLPMDFLNQHEPTNIDIRFENEVKYGNRVTSSVLVDSSDNAKIKTVHEIKSNDVLSASATIVWKDIKAKGND

SEQ ID NO: 5217 - protein, 240 aa, Lactobacillus buchneri
MKILAINTSNQPLSVAVLDNDQLLAQTTITTHRKHAEFLMPVIEDLVQKADLKPTDLDRVVVAAGPGSYTGIRMAVTAAKTIASTLGIELVPVSSLLNLALNVQEEDVLINPIFDGRNQNMFTGLYRYRSRRIQTVIEDQHTNLTKWLETVSRYDQRIIILGDTDPFERSMRDVLHNRLVVANPYLGIPSATLLGLYGLSQSPVPVVDAVVPRYLRLTKAEADWKKLHPNEDTHDYVEKV

SEQ ID NO: 5218 - protein, 193 aa, Lactobacillus buchneri
MTMLKKFKEWFNQQFYNKEVQLRERYLDIKNHDVEINGTEYFLAKAMIPDIPEILGIERAVYGGQTPWDDRAFRTELMRKTDRLYLVLRRNDWLVAFIGCSLNDHTKDCHITNVAVAPNFQNHGLGYFLVTTIIKKARQLEYAKVTLEVRVSNTRAQKLYRDIGFVDNGIKKDYYFNDREDALNMVLDITKIG

SEQ ID NO: 5219 - protein, 343 aa, Lactobacillus buchneri
VARDLVLAFETSCDETSVAVIENGNRILSNIVATQIKSHQRFGGVVPEVASRHHIEQITGCIGDALREADVSYDELTSVAVTYGPGLVGALLIGVTAAKAVAWAHNLPLVPVNHLAGHIYAARLVEPIEFPAMALVVSGGHTELVYMPEENQFQIIGETRDDAAGEAYDKIGRVLGINYPAGKPVDELAHKGQDTFHFPRAMDADDNFDFSFSGLKSAFINTVHHADQINEKLSREDLAASFQQAVVDVLADKTNRALKEFPVKQLILAGGVAANQGLRERLTKEVAAFADTKLELVPLSLCGDNAAMIGAAGEMLYRHGVRGDATLNADPGLEFDWLADEAK

SEQ ID NO: 5220 - protein, 649 aa, Lactobacillus buchneri
LIILQAQDLTKRFNGETIFSKVNLAIQEKSRVALVGRNGAGKSTLVKMIIGEQSVDGGQISTKKNLSIGYLAQDTGLNSDKSIYAEMASVFASLKEQEAKLHALEKQMGSLGVDANTEEYETISSQYDNIRADFEQHNGYGYDAEIRGVLHGFGFGEADYDRPINELSGGQKTQLALAKLLLEKPELLILDEPTNHLDVETITWLEGYIQNYSGALLIISHDRYFLDRIVTEVYEMSQGTLHHFTGNYTDYTKKKDQLIDQEWKEYDKQQAKIQKLQTFVEKNIVRASTTKQAQARRKQLEKMDKLQKPTADSKTARFSFSPKSKSGNNVLNVTNAAVGYSTVLCEPVNLDVKRHQAIAIVGPNGVGKSTLLKSILGIIPFLKGKAQFGTGVDTGYYDQEQASLHASKTVLEELWDDHPTTPEGDIRSILGSFLFSGDDVSKMVHDLSGGEKARLLLTKLAMQHNNFLMLDEPTNHLDIDSREVLEKALNQFDGTILFVSHDRYFINKIATAVVELSRHGTTLYLGNYDYYVDKKDEQEAIKAHEAEKKAAGQPTPVAVPTTDKKNYEINKQNQKEHRKLEREVKALETKLDELTQSKDQIEAEMTKPDVFNDLGKLQDLQQQLDQVTAQITETESSWETASLKLEDSE

SEQ ID NO: 5221 - protein, 210 aa, Lactobacillus buchneri
LTAENIPRATAKRLPIYYRYLNILHDTGKQRISSTELAEAVQVDSATIRRDFSYFGALGKRGYGYDVDNLLSFFKTILNQEHLTNVALIGVGNLGHALLNFNFHKDGNVRISAAFDTDDKIVNTIEDGVPVYPIEELSHQLHDQQIKVIILTVPSKVAQSIADDAVAGGVKGVLNFTPIRLQVPEDVLVQNVDLTNELQTLIYFIENFGK

SEQ ID NO: 5222 - protein, 106 aa, Lactobacillus buchneri
MLLKIVANGGTNVLKPLGDRVIIETEKEEEKSVGGIVLADNAKKKPQAGTVVAVGDGRVLDNGTKVAPVVKKGDKVMFDKYAGTEIEDNDQTYLVLHEKDIVAIVE

SEQ ID NO: 5223 - protein, 540 aa, Lactobacillus buchneri
MAKQVKFSEDARSAMLKGVDKLADTVKATIGPKGRNVVLEQSAGTPTITNDGVTIAKSIELPDHFENMGAKLVSEVASKTNDVAGDGTTTATVLTQAIVNEGMKNVTAGANPVGIRRGIEKATKAAVDALHKMSHDVKTKDDIAQIASISSANTEVGKLIADAMEKVGHDGVITIEESRGVDTSLDVVEGMQFDRGYMSQYMVTDNDKMEANLDNPYILVTDKKITNIQDILPLLQKIVEQGRSLLIIADDIGGEALPTLVLNKMRGTFNVVAVKAPGFGDRRKDQLQDIAILTGATLITDDLGLNLKDATLEQLGQANKVNVTKDSTTIVDGSGSNDEIANRVAEIKTQIEKTTSDFDRDKLKERLAKLSGGVAVVRVGAATETELKEKKYRIEDALNATRAAVEEGFVPGGGTALINVIPEIAKLDAEAGGDEETGIRIVLRALEEPVRQIAENAGVEGSVIVEKLKDEKPGIGYNAANGKFEDMISDGIVDPTKVTRSALQNAASVSALLLTTEAVVADEPKKDAPAAPMPQPGMGM

SEQ ID NO: 5224 - protein, 32 aa, Lactobacillus buchneri
MVHKNGRLLNKGVTIYVALSQTAPYWKAIKDH

SEQ ID NO: 5225 - protein, 613 aa, Lactobacillus buchneri
MWRYLKRLLIGKPLKTTDEGGQSLTKFKALALLSSDALSSVAYGTEQITTILITLSAAALMYQIWVAALVLVLLAAITLSYQQIIHAYPSGGGAYVVASTNWGEQAGLIAGGSLLVDYMLTVAVSTTSATEAITSAIPSLYSHGVLISCLIVVGIMLLNLRGIRESASFLTLPVYLFIIMIIAMIIYGGYNIVTGNIEYHAAAHIGAPVEGMTLVLFFRAFSSGSSSLTGVEAISNAVPNFNKPKSKNAAATLAIMATILACFFGGITFLSYYMGIMPNSHETVLSQIGETVFGHGIVYYILQLSTAMILAVAANTGFSAFPILAYNLAKDKFLPHAYLDKGDRLGYSNGIISLAVGAIVLIQIFGGRTNSLIPLYAVGVFIPFTLSQSGMIIHWRRNRGKNWQLKSVINFVGAFISLTLVTCLFLLRFPNVWPYLIVMPILLRIFYKINHHYKRVAEQLRVVEENTEIATTHHFDGSTVIVLVSGVTRVTANAISYAQSIGDYVIAMHVSFDSNPEKEHKTSEQFKKDFPDVRFVDIHSSYRSIAQPTLRFCDVIAKRAADRNYSTTVLVPQFVPRHRWENVLHNQTSLRLRAILNSRQNIIISTYNYHLRE

SEQ ID NO: 5226 - protein, 250 aa, Lactobacillus buchneri
MSATQTTIIAYLGTPIFGICLSLLVFLFGQWLFKIGKGFFLFQPLFVGMVLGIFILWLMAKMFGVDVTWFYTNAYKPGGDIIFWFLNPATIAFAVPLYKRNDIVKRFWLEILLSLIIGLFISLFIIYYVSKLIGLNNNGIASMLPQAATTAIAMPISGAIGGTPAVTAMACILNAVLIYALATWLIKIFHLTEPIGQGLGLGTAGHTVGSAKAIQLSSVSGAMAAIAVVIISIVVDIVVPTFANFMGIAH

SEQ ID NO: 5227 - protein, 150 aa, Lactobacillus buchneri
MADKTNTTQAETKDAPILIQMGIFAGVLFVSSLISAWLVAVAPKFPVPTPVLGLIILYLLLTFHIVKVEWVDKFATFMIGMIAFLFVPSGIQLTASLDIMKAQGVQLIVAIIISTVVLLVVVAYTTSFFIWIRKTVFHGDITVSEDVEKK

SEQ ID NO: 5228 - protein, 363 aa, Lactobacillus buchneri
LKFEIIVSLFATMIISAVLTPFIRKLAFAVGAEDRPNKRRVNKIPMPTIGGLAIFIAYTFTTMILLRDQFPTKILWGVYGGEVIIILTGIIDDIFVLKPRQKVLGISIAALWVYFTAGVKMTTITLPFITIHLGWLSLPVTWIWILAITNAVNLIDGLDGLATGVAIIALTTMGITAMFFLNVGNIFVAIMIFTLVAACIGFLPYNFFPARIYLGDTGALFIGFMMSVFSLFGLKNATFITLLIPVMILGVPITDTVFAIFRRLLNKEPITHADKRHLHHRLMQIGLTHRQTVLVIYGIALIFSFISLLYPISTLWGSILLTIAVLIGLELFVETIGLVGEDRQPLLNGIKKLVKDTTSKNNH

SEQ ID NO: 5229 - protein, 209 aa, Lactobacillus buchneri
NADHAZREDCTASEMNTTLIIYCHPYKRSFNHAVLEAVISTLASKGRSWKLIDLHQAQFNPTYDVEELRLFHQGKSHDQQTIEYLDDLRRANTVIFITPVWWNSIPGMLKGFVDKVMKEGAGLSHTVTKFGVHGELGNIKHGYVLTTSTSPTFYLRFFSGNGIQKIFIHQTLRQLGISHCKWINFGNISNSTLSSRKKYLQQLRSYNFS

SEQ ID NO: 5230 - protein, 201 aa, Lactobacillus buchneri
VLSWVKQGMIQIAGKTNHTKETIISQTIRMINEHGYQNISLRKLLGTLDLTTGAFYKHFSSKEDLFKHVTVTISKKFFVQASNHLAKGNKEDALQTLIDLGEFVIHQIETVPNLMDFLLFNPGIVKIYSQNFDDNSFSFLVLTHEIIHNLATQHSLREPENDIFIKVWAFIQGYGSLIANGAITYRREFLALAATQLIGED

SEQ ID NO: 5231 - protein, 243 aa, Lactobacillus buchneri
IMPACTFAMILYMEMBERYIGZLKNESLTIKSNGTHEIEIKKSRFLCTMARIDNENQAKKIIDQVTKDNPKANHNCYAYMLGDDDHIQRESDNGEPSGTAGVPILEVLKMNELHNVLAVVTRYFGGIKLGAGGLIRAYSNATSTTIDSLGIVKLVSKQELNLLIDYNQFDRLKYFLENAAIPVEETNYTDKIELVIAVSDSEFNPLITQITNLLSDQFTYKKGQYKIFEVPYSREDRQKDERK

SEQ ID NO: 5232 - protein, 440 aa, Lactobacillus buchneri
MINDLSELYGRQMPQRDLAATLQNSPDIRLRPAISDDHGLKCGRCGSKLRRSLASLPNHHFYCYICIQMGRVDTLSPLAYLEEPNHFTENPDPLSWSGQLTQLQNECADKVIEVFQQRQRHLLWAVTGAGKTEMLFKGISWAISNGLRVGIASPRVDVCIELFPRIQAAFNQVSIVLLHGKSEQRYQYSQITVCTTHQLLRFYHAFDVLIIDEVDVFPYSGNPMLHFGVQNAIKPAGATLYLTATPDQALFKAISRKQLSVSYLPIRYHGHYLPEISAIRVKSLNEQLQAGKLPQKILRMVADLVTEKQRFLLFVPHIKDLSQAAAAIKAAGIAAKFKTVYSADPERIEKVALMRSQQLDFLITTTILERGVTFPGIDVLVLKADSEIFSAAALVQIAGRVGRNSDRPTGQVLFYCEFKTANIKSCDRQIKLMNRKAAQL

SEQ ID NO: 5233 - protein, 230 aa, Lactobacillus buchneri
MKACLLCGSRLRQEIPLADLIRLTPLQKRAICEACSPTFSALNLLPTCSSCGRRRTTDMSDPCYDCLRWEKDGQFKFINSAMYEYNPAMKDYMKRYKFAGDYRLRKVFSDQIHEQLKKQSAIIVPIPVGKDTMATRGFNQVTGLLENDRYLNLLSVRFDKKAVRQSAKNRQGRLLLDQPFEMIESQKNQVKNQAVLLVDDVYTTGTTIRHAAALIQQAGAASVKGFTLAR

SEQ ID NO: 5234 - protein, 188 aa, Lactobacillus buchneri
MLIFNIRGENIEVTQAIRDYVEKRISKLEKYFEKDMKNTAHVNLKVYPDKQAKVEVTIPLPYLTLRAEEMSNDLYASVDLVTDKLERQIRKYKTKVNRKSREKGFKNLEFAPAADTSASESDSDDESKFQVVRTKQLALKPMDNEEAILQMDMLGHDFFIYEDAETSGINIVYRRNDGRYGLIETGEE

SEQ ID NO: 5235 - protein, 787 aa, Lactobacillus buchneri
MANILRTWVESDTREQKRLSKIADKVGSYAEEYRQLSDEELQAKTPAFKKRYQNGETLDDLLPEAFAVAREGAKRVLGLYPFHVQIMGGIVLHEGNIAEMKTGEGKTLTATMPVYLNALAGEGVHVVTVNEYLSQRDATEMGELYNWLGLTVGVNTTEKDADEKREAYAADITYSTNGEIGFDYLRDNMVAYKEQMVQRPLNFAIVDEVDSILIDEARTPLIISGQSSGTSDLYQRTDRFAKTLHEGDDFKLDLETKTVSLTDQGIEKAEKYFNLKNLYDTDNTALTHHLDQALRANFIMLRDKDYVVQDDEVKIVDSFTGRIMEGRRFSDGLHQALEAKEGVTINEESKTMATITYQNLFRMYKKLAGMTGTAKTEAEEFREIYNMEVISVPTNKPVVRVDHPDVLYPTLEAKFEAVVNKIKELHKKGQPMLVGTVAVETSEYLSQRLDEEKIPHVVLNAKNHAKEAEIVANAGQRGAVTIATNMAGRGTDIKLGPGVVELGGLAVIGTERHESRRIDNQLRGRSGRQGDPGLSQFYLSLEDDLMRRFGSEKIKNFLEHLNVEGEDAVIRSRMITKQVESAQKRVEGNNYDSRKNVLQYDDVMRQQREVIYGERREVIDEQKDLKWVIMPMIERTINRIVDLHTQGEKEDWDLQTILDFAISAMVSPDQISLEDFQGKSADEIKSMLMGLANKEYKEKQEQLNDESQMLEFEKVVILRVVDSHWTDHIDIMDQLRQSIGLRGYGQQNPLVEYQREGYKMFEEMIADIEYDATRLFMKAEIRQNMQR

SEQ ID NO: 5236 - protein, 354 aa, Lactobacillus buchneri
MVLGGHFDLDALSESIAINESKMAEPGFWDDQEAAQKLIDQTNQLKTKRDNFVGLKNKLDDLKVTLELIEEDAHSGMEGEFETDEKQLKTKLDRYRLNLLLNGKYDHNNAILEIHPGAGGTEAQDWGSMLLRMYTRWAEAHGFTVQTLDYQVGDVAGLNSVSLLISGENVYGYLRSEKGIHRLVRLSPFDSAGRRHTSFASVDVMPELNDDVSIDINPDDLRIDVYRSSGAGGQHINKTSSAVRITHLPTGIVAASQAQRSQLQNRQTAMNMLKSKLYELEEEKKAEEKAKIEGEQKDIGWGSQIRSYVFHPYSMVKDHRTNYETANVNGVMDGDLDPFINAYLQWQLSQKNPD

SEQ ID NO: 5237 - protein, 298 aa, Lactobacillus buchneri
  misc_feature (270)..(274): Xaa can be any naturally occurring amino acid
MKFLIACGFYGLQPALWIGVIRSYLIHTRRLKKERGIFNSAIYEDFYEGRHFVRMGLIFGILASVVLGGFLSISLEWLIIYEGLLLISLTLIHWWLLSVTVAGIASLLALGLPNISELRPLLHWFEGLGINSTTVAPLNLLILFVVIILANAVFLNVNGGRFDSPTLVRNQRNNKTAVYKFNELTIFPFLLFVPGDWIHTSLPMMPLFQVHNHFYALLLVPILIGLKFTVKRSVPRALFKIMSHGIYLLAGIGVCLAIAGYFVPHLILPXXXXXCPGNWHSTGNPSRQDGSQSWRCDP

SEQ ID NO: 5238 - protein, 241 aa, Lactobacillus buchneri
VKKVLVVDDEPAIVTLLEYNLKQANFEVQSATNGVDALSMAENGQFDIVLLDLMLPQMSGEQVLKQLRMDRNDTPVILLTAKDTEFDKVFGLEMGADDYIPKPFSPREVIARINAVLRRYEKSAAASETPAAKSAENVETTGPFTIDHKKYRVSADSKNLKLTPKEFELMQYLVSHENQVLSRDQLLQGVWGFDYSGQSRMVDIQIAHLREKIEPDPKRPKYLRTVRGFGYEFSTGDDDAE

SEQ ID NO: 5239 - protein, 470 aa, Lactobacillus buchneri
MSSPRGMMTLSKIYKQILTVVILSIATLAVLFYGFTSGNLGWADLALLLALVDAIAGIILIIQYRQHDKLLKQLQIMTENIVHHQPAVPLFVEPDNPLKGVADQLNELQSRQQDEGKSIRNSNAELITILSSLPVGVMVIDSTHDVIFANHKMSVMLGRDILTQVHPYTQDIRNYQLLSLIENVYDSHKSQQEEIQSVGATSVTWDTSVVFNQLENDFHILVIMYDISDIINVKQMQIDFLRNASHELKTPITAISGFTKTLLGGAMDDKKSLVEFLKIIDQQSDQLASLVQDILTISHIQNGTNYHYKPLALHDFIDAELASYQSMIQGNHVSIHNQVPEHVEVIADTTTLTRILRNLVSNAVKYNRPNGEVNITYSDNDSYWQLHVSDTGIGIAQKDISRLFERFYRADDSRTKQKVSGTGLGLSIVKEMVDAVGGTIDVKSQRGVGSTFTVNFPIVKDRNQPNTQTD

SEQ ID NO: 5240 - protein, 294 aa, Lactobacillus buchneri
MRKRTIVKLLLCVVVIVAGIGAYNARSKTSTNQQSITAVGSTALQPLVEAASEQYSADHAGIFINVQGGGSGTGLSQIESGAVQMGNSDLFAEEKAGINPAGLVDHKIAVVGVAPITNDRVGIDNLSTAQLIAIFTGKYTNWKQLGGPDLPITLINRSQGSGTRVTFEQYGLKGHESATAQEQDSSGTVRQIVSSTPGAISYVSFGYFNKSIHPLSVDGIKPTEQNVMDNKWKIWSYEHIYTRGKPTGLTKKFLTYLKNDHIQTTLFNKLGYISVKDMHYQRTWQGKITKGSGE

SEQ ID NO: 5241 - protein, 309 aa, Lactobacillus buchneri
VQNEKLAKQLMKKSKTARYERFGHLLSLSALLLIMAIVLGIIVFVASKGLATFFKDGISVKDFFTGTLWNPGTKTPNGHQAVGALPMIVGSFLVTILAALLSTPFAIGTAVYMTEISPKRGAKILQPVTELLVGIPSVVYGFIGLSVVVPFVRNTFGGSGFGILSGTFVLFVMILPTIVSMTVDSLRGVPKFYRQASLALGATKWQTIWKVVLRAATPGILTAVVFGMARAFGEALAVQMVIGNAALMPQNLTSPASTLTSVLTAGMGNTVMGSLQNDALWSLALVLLVMSLFFNLLVHMIGRKGAFKK

SEQ ID NO: 5242 - protein, 296 aa, Lactobacillus buchneri
MNRTQKQSRFAIACLKAVAGFVVVILAFLIGYIFITGLPNISWHFLTSPAKAFNAGGGIGIQLFNSFYLLVLAMLISLPIALGAAIYLNEYAKDNWFTATIKTSIEILSSLPSVVVGLFGFLLFVVQFNYGFSIISGALTLTIFNLPLLTRNIEDSLSNVSDDQRQGGLGLGLSKYETIIHIVVPASLPGIISGIILCSGRVFGEAAALIYTAGQSAPALNFADWNPFNIDSPLSPLRPAETLAVHIWKINSEGIMPDLTQVSSGSAAVLVLAILIFNLSARWIGRKVFERMTSVK

SEQ ID NO: 5243 - protein, 271 aa, Lactobacillus buchneri
MQNTTELNNKPKRFIYDFNPEENDITMQTKDLEIYYGKTLAMHNADLKFKKNTITALIGPSGSGKSTFLRALNRMNDGVATVKGEILYQGVNINQPKIDVYEVRRRIGMVFQRPNPFAKSIYDNVTFALQRRGIHDKKTLDQVVETTLKQAAVWDQVKDSLNKSALSLSGGQAQRVCIARALAVQPDVLLLDEPASALDPVSTQQLEATLRELKKDYTIIIVTHNMQQAARLSDYTVFFNMGEAIEYNKTRKVFTRPKVQMTDDYVSGNFG

SEQ ID NO: 5244 - protein, 252 aa, Lactobacillus buchneri
MATPIISADNLDLFYDDFQALYGIHLDFLPNQISALIGPSGCGKSTFLRCLNRMNDMIDGVTITGAVQFHGENIYSPQTNLVELRKSIGMVFQQPNPFPFSVYDNITYGLRIAGLRDKQKLDEIVEKSLKQAAVWDEVKDNLYDNALSFSGGQQQRICIARVLATSPSVILMDEPTSALDPISSAKIENTLLELKKDYTIIIVTHNLQQASRISDKTAFFMEGRVVEYDDTTKMFVNPEEKQTEDYVSGRFG

SEQ ID NO: 5245 - protein, 218 aa, Lactobacillus buchneri
MGKVFDEEIITLKADFMKLGALVGEAVTNAGQSFVDHDIQKAETVITNDHEINHLQIHIEKRSFEMIALYQPVTGDLREVVGILKAVTDLERAGDHARNVARSVIDIKGKQRIASVEEIIATMSQEVSEQYADSIESYGDADQDKAKRTAQQYDKKIDQLYNDIASPSYQAMAKDPEIVSSAIIYLNVAKDLGRVSDYSTNICEWTVYLATGKIIELN

SEQ ID NO: 5246 - protein, 109 aa, Lactobacillus buchneri
MNSHKKLRRSSTNRVISGVLGGISEYLDWNAVLVRILYVVLAFTPGINVVAIIGYIIMMFAIPSDTPGSGSAFDQFKTTLSGGTSNDKSRKVIHNVEEKDVHDDKKRGQ

SEQ ID NO: 5247 - protein, 115 aa, Lactobacillus buchneri
LRFLTNVLVDTILFVAISGFFPANFYVASVGIAFVAAVVLAVLNWLVRPIITILSLPINLLTLGLFTFVINGLMLELTATIVGANFRFSSFWVAIGVAILMSAVSWIIAEYFRKP

SEQ ID NO: 5248 - protein, 340 aa, Lactobacillus buchneri
LTESVTVADLVKNARLDVYYGKEYLEERTISTADISRPGLELTGFFNYYPVKRIQLLGITEISYSKGMSHEELLDVMQQMCQPQTPAFVVSTQLDPPEELLEAAKEQHLPVLGSKLTTSRVLSNMTNYLDDKLAERKSLHGVLVDVYGLGILITGDSGIGKSETALELVKRGHRLIADDRVEVYQQDEQTLMGTAPAILRHLLEIRGIGIIDVMTLFGAGAVRSQTKVALIIHLANYTKEAKFDRLGNGTQNVHIFDVDVPKITIPVRTGRNLAIIIEAAAMNFRAQSMGYDATETFDRNLNNLIKVNSKNDEKHKEEQEHLEEKNKDLIDGRDKDSDKK

SEQ ID NO: 5249 - protein, 278 aa, Lactobacillus buchneri
LTNLLSLALNPIAFNLGPIEVHWYGIIIASGVILAVWLAVREGDKRGIKADDIYDMILWALPAALICARLYYVIFQWSYYKDNPGEIIKIWDGGIAIYGSLIGAMIVVILFCRHRFIPVWLMLDVAAPTVILAQSIGRWGNFMNQEAFGQVTSLSFLTGLRLPHFIITQMYISGAYRQPTFLYESLWSFLGFLVLITLRHNSHLFKRGEVFLTYVMWYSFGRFFVEGMRTDSLMLGGLRVSQILSIILFVGAIGIIIYRRLRQPHNPWYLEGSKLTVN

SEQ ID NO: 5250 - protein, 338 aa, Lactobacillus buchneri
MAKKVAVLGAGSWGSVLASLLDENGSDVKLWSYNPTQVKELNEQHTNTKYIKNFTFSDSLVATNDLKDAIDGVDYILFVVPTQVTRSVAKQVAEILADRNQKVNIIHASKGIEEKTYLRLSQVLAQEIDPQNRKSISVLSGPSQAEDVVTHDITLVTVASDSDQAATEIQGLFMNNYFRVYTSDDVIGVEIGAALKNIIALGAGALYGLGYKDNAKAALMTRGLAEISRLGTSFGANPLTFIGLSGVGDIIVTATSTNSRNWRAGNELGKGHSLDEVINNMGMVIEGIATTRAAYELSKKRGVEMPITSAIYHVLYDHADIKETINQLMTREGRSEIE

SEQ ID NO: 5251 - protein, 298 aa, Lactobacillus buchneri
MTRKVTKAVIPAAGLGTRFLPETKALPKEMLPIVDTPTIQFIVEEAKQAGIKDIVIVIGKGKRSIEDHFDSNPELEMNLEERHKNDILETIRKTNDMNIYFIRQSHPRGLGDAIYTARSFISNEPFVVMLGDDVMQDKVPLTKQLMESYQQTGASTLAVKKVAHKDISKYGVIDPSEEVRPGLFNVKKFVEKPTPEKAPSDLAIIGRYLLTPEIFGILENAKPDKTGEIQLTSAIDTLNQTQRVFAHEFKGERFDTGNKLSWLKTNIIFGLRHPEISDGLRTYLKDLGAQLTEEDKKK

SEQ ID NO: 5252 - protein, 317 aa, Lactobacillus buchneri
MAKQYDVVIIGAGPGGMTAALYASRANLSVAMIDRGIYGGQMNNTAAIENYPGFKSIMGPDLAQNMYDSSINFGAEYVYGTVSAVEDHGDYKLVKTDEDEIQAKVVIIATGSEYKKLGIPGEHEYGGKGVSYCAVCDGAFFKNKEVVVVGGGDSAIEEASYLAGIVDHVTVIHRRDQLRAQKVIQDRAFANDKIDFVWNSNVTEVLGDDNKVTGVKVVNNQTNEESVLETSGVFIYVGLLPMTDAFKDLNITDEDGWIQTNDQMETSIPGIYAIGDVRQKDLRQIATAVGEGGIAGQQAFKYVESLADTSKASVSEH

SEQ ID NO: 5253 - protein, 216 aa, Lactobacillus buchneri
MGMHQYLESLDELELINRAPGYFKFEQHSVAAHSFKVTEIAQFLGDVEENAGEKVDWRGLYEKALNHDYTERFIGDIKTPVKYATPKLRSMLADVDDKLTENFVQNEIPDEFQDAYRRRLSEGKDDSLEGRILAVADKVDLLYESFGEIQKGNPEEVYPEMYKESLSTMLEYRDMHCVQYVLTKVIPDMLAENFTTQDKLRRLTRKVLKKEDNSKE

SEQ ID NO: 5254 - protein, 668 aa, Lactobacillus buchneri
LIEREADRKFDLVSKYKPTGDQPDAIKKLVAGINEGKKAQILKGATGTGKTFTISNVIAQVNKPTLVLSHNKTLAGQLYGEFKEFFPHNAVEYFVSYYDYYQPEAYVPSSDTYIEKDSSINDEIDQLRHSATSFLLERNDVIVVASVSSIFGLGDPSEYRNHVVSLRVGQTIERDHFLRQLVDIQYDRNDIDFQRGRFRVHGDVVEVFPASWDEHAFRIEFFGDEIDRIREVDTLTGEVIGDRDHIAIFPATHFLTSDDVMNVALPEIKDEMDKQVAKFEKEGKLLEAQRLKQRTTYDIEMMREMGYTSGIENYSRFMDRRKPGQPPFTLLDFFPDDFLLVVDESHQTMPQIRGMYNGDQARKQQLVNYGFRLPSALDNRPLTLSEFEQHVHQVVYMSATPGPYELDQTKDVVNQVIRPTGLLDPTIDVRPIMGQMDDLVGEINKRVDKHERVFVTTLTKKMAEDLTDYLKDLGIKVKYLHSDIKTLERTQIIRDLRLGKFDVLVGINLLREGIDVPEVSLVAILDADKEGFLRNERSLIQTIGRASRNEHGAVIMYADTVTDSMKAAIDETAHRRAIQIAYNKKHGITPTTIVKPIRNLISITKGSDDAGEKDDFVESDFEQMSKKDQKDMLARLTEEMRDAAKKLDFEQAATLRDTIIELKGQTSK

SEQ ID NO: 5255 - protein, 958 aa, Lactobacillus buchneri
LAMDKIVIRGARAHNLKNVNVTIPKNKLVVMTGLSGSGKSSLAFDTLYAEGQRRYVESLSSYARQFLGQMDKPDVDSIDGLSPAISIDQKTTSKNPRSTVGTVTEINDYFRLLWARVGVPICPNDGSVISSQSVDQMIDQIMKLPERTKLQILSPIVRGKKGQHKKIFEKIKREGFVRVQVDGETYDIDEAPELDKNKSHDINIIIDRIIVKDGINNRLSDSLEAALRLSGGYAVADFLGERDPLMFSEHYACPICGFTVGELEPRLFSFNSPLGACPDCDGLGMKLEVDEDLVVPDRTKTLAEGALAPWNSASSKWYPNMLKQVCDAQGIDMDVPFNKLPKKQQNFVLYGSKTKSFHFVLQSDFGGIRDVDGPFEGVVNNVDRRYHNTSSDFTRDNLSQYMTELTCQTCHGYRLNRQALAVKVGKHNVAQISALDVTAELNFFQSLTFGEQDTMIAKPIIKEITDRLTFLRNVGLDYLTLSRSARTLSGGEAQRIRLATQIGSNLTGVLYILDEPSIGLHQRDNDRLIASLKKMRDLGNTLIVVEHDEDTMRAADYIVDIGPGAGQQGGRVMAVGTPADIEKVPESITGQYLSGKRFIPVPDKRRKGNGKKIRVTGAAENNLKDLTVDFPLGKMVVVTGVSGSGKSTLVNDILKKALAQKLNHNSEKPGKYKSISGYKNIEKIIDIDQTPIGRTPRSNPATYTGVFDDIRGLFANTNDAKLRGFKKGRFSFNVKGGRCETCHGDGILKIEMNFLPDVYVPCEVCHGKRYNAETLEVEYKGKNIADVLDMTVDEAVDFFSAIPKISRKLQTIKDVGLGYVHLGQPATTLSGGEAQRMKLASELHKKANGQNFYILDEPTTGLHSEDIRRLLGVLQKLVDQGNTVLIIEHNLDVVKSADYLIDLGPEGGDGGGTVVATGTPEQLAKVPESYTGQYLKPVLERDKKLTKQAEKQAVKASK

SEQ ID NO: 5256 - protein, 294 aa, Lactobacillus buchneri
MAVNNQFVIITGMSGAGKTVAMQSFEDLGYFCVDNMPPTLLPKFKELIRMERDINKIALVMDLRSQVFYDEIIDMFNDLKKNDDNNVDIIFLDSSDQKLVSRYKETRRAHPLARNGRVIDGIKKERELLANVKQAADLVVDTTNMAPRRLREEVFHNFESTDETHTFHVEVMSFGFKYGLPLDADIVMDVRFLPNPYYDAKMRYKTGLDKPVRDYVMNSQGAKEFYQKLLDMMVFTLPGYQKEGKASLTIAIGCTGGQHRSVAIAQQLANDLKDQYPVNITHRDIDRHKTKEGN

SEQ ID NO: 5257 - protein, 334 aa, Lactobacillus buchneri
MLDALHTHQPRIVVIGGGTGLPVILKNLRNRHVDITAIVTVADDGGSSGILRNYINVVPPGDIRNVMVALSEMPELYLDLFQYRFRSSDQFFAGHALGNLIIAALSEMKGGIFDSVQILSDMLKVDGHIYPAANEPLELNAEFSDGTTMSGESEITAAGKLIKRVWVETTDDSHKPEAVHQVIDAIMNADQIVLGPGSLFTSILPNLMIENVGEALRQTSADIVYICNIMTQKGETENFTEADHVRVLNRHLGMNFINTVLVNIKEVPAEYIDYQKWNEVSQPVKHDFAGLRAMGCRVISADFLELKDRGAFHNGQEVADELINLLGRSLDDHK

SEQ ID NO: 5258 - protein, 314 aa, Lactobacillus buchneri
MSYASEVKKELTSLTVHRDNAKAELMALIRINGSLSISNHHFVLNVSSENPAIARRMYKLLSKFYGITGELSVRRKMKLKKNNLYILRVENKATQLLDDLGIFDGASIVERVPSHMLTEDSQIRSYLRGAFLASGSVNNPETSRYHLEIYSLYENHNEMIAEMMNKYHLKARTTQRRSGYITYLKEAEKIADFLQLIGATSSMLKFEDIRIVRDMRNSVNRLVNCENANLNKVANAASKQIENIKLIDEMVGLNKLNPKLAQVARARLKHPEVSLKELGDLVEGGPISKSGVNHRLRKINEYAGKLAQGLTPEV

SEQ ID NO: 5259 - protein, 358 aa, Lactobacillus buchneri
MDVNQTKEQVKQTADESIPTEMKAWEIVKPGSINGAVSPLRYTTKPVPKPKRGEVLVKVIACGVCHTDLHVTEGDLPVHKEHLTPGHEIVGRVVQMGAETRRFKLGDRIGIPWLRWTCGVCEYCRSGRENLCPNSLYTGWDHDGGYAEYVTVPEGFAYRIPARFDSLTAAPLLCAGIIGYRAYERANVPAGGTLGLYGFGGSAHLTAQIAMKQGIEVHVLTRGEDARKFALQLGAASARGTYDMPPVKLDSAINYTPVGDVVPKAMEALKPGGTLAMAGIHSTDIPQMSYPSHIFHEKNLTSVESNTRRDGEEFLTLADRLNIHPEVTEYPLAKADEALKYIAKGDIRGACVLRVSEG

SEQ ID NO: 5260 - protein, 197 aa, Lactobacillus buchneri
MNLVPTVIEQSAGGERAYDIYSRLLKDRIIMLSGPIEDDMANAIIAQLLFLDAQDSEKDIYLYINSPGGVITSGMAIYDTMNFVKSDVQTIVMGMAASMASVLASSGAKGKRFALPHAQVLIHQPSGGAQGQQTEIEIAAEEILKARKMINNLLAENSGQPIEKINKDTERDNYLTAQEAVDYGLLDGIMTSSSEKQ

SEQ ID NO: 5261 - protein, 310 aa, Lactobacillus buchneri
MRTHHISLLTRDAQQNIDFYTRVLGMRLVKNTVNQENIRIRHLFYGDYLGTPGSVVTFFVVPLLGHRTDGKHFFNNIKLSIPTGSTDFWKKRLTDHSVAVQDIDHGLVFADPDDVEVKLLETSEVLTDMRVVPDNGIPAEKQITHLMGTELHVPDPEATSAFFHNWLGIPVENNVVQLEDGQSIELFESDQQDVRTRFGRGSIDHFAIQAPTKAALFKFWDIAKEQHLNIEEYADRGWFKSLYVRDPGDNRVEIATTTPGFSLEEPILTMGQGLSLPPKFESQRQEIMDFYAKEGVDFTEGVREPTSVPD

SEQ ID NO: 5262 - protein, 148 aa, Lactobacillus buchneri
MKIVEETKVSPKLVKDLLTVWESSVKATHLFLTDNEIQKIKKVIPEAIGGVQHLIVIENDNGDPVGFMGINDRMLEMLFISNQYRGKGLGKRLLDYGMQQYSIDQLGVNEQNPLARGFYEHMGFEVYKRTEFDEQGNHFPILYMKKAE

SEQ ID NO: 5263 - protein, 336 aa, Lactobacillus buchneri
MTVKIGINGFGRIGRLAFKRIHELHSDEIEVAAINDLTTPSMLAYLLKYDSTHGRFPGDVSATDKGIVVDGKEIPVYAEKDASNLPWVKNDGVDYVLECTGFYTSEEKSQAHIKAGAKRVLISAPAGQIKTVVPGVNLDELNSNDVIVSAGSCTTNCLAPMAYFMNKDFGIKVGTMTTVHAFTASQQILDGPKTKKKRNNRTASANTIPHSTGAAKAIGLVIPDLAGKLQGHAQRVAVVDGSLTELVAVLDKKVTADEVNDAMKKHTADNPAFGYNADEIVSSDIIDDSHGSVFDPTQTEVTTAGDSQLVKTVAWYDNEWGFTCNMVRTLLKFASL

SEQ ID NO: 5264 - protein, 404 aa, Lactobacillus buchneri
LAKLTVSDLNLEGKKVLMRVDFNVPIKDGVIGDDNRIQAALPTIKYVLDHKGKAILCSHLGRIKKEDDKKGLSLRPVAERLSNLLNKPVIFVPVTEGKQLEDAINKMEDGSVLLFENTRYEDVVNGEYVKRESGNDPKLGEYWASLADEFINDAFGTAHRSHASNAGIAEAMHKDGKPVAAGFLMEKEIQFLGEAVNNPKRPFVAILGGAKVSDKIGVIDNLLDKADKIIIGGGMTYTFYAAKGIKIGDSLIEKDKIDVAKKILEKGGDKIVLPTDNVVAKEFKNDAEHKVVAGDIDDGWMALDIGPKSIEDFENVLKDAKTVVWNGPMGVFEMPNYAQGTLRIGKFLGTLNDATTIVGGGDSTAAVKQLGVADKLTHISTGGGASLQYLEGKTLPGIAAIDNK

SEQ ID NO: 5265 - protein, 252 aa, Lactobacillus buchneri
MRIPFVAGNWKMNLSVAEAVKFLQAIEGELPDPKITETCIAASPLFLESMVEENGDSPLIISAENCFYEDEGAYTGETSPKALAEMGVTHVIIGHSERRKYFNETDDIINKKVHAAFRNQLTPIICCDETMSRRESADRISWVVSQVTNALKSITPQQAEKIIVAYEPSWAIGSGKTASSDEAEEGCYLIRQTIADLYGDDIADQVRVLYGGSVNDENADDILSQTDIDGVLAGGASLKPDSFLKLANFLQK

SEQ ID NO: 5266 - protein, 439 aa, Lactobacillus buchneri
MSIISDIYAREVLDSRGNPTVEVELYTEAGAMGRGIVPSGASTGEHEAVELRDGDKDRYMGKGVTKAVDNVNNIIAKEIVGYDVTDQLAIDKAMIELDGTPNKGKLGANAILGVSLAAARAAADELEVPLYNYLGGFNGHLLPTPMLNVINGGKHANNKVDFQEFMIMPVGAPTIKEAIRWSSETFHNLKNLLNERGYSTAVGDEGGFAPDLKNNEEPFEILVEAIQRAGYKPGKDIAIAFDCAASEFYNTDTKKYDLKGDGKSYTADEFVTLLESIVDKYPVISIEDPLDENEWADWQMATKRLGKKVQIVGDDLFVTNTDYLKKGINMGVANAILIKLNQIGTLTETVEAVEMAKEAGYTAIISHRSGETEDTTIADLVVGLNAGQIKTGSMSRGERIAKYNQLMRIEDQLGDVADYKGIHSFYNLSEQARQDILNK

SEQ ID NO: 5267 - protein, 680 aa, Lactobacillus buchneri
LKKTLLLSVSLGVLGFASPLVHEQIVGAEISQTATQEFPDKITIHQQFQVRNIRGDKSVLDKQATVKMYIDKSKSSTFSAPDNVPHYHPVVSEVHYSPGMVVNYMAEDAVVTIKYLDENNQPIQDNKVFNQATIFGTYRLNKNEFDVSGYELLNSKDINGKIKETNWDVTLKYKSLNPLIAADWLANVVVPDQPEPGNSKSGETGQTSEPIQLVSEKPMSESASTPVVSTTATTDMQPSPSTPSEAGNHVVPSVTQTEPTHQPAVKPVETPDKEVKDTTASKSGPKHDDKKVKVVGATGTENSQVTPPVAAPGTKLPDPEPKIQPTTKTNGASSRSDKETRVTKPESKKEGAVADSSTNAKSTSSVQSETGKKSPSSKPVETTAESLKPDEKVQGISKTSAKPSEKPADLPGKTTDQSGSTKNTVKTSESDSKDSEKPVVQTKPKIPKINQTKVPEKSTDHQEMQPMTTTYQLHGIDTHGHLLFNKALHLTSEEARAFRSKNVEFYGYELQSTDLDASSKTLTLHYTAKKVTFNIINVDQDGKTISKDSVELEYGQTKTYTAKFISGYRVQQPTQELKADNLMPEDVHFTYIKLADKSNKPLAEPTALSSKTGHKKGRQSAISGRNPSETKSKRHSETKDTSEVSEKLPQTGESQSVVGVLSGVALLGALIGKKLFKRLI

SEQ ID NO: 5268 - protein, 509 aa, Lactobacillus buchneri
LQVRGSYKLSQVKTIVNGIVIGVLAGSAVSMFRWSIGHMTDLMRYLYINSIHHLSFLLTTIVINIAIGLLVGWFLKQQPDIKGSGIPQVEGQLLGEVDYGWWAILWRKFVGGILAIGSGLYLGREGPSIQLGSTLGQGVAHFTKQVGFDRQVLISSGAAAGLSAAFNAPIASTLFVLEEIYHNFSTNIWIVSLTSAVTSDMVATYVFGLKPVLYMRSTPLPLKYFLWVVILGIVLGVLGRLYQMVILRMGKWYRHTHIPWYFNGIIPLLLVIPMGAFFPHLLGGGSDIILRLSSANYPTLILCLYFIIRFVFSMLSYGSGLPGGIFLPILCLGGLIGAIVGSIAVNLGLMNPLYFSSFIIMGMAGYFAAISKAPFTAILLITEMVGTLTHLLGLAVVSLIAYGVLDLLNGKPVYYSMLQQLLKVQTKMNLGRTAEIMETVYAGSQMDGKMVRQIKWPMGSLLTKIQRNGVEIVPAGGTLIRWGDTLFINVSTKNQHAITQQIIALTTET

SEQ ID NO: 5269 - protein, 78 aa, Lactobacillus buchneri
VYNFLLTLLLIDCVLITIAVLMQPSKTNDAMSALTGGADDLFAKQKPRGFEAFMQKTTLVLGIIFFLLALALVWISSH

SEQ ID NO: 5270 - protein, 248 aa, Lactobacillus buchneri
MQTPVKSFYFEHGPRAIILLHAFASGPVDVRMLARYLERQNYTVYAPMFTGHGTADFTDILIQGTPERWWNDAKRAVQFLKDKGYDQISIFGISLGGIFAAKTLENDPTLLGGGSFGSPIVRKRQFSVHNTFMQMAKANFVQYDTNEAIMNSKLKWLDENIDILLGKIADFTVGVAQDLPKITQPYFIGQGLSDEIVNPESAKSLRDGLVNSRVSYHEYPNASHMITVNPAHKQLEADLTEFLTQLYE

SEQ ID NO: 5271 - protein, 776 aa, Lactobacillus buchneri
LQDNDLKNQIENVLRTYPDNVFTVEKIADVLRSHGSAAFKLIVQELASLERDKVAVVTEDGKFQLNPDKQQLSGIFHANDKGFGFVAYDENAPDAYIAPDNTMNALNGDTVEMEIVRPAQPGSDRGPEGKVTKIAEHKYTRVVGPFEKTDDDKGYIGQLTLNDKKIAKYKFYINDVGLKPTPGEVITAQITEYPSTKHPDYMVGIADEVIGSVDDPGIDILQIVYAHDIPAEFPEDVIQAADAIPDHVTEAEKIGREDITDQDLVTIDGESSKDLDDAVTAWKLPNGNYHLGVHIADVSHYVQPGSAIDKEAFRRGTSVYLTDRVIPMLPRRLSNGICSLNEGELRLCMSCEMEIDPSGNIIKHRIHPSLMRSTARMTYTAVNNILESHDQKTMDRYDKLVPMFETMGELHKILYKHRKARGAIDFDDNEAEIIVDDKGHPIDIKLRVRGTAERMIESFMLAANETVAKHYYEKHVPFIYRVHETPDADRIRTFFETLTAFGINVKGDPEHVTPKTLQNVLKKVAGKPEEMMVSVMLLRSLKQARYADQSLGHFGLAAPFYTHFTSPIRRYPDTMVHRLIHYYQDNGINDETKKRYANVLDEIATTTSQYERRAVDAERDTDSMKKAEYMNDHIGEEFDGVVSSVMKFGLFIELPNTVEGLVHISRMNDDYYQYVEQFMALVGRNTRRTYKMGQAIRVKVVNVDVKQSAVDFDIVDPEKTPQSNMLPKRTYHNNNYHGNNERHGNSNNNSRSNHANNNRGRNNNHGNNGHRNHNKH

SEQ ID NO: 5272 - protein, 157 aa, Lactobacillus buchneri
MAKGKKQHNNDNLMAQNKKARHDYSISETYEAGIVLTGTEIKSIRARRINLKDGFVQIRNDEAYMMNVHISEYAEGNQFNHDPLRNRKLLLHKKQIRKLAQITQDKGVTIVPLKVYLKNGFAKVLIGVATGKHEYDKRETIKRRDQKRQIERVMKHY

SEQ ID NO: 5273 - protein, 189 aa, Lactobacillus buchneri
MSRKLQLNLTELDHTRSTKVTDQYRDTKYLIVGKWGLIDDTFSIYSISGEVVATVRQQSLGMTPKFDLYYLDQFVGGSVIHFTMHYTTIFINGINWLVAGNQDKQTYRIMHGRQRIATIKSYSQSDQVIRIMDVDNTNHEPLVLAIAAILNHPSLAHASRLKLGVLNKAPVKPNLESENISTLHNENKR

SEQ ID NO: 5274 - protein, 230 aa, Lactobacillus buchneri
MKPFIKNDWWDVLKPEFEKTYYQQLRQFLISEYKTQYIHPDMNHIFEAFQLTPFSKVKVVILGQDPYHEPHQAQGLSFSVMPGVKIPPSLQNIYKELQSDLGIKPVEHGDLESWAKQGVLLLNSVLTVRNGQAFSHKGKGWEQLTDAAIQKLSAREKPVVFILWGRAARDKIALIDTKTNVVIQSAHPSPLSAHRGFFGSKPFSKTNEALEAMGEEPINWQLPEKVSQTS

SEQ ID NO: 5275 - protein, 324 aa, Lactobacillus buchneri
MELFESLKQKIKGKNISIVFPEGDDVRILGAASRLAKDGLVNPVILGAKDTVEKVAKDADIDLGNVEIIDYLNQPADQIDEMVAAIVERRKGKTDEAKARDWLKDPNYFGTTLVYMNKINGMVSGANHPTGDTVRPALQIIKTKPGVKLISGAFIMQKGDERYLFADCAINLDPDANALAEIAVESGKVAKTFDIDPKVALLSFSTKGSAKGDMVTKVQEATKLAQEQAPDMAIDGEMQFDAAFVPTVAEKKAPGSNVAGKATVFVFPELQSGNIGYKIAQRFGGFEAIGPILQGLNKPVSDLSRGSNEEDVYKVAIITAAQAL

SEQ ID NO: 5276 - protein, 156 aa, Lactobacillus buchneri
LTKTITVHSADQTMTIGEKLAAYLAPQDLILLDGDLGAGKTTFTKGLAKGLGITRPIKSPTFTIIREYQDGRIPLYHMDVYRLEEGGGDDLGLEEYFNGDGVNVVEWSKFVADELPDDYLRIIFRRDDSEGDNVRTLTFEATGHRFEQLIDDIFSE

SEQ ID NO: 5277 - protein, 164 aa, Lactobacillus buchneri
VAEEVDFRLAEPSDGQAILDLLKVLQGESDTFLVDSDLDDITAADEAQQINLINHSRTNLMAVATYGSELIGIVTVDSVDNGVGEVGVAVLAGYQGYSIGTNLMELAIDWATDFSSLDQLVLTVFSKNEPAIHVYYKVGFHDTDVYFQDGREVVRMAFDVPKKD

SEQ ID NO: 5278 - protein, 177 aa, Lactobacillus buchneri
MNFVAMDFETANAKRASACSIALAIVRDNQITNEFYSLINPEMDFSWRNINVHGIHERDVVDAPTFPEVWRHIQPLFSANKLVIAHNASFDNSVLKRTLERYEVQPPHYLTLDTLRTSKQFYPTLENHKLNTLCDKLNIVLEHHHNALDDSVACANILLTEQAQFGSDMLRPFVKAI

SEQ ID NO: 5279 - protein, 304 aa, Lactobacillus buchneri
MMQSKTVVDLYPKIEILLNEPLSKYTHTLTGGPADILAFPKSIKECQEMLDYANEQSLPVTVVGNASNLIVKDGGIRGLTMILTKMNRISSHDNEVVADAGAALIDVTKAAQAHSLTHLEFAAGIPGSVGGAVFMNAGAYGGEIANVVSGAEVLTPDNHIIHLNHQELDFGYRHCSVQENHQIVISATFSLEVGIADKIQKRMDHLNALRASKQPLELPSCGSVFKRPTGYFAGKLIHDAGLQGFQIGGAQVSMKHAGFIVNVDGATATDYLNVIAHVQKTVYDKFGVHLETEVRIIGEDPKSN

SEQ ID NO: 5280 - protein, 706 aa, Lactobacillus buchneri
VHILEAVILLMTLVVFSNVVDHFVPAVPVSLIQVVLGLGAALIMRVTIPLETDWFLLLFIAPLLFNDGRRFPKQELWKLRGPILANAIVLVFLTTILGGLLFHLIIPTMPFSVSFALAAILSPTDPVAVQSISKRAKLPEGILHIVSGESLINDASGLIAFKYAIAATVTGVFSIKTAAIDFVYISIMGFVSGLVIMGLILMIENWLYRQGINDVIFSTVLQVTTPFVVYLVTEEFLHASGVIAVVAAGIIFHFYGTAPDRSQPELKLVSEKTWDIIIYTLNGIVFLILGIELPLATTNVIQNNKINTFAALGISFLAWLILLAIRVVWIYAYQAVSSIRSRKIKSIQTKQMPTFKAALLAGLSGVRGAVTMAGVLSIPMTIDNGSPFPSRSLALFVAAGVIIISLVVATVTLPLISEDKAPLLTRANSTDDPDEIDTGSADSDAEYISEDEARVYIMKLAVQRIEEERRPNNQKEAFDLILDYQFLIRRLELKLQDKKEMDSIIADELALRRVALRGERAAVQKLFDDQKISKQAFLIANAKLQRLENRMIRSVGRKVKLGHGTARNFIKLRNRVSLWLIRRKTNEDISDELALIQREQAKAAISALSDYFARDDIDNQRFDSQSVYHLIVHYRNQIELAKDHSKKQINDQAMNYQSLRIKALAAEREGVQVLLEQGNIDWSMAAHLRQYINYSETVLIMDYQNE

SEQ ID NO: 5281 - protein, 249 aa, Lactobacillus buchneri
MNDKGLVNFRDIGGIRVPSGKLQSGYFFRSGQIAGISQEQTAFLQDQCRIRDVYDFRSTDEVKQAPDSAISGAKYYHIDILSDKTSNGASLGAMITDGNKVHENMLKTYESIVLSQSAQQGYHDFMTDLLADDAPILFHCFAGKDRTGFAAAVILKVAGADDQQIMDDYLLTNQLRVKANEDLLNRFKNEMNQQQLDNLHTALLVDADYLRHANDVLLEHFGSFDGYLKNGLDLPSDYIARFREKFVTD

SEQ ID NO: 5282 - protein, 217 aa, Lactobacillus buchneri
VNTKTKWLVRGLFLVWIALLYSYLKQPPFNFLVLNTFLAFIPIELSFHIDVGKPQNGLLFWVLIIVWLLFYPNTPYLLTDLFHLSLLNPYGVNGLLRLDDLMWFKFALLLISTIFSTLVGLWGLDKVGDAITARFHAHNLLVKHAVIVALTILASIGIFIGRFLRIHTIYLFLTPELFIRPLLNMWSRPTIVFIVLLTAVQLVFYYTLKLIQKPQSK

SEQ ID NO: 5283 - protein, 280 aa, Lactobacillus buchneri
MNWSDIFTIHNLTSLIDILAVWFLIYNLLLIVRDTKAVQLLRGIVLILVVKIISAYTGLSTLSWIMDQVINWGVIGLIVIFQPEIRRGLEHLGRGSIFVKGRKENEAAQKMITALDRAIQYMSKRRIGALITLQMNTGLEEYIETGIALDADVSGELLINIFIPNTPLHDGAVIIKNNRVAAAAAYLPLSQSNLIPKELGTRHRAAVGISELTDAMTVVISEETGEVSITQNNELLRGMTRDDYLKYFKDQLFTDEDDQTHRTFLSTVSGFIDKHFKGGR

SEQ ID NO: 5284 - protein, 321 aa, Lactobacillus buchneri
MRQWLLKNWAYRLLSLFFAILLFMYVGSTQSSTTSNQSGNTNSTSLTSNRTQTFSVPLSLTVNSNKYFVTGYPQKVKVHLTGPSALVTTTANTQNFKAYADLSKLGVGTHTVRIQQDGLNNDLRYRFEPATIKVDIQPRETVSYPLTVKYSQRNIASGYQAGEANADVKNVKITGASDQINRIKSVVAQLNVPQNAKSSISSQAIIEALDAKQNTVNVVITPATADVTLPITPGNSKELPIKLEPKGVTDDNESFTLTSATKRVRVFGTKAELAKLASVKVEVDTSDVTKTKTKQVTLDPKLNGVKGFDPERISVKITRNN

SEQ ID NO: 5285 - protein, 449 aa, Lactobacillus buchneri
MKYFGTDGVRGIANKELTPELAFKCGRAGGYVLTHHSERKQPQVLVARDTRISGQMLEEALVAGLLSVGIEVLNLGIVTTPGVAYLVRNQEADAGVMITASHNPVEYNGIKFFGADGYKLSDELEEEIEGILERPEDILPRPAADGLGVVGDYLEGSQKYIHFLEQTISEDLSGMKVAVDAANGSTSKLVTTLYADLGIEFETLATNPDGLNINDHVGSTHPEQLQKFVLDKGVSAGIAFDGDGDRCIAVDENGKLVDGDAIMYICGKYMAERGRLKKNTIVTTVMSNMGMYKATEREGMTSVKTQVGDRYVVEKMNQDGYNLGGEQSGHIIFLDFNTTGDGMLTSLQLLSVMKATGKKLSELAGEIKKYPQRLINVKVADKKHALDNDKVKDVIAQVEEEMHGDGRVLVRPSGTEPLLRVMTEAPTQDLVDDYTKRIADVVRDEMGIE

SEQ ID NO: 5286 - protein, 605 aa, Lactobacillus buchneri
MCGIVGVTGNDNAVSILLEGLEKLEYRGYDSAGIYVNDLNGNDYLVKRKGRISELEAAVGPEVHGSVGIGHTRWATHGVVSVDNAHPQYSEDHRFYLVHNGVIENYKELKAKYLSNTTFTSQTDTEVVVQLVDRFVQTEGMTTKEAFLKTLSLLEGSSYAFLLIDSTDPETLYVAKNKSPLLIGVGDGCNVVCSDALAMLNVTHDFLELHDGEVVTIKPDSVDIEDRDGHKVQRDTFHVDMDAQETDKGPYPYYMLKEIDEQPNVMRKLASLYTEESGKPNVDSQLINAMKEADRLYIVGAGTSYHAGLVGKKLFEKLAHVPTEVHIASEFAYDNPLLSKKPFFIFLSQSGETADSREVLVNVNANNYESLTITNVENSTLFREATYTMLLHAGPEISVASTKAYTAQIGVEAILAKALGEAKEQTIAEEFDIRQQLGLVATGMQAIIDEKDVIDDLAKKYFVPANRAFYIGRGIDQTVSLESALKLKEISYVQAEGFASGELKHGTIALIEEGTPVVGIITQKRTANLTRSNLQETESRGAATFTIVRKGLAEEDDTLIIPDVNELITPLLSVVPAQLIAYYTSLNKGLDVDRPRNLAKSVTVE

SEQ ID NO: 5287 - protein, 501 aa, Lactobacillus buchneri
LNKIIKHGLTALLVTGMGVLFTAFSAQSTYQQAYASTASSFISKYKNDVTKASSKYNLYGSVMMAQAGLESGWGQSQLTIEANNFFGIKGAYNGASVSMPTTEYNSNGQMINTTANFKKYPTAYASFADNGSTLRNGTSWNPKYYSGSWKENAATYQDAANALTGKYATAPGYGQSLITVIQTYNLDQLFGETGDGSSASSSTSASSSSAASSSTASSSSASSATASSTETSMPTAPKLAKVKYYKASGKDLVPLSSKYKKYYVYNHVKGSTTSEKRYTWSQLGVNSRVQVYLDMRGVKTNSSTNWYRLRFYSNAKAKKFWVSAPALSFATTYSGTATGALTPSKTSSGYIYNHIVGSSYLSKPVKKVKTIAAANKGYNVNKTALQKTTKGLILWYRIADGKTKGWIKASDVVSYPGSVAVVNHKETKSISKNANSTYLYDHANSTGNLQKHYKLNQVDLQVGTKVTVDKIGYKVSDHSLWYRISTPNSSTKYWVSSAFLS

SEQ ID NO: 5288 - protein, 258 aa, Lactobacillus buchneri
MKALIATVAVTGFCFVQANHSHASVETDFINQLKTPVVKISKANHLYPSVMMAQAIVESDFGRSELSLDANNYFGVKGAYNGQSVTMSTGEYTSKGKHYMTAAAFKKYPSVEASIKDNAYLLRHGTLSDPNYYEGTWTTNAISSSDAAMALSLTYATDMNYGNKLNAIITKYDLNKLDGSVSTGDIGSKIDASLNKQLAGDSKKSALIRAENSRSKINSIPKRIIPNFVFNDKGAVAINQGDAVIQFNSLPLQRVVRR

SEQ ID NO: 5289 - protein, 357 aa, Lactobacillus buchneri
MENDYKVKVENVTKEYELFKTQSEKLRSFFSITKKQVPHFWSLMGVSLTVKPGETLGLIGVNGSGKSTISNIISGIIPQTTGYVDVRGETSIVAIHAGLRSSLTGRENIRLKSLMQGLTNEEIDELMPDIIAFADIGDFVDQPVKSYSSGMRSRLGFAIAVHINPDILIIDEALSVGDDTFYQKCVDKITEFKQEGKTIIFVSHSLKQIEMLCDKVAWINYGELKMVGDTKEVTQKYREFTQWFKKLSKKEKHKFETERKSVQKNFSIKNYQKQITEQEQNAHPDEKDVPAKIHKRFYGSVISEKMSVWNQLLTWAVLIVVVFFCLVNVSGHSVEHVINNPSAIVHPSHTLHLPGKE

SEQ ID NO: 5290 - protein, 102 aa, Lactobacillus buchneri
LKSHEVLTLIEEITRNDGSKYIEISNMVQNGRAELAAERGFIKQVRILQLNIPHSPHVAKYEQYINENYTMPTEDMDHFEEWHKTPEMQKEVDIILKENHIS

SEQ ID NO: 5291 - protein, 102 aa, Lactobacillus buchneri
MFNPNESRFASYTIVSSLPDEAIDNVWYIIDNDLQGVFQLSNLITFNLVNNDGNLSYDFIQGNELVATFDSPYPYDNGYPKSLVVYDSGDRQIIATPSEINL

SEQ ID NO: 5292 - protein, 274 aa, Lactobacillus buchneri
MADDAISLIHQVELDLFKQFAKITHQHHIHYIALGGTMLGAVRHQGFIPWDDDMDVGMLRVDYEQFLKVAEQDLKGTHYFLQTPWTDENYALSYSKLLDRNTFIEEKNNVNNARKGVFLDIFPLDRIPDSPARQRRQILDMRRLDSRIYLKLRYNVIDNPIRKFHASLSAEQAETAEDFKKQRESVMTMYNDKAALMNVKNLASQYAYEKEILSLDQLNDTIVLPFEDTYIRVPADYDGILTKIYGDYMTLPPENARTEKHIVRLITDNQEFEL

SEQ ID NO: 5293 - protein, 152 aa, Lactobacillus buchneri
MSKTNQDLLKEAIDVYLSSLKYLDNFVSEPATKYGLSFEQYLILHTIAEKQNVSLMDIASERRVTRSAISRQIKVLLQHDYIFQKPAESDRRRLYLHLTPTGEQTEKHVNDLITKRFDSWISRYGDDKVRAILKFIKEFAAEEMNSKDYTNK

SEQ ID NO: 5294 - protein, 351 aa, Lactobacillus buchneri
MWMVALTGVVFAVLTVALGTYLIKNRNTSVLGWLANLDLLALLALLVQLFEVFGEKYNALVIAVAVAIVGLAVILGLILSFIFWFINAIVVWRKEGYSLSGSLTLIVGIGVVLIDVLIFFNPIDLPTPIQAFVMTFLTMLIAYILLTVWNTLSSMLLYQLYFPRSNKDYIIVLGAGLVDGHKVGRLLGGRINKGIAFYNHQIHRTNKRAKLVFSGGQGGDELLPESIAMRDYALEHGARGADTLIEDQSVNTFQNMKFSKALIDKDAGSTNHRIVFVTSNYHTLRAGILSREVGMHAFGIGSKTPFYYLPNAVIREYLALVVMHKKFHLVMLGLMLVASVIVGVLAGLGIA

SEQ ID NO: 5295 - protein, 83 aa, Lactobacillus buchneri
MFSLLWTLIIGGIIGALAGAIASRDMPMGWIGNIVGGLIGAWLGEAIFGSWGPQLAGMAILPAIVGAVILVLVVSMVTRGMAR

SEQ ID NO: 5296 - protein, 188 aa, Lactobacillus buchneri
LNKFSRLMIWIVSLIGIAQSVWLVGLVIPIDYLSPVVTQTIQTDTPWMMIGAAIVSAVVALVSLMMLITAIFAPRKADQLRFESPHGRLSISKSAVEKILQNRIMTQNNVNHVTVKLRLRTRNRVVRVSVNAVDKLNQDLVKLGEAIQNNVVDEIQQLMDVEVKKVRVKVTPFEASSRREKASRPRVV

SEQ ID NO: 5297 - protein, 60 aa, Lactobacillus buchneri
MNAIMYGAVFGMVAGVVWVFGGLSGMLTVLALTLIGALIGTVIWKFGGLKRLISQLVSDD

SEQ ID NO: 5298 - protein, 146 aa, Lactobacillus buchneri
MTVMDATIQKSDLNKKLTFENSVIEKIAGLVSRNVDGVLSLDGGMMSELADRFSKTTDPTKGIDAEVGEKQVALDMEATIEYGADARQIFDEICSRTQKAIKNYTGLDVVEINLNINDVLTKKEWEQQSTRKKDDIANTVNDDRVE

SEQ ID NO: 5299 - protein, 136 aa, Lactobacillus buchneri
MTQENSSVATVLTYDDSVLTKIAGNTVRDVDGVLSLEGNLIDSVTDRFSDETDPSTGVKVDLDNDDKEVKLAMDAVLEYGKCIPTVFNKITTKLTQTITEMTDLKPTEIKIHVKDLQTRDEFLKKNQKKDKGEKKK

SEQ ID NO: 5300 - protein, 55 aa, Lactobacillus buchneri
MSHFDISMLITIAIGFILMTVTNNRPFAITLAVLAIGLTIMLTIKKILNRKQSHS

SEQ ID NO: 5301 - protein, 120 aa, Lactobacillus buchneri
MANKVSRYNNDQWETAKESVLQEYEDYKQTLRDQGVDYTIKNARKLLIYQDLVAEWQHKLGTVITDLEDNLFALTIFDDLKKRKQSSLLARGYEHISSWPDFNPTALALWLELEEDEAMA

SEQ ID NO: 5302 - protein, 185 aa, Lactobacillus buchneri
MESHTALLIIDYTNDFVADKGALSCGGPGQVLEPHILKLADEFVANGDWVILPTDVHTPNDPYHPETKLFPPHNVRGTWGREFYGGLSPWFKEHQADDKVYMYDKTRYSAFAGTDLDIRLRERHVDTVHLVGVCSDICVLHTAVDAYNLCYNIVVHKSGVAGLTQAGNDWALDHFEHVLGATVED

SEQ ID NO: 5303 - protein, 453 aa, Lactobacillus buchneri
METKDQTNSLSRSLKSRHIQMIAIGGAIGTGLFLGSGSAIHTSGPSIILSYLIVGIFCFLLMRGIGELLLSDTSKHSFLDFVKMYLGDRWEFVTGWTYWFCWISLAMADLTATGIYIKYWFPGVPQWIPPLIILLCLFAANLVNVGLFGEMESWFSMIKVVAIILLVVVGVGLAVFHVNVDGSTASFSQLVSHGGFFPTGAHGFLMSFQMVVFAFVGIEMVGLTAGETDDPKANLPKAINSLPIRIGLFYIGSMIAVMSVYPWNKITTTASPFVQVFSGVGIVGAAGILNFVVLTAAVSATNSCLFSTSRTMYALSMGGNASSFLTKLGRNGVPNIALNFSTAFLLIIVVLNYFIPAGVFNLVSSVSTINFVVVWVVLIIVHIKYRRAHPKGSEVFRMPGYPLSDYLTLAFFVFILGFLLVNSSTRVAMVISLISIGSMLVIYQVIQRRHGGR

SEQ ID NO: 5304 - protein, 303 aa, Lactobacillus buchneri
MIKIHKFDTYTWVEAISPTEDELNDITIDYRAPAKFKGYMLDRHEQPRATFDDLSGFSALVVRAIADPKQSRMLTSPIFLGFSNSLLITVCHAQEQAKLVSDHSKLAYDSVAEHILAILFALISPFFDKLDEISQKAEKLEGMHNRAISNHSLDELAALKTSLVYLRSATAGNLIALQELQATIKDNLKMSPELASKTNESIGDLLIEYKQCQTMFDVVGDVVRETESAFGNILNNKLNQTMQFLTIWSLILAIPPIVSGFYGMNVKLPFAGRGEAWFYTVVLTMVMVLLMIVYIKKDRRFKK

SEQ ID NO: 5305 - protein, 117 aa, Lactobacillus buchneri
VNIKVVGDIRVGKIQPSLTGNPIVDDVLIQHFCDRLKEKLNSLQPSVDIIPDHFFDATKPCADIILMDRRIIDDLPDELLMNFKIIDIDHNDILRGNITEAVNALKRYDSGKHVFAM

SEQ ID NO: 5306 - protein, 234 aa, Lactobacillus buchneri
LLKFDRSILIQSGLRAVSMVFIWMLFANISLKGFFVNPRLLHLLVIGFVFAVLLTAVSRPHKNAVMVVLTDILLGILLASLYLDTPSINVWLILIGFLLANLLLVSNLIDEPHCRWIIYGFISGTGIVLLFTTTYHHYFSLVSLMYITLMIFANIFFSYYAFMKQNNQLSMMIVSVLILMLCLTLNISFFKIILIAGILAFYAYFESRVNFRNFEKRANVSTVSFLLFSMLVCF

SEQ ID NO: 5307 - protein, 396 aa, Lactobacillus buchneri
MREKHLFTSESVSEGHPDKIADQISDAILDALLAKDPDARVACETSVTTGLVFVFGEISTTAYVDIQKVVRNTIKRIGYADGRYGFDGDSCGVIVALDGQSPDIALGVDDALEQREGNTDPLDQIGAGDQGLMFGYAIDETPELMPLPISLAHKLMRKQADLRKSGEIGYLGPDAKAEVTVEYDDNAKPVRVDTVVLSTQHDDGVRLDQVRTDVINQIIKQVIPAKYLDDKTRYLVNPTGRFVIGGPQGDAGLTGRKIIVDTYGGYAHHGGGAFSGKDATKVDRSASYAARYIAKNIVAAGLASEAEIQLAYAIGVAKPVSIDINTFGTGKVPEDQLIDATRALFDLRPAGIIKMLDLKRPIYEQTAAYGHFGRTDIDLPWEHTDKVDALKDYFKL

SEQ ID NO: 5308 - protein, 492 aa, Lactobacillus buchneri
MTKTATKSNVTLVTIALFVATFMAAIEGTIVSTAMPTIVGDLRGVSLMNWVFSIFLLTNAIATPIYGKLADSIGRKPMFIGGILIFVFGSVMSGLSHSMVVLIFWRAVQGVGAGSIMPISNTIIADIYPLEKRAQVLGLNSSAWGIASVIAPLLGGFIVDHLSWHWIFFINLPIGLIVMVMVQIFLHEDKHHSTTKMDIAGTTWLTMMLLAVMYAFQLVGQDPINWQIVAVCFLVTVIATVMFIRTERLAADPLIPMELFDNRTFVVQNIVVFLVSGFLIGYEVYLPDWTQGILGLRASMAGFAVTPSSLMWIVGSFLAGKLLARTSPYRIINLSLFFILVGAIIMVLIPAYTPFVAFLGISMICGTGFGLTVTTSIISVQNEVKPTQIGVATSFNTLCRTLGQTLMISIFGIVMNTTMLRGVRQTEHTSLKMMDKLINPLTANQLSDKILPQLRNILYNSLHNVFVVGLILIIIAYICNLFDRKNKKQRIN

SEQ ID NO: 5309 - protein, 190 aa, Lactobacillus buchneri
MKIKSALEYSHELLSETVDSGDTVVDCTMGNGHDTLFLANLVGKQGTVYGFDIQAQAVENTKALLKTNHVRTKNVYLYNISHAKVDEILPYETMISGAIFNLGYLPGGDKTIVTYPETTIAAIKGCLNHLCHNGVIVVVAYYGHPGGEREKNTVLEFGSQLDQKRYSVLKYSFLNQQHFPPILMAIQRID

SEQ ID NO: 5310 - protein, 213 aa, Lactobacillus buchneri
MKKQSQKISSTVSLVSLVIFLILTYGVVLHKEWINTFDTYFGHMVRSFQTPSLTSFMIHFTELGNYQSLLGFTIGAGLILFLVRKIKSALFLLINGVVLAAPIDTLVKHMVNRPRPSLTHLVAVHSSSFPSGHSMSIMVVAGSLILLANRMLKGSSQRLIVDLILIIMIVGIGISRIYVGVHYASDVLGGWSLGLVTLMVSQWVFNRFAGGIS

SEQ ID NO: 5311 - protein, 806 aa, Lactobacillus buchneri
MAYNHEVIERKWQHYWKEHKTFKTEEVADKDKYYVLDMFPYPSGQGLHVGHPEGYTATDIMARMKRMQGKNVLHPMGWDAFGLPAEQYALKTGHNPRDFTAKNIKTFKRQIRSLGFSYDWDREINTTDPSYYKWTQWIFEELYKRGLAYEDNIEVNWAPDFMGGTVVANEEVVDGKTERGGYPVYRVPMRQWVLKITAYADRLIDDLDDLDWPESIKEQQRNWIGRSRGASVFFEVKGHPDDKVEVFTTRPDTLFGATYMVLAPEHQLVSKITTPEQAAEVKAYQEEVSRKSDLERTDLNKDKSGVFTGAYGINPMTGKEVPIWIGDYVLESYGTGAIMAVPAHDDRDYDFAKKFGLPIVPVIEGGNTDEAAYTGDGPHFNSGFMDGMGKDDAIKAAIDWLTDHKAGHEKVNYRLRDWIFSRQRYWGEPIPVIHWEDGETTLVPEDELPLRLPKAKDIQTSGGKESPLANLDDWVNVVDKNGRKGKRETNTMPQWAGSSWYWLRYMDPHNDQAIASPEKLKYWSPVDLYVGGAEHAVLHLLYARFWHKFLYDLGVVPTKEPFQKLVNQGMILGTNHEKMSKSKGNVINPDDIVDEYGADTLRVYEMFMGPIDAAKPWSTEGIHGAYHWLDRVWRLLIDDNNHLRDRVTTINDGKLDKIYNQTVKIVSDDFEHMRFNVGISQMMVFVNDAYKADSLPIDYMEGFVKLLSPVAPHIAEELWSLLGHDGTITYEKWPTYDASKLVENTVQMVVQVNGKVRSHIKVARDLDKEKVEQTAKSDENVERYLEGKTVRKVIVIPNKIVNIVVG

SEQ ID NO: 5312 - protein, 557 aa, Lactobacillus buchneri
MDKFDKVTLGKANGFKFWSSLALMAASGLIMLQAPLAHADFPADNVRTTELGQRVTFYVQPVSKSDSAGDWQVIPGVKPIKMVGNIGESFQVPVYQNFVPTATISHTVPDSRADLQHPLLLKYRQESTGLYTATVNINYMNRQDSHTLDTATKTLHYADQVTIKPKKIQGYQPVEATFESPYFTKNNDQSVNFWFRELRDLTCLVKFWYRPVNASQPDQPEQVKEAQAKPNHAGVSTSSHSGTDSKLVEAAKPVTQDSGDTKPASSNVAPVLPVNSTDQAQKSAPQVEVKQQRPTVTQPTLVTKEPVFQAVKPVETKAASLPSDLSQVAQQSPVVPSKPTNSTRVNVAGKSQISVSRPTESVRTSSRPATDSHLGAIGVAILNNPMNAGQTTITQPTPNKKVAVKGVAVYAIKTVGLYNSPNFKSGNRLFRYPAQKRYARPMFVVTGYARSATGQLRYRVRDVNHQSPSHGKAGYLTANWTYVRPVYYASRHPKIKVINPTGIHGYQGKNLTGRVATYKKGQTVNVKRMVHYHLTTRFVLADGSYITANRKLVSAFK

SEQ ID NO: 5313 - protein, 317 aa, Lactobacillus buchneri
LINYRRSRNLRILYFVIGGLIILGFGFNIWQDQRASDQLKANYIDSSTPTIFVHGWGATLRSEKDMISAAEVSGAASRRMIVRVRANGKLSVTGTVKSWMVNPIIMVRMDNNRAGEVQYARWLTKVCKLLKQKYHVNQLNFVGHSMGAYAVVYYNLLNGNRSDLPRTNKLCVIAGPYDGIMDNHKSNQPTSGPLMQLWDDAPNKNRILPTGKPKIIHPEYKLLYRLRKNFPRQARVLNIYGNLGDGSNSDGVVTNASALSLGYILRDHVSFYQTFQAFGPKAQHSALHNNNIAVNKILTEFLWNKNYQDSSASELMQ

SEQ ID NO: 5314 - protein, 342 aa, Lactobacillus buchneri
VSKKRIEWIDVAKAVGIVAVVFGHAMTRHGTMFHFLYWWHMPIFFIMGGFFLKPIVNNNWIGFFKKRILPLLISYLICGGFLILLSHFIRGESWSYTIFYFARLLYGGRTLNHYLSVFWYINVYLLALVFTSIVITYVKSREAQIIVAFASLIISTSYKHIYFLSYKYVPWDFDVAFIAMFFMLFGYLYFHKIQQFVKDLWVIIPAAMLTVWLFWMQHMDRFNFAFFLKSKIIHASYHHIPISRVSYITFIPIIVCLVVFSASYYFCKFMPQFLIKPVQLLGQQTLGIMYLHKAVIDIIDEAGYNGAIMETILAVLISFILSLGYGYVKQKIKNSRIRRSIS

SEQ ID NO: 5315 - protein, 378 aa, Lactobacillus buchneri
MIDNHQNLTEKSRDQMLSGSAWMTAGSILSRFLGAVYIIPWGIWFGNYFFQANALYGLGYNIYSFFLIAAIAGIPSAIAKQVAHYNALNEYGVGVRLYKRGLVLAIATGVICAVILYFGAPLIDGGNPNVIPVLHSLAWAILIIPTMSLTRGYFQGYQQMAPSAISQFVEQLARVAYMLLTAFIMMRVLHGSWVNAVSQSTFAAFIGAVAGLATLGVYYFRRREDFRQLVLSSNNEIHVEAKQLYQEIIAQAVPFIILGAGITIFMLIDQFTFFKIMRMATDYNYATLSDLYAMFAVNSNKLIMITVSLSSALAITAVPMLSEALTSGDNVEIRKQNSNVMALFMFVMIPAALVMPQLPDRLTGSSMAPLIRHSALIF

SEQ ID NO: 5316 - protein, 161 aa, Lactobacillus buchneri
MGLFVVISAVMQGLSQNRRAVKFFAVGTVVKFVLQWPCTYFLGSFGPLLSTGIGLTVANWLILRYLNRHFGFEKRMLDIAFRKISKYSLFMYAAALLTVYGLNFVVQLIGNPFGRVVSLIVTLVAVLVGGVIYLYLALKSRIADMILGPRSDKLRRLLKIE

SEQ ID NO: 5317 - protein, 280 aa, Lactobacillus buchneri
MMINVKKITSQILTDVIRKRPADSFKGTYGKIALIGGSQNFGGAIIMASLAAVYSGAGLVTTITDPSNQTSLHDWLPEAMFVDWNNFDQAEPIIKSADVVVIGPGLGTDPSALTLLTKVFRIAGSEQKLVIDGSALTLLAANNLPLPKDSTNILTPHQMEWQRVSGIKIADQTPEKNQAAAKQLHAIVVVKSHRTQVYADNHVYENTGGTPAQATGGMGDTLAGMVGGFAAQFKNPQKAVLAAVYSHSAIADKLAEKQYVVLPHQISEALPKFMYKHQAK

SEQ ID NO: 5318 - protein, 467 aa, Lactobacillus buchneri
MTVDWKKRAQSYQDEYLNDLKELISINSVRDDEHKTDEFPLGEGPTQAMLKFLSFGERDGFKTQNIDNIVGYIEYGSGDQTMAMQAHADVMPAGDGWETNPFEMVEKNGNVYGRGTSDDKGPALAAYYGLRMLKDNGIMPKMKIRLIIGTDEESDWTGMKHYFQVEPQPTFGFSPDAEFPLINGEKGNATYVTTFGHTNGSEFTLKRFDSGLRLNMVPGSADALVEVGDNEKFVDGFTEFLDQNPIAGDVKSTGQGVALHITGKAAHAMEPKNGVNAGTYLAKFLNAYPFDGAAKEFISYLAEDLHDDSRATKIGAAHVDDIMGELTMNVGIMKFDTQHGGSVNTNFRYPKGTDDQEILAHLQQAAEKRHGTVKEINNMDTHYVDPSDPIVSTLMHVYQEQTGDMDSKPEVVGGGTYARLMKRGVAFGALFPNAQDTMHQANEFQPVADLIKAMAIYGQSIYELTAK

SEQ ID NO: 5319 - protein, 154 aa, Lactobacillus buchneri
MLDFNYSNILVGIDGSKTAAKAVRQAITIAEHNHAKLTIVAIINDREILGVSKAALIGFGNVNQSTIDEVKSRFQRLVHKYELMAKDRGLAVSAFVTSGDPKNKLAHELVDDEHVDAIVVGATGANFVDRMTMGSTAAFVIAQAPCDVFVVHRD

SEQ ID NO: 5320 - protein, 120 aa, Lactobacillus buchneri
LQNTKQHKLSAAQICGWIVWWVITIVVLALAIFMLTRTTDAAGVHNSWNYHMIAIFLLLVYGIQQIIAFFGIKRLHYNESYVWPIVLIVLGVLGSFLYVISGIWGLIVNNPQKNQPTKIE

SEQ ID NO: 5321 - protein, 262 aa, Lactobacillus buchneri
MIDIVFSDSFASTLKYYYQKRHLDGQVLALPMYLSLGDISQRSFMESRQTIYKIEYAHYQASEQLTVEAVNALRQGLDQLSQMAQAGESFRIWWSETADDYCGFLWICDYLKDFSVQTTSVKVPMTLVREDSLMIISKLGEISEDAIDELQLASLQRDLSANSRRAFSYYWHDLRSENNPIRTVINGTVVSQSIDFYDRFVLANLSQRRFRNILRVIGETLGDYPFTADWWYRHRIDYLVSKGSVDYKADPDAIVGKIKLAK

SEQ ID NO: 5322 - protein, 217 aa, Lactobacillus buchneri
MVIITAGMIGVGKTTLTGKIAEHLGTKAFFEPVGDNPVLPLYYSNPKQYGFLLQIYFLNKRFSMIKQALSDDNNVLDRSIYEDALFTRENNAQGNITDTELAVYLKLLNNMMAELDELPKKAPDLLVYADSDFDTIKHRIKKRGRDYEQFDDNPGLQEYYFKMWAAYKKWFQEYDVSPKIKIDLQKYDLSDPKNVTIVLGQIDDALAKIRQPQSETL

SEQ ID NO: 5323 - protein, 256 aa, Lactobacillus buchneri
MYKAVVFFDLDGTLFDNEKNVSDENVAAINELRANNILPVISTGRNIFEIQYVIDATGINSLVSANGSYVQYEGKKLKAEQISDDVIEEILAFAKQQGDVISFYNNKEFALTFENDMTKVNYRLLRLTPHVDPEFYKHHEVNFLNVFNYDKDKLYQDKFKGKLSLVRNNPRCLDTMKWGVSKQTGIQALMKKLNLGDVPSYAFGDQMNDLQMFSEVKFPIAMGNGVPEVKEKASFVTKSNINGGIVNGLKHYGLID

SEQ ID NO: 5324 - protein, 223 aa, Lactobacillus buchneri
MAKFSDIKGFVFDLDGVITDTSVFHSQAWHQVADKVGAPWSKELEDGLKGISRMDSLEMILKAGNLQDKYTDEQKVDLATEKNTNYLKLVDQMTPDNILPGIKAFLDEIKNGGYLLSLASASKNAPKVLQKLNLTDYFPKIVDPKTLSKGKPDPEIYVKGAELIDLKPEQCIGVEDAAAGVESINAAGETSIGIGDKNILKDADINFADTSEMTLANIEKQMN

SEQ ID NO: 5325 - protein, 905 aa, Lactobacillus buchneri
MRTFAIRARDGVMELNYSEDSNKPPFRKFMITYNPKFSIGDNLENIKAALTGLPIDAAIIENSLNYEFSDTIIGINHQKIDIGLAIANMMNIPVVNLQKIKEVGLKKAVADKEEYLKWHLDYYGEYAGKRNYGQEAMLTIGNGYFGLRGAYVESHADKDNYPGMYVAGVYNQLTTKINDRDVVNEDLVNLPNAQYISFGVDHQLPFTIKKADIQDIYRSLDLKTGTLTTTLHVQLSTGHIIQVRATKVANMDQWHRYAIKYELKPINFSGSLQIYAGIDGNVINGNVERYQDFDQHHIDVIGMSAHDNQVSMTGQTKTSHVQFVINSKLSSPDFDTKKLIDTTTEEGKVQQALSINVEPGKEYEFKKNVTVFTSQDENDHLEADAQKELDDSSFEDTLSDSEKFWSNVWQHSDIIIDNDLTSQKLTRVNIFHMLVTSAALSSGKLDASVGARGLHGEAYRGHIFWDVTFDLPFYAIHYPAIAKQCLLYRYNRLAEARKYAASEDKQGAMYPWQSGMYGDEQSQFVHLNPVSGKWDPDNSRLQRHVSISVAYDIINYVHITGDKEFMDQYGLEMLLSISKFWVSMTDYDQSADRYDIHHVMGPDEFHEEYPNSNDHGLTNNAYTNIMVSWLFDKVNTLVSQEDSAVLKQASEKAGFDDALLAKMNDIAHKLRLDINEEGIIGQFSGYFNLSKLNFDSYRKKYGDISRIDRLLKGEGKSPDAYQVAKQADTLMAYYELPFDEVQEVINRLGYKLPANFFTSNLRFYLDRTTHGSTLSRIVYSVLDEIDGNMDQSWQLFSTALFSDYYDIQGGTTAEGIHLGVMGATLQIETKCYGGVRFDTDEVTINPHLPSTWSKISFKETYQGINYHFVIGHHRIDVTADADTHVSVAKKAYSLTKNKMATITYK

SEQ ID NO: 5326 - protein, 121 aa, Lactobacillus buchneri
MLKEFKAFIARGNVIDLAVGVIIGGAFTGIVTSLTNNLINPLIGIFLGKIDLSNLIFKVGDATFRYGAFINSLINFLIVAFVVFILIKLINKVLKRQPTKPAIDNKEVLLSEIRDLLKNKQ

SEQ ID NO: 5327 - protein, 76 aa, Lactobacillus buchneri
LKKSKLFLIVGAVVLVLAVAFFITKSWHLSVLSFALIWLIAIIAIRLILTPLVVMIVRQRDERKAQREADDNSRDK

SEQ ID NO: 5328 - protein, 615 aa, Lactobacillus buchneri
MNKDWLHRIFITAGLILLAIGGSAATSGQAAAKTTNVADSKQQLVDIVLRPKSQSALHQFVYNTVTPSSPTYRKFVSPSTFAKRFSQSPKQIKALQTYLRHHHLKAQTYKGNLIMVVKGSTKNVEKAFKVNLVNVNNGEVKYQKASRNPQLPKKLSKVVYTVFGLSNYSPFSSYKTKFQPSSLHTRAASGTTTTKKYSPTRFVRRYNLQSLYDNGSTGRSKTIGIISFANFHPNDVYRYWDDEGINVKSNRLSVYRTNGFKGTWDGYDETTIDVEQAGAIAPDSNIRTYIARPNILGMVNSIAAAVGQNVADSLSLSWGQSEAQVAYEMKQGITPKKYNQIMNLLFEQAAAQGMSVFTATGDNGAYDGITTGLTSGLSVDTPSNSPYVTAVGGTTLPKTYTVNKKKVTIHQERAWGADFLYPNYKHQRFFGTLDMLQSFFAGGGGGFSKYNARPAYQKGISGVGTYDATNLWKFKYGRPELLKKPINLSGKSSGRNLPDISANADPNTGYSMFITPKNNRNSKGQWLITGGTSVVAPQMAAASVLMSDFTTNGRLGFWNPQIYRFAKRSTSPFKPLDSRTNNTNLYYTGQPGKIYNQATGLGTIDFTALNKAFNS

SEQ ID NO: 5329 - protein, 271 aa, Lactobacillus buchneri
  misc_feature (4)..(4): Xaa can be any naturally occurring amino acid
CAAXAMINTERMINALPRTEASESELFIMMNITYMEEQRKLTFGDYFERLMIFFGLIILVGSVQLPLMFIAQGKLSAVANYAVGALYLLGFLIAIWLAQYAYRKYGRYEVKKMTWPNVKTIVIAWIAFLVIEFLLGNLNKLVYHVTQTDNNQEIQSLLSSNHLTLILMGFTAIFCSPILEETIFRGYLMTAFFRSTEKWAPIIVSGMAFALPHMDPDLSHFNIISFLTYAILGCILAYLYVTTKNLKVSIGLHFLNNLIAVGGMIAMIFAV

SEQ ID NO: 5330 - protein, 369 aa, Lactobacillus buchneri
MGLSVKLMNDLSDGLKGRRNLITDVGGVKVGQVTIDDGDVHSGVTAILPHTGNLFRHKVPAASCVLNGFGKSVGLVQIDELGTIETPIVMTNTFGVGTALNALTKQMLADNPEIGDTTSTVNLIVAECNDGDVSNIRKMAITEQNVSDALAAVNDDFEEGAVGSGRGMMCYDLKGGIGSSSRIVTVDKKHQYTVGALVMTNYGYLTDFIVNGMPIGAPLAKMLAKDKQKEEKGSIITILATDAPLNARQLKRMAKRATVGINRSGGYIGNGSGEIVLAFSTANLVDHFETSEFDTVTRFNDNQIDLFFRATAAVVDEAILSSMVHAESVVDRKGRLRLNLVDACKKLISQQPDYTDMVEQVFSQLGVVK

SEQ ID NO: 5331 - protein, 183 aa, Lactobacillus buchneri
MSAKILLGAENIRQLAWGAVNGCEAASLLEGLHYQGRALDLNYGQFLLQMPISPDSNPYHGFGGSPFTNRPGKFEAIFTRPLMWWGNRYGNLQELSGADPQWLYDFVAKGEPVLTFVTVRFEQPEWDSYPFGQVPANNHAVLLDGIDGDQVHVSDPIDGQYWLPKTKFEPIYLSRKMAIAITK

SEQ ID NO: 5332 - protein, 539 aa, Lactobacillus buchneri
MHLSRGVAALAGVASIALILAGCGQKSGQANKTIKTSTDSELTTVDPSKTTAVGTFNVLNNVDEGLVRLGKNSKVEPGIAKSWTVSKDGKTYTYNLRKGAKWSNGDPVTAKDFVYSWQRTLNPKTASQYGYLFSGIKNADKIQNKKAKVSSLGIKADGNYKLTVTLEQRIPYFNLLMGFPVFFPQDAKAVNKYGNDYGTSAKTQVYNGPFTLTGWTGTNNKWTLKKNTDYWDKKAVKLDDIKFSVQPDPSTSLNLYNQGKLDMSQLSATQAKQMGNKKDMISRKQSSNYYIAVNQKNKVFKNLKIRQAMSMIINRKTLANKVMGGGAIDNNSFVSEGLAVSPKNGTDFTKDTTAPASMTYNPTKAKQLFKEGLQEVGRSSLHFTLLNSDGSDQKQLSEYLQSALQKLPGLTVTLNNIPGRSILSRQADGQFTVTVANWFADFSDPITFLNILTSNNPSNISGWKNSEYDSLIKASNADDGSNANARWDDMVKAQNLALKDQAIIPLYQSGEKWMVNSKVKGIVYNTAGANYNFKEAYVK

SEQ ID NO: 5333 - protein, 357 aa, Lactobacillus buchneri
LEPVIKKIDVQEAAVPLKRPFKTALRTVTTAQTLIVKMTTSDGKVGYGEAAPTPVITGDTLPSIESAINDVIGPKLIGKPLFDSADIKATIDQSMVHNSSPKAALNIAVNDLLAQSYGVPLYQLLGGHSDHITTDYTVSVGTIEDMITQAQDLITKGFTTLKIKVGDDSEEADLDKIVAIRKAVGPAIQIRLDANQGWHPKQAVAVINRMQDLNLNIQLVEQPVKATDFDGLAYVTANTTTMIMADESIFSIEDAARIISMRGCDIINLKLMKAGGIDNAVKINTLAEAAGIPCMVGSMIESSVSVTAAAHLAAAKRNIQYVDLDASMMFSSNPIVGGIINQKNEISFPDLPGLGFK

SEQ ID NO: 5334 - protein, 296 aa, Lactobacillus buchneri
METRRVKVPVATIWKSKESPRKVDQPALDGDGKKWVEQMSDEQSVALSDDDLLETQALFNDEVIIDHFDGDWAKVYIPSQRDDSDSRGYPGWVPSKLLSDQQISYPPVTSIVRIAVRTANLYDENKKPVLEISLGTVLPQTGTSGDYIAVVTPLGKGFIDKSAAVLPFVGSNAGETMVEMGRQFLGERYLWGGTSSYGFDCSGFAYTLHRVLGFDIPRDADDQQENGLPLAPEEILPGDLVFFAYDHGKGYVHHVGMYIGNGKMIESRTPGAKVDIAELTEPKFAAEFAGFRRYWR

SEQ ID NO: 5335 - protein, 248 aa, Lactobacillus buchneri
MSELSETIERVMADSSFKYGLLIQSNGQTLVDHDSHEAFPSASLIKLAILNDVLDSNVDLDQSVDVSTDELVGGAGILQLMSVRSWKLRDLLALMISVSDNSATNVVISLMGMNHIQHYLQTHDFHETRLERYLMDGRALASGKNNYTSATESLRLLQQALHNGSEVQSWFVNQQFRYKLPGNFDESGENVAVYNKTGEGNLIDHDVAQIVYNNHSVDIAMLTAGSLNRMETIQKFNQVGQSVVDWLA

SEQ ID NO: 5336 - protein, 150 aa, Lactobacillus buchneri
MPQTQPIRLDGQLCFQVYSANKKFNHFYQQALKPFDLTYPQYIAMLTLWQYAPLSVKQLGEYLHLDSGTLTPLLKRLENHGWITRSRCEADERTVVIQLTDKAKEQQDNVFSRVNSCFDVLGLTPAEKEACSQTMATIEQKLDLYNQTQI

SEQ ID NO: 5337 - protein, 232 aa, Lactobacillus buchneri
MKIGKLRFSTWLFWITVVSMAAYLGYYGYWLMKGQPKFHGQTLLLVEVFIGILIASLPFLIEKLGRFYFPQIELVFFYIFLYMSIFLGSGLQFYSVPFWDKYEHVFSAMMLAGLGFSIFQGLMSARDNATNKPFLMSLFAFTFGTTCGVFWEMYEFTADGLGGLNLQRYEEAGKLLLGRAALMDTMTDLIADLAGAFLMALIGYLMMKHDPSSSRYLVFKTKRQNFFSSYYF

SEQ ID NO: 5338 - protein, 649 aa, Lactobacillus buchneri
MRGKRLVIGILSGIFVIAGSVSTSAKSNTYTMPKVSPSKTVVANIALKPQSSSQLTDYVYATVDPSSPNYHQYLTPGQFASQFGRPTTDINDFKSYLGKYHLKASVYPGNLAIKVVGTRKNLIRAFNAKQVKVSKNDYRTKVKLPAKLSAQTVSVIGVYATKPKSKKTSLAVTPSLPQNPTPPNTDLSKTSFAKKYGALKFADHYQVSDLYKQGLTGQGQRIGIIAMDDFNAKDVLKYWQQTGVNADPSRINKIYSIDGAKTGHLILSMGLNPAQIESTLDVNQSGAVAPDAKIDAYIGLSLKNVTSTTSSYYTAFMQAVSDDRDKQISTSFSPNTELASQWEQGASASLGEYNDAFNLLLEQAAVQGISVFRASGDYGPRELALKQFNHVFSTSPYQVITGGTTLPYTKITDGRLITIDKERAWGDTYSNPQTKPANYGGSGGGFSILNPTPRYQQGFSGVNTFQAIDLLKYKSGGFLVNKDPQIIIGKGSGRNVPDVSANADSYTGYATYVSGQDLAYAKDGKTVISVPVKQWTVNGGTSFVSPQMAGANAVMNSGTTSPIGFWNPQIYQFAVQPDSPFTVLDDADNNNNLYYTGQPGKLYNQATGLGTVNFAKLYTKFSSEGPIKTIVVLTRDSPTKHSSFNMLIT

SEQ ID NO: 5339 - protein, 146 aa, Lactobacillus buchneri
MYDNILVPLDGSKNSQQALEEACKLAKQFDSKLQLVTVINNTNFYYGAGAAGMPPSMYDDQHKIAENIIDEAKKYADSQGVKYETAIDIGNPKNIIAHVYPDEHDVDLIVIGKSGVDAINRLLIGSTTAFVVRNATTKVLVVNTKG

SEQ ID NO: 5340 - protein, 77 aa, Lactobacillus buchneri
MDEIVFFNPGDSIGNFHDHNEAVKTAQIYKEKEHNKKVLVVHGVDNKNFDIFMADDIISHDNERNAIQKPYKISDRI

SEQ ID NO: 5341 - protein, 626 aa, Lactobacillus buchneri
MCGFVGYVNQKDVPEGTINSMADRIKHRGPDDEAYFSDDNVSMGFRRLSIIDLAHGRQPMFNADQTKVLTFNGEIYNYKEIREELRDLGYVFKTDVDSEVLVYGYEEWGPALLDKLRGMFAFVIYDKKNNEVFGARDHFGIKPLYYYDDGDTFLWGSEIKAFLEHPNFNKELNLRLLPIHLSFEFIPSRETMFKHVYKLLPGQYFLHKNGKTETHRYYKFNYDHIDNSQTIEGDADKIGKLIDDSVKAHMIADVEVGSFLSSGIDSSYVLNEAAKLKPIQSFSIGFHHSKYSELAWSTEFAKTINQKNTPIYMNGDDYFNFLPTMMYYMDEPLSNPAAIQLYYLSKDTSKHVKVALSGEGADEFFGGYNTYLEAIPFDRYQKYVPKPVRKGLAAVAKRLPRFHGKRFLVRGAQPLSERYYRVNYVFNYDDRNRVLKDPSINTDSGAYTKHIFDDVKGKDEMTQMEYFDINTWLPFDILHKADRMSMCNSLEVRVPFVDKEVAKFAETMPVKTRITPDETKIALRTSAEREMPKKTALKEKLGFPSPIASWINDPKYHERIVNAFHSDTGKKFFNTNELDRLLKEHAEGKSNMQKIFTIYTFILWYQVYFPEDTTENTVSLVHRTQI

SEQ ID NO: 5342 - protein, 511 aa, Lactobacillus buchneri
LAQITVAEVLVLLKEHNLLLESQLSSSSHPFDQIAYNSKLVTDNCLFFCKGNFKSAYLDDARQNGATAYMSEKTYQNAGIPGIIVKNIQKAMSLVSAAFFGFPQDQLPTIAYTGTKGKTTSAYFTKAILDQTYQRKVALSSTINTVVGLKPEDVVKSNLTTPESLDLFTMMRKAADNGMSHLVMEVSSQAYKKNRVYGLHYDVGVFLNISPDHIGRNEHPTFADYLHCKEQLLVNSDVCVLNADGTHLTDIFYTAKATTQPENIFIYGRAGQNQETEFPVDVEYRSLKDSLTENQIQVTARTAKAKQLNIDGVYRIGIPGDYNEGNAVAAAITSALMGAKPTEIAYGLANTTVPGRMEIYQTHDHGTIYVDYAHNYGSLHSVLDFLKKQAPNGKVTVITGSTGDKGIDRREGLGKAINEAADQAYLTTDDPATEDPQQIAKEIAAHIDTSKVATTYIPDRKQAITKAVSESQKGDLVVVAGKGHDQYQKINGKNVPYEGDAAIVKNLVKGL

SEQ ID NO: 5343 - protein, 416 aa, Lactobacillus buchneri
MKNKQLDFTPVLLGSDFNAYGMARSLYEIYGKPVKAFAQTQLAPTRFTKIVDLELIPGFSEDPVWIDTMKQLKKRYANHQEPVILIGCGDGYAELIAKHKAELEDVFICPYIDYDLLKKLNDKENFYKMCDQYDLPYPKTRIISKAMYASGEPIEQPFGYPVALKPANSVEWLDIHFEGRKKAFIIKSEAEFREIVAKSYDNGYTSDFILQDFIPGDDSNMRTLNVYVDKNHQVKLMCLGHPLLEDPAPAAIGNYVAIIPEFNQEIYNKVQAFLEKINFHGYANFDLKFDHRDNSYKLFEINLRTGRSSFFVTLNGHHLADWVIQDYVFDSLKDQSTLYANKDPRQYFLWLGVTPKIFEKYAKDNAAKKQAMEMINEGRYGDTFWYAKDKNIKRFALYKWMMHNYAKSFKTYFVEK

SEQ ID NO: 5344 - protein, 236 aa, Lactobacillus buchneri
LKNFFTIIGGMGTEATETFIHILNDRTQATKDQDYLNYILVNHSTVPDRTDYILDHSKPNPLIPLAEDVKQQSALHPDFFAIPCNTAHYFYDELQKLTDVPILHMPKETVAAIKDYAPNAKRVGLIATEGTLHDQIYDHEIINAGYELVKPTDKIADQTMTLIYDDIKAKNEVDEGLYHLILSQMVESLKCDIVILGCTELSVAQQRAGNHDYPVIDAQTVLADKCIELAEANRAK

SEQ ID NO: 5345 - protein, 112 aa, Lactobacillus buchneri
MWIILNYSCWAILFVNFIWGLTRSMKKHVIDSMMIARVFYWLIMISQVVISLRSFHRHPLLVIIGTVVTLAVIALTETAYGRKQDVNYSPKLLWLLMLATPIAVCLQTLVNY

SEQ ID NO: 5346 - protein, 563 aa, Lactobacillus buchneri
MDYKAQVTNSILSVLNDELSSAEVYEKLEKPKTLAMGDLAFPAFSLAKVFHKAPNAIAQDLVEKIDQSSYEKVEAKGAYLNFFLDKGNFSNEILNEVLEEGSAYGQNDSGKGGNVPIDMSSPNIAKPISMGHLRSTVIGNSIAKLLVKNGYHPIKDNHLGDWGTQFGKLIVAYKKWGNEEDVKKDPINNLVKYYVKFHKEDKEHPELDDEARETFKKLEDGNEEEVFLWKWFRKVSLESFNKIYEKLGVTFDTYNGEAFYNDKMDEGIQILKDKGLLVESQGAQVVKLDKYNLNPALILKSDGATLYITRDIATAIYRDRTYKPAMNLYVVGAEQTYYFQQLKAVLLEMGLPSAENLHHIPFGLITVNGKKLSTRSGRIILLDEVLDDAIDLAKKQIEAKNPDLPNKDEVAKEVGVGAIIFGDLKNERTNNIDFVLEDQLRFEGETGPYVQYSHARAESILRKAGDIDLHGANKQLDDPAAWETVTALKDFPDVVKSACKDFEPSEIAKYALRLAKSFNKYYAHSKILVEDDQLAARLSLVKAVSIVLKESLNLLGVKAPDAM

SEQ ID NO: 5347 - protein, 695 aa, Lactobacillus buchneri
MNKNSTNSFRKSVGTFLKRFNRFCRRFHLVKWLVVIFLSISLVTSTYLVFLAKTAHVQNLESSLSKTTEIFDVNNKKAGELYAQKGTYVHLNQVSANIPKAVLSTEDRNFYHEYGFSFKGIARAMFLLVKNKLLHRNYISGGGSTLTQQLVKNAYLSQEQTMTRKLKELFLSIQVENVYSKNEILTMYLNNAYFGNGVWGVQDAARKYFGENAVNLSVPDSAVLAGMLTSPSAFNPIDHPKAAKWRRNVVLQLMVENNKLTQAQANYYKKTPITLRDTYVRKDGYKYPYYFDAVIDEAISKYGMTESEIMNRGYRIYTNLNQAQQQAMQNNFNNNAMFPANAADGTEVQAASIGVSPTTGGVTAVVGGRGKHVFRGYNRATQITRQPGSTMKPLAVYTPALEAGYKFDSELVDKKKSYGTNHYTPKNYNNVYQGKVPMYEALAQSMNAPAVWLLNQIGVNRGYQSVKDFNIPVTKKDKNLALALGGMSGGVSPQQMAGAYTAFANGGKIVKPFYIRKIVDSTGKVVVDNTAKQEGRQIMSSSVAKQMTSMMLGVFNNGTGADAKPYGYQVAGKTGSTEADNTGSADATKDKWIIGYTPDLVVATWEGFDNTSQAHHLENLSGTGVGPLFKNEMQTMLPYTKNSSFNTKDAQSIVQGESSNDNLWDTIQKKTNQYGNQIEQKAKDLIDDAKSWFKH

SEQ ID NO: 5348 - protein, 114 aa, Lactobacillus buchneri
MNEKMTATTNQLQAELIASDEFTEIKAAYDALKKSLDDYKLFNDFQDAQQNLQQKQMQGVQPTQDEIQNIQAIAGKMRESQLISALMTKEKALSQLLSDINETVTKPISDLYKS

SEQ ID NO: 5349 - protein, 413 aa, Lactobacillus buchneri
MKFIHTADLHLDSPFLGLKSHVLPNELWEKVHQSTFDSFQRIIDDAIEQQVDFVLLAGDLFDREERSVAADAFLVAQLNRLNEHGIEAFISFGNHDYSTADPASFGYPANTLVFGNQVETKQYTLNDGEVVAVSGFSFDKQWITQPMIQDYPTAVSDVNWNIGMLHGSLSSLNSPEANYAPFTLSELEEKGYDYWALGHIHKRQSLNEQQTINYSGNTQGRHINESGEKGYLLVQSDDQHLQTKFVPTAPIVWDRVAISLDKMSADQIVESILEKIANLHYDKLHFIRIQLASQTAIDADLLAKINNGDLLDDLQDINADKWQQLNCWITSIEAPQVKSLVYSSIDQDYFNQAKAATLNDEVFDQILKDFNKQPTFIKDEVGSEESKQEIFDQAGAILQENVVHEDTEEDKSK

SEQ ID NO: 5350 - protein, 862 aa, Lactobacillus buchneri
VIIKQLNIYGFGRWIDQKIDIKNPLQMIYGPNEAGKSTIIAFIKGILFGFTDKKHSIHGQYQPKGSAPYGGEIIFSADQHNYKVVRTGLKYGGTVKFYDLDNDTELTADDYQQLIAPIDRTAYDQLFYFGSVDQTAFYKIGRDELRLRIQSLGVAGAGDWMDLQTNLDKQSAKMYAPRGRTKKINIQIAEYKKLEDQVSAAKAHFPHYQDLQVQLKQDQAKSKDLQADLKTANHQLDNKRRLQTVMPLVNRLNDLNTVDSSQLKPQFGDADLNEFNKLNMALTAESADVQKAETAVAEVARQSSRKPVQTFYEAHSDTIERLYQELPAARKVALAIELGDSQLQDVQRQIQTQSASIAKNEQGNLPQAFDDQTFSRVNELLREQQNLQEKRAEVTRKKTQSAEQPHGNGGLIWYGVAAALVVLGFLLGSSSFGWIGYILAVVAALWGWYSAKGSSKSQPTSSPSHEDPVEIDQKLEQIRTELTAVQKQFGLQGIDEAKWLPMQSSLREIQRLQQSYQQQKTALNEQQAKYQDYLDQWQFASDWLKFDQTKYSTAIETIGKTVAHWQQLSTDYQHQQAVLTQEKKTLAAAKAKLVELTQQKQTFLKDRHVENDEAFQKGVAFQAELAKQLDQKATLESQIKAAKISIPENIDQDALNTDVREATEKVQSLQDQLNDLSREMTRVQTEIAGLIKNGQYYDLRQELANQQTEIVENVQKYLALKLSSQWIQAVLDIASKGRLPKTLALAKQYFATLTNDAYKEIIFKKEISVVRKDDVSFPINELSTGTLEQLYLALIFSMAVGFSSQYPMPIIIDDGFVNFDQRRKAAALAMLQQVSEKTQVLYFTANLDANTDSKLVLDLKTL

SEQ ID NO: 5351 - protein, 328 aa, Lactobacillus buchneri
MAKQLMDIKLDEEFEMYVLLKDASKRVAKNGKPFLSLVFQDQSGQISGKYWDASPTDVEQFVSGKVVLLKGKRENYMNSPQIKILAMRLANQSEPHDPVNFVKRAGMSRDQMEEYIDQTIFEITNATYNRIVRSLISKHANAFYTFPAAKSNHHDFAGGLAFHTISILKLAHSIVNQYEGINAPLLYAGAILHDLGKTIELSGPIATEYTLAGNLLGHLSIMDAEIVEAADKLGIDPKSQDLILLRHMILSHHGLLEYGSPERPKILEAEILHHLDELDATIMMIQSATKNVEPGQFSDRVFGLDNRRFYKPEKSVDPKQKPTQGELL

SEQ ID NO: 5352 - protein, 298 aa, Lactobacillus buchneri
MCFCMKKWLIVLAGIMMSFTLAACGSKTVATTNGGKITESAYYSSLKSTSSGKQVLQQMILNKVLEKQYGKDVKDSQVNSEFAKYKKQYGSSFNSVLQQNGMTASQLKDSIRSNLLLKQAVKDNVKITDAQLETQFKSYQPKVTVNQILVSKKSTAEKVISELKDGKSFSSLAKKYSTDTATKNKGGRIAAFDNTNTSLDANFKKAAFKLKNGEYTKTPVKTQYGYQVIQMVNHPSKGTWKQHESELKDQIVTSKMSDSNTLHSVVSKVLKKGKVTIQDKDLQNVLSDYLSTSSSAKK

SEQ ID NO: 5353 - protein, 101 aa, Lactobacillus buchneri
MKTVFKIVGATAVVAGVYLYSRKETPQEFVERAKSTFDDRKQKAADWKSAYDDFKKSMNAFTAQMPVLEKTINDISRDVDEAMFKIQPRLDEINKYTDKLK

SEQ ID NO: 5354 - protein, 142 aa, Lactobacillus buchneri
LKDCIFCKIVRNEIPSYTVYEDDIVKAFLDISQGTPGHTLVIPKKHIANIFEYDEELASEVFARIPKIARAVKASNPDIKGMNILNNNGQVAYQSVFHSHFHLVPRYTSNDDFKMIFKDNSNKYSPEQLKAIQESIEQHMGD

SEQ ID NO: 5355 - protein, 245 aa, Lactobacillus buchneri
MTLQVSNLVGGYSQVPVLKDVNFDVKDGELVGLIGLNGAGKSTTINHIIGLLTPFKGSIKINGVGLNDDVKQYKEQIAYIPEQPIVYKELTLKEHLEMTMLAYGLDQDESWKRAHDLLKLFRLDNKLDWFPDNFSKGMRQKVMIVCAFLTNAKLFIIDEPFLGLDPLAVNDLLNLISERKQQGASILMSTHVLDTAQRYCDRFVLLHDGQVRTEGTIEELRKLFPDAGDSLNDIYLTLAREGDAS

SEQ ID NO: 5356 - protein, 407 aa, Lactobacillus buchneri
MKQLFRQRLTTHLKEMMRYLRLVFNDYFVLALLFVIGGLGYYYSNALKQLHTGLWWAPIVIIGILLVSVQLGRFATLIEAPDYVFLLPKESELYNYLRSGFRYSLSIAVAIQVLFWILLMPFVQVTMRATSTELYLLLATILILKITWLNTDFARKYHLQQSWLASRLIFRLLLPVIALGSSIYINYWLGLGIAVAALFVSYFSRRNWVSRSLDWTTMITDENSRMHTVYQFFNLFTDVPTLQGSVKRRRYVDGILSRIKLIPKNTYLYLYAHGIVRDNEMSGLYVRLLVIGTLFLVFVKGELLPIFLSLLFVYLIGFQMIPFYFHFSDNAFVHIYPITNQYQLKSFQRVLLYLLSTVGVVFAVAVLAVNLATPVTIIGVIVGEALEIWAFVYLYLPRRLARSERTR

SEQ ID NO: 5357 - protein, 214 aa, Lactobacillus buchneri
MRVRKKPWADKYIKNHGDYIVTDPKNWLGKWQDRFAKVQPLNVEVGIGKGRFIIETARANPDINYIGIELQTSVIATALRSFMADPLPNVQFVLTDGANLDELFYENEIKKIFLNFSDPWPKKRHAKRRLTSPLFLKTYNHVLDQDGDIEFKTDNRGLFEYTLVTMNNFPMKFDYVSLDLHHSPENESNIETEYEQKFSPKGPIYKLIAHFTAS

SEQ ID NO: 5358 - protein, 102 aa, Lactobacillus buchneri
MKKQTVFYGLALAALAGSAYIVAKSDRKHEKFLAAIVKDTKQSAALKGFKYIGSWSILPTTDSTPLFHFGFNYLNPEGDRKTEEFWVDQTSQQVVKHQVMTL

SEQ ID NO: 5359 - protein, 111 aa, Lactobacillus buchneri
LQNLPKTNLKDLTKQLENGKYMLFFTADWCPDCRFIKPAMPAIEAEYPEYTFLQVDRDENIDLAGEMGIMGIPSFVAYSDGQEIGRFNNGDRKTKAEVENFINSLASTVAK

SEQ ID NO: 5360 - protein, 212 aa, Lactobacillus buchneri
MLITSYNPNSTGDTMVLIMNPDVGEQSVTIHDKVARIFAADSNQTLGYNFLEASKVLPEIVHENGQVHLTEDQVTRLNQYLGDHGFPADIRYDNQPKFVVGYVKSVEDHPKANHLQITKTDIGTGKDVQIVSGSPNMREDIKVVVALSGAMMPDGQIIWPGKLRGVESDGMICSGRELGLPNAPQVPGALILPDDYQVGDAFDFDKTQHLFD

SEQ ID NO: 5361 - protein, 722 aa, Lactobacillus buchneri
MKHYDGPAFFRRKGITRKPHQEREIKQNNQPVAPKIQDTRSSKVPDSKFDRRDETPAFLKEIKNFKPQKRSKSDKRKQQIQTNYFLSQAHRRHRLYDELTRRLRITYDDLIVIADKQPTIDQPREQHPKQPVQSPKPAKPTEGQPQTSPQKSSLTDQPKISSGEGVRHLNRQPRKALNHHGLGQSFNSIMHNQRASESDLSLFNAQQLSHNAQVKKVNHVNQPTKGVQHSLAEPNVSEKPTEDRGYQFPPLSLLAKPQQAESESIDDWIIHQSEILNQTFSAFKVNAQVVDWTNGPTVTQFQVKLALGVKVSRITNLTDDLKLALAAKDIRIEAPIPGKTTVGIEIPNPNPRPVVLSEVISTKHFQDSQSPLTTALGVDLSGVPRTTDIKKMPHGLIAGATGSGKSVFINSLLVSLLYKATPADLRLLLIDPKAVELAPYDGIPHLLSPVISDPKTAAASLKWVTEEMDQRYEKLAAAGAKNIEQFNRQASEAHEYGLKMPYILVIIDELADLMMVASSEVEDYIVRITQKARAAGIHLIVATQRPSVDIVTGTIKNNIPTRIAFMVSSQVDSRTILDSAGAERLLGRGDMLYLGSGANQPVRLQGAFVTNQELDGIVDYVRQQGEPKYLFTPDSLKRASTETSSEDRLMPQVLKYIGNEETISTSKLQRVFSIGYNRAANIIDHLQEKNLVSEQQGSKPRTVYYKPAADESARESPQNHQK

SEQ ID NO: 5362 - protein, 443 aa, Lactobacillus buchneri
MNSDTVYHFVGIKGTGMAAMALILHDRGEKVQGSDIDQYTFTQRGLEKAGIKILPFDENNIHEGLTVIAGNSFTDDHPEIKKARDMGLTVYRYHEFLGKIIKGKTSIGVSGAHGKTSTTGLLAHVLSGIAPTDYLIGDGSGKGVPNARFFVYEADEYRRHFLATEPDYAIMTNIDFDHPDYYKSIDDVADAFQTFANQTKKGIFAWGDDKRLRQLKAKVPIYYYGLKDTDDFQAVDVKRTTSGSSFDVTYKGKNLGNFSVPLFGEHNIFNSLAVIAVAYFEDVDLDEIRKELKTFQGVKRRFAERKIAGMTIIDDYAHHPTEIKATIDAARQEYPSKKIAVVFQPHTFSRTIALMDDFAKSLNLADEVFLTSIYSSPRESHGKVSSEDLSKKITKGGRILSVDNMSPLLDYDNDVVIFMGAGDIQKYEKSYEDLLSHLSKKIN

SEQ ID NO: 5363 - protein, 240 aa, Lactobacillus buchneri
MNNYPNEQQEARRVVNNAAGLNAFLTKMYGWMSLAVLVSAATAFLVSGSVAGGMAAYIAGHQGVMWGSMILWFVLPFVISLQALKRPTLAFTVLMLYSILSGFVFATIAWAYTGASIAAAFVSASAIFITMTTVGLVTHKNLDRWGAQATAALIALIIAMIINIFLRSSVISFVFSIIAVLIFTVLTAYDTQKMKQMYNQYSGNGEVSMTGLAVFGALQLYLDFVNLFLQLLSIFGNNDR

SEQ ID NO: 5364 - protein, 884 aa, Lactobacillus buchneri
MTKKLLLIDGNSIAIKAFYALYTAMDKFTNPSGLHTSAIYGFNRMLDKVLADEKPTDVLVAFDAGKTTFRTKMYADYKGGRAKTPTELSEQFPFLKELINARGISTYELPDYEADDIIGTLAKKAEEAGDYQVVIVTGDRDLTQLTSDKTTVQVSKKGVTELETYTPKHVEEKLGVKPSQIIEIKGLKGDNSDNYPGVEKVGDKTAVRLVQQFGTIDNLYQNIDQVSGKKLKEHLIHDQAQAERAHTLATINRDAPVTVSLDQLKYQGDNIDKLTDFYERMGFKSFLAKLSVDDQDHADDQADIQYTVLSAKNAAELDQFTDEVTFHLEMSEENYHTSPLVGFAIGQGDKWYVTNDPELLHNQHVIDLLTSKTIKKNVFDAKRTYVGLYRQGIELANVDFDMLLVSYLLNTTNNSNDVGTVAHLHGFYNVKTDEEVYGKGAKRHIDPQSPAFLAHLVHKVKAIDALHDGMFKDLDAHNQSKLYWDIEIKIAFVLAHMEINGIKVDAATLEGMGSKFKERLAEIEQTIFQEAGEEFNIGSPKQLGKILFEKLRLPILKKTKTGYSTSVDVLEKLAPDAPIVQNVLDYRQISKLQSTYVDGLLKVIHPDDSKVHTRYLQTLTQTGRLSSVDPNLQNIPVRSEEGRLIRQAFIPSHPGWQIFSSDYSQIELRVLASITDDQNMQDAFKNGEDIHATTARRIFGLPSNEEVTPELRRQAKAVNFGIVYGISDFGLASNTGITRKQAHQFIERYFEEYPGVKKYTEDIVEFARNHRYVETIAHRRRYLPDINSKSFNLRSFAERTAMNTPIQGSAADIIKIAMINMADAIKDMKTRMLLQVHDELIFEVPDEELDTVKQLIPSVMDSAIHLNVPLKVESHWGKTWYDAK

SEQ ID NO: 5365 - protein, 280 aa, Lactobacillus buchneri
MPELPEVETVRRGLTQLVKGSTIQSVDVLYAKMINLPPNDFKKALRGKTIEKIDRRGKYLLIRLSDNLTIVSHLRMEGKYDVEPEDAPVGKHTHIIFHLTDGRQLRYNDTRKFGRMNLVDTGTEMQVAGLKTIGPEPTEDNLTVDYMQKIFSKSRKVIKPFLLDQSNIAGLGNIYADEVLWLSKINPQQPANTLTLRQIKELRKNIIAELAKAIAGHGTTVHSYSTAYGEAGSFQNQLNVYGREGEPCPRCGTKIVKIKLAQRGTHFCPKCQPLRGVKND

SEQ ID NO: 5366 - protein, 196 aa, Lactobacillus buchneri
MTKLIGLTGGIATGKSVVSDYLHQQEIPVIDADIVTHQVEQTGTPGLQALVDAFGQRILLADGALDRQAIGRIVFNNPADLKQLVRIIDPFIREEIFSQLKRYRDAELTVLDAPTLFENGYVHLVDEVVVVYCDPVTQLQRLMKRNKLSIVSATKRIRNQWPLQTKCDLADTIIYNSGTMTTTLTQVDRWLAKETK

SEQ ID NO: 5367 - protein, 162 aa, Lactobacillus buchneri
MQCPHCGYNGSKVVDSRPTDDGRVIRRRRECEHCGFRFTTFERVEVTPLLVVKKNGNREEFNREKLLKGIVRSAEKRPVSMDAITNLVDRVENKLRSLGENEVSSQQIGEYVMEDLANLDEIAYIRFASVYRQFKDMSVFYKELKEIMEKDKKKGQDHSGDK

SEQ ID NO: 5368 - protein, 461 aa, Lactobacillus buchneri
MAESFDKLTPDTKYLTTNAHINRSLDHSVLTNLYLPIIGEKALGLYNLLWSMSLNDHNQLVLHKHYEIQSMLNCKIDQLVAIRKQLEGVKLINTLVSQNKPDVLIYSLNLPLTAEQFLRTDILSIILLGKVGETTYKQIVDRLVLPLPDLGETTNISASLLDLFAVPQNLIKNIPGAVNDAKQTIVRSAANVSENSFEPDSRQFNFKLLLSMLENSYVDLNSVKAARDLILSENLLYGIDEIQMAKLIQKATNLSTNELNQSQLKAIITDNFSRHQAENVEKAASTAEITPSSAKFDTATNQLISISKKTAPVVFLEQIKKQKHGIVTSGEQRTLRELVNLRVLPNEVINILIYYLLVDENRSTLNKNLMSTIADDWSQHGIFDAEHAIDAIKNRTIDKQKKADQWAAKYKQRRVNVKETLPDWAKDDQPSSASQPTSQLTEAQKKQLKAQLDKLKKPGSR

SEQ ID NO: 5369 - protein, 319 aa, Lactobacillus buchneri
MEKVSDFVKKLMEDRQFKGGNVASGFQKIIEQIKNDPEIAKFLQDHQGELAPDAVDRSAAKLYEYVNVKNQIKAKKQSFAPGYLPQLVINDHLIDIAYSASPEVIEKQRSQSLARRIKTVSMPKDIKDARIAEFDGADPDNPDPNRYTALSMALDFIAQMKADKKTFHPGLYIYGPFGVGKTYLTGAIANELADNGIQTTMVHFPSFAVEMKSAITDNSVTEKIDVIKKSPVLMIDDIGADSMSSWVRDEVLGVILEYRMQQQLPTFFTSNFSMAQLEQEHLRINQKGDDEPLKAKRLMQRIRFLSREVEMTGKNRRPV

SEQ ID NO: 5370 - protein, 648 aa, Lactobacillus buchneri
MSQLSFEFPDGSVKQFDDGVTSEAIAKSIAVSLGKKAVAAKVDGKWVNNDEPLHKGGKIEIVTSDSDEGLSVLRATAAQILKMAIANDFDNIHFGESDADKDGFFVDTDKPDTQISVDQLSSLEDSMHKIIKQDLPIKVVFLSAADAAKVAGDDPYQKELVKANEVNGQVKFFQIGDFQSIAEGAVLPSTGKVKIFKLLSVAGAYWQGKSSNPMLQRIYATAFNKQKDLDADLEKRKEAHERDHRVIGNELDLFFVDPKVGAGLPYWMPNGATIRRTIERYIVDKEVANGYQHVYTPVLANLDLYKQSGHWDHYREDMFPPMDMGDGEELELRPMNCPSHIQIYNHHIRSYRELPLRIAELGMMHRYEKSGALSGLQRVREMTLNDGHTFVALDQIQEEFKNILNLMVEVYHDFDINDYTFRLSYRDPKNTEKYFDDDEMWTRAQTMLKGAMDEMGLDYVEAEGEAAFYGPKLDVQTKTALGNEETLSTIQLDFMLPERFDLHYIGEDGKQHRPVMIHRGLVSTMERFVAYLTEIYKGAFPTWLAPHQVKIIPVSQDKHLDYAKKINDQLRALKIRSSVDTRAEKMGYLIRDAQTHKIPYTLVVGDEEVSGNSVSVRKYGEQDTQSESVPDFIDEVSKDIASYSREED

SEQ ID NO: 5371 - protein, 156 aa, Lactobacillus buchneri
LIGANGDQLGVKTKSEALQLAEDADLDLVLVAPKAKPPVAKILDYGKYRFELQKKERESRKKQKVISVKEVRLSPTIDVNDFNTKLKNAKKFLAKGEKVRVSIRFKGRAITHKDIGRKVLDQMAAETADVATVTQRPKMDGRSMFLMLSPKDQDQK

SEQ ID NO: 5372 - protein, 65 aa, Lactobacillus buchneri
MPKQKTNRAAAKRFKRTANGGFKSANAYTSHRFHGKTKKQRRQLRGTSMMDKTNIKTYKKLLPHL

SEQ ID NO: 5373 - protein, 118 aa, Lactobacillus buchneri
MPRVKGGTVTHARRKRVLKLAKGYRGGKSRLFKTAKDQVMKSQVYAFRDRRNNKGNFRKLWIARINAAARLNDLSYSQFMHGLKLANIDMNRKMLADLAVSDTEAFKALTDEAKKALK

SEQ ID NO: 5374 - protein, 171 aa, Lactobacillus buchneri
MLSRFKPTWMIGDIYTISPQFLRDHNINCVLTDLDNTLVPWNSKKGSQALRNWLSENKKFGIKVIVVSNNSHKRIQRAVQDYELPFVPRAMKPLTIGIRHALKEFNLQKRNTVMIGDQLMTDVVAANSCGVRSILVKPLVRDDAWNTTINRYFEKIVWNKLSKKYPDLHWK

SEQ ID NO: 5375 - protein, 378 aa, Lactobacillus buchneri
MANSEVVVDGEVVHCVGCGAAVQTTDKNALGYTPESALKKGLENGEVYCQRCFRLRHYNEIAPVSLSDDDFLKLLTSISDTDSLIVYVVDIFDVNGSLIPGLHRFVGSNPVLLVGNKLDILPKALKHNKVKDWLRQQANAAGIRPIDVELISAKTNFDIDRLLDQIEKYRQGKDVYVVGVTNVGKSTLINSIVRQSTGIKELITTSRFPGTTLDRIDIPLNDGHNLVDTPGIIQPEQMAHHLSGKELNLVTPQKTIKPKGYQLNPGQTLFFAGVARFDYNSGDKRHGFTVYAENNLFIHRTKLENADEFYATHVGSFLTPPTEDQKADFPALEPHEFKSTEKSDLVIEGLGWVTVPEGVSVTGWAPKGVSVLMRPAMI

SEQ ID NO: 5376 - protein, 103 aa, Lactobacillus buchneri
MKLTGKQKRFLRANANRMRPIFEVGKNGLSPVWLEEIQKALDTRELIKINVLQNSAATVDDIKDYIETKSDVTVVQTIGKTLVLFKPSKDPNKQKLSNEVLAI

SEQ ID NO: 5377 - protein, 210 aa, Lactobacillus buchneri
MSNVMNHVETLTQTKTITKQNGKRIGILGGTFNPIHNGHLIIAEQVLDQLGLDKVYFMPDANPPHVDRKFAIDAKDRVAMINCAIRDNPKFAIEMTEIMRGGVSYSYDTMKQLTQQHPENQYYFIIGGDMVDYLPKWYRIDDLVKLVSFVGVKRDGYTPASKYPVIWVDVPFIDISSSLIRSKMRQHQSIKYLVPAAVEHYIKENHLYEK

SEQ ID NO: 5378 - protein, 203 aa, Lactobacillus buchneri
MKNDQLIYQGHFVPYTRDELVGKLRAALSDHRFQHCLRVEQTAMDLAEQNGVDIEKAAIGGLVHDYAKQRPDDDFIQAIKDYQLEPELLNYGNAIWHGVVGWLFVKNELQITDIDILNAVRYHTVGHQYMTPLEQIVYMADYIEPGRDFPGVDEARKITKNNLQDGVAYQTKQTLGYLVAHNKPVFPQTIVTYNSWVPSSGID

SEQ ID NO: 5379 - protein, 118 aa, Lactobacillus buchneri
MNSKEISEVVVRAADSKRANDIVVLDMQKVSLMADYFVIADAASSRQVKAIADEIVDQVEADDVNVYSVSGKDSARWILIDLGDVVVHIFQKDVRDFYNLEKLWSDAPIVNTDSWVEA

SEQ ID NO: 5380 - protein, 251 aa, Lactobacillus buchneri
MIYTEFAKFYDDLFDATLYDRWAHFVVNKTKGIQKPPSEIKILDLACGTGRLAIKLAQKGFQVTGADLSEDMLTIAEQRAREASVDVPFIQTDMRNLDGLDQYDLICCFDDSLNYLIDQNDLETTFKAVYDHLNSDGQFLFDVISPYQATEVYPGYMYNYRSEDAAFMWTSYEGDFAPMAVEHELNFFQYNEEKDAYDAYNEIHRERAYDDTVIKDLLSQTGFLVTLASTDFGDNPFVRETKRWFFSTGKD

SEQ ID NO: 5381 - protein, 378 aa, Lactobacillus buchneri
MLQAVGIVSEYNPFHNGHLYMLEQAKQATGADVTVAIMSGNWLQRGEPAAYDKWQRAHAALLGGVDLVIELPLFSAVQPSHLFSKGAVDLAAKIKCRWLAFGAEHPEMDYQKLIDHQPKNPADFKRFDRPYASVFQDYLFEKTGIRLNQPNDVLGFGYAKANVEAGRPLSLVPIKRKGSQHDATQIDDVSPIASATAIRQAVVKHDLKAADRVVPKGTMGMLEHDRMLTWQDFWPFLRFELVESPIEKLHQIYQMTEGIEYRLKRAAIKAESFTEFLHLVKTKRYTYTRIQRLCTYVLLHAVPSDMLQAAGYVRLLGFNAVGQRYLNQIKGDLDVPLITKITDDVVADTIQMDFRGGMLTQMINGLSQDYYRHPIIME

SEQ ID NO: 5382 - protein, 184 aa, Lactobacillus buchneri
LKWYFRDLQKYSDTDPFTFNENLQIKADLLDRYADEVIDASDFHVEGTAFADRGDVIIDSHIVGKLVVPSSRSLTPVDLPLDFTVEEFYVPSKAAESRYGKDDVVFVLDEDDMVDMQRAVVDNVILHIPMHVLSPEELAGKEMPSGDDWDVMSVDDYSKQKAELKTVDPRLAELKDFFKNRDSK

SEQ ID NO: 5383 - protein, 58 aa, Lactobacillus buchneri
MATPARRTSKARKRMRRGHIKLTTPNLSLDPKTGEYTMPHHVSPSGFYKGRKVIKDNK

SEQ ID NO: 5384 - protein, 338 aa, Lactobacillus buchneri
MKAAVVRDPVDGYVDIKDVTLRPIHQGEALVQVEYCGLCHTDLHVAEGDFGKVPGRIIGHEGVGKVIQVADDVTNLKIGDRVSIAWFYRGCGHCEYCITGRETLCRNVQNSGYTVDGAMAEQVIVPADYAVKVPEGLDPIEATSLTCAGVTMYKALKVGDTRPGQWVEVVGCGGLGNLAVQYAHNVFGAHVVAVDGNEQKLQAAKDNGADITINRHDPDVADQIQKKVGGVHNAQITAVTTEAFTTSVNALRPDGKLVAVALPKGDMALNIDKTVLDGIQVAGSLVGTRQDLAETFQFGAEGKVKPIVQTRRLDEVNDIIDEMKANKIVGRMVVDFTK

SEQ ID NO: 5385 - protein, 228 aa, Lactobacillus buchneri
MSRILIIEDEKNLARFVELELKHEGYDTQVELNGRTGLQAALDENFDVILLDLMLPELNGMEVARRLREKKNTPIIMMTARDSVIDRVSGFDHGADDYIVKPFAIEELLARIRALLRRIQIENDQQKNNKKSVTFKDLTIEKESRIVRRGDEVINLTKREYELLLTLMENVDVVLARDVLLTKVWGYDSEVETNVVDVYIRYLRNKIDRPGENSYIQTVRGTGYVMRS

SEQ ID NO: 5386 - protein, 540 aa, Lactobacillus buchneri
MNQPNTKPKRRKTSLKWKWAFFTSIGVLAIVVIFSCLIFNRFTNVLFQQERSHIDNTLSTVSSRLTNYASPLTKSDVGHYLKPKITDSNDQVTQADGNDLYSNSLIVNFSRDNILVNVYSVNGKELFESRKSTAKFYSASKRKIFTTRHNGHQILVGSEPLLSKKNGSLIGYAQVTDQLDNYRATANKLLVILIILVLISVLLTMIFAYILAQELLRPINDIQKTINEVKSDPDSDARVPAFRSNDELTDLAQLLNGMLDQTQRYIDQQQQFVEDVSHELRTPVAVIQGHIDMLLRWGKDDPEVLEESLKASLQETNRMKSLVSEMLDLSRAEQIEINYGEEITDVNQVFEQVYNDFKMIHPDFTFTFDDDTDHDVYVKIYRNHLEQVLVILLDNAIKYSTKRKEVHLSLSTSMAMVNIAVQDFGEGISEEDKQKVFNRFYRVDKARSRDKGGNGLGLSIAHRLIEAYHGNISIESSLGSGSIFQINLPILQHLPSEEEMEKKTSSTSKEQSEDSGLPEGILDTSKHDDRPLNDDEHHEK

SEQ ID NO: 5387 - protein, 622 aa, Lactobacillus buchneri
LFSFMNQISLLIILLAALVIPLAMARFKITFLPTAVVEIIVGILLGPSLFNWITNSETLEILQNVGVIFLLFLSGMEIDFSLFKKKPTTLSPLEKKSQHDQPKYSVLQVATIAYASIVGMSFVIAYLLQLSGLFTDIWLAAILFMTISLGIVIAGLKEKELLSKPFGQAILLIAALGEVVPMVGLTFYASAYSPHSKSLWLILLILVAAALLFWRFKAFFRFFDRINKSTTQLDIRLSFFIIVALVTVAESVGAEGILGAFLAGIVIKLLEPHEETKVRLDSIGYGFFIPIFFIMSGVNLNLKELITNPQTLVLIPVIFVGYVLAKSLVFSALKLRFKNLNAVAGTAMTATTITVVLAVLQVANHLHRITSQQSGAFLLSAVITCVFGPLIFNKLYSSEAEDLKKTSVHFIGTNLTTVPVAQQLAKGWYDVTMYTNNQHNYRAFNSETTIHLLDSLEPEVMIKNGVFDADVVVFGQINSEKNYELAKIAKQYGVRRVIVRFEDRNILDDRRDELDRLGVELYNTPDVNISMLRALIEAPSTMRLMTSTDSSVYEVALRNRLYADIQVRNIPFIDKVTITQIYRDKRFIRPTGGTSLKLNDRIIFTSSKAEAPEVRRELGKLN

SEQ ID NO: 5388 - protein, 343 aa, Lactobacillus buchneri
MKKFKHLTTLGLLSGMALLLSGCVRTTKSGKPYGAVYDYLARPAQAIMEWIAQFVGSYGWAIIVLTVVVRLFLLPIMVRQMKASTIQQEKMQLIRPQMAELQKRQKAASTPEEQTAASQAMMALYKQNGISMTGGIGCLPLLIQMPIFTALYAAIRYSPELSHTVFMGIRLGQSSWLLAVLSFASYLLQGYIAMLGTPAAQKKQMGAMMLLSPIMILVFTLSAPAGLGIYFFIGGLFACLQTLIINMYRPRIRKRIAKENEGKKAVTVEDLMPDPTPTASGTKSTGSDIHQRNRQRNTGKQQSGHQPQARPAAQPTKTTVDKQAEKPAAKRPRNAGKQQRHHK

SEQ ID NO: 5389 - protein, 94 aa, Lactobacillus buchneri
LNDKIQTVKMNASGRVQGVGFRWSTIQLAESLNISGWVKNEIDGSVSILASGESENLAQFIQKIKNSPTPFAKVKSLQVNYIAKRVNKGFNVKY

SEQ ID NO: 5390 - protein, 256 aa, Lactobacillus buchneri
MDIERITSNQNNRVKEWTKMQSKKGRVKSGEYVIEGWHIVDEAIRHRQTIKQLMVVDESYLGDLPVDDDTEIFLITPEIAKHISSTETPQGVFAVLNTEDYHEQIPDDLKGAWLLLDNIQDPGNIGTMVRTADAAGLNGIVFGKGSADLYNPKVVRSMQGSQFHMKLFTGDILEWMAAFKEAGVKTYGTELNDQAISYYDITPTKQFALIMGNEGNGVDPKILEKTDQNLYIPMNGEAESLNVAVATGILLFKFVK

SEQ ID NO: 5391 - protein, 168 aa, Lactobacillus buchneri
MQKDEWKNDSEYREIVSDLMATDMVKKLANYTQHHHSTRLEHSIAVSFDSYKIAKRRGLDYRAVARAGLLHDLFFYDWRTTKFDLGSHAFIHPRVALRNAERITKLSPMEKDIILKHMWGLTLARPKYEESVIVSLVDDYEAVHEFVSPLKSKFETLKKQVKRTTAVK

SEQ ID NO: 5392 - protein, 116 aa, Lactobacillus buchneri
MRQVVGLQDAINYYLCPKFEKTFSFLGKKWNGLIIDVLLQEGVLRFREIARQIPKCSDRVLVERLRELEDDGVVVRTEHDDSSLIEYSLTEQGKELAPIMHEIHTWSEKWYPSVEK

SEQ ID NO: 5393 - protein, 349 aa, Lactobacillus buchneri
MSLRDQLTEIKEKGLADIQQTNDLKALNEIRVHLLGKKGPITAALRGIKELTPEERPEVGSYANKIRDAITEAVSDHREKLEDAALNAQLAAEKIDVTMPGKPVAQGQPHVIQQIIDQIVDLFLGMGYEVLSGPEVEEDKYNFEMMNLPKNHPARDMQDTFYISKEILMRTQTSPMQARALEKHDFSKGPLKMISPGIVYRRDTDDPTHSHQFHQVEGLFIDEHVTMADLKGTLITMAQNIFGDKFDIRLRPSYFPFTEPSVEVDVTCFNCMGKGCDVCKHTGWIEVLGAGMVHPNVLDMAGVDSKKYGGFAFGVGPDRFAMLKYGVDDIRDFYLDDVRFLNQFSKRGN

SEQ ID NO: 5394 - protein, 803 aa, Lactobacillus buchneri
MKVSYKWLKQYLDLNMPAKDLAEKIERTAVEVDSVTVAEDGLKKLVVGHILSMTKHPESDHLHVCQVDVGEDEPLQIVCGAPNVDVDQKVIVALPNSRIGGNVKIKRSKMRGIESSGMICALDEIGFSKDVIPKEWADGIYVFDDDVPVGEPIYKYLGMDDPIIDLDVTPNRGDMLSILGTVHDLAAIYNQQPEIKKPVVDEDSSLDANQEIQAKADDQLAKTYKLRVVEGVKIAPSPSWLQIVLWNAGIRPINNVVDVTNYILLKYGQPLHSFDKDKINGNVNVRLAQKGEKLTTLDEDEHELSADDIVIADDDKPIALAGVMGGFNTQIDDNTSNVVIESAIFDSFKIRKTAQRHNLHSEASQRFERGINPDGVQDAVDEAVSMIKQLAGGKIAKGTVTASEYHPKLPTIYITAERTNHVLGTSLTTAEIKSIFDRLGFSSEAHDDGLNVTIPARRWDIFRDADLYEEVARIYGYDNLPATLPTGRQSIGVLTPIQKLQRASRTALEGLGLTQAISYSLTTAEKAKMFLMRDSQETKLLWPMTQDHAVLRMNMLSGLLDDVAYNHAHKVDDVALYESGRVFYKHSADQIRPEEVEHIAGVVTGNFTDPLWNNHVKPVDFFQLKGIVNQFLVNLGVKGDIEYTATDQYPEMHPGRTANISIHGHYVGFLGQIHPRIAKQFKIKETYGFELNMQELIDLPKDDNQYQAISKYPSIKRDISLVVDQDVTNSQILAVMNKRGGAFLNDVRLFDVYEGDNVPDGKKSMAYSLTYVDPRETLKDEVVNTAFEKIKKRLTADLNAEIR

SEQ ID NO: 5395 - protein, 373 aa, Lactobacillus buchneri
MTDDSSRRNPKPNKSLGRRIIISVITLLVILAATIGLMGYRYFQDALKPLNPQNTNVTQVHIPLGASNKQIGSILQNKKIVKSGMVFDYYVKSNNMANFRAGYYQLKPSMSLKTIAKRLQRGGTDQPIQSTKGKVLIREGANIDQIATQISVTTDFDRGDFLKLMKNQTYLEQLASRYPKLLNPAMKAKNVRYRLEGYLYPATYEVEKNTSLKSLVNQMVAKTNQMVSPHFAAIKKSGMNMQQFMTLSSLIEREGVNQTDRRKMAGVLLNRIDINMPLQSDVAVLYAIHRNNKVLTNKDLQSDSPYNLYKYTGFGPGPFDSPSISSMSAVLHPLDRSKNYLYFVANTKTKKVYYSKTYAEHQQQIAAHTSDNN

SEQ ID NO: 5396 - protein, 224 aa, Lactobacillus buchneri
MVNHKTRPVVIGITGGSGSGKTTVARKIFDQLSNYSITIIQQDSYYNDQADMKMADRKKVNYDHPMAFDFDLLIKQLKQLLQYEPIEKPVYDYGQFTRSQQTIHQEPREVIILEGILILDDKRLRDLMDIKVFVDTDDDIRLIRRIERDTKERGRSLDNIIHQYLMTVKPMYHQFVEPTKRYADLIVPEGGENQVAIDLLTTKMRSILMRRGNKEIKNNLDSTI

SEQ ID NO: 5397 - protein, 157 aa, Lactobacillus buchneri
MAEDTYPMTADGRDKLKAELEDLKVNQRPKVVERIKIARSYGDLSENSEYESAKDEQSMLESRITTIEHMLQYAQIIDSNDSDKDEVTVGKKVTFQELPDEDPETYQIVGAAEADPMSGKISNDSPIAKGLIGHRLNEEVNIPIPAGTMKVKITKVE

SEQ ID NO: 5398 - protein, 105 aa, Lactobacillus buchneri
MKIDVTDSASKWFQSEMGLSQGNGVRFYGKVYGKTPVHEGFSLALTRDDHPGETYTKTEKDGITYFVDEDDRWFFVGFDLKVDFNPEKDPENVVYTYTPNGDLDK

SEQ ID NO: 5399 - protein, 892 aa, Lactobacillus buchneri
MNSKKTTKISILVLCFLVPVLISTSYFIFRHFAPFGGSSVMTVDLGQQYIDFYTNFHDTLLHSPSGFFFSFSKALGGDMMGTWAYYLMSPLNLIMLLFPLSKLPSVLGIITIIKYGLAGLSFGYFLMKVTKHVGWSIIGFSASYAMMGWMVANQFNMLWTDVLFVLPMIFYGLFKILKNQSSAIYIISLTAMLIMNYYMSYMIAIFLTLFMFIYWAAKALPVENQTSTKAVLKWLKASILSGILAAWLLLPTFFSLLGSKTQYSKGQYKIKFEYNPLDMLGKFFNGSVNFNELPAGTANVFVASVVLILFVYYFFIPTIKRNVKIANISLTAFMILSMCFQPLDLFWHGMQLPVWYTFRFSYLFSFWMILTAFQAFLHILDEGINWKGYLVTAGIMALGVLYVELRWKHLEYMRHFDFLWGCVYLVVSLGIVVFLGIYRRNIVLAMTLAVLMSGEMALNMVTSLNHLDYLKASNYTQFERVMRKHVNKIKQKDKGFYRLGTTFSRTKNDAFTGNYNGGSIFSSTLESDTSQFFKNIGQPNGDSFVLYSNGTMFTDSLLNMKYYMSHQIPEANPNKKPKKQLLTTLTRKPDYNNYTLLSQDALIGTYRNPYAVPIGFLAPKSGMEHNSIAKSPITYQNQIAHRLDPNIKNLFEPATYTDMRYNNIQPISQLDNAVLKKKNLLEMSYIIFSVPIEKNTSYYMTLGTEINKGNISISVDGQAQTQFTPSEKTIIANIATGTSINTTANVQIFVNKNNALLQDVKLYKVHNSKIAQFSKDLNAKPYKVTKWNHHQLTGTVDVKSNNQALTTTIPFENGWTAKVDGKSVKPKRWAKMFLYIPINKGHHKVVFTYWPEGLRVGLLITAFGLAFIGTEATLKHRKKQKAKHTETPTNTK

SEQ ID NO: 5400 - protein, 377 aa, Lactobacillus buchneri
MPSIRKHGHGYQVRYYYYDANGQEHEKTKSGFRTKSAAKLFASQLEIDIHNGLDLVPKDPKFADYFDYFYHTYKEPKIENQTKNRYKITSRVLHNYFGDVTLKSIDRPQYQAFINFYGHSHAKDTVYKVNSLIRATVQNAILDDLIHKDFTQRVSLIYDKSRDKHVEYLNVAEIKRLIAYLENHLNYHFTSTFMILTAVLTGARLGEIQALTWNDVNFNFKTISITKSWNSSEGGGFKDTKTAGSNRIIAVNDELLKSLKILKDHNNGELIFVNQYKSIPSSSAVNKKLRSILKDLGIKKQGFHFHSLRHSHVAYLLSRGIDIYIISKRLGHADVSTTTKIYSYLMDEYKAKNDQQIREELDNLSSHDETIPIKRNL

SEQ ID NO: 5401 - protein, 574 aa, Lactobacillus buchneri
MKKSLKKTLFAGVAALSFVAVAGVSSTNASAKSYAKVTSNKALTTDATTRNVAVNGTNALYTKAGTLKGAKTVATKTTLASLKNSKQGQKNFRAYRVATTNRGSVYYKVVSFDKTYRGWIYGGKSTASFAGGIASFSTTTAPAAAANTSSSASSASINTQGQTTALTDAQKNATYKITKAGTANDGTATTYTYPAWTEYRKGRTVTDATPYANDTFKVTDQTTRTREGDLWVKIADTNATNGQKINGWIKYSALTAQATTPTTTPVADNAVRITFTDPSGQTIKSFDYTKTNAKKGDTLGTLTSTDNGTYTWTLDSSVQTSLQSQANEALQGTGYGFKLDNNISLLAQAKTGSEVKLPLAKGDTVYQKLSPVAYVNGSNATNNSKLTNYVGVKNLPSSYFAEKVPLDKANLFDLSQVTKNGVPLDVLKKQVADYVSWVNSTKHKGGTTTKSTDNRLNNINNAIATAAKNTYIAPANLAISDLFSGNTNASYTGTDVLNYLNKHNELKTLKSAVFPVFDKNGNISHFAQYTFTAQQALGGTFGQGATTVYYSYSTTPSQTSFPTASSSNTYSPFE

SEQ ID NO: 5402 - protein, 103 aa, Lactobacillus buchneri
MDTEELRDYLKENSNIENLFTSKCLQYLTEKNNQRSLDKRWPQERIDREAANMYYKFLVNIHDKISSNFKGLAKHDPNKWRHFISVNEMLDQLEESIVELDFE

SEQ ID NO: 5403 - protein, 254 aa, Lactobacillus buchneri
LTNKISTGDRLKQLMNERNIKQVDIIAKTKPLSERTGIKISKTDLSQYINNKSEPRQDKLYILAKALNVNEGWLMGFDVPRNREKVDKGNDILPIYDQLHPSRQEKVYNYASDQLNEQNNEKITSMFDHKPMIEIPAGRSTAAGSPINGEDQDTQLIHKLIAGEKVPAGADELVTVDGDSMEPLLKKGSQVFIHYQPEVENGEIAIVHIRDVGVTCKKFYVNEDNTVTLKSINKAYDDMVFDCDEVNVIGKVIL

SEQ ID NO: 5404 - protein, 74 aa, Lactobacillus buchneri
MIFDYSMLLGKIVSKYGTQYNFAIALGVSERTLSLKLNNKIPWTQKEIEHCIKLLDISRGDIPEYFFDLKVQFS

SEQ ID NO: 5405 - protein, 37 aa, Lactobacillus buchneri
MEKGKLHQYFDSNIQPILNMAIGVLFMTIGYLLGHMS

SEQ ID NO: 5406 - protein, 74 aa, Lactobacillus buchneri
VTNDEFDEKYAEFLNKFDDTFHDEENIERIREDVKNGNSNDDWTNKMFKFIQQYENERTNNLVRIGLKEFLIKD

SEQ ID NO: 5407 - protein, 66 aa, Lactobacillus buchneri
MAKPRLVLEKKAPEPRVSRLISINTDLYNQLMDIKHETGLTVTAVVNKFIAYGVKNVEIEDNKNDD

SEQ ID NO: 5408 - protein, 65 aa, Lactobacillus buchneri
MIDKNTSFELKQIDLLDQAKSTNISLILENGSILLSEIKKAQQLSAELGDVLNHIKHFNPEFRMK

SEQ ID NO: 5409 - protein, 66 aa, Lactobacillus buchneri
LKHDYIYFCHDNQGNNVPLATGSTSDLQLVLWLNRQEKETIIPKKWASKELFVRVNEENFIVKNRS

SEQ ID NO: 5410 - protein, 80 aa, Lactobacillus buchneri
MKLNQDCVRDIMLFIEKNVTFGMFLHLNDFIESSDLKKYDSKTIKYTLGKLASVSMSMIESISAQVISNIIKSQMIKNGF

SEQ ID NO: 5411 - protein, 108 aa, Lactobacillus buchneri
MSQVISAKVSIQIPDNFELINKEDYQKLKRESTFGRTWNLNDLRKWCGNKSPQWLKENFLENPKYSREMQALMDDRYLVHRGSKGSPWLFKATKMQQFLEDHWSEFNW

SEQ ID NO: 5412 - protein, 41 aa, Lactobacillus buchneri
MVLILPQWLDYVIFSAIGFWVGTEYMKYKANPKTFWKGWFD

SEQ ID NO: 5413 - protein, 64 aa, Lactobacillus buchneri
MNKLQKYSTSELIGELRKRKEAQLFHGGLYANTEIRGKYGQENMKLPNDYWILLISDFSPLNNS

SEQ ID NO: 5414 - protein, 70 aa, Lactobacillus buchneri
MDLYNWLMRFKDVSLPVGDVAREIRSDRSFPKGNLDWKHLKEYLKSIGFSDSKLEIVKNVFNYYLAEKSR

SEQ ID NO: 5415 - protein, 52 aa, Lactobacillus buchneri
MKTLTIQNRIKRLNMIIGRTPVENDHSLLAYFFVLDKEKQRLSEYILHHEVE

SEQ ID NO: 5416 - protein, 89 aa, Lactobacillus buchneri
MTKFWRAVGVMDSQILETGVSRADVMRKLSIKYPTYVVTGTDKDFMKKRKERVPIYPEPIRLICGRITKSKSKEIAEMKNSIDQRHYLH

SEQ ID NO: 5417 - protein, 285 aa, Lactobacillus buchneri
MSNELSLPEYTIDYQLPVITINNFDQLKTAVEAYANKYQGMAVTASTEKESKYSRAELRKLKQALDDKRKEIRKKYAEPYQRFAAQIKDLEMTLDSSINPIDAGLKELEEQQRQLRLKHVQSLIAEMAPNYHVEPGEVEIDPTWLNKTTTKKKVTEGIADVMGYVKKKHDDLEAGIKTITKYAQAYQIDPAGWIDQLKQGQDVNYLLQAIDNQVKLNKQKQQTLEAQAAEAQTHQIQQKDKTIDTNTGEIVSHSVSLKITATIPQMKLLRAFMDSNQIRYQRVGA

SEQ ID NO: 5418 - protein, 231 aa, Lactobacillus buchneri
MKTIEAKDLQRTLNWRVILYAKPGTGKTTCVKYLPGKTRIFDLDNSAKVLAGISNVTVDEMDRTHPEEDMKQYLEQASELIVGYDNLVIDNVSSFEKDWFVEKGKGSHNGISNELQDYSQWTNYFSRVMTAIYALPVNVLTTAWETQRQITTENGQQFNQYAPEIRQSVMDGMLGLCDVVGRLIINPKTNGRGVMLQGNDSIYAKNRLDNRTMCAAKDLFKFGSGNDDKTN

SEQ ID NO: 5419 - protein, 231 aa, Lactobacillus buchneri
MTKLIDITGKKFGRLTAVCIDNSQRPKGSTRAYWRFKCDCGNVTYASGIDVRKGKIQSCGCLHDELASKRFRKHGHSNTKLYFVWESMKQRCFNPNNKSFSDYGGRGVSICNQWKNSFCAFERWSIQNGYESGKSIDRIDVDGNYCPSNCRWTDWKTQANNRRKRNSPVTNRLRADNISGVRGVSFDKSKNKWVAKMMYRNRIILDRSFTSYEEAVKERHLAEIRCQKNAI

SEQ ID NO: 5420 - protein, 451 aa, Lactobacillus buchneri
MPFKLFDYQQRIVDETRQKIGQGNNGVLIVSPPGSGKSVIIAEIARLTVSKGGRILFFVHRQELVNQIVKSFQKQDVDLMNCTIMTVGKVANRLDHLPKPNLIICDESQHSRAKTYLKIFKYYSDVPRLGFSGSPWRMNGAGFDDIYSAMVKGPTVKWLIEHKKLSPYKYYSVTLFNDEKLKKSSTGDYTNQSVSDSAKPTLYGDIVKTWMDKAFGQRTIVYAHDTQHSKQIAAEFRKAGISAKHCDSKTPSDERKRIMSDFRKGKITVLCNFGLVDEGYDVKECTCCVIARPTESLVFDIQATMRCMRYLPNKMATIIDHAANYTRFGLPDTPRQWSLEGRPKKKRQNNTKSIPVKTCPNCFAVVPTQCRVCPQCGNEIKYDADGMEIDETASIEKVGEFKLTTDYSKIQTARKKPEDAQSYKELLEIAKARGYKAGWAYVQAKRLKMVN

SEQ ID NO: 5421 - protein, 197 aa, Lactobacillus buchneri
MAFIQANYKNNEHKDFSALPSGNYEMIIKSAQEKATKNGAESLQLDLVVRNDLDGVTGLKNTNAKYHNRHVFMDNWKRKTTNQYDLDSFQYILEAVQIPEGTPLNTINDFTKAVANKPAKVYVKKTVDDYGGEKKDINQIAPWNFSKSDYPQVQHVWKDQKDGKNPFAGNQPASAPTDNPFDNSGDSIDISDDDLPF

SEQ ID NO: 5422 - protein, 766 aa, Lactobacillus buchneri
VAYENIPNELRALKQWGLFQKIWQPERNKYTKIPHNALDGGAGRTNDPSTWTDYQTALKALQTYQMDGLAFYFANGYVGLDIDHIGDELEKYAAQDYQQNEVQDVLTMTKSYVEISLSGTGIHAIFKGKIPGDRRRKGNVEMYESGRFFALTGKTIGPYSDRINTPQPQVMKLIYKHYFGESNVIKLPNQAPIRPNDLSVDEIIKRAELSRTGKRFKMFMHGGWEGFYTSHSEADLAFSNDLAFWTGRDFNKMDEIFRKSSLMRPKYDEKHGKTTYGVSLLNKSINETRETFNPQQHPLHKYDLKFLKSKPKKKLPPRSWDDTGNADRFIDVFGNLVKYSYIDKSWYFYNGSYWEMDDQGKAAQFVDMTVDNMKNEKLHVAAGVDPEKAKVAWEKFLKKSRSHAAKQAMISEVQHRVPVLHGQFDQDKTLLNTVNGYIDLTSGILKDHDIKKMFSHQTSVEYTDKIDCPEWDEFLNQIFAGDQELIHYIQKAVGYSATGSIKEQVMFILYGNGRNGKSIFIDTISDILGTYAKSMQADSIMVRQNKSGANSDIARLESARLVTSSEPNEGVRLDEGLVKQLTGGDKVTARYLYGKEFEFKPQFKLWLATNHKPIIRGTDDGIWRRLMLIPFKVKIPDGQVDKNLKDKLKRESVGILNWIVEGCLLWQREGLNPPISVTRASRQYREEMDVISLFVDDCCEVGDSYRAPAGELFKKYQSWAKDNSEYSMSKQKFSREIKQKFEYKQSNGRFYLGLKIRDDPRLNWTK

SEQ ID NO: 5423 - protein, 129 aa, Lactobacillus buchneri
MDTTTKLSVHLSVHLSVIIIWRRIKIKSEHEIQTEILLALSRHDCTVCRSNAGKIKTDDGRRIMLFPRGWPDITGFEHHSGKMILIEVKNERGKLREDQKRFAKFIKQYPVLYGVCRSVDDALKIIGGK

SEQ ID NO: 5424 - protein, 137 aa, Lactobacillus buchneri
MTVKIVDKELFKMYQCAMAENISDWKRIAKFAKFIDKYADDETISNRDDLASVIDAILNHETVKLSAQMYRLKMNGMVGSNGQQYVSRRVDDRGGYFICGIRNPHVCRGEITQQFTRDEAEFLKDLLNNSSIQSVEG

SEQ ID NO: 5425 - protein, 63 aa, Lactobacillus buchneri
MTYVIKKQGKVHKLKEFRSIQAVLKAETGLPIKTWMVEESVQHHQNICGWTISEINAKKSVNN

SEQ ID NO: 5426 - protein, 298 aa, Lactobacillus buchneri
MGNENLVKAITESRNFENGINRIHYSIHCSRDDAFSLLIEQVLRRIHFWNYNNANTLIKAFSDHGNPDFKNKQWAITYAAKDVVEDYYGHKTLLVENFDKSDELGQLAPINCKSSVSVENSLVNKVISLFPTDKTKLFVKSLLKYGKIATMDIFSMTDKKFEHALYDRIAYVKSNAQMFTEQLSVFDHQDTLDKLKVLGDFEYYINKYADPMTLNSEVHALFISNSDLFNDIFDYATKVYGMKYQGVVWKSFGLINDHELKLDEYKLIDSIIDLQQELSKQFVPKEGQVSLYEATYLS

SEQ ID NO: 5427 - protein, 151 aa, Lactobacillus buchneri
MKLHICHEVGCQALIPMGQRYCSEHVTQHQKPNHAVSSARNREYNMYYRDQTANKFYHSKEWKKIRQFVAARDYYLDAVTGLPVSNDKIIVDHIVPRRVLPVDKWLDIDNLWCLSPTTHNTKTKIEQSLNQNQLKHCSKRWWIKVLSERTK

SEQ ID NO: 5428 - protein, 172 aa, Lactobacillus buchneri
MPKQMKLTTDKHARKDQRVRTQKLITETSGMDLIQKSCPKYLSSYARAMWTKLVPILQASGYVKQADKGTIEAFCINYQLLRKGYDSIKTDGVVTKVSKTVVNQRTGETYEDNAGWKRNPASQIIDSATAKLNSLAHELGLTPSARASLLQLSDDNDEEPNIKEMLNGGSEF

SEQ ID NO: 5429 - protein, 631 aa, Lactobacillus buchneri
VVQEFDFTQRNTNLDKIFQQLDGKGYFDEIKSKYRDPATVYCYRVLTGQQLACKTIKLAAFRHLNDLKRSTEGNFPYYYDLDKCRNICNFARMCPDVSQNKPIPLMIWQQAILCLSQGWRTKEDKQKRFERCMVSVARTNGKSYLLNILILYAYLVEASDQFNADLCYLAPVDKQSKKSWRYIKQTFNSLQEMPGFRKLIKDQNIAINDDVLKSTKTQNQILRMTAGSAQLDAFHFLFATVDEYGDENFNSDVISKVTSGQVQTSNRQTFFISTAYSNPKVPMYSDVRRLTKVMEKDSNRTEDSTLALIWQQDDQDEVENPETWVKSNPLLDLPAKHDTLLKGLISERDSKLEDGTLNDFINRNLNMWLQTAKDKYLKLEDIQKSVVSDFEIDNQDCYVGFDLSHASDDTAYSFVFPYLNGEQKKYFILQHSFVPLARADNSIIVKEKQDGINYSNAEKLGFCDISQNSYGLIDEDFVGRWFLDFVNDHHLRVKAFIYDPYQASAITDWLDNNMPEVPFITLKQGTVSLSSPTVFLRNQFIAGNIEMLADPILQTCLVNAVTVANPYGIKIDRTALTSKIDCADATIDAMSQALFYFENPNHGLKEDKKNPFNGMSNEEVNEFFTSDYFSF

SEQ ID NO: 5430 - protein, 54 aa, Lactobacillus buchneri
LNLKQLWAGLITNLSFILFLFGLIAFVVAASLINFIVGWVVAGIALIVLAYVIS

SEQ ID NO: 5431 - protein, 382 aa, Lactobacillus buchneri
MLNPFKNFMSKQTQTISTTGYSPFMLNGTLLSTNTVDADGALQNSDIYAVINRIAGDVASCEFKTDQYSNMLNQPSTLLSAYNFWQAVSAQMMLTGNAFVLIQRNGNGSPAGLTLIPFYQVSITLDNQQNVLYYTVNYGDDRGQVTYLAADILHFRLFVSGQVATELVGSSPLNSLAKEINIQNYSNQLSLSSLKNAIAPSYTITVPAAKLEPEAKENIRKSFENQNSGSNAGRPIVLDQSAQLDSLQINPDIAKLLNNATFSQTQIAKAFCVPDSYLNGQGDEQSSIEMIRSLYQNSLSLYIRPIESELSLKLGIDIKMDINSAIDVDHQQLISNITKLSTGQSPALTPQQAQTILKQAGVFPDLKVSAVEGGDDNDNSAN

SEQ ID NO: 5432 - protein, 233 aa, Lactobacillus buchneri
MTTVPIKGVVSSDDDAEVYQFFGYSTVTPSAVKDALSTANGQNIVAEINSPGGDVFAGSEIYTALKNYTGNVEVDIVGLAASAASVIAMAGDTIKISPTAQLMIHRASTVSQGNADDLSSDLQGLNSTDQSIANVYVQRTGLEPQAVMQMMNKETYINAKDAVEQGFADEIMFDDQPAKVTNMLSPVMLSNQAISKIKSLLTKVKEKPKETNSQTSDQLRSHKLAILFKKEGN

SEQ ID NO: 5433 - protein, 413 aa, Lactobacillus buchneri
MDLNKLHDAWLEAGQKVTDLQEKRNQMAVELNDSPEKYSDEDLTKIADSIDKAKKTRDFAKGAYDDALATAKLVKPDKPAAGGQKDVTPKDKPKFINIVKGALKGDPKFLNLMSSGLDANGNGVGLTIPEDVQTAINTLKQTFTSLEPLVTVEGVSAPSGSRVIEPRQSVTPFANLDDETAQIGNNDEPASFKPLTYKIHRYAGISSITNTLMNDSDANLLAYLENWIAKKDVITRNSEILKALAKLPSAQKTTVDSFDAIKDIYNKELDPLIWNESAFITNQSGFAVLDKVKDNNGQYVIQPNPLNPSQKMLAGKTITVIADAFLPNDGNSFPLYIGALTEAVRLFDLQQMSLLATNIGAGSFENDLTKIRAIDRFDVELWDTESVIYAPFTGLADLTPAAKTSGTTSSTGK

SEQ ID NO: 5434 - protein, 96 aa, Lactobacillus buchneri
VTVNPTELMDELHIDQSPTELTTVTNLINEATEIVNHSVSSSETQYQASSIYDLAIKTLATQLYYDRELSRGMSAGLLMMLDQLQGMVSGSDPDGT

SEQ ID NO: 5435 - protein, 120 aa, Lactobacillus buchneri
MALNKFSPEQFNRQAQFGMALPTINPNTGASGTQFKPQFVLWCMPYTRTNTQNVSLLGTDFEDTIQIVIRHNPLIDKGLLVQYQDQLYQIVNLSLDDSNKIVTYDILTLQINERVGKKHG

SEQ ID NO: 5436 - protein, 132 aa, Lactobacillus buchneri
MVSMAEQLDDYLAKIKRLVPNRAERTIITKAGADVLQKKLADETKRLHYSNRIATGNDPHLADSVLVSSKNIDGDVDGTATVGWVKKKAVIARWLNDGTVYIVGDHFVEKTREETRSDILKSEYIKWKELGH

SEQ ID NO: 5437 - protein, 129 aa, Lactobacillus buchneri
MELPVMTVYQLIQSLHYGWIDQLYSMNIPPGADTSGKQTIVLITSITEPLGGYRNDQFSNMQANIQVQIFWKKDTQENTFNEEVALMNNLENQDWLVSSHEPNTVDPDTDQITATFSVSKTITMKKEGF

SEQ ID NO: 5438 - protein, 228 aa, Lactobacillus buchneri
MSTHGIKDVTFGLVDATGKLLTGDAGVGTNGIYLVDGDAKGATTATVSGLEAAGTVAYANDEAKRVSNGQAQPEVALEFLDIDFDELQKLKGYIQDAANGGWTRQLPKPHVAMLLHFRSYTNIDMYEGFANGQLIETGSSHATDNNAETDANTALTYQALTPADNTIFNGEPYKIWMSQDAGFDKAKMLAEVFGGYSATTGSSTTGSTTGSTTGSATGSTTGGTTPGK

SEQ ID NO: 5439 - protein, 125 aa, Lactobacillus buchneri
MKINITKLGLRKKSAEVKTTVGVVEKAQNLQIQLLKSDSIDFTNDDPLAVLETQKKMVQGLLQFMIDIFKLSDKEVEKIKSTLDFTDFQNFMAYVLFRFQGMSDEDWETVTKQQTEESADPKENN

SEQ ID NO: 5440 - protein, 1858 aa, Lactobacillus buchneri
MATINDVMSTSIRLDAVQPTQSLKTLTNYIKANTNAWRSQEVALKSSGDKLDALKTRYQGISEEIKGYNLKIDELKRRQSGLDQTTNQGSEKYAKYANQIAKAQEKIAGLNDQQSKAEKQFEYLNSGLSGLQRNYHNLNQVTNSYVDALKAQGKINQAGQVKLKGLKEGLNSLSDQYRLQNNELSKNSQVYKQAQLAYEKQQNVVNRLANDTHKNADEYAQEKEKLNQLKGSLDIANEAFNTQQVRVNKTAASLANVRSDVVKYDLQVGHMSDAMARMGDKANVAKNKIKNSFGSIKGSLLGASVAMGTLGAAAFSGAKKATELQNVYKVNQNLLVTGGDKTKTAIKTVTEMQKDGTKYALKYGVSQKEIADQYQDLIKRGHTGAESLAVMKTELQASVASGDDFKDVVKVSSQAIEAFGMKTNNTAKMMHNTKRVVNALAYSADMTATDFHSLGKGMEYVGDSAHNAGFSIEQTSAALGELSNHGLEADKAGTGLRKIITSLAAPTNSAMGALNDIGIKSTKIFQTANGNFKTLPAIFKIIEEHTKKLGGADTARIFKTIFGQTGMQAAQILARYNGQLADLTNNVSKASKAGTYVQKLANKNAQTAQMSQKRFKQAWDQLSIMFGSKLLPYMTKAANQMTKLFGEKGFQKDIGKTATLTAHVAGGIANIGIFAVKHYEGVKRFGEALTAIWAVGKVYKYFKIFSDLTSVFSGQKLKVNRLTSAYDDQTLAIERNTKAKEANVDAGNETSKVDDIADNAGGEGKVAEGAEKDGKMAIHDIDDTSKVAEDTGKIGRFAKLAEKFRGVSKFGKVAAGSVGVLDVLNSATDLIGMKKKTAGSHIGAATGSLGGTAAGAAIGTAIFPGIGTAVGAGLGGLVGEGVGRKFGKAIQKGLSAQKIHVPKLSAKSSFKKLSDEATSYYKNREAQDKKNLQLLYKNGDITKKEYEKRLQIIKDEGSKANRLTLMSQKDQQAIAKYYAQSRQRLTKSWNEKILKAENKYGKGSVQVEKLQEEKKESLEKQHLKFATKVTAKEAELHTTLAGQIKLSTNKIAKDYKTLTEKSKKYSKEKMIKLVANADEEQKSVSKKANDEYHSVYNSAWKKYKNTVKAADEEYKGNSSAAKAQRQKIIEEARKQRIGVINHAAKQKNDSITKAKQQSDKVYDYAHNQNQKVTAQAVSQYENIKKNNSKTKDNYSLSWHGIWKSVGNWIGKLVNGMNKNAISAQNKVFKQYGGSQTLDQIPTVAWATGTGLLKNGLLTKPVLAKLNDGHDSPETHNKEIIVHADGQLEPVEGKDTHRFLEAGSGVLNATESKMLMALNGMQHFASGTGLFGGIGKFFKGIWGSLKQKLSALSHIAKHSDATFKQVFQPNFGDIKGTVGKNFANMFGKRDKQQGSVWWDTAWNMLHGMVSEGGGQTDSAFLNEAKKLANRAHHRYSEGSNVRLGPNYYDCSGLVYETLKHMGITVPGGSTTVPEYKYSKPVSWKNAKTGDLAFFGAGGSQHVGIVVDNSGSGHMFSAENPKDGIKYSTIKGFGDFVGIRRVPGLIDKVKKSTKSHKQSSGLQALVKSQLKHSGVWSWVSKNLKPLWQKLFGSLSSFGLSGDVAARAKTLAKALKKLDPRATKAGIAAILGNWEFESGLNPNARDSSGGASGLGQWLGGRLNHLKSYAQRHGENWRNAATQLKFALSDDSSDSSVFKRILEGHGSIASLASQFSEDWERGGYTGQHVNGAKKVANYLGYANGGLVDQEQLIKVAERNKPETIIPWDINKRGRAYELLADTMAHFKQTDQHTNQSSNSDGQAVKRLEAKFDTMIKLMSQLVDGQNNPIPAVVTDKQIVQAVNKHNKRTTAKNNWGRGVTFG

SEQ ID NO: 5441 - protein, 409 aa, Lactobacillus buchneri
LANNDNYDVNTFDFAFDEDGNGGFNSEDDLGIFLNHVSKPLAPNITESFQDVPKRYGGVYLGTDYGEKEFDIPITCFCTTRDEYNERIKTLTNVLVNTSSDADTEYPLRFNDDPDVTYYGHFTSIPTPTFINEGVQDFQTTLVFMLADPRGFLPQKEIKITDNDQQIIPEGNTEVDPIIHIIPKTDLYYVGYETNDDYVAVGYNVDDGDTTTDSDGNVTVMGQSQTQQVDDPCNSLATWIQCSENTQAFPIYKGEIDGSSAATGTSIMVAKDKDDHYEWGTRGKHKNFYGPAVMHNGLPKITPYWKVSVRLHHVKRMKNERAMGKIEAYLLDNNGNVCGRMGIEDYSMGRYPRAFIQLGNNFDSSNSDSYLTLLFDEGNGQQKQNEATKHVKVAYTKTVTVKKTTKKKK

SEQ ID NO: 5442 - protein, 249 aa, Lactobacillus buchneri
MNLQFFARRKRKTRRKTKTKKKRVVKSKKGGKKSSSKGGKKTSAPKATTKKKKEKEYVTETSYMNKDAYSNFYGEFILERQKKSDSSGNVYDNWVAEINQWDPKTGEPYSVNNTSKTHMHKEKLDKSGKFGFALANLGVFFGKHDIKEDLVNPVVAYKSDYEALTNYEEWRSDGSTDPDDTPHIIAKAGQEIIIDTANNKVTIDGKPADKYVSWLSTFPKLTGGVPQTLHFFPDPKNADVTIEYRPAIK

SEQ ID NO: 5443 - protein, 860 aa, Lactobacillus buchneri
LYIILDKNLKRVATLSTNSDANPFWGEVVERQIADDNSNSDDGITGVSTFNSTDPNANSKSWNDTLTGLTMLQSAPAAQYLTVGNSVAVYDDVHNHWRIYRIYQVDENIDATSGAHLVTVDAINLAIYKLNKTIPPQKEIKDCKLDQAMQWIMADTGWDLQNNCSSGLFADINFDGTSSSQAALQTVLSTYDAEADAYCHIDANGIVTDLILELADQLGEDEGKSITYGQNMLSVQRETVDTNLVTKLYIVGANNASIASVNNGKNYITDVSANSLYNTDQNTWLEGTITSDTITEPKALLDWGLRELRLYNHPRINYAVEVTQDFQANLGDTIKVIDLSMNPILTTEARVIQQTTSESDPSQNKVVLGEFSTVKVITPAFIRNMEQRWNDHVKKLFEEARENANAATVSLITPLGSTWYNTDTSKRVIARLFIEGENVTSYLSPQAFNWQKINMDGTRDIGWEADHAKDGYQVTIEPPFVGTLLVTIDDTYVKDEAEMWIDTSNSADGSWNKLWETKDAANKDFNGDQHIGALQFSYLLSDGLVLSSYHYTKDKSHSDCEFIKWNADGTLQSMMFVTGGGHCGSFGYDESSNTIYTEIKDPIDGKYYLVTMTYQANTSASNITKWCQVKQYFRVNVDLKNNLWLGSTTSGKVYVCQISDLQAGNFNPIIEFNLQDFGWKPLPAGTINNGTYNTLQANGISYPFAFFTAGDTNNADDKHVMCINLITQSMVFDYVVEPMQDIKLTVPLENGGHLEPEGIYEDVNNSRLIVGFNVSEYRDAAHTVSIAHSALYTAPLGIRDDSKDLVVEYPEQDEGENDEVEQPVIAGNDNADDSDDSSDSDEDGDESTGEGTKIEDGDSN

SEQ ID NO: 5444 - protein, 277 aa, Lactobacillus buchneri
LIIATGTLNIDENAKLAQQASDDAKNAANSAADEAGKIKTSLDGKITVSSQEPFDDGKSHDEGDIWYVQDSNHITSEMYTYDGSDWVKTKMSQTALSVGQLSALSADLGTIEAGYLNSVEIDSSIIKAAKIDATSTITGASIEEDGNNGRITLDTNGFCAISNGKYLQFVSGNSNGYTQIRGGLDVDSINVGSSIIEGQTFQAYGGNNTHIGSENAWTYLAEGIKCGPGGYISSVSGTDIYFHNEAGTTIDLHAGDVISHGTNLLSEINKIENKLKM

SEQ ID NO: 5445 - protein, 46 aa, Lactobacillus buchneri
MSNINAQDLIDQLVNEYSQDMAAKNQQIALLKIENNQLRKKVKTNE

SEQ ID NO: 5446 - protein, 702 aa, Lactobacillus buchneri
MSKELAFTDDNDVVKYLDTTTAFNLALTADGVAFDLTNAKSILVKIANDDGYIMQEAIDLTTVTSPLGGTLSFPINQNIMNTLVPDDYDIEVWVTMNDGTQAIFPSDGTLGFSIEENLMSDTGEVIPTITLNDFQQQFDDLSSQMENAVHNVQKGDQGNPGNGIKAANNQYQLSDSPVTVPTGGWSDTILATTDQLPYLWTKIIFTYDDGTTKETNFVSSRGDTGSQGPIGPVGPQGKQGNGLVVRGKADKEENLPTTGNNQGDGYLVGTDLYIWIDDSWQNMGSITPDLADYVKVADMNNALNTKVNVADMRKPASDVAGIEEVSAKQDKIGYTPADDSKVVHNSGAEEIGGPKTFDIAPIDKATGNPYITKDGVPTNYAKDNNDGTITANGTIFNLLKSLSASSIPQDPTKDYNTLPQGLALMSEVNGEPANMPPVKSTYLTLTIASSFATGRKRQLAWLDAGANSSNNNYTYIRYCVGSTWSSWDSIPTSTQISSLIPSTIADTTKPANFTDGLQKGGKDVATTTDVTSAVNSATSNVVTTDKLANFTAGLQSGGVSVATSDDLKSVENSAWRQLSMPDCNGMGGITLLYRNFISDHYMNLYAYGTAINSNTKGPTMLDLSSLIDNIESVSGVARDLESDGYHIFSSSSSGRSGSVDLVSSGNKLTLDANIMITMSSFMLIIGDDSPFAKVKYDNWIGS

SEQ ID NO: 5447 - protein, 136 aa, Lactobacillus buchneri
MFIYVTFDSNGFVTDYKKVETDGYTKVFVLDSWINQFAQYPDKFRYDSTTQKLLNPGNLPSVSLDQVSTDVTTLQTQLKSLQSTGTQTDSQLGTLVSNISVVQGQILGELQNIQTQLNASEKATAVPAANTTNSPA

SEQ ID NO: 5448 - protein, 58 aa, Lactobacillus buchneri
MFNIDWHGMLKIEYDNGWLSYDKLKLFVGWNELTKDQFTDITGKNYDTGSVAQVTSSS

SEQ ID NO: 5449 - protein, 155 aa, Lactobacillus buchneri
MYTQILNILNSFKATGLVAFLIAVIPATYKLVKPLIEAKIKTEKNTHIKQGMELGLKLANAFVPVVASMPALSNSDRKEAVNQSIDSNLKNSGFNFKAETIEGLAEQAYQYYKHTLKGDNHKAPVTPAPTNDVTSDVPVDDDPEVFNEPQSAQQK

SEQ ID NO: 5450 - protein, 274 aa, Lactobacillus buchneri
MTKKVADLSAYQGSSETYMKSLKSHGIDTTVVKLTEGTGYINPKAREQVANGFKVFGTVSVYHFFHGHGSSEAKYFLAWVKEFGLDKSTVLALDVEAQDLPWKTTAEVNVFLKQLKANGFSHVITYGSGSWFIEKRIDRTELIDKHIWVAAYGVNQPGIDNANAWQYTDNYEGLSVDASLDFDGSLSGSGIVIKTAKPEYYQTPGLYEATQSVIHQFNDAEFKSKRHTRLIKGSRFYATPIKYGKIYRLSTPTGYYTANKDKVRFIFAVKAGGK

SEQ ID NO: 5451 - protein, 83 aa, Lactobacillus buchneri
MTEIPDEINMTEMLIGIKEDISSIKQQLSDQADLNEKADKALAKSIENEHRIDNLTHINYALISLVAAGILVPLIIYLIEKFM

SEQ ID NO: 5452 - protein, 254 aa, Lactobacillus buchneri
MRWQISFKDKDDTVSLIPFDKRDALYTQTAIEDVLNPKAFIKALTDTAAKFNISFKKISLSSDGLVSHLYDAESKELSAISYNGTDLQDVIKKMHEFINKHKGAIAWKYNEIYKSMTLNNKKDLVKTALKKAFNGDDTLFNIANTSNTKKDPSSNNNDYKKVTIKDIYSSMSFTILDYKDKYVIPKGMMIAKVRSNSVPNRLSLLLDEYQKENKIINYKLKESIIWDNKDLRDIAMFLVGRLIHKQSIDKYIQN

SEQ ID NO: 5453 - protein, 124 aa, Lactobacillus buchneri
MSLINNPNKKDPLDRGHEITPEKEFTLDDLTETKKKETQEKTLSSKNNVSSVTFYANIRINNHIKNIAEAIAINGYSKSQKDSIEKALNYFLDSFSKDERRGIETSIETLEQRDVFQKHKKLSN

SEQ ID NO: 5454 - protein, 269 aa, Lactobacillus buchneri
MTTVLTFSNFKGGTGKTTNSTMTGIELARRGYKTLLIDLDPQANATNLYLKTKENKTGDLVTFKETLMAGIKSQNIKATIINIVDNLDVLPSSADFALYPRYMETVKKDYSERVKYLSQMISEWKGEYDYILIDVPPTISLITDSALYATDYAVIVLQTQERSLQGAEAFIRYLQDTLINQFHAPTLDVAGILPVLLKNGAPVDLSTLSKAETMFGKENMFKTTIKNMERLKRYDVTGVTFKDQFDRAVQEVYKNVVDELLSRISEESL

SEQ ID NO: 5455 - protein, 99 aa, Lactobacillus buchneri
MEFLIAAAIVIAILYFLGHFLLTIWGLVLCLLTLALLTWGLLKFFADDLGYQIILSLLILALLGLSFVLPNGQGTINLNHYQYTRISRQGHLCPPRLRE

SEQ ID NO: 5456 - protein, 264 aa, Lactobacillus buchneri
LDEYKLYPAGDCAINVTFSNRVDPQINRSIQQLQENLRSMQQTGITGFVPAFRTLTVFYDPILVTFEQLKRVIHQASLKASTLQTQAIRIVHIPVCYGKDFGPDLKNVANHAKLTPREVVKRHCQPNYLIYMLGFLPGFVYLGGLDPQLATPRLATPRLKIEPGAVGIAGEQTGIYPIESPGGWQIIGQTPLRLFQPDQDEPFYYHAGDYIHFDPVSDFEYQQIKKMVDEGHYQVYIETRKVTEDGDSSDTAGITDDGSGSGKN

SEQ ID NO: 5457 - protein, 333 aa, Lactobacillus buchneri
MGIRVTQPGLLTTVQDLGRTKGLAQGFSPSGVMDQWSAIQGNLLVNNVENEAVLEYSILGPTVTFSTPAVIAVTGGVVNAKLNGTQIHENQAIEVNSEDVLEIGPLTQGRYGYLAVSGGLQVDSILASKATSLRYGLGGFKGRALKTGDFLATVEPKPVIAEPEKRKIAVSSHDTDQTVLIRVTEGPQFAQFEAETITAFTNQQFKISKNADRMGLRLEGQPLSVANVPEMLSEATVAGGIQVPKNGQPIVLMADRQTTGGYPVIGVVASVDLPTIAQLVPGQVVRFKMISLTQSQQALADQKAQLKQIKQTFDALNPKVSRKTATKISRLFR

SEQ ID NO: 5458 - protein, 138 aa, Lactobacillus buchneri
MNLDEIKAVMALMKQNDVTEFEYENDEQRYKLKRGSTQGVPTTQLVAPVEEAVAPVADEPTTINAPMVGIFYEAPSPDEKAFVKVGDQVEKGQTIGVIEAMKMMHDVVADHAGKITKVLVANEENVEFDQPLFEIEID

SEQ ID NO: 5459 - protein, 441 aa, Lactobacillus buchneri
MHKILIANRGEIAVRIIRACHEIGLRTVAVYSTVDRDALHVKMADQAVCIGPANPQASYLNQTNIIEAARRTGADAIHPGYGFLSENAEFAKLCETQGITFIGPHSETIALLGDKARAREVMQNADVPVIPGSAEGFTELGTALYQANEIGYPVMLKAAAGGGGKGMRLIHSEAQLKHEFTMAQGEAQKAFGNPEMYLEKFIVRPRHIEVQILADSFGNAVSLGERDCSLQRYHQKVMEEAPSAIDHKTRYEMLSTARRAAKTLNFLGAGTIEFLYAGPSQFYFMEMNTRIQVEHPITEFITGVDLVRGQLRIAAGMALGISQEKVTLNGYALECRITATVPGTIKGLHLPGGNGVRVDTALYQGYQVPANYDALLAKIITYAPTREIAVKKMQVAIDETVIEGVGTNLDFLYRLLNNQDVLDNKFDIEFIDRLIKEDAHD

SEQ ID NO: 5460 - protein, 262 aa, Lactobacillus buchneri
MTEFITPKQIRQQSRTGAFTGQTSGMCPGYTQANLVILPKKEAYDFLLFAQRNPKPCPILEVADAGSKRLQTFAQDVDLATDFPKYRVYQNGELVSEPTDVTDIWRGDLVSFLIGCSFSFEAALIAAGIEMRHITMKRNVPMYKTNIKAKSAGQFHGNYVVSMRPIPEEQVVKAITITERLPQVHGTPIQIGDSERIGIQNLDQPDFGDAVEIYPGEVPVFWACGVTPQAVVMESKPEFVITHAPGHMLVTDIRDNQLADIL

SEQ ID NO: 5461 - protein, 249 aa, Lactobacillus buchneri
MAKIDLNCDLGESFGRYKLGLDEDVLPYITSANIACGFHAGDPEVMAQTVTLATKDHVALGAHPGLHDLEGFGRRRMQISALAAKADVQYQVGALQAFTPDGKLHHVKPHGALYNMAAANHELARAICEGIYAVDPTLILVGLANSELISAAQEIGLPYAQEVFADRQYEPDGSLVSRTKPNAVITDEDVAVKRVIQMVEEHQIKAVDGSILTIHPDTVCVHGDGIKAVAFVKKIHSALDQEGIEVKSM

SEQ ID NO: 5462 - protein, 399 aa, Lactobacillus buchneri
MEKKTKKRSPFNVAMGAAFMMAMAAVGPGFLTQTATFTSKMGADFGFAILICILVDIVVQLNIWRIIIVSGRHAQVLANEVVPGLGYVLSALIVIGGFFFNIGNIGGAGLGLNVLFGISPENGALIAAAVAIVLFLVRNAMLVVDRTVQLLAVVKVLILIYILAVTTVPLQSAVHHTFMPTSIDFYSIVTIVGGTVGGYISFSGGHRLLEGGVRGINNIKYVNEGALTGIGVASVIRVMLFLAGLAVVLAGHQLDPTNPAATIFKVAAGNFGYKFFGLLLFAAGMTSTLGSTFTSISFLDYNVNKEGHESWRPWIIVGFIALSTMIFYFIGSPAKVLVIVGALNGLILPIALAILLIAATRHKIMGAQYRHPRWLLVTGWIVVLFMAYAGIRTLLTIQF

SEQ ID NO: 5463 - protein, 225 aa, Lactobacillus buchneri
MNESAKLLPQKYMEGDKVHVLGIDVSRGKSNCALLHDHTVIKEFQIIHNKSGLAKLKSIITSDLPVMAVFETTGIYSRVLTRFFSEEGMNYLEINPLESSIRMAGLRRQKTDRSDAVKLALLGIDQKSLIHGRRPYSRPYEQLHLMAHRYLEITKERSRIINHLHAALDQTFPELNDIFNPIRSVLGLTFVSLFPHPDFLTGYIPGTMAKQIIGLVSPKIGFNRT

SEQ ID NO: 5464 - protein, 131 aa, Lactobacillus buchneri
LRVFLGRERYQLPLLLGFTGKIARFPSYKQLNAYVGIDLRRTQSGGLKEADRINRRGQSSARYIMFEMIRSMLRNKARIDNHIVDYYYKLKKGPHPKPDMVAMIACVNRLDRTIMNLVRTNQIYNYARTSH

SEQ ID NO: 5465 - protein, 146 aa, Lactobacillus buchneri
LKSAENLDEKQLFYDRHLRKQLTQLERVEEGLAVSPELKASYESMQNIMKSLKDHDKDGIVDYLYNTQNLSRQMKEIFRTFKKNLEVILNASETGYSNGPVEGMNRMIKPIQRTAFGFRNYHHMISRIKLRQMKTKPDKKTELKVA

SEQ ID NO: 5466 - protein, 93 aa, Lactobacillus buchneri
MAVKEKKRVQVQIDKELADNTEAVLSQLGLNPTTAINMFYKRIVANGALPFNVSLSEEERANLRFLKATKETPVTEFKDAKEVADWLNDPDED

SEQ ID NO: 5467 - protein, 367 aa, Lactobacillus buchneri
MDQTNFKFYQADNVYGALFFQFPKVLMYGEKYKHLSSDAKLAYMVLKDRLEYSLRNNWVDEDGNIYFVYTNAELMELFNSSEKTVIKIKKELEGLNLLRQKRMGFQPKAGKQLPNRLYLASLDVQATDVYLRGEQSETPETLAGRRTVNSTVQHDTVETLAGRRTVNSTVQHDTVEKDAQTLAGRRTVNSTVNLDKEPRSLDTNRYNIDTQKLDFSTAHFSPAELETQNRDLVTHANDFLTDEVSGFPIFLEPEAVQLLSFWCRTPQQMRRFIGIILNAKYRVEKDHKDIGVLIPLDDEELKPLMTKALRRYFNALRSNEKHIKNVENYLYGTMQNLFGVWWNKQAARKYAAKHPEEQNPDDEPSWY

SEQ ID NO: 5468 - protein, 269 aa, Lactobacillus buchneri
MTQVITFGNFKGGVGKTSNSTMVALELSNRDFKTLLVDLDPQGNATNLYLKTKLNISNEVGHFDKTLMSSVEDGNLDSSIINIKDNLDLLASAPDFSLYPRYMEKLHNYNDRVKEFDRLLTPLKAKYDYVIIDIPPTISLITDSALYASDYCLIVMQTHEHSFEGAEAFIKYIQEEVIDEYQAPRLELVGILAVLLQAGAPVDEATVANAISEFGEENLFKTRIHSMQRLKRYGITGITFKSKFDKRVFAVYKDVTDELLQRIEVIEHG

SEQ ID NO: 5469 - protein, 111 aa, Lactobacillus buchneri
MANSLIRSNRNKANAIPKPAKQAKASDFDKTASDSKAVSSVTFDTNLKISNHTRNKLQAMAMIGYAENQRLSVDTAIQSFYEQLSTNEQREFDLQVSTLETRDVKLKSRNN

SEQ ID NO: 5470 - protein, 38 aa, Lactobacillus buchneri
MSYSEAMAKHYYLNIFYPVWVYFFTLCCISIVNSPLKE

SEQ ID NO: 5471 - protein, 292 aa, Lactobacillus buchneri
MKIKFDIAKQNTPKAIRLLSAQRNLYSQAKFIELFSFLSTLVPIILILFIGNGICIQFVTTIATVISLLLTQWSKDEIKSAARIQEKFDTLIFGLYWNEILVGREPSPEIINKFSKKKDQSILKNWYPNPNLDSDELNIIICQRNNVVWNIHLHKACKNVIAFLLLLFLGFITAGIFFKDYMWVHAMDTAIVTIIPIVIKLVNYWISFKALLGGETQLINKIDDVIHSVDENRYSISVEDLRSIQDFIFINIRSATVLVPNWIYFVTKKNREEAMESSTKSIADNLKKHSEH

SEQ ID NO: 5472 - protein, 298 aa, Lactobacillus buchneri
VIISFQVSDLSQKSEENLELYSSSEFSLKMGSFARKTQIRPLDDVDQMIIFSAKGSTANLDTSQWNQVFINVPDSAPELKKMDGEYGLSSIKVLNYLKQLLNGISQYQSADIKRSKQALRLELSSYDWGFDIVPGFRTVDDGQGYYYYIIPNGEGAWEKTDPRIDRQNLTEYQKKATIDLREVVRILKYWRKAHNAVCKLNSYALETTVLDFIDTNPIYSNSREFIENFLLYLSKAVFGSVQDRKGFQGDLNSLDFAARLEIQKKAIYYHDLIKEANNYETVSMSEQAIKSWITFFGN

SEQ ID NO: 5473 - protein, 72 aa, Lactobacillus buchneri
MAKQKFSFCPYCGAKLKPDDVVCLNCGKKLPVDDAQPSSTNSWWTGLSRLFGNPYKEGMSRYRAEKNEKHQK

SEQ ID NO: 5474 - protein, 122 aa, Lactobacillus buchneri
MVAKKKGFKMPKWLVNTLQVTLMVAILMALYNFLGPMVFKKGSYFPWWTFPYSVVGALFLIGGWNFLSHRMNVMHNQIIAEDKAKKQREEQIRQAGAAKEQAEAEKRRQRNANRNKGQQQSR

SEQ ID NO: 5475 - protein, 387 aa, Lactobacillus buchneri
MKTLYDKLRTAQIDEQLINAFQNDSDIVYTGVIQFLSDKDFIMLTYNDYGIQDGEVYLKISSVKSIDTDSYDLANMQDRIEFDEKHHLNSQPSFDLPIKMSDSLFDRVIQTLQDDQKVGLVITAQAGKLKYNEGLISDLQDDGMVFTNINKFDFSKQSVFNIRFDDIRGIEFGGTELQLLQNVLDMVKPENHVENEIIDDPSVFRDQIEQLRNSGDWVVIDTNDNRKYFYVGKIISSNEKEFVMMVVDMNGRFGGYVWIRYDDIGRIITDSDYLRVIDKFVIENKHNKHFALPVLNSDRAFDNADNILIHIITQSIQYQKVIRFETADEDNFAGYPTSIDLQTGVLNVELLDVDDDGDLPTRQIGIENIREMAFDYFKAFLTENEID

SEQ ID NO: 5476 - protein, 324 aa, Lactobacillus buchneri
MKTILAIHTGGTISMSQNEKGEVVPNDENPIAEEQVILKGQINLITDEMFNLPSPHVTPEVMLKIKQRIMKAIDDGVDGVVITHGTDTLEETAYFLDLTLPNTIPVVVTGAMRSSNEIGSDGLYNFRNAILVAATDESYGKGVVVVMNDEIHTARYVTKTHTTNVATFRTPTFGPIGIVTQNKAKYFQELIQTEVCDINQVVEGVYLIKAYAGMDGTLFDAINNDNTKGLVLEGLGAGNVPPQTLPAIQRLLDNHIPIVLVSRCYNGVAQDIYDYEGGGIQLMKMGTILCQGLNGQKARIKLLVGLSDNMSGDELREFMGNAIS

SEQ ID NO: 5477 - protein, 123 aa, Lactobacillus buchneri
MPNSDRYYTPQNSKDAMRQIEKLFNKYKDAPLTQELVDYHQNLVNRLKTDILAAAKQENVPARIESINTMIAAMERWLKVRLAGNPYNGKMKNFKFVSDESLPKFKRHVHKMNGGSTHRSSRH

SEQ ID NO: 5478 - protein, 362 aa, Lactobacillus buchneri
LSKTIVELKNVYKKYDDGFTALKNISFKLQEGEFYTLLGPSGCGKTTILQSIAGFTEVTSGQVLFDGKEINDIPANKRQLNTVFQDYALFPNMNVFDNVAFGLVVHNAKKDEIQTRVHDALKMVQLEQYATREISELSGGQQQRIAIARAIVNRPKVLLLDEPLSALDAKLRKDMQYELRELQQNLGITFLFVTHDQEEALAMSDEIFVMNKGEILQKGSPVDIYDEPINHFVADFIGESNIIPGKMVADYQVAFLGHQFECADAGMRPNEPVEVVIRPEDLVITTPEKGKLQVKVDTQLFRGDYYEILAYDEAGNEWLIHSTNASTDDAIIGLTFGPDDMHIMRYNETEAKFNHRLESYEE

SEQ ID NO: 5479 - protein, 270 aa, Lactobacillus buchneri
MKRNYRGLFFTPYILWLTMFVIAPVALIIYYSFFNIHNHFTFANYQEFFSSGTYLTMTANSVLYAFLITLFAILISYPMALVISKLKHRDLWILLVILPTWINLLLKAYAFIGLLSHDGLVNDLFQFFGIPAQHMLFTDASFILVAAYIQIPFMILPIYNSLTDISDSYIRASRDLGATKWQTLTKVIIPMTMPGIKSGIQIVFIPSLSLFMLSRLIGGNKVITLGTAVEEHFLTTMNWGMGSTIGVVLIISMVIVMLLTNTKRKRRRTS

SEQ ID NO: 5480 - protein, 273 aa, Lactobacillus buchneri
VNDKASRTGKIYITIIFLLLYIPIVYLILYSFSKGTTMTNFQGFSLKHYGELFNDKRMLAIFLNTILIALLSSVCSTIIGTMGALAVHNAKRRHEREALLSLNSILLVSPDVIIGASFLIFFTALKLPLGFWSVLLSHIAFEIPIVLLLVLPRLDEMSPSMTNAAMDLGASPAQILSKIVLPYIQPGIIAGFFMAITYSLDDFAVTFFVTGNGFTTLSVEIYSRARQGISLEINALAGIMFIFSLILVGVYYWIETRNTASTGKKPIVEVTDR

SEQ ID NO: 5481 - protein, 356 aa, Lactobacillus buchneri
MKKFLAALIAILALCAGLAYGSNQLTKSTGDTGNKVLNLYNWGDYIDPSLLTKFQKETGYHVNVETFDSNEAMYTKIKQGGTSYDLTVPSEYMVEKMKADHMLIPLDKSRLVGMNHYGRSFLNKSFDPRNKYSIPYFWGTLGIIYNDQYVKPGSLEHWNQLWSKKYRNDIMLIDSARDILGFSLISMGQSVNTTNSAELIKAKDKLNRLSPNVKAVVADEIKMYMAEGEAPIAVDWSGEASEMMSQNSHLHYVVPTEGSNMWFDNLVIPKTAKHFKAIYAFLNFMNKPENAAQNAEYIGYSTPNMSAFKLLPKATRDDKQFYPTQNVIDRLQVYSNLSPQKVQEYNDLYLEFKMHH

SEQ ID NO: 5482 - protein, 109 aa, Lactobacillus buchneri
MAKKNMRQEIIIDMDEFIVTYAATLLDPNQNLSELVYNTAKEDITKWDDLFHDQGFGRKNKFINIGRGYLRDAQNLDAEEAEKQGDQLAQEAIDYLGKHTDFFEKWRTD

SEQ ID NO: 5483 - protein, 478 aa, Lactobacillus buchneri
MNHTPAQSTTQKNGWWILVSIGMFAFMSNLDSSIVNIAMPIMAKQLHVPMNQIEWVVSSYLIVLTALLLFFGKLGDIYGKIKVFRIGTVVFLLGSFLSGLQINFPFLLVGRFIQGTGAAMTLSNTYGITTSTFGIKERGRAMGFVGTFVALGAIAGPGLGGLILSRLSWGYIFWVNLPIGIIAVILGAIVMPKAYQTVPGTIDWLGFINFSLMIIGLFLGVFIGQELGYGSPIALALFALGLITMWGFFHAEKRAKNPLMPLSLFKIKPFTYGLGAAVLIFLSNFFTVIIVPFYLEDARHLSAGEAGALLIIFPVVMVFAGPFGGWLADHFSPAATATGGLLIVAVAQAMYFFLTLTSPMWVYVVITIIMAFGTGLFQSPNSDIVMSVVPKDSLGSAGSLNALARNVGMISGTALSTSALFIAMSVKAGFHVTNYLPNQPEVFIFGMHVAFAVSLVIILGAWVLSIMQGRTVKPGDLK

SEQ ID NO: 5484 - protein, 906 aa, Lactobacillus buchneri
MADNMNEVPPDEKLWQRSTDELVKQYQTNEEDGISEQEAAKRLARDGYNELTAKKKSKLLQFLLQFNNSIIYILIAAAVITLFMHHYSDSAVIGIVIIANAFIGFFQEMQADNALSKIKELLVSQNYVIRDGHKIEVPARELVVGDLVNLEAGDAVPADLRLISADNMRAQESTLTGESNSVEKTEDPINKDSVPLAERSNMAFASTAVTQGSGVGIVIATGKDTQIGQIQQSVAEVKTQVTPLMRNLNKLGINLSLFIVAIAILLFVLGLYTKIYSLPTLTIAIITMVVGSIPEGLPASTSVVLARGVQVMTKKGAIVKTLPAVETLGAVDIVDTDKTGTLTKNEMTVTDVITDEHHYQVTGVGFIAGDKGVDGDVLLDGQKYDWKQDQQFRDLVDIAGTTTDAELVQTDGEWQLNGEPTDGALTTLFHKLIGREPEVDEVDTLPFDSAYRYSARLIKENDHHELMVKGAPGTIFDMVKQSDPNFDDQTWYERVAKLTEQGLRVVALGYKNVPTDVDEIDQDKIADGIQLSGVVGIIDPPREEVIPSIQSLRRAGVKVNMITGDHPDTASAIARKLDLDESIHAITGPEIDEMSDEDLIKNIGRYNVFARTTPANKLRIVKAQQANSKIVAMTGDGVNDAAALKQANIGIAMGIKGTAVAKEAADMVLVNDSFTTIVDAVAEGRHVFDNIQKTIRFLLPTSFAEGLVVLISMIMGQELPLFPTQLLWINTVSALTIQFAFIFEPAEESIMIRGPRNVAKGILGKMDVFEITYVSILISALGIFTFDRFVDSGVLTAVLGSTMAVNIIIFGKIFYLFNIRNSYPIISKHFFENKMAFIIIGILLALQAAMFYIPFMQDVFHTGSIDFFYGWVVPTIAGFIVLVVTEIIKLGRIEYRKRKGQATKIK

SEQ ID NO: 5485 - protein, 253 aa, Lactobacillus buchneri
MKLAVEINDDSTRMTLPDGQGTIVVTRTVDQANADVNLYLKDGKLISVQTEPTDKADGVIQIEPAWDLEAGSLAKSFSEYAVERGILKKDLLEMVKIPSNQRKTVEAFRNLVLTVLNGLGFRSVFVPKKKFKGKPRHKFTKQVSEIPFYVDHDGAKAIVYWQKRNEMLVKAGAVMKAEPDLNQDGSLGFSAKFAQKLRSENADSFHNFVTTKDIVLKSVNEVGLFLYFAGTNSWLVLKDENGKTIDEWTKVVE

SEQ ID NO: 5486 - protein, 799 aa, Lactobacillus buchneri
MTNFDSDEYLQKVNLYWKAANYLSVGQLFLRDNPLLKRDLVADDVKIKPIGHWGTIASQNFMYAHLNRVIKKYNLNMFYIEGSGHGGQVMVSNSYLDGSYSEIYPKIAQNETGLQRLFKQFSFPGGVASHAAPETPGSMHEGGELGYSIAHGTGAILDNPDVIAAVEIGDGEAETGPLAASWFSNKFINPIHDGAILPMLNLNGFKISNPTILSRMSDADLTKYFEGMGWKPYFVETKGDPEDYTRVHQTMAKTMDAIITEIKAIQKHARDNNDDTLPHWPMLVLRSPKGWTGPKFDLDGNPIAGSFRAHQVPIPVSAGQMDHKDLLINWLKSYEPEKLFNNNGSVKAEIKATTPDGDQRMAMNPIVNGGINPKKLDMPNPADYALKIDKPGDKEAQDTEVLSNFYTEIMKRNGKSFRAFGPDETKSNKFFSMLDYGKRQWEEPIKTPNDENMAPEGRVIDSQLSEHQAEGWLEGYVLSGRHGFFASYEAFTRVIDSMLTQHYKWLRKASEQSWRHDYPSLNIMNVSHAFQQDHNGYTHQDPGMLGHLAEKGHELVNEYVPADANSLLAVMNTALQTREKINLIVASKHPRPQWFSMDEATKLVNDGLGIIPWASNDEGDPDVIFATAGTEATMESLAAIDMLHEAFPQLKVRFINVIDILRLRPSNEDQDSRGLTQAEFDKYFTTDTPVIFAFHGFENTFRGLVYNRHNHNISFHGYRENGDITTPFDMRVLNELDRYHLAKDAISRTKFAASADDFEAKMDQMLQKHHDYIRQYGTDIPEVQNWKWSGNLTNKLTTE

SEQ ID NO: 5487 - protein, 284 aa, Lactobacillus buchneri
MRIGFVSDLHIDFNRQYDFVSVLGQLISDENLDQLVIMGDSANGLQRNLRFYQQLAEALPVPFHTLIGNHDLYVDHPRQKSVQQIQTASRTAYRDLDRLPTSLTRHPFETRHWLITGINGWYDYTFANHFSEAAGPRYANNFVAKHVWPDQLYINGNQISYRRDRKWVVEQILAWQHQINRLAVSGKKILVASHMLPTKKLARQLPIPFYDRFMYQLGSDRYRQLFEHNHVSLSLSGHSHMPNSVIENGIRYRNLSLGYDFQWQNPGDALGELKRVMFVLEDES

SEQ ID NO: 5488 - protein, 359 aa, Lactobacillus buchneri
MKEFNVAILGATGAVGTRMIQQLEQSTIPVKSVKLLASSRSAGKVLQFRGQDITVEETTPDSFNGIDLVLSSAGGSTSKKFLPEAVKRGAVCVDNTSAFRMEKEVPLVIPEVNEKALYNHRGIIANPNCSTIQMVVCLEPIYKKYGLKQVIVSTYQAVSGAGQSALNELMEESQQVLNGEPTEPKILPTKGDKKHYQMAFNLLPQIDVFESDGYYTHEEWKMIHETKKIMLDDMDAKDIKVTATCVRVPIRIAHGESVYFEVADKNATADQIKAALDGADGVVLQDDTAHQIYPQSIEAEGKRETFVGRVRPDFENEGAFNMWVVSDNLLKGAAWNAVQIAERLVADDLVRVPENPYLG

SEQ ID NO: 5489 - protein, 395 aa, Lactobacillus buchneri
MPQLDSKLSEVVNQNVNAVGPSGIREFDQEISSIPGIVKLTIGEPDFDVPEHAKQAAIKSIEENKSHYSAQKGIPELRDGISNYLKDRTGVYYDPATEIVVTVGATEAIYSALTTILNPGDKVIVPTPAFALYFPIIQVAGAELITIDTSDDGFVLTPEKLQKVLDENGDSVKAIILNYPSNPTGVEYTEAQLKALADIISQHKMYVLADEIYSELTYGVKHHSIAAMIPGQTILINGLSKSHAMTGYRIGYIAAPKDFVTNASKMHAFVVTAPSNPAQYAAAEALTNGLDDPIPMRAAYHKRRDYIADRLEKMGMQIVMPQGAFYIFAKIPDTIDETSVEFATHLAKDAKVGVTPGSAFGPGGEGWIRMSYAASDEDITLAMDRMNSYLLELTK

SEQ ID NO: 5490 - protein, 257 aa, Lactobacillus buchneri
MIKVLVAGFMGSMGQKTVQMVNKNDDFELVGAYNPGIDTVHLKGMGMDDKVKLFASLDEIDTDADVWIDFTVPAAAFDNAKFAIEHGIHPVIGTSGMSDEQVDQLKKLAQQTNVGGILAPNFGISAVLLMKFAKEAAKYMPGVEIIEMHHDDKLDAPSGTALATAKMIAEVRGKHDSPATEETLKGVRGGDYDGIKIHSVRLPGYVAHEQVLFGSKGEALTIRQDSFDRASFMSGVELAVPAAAKATKLIVGLENIM

SEQ ID NO: 5491 - protein, 305 aa, Lactobacillus buchneri
MMISADIMTAIVTPFGEDGSINFDGLEKLTNHLLDTGSRGFVIGGTTGETPTLSHDEKIELYTRFAQIVNGRGTIIAGTGSNNTAETVRLTAEVGNIPGIDYALVVVPYYNKPNQRGMIAHFTAVAEQSPVPLIIYNIPGRTGVTMANDTVVELSHNANIAGVKQCTSLEDLEYLVQNTPDDFNVYTGEDAQALSAKAVGANGVISVTSHIYDREMRKMYDALESGDVETAGDMMRFLTPKVQALFMYPSPSCVKAILNVQGFGAGDCRLPILSLNDEEKATLASKLGVSRLEDIPVDGTEMARS

SEQ ID NO: 5492 - protein, 383 aa, Lactobacillus buchneri
MSQLTKEDLIGIRRHLHEYPELAMHERATHDYLLKTIQSFNQQYIEIREIPKLPTALLVYVNGSNPKRTIGYRTDIDALPVSEKTGLPFSSKNPGVMHACGHDIHMTVALGVLNWFSEHQPADNMVFFFQPAEESENGGKVAYELGVFEGKWRPDEFYGLHDNPDLPAGAIGCRMGTLFAGTTEVNVDLIGKSGHAAYPQNANDMVVAAAEFIGQVQTIVSRSVNPIEGGVITFGKLDAGTIRNVIAGQARIEGTIRGLTQKMIEHIVDRLKMVANGVATSYGAEVKIHFNQGGYLPVENNDELTRRLIEFAKQDPETDFVETQPAMTGEDFGYLLSKIPGTMFWLGVDDDSQLHSATLNPKESSIPKGIKSITRFLEYRMNN

SEQ ID NO: 5493 - protein, 236 aa, Lactobacillus buchneri
MEQLSAREIIDFIGNAKKKTPVKIYLKGSIKDIKFPKSIKAFAEKHTATLFGDWTDVKRFLKKNKSAIDDYQVEADSRNSAVPLLDIKEINARIEPGAIIRDHVTIGNNAVIMMGAIINIGAEIGDDTMIDMGVVMGGRAIVGKHSHIGAGAVLAGVVEPASAKPVQIDDNVLVGANAVVIEGVHVGEGAVVAAGSIVTKDVAPHTVVAGVPARKVKDVDEKTTSETGLEDDLRKL

SEQ ID NO: 5494 - protein, 435 aa, Lactobacillus buchneri
MSNQIDQLSTNQAGHLEIGGVDSLDLVKQYKTPLVVYDVKSIRDQIHHFQKVFQDNGVDFAVSYASKAFACIAMFQLINQEKAHIDVVSGGELYTAIKAGFPMERVSFHGNDKSREELEMAVEHQIGVIILDNFHEIDLLKEVLEDKQSHINVMLRVTPGVSAHTHEYDQTGQVDSKFGFDIQSGQARKALGLVLEDQRMNMLGIHCHIGSQIFEVKGFEMAAVKLIDTLADWNKEIGYVAKVVNVGGGFGIKYTEDDDPIAPEMFVDAIVKAIKKRTEEVNLPMPAVWIEPGRSIAGPAGYNLYTVGSRKDVPGIRSYVTVDGGMGDNIRPALYQAKYEAVLAKNPSAPIKETVRIAGKYCESGDILIQKQDLPATQPGDVLAMLDTGAYGYAMASNYNRNPRPAVVFVENGKSQVAIRRETFEDLVALDEEFN

SEQ ID NO: 5495 - protein, 464 aa, Lactobacillus buchneri
MKVVKFGGSSLADAAHVQKVIRIVQSDPERKVVVTSAPGKRFADDIKVTDLLIKYANAIINGTDAKSIVATIFDRYQEIGNGFHVSKSVLDDLKAKLTALPDQSYPNDDYLMAAFKAHGERLNAELFAACLTEAGTQARFVDPSEAGILLSDNPNGATVLEQTYDNLANLTYGEETLVFPGFFGFTKEGNIATFARGGSDITGSILARGLKADLYENFTDVDAIFAANPKIVPDARPIHKMTFREMRELSYAGFSVFNDEAIIPAIQGQVPINVKNTNNPDLPGTLIVPEKDFTSKKPVTGIAASNRFSALYLHRYLLNKEVGFTLKILQILYKYDVSYEHMPSGIDDLTIIFDRSQLDSDTIKKMCHDIQVELNPDTLDWIDDYAIIMVVGEGMRARVGTIENIIRPLAEHDIPVHMINQGASRISIMLGTRQSDADAAVKYIYQHFFKEDPSVNQLEYQAEV

SEQ ID NO: 5496 - protein, 330 aa, Lactobacillus buchneri
MVQLLKVHGSQNKFFILDQTALQTKLSQPELVALAKHITEPETGLLDGADGLLVIDDSDHPDTLGSMQVINTDGSIASMCGNGLRTVSRYLSDKFGEDQFKVETMDSDLHVHREADLADNVPTFSVEISPVTFAKETLPFDNLGTDTLINKAVPEFAPDLKFTAISVPNPHLISFVDEETMHSKTLGQLGKMLNDPNPYFPDGVNVSFAQILDHNTLFVRTYERGVGFTNACGTGMSATSLAFCLNHPEMADFDELISVYNPGGMVKTRVHSRDDTFSIDLIGNATFTHKIEIPEADLHANDLEHAQITETDEQPAYLRFVESLKNQLIK

SEQ ID NO: 5497 - protein, 72 aa, Lactobacillus buchneri
MLNAQKLQAIVDTFAKYNVEIQTDGMRITAVNGQPADFDATTFMQDQLIEMICKVLANQLIHEVWVNEHTKK

SEQ ID NO: 5498 - protein, 197 aa, Lactobacillus buchneri
LTPQFGEIYRTKRATYFAIGEVVTHNPQLILDNVNYIGKKNFVIHIKFGQGIARKAVLLVKMTGEELPSYLARTDGESFAAAVGDGDLELINPGDQELNHYQLVEELEIEDPDDEKIAQIASIRENTIQLVEDYLNKLQIKIDKLSQRKANHYFSSKSHYEDVKDFLLLVAPYLDLRIKPNQVRQDEWRLKLRLGGQ

SEQ ID NO: 5499 - protein, 786 aa, Lactobacillus buchneri
MAVHQVGIRELVEFLLRTGDLSPVISSENTAQEGSRIHRKIQRSRPASYQSEVALKTSIQYLDDEYVISGRADGIDDRDGKPLIEEIKTSDLEFSSVPDSTLQLYWGQVKVYAYIVMHQADIRSVDLQLTYVQTPDEKITTKTQTITKTDSELFFTALVTEFEQWIKLRHELDENRISSAKKLQFPFSDYRPGQHKLATNVYKTILLEKHLFVEAPTGTGKTISTLFPAIKSMGEQLINRIFYFTAKQSTRHVAENTISIMAEQGLKLKSITLTAKDKITFPTEKELPPENNPYMVGYYDRVRPAIKDIIQHENQITKATIQEYAEKHKVDPFEFSLDVSLFCDIIICDYNYLFDPQVHLQRFFSFPDPTNCFLVDEVHNLVQRSREMYSATLESSPIDPLLERLVKKKAGNQKVIKRLKSLKRSFKRYSKPASEVVDKQIAQLAPLDNFNNTLENLIETIHQWLATQTPSDTVDAVVDYYLQCRRYYLISTFYDETYRTRIIIGDHTIIFRQFCMDPSKQLKACLNLGRAAILFSATLSPMSYYRQVLGNEEDSLGMISHSSFPPQNCQVIIANNINTLYANRENSLQPICENIYTMITQKVGHYMMFFPSMAYLNATLSKFVELHPDIDVINQQPEMDNAARTAFLDAFRTEDHQTKVGFALLGGIFSEGIDLKNDQLIGVGIISVGLPGMNKESDLIRDYFDSLNGQGFSFAYQLPGFNNVSQAAGRVIRTDEDKGVIVLMDQRFNQTRYRQIFPQNWTNIKVTNNPNQLRNALQNFWQHGNQ

SEQ ID NO: 5500 - protein, 283 aa, Lactobacillus buchneri
LKLAMYDHQPTFVALQNGQFWGVPIIGYDSIDDILNDWQNFLANVLININDDKIIDNDNATQLDPQHFEQPVQHPRQLPAVGFNYLDHMKEMDIVKPKRPNIFNKFVSSLAGPHNSIHLSSDTVDWESELVVVIGRGGRNISREDAEDAIAGYMVGQDISDRTVQSIDGPSTQFDLGKSYKNYSPVGPYITTIADVDDIVSKTVTTKVNGEIMQQATIDKMIFDIQTLVSYISNVIELYPGDLIFTGTPSGTGVGRDPQVFLKSGDLFTSEIDGLGTIETKVN

SEQ ID NO: 5501 - protein, 350 aa, Lactobacillus buchneri
LIEKYLLGTYTRRISKGVYQLELDTENQKLQNLTFVGSAIDPTYVAESNQKRIYAITKVKDDKGDVTGGFVEWDGTSDDFPLKPIASVHDQETSPAYIAVDEDKRLVFTANYHAGTVNTYRIADDGSISKADRIMDKGTLGFRKEQQDGPHPHYINLTPEGRVVAVDLGVDKVFIYDLEANGKLVPVSELQMQDGYGPRHIYFDAKKKVAYLVGELSSNVAVLDYDADKGVLSLRDIHSTIPDDWTEHNGAAAIRVSKDGRFVYVSNRGNNSIAVFSSDESGNLSLIQRISTEGDFPRDFNLSDDQSFVIALNQNSDNATLYTRDPESGKLTMIQKDFTVPEGVSILRKK

SEQ ID NO: 5502 - protein, 163 aa, Lactobacillus buchneri
MTSFEKFHPVLTAHLTLDWLTQTPVKSIDDLFSKPAVTTAKAEKMPSQILDTVKEINHIMRRVMNDKELTWGITDSNSDAFVGIISLRGFEAAAPSGSIEFIIDQDHREYLAEVVERAVRFSQDHFEFNQLSITFNDVSSQTAKELSGIGFVGDGEQRFTIQL

SEQ ID NO: 5503 - protein, 155 aa, Lactobacillus buchneri
MTNTTLKRSLGQLKKQGVRITPQREVILDYLITHHNHPDVETIRDGIEDKLPNLSVATIYNTLKMLVDNGLVIELPNNDGGIRYDYFGVPHYHAICENCGKIIDIFDDDYPELVKHVQQTTREKTDFLVTGTQLEVTGICPDCQRKLHLAKLANK

SEQ ID NO: 5504 - protein, 313 aa, Lactobacillus buchneri
MFGLSSTAGASSVNDYIANNNIGHASVTSSVWSGFPKNAYRNGTGKPEGVVVHETANPNSTIYNEIAYMKKNYNNAFVHSFVDASRIINIANTNYLAWGAGYPANARFVQFEQVEVHSKSAFAHEIANAAYYTAYILDKYGLKPNDAAYDGKGTVWSHGGVSKYLGGTNHTDPAGYYASAGKKYFGASYTFAQFYQLVKTTYNNLADDGAAHGSLTASSAKTAYDKVTYAKADTKASLGDNYKSYRLYNHVKNSRSGVKSYSWSSVDASVGKKVYIDDIGTKSNGHDWYRITFSTDSGAQKYWVYEKALDLIN

SEQ ID NO: 5505 - protein, 271 aa, Lactobacillus buchneri
MDKRIINANRIVVKVGTSSLIHPNGAVNLKTFDELAYTLSALNNQGKQLVLVSSGAIGVGLNKMHLKKRPTEIGAQQALAAIGQSELMTLFTQRFDHYLTDIAQVLLTHDIFDYPKSNQFVMNTFNCLLRDNVIPIVNENDTVATDELDHKTTFGDNDQLSAIVASHVDADLLIVLSDVDGFYDQNPNKVADANLIRTVSHVDENEFGVAGGTGSRFGTGGMQTKLLAAKRMLDEDRIMVLANGADPRIIFKILAGKDVGTIFQKESVAHE

SEQ ID NO: 5506 - protein, 414 aa, Lactobacillus buchneri
MNDKLIEIGKNAKAAAYKLNLLDTVTKNRILNEFAIALGQNTELILSANQKDLANATDMPSKFTDRLKLTSQRITDMAEGLRQVAGLADPIGDIDKGWENDAGLNIEKKRVPLGVIAMIFEARPNVTVDASALTFKSGNAVILRGGKEAINTNLALAEVLRQVLKANQLDENAIQILHDTSHDTANDLMHLNQYVDVLIPRGGAGLINAVVKNSTVPVIETGAGNCHVYVDKDAELQMAIDIVVNAKVQRPSVCNAAEKLLIHRDVAESMLPAIAQALEDHGVELRGDEASRQIVSSITPATQDDWSTEYNDLIMAVKVVDDEQAAIEHINQYSTGHSEVIISDNYQSGQEFLNKIDSACVYVNASTRFTDGFEFGFGAEIGISTQKLHARGPMGLNELTTTKYVIRGNGQVRK

SEQ ID NO: 5507 - protein, 182 aa, Lactobacillus buchneri
VSYYNFVDRPSKQRIQEMADQLHLAVSPDAVHLFLDFQLAYREVEKNYESLVASFDLSESRFIILMFLYYADDKQLLPSEIAHKLGVTKPTISKLLRGMEQQGLVSSHQSSTDKRVRDIQLTPAGEKLLRTFLPYNYRSSSLLFEDFTDEEKQQFAHLLRKLLKSKDKIQQLEEDYHEHRKN

SEQ ID NO: 5508 - protein, 121 aa, Lactobacillus buchneri
MNTEKINLLETYLSLYINPMDVLKAGQTGQSPYVILDVRNAPAQIKKDQIKGAVAMPAKDLAAHLSELDKAKTYVVYDWNGGTILGKQAVLILLKAGFDAFELAGSLEGWKGMNLPLETIQ

SEQ ID NO: 5509 - protein, 507 aa, Lactobacillus buchneri
MIDEVVAYVDKNAAAIMQALWQHIEISLIAILITIVIAIPLAIGLVNRPKIGEIISQIAGVIQTIPSLAVLGILIPFVGIGTVPAIIALVLYAIMPIFQNTYAGLTHIDPVLLEAADALGVTKRFKLFRIELPLAMPMILSGIRIATVLVIGTATLAALIGGGGLGTYILLGIQTNNNAALIVGAVLSAILALVASWLIKVLSQFSFKKLGIGVLVVLILGGAGLGWSLFNKPSQTITIAGKMGGEPEILINMYKDLVKQESLQTKVQLKPNFGGTSFLFKALQSDQIDVYPEFTGTVLQSLVHSPKKVNSEPQLAYRDAKNALSQKFHMRYLKPMAYQNGYAITVRQSTAKKYHLRTIADLQRVGSQLTGAFDPDFYQQSDGYPGLRKAYHFQLKSVRTMEPSLRYVALADGRVDVTDAYTTDPQIREYHLVVLKDSKQFFPPYQGAPLMTDQFAKTHPQVVRALSRLAGKITTRDMQEMNYQVTVKHRSAAAVAKQYLQQHHLLK

SEQ ID NO: 5510 - protein, 256 aa, Lactobacillus buchneri
MGAITALGIVLLVLMIIVGGKQGITSFLSLVVNFGILFFTIVLIAFHLPPIIVTIVASVILLSITIFWSSASDNASTTAFQASVIVLILIVVIIIPIEYWAQVGGFGLEDSEELEGLSTYVGIDFTKIAIATAILSSLGAVAEAAIAIASGLDEIITQHQAIKSEQLFLDGTVIGKQIIGTAVNTLFFGFFGSSLALFIWFYGLNYSFGDILNDKVFAAELIAIVVSLIGVVTTIPVTTWLMSFKLKRLHKAQLKH

SEQ ID NO: 5511 - protein, 368 aa, Lactobacillus buchneri
MNSKLTSKMTWLQIVLVVAFCFLAAFFCQHNDGLYQQTIYRVDRVQNGKAIKMTDEFQNVDHYHNQQLFGTITNGKYAGQKLSIKNAYSDSHAMDHQYTKGQKLFITLHTQPKLHATVKDIKRDAPIAFLFAIAISLLFVILKLRGVTVISSILINTILFWIAVKLDHNNNGAAVIWIFSVLAVIFCFVTLLLVMGWSKKMLVTLSAVLCATAATILITLIVFGLTNERGIYYESMQYVTQLPKPLFIAEVLIGVLGAVMDEATDIVASLATLKQERPELSRMAIFKSGRQIGKSIMGPLINVLFFIFMAETLAMTLLYLKNGNTWHYSFSMNMSLGMTSSLISGIGIVLTVILSSAFAGLWIKGDER

SEQ ID NO: 5512 - protein, 144 aa, Lactobacillus buchneri
MYDTILVPVDGSDNAMRAVEEAADLAKSFDATLQIVSVASDQRYVQYGVTLGQDVMESFRERAEEILDDAREIAEKKGAKVETHFVVGVPKIQIAKELPEKYDASLIVIGKSGVNGISRAILGSTTAYVVRHSTVNVMVVDYKK

SEQ ID NO: 5513 - protein, 174 aa, Lactobacillus buchneri
LNLEAIIIETIKCSDTRAIHESYVFPAQLNNNRIQFGGETLRILDANAGLAGVKFLPGNLSFVTAGYDHVQFLSPARPNEILTCISYVTGSSKRAVEVFTKFLTTDTKTKDVQVAFMAFCTLIVTNEISEIHFPELVGESAEEKYLLATYDDRLKERHAELADNKTIISHLSFE

SEQ ID NO: 5514 - protein, 356 aa, Lactobacillus buchneri
MKAVRIYGEKDIRVEDVEIPEPKDDQVQIKVKYCGICGSDLHAYLEGWGLPTVPYPLTGKTVPITLGHEFSGEIVKVGKDVDDLQVGDHVAVEPLLACGKCENCRAGNYNFCNRAVSTDGAGNFLGFSEDGGMAEFANVQGVFAHKMPKDMDFELGALAEPTAVVYEAIKKSHLREGQNVAVMGAGPIGLLEAVLAKIAGANHVYIVDVSKVRLDKAKELGIEHVLDPSQDDVEKIIKQDLPNGVDITFECAGVQATFDSALKVTKRTGIIQVVALYAKPVTMNMTDDLIMQGKDVITTLCYNNSFPNVLGIIDNHKDLFKKVVTKKISLDNALEDGIKALSTDKSQVKIMIDPSL

SEQ ID NO: 5515 - protein, 115 aa, Lactobacillus buchneri
MTDDPVSINSIVLIDNRHLSESERIFKLLSNPNRLQMLKVLAQQELNVSELGNLLGLEQSYVSHQLALLRKHQLVSSHRDGKANYYQLDDPHILYVINEMLKHADHVIRGKKHGE

SEQ ID NO: 5516 - protein, 207 aa, Lactobacillus buchneri
MESNTDSQTLVVRSLHTEYFSTAWMAFEFMVGFYSGLKAGSILLIAFGLDSFLEIISGSTLIWRLRKENTGAGPEAIERAEKRSSLIVGIVLLLLAVYVTAVSLFNLFTHATADTSYSGIAIGIASVLLMPILMVRKQSLGKALHSDALVEDGMCNITCAYMAATVLIGALLTALLNWWWADSVAALILVYFIASEGWESFQEGHAK

SEQ ID NO: 5517 - protein, 110 aa, Lactobacillus buchneri
MPSFNFVLLTIIGTGIVTWLSRITPFVVLKKFQLSKGVVEFLSFVPIAIMSALWFENLFVQHVGHLPSIDWENFLASLPTVLAAVISKNLLVIVVVGVISLGVIRLVMGM

SEQ ID NO: 5518 - protein, 235 aa, Lactobacillus buchneri
MNGDLTVSAASKDTLPTVFGYIGIGVAFGIVGKAAGLSPLLVTLMSIITYAGSAQFVIVSMLVTHSPIFSIIFSVFLVNSRMILMSTTLASYFKYDSMFKNILVGTLLTDESFALGMNKLNYSDNHLNFAWFNTANVISYMTWILSSLVGAVLGNFISNPEKFGLDFALVAMFIGLLYLQLISDKSIKFNLQLIVVGFVLVAIYLGLIFIPSSLLILLVTLVACSFGVVMKHAFF

SEQ ID NO: 5519 - protein, 151 aa, Lactobacillus buchneri
MQVDAIVNAANTALSGGGGVDGAIHRAAGPELDEACRKLNGCPTGEAKVTPGFRLPAKFVIHTPGPIWRGGHNNEPQLLRNSYVNSLKRAVENHCQTVAFPSISTGVYDFPLDKAAKIAIDAIRTFDAPLDVTMVCFDPGTYDAYQRALAN

SEQ ID NO: 5520 - protein, 441 aa, Lactobacillus buchneri
MKQESLFAGNQDGNQPLASRVRPKTLDQFVGQHQLVGKGKVLREIIESDQLPSIIFWGPPGVGKTTLAEIIAKKTQAKFVTFSAVTSGIKEIREIMKDAEANREMGGKTIVFVDEIHRFNKAQQDAFLPFVERGSITLIGATTENPSFEINSALLSRCKVFVLQPLETDDIVQLIHQTLKNPAAFPKETISIDDQAVKEVAEFANGDARVALNTLEMAVNNSPKQDGKVTVSTDNLHQLMNTKSFLYDKHGEEHYNIISALHKSMRNSDPDAAVYWLTRMLSGGEDPLYIARRMVRFASEDIGLADTNALNVAINVFQACQFLGMPECNVHLTECAIYLSLAPKSNAVYKATLGAETDVKHSINEPVPLQLRNAPTSLMSKLGYGKGYQYAHEAKDKLTNMQTMPDSLVGHTYYEPTEQGNEVRFKKRLEQIKAWEKAHRK

SEQ ID NO: 5521 - protein, 71 aa, Lactobacillus buchneri
MSYNNNFYREPAFWLSICAAAVGLMSLFLGNAVQYSIIWWLQLLIVVIALIGIFYFFSKYSKDQENKNKHL

SEQ ID NO: 5522 - protein, 598 aa, Lactobacillus buchneri
MSQQLLSKFRQHQGLVINLGFFCLSLLAVLPFWLTMHVYSGPDLQFHLSRIEEMLANLQNGAPFSHIATRTFNQIGDAVVACYPWIWLYIFAGLRFVLSPISAIYFAYVLVVFATLVIAYYSMKLVSKSSRISFYFAILYGLTTYLVMEIITTQFGEFLAYPFIPLAFAGLYEVMFEDTNRWYLLTIGVTGIMYAHAPTTLIVVIALLVFYLAFFTKQPVKERAARLMKIGIAAVYSLILSLIVWGPIAVLAMSQKLMRPNPQTLYADPQSLFTWLNQSLANKGIGLILLLLLIFGGFFIKRVPPIGRYAYFSSFVTLFVLSNLFPWNLIHHIPLLNGIEAIQSGHRIIPVLVMFIAAFGSYLLATQFSRRTIGVSALVIVASLCLINSFDYSAMYSMNVATDQNPYDNQFNRTSQPELTYKATPTHQIPRSNLNLQNYKVNNQDYQNQFPTDNGSGRTDYLPMTAGKHIDDLANKVTILNGQRFEIATASLHPGNNSLSYQLAVPMKKGTTLDLPFVHYAGMNYTVKFNGKTIQKPATSNRGTFKLTIPQTVKQAKISIQSRGVKFNGLFTALSIVGWLGLLGLGLVRKYRKRINLS

SEQ ID NO: 5523 - protein, 112 aa, Lactobacillus buchneri
MTVATQTQFKEALSSKEKFNDFISDYFATHKFLSGSYDDGIYFENYQVHLDSKNGLVITLITGSYTGQAFPIKDTENISVEDFRQLILNKKFADKTTSLSDVFHMTADTIDR

SEQ ID NO: 5524 - protein, 306 aa, Lactobacillus buchneri
MDEKKIFDREKSFRYNGDRDLKIAKIPTSATVEDLNKDDIKARIENNIATLQDLQGKLYAQNHFGVLVIFQGMDGSGKDSMIRHILSGVNPQGIEVTSFKSPTSIELSHDYLWRIHRHIPEHGIIGIFNRSYYEDVLISRVHPEMIVNAKIGSITKLDQVDNKFFDGRFKDINFFEDYLTRNGFMVLKFFLHMSADEQRDRFKRRIELPDHNWKFASADIKERRYFNDYQKAYEDAIEHTANKTNPWYIIPSDDKWYSRLCVSDIIDRRMKELPLKYPDLPESEKAELEKALAELEKVPEKSKKNK

SEQ ID NO: 5525 - protein, 655 aa, Lactobacillus buchneri
LNILKANSTTGGQPDQPAEDSIDKSLLKDDLYKAVNGRWEKTAKIPADHSSTGGFMDLNDNIDKQLMSDLDDIIKENQPHEEPFSEFLKLYELARNYKKRDADGGEPLKPYLEKIENITNFDDLNELLPELVKEGYPLPFGFWVEPDMKNTQVNALFAAVPGLFLPDRTYYENNNPAYKQLMPVFTKMASQLLVLADYSSNEADEIVESAKRFDAKIAPNVKSAEESADYSKMYNPQEFAYFSESSSHLDFVNLADALFGKAPEQIIVTEPKFYERFDGLVNSDTFKDMKNWMLVNMVRLASGYLSEEFRQTGSVFSRALSGKKEATPQKKSAFYLAEGTFGQTIGDYYAKKYFGPKAKADVEHMVKNMINVYKNRLSNNTWLGKDTREKAILKLDKLELQVGYPDHIDELEYKFKVTPENEGGTLFDNMSKFGAITVQDTFEKLGKPVDRTKWEMSAATVNAYYEPFKNIIVFPAAILQAPFYSLKQTSSQNYGGIGAVIAHEISHAFDNNGSLFDELGNLNNWWTKEDHEYFSKLADKMIKEFDGIPFAGGKVNGKLTVSENIADAGGLSCANEAAKNEADYNLYDFFINWAKVWRMKATEQYKQLLLNIDVHAPAELRANVQVKNLDDFYSTFDVKDGDGMYLEPDKRVKIW

SEQ ID NO: 5526 - protein, 245 aa, Lactobacillus buchneri
MTTNNQILLNNLERLGLNKIREYLPNYLDQIHTDNLSLTEALIDLTNSELQNRHEGQIARAIGRARFPNTKSLDTFDFSFQPSINRQEVLEFQNLAFMEKSENLIFIGNPGVGKTHLAISIGIEACKQGCRVLFINCHELLIRLRAAYEKGLLDRSLSRYSRYDLLIIDEIGYLPIGHQEANLLFQLVNARYEKHSTIITSNSDLSAWVDIFQNPTVTAAILDRLVHHVHVVKITGKSYRLRGLK

SEQ ID NO: 5527 - protein, 69 aa, Lactobacillus buchneri
MSQSNLEKQEAKLKALNQKIKDEKNKIEQRLGKQIISQANLDYANLSNDQIKLLAQQFSEFLKVKSVDH

SEQ ID NO: 5528 - protein, 92 aa, Lactobacillus buchneri
MSNQYEKLVEQQARLKQKIEREDFKLRQSKYYENRQARKARSRRLIQKGALLEKYFQADNLSVEQTEELLKIFADYVNAHKPDKLKNDQPNN

SEQ ID NO: 5529 - protein, 63 aa, Lactobacillus buchneri
MNMKDTITINDFFEIAKETDLKDLLDKSLHEPDPEKRKVYDALYTYFLDKRQDEVIKRKDFVR

SEQ ID NO: 5530 - protein, 109 aa, Lactobacillus buchneri
MPVQHMYPMHEPVDTHLSIVIHTANESRGLDLMDNLQANLRDPEVHYQVKQKGIIIVDVEDPQDNSFIGINNSIQQYGFDLVIRVERNFESDQPTIESIDNNNQSINRN

SEQ ID NO: 5531 - protein, 267 aa, Lactobacillus buchneri
MPITNEPLGPVHTTVKLVTPVKDLGDQIPKYLIEDPDATEATQTRYNSLQEVGDDFDPDSLVYLHAQAVFGGPNPPEAILVVKAVAENSFVSPTSINVDQSSVTGTVGGTTKVTTTVLPATATDKSVSAVSGDTKVASVSPNGDGSFTIAFKSAGNSTITFQTGVNDEITTTTHVSVAAAVTKVTGVKLDKTTLSGKVGGNDQLTASVQPSGATNQGVLFSSSDDTVAKVDSTGKVTYVKEGTAVITATTEDGGFTATSNVTVSAAS

SEQ ID NO: 5532 - protein, 83 aa, Lactobacillus buchneri
MLQIKSENNVNTIAFDGQVDGVTLKFEVDLDDATLINTVKAVAPNTSFAESLFKTALNKISTANFNKKSNEGSNGTDPAQTTK

SEQ ID NO: 5533 - protein, 261 aa, Lactobacillus buchneri
MANSDNLIAAVKKFYNSGDEYLIPVGIDKSKIPALSNYIEAQNTGLLLVDVDDIADTAPYASNVNTAAFKANTDANHANVLSSGTVGAVSALPVGSFDIANTSGLDDSVLPQDQLSFQQDQLVPYSEGNINTYYFAQGMPIVRDGKTLSGDYIDMLLGRDFIIKHSNKKLTEIMVKNPKISYDNTGINLLKSGIESVFDQLYRNGGIGEKDNGKPDYTVTALPREDMKDTDVSQRIYRGLSWQYHPADAIDDVYISGEIDL

SEQ ID NO: 5534 - protein, 135 aa, Lactobacillus buchneri
MQLTQHTFDPWEVSVQIDGLPFTDFGTGDKVAVAWNNDNVTDSVDNNGNGKSAINHDHSGTFTFSIDPNAANYAHLIDLANNLTGVPVSVTSSFAHFHTDSARITRPVDTTLNAEYPSVSVVFKASVLQVDPITA

SEQ ID NO: 5535 - protein, 130 aa, Lactobacillus buchneri
MTEEVKTKSTTKKAAETPVKEPKLVRTERNGMIVGSVTLWDKKTKQNIKYPFNFPGVENAVKFTDLADVSRHAYWDAFINGNDDLGLNPLIGTPTVGGKPEKMSWEFWENHSGVMKVCSEADRFLVQELN

SEQ ID NO: 5536 - protein, 1983 aa, Lactobacillus buchneri
MGYARSAKVGFRVVSENMDAIDRANDKMDRLIRSSREANNQLSHFGDRMSVQGLTKFEDKYDSLISKSTKLSDTVTNNVDKINNRLKGLADNSREYAGQIGKAFSDTSKEARNSFKRLPKEANFKVKTNLKQTSSDIDHANTRVQRFGTKGKTSFDNLSRSGRKTTKSFRNLYDAGNDFVNISSQIAMGAGMIGAAFLKSANEVTNLQNKYITIKNLLKTGGESSSQSRRETSLMQKENNRFALQYGVSPTAMAKGGEELIRRGYSGTQELASHKYFLQAARASGDPYNEVVNYGAPTLEQFGYKTRAGSSRSKMAGYTKKVLNEMAYGADLTATNFNGMGDALRYVGATAHSSNQGLARTVAGIGVLSNNGQDGSIAGTGLRKVMNSFAAPNMAAKSQQGQVMSALGLKPSDFQKANGQVKSLADNMDVLKKATAGMSSAQKFNVFHMFFGTTGQESGLILANNTKQLRSLTGQVSRAQQYGKNGYIQSLAKKNMQSWKNQIDVFKQYINIMGMGFTKTVLPSFTKALGVANKFLKVLIGLPTPIKKAAGYATAFAGIWGGIKVGKGLLGLSSSLLFGKGRRASAASGALSVAEDVAGASPLAGSRLHREGKVLTSRSESTHFAPSRLGNAATALSSDRLLRGMSYATIGLQIGGHAVSAFKKGVDSKQGGSQMWQAGGNAVGAGLGAALSGGNPLVMMIGSSVGGSVAKYIAGSKYIKNLAKGGNVDGTKRRESVPGESGAGLQGPEAQAANGLGYRQAMNARKNSNNKVHHRRVALGLDKYGDKELKSFTSSFNKANQNWATVSKGTGSKINQNVYGSLRKGLKSYTNSEKSSSSKRIQMLLKEGVISKKQAASMEKTDTKYWNSHYSKASKSISKVTQSERNGGKGREAAISFANRAVSKLLTNNANKETIIYGRLKDRTSKLSQSQARSIIRSSYKTMQSTVSSANKTYKSAKSAANKKYESVRNAADKEYYVTGSITKKQHDKIVKSARSQRDKTISAARTTKNKTIDNAETMHEKVVQKTSAMVKGNLTQMNTWTGKMKGIWSKFGDWWGNLWGGLTKIGHLGAKAMASNLTPELEKTNSFLGKLKSGKKSPRKSKRTASTDASRLPGNVFASHALGTSGAAMHAHNALVAEGGIEMAYKVNGRKARILGSNGPAIAKVKPGERILNHKDTMKVLSGSYGKNLPGYSTGNTKLGGKQAKSDIDGLSKKNSQVWSKVSKTTSKHTKGIKKQTVGDYDALQKGSYKQLVQFDKGNTSKWRNINSHTKHYTNQSKNQAISTYDSMQKGVQKQVNQMQSGVISSGKATATGFGHALGKMDNYAHSAMSNTVHQLNGGIKGIDKVLGQFGGNSSVINAIHYARGSNGQLEHDQLAILNDAKSGPRQEAIVHQNGSLSLPSGKDTVRYLKRGESVLNGHQVKKLADQGIIPHFAKGSGVSHSELNKIISKNNAHPNKAFSNEFSSQISRSNTVLGNAVKGLSKRATTKYGNPWSTEVWHQMDNARSSEGSGAYGSGTWLHNPGNGFGVSSGFGYRGPVAGGLSTHDGVDFSGGHVVHAVHPGKVIRSGGALNGWGGPNGIGQNMVTKSKDGYYVIYQEFNGKNNSGAHTYVSVGDDVNAGQKIAALGPAGTHVHIGVSKHNPFSNNPDSTSGWFDVTKMRSTKAKKAAKKSKQASSALSKLVSKEIAPQLKWVKKHLRASNVGSLGLSGSIASRAKTLYDAIKAAYPSATKNGIEAVLGNWEFESGGLNPGISNSAGALGLGQWLDRGPALRRYAASHHMSWKNAGLQINFALHGDGANSSILKRILRSHGSVASLAAQFSTDWERGGYTSQHVNGARKIQAALHNNGGWSSKNKLNIYGEKDPEVAINPKKRNADSLIGSAIDARSKVSNSVFSNESQKKMHKALLENLRKYNPLKGLASHSKPAANANSNVTVNLNMNITVNADDKNAGEKVANDISRQVEEKVQAIFGQMMATQERGTA

SEQ ID NO: 5537 - protein, 659 aa, Lactobacillus buchneri
MAATSDVAKNAYNSALSVLDSTQAAYNQANSDYLESLNNQTDGAGLDIDESSHKLLAQYTSGTSPYIGSQYCVPYSGGYLISYNSGENTIYQQMDSSMKYVSKMIVVNGSHGSSFGIDGSGNIWASVRNNGYQISKFPYQAGSYINASSLEPLFSSQSLLRVNYDIANNLVGYTVDDSYCICDPSDLTNPKKTINISTMGFSVGQQTWQSQSLSWPYVFWQSGAYNSNSDPATVGCFNADTNTKEFVKSYLTSSYGMKYSYNEPEGIYSTGSAVLVTFNNNDNGSNSINYLFSIPTLTADSTVSERLKALNNLKKALADAKTAFNSAKSDFQKYQSTSKTIVKDTRIYKNATKDVKNQKKLVASTKKKIAIVTKQYAKATGAKKQSLKKQLDSLNKVYKEQNSALTTLKKKQSTAKSKLSKAQSKSSTAEKALKRSILKKEISAAVMTETGGKDVTWITPVNPGSKESYAVLWPDSEDFSETVNVNETSVIKHTPINTVTQAGTESISVGGALIGEDGDVPTLVKKFERVRKWAENTAEVQLIGQTSFTHAIISAIDKPHDTYLTNQIPLTITLQKVDWASSNIKKKKNSTKSKGKAKKVAGSGHTQKNSKSTVKTVTTKSGDTYYKFSQKYNVSVARLRKWNKYADRSIPVGVKLRVK

SEQ ID NO: 5538 - protein, 158 aa, Lactobacillus buchneri
LSLRDKLIVDMSDLPNYVILPIGTENFTIEFYYRERYDTLYFNLYDSDDTPLIMGEKLVYGMPLWNINDANLPSERIIPLDEAGVEDTVSIDNFQSSVFLYFDDLDPEVENPDNADQDDLDSDNSDLLDDDSGSSLIEDEPAMDNNEFALPSDWSDTK

SEQ ID NO: 5539 - protein, 410 aa, Lactobacillus buchneri
MNYVRLYRRVEIDGKKGKLTLKSYAKVPYNISMDIESSYASGSRETTTVTVLGMPKEDINYLAKGANARVYAGWYGENGISNNVGIIMEGKLASPTPSTVDSSGKSTTITIVDGSDYDKIAEIKKKVTTARSVSAQKTLDQTITAYNSKMNAQRRKWIDNHPNATSKQLRAYSHTIITKKNAFAKKKRQEYVKQKANHTAKAKVSKKTKYKPLSFAKNTKGSSIIKKIAKEAGIKIYKLKLVYDKKFTKGYTAKSKPMAAIKSVASQCKTPISYPNGRLEIADYSKNKKSGLHLNYDTGLLSEPEPQDDSDDGLQHYQVTALFRPYFTTGYIFYLESTVITGWVLINSGTTSITDDSGQSTLDVVDYSKYKKKNSQSVKKAKTKDQKAKEKLDAANRKKLKEKQRRRRKK

SEQ ID NO: 5540 - protein, 138 aa, Lactobacillus buchneri
MTKSRNYIREFMDQFKNDVMSDIHSAIRCKIVKVNADKTYDVQPLALFSDGAKRPQLLSLQASFIPIKIKYHDDIGDSHDFSPFYAEMTINYQVGDVVIVVFEDRDTSNSKGNDVFKIDSERMHDANDGVIIGKVDIK

SEQ ID NO: 5541 - protein, 122 aa, Lactobacillus buchneri
MTQDIYINDSGDFEQDDRGNVSVVSGMDEIAQSCKIALNTRKGGWTLDGDEGLDWSSVIGSNVHDQFVTAAIRDCLLEDPRIDEISLISFDRSEKRVLKVSIKIEVNNQLKEITWETGDIDD

SEQ ID NO: 5542 - protein, 385 aa, Lactobacillus buchneri
MIDENGYSPLNYDDALDTVQGFIRKENGEDTNVSSRSFWGTIARVLAQIAVNLDENCENVHDSGYIQQATGVNLDRIGGNYGLMRKQAEPASVTLSFTGTPGYVIPTGTVFMDDNGNEFYSVDDCQLDVNGVGTTIVVSSELGSQYNVDAGTIVNQQSPVEELDNVTNSQAAEGGQDMETDLDFRNRLLLASNSNESGTINGVYTALMNTQGVTAVKSVYNASISDNDSYGNPPKTVHYYVQGGTDQDVANTIFRVGGGGITLYGSLSKTVLDDSGSIQTIFFDRPQETPIYVKASIRVSDSFDQSEGTDDVKAAIEGYIESLKMGDTVVTNQFFSNIYAIDGINYADVAIGTDKGKLSSDNIVLTAFEIPTIDDDNVEVDYVSN

SEQ ID NO: 5543 - protein, 206 aa, Lactobacillus buchneri
MYQTSYDELYPQIFKMFDRGLAVGTGSNINTVIRVLSDFQLWLDNGAEMIQSSWIIDEAVGEQLDEIGDDIHQPRYGANDDTYRFILKTKILASHSGGTINDIINIVCNALQIDPKTSSLKVHTDYHWDGTKMVGNPQVVDIDQLPTSLISSNQTLLVLMDRLSSATLNGVTINTIAFMNNSKLIEYVGVGTQSIMVKEVNVKGGN

SEQ ID NO: 5544 - protein, 511 aa, Lactobacillus buchneri
MAYDLAKVTANGNNLIAQILANKSSLSIDKIEISDTQLSSTTDISTMTSVPKVVQTVSANGFSKNSNTLIISTVVDNSSISADYKAWVFGIWGSDSQNGQSQLIAVITSTNSPDTIPAFSGSTPVSYTYKFNIGFSNASQIQFNMIDDAFATNDTVVHTTGDETIDGQKKFKVDPVDGAGNAYAKTIDVNQQLDRKVNVSDMRKPASDVAGIEEVNAKQDKIGYTPADDSKVVHDNHDGTITASGTIFNLLKSLSATSIPQDPTKDYNTLPQGLALMSETNGEPANMPPVKSTYLTLTIASSFATGRKRQLAWLDAGANSSNNNYTYIRYCVGSTWSSWDSIPTSTQISSLIPSTIADTTKLANFTAGLQSGGVSVATSDDLKSVEKSAWHQLSMPDCNGMGGITLLYRNFISDHYMNLYAYGIGIQSNIQGPTMLDLSSLIDNIESVSGVATGPTFTYVSPNSGYAQLVASINKLKLGSDVSMEVNRRPVLISGNGSPFAKVTYDNWIGS

SEQ ID NO: 5545 - protein, 151 aa, Lactobacillus buchneri
MGKEKEHKKASFSESELRKMKNDLSNVNDLFYIFVALLTVFQTLYNSNSVLLVFTTSVYVTPVLIFYIEDYSLLAKYWEKEKHFHFSKGKIFKLTIWFLFLLTFSVIVTLLLCIYTFKSYKLFYVLIRFETLYTLFMIIVRTLVMRTLIWR

SEQ ID NO: 5546 - protein, 178 aa, Lactobacillus buchneri
MVTMTLIALLVIFAGVIFGTWLNANSFKDTLKIIFLIPIIYYFFVKQEIDADQKEMLQIFNLMLEKLLKPRTLSRIAAKSHENVKSVRYKIKQIERDLNSGKLYTRRKSRKFLRSHGMLSFTLLYAGLINMSQAGDLMEKNAGDILLSQTHRLSKEDYKKATPIFKRKILKKYGLPAA

SEQ ID NO: 5547 - protein, 105 aa, Lactobacillus buchneri
MPLSDQDHQMLLKHGKELSDHERRITDLNNKMTDTLKSVDESNKYLREQNNRILEAIIRGDEKSENHKNEMEVINRQNLWKVVTIAIGSSSVIYLILQQLMHFIH

SEQ ID NO: 5548 - protein, 71 aa, Lactobacillus buchneri
MLTKKYGTVSILFAANVADGGRTIDEVPTPFKADVQALLKTDELSSEPTLPAASTDSGNGFAKNDTQEVAK

SEQ ID NO: 5549 - protein, 170 aa, Lactobacillus buchneri
MFAILTKTFNYLQSTGVLAAGIAFILAVWKAVLPIAQSHAKTAQEKLFLTAVQGFVARYAQVQALSKSDRFAAVLNDALDFASDHGYTWAKSDLVKGIIENIYQDYKNAGKDVAPVITTPSSDVVKDEPETVAPSTTDNSTTDTSKSDSTDTVESDGASDIAKLEGEVEK

SEQ ID NO: 5550 - protein, 274 aa, Lactobacillus buchneri
MAYPIVVDTSAWQSDSLSFFTGLKTYGVSGAMVKLSEGVKYTSPKAANQIANAYKAYGVVGVYHFWHYGTNEAQYFLDKVKKMGLDKTTWLALDVEAPDLPQKCTAGINKFLGYLYANGYHNLMVYGSTSWFKEGRINQAKLHKYAKLWVAAYGTSQPGINHVDIWQYTDRFKGMSLDASYDFKNLLKSNGKSATPIKPEYYTAKGLYEVKTDLIHAYNKLPLKGDKNKRYVRLAKGSRFYGVAVKDGDIYSLKTQVGYLTANKDYVELIKEVK

SEQ ID NO: 5551 - protein, 219 aa, Lactobacillus buchneri
MECVSLYIDESGNFGSSGRYFTLTSLRCIDHSNFKLNRAVKKASLKIKKRYDGSVTRTGEVKASLCNPIAKDYMLRKIKKSVDRIDYITADLSYIEPRLLNNQNILYNYLLTFLISPIIKNNSDLSEIHIYLDNRSLKVGDEMSFSDYIKSKIWIEYDRPDISVSVHYVDSQSDYHIQGADFVANAINGFYEYNESYFTQILRSCMEVRVKFPYKYFGK

SEQ ID NO: 5552 - protein, 303 aa, Lactobacillus buchneri
MKTGTKIITLDNGYHLWTNTQGTGNIHLLALHGGPGGEHEYWEDAAKQLKKQGLDVQVTMYDQLGSWYSDSPDFSDPKNRKDILNYDYFLNEVDEVREKLGLDNFYLIGQSWGGLLVQEYAAKFGQHLKGAIISSMVDRIDDYTKHLEEVREKALTPEQVAYMKDCEAKGDYDNDKYQSYVDILNKGYIDRKQPSKLSHLIDVTNTDIYGAFQGDNEFVVTGKLAEWNFTDQLKNIKVPTLVTFGEHETMPIETGKRMAQMIPNAKFVSTPEGGHHHMIDNPDVYYDHLATFIREVESDTFNK

SEQ ID NO: 5553 - protein, 809 aa, Lactobacillus buchneri
MKINQFAYVPTDHHTIVKELADVHFLTAQTKKMADPVMLYRQFLLKFFIEKQSLATRIQKVANLMATPTLNAYEFTTTQAAVSKLAFYNVGLQLLGFEVGLDFELNDPFSAMKKYRLPMAVVDDTLDRNQVIDAWYKLLNTRTKFGQTLIDYLAGQGYYHQFFGTDELKQPLIFNGKSQAVFDTTKLIRDVVYVEAPLDNDHDGKRDLLKTEIIRPGETENGLKVPVIFTASPYDQGTNDHQADQMTHDVNQEKLTRKQPNHLSYEDVKFDYDNHDLPEPRTIKDTNKVAEESFVKTWTYSLNDYFLARGFAVVYSSGVGTKDSDGVRTTGTPDETISATSVIEWLHGDRTAFTNRSDQIAIPAWWSNGNVGMTGRSYLGTLSTAAAMTGVDGLKTAVVEAGISNYYDYYRENGLVVAPGGFQGEDTDVLGELTFSREQSAADYLKIKDTWLAQLKKLTAGQDRVTGSYNSFWDNRNLLKNVNIKADMLLVHGLNDWNVKLSHVYNLRKTLKNEKITQKLVLHQGQHEYLNNFRSVDFTDIVNLWLTNKLLAVDNQANQIVPDVLVQDNAEPETWNTYKDWGGNVKEIPLDDKRWTDLNENHSFSDQLPDDLFKDYIENTKKWQKALFTKNHSKLDKHSIKLVSEPLDQDITVDGRATITLRAASSADLGLLSAALVDYGVEKRLTAVPQILSAQQIITGYQWRKDDLKEFLPEKKASAYKKFTDAHMNMQNRTNNYQSDDLKPGQYYNFTMAFQPTFWRLLKGHQLGLIIYATDMDYTIRSNQDISYTVDLSASKIELPLLTADDNQG

SEQ ID NO: 5554 - protein, 407 aa, Lactobacillus buchneri
MTVYDNQSTAELIHSLTQIDIAIIQKDGTPVVQIQENVLPAFHRLNEFDPIFQQIEQFHANEYLTYTDSAQLSYVAARLDQPDDQVVVLGPFLTTTLTIDGINDIVAMNSYTISEHRQLTQLYQSLPVLAEDKINDLATLMTNLFSRQLATAHEKAKVTHGPQPIERSLMTVNSDHRAQIEANYANEAKITNAIASGDQVAVHRLNTTMTKIFDSFSNRIPGKPLRSSKNICFVFNTICRIAAHKGGVHPVYLNDISEKYALLIERQNTLQGLHILVHSMTREYCQLVLTLSTSGYSPMIQRAADYILLNLGHPITLNQIAQSIGTNPSYLSRKFKQEVGMTITDYVNHRRIVLAKQYLSRPTPSITDIALMTGFNDLNYFIRVFKKLTGQTPLQFRQKPTGSGIQK

SEQ ID NO: 5555 - protein, 603 aa, Lactobacillus buchneri
MLYPLTTPSRTVLDLSGLWKFMIDEEITPIDPKRPLPTEDVISVPASFNDQTASKKIREHNGFVWYETNFDIAKPLRSQRLVLRFGSATHEAWVYLNGQEIAHHKGGFTPFEVEINDYLKDSDNRLTVKLSNILDYTTLPVGNYSESTDQDGHKLRHVDENFDFFNYAGLQRPVKIYSTPADYISDITVVPDVHLAESSADVQVKVATHGEIDGVKVTILDQDGQPVVSGTSADTTLHIDHVHLWQPLNAYLYTAKVTVSRNGEVIDTYSEDFGVRKIEVKNAQFLINGEPFYFKGFGKHEDSYVHGRGINQPVNVLDINLMKDMGANSFRTSHYPYSEEMMRLCDREGIVVIDETPAVGLMVTFGFDVSMLESDDYQDDTWTKLKTADAHKQVIKEIIDRDKNHACVAMWSIANEAATFSKGSYEYFKPLFDEARQLDPQKRPCTYTSIMMATPKTDNCIGLVDVIALNRYYGWYVGNGDLKMAEQATRDELQEYSDKFPDKPIMYTEYGADTIPGLHSNYDEPFSEEFQEDYYRMASKVFDEFPHFVGEQLWNFADFQTKFGIQRVQGNKKGIFTRSREPKMVVRYLKARWTKIPNFGYKK

SEQ ID NO: 5556 - protein, 480 aa, Lactobacillus buchneri
LKTEKLKMREKVAYGLGDLGNGLMFQFAQLFLLKFYTDVLQIPAYWGGLIFLIAKFFDAFVDTSVGAFVDSRQHISKRGKFRPYILYGSLFLGIATVACFVTPNFGETGRIIYAFVSYNIMGFCYSVVNIPYGSLAAAMTMDSGDRTSLAAARNLTGQMAALLTGAVVIPLVAIFATPKIGYIATVAIFAAAGVVSQILCYSGTKERIIDHKPRQKGDGLKSIKGLLTNRPFIILSIFTILSVGSMFLKMGIQLYYFQYVLGQVGIVSIVSLLSALSIIPAVIFATPLVKKIGKKNVAIYATLGFIAAELVNFFITGSHVVPYLIVNTISYMFLGFSGTVAFAFVNDVIEYGQLQTGIRSEGIIYSGYSFVRKIAQGVAGFIPGLALTMTGYVANQPQSASTISGISAVYFLVPAIASAISCIVFYFGYDLTDEKHAEIVKELERRETNRKQNEHLDVIDDNSVVDSLNSEVPNTGMVNH

SEQ ID NO: 5557 - protein, 402 aa, Lactobacillus buchneri
MSTIIAALKESGDENRVAITPDVAAKLVHSKFEVMIEQGAGQNAYFSDQAYQDAGAKVVSRDDAVSQANVIATVDLPDSETLGKLHEGQILIGLLKALTDLDSVQKLAKQKVTALSFELLPRTISRAQSMDVLSSQASIAGYKAALVAADKFARYFPMMITAAGTAKPAKVLVLGTGVAGLQAIGTAKRLGAIVSGYDVRPASRGEVESLGAEFLTSSVSAVGEGGYARQLSADEQKQQQDELIGFIKQNDIVITTAQVPGRKPPLLVPQAAVDNAKPGSVFVDLAASDLGGNVAGSKPDQTVITDSGVQLIGAGNLASEMATSASEMFSKNVQAVINDVADKDAQITIDLKDDVMSQLVATDHGEIISERVRKALNLPISKPAEDDAAPADSDDKSAEKGD

SEQ ID NO: 5558 - protein, 106 aa, Lactobacillus buchneri
MSQELYTNLAIFVLSLLVGFEVMSKIPSTLQTPMMSGANAIHGVVVVGAFVIAAEASSWYFYLLAFLAAFFAAVNVAGGYTVTDRMLGMFNRPKKQPNSADKGGDK

SEQ ID NO: 5559 - protein, 472 aa, Lactobacillus buchneri
MSLLKTIASLIYLLSAVCYVIGVHMMRSPKTARNGNLLSGLGMAMAVVMILVEIIAKGQITLIGWTVLFAGLLIGILYGVIRARKVPMTDVPQLVSLFNAVGGGAAATIGIFDYTHEAVGTSLSLAFSIPVLLDIIIGGITFSGSLIATGKLSGHVPGKPISFPGDKLINGLAVLAIIVAGVWMIGFPSAYWPMVLALLASLIFGLLMTLPIGGADMPVVVSLLNAFTGLAVAFAGFVIDNQVLIIAGALVGAAGTILTLQMAEAMNRSVANIIAGGFGSGDSNGSTGAGAEVPTNIKKTTPDDVGMQLAYAHNVMIVPGYGLAAAQAQHEVAELAKLLTDAGINVNYAIHPVAGRMPGHMNVLLADVNVPYDQMKQLDEANSMFENTDVSLVIGANDVTNPLAREKGNAISGMPILDVDKSKSVVVIKRSMSTGYAGVQNPLFSEDQTSMMFSDAKKGLQEIIAATKGYLD

SEQ ID NO: 5560 - protein, 713 aa, Lactobacillus buchneri
MERSKRLLNFLLMITTTAILMFVGMVLNNQTPMVTAANAATTQDEQTIDKIMPNEKLRELVLINMKDQKIIQDPNFTLNDFTPTTFKEDLAKLTQLGWEIGTNEQVDRQEPVNGGNGSVGPANKGNYSLEGLEYCTNLTKLELNADLNRGSKFHHDDIIDVSPLEGLEKLEYINLSGNRIQDISPIAGLKNVKTLYLNNNCINNLNTLDAEQYTEGFNYLEQIVIKPLQVLHSNTYTWKAPFVDALPKNVKTEDNKPFQPYQQKFLRPGTLAYGNPTDTKYSQIDVFRNGTRGTGVAQGTTTINGDDFTYTNLAPQIIPTDPTNPWASYYPNATVVNNTYTYYMIAQYNVYPGEPLYAALSYFMPYVIQPEEAQPVTVEYVDTNGNSIHASATIKGEIDQAFDLSTADYKLNIPGYTFSKYYPAQTGKITGEKQTFKLIYTKNSTPVNPTPPTTPTPNPPTNPETPTFPVHPTPPSGTQLPNYAKTTGEVVYSLKKIYLYKNPTFKKAERLVGYTQKPRVFRPMFVVTGYSYSNAGRLRFKVVDVNHDSPTAGMTGYITTKSSFVSPVYYQAVPKFITVISPNGVIEYNEKDLTKPVQTFKQGRILKVESITTHNLTTRYMLGNGNFITANRKLVMNGKQKQPTRVVAKKTINRYTTANFTKKNGHYKKGAKIKVNFYTYSHDASNTKSGAKRFAVKGGYITANSKFVKVYYK

SEQ ID NO: 5561 - protein, 379 aa, Lactobacillus buchneri
MAFVGQIALILIATLLAAAISQRLGMPAVIGQLIAGVILGPGILGVLHNTELMHAGAEIGVIILMFIAGIESDLDLLKKYFKPAISVAAIGVLFPMIVFYGYGQIMGQGFERSIFWGVIFAATSVSISVEVLREFKKLNTKEGATILGAAVVDDIIAVILLSIFVSSFGVSGSGSSNLLVATLYQLMYFLGVIVLVKWVVPVVLRVAERLPVHGSVAITSLVICLTMAWSADALGLSSVVGAFFAGVAVSQTKFQDEISSSVSSVGYTFFIPIFFVSIGLDMEFNNVIKNLGFIVIMTILAIATKLFGGALGAWITKMNWSSAFIVGSGMVSRGEMALIIAQIGLSANLMAKNLYSEIIIVIVLSTIVAPMLLKKTMKV

SEQ ID NO: 5562 - protein, 143 aa, Lactobacillus buchneri
MVTEYASGAVVYEIRDGKIWYLLLQSATSDFWGLPKGHVEKNENLIQTAIREIREETSLKTQIDANFKEKVEYDMNNGHHKDVTFFVSRVAPEVKVRKQDEEINSFGWFDYEDAYEKLTYDNLRQLLKHADTYIRNKENIEEA

SEQ ID NO: 5563 - protein, 184 aa, Lactobacillus buchneri
MKNRVFVITGAAGSGKTTVRDYLHDQYQMARVITHTTRPPRENERDGVDYYFEDDQSFFDNHFLESVHYAGHYYGSSYEGLENAWEKSPFATIVLDTAGAITYKQKLGEKAIIIFLQVGDTEELKRRMQGRGDNAEMVAKRVSSKEYHRDLEMPHELQGKAYQVVNQDWQQTRQQIDKIVENYR

SEQ ID NO: 5564 - protein, 147 aa, Lactobacillus buchneri
MPAAIEQATKVLKENNFKITKQRRAMIEFLVGTATHKFVEVTSIDDFMRKTFPNMSHNTIYRNISEFANLGIVERQVQGDRASVKFQCDFQHEHHHHFICSNCGKVIELKDCPLSPEITSQLTGCEVTGHLFQIYGLCPQCVNLMNN

SEQ ID NO: 5565 - protein, 199 aa, Lactobacillus buchneri
MDNRIPPLITPFAILSISLALGATNVVVNNVTSTNEGTPRTTQTTNQKKISDSIYGNKKKTNDSDAKEKAEKAKEASEKKKAAEESSAAKASSEKAESEKNASSSDDQTNDDTTNNNKNTTTGTTTNKGTTTNKGTTTNKGTTTGGNTTNNNNSDQNTQTSSDSSNQTTGTTGGTNTQNNNNTNANADVTTGNTGEGTN

SEQ ID NO: 5566 - protein, 274 aa, Lactobacillus buchneri
MFSFLDMVNHYLGYFNINVTLKSRIYTVLGFFGDVYLFYISFRFLQNQMFSKGVPILLVAIILLYFTICNFFYYFTKKQPWFDISPKIAKLLHIQEHPRETQVQSKMGTTVIADERNVPANGLFDDQHLLPAKIEVSPMQQANIDRLVAQMERQQLFRADYNGMSDRKIYELLKVNSKPIYAIGKGVLLPYFEMQKQGSSLMVYCGLNQAEIYPVGEIKRIGLQSIRSLDLSQVKLYLASVTLVGGPYKQIGRAGVIEAPQDYKLRAMVAYKKL

SEQ ID NO: 5567 - protein, 222 aa, Lactobacillus buchneri
MRINVLQHVADEGPGSIQDWAHAKGHQMYIYHPDQFGLLPTAAQTDMLIILGGPMSPNDDLPWIQQERELIQQLLDAQTPIFGACFGAPQIAKVLGYAVSKGPAKEVGWAPVYRKSDVIPGLPEQLTALHWHEDMFELPDDADLLFSSDHLANQGFVLNHQVVGLQFHFEPKEDNVREMVVNDAAYIQGSVLNQSADEILARQVPAENKNVMFQILDYISEN

SEQ ID NO: 5568 - protein, 246 aa, Lactobacillus buchneri
MAMIEFQDVQKYYGDFHALKDINLKIEAGETVVLIGPSGSGKSTLIRTVNGLEPIQEGKLIVNGQDLANKKTDVNRIRKNVGMVFQHFNLYANKTVLENIMLAPRIVLKRPEKENKELAMQLLDQVGLQSQANKLPAQLSGGQQQRIAIARSLAMRPKCLLFDEPTSALDPEMIDDVLNVMKDIAQDSDMTMLVVTHEMGFAREVANRVIFMDDGQILEDDTSDKFFDGEPSNERARQFLGKIITH

SEQ ID NO: 5569 - protein, 193 aa, Lactobacillus buchneri
MKKIISRIGLLLTLLLMVVSLSACSSAASQKNVLKDDKQTKTITWGVKADTKLFGLMDVRDNQIKGFEIDLAKAMTKQILGKDGKARFIQVTSQTRMPLLRNGNIDAIMATMTITPERAKQVDFSRSYFDAGQAILVKNGSPIKNVKDLNHKGAIVLGVVGSNSVQNIKKFAPKARVLQLSDYSQKLSKIYDF

SEQ ID NO: 5570 - protein, 302 aa, Lactobacillus buchneri
MIKPEKTINGTKWIETIQINAEERATLEDQYGIDEDIIEYVTDKDESTNYVYDINEDDQLFIFLAPYALDKDALRYITQPFGMLLHKGVLFTFNQSHIPEVNTALYSALDNPEVKSVDAFILETLFAVVDSFIPISRGITKKRNYLDKMLNRKTKNSDLVSLSHLQQTLTFLSSAVQTNLSELNRLPKTHFGVGADQDKIDLFEDVQIEGEQVQRMFEIETQVVDRIDHTFNSIANNNLNDTMKFLTIWSLTMAVPTIITGFYGMNVKLPLAGMQYAWMLTLGISVALIVAMLIMLKVRRKM

SEQ ID NO: 5571 - protein, 461 aa, Lactobacillus buchneri
MRESVEMKEPKKKFFSSTEDAGDSKSLDEVNGSIIVPQDAGFWRTLITYTGPGILIAVGYMDPGNWITSIAGGAQFKYSLLSVVLISSLIAMLLQSMAAKLGIVTGKDLAQLTRERTSKRVGFILWIITELAIMATDVAEIIGSGIALELLFKIPLVVGILITSADVLILLLLMRLGFRKIEAIVATLVAVILLVFSYEVFLAGPNMPELFAGYIPSTSIVTNKSMLYLALGIVGATVMPHDLFLGSSISQTRRVDRKNRKDVAKAIKFSTIDSNIQLSLAFIVNSLLLVLGAALFFGTNSSVGRFVDLFNALQDSHIVGAIASPILSMLFAVALLSSGQSSTITGTLSGQIIMEGFIHLKMPLWAQRLITRLLSVTPVLIFAIYYHGNEAKIEGLLTASQVFLSIALPFAIIPLVMFTSNKKLMGEFVNHTWVKYAAWFATIVLVTLNVYLILQTVGLLK

SEQ ID NO: 5572 - protein, 212 aa, Lactobacillus buchneri
MLNGTELKLFADANVLNAMTDKQVKILLAAIEVFAEKGYANASTKEIATKAGVSEGNIFSKFKNKRGLLNAIIEPVINSIFPAVLTEFKTDQLPLQFVTLHAFVDSLVRDRIQFLKDNAAVLKIFVSEVLYNETVRKELLTKFPPLYWHNINKNLNQLKDNHLIVNWENLEILKIIWSVVGGVIIGYLLFNQPLEQREITHIIDALVKSLAR

SEQ ID NO: 5573 - protein, 464 aa, Lactobacillus buchneri
MKRNDNGLLYGPDDKVSYFQSGLLGLQHVLAMDVYVPPIIIAGLLSMSLAQKTGFLQAAFLACGIGTILQTRYFMKLPVSQGPSFVPIGAVAGVYLANGAANGGMATVLGSLIVGALLLILLGVSGVYQKIINTLVPAIVGGTIITCVGLSLLPSALNDNIFKAAGNVNQNIEIAAITALAMLVAITIGIRIPQLQRLFKVSSIIIALIVGTIVASMMGRFDWSVVNNAAWISLPHFTSLHYGIHFSLPAILTFVVIYMVLTTETTGTWFAMSAVVGEKITKKQWNRGIIGEGLSCLFAALLGTTPMTGYSTNAGVVSITGVASKRVFVSAGIWFVVLGFFGKLSAFLSAVPAAVIGGIFSIICVIIMLNGLNVIRNLATDESSIYVLGIPIVLTMAVILLPAKVVSETPQMVQYLLGSPITIAALSAIIINLVMGNRKVSEATEDSEEIKSTDAPKEQLAESK

SEQ ID NO: 5574 - protein, 164 aa, Lactobacillus buchneri
MSKSVNWKAALIAGGVAGVISGLVKLGWENVLPPRTPERNKTNPPQRLLEQAGIPEQVTHATYTYSDQQLPWVSYMIHFGFSTSFAMFYSLAGHYVPVIKMGDGTLFGLGVWGAFHLGIMPAMGTVPSAKDQPVEEHVSEALGHVVWMWTNDLIADEVYHKLTK

SEQ ID NO: 5575 - protein, 67 aa, Lactobacillus buchneri
MEQGTVKWFNGDKGYGFITLEDGKDVFVHFSAINADGYKTLEEGQKVTLDVEDSDRGPQAANVTVVE

SEQ ID NO: 5576 - protein, 287 aa, Lactobacillus buchneri
MNVLLMLLPAVGWGLLGPVVARIGGKPANQIFGTAVGTLLVAAVMTLFYHPHLSVPTFLAAVLAGSFWVIGQVGQFISFKNIGVSTTMPTSTGFQLIGTSLVGVVIFGEWSTMMEKLLGAGGILILIVGIMLTSVTDKPLVAQRTPQKKLPTILMLLMTTLGYVVYMAIPRGLNHSGLAIFFPEAIGILLAVLVYVFVTGQQRIIKEPVSWLNIAGGLVFSLGAISYIGSVQANGVNSAFVVSQLAVVISTLLGMIWMHETKTPRELAFTIFGLLLIVSGAVITTVF

SEQ ID NO: 5577 - protein, 216 aa, Lactobacillus buchneri
MINPVPLYKEMFQQMGPQHWWPADSKMEIVIGAILVQNTNWNNVDMALTNLKDETHLDVKQILNLPTETLQSLIRPSGFYVNKTRSLQAVLKWFDQDDCNFALMADKYKSDLRRTMLKLPGVGEETADSLLVYVFDQPAFIADKYARTLFTDLGFRNLGNYSKLQKRIWLPESFTYQDAQEFHGLIDEFGKRYLKSRRDFDASFLGGFDKHQLDRP

SEQ ID NO: 5578 - protein, 205 aa, Lactobacillus buchneri
MTEQEKMLAGKIYDPTDPLLAAQQHQAHRLSKRYNDTFDEDTEERAKIVAELLPNADKGIYLQGPIFFDYGIYTTIGDHFYGNANLTILDDCPVTIGSNVMFGPNVTLATPMHPLRYQDRNLKQRSDGSEYDDEYAKPITIESNCWLASNVVVIGGVTIGAGSVIGAGSVVTRNIPANSLAVGNPCRVIRTITADDDIHLKSNLF

SEQ ID NO: 5579 - protein, 497 aa, Lactobacillus buchneri
MSKKKITLVGLILMIFTTIYGFANTTVAYEQMGYASIIWYVLAAILFLLPTAMMFAEYGSTFKDAHGGIYSWLAGSIGEEWAFIGTFIWLSSWIIWMMSTASKVWIPFATTLFGHDTTQSWSFFGLSSTKTIGLLAILWIITVTWFAVRGMDSISKISSVGGIFVSLLTVIFAIASVTVLILNGGHLAQPVTGMHSFIQSPNPDFQSPIALISFMVYAVFAYAGTETLGGVTDNMHEPEKTFPRGLIISTLVITVMYSLSIFLWGITANWHSVLGNGHVNLGNITYVLMANLGVVLGQSLHLSAAASTILGTTFARFAGLSMFMAYMGSFFVLVYSPLKSFIMGSNPNFWPAKMTKLNKKGMPGFAMWTQAVIVAVLIFFVTFGGSSAKQFYVILTNMGNISTSFPYIFLVAAFPFFKRKQNLERPFEIYTKRWMTDTISIIVLIVLIGGIGFTAVYPILEHDYVNAFWTIIGPIFFGLVAWAFLTYQSHKLRKKAH

SEQ ID NO: 5580 - protein, 229 aa, Lactobacillus buchneri
LAKLVLIRHGQSEWNLSNQFTGWVDVDLSEEGVKQAINAGKLIKKAGIQFDFAFTSVLTRAIKTLHYALEYSDQLWIPEVKSWRLNERHYGALQGHNKKKAAEKYGDEQVHIWRRSYDVLPPLLKADDEGSAVHDRRYANLDPHIIPGGENLKVTLERVMPFWEDEIAPKLLDGKNVIIAGHGNSLRALSKYIENISDEDIMNLEMATGEPVVYDFDDKLNVVSKTKLD

SEQ ID NO: 5581 - protein, 349 aa, Lactobacillus buchneri
LSIWARFVNNVPLRRFTVLMLVIFVLYVTRSMISTVLLTFIFCLLVVKLTNAIRRHIKIPAGIIVTFVYLLVILGLYFAVTKYIPKIADQTIRTTQDIILFYTNPKNLPDDTTMSWLNELVKQSNIMAQMKNGVSLVWKYVTGVGTMGITLFLSMILSFFFAIEQRTMTRFSKLFLESDFGWFFQDLYFFGKKFVATFGVVIEAQFFIAICNTVLTTIVMAFMHLPQLAALALMVFILSLIPVAGVIISFVPLSLVGYSVGGWNDVFYLLITIIVVHAFEAYILNPNFMASKTNLPIFYTFVVLLIGEHFFGIWGLICGVPIFTFFLDILGVKKHEGKLDKVPTKPGEP

SEQ ID NO: 5582 - protein, 300 aa, Lactobacillus buchneri
LKKWIWIVIAIVIGASVGGYAYARHSQNEKIYAEAMQRGRLQISNEKYTAAETSFTNALKRKPNDDKADKILNQTQSFISANDLFDDLKFGQAKSEYQSVVDTKKGNELLSDRAKAQITKIKGIQNNRQNYNKIYNQALDQAGNGQYTESNSTLDKIFSDKSIHQKYYADILKKAQTLRDKNNDAISGNASASSNSFDSSTSDSNTSNNPNVSGAKGASLTSSEKKAAAAYKGSNEYTVTKGDRDLDGKPITAAQITSARKQISAAGVDSNAMSDQDVRNVIKGAHKNGETIGQYVKARY

SEQ ID NO: 5583 - protein, 126 aa, Lactobacillus buchneri
MADSSEEYIKQHMFGNPQIKPDEKRAFLGNFRERVALALTIGQLQQAGTAEMVTKILKNYPEYRLYINGRMDQDLIDPFMDIAIKENYKYTILVQNGMRVDQRLSPDDFGLVVANPTEKIKRRILL

SEQ ID NO: 5584 - protein, 110 aa, Lactobacillus buchneri
MEWNTTQHVWLILGCFCVAFAPRLIPLMFFRTRKIPDWFNEWMRYVPISLFTALVVKDIFISPEYTVTIVNRAPEMIAAVIVIGIAYWTRSMAISVVLGLVAVFLLAMVV

SEQ ID NO: 5585 - protein, 263 aa, Lactobacillus buchneri
LGKAVAKSREKLPYWRRILDASLPVDLSYIPIGLACGILLNASGFNVWTTLMVSIMVFSGGAQFLIASLLATNAPMLSVILMMFFLELRYALLGSSLSKYLHGESLGFTALFAASMNDENYALNYLKFSTDKKFTPHEALHVEHMTLIFWTISNIIGSLIGSAINIDLTIVHFALTALFLYMIVVQLKNGLIIVICILSGFLAAFFMVLTKSTLGLVLSTLTASFIGFLVEATIRKYKPKSGWLRPMKNPAGSPEDADEDADD

SEQ ID NO: 5586 - protein, 421 aa, Lactobacillus buchneri
MKHRIKILTALMGFFCVLTLSMTVDAKSTVTPEPAIYAKSAIAVDADSGQILYQKNANQPRAIASISKLMTVYIVHQQIKANKLAWDDKVKISSELAKLSTASGLTNVPLTAGKAYSVRQLINATLVESANAAALALGQKVAGTATKFAALMNKTARKIGISDGHFYNASGLTNKLTGKLALPHVSANAENRLSAKDVALLAQKLLQKFPKVTNITKQTTSTFYGTTMTGHNQLIDDHNLGQGVRVDGLKTGTSDKAGACFVGSATTNGKHRIITVVLGARNKSASDPARFIQTAKLMKWVYATHQPIKLAAGATIAGVGKAKIPDGKQTTILPVTKTTHWVWADKGTSAKQISGQYVNQPAKLTSPTKKGTEVGHARLSIDGKRLQYIGHSAGKLVMVTNQSVKKANFFVRLWRAILRLF

SEQ ID NO: 5587 - protein, 388 aa, Lactobacillus buchneri
MKLTGREKTELFLEGVVTVILLLLLNLSVIILINQSISTNPGLRDGIFIIKRSILIGPDHMHLWSWENIFIVLLLLFDGAVVYWRLIRRYHQIQLRHIISELHYIANGHLNHRIPFKLSGNTQSVVESINALVDSVIKSMDEERAIESSKDELITNVSHDLRTPLTSILGYLGLIRDKQYHSQEDLLKYTEIAYLKAKQMKSLVDNLFEYTKVKQTGTPLSISKIDLNQMMEQLVASFELEADKSGLAIAAKETDKPLYIEADAEKLGRVFNNLISNAIKYGKGGHHIYLSAAVGQPGEVVIHVANDGPEIPQKSLDQIFERFYRVESSRNKDTGGSGLGLAIAQSIIDLHGGYINVSSDEKLTTFAIHLPVQHGDKLSKKPRQKIAE

SEQ ID NO: 5588 - protein, 229 aa, Lactobacillus buchneri
MKILVVDDDKEIAQLLEIYIRNEGYEPVSAYSGQEALTRLRTESDIGLMILDIMMPGMNGIEVVKEVRKDSQIPIIILSAKTEDMDKIQGLISGADDYVTKPFNPLEVMARVKSLLRRTEEHVTNDTPDVLDIGPLTINKDSHEVKTITGTPIQLTALEFGILYLLASHPNRVFSADEIFERVWRQESIVSAKTVMVHVSHLRDKIEEATNGEKVIQTVWGVGYKIESH

SEQ ID NO: 5589 - protein, 88 aa, Lactobacillus buchneri
MDYSESKKYVTVQTNPLRSEVGDGTDGIFMNVTYFGKNASKYHNALISFSYWWNNLGDIPESNPEGSVVVFKNGKVSFSDSLYNKLPD

SEQ ID NO: 5590 - protein, 321 aa, Lactobacillus buchneri
MTKYYLGVDLGGTNIKAGLFDEDFQTVQKLHKPTHEEAGPTEVLNRIWACCQQLMAQEKITSDDILAAGFGIPGQMDVEKGISIFSPNFTDWKDVPVAKWLQDKLGQPVFIDNDVRVNLYGEMAFGAGRGHRNVVLVTIGTGLGAAVLINGQVLYGASNSVGEIGHMNMYRHGRPCACGSTGCLGRYVSARGIVKTMQEKLADGQTSLVGEWMSQGQELTTKLISKAVAKGDPTAVEVFKETGELLGFGLGNVINLFNPETLILGGGVSAAGEPLFKYTRETLAHHSLPVAREACKLETAQLGDEAGMVGAAVYAGQKVRA

SEQ ID NO: 5591 - protein, 53 aa, Lactobacillus buchneri
MVNNIWLRWFFVLLYLVMGILLYLGMNMVVMYLMVIGMFLEALCSLIGYYHSK

SEQ ID NO: 5592 - protein, 56 aa, Lactobacillus buchneri
MNLTEYLHSQLKFLNDQMSSAKKDKDETMQYLVDSKITEVKLILEALQKGIIDGIS

SEQ ID NO: 5593 - protein, 264 aa, Lactobacillus buchneri
LITLKSPREIEKMAESGAVLAGVHKELRKMIKPGLDTWDIELFARRYIKDHDAYPSEMGFDGYKFATCISINDEVAHGIPRKGLKLKNGDILKVDMCVNKDGFESDSCWTYAVGDVSDEIKKLMEVTRKGLYLGIDQAVIGNRLGDIGNAIQTYVEDQNHMGDVRELIGHGIQPSIHEEPNVPAYGVPGQGLRLKEGMTITIEPMVNTGTWEIADRYDKKDDWTYYVSADGTPSAQYEHTLAITKDGPKILTSQDPDIDAKYLL

SEQ ID NO: 5594 - protein, 166 aa, Lactobacillus buchneri
MNNKNFKFPDTAAYEFVIQALKDRGVTYEDIAEMAYNLQKKFVPNIQMDEVKKDTIDVLHKREVLNNAMVGLELDRLATEGKIKEPLESIIMNDSGVFGVDEGIALNIANIYGTIGITNYGFVDREKTGVTKKLDEAKDGTSNTFIDDIVGAIASAVSAKIAHRNN

SEQ ID NO: 5595 - protein, 207 aa, Lactobacillus buchneri
LDQDPFYSNGTTDEISKKLLGMLLTYDSPKGLVGGRIVETEAYMGQKDSAAHAFKGRRTASNEPLYGPPGTVYIYSIHGRYLLDVAAQAKDVPQGILIRAIEPTIGLAVMEQNRTRHGVELTNGPGKLMEAFGIADKDMNMEIFGDSKLNIHQDDKKIPIQIEESNRIGVANQGTWATKPLRYFVKGNPYVSGIKKRDYDQKSHGWR

SEQ ID NO: 5596 - protein, 122 aa, Lactobacillus buchneri
MQLKLERIYDKPQDLSGYRVLVDRLWPRGISKVNAKLDEWEKEIAPSKELRTWFSHDPEKFPDFKEKYVAELDANPQTKDFVKLIGDQLKNGNVILLYGAKDREHNQAVVLKQYLTDHLGQL

SEQ ID NO: 5597 - protein, 224 aa, Lactobacillus buchneri
MTDFANIKGVLFDLNGIITDSWRYHSQSWRQIAEGIGVQWNQDLEEAIKGRDRIDSLNEILRVGGLVGKYSDQQKEALADKKNAIYQQMLEIMNPDDILPGIRDFLAELRLNHYQMIIASASANAPKEIHKLELEDYFPLIVNLADIKHNKPAPDVYLKAAEMLHLNVDQCIGIDDGIVGVESINAANVVSIGVGDPEVLTMADINFESTKELTLANIRQSWPK

SEQ ID NO: 5598 - protein, 146 aa, Lactobacillus buchneri
MSNINLIPYLTFENTKEALDYYQTVFGATDVQRESPTEKQAQDMSLNDDVNLDDLTMQASFNILGKQIFCADSFLGKPVISSMISLMFEVDLHDSDALSSLQDLYERVVESEEVKVIVTFEKKTSGNKYGQIVDKYGITWIFNAVK

SEQ ID NO: 5599 - protein, 187 aa, Lactobacillus buchneri
MKLAITIFVLNALYISINTFRTMLVVKGHQFLAPIVAVGEEFVYVMALAIALQHIDSPLNIAAYAVGFGVGIYIGIVIEDKIALGYVNFEVTVQIDPTNPIHAHNEELAEKLRNLGYGVTVSRAEGRSGARLVLSILAPRKADRRLMEQIKEISPDAFVMVQEPVQLSGGFWSKEVDRRYHSTNHMH

SEQ ID NO: 5600 - protein, 303 aa, Lactobacillus buchneri
MKYYAVKKGRKTGIFTSWDEAEKKVKGFSGAQYKSFKTEAEANAYLNGAKKTTSPTKTHHKSHKKASTGRRSVQPDGDIIVYTDGGSRNHGNHRGGHVKASDKAAWAFLVQTGSQKYFESGGEFGATNNRMEIMAFLEALKYLKRQGLQNERIGVVMDSQYVLDAIQKGWLAGWRRRGWNKSDGSKLHNKQLWQAVDANLRDFPIIRYYWTKGHAGDEGNVFVDHLLNQTMDQMGQPDPQASPAVTPDKQGPQPIPKPQPIKQQPTPRQPKPIHRKTAPTTPTSVQDIENSLKQLGLFDEDDD

SEQ ID NO: 5601 - protein, 165 aa, Lactobacillus buchneri
MTQTKATLISVIEAKALLKDQSDQINERFPRLKKQGKYILPDYRLTRKREAFKIRKHTFLQHHARSYVAFDSENGQTLWMHNFPSLTEALFWLDTGLKPTDTDTNTSYKSWKDLHEDDINALKDILKERSRKRKEAAAAKKAASVPKKKPAAVKKSTVVKKKKAN

SEQ ID NO: 5602 - protein, 287 aa, Lactobacillus buchneri
MTFTPVKLGERDKVIQNIAENVRQGKFNQKVELHDPVLTLTEQHEVLDHFLKLHQTKRYHWRAAEARSVMNMAARMMNPNLKVEGTDNLKALEWPAIITCNHFSPIDSLLVRSALNQPDLSIVVELTNLKMPGMLGFLMTYADTIPVSDSVNYMGKGFIALLQSSLARKQSILIYPEREMWFNYRKPRPLERGAYYYAVRLNVPIVSCFVSMVDAPTKSDPHGINYTVHVLPPIYPDAVEKSTTSQREAAEKMRQIDYQQKVAAYEKAYDRQFTTDFSPDDIAGHYQ

SEQ ID NO: 5603 - protein, 316 aa, Lactobacillus buchneri
MENQTVPIFYAVDDNYAPYLAVSLSSLVAHTSPDRHYQVIVLCDDLNTDNQGRLKAFETDNLKIQFVSINDRLKQEITDKNNKLRSDYFTFTIYFRLFIAELFPKLDKALYLDADTVVLKDVGELFDTQLGDNLVGAVPDHFIGHTPETIDYAEQAVGIDSQKYVNSGVLLMNLAEMRRSKFAEHFLQLLNKYHFKSLAPDQDYMNAIARNRIYYLNPSWNIQITTPQDVEPWLIHYNLFAKPWRYDDAPRQSYFWTYAKQTDYETMLKQQLADMNPKEVARDQKNQSDLIQLAVDIIKTPTTFYARAKQGVKIAL

SEQ ID NO: 5604 - protein, 258 aa, Lactobacillus buchneri
MTKRASKVFTYHDFDDDVVFTKNQNATIPEGYIWLHQNWFYRVTATVVYWVAVVVSFVYCRLYLRTSFRNKRCLRTQGKRGAFIYANHTQPLGDALLPMLVAVPRRAYPIAEPANLGIPIVGRLLTMGGALILPAKLSQMIQFQRAMNARLDQHQRVFIYPEAHVWPYYTKIRPFPVGAFHYPVAADLPSYSMTITYQKGRLLSRPKQVVYFDGPFMPDKSLPRKQRQQKLHDQIHAQMVTRSHQSNVSFMTYQHQSH

SEQ ID NO: 5605 - protein, 583 aa, Lactobacillus buchneri
MQAQSKNNTKFNFKTFMGLINRIHPRYWQLLLGFFLGVVATAMQLMVPGIAKGIINSIGHSMDVGLIVAVILLFVFSTIIGAFSGSILGFFGEDVVYKLRTTLWDKILTLPVGYFDQTKSGEITSRLVNDSTQVKELLANSVPKTATSILQLVGALVLMLIMDWRMTLIMFIAVPLVLICLLPIVRQSHKVARARQDALADLNGKAGEMLGEVRLVKSSTAENLERTAGDKRMYRLYRIGLKEAIYDSIAGPVMGMVMMAMVLGILGYGAIRVREGAIDIGTLFSFLMYLVQMISPFAVLGQFMSDVAKASGSTTRIQALLQTHEEDHLTGTDLDIGDQTLQMNHVSFSYDQHHPVLSDVSFTAEPNSVIAFAGPSGGGKSTIFSLIERFYEPNEGSITIGNTNITDIQLADWRQQIGLVGQDAAIMSGTIRYNLTYGLPGHFSDEQLWHVLEMAYATQFVQKMPQGLDTEVGERGVKVSGGQRQRLAIARAFLRNPKILMLDEATASLDSESEMMVQKALDQLMANRTTLVIAHRLSTITNADEIYFIENGRVTGQGTHQQLVKTTPLYREYVKNQSATRPG

SEQ ID NO: 5606 - protein, 425 aa, Lactobacillus buchneri
MLVKTWYIIFMRKKETIILIISSIVLGLIVGLSSLFLGLLLNFVEHLFLHFEETARYPMGIDVAPSTRLWAVFAGGIISAIIWWILRTKVKPPVTIKAGLGGQNMPALQTAIHVITQIFYVGTGGSVGRELAPREAGAMIAQKWNDLLLKYHLAVLSKDDVKLLMAAAAGAGFAGVYNAPITGMFFCIEILLKKISFRTVGVSLSMSIIAMLVSSSVRGTEPYYLVGHTSFDTTFLPFVIVIAALCGIAGGLFRKSFTWAEKHQTKSNHILWQLPLMALITGMTLTQLPQIMGNGRPLAQMAISTTSNHFILLLLLSGLIKGLVTVLTIRSGAAGGTLTPSIAIGAVIGTIAGMIVAPITTIPVWQFSVLGGCSLLAASQQAPLMALFMIIEVSHLNYSALIPLGLGVIISTGVAKSILKLEFTL

SEQ ID NO: 5607 - protein, 397 aa, Lactobacillus buchneri
MMIYAGIDVAKYEHHLSIIDDQGTVLLADLEFLNNREGFLTAQATLDNARTADGQVQVGLENTGHYGYNLISYLRQHKFQVFAYNPLLIKKYIQANTLRHTKTDPQDALEIAKKLRSDTTKVSFEADADIIELKSDTRYLEGLKRKRVKTKLAFTNVLDQEFPELAPNLGPVSAKYSQWLLALLKRYPSTDKLAHGRINTMTNIITKYSMKQHGEEMAIKVRELARETIGQASDSLSFQLLQLIDALQFETQQIKEADQKIHKIMNRIKTPLLSIPGVGETLAAIILAEIRNVNYFQSPNQILAFAGAEPSIIRSGEMQGNYGHMVKHGSTQLRWALFQAARLCAMYSPTMRAYYQKKRSEGKPYLVALSHVVKKLVRIIYHILKYNDPWSETVIRD

SEQ ID NO: 5608 - protein, 378 aa, Lactobacillus buchneri
MNKPLRTIFTFALAFTAAGVLAASTNAQADIIDVPGAVKSIPQVNAGNVLTNYDSSDLKNIDNTSPIGNMDRKYNQGTIDPTQDNAGDTFATTDATTTTANSFKTQWFLPDGFNVTDYQHGNFQSVALDDSGNVYFVESNGSDTNLGVIIKFDTNKLKQLGLENDPMALWNAFNYFNPYTEDGVTHNNQYDDLYESMKDTFKTVKSLTSKEATVKAAMNDLANAKRTTQAKYRKTSSTTKKHLAASLKANAKKMAADRTKLTALQKQIAHGQSQIAKIKAKNPELFKNIEIAETAQLSPQVDIGHGQTLTFNPQNKHLYLVEDNTLTDLRNRDENNTVLEMDPNTMEPIRQYNFKMFQGTKGNLQLHTLDKLYYVKEK

SEQ ID NO: 5609 - protein, 701 aa, Lactobacillus buchneri
MIVKLKSSIFISAVALGILGVSCVASTAHASAPKTLTAEHPLTGSPASHNVTFTGTSALYSKPPVSKGAHVVAGKATLKQLASAKSSADNFVADRQATAKNGAVYYKVTSFDGQYHGWIYGGKKAGQFSGGLEPFRTFNQTTPPASLSKYTFKIAAPGFQNDGKTVTYKAPINTTYQAGKQIGDSVRYANTTFKIDGMGTRAREGDVWVHISALNSADAKANGWILYKGLRQAESPIPNNALRIDLVDSNGNLIRYINYTSANAQYDQPLGTPYETSWTLGNDDLANIQVAVRQALQGTGYNLDTISANQAGFLAQAKFGHRASLTVKSADPIPGNAIRINLVNDANAVIDTVDYTPTGAQPGQLLGTSSNGTASLNDADQKAIQSAISTALKDSGYQLTDLSTDQISDLAKTKFGGDVYLKANSSDTSIADNAVRINFVDPSNGKVIKSIDYVNTDADDPAKKGTTLGTQKSGKWLLGDSDVVEINALAASSLSGTGYLLNQEHLSDDQQSTLAQAKFGSSVSINVGKANNSTHFNLYAASSSGDSANAQQLTPTGLTYVNNSWEFPDVGGSSQPTYSQLSAADIAGLSATNLANFKQALAKYSSDSLAAINNSFKSAAEMQYVDNGQTASLNRADLDSAKSNLKNSSWSTLQSPKYPVFGKDANGSINIAWQTITYHAKSVKQNADDQSLSLTYTFDAQ

SEQ ID NO: 5610 - protein, 108 aa, Lactobacillus buchneri
MAEDHFIISTTEHIPGKEYEVIGEVFGLTTQSKNVVRNIGAGLKNIVGGEIKDYTKMLDEARNISVDRLKQNAIKMGADAVVMMRFDSGSIGADMQSVAAYGTAVKYK

SEQ ID NO: 5611 - protein, 462 aa, Lactobacillus buchneri
  misc_feature (5)..(5): Xaa can be any naturally occurring amino acid
NADHXIDASEMKVAVIGCTHAGTFAIKTILAEHPDAEVTVYEKNDNISFLSCGIALYLGGHVKDPQGLFYSSPDELKKLGASVKMNHEVTNVDPASKTIEVTDLKNDQSFEDTYDKLVVTTGSWPVIPPIKGVDNKNVYLCKNWNHAKELFETAPEKKRITIVGAGYIGAELAEAYNTKGHEVTLLDGADRIMSKYFDKEFTDVVEKDFTDHGVTLGLDQQVTEISGDDTVTIKTTKGTYETDLVVLCVGFRPNTGLFKGKLAMTDNGALITNEYMQTSDPDIYGAGDSVAVHYNPTHGLAYIPLATNAVRQGILVGKNIEKPTVKYMGTQSSSGLKLYDKTIVSTGLTMAAAKAQNINASEVIITDNYRPEFMPTTEPVLMSLVYDPETRRILGGSLLSTYDVSQSANTLSVCIQNENTIDDLAMVDMLFQPQFDRPFNYLNILAQAAQEQAAKLAGTTSK

SEQ ID NO: 5612 - protein, 292 aa, Lactobacillus buchneri
LKFSWTVTDNDPQSLKKFLNTKGISHRMYKSAKTDGGQFRVGGRKVDATVVLRAGDQVTVDFPAEASDPNVAVSRQPISVIYEDDNWLIVDKPAGLTVVPGPANRDDTLVNRVKGHLVENGAEDLVPHIITRLDRFTSGLVLIAKHRLANSLANEMLAAKTLHKQYQAVVAGVGLEKHGFIDRPITKDPTGYGQRISDDGKPAQTEYWVDQAYEDRTLVDVVLHTGRTHQIRVHFASIDHPLLGDALYHGPMDLGIGRQALHATQLRFEDPFSNRALSFKSQLPQDISALLH

SEQ ID NO: 5613 - protein, 58 aa, Lactobacillus buchneri
MSTNGESDQTVQKIIAEMETNLSVLSWMKAAEEDKQTREHIRALKAALLKAKSDLIKA

SEQ ID NO: 5614 - protein, 263 aa, Lactobacillus buchneri
MPEAKTAICFIDHREHMLIDGRYLKDLEPATRNLIKGDYPKAKVTDFICDHDLLKYQLMRVDGMVNADVKQTKKINRRLTKAMQSDDYDIIDVNDNLAKSLTFGQKVSDAVARFGGSWGFIGVFTFVLIAWMCINGLQLFGMHFDPYPFILLNLALSCIAAIQAPIIMMSQNRAADRDRMSSENDYHVNQKSEHELRILHAKLDNLTQNQLPHSLEIQKLEIEILGQIRTELDMIQRNQFGNPKSNLNENDQQDHENHSENDQ

SEQ ID NO: 5615 - protein, 196 aa, Lactobacillus buchneri
LITVREAQQDDAGQIAPLIDIIFDEMDLDELEDVPEPGLAKVITRAYQTDTYLSSKASTVVAEANGQVVGVVFGYPSENEDAINKVLINLSKKSADFKEPYIPDSETNSDEWYLDSIAVDPNWQGHGIGSKLLAAVPRMALNDGKSVIGLNVDFENPEAKKLYERKGFKTVGTQMIGDHLYDHMQKTAKQRSLLYV

SEQ ID NO: 5616 - protein, 66 aa, Lactobacillus buchneri
LNRVREYRKQVGISQFALAEKVGVARQTINLIENDKYNPSLKLCISLAEELGTDLNTLFWKVDENS

SEQ ID NO: 5617 - protein, 165 aa, Lactobacillus buchneri
MKESFLIKIMRYFFSIRGVLDEHNAREIGKVATNAFMFLWMYTGIANAVFLLLPQAIKTGSMINGFILFNMFIVWGGVGLYVTHKVSELKLNYQEVSTKEYPKAVHKAVIHGAWFGISYGLVTYLMFAQFNGFFSIVSIGFAIFIILISWTSDTQREIAHIVKVE

SEQ ID NO: 5618 - protein, 174 aa, Lactobacillus buchneri
MRQDDTISTKLFRYFFHIRGVLDKAARQQMNAAISKAFLFMWLYILVFTGGVLLFVKNTPNSESWMLFVYLSLLIGVGGSGLYIRRRAADLGLDIRKVIANQYDDAVEDAVMGSVWVGFLGGVVLFAVWMNVSPADRPFPGIFAFLFLVVACVWEAREAINHIVVVESDVKRRK

SEQ ID NO: 5619 - protein, 177 aa, Lactobacillus buchneri
MKAKESFGSRLLMHWFGVKRPFDEYKHQQIGRIGTNAYMILAVYLLVSSIVAIFVGQKHPEEALIGLVMINIVMVGFVVNIYILIATTRAHIVTREIQAASRQEIIKKAVLKGIGFGIYFMVIMLIADILMDWYFDGTSPLNSVENMGVIWPNVRSGLFFGATMAIYEILTTKVYKE

SEQ ID NO: 5620 - protein, 131 aa, Lactobacillus buchneri
MEDNIKLGNPVFDKMMFVLDKPVNEQNHRDYRFNNEELVQISDGIWAMPAYMKDDDDFSMFFIITEIDDGNTVLAFSTGEKKGEQFSLSNPIITGEALNMLVQHDKDMAASILHFLDQISKADEGNWRMVE

SEQ ID NO: 5621 - protein, 73 aa, Lactobacillus buchneri
MKLTLNETAAKFNVSPDVIDDYIKNGLVPSKPQVAVGAEFDDTDMYWMEMVNCFIENGSSVEDVKQLIKRCKI

SEQ ID NO: 5622 - protein, 220 aa, Lactobacillus buchneri
NADHAZREDCTASEMAKVLVVIARPESSKSRTLKVLRAFMDEYVKIHPNDVIERLDLYKVDFQEIDGDIFSAWDELEAGRQFSDLTSIQQVKLAEFNTSTDQFLAADKVVIANPLINLMVPTKLKAWIDTINVAGKTFKYTDTGTAVPLTSGKKALHIQAAGGKYNNQDFGTQYVKGILNFVGVQSVAKLSVEGMDHFPDQANQIVADAEVKARRIADDF

SEQ ID NO: 5623 - protein, 303 aa, Lactobacillus buchneri
MAEKNHNHEELAGAKFFWVTVLNVVITIAEFIGGALSGSLSLISDAFHNAGDSVSIVFSYVASRISKRRQNGRNTFGYKRAEIIAAFLNSIALALICVFLIIEALKRISKPEPINGNLMLTIAVIGLAANLLSAFLLNSGSKSSLNMKATYLHILSDALSSVAIIIGGILIDLYNWTLVDPIVTVLVAVYIFYESIPIIRQTCRILMQGAPSLDYDQIKKDLLQIDGVFSVHHVHAWSIDENNVIFSAHVNMHDMKLSEAEPIYSEISKVLKDKYHMCHVTIQAETTRGEHEDIIYDRGNDIP

SEQ ID NO: 5624 - protein, 215 aa, Lactobacillus buchneri
MTPMKEDYLKIIFELGGTDDLVSNKQIALSLNIAAGSVTEMVNKMMAEKLVTHQPYSGVQLTQKGKRYAEELVRKHRIWETFLVNTLHYDISDVHDEAELLEHVTSDKMIDHLDDFLGNPKRCPHGGVIPDRNGNYHPDHDKLLTDAKDGEEVIVNRFIDNHDLLTLLGDIKLDIGDKLKIISHDPFEGSVTVKNVTDKKKLVIGFKTAHYVFVR

SEQ ID NO: 5625 - protein, 256 aa, Lactobacillus buchneri
MADTATRQENYDHLVLNTCVLAGRIMIESGSEMSRVNDTIMRIAKNAGLKDAQVYATLTGIIMSGGVKEVGAEVGSIDKRAFDMEKVAKVNELSRAYAAKKIDIYEFRDDLVHIDDLVATFPLWLQTLGAGLVSGTLVVVFQNNLPDFWITFIVGMFGWAVYYFLNIYIQIRFLSEFLAAVVVGALALIAVKNGIGVKADDIIIGGMMPLVPGIPLTNAVRDALSGNLISGPARGIEALISACALGFGVAIALHFF

SEQ ID NO: 5626 - protein, 151 aa, Lactobacillus buchneri
MNLFIIKCICVYFSGIGFGLIVNLPHRALNVAGITATLSWLVYYGVMNTWGGLGSANFFGGLTIGLVSVVIAHLKKMPSILFDVPGLVPLVPGGQAYNTIKNFALGDYQVAFNYLSEVVWIAGSIALGFIVAELINKIRIKIKYVSKGWDK

SEQ ID NO: 5627 - protein, 105 aa, Lactobacillus buchneri
MAIQISSELLDGCVLGILNGQDYYGYALTQKVQESISVSESTMYPVLRRLKKNDLLTTYDEPYQGRNRRYYKITPEGKRQFGIIQQEWQEFKQGIDNMLGDDQNE

SEQ ID NO: 5628 - protein, 209 aa, Lactobacillus buchneri
MNDYIEEFQALLGQLSPEERDEAVDFYREYLQDGGYASYDDCIRELGTPHQLARKVLADYSIRTLDAPMSQQSRQQPKNDVKTIWLIILALLSTPVTIPLALALAGVIFAGIAVSGSLIIAVLAIFFAVVVVGITGFVVGLGTLFSSFWTGIFYLGMGLMVIGVMIMLVPVFKAVVNGLIRGITLFSKWIYNKIVPKNRAERKGKGDQK

SEQ ID NO: 5629 - protein, 296 aa, Lactobacillus buchneri
MKKTVIVGLTVTLVGTVLLVLGLGNGGARTVYWDHGFTTDQSTPVKSHQTSAKFSGVKNFSLSTASPVQIKKGNVSKIEVTYPSATKITQSGNTLHFNLKSPRKHHGIIFFGDFRRARQAFGKTIITVPKSMKVGTINSDIANSITIKNMTIKTITSSGVGDVNLNHVTTTENLDLENTGDVNLSTSTFPSAHLDVGAGDVDLTSNKFDSMSVETGAGDINFNSQKVGKSFTAHSDVGDISGHVVKNKRTQISVSADVGDASLFGSSHNKKIDSNAKNPVTYRFTSDVGDVTIHQS

SEQ ID NO: 5630 - protein, 126 aa, Lactobacillus buchneri
MDKNTKEQMTEEMADVQLIIGKILRLGVIISATVMIIGLVLLIVKGNGGYPHNAFPTDFTQIWAGIAELKPYAIMMLGIFLLILTPVLRVVVSIYSFYREGDSLYVWITTIVLVILGISFVFGILR

SEQ ID NO: 5631 - protein, 278 aa, Lactobacillus buchneri
LINYALLMIAIGVFAGFAGAILGLGGGIILTPILTLLMGVDIKYAIGASIIAVIATSSGATIAYLRDKVLNLRVAMFLEIATTLGALSGALLTGVIDPKYLYILFGLLLLFSGYNMIRKLISHQEVLHRAHPDQLSSKFKLDSSYFDNVEGKTINYQVEHIPGGLAVMYGAGIASGLLGIGSGAFKVMAMDTVMKMPLKPSTSTSNLMMGVTAAASATVYFFNGSIKPMIAVPLALGILVGARGGSRIMRDMSARTIRMIFVPILFYIGIEMFMKGIR

SEQ ID NO: 5632 - protein, 229 aa, Lactobacillus buchneri
MYGNEDYMLMERDPNRLVKLIVSLCFTTLLSISVAFNFDYLQFLDSIFTTAIQGSAPTPGLEHFYSVITFLASPKMDIFWVFIIAFFLWGFKYKVPALWALGTIVGGDVIGAVVKQLVRRHRPPLHLGVDNGYSFPSGHVLGFFLVAGVLWIIVLPLIERASIRVVIKVLLVIVLALVMLSRVYLNAHYPTDTVGACLVGYSWLLVAEMLYASYAPRVARYRFVVHTKI

SEQ ID NO: 5633 - protein, 185 aa, Lactobacillus buchneri
GNATFAMILYPRTEINMDLPIETNRLQLTELTLADLTAYEKLISIPEIAAGAGFNLVSNQQMLGAVAKRQIATPNSFGIRIHDRLIGAILLYEQVGFDHQPDPANLELSYFLHPDLWHQGIMSEALTKLIEELAVNPTIETLNAEVFSDNQASKGVLKKVGFQVKTTLIDPLVGKEKTIYQLALQ

SEQ ID NO: 5634 - protein, 494 aa, Lactobacillus buchneri
MNDNESQEANGQVKRGLKARHVSMIALGGCIGTGLFVASGSAISQAGPGGALTAYVLMGMMVYFLMTSLGEMATNMPISGSFAAYSSKYVDPALGFAMGWNYWFNWAITVAVDISTAALVMKFWLPNVPAWIWSAIALVIIFLINAMSVSTFGETEFWMSAIKVVTIIIFLVVGALTIFGIMGGHFVGMRNFSIKQAPFVGGFPAILSVFVVAGFSFQGTELVGITAGESQDPQHSVPKAINEVFWRIILFYILTIFVIAAIIPYTSHSLLGSSATDIAISPFTLVFQRAGLAAAASVMNAVILTSVISSANSGMYASTRMLYSLSNSGYAPKSLGKTAANGIPYYSLLATTFVSLLTFISSIAGPQIYMWLVAASGLTGFIAWFGIAISHYRFRRAFIRQGHDLSELKYHAKLFPFGPVLCLILCILVIVGQNPQAFASFDWKQILVTYISVPLVLILYFWYKLKHHTKIIPLDQVDVSPAHKDEDLSKLNNK

SEQ ID NO: 5635 - protein, 346 aa, Lactobacillus buchneri
MKKFMSKGKFERMNKLSNDQNIIDALALDQRGSLVKGMKTASEKYGKLFSMKMVYDFKEIVSEILSPLSSAVLLDEQMGFKGIQAKAKDTGLIMSYEKTGYDADTPGRLPSLIPDQSAQIMVEKGADALKVLVYYNPNDPDEINDVKKAFAERYGTEGLAAQTPTFFEIVTYDDRYDSKSLDFAKIKPDLVLQSMMEFTKEKYHIDVLKMEIPFNPTYVKEWADGGDYAYTEDQAKGYLKELSDEATRPFIFLSAGVPTPVFQRELKLAGDAGAKFNGVLSGRATWLEGVDIYIRDGKDGLVDWLKRKGTRNVTELTQILSENATPWFEAYGGLDNIQVVDVSNIN

SEQ ID NO: 5636 - protein, 212 aa, Lactobacillus buchneri
MLVLAGTIGAGKTSLTKMLSQHLGTPAYYESVEHNRILPLFYKDPKKYAFLLQIDFLNRRMDDIKKAWQNDESVLDRSIFEDSLLFHLNADLGRATETEVTIYDSLLENMMQEMPQTDHSKNPDLLIHINISFETMLRRIQKRGRSYEQIDNDPDLYQYYKDLNARYQTWYQEYDKSPKIQIDGDKYDFVENDADKHKVIDLIDAKVDKLAI

SEQ ID NO: 5637 - protein, 427 aa, Lactobacillus buchneri
MLDIKKIRKDPDFTKEKLATRGIKPETIDELVGYDAKRRDLIVESESLKAKRNAVSDQISQKKRNKEDATEAINQMKQVGQRIKELDEQLRQVEEDEHNLAAHLPNIPHDDVPVSLTEEGSVELRKIGQIPSFDFEPKHHWEIGENLGILDFERAAKVSGSRFVYYIGDGALLERAVYNFYLDQNTAAGYTEVIPPYMVNNDSMYGTGQFPKFLENKSGYEIQDSDLTLIPTAEVPLVNYYRNEVIPTEKLPVSVTALSPAFRSEAGSAGRDTKGLIRLHQFNKVEMVKFTKPEDSWKALEEITHQAEVNLQKLGLAYHVITLTTSDMSFTAAMTHDLEVWFPAQDKYREISSCSNCTDFQARRAHIQYRDDEGKLHFVHTLNGSGLAVGRTVAAILENYQNEDGTVTIPEVLRPYMHGMTKIEKQN

SEQ ID NO: 5638 - protein, 155 aa, Lactobacillus buchneri
MADENISDLIEHYLKEILAENEQVKIRRSEIAGLFDVVPSQINYVINTRFTIQNGYIVESKRGGGGYIRIEKVHLLDDIDVLNSLIAAIGNKLSKRDSETIVQTLYNNELINRREVSIILAAIDKDAIDLNNSDLTDILRANIMVSILNRLRYER

SEQ ID NO: 5639 - protein, 830 aa, Lactobacillus buchneri
MNNLFTPSAKNVLTIAQEQAKKFKHQAIGTEHLLLGLLIETNGIAYKALQQFSVTAEDVTEEVERFAGYGNLKDLSSNDYLPYSPKAKEVLAQAGEFAKKNGVPKVGTEHILLSLLTDETILSSRILINLGLDLSQIRKVTLRKMGISGGSMASNLASKQRGRQQKPADSKTPTIDSLARDLTEMARQDRLDPTVGRDLEVKRVVQILARRTKNNPVLIGEPGVGKTAIAEGLAERIVSGDVPGDMSKKRLMMLDMGSLVAGTKYRGEFEDRLKKVIDEIYQDGNIILFIDELHTLIGAGGAEGAIDASNILKPALARGELQLIGATTLDEYQKYIESDAALERRFAKVMVDEPTTDETVEILKGLRPKYEQHHHVEITDDAIETAVNLSNRYISDRFLPDKAIDLMDEAAAKVRIDHLQKSDAVDDHKKLSDLLSELNEALVAQDYEKAAKIRKQTNQLQDELAQDNDSEEGSEDAHYPVKETPQDVAEIVGEWTGIPVTRLSSTEADRLVNLEKILHKRVVGQEEAISAVSRSIRRARSGLKDPNRPIGSFMFLGPTGVGKTELAKAVAEAVFGSEEDMIRVDMSEFMEKYSTSRLIGSAPGYVGYDEGGQLTEKVRQKPYSVVLFDEVEKAHPDVFNLLLQVLDDGYLTDAKGRKIDFRNTVIIMTSNLGATTLRDKKTVGFGQEDAKEGYAAMKDTIQAALKQRFRPEFLNRIDEVVVFHSLTKDELDQIVYLMAKPVIKRIHDQGIDIKITKTAIGIISKRGFDPEYGARPIRRAIQTELEDNLSAKLLAKEIVPGDSVTVGGRNNQITISVKKPERKTLVNDKK

SEQ ID NO: 5640 - protein, 1202 aa, Lactobacillus buchneri
LAGHLVKYGKHRTRRSYARIKEVLDLPNLIEIQTNSYNWFLHEGLKETFDGIMPIDDFQGKLSLEFVDYQLLTPKYTVDEAREHEANYSAPLHITLKLTNHETGEIKTHDVFFGDFPLMTDQGTFIINGAERVIVSQLVRSPGVYYHADKDKNGRDSFGTTVIPNRGAWLEFETDAKNIAYVRIDRTRKIPLTELIRALGFGSDSEIIDILGDNDSLGLTLEKDVHKDTDDSRVEESLKDIYERLRPGEPKTADSSRSLLTARFFDPKRYDMAPVGRYKTNKKLSLKNRLLGLTLAETLADPDTGEVIAQKGTVVTKDVMKDLAPFLDNDEFKAYTFTPSDEAVVTEPMTVQIIKVQSVNDPDRVVPLIGNDNIPLSFKHITPADIISAMNYFFNLQEGIGSIDDIDHLGNRRIRSVGELLQNQFRIGLSRMERVVRERMSIQDTSTVTPQQLINIRPVVASIKEFFGSSQLSQFMDQTNPLGELTHKRRLSALGPGGLTRDRAGYEVRDVHYTHYGRMCPIETPEGPNIGLINSLSSYARVNKYGFIETPYRRVDWTTHKVTDRIDYLTADEEDNFVIAQANSPLNDDGSFVNNIVMARHKSNNIEIGIDKVDYMDVSPKQVVAVATACIPFLENDDSNRALMGANMQRQAVPLIDPHAPLVGTGIEYKAAHDSGVALICKNEGTVEYVDAREIRVRRDDKSLDKYKLMKFRRSNGGKNYNQRPIVKVGDRVDADEILADGPSMEGGELALGQNPVVAFMTWQGYNFEDAIAISERLVKDDVYTSIHIEEYESETRDTKLGPEEMTREIPNVGEDALKNLDEDGTVRIGAEVHDGDILVGKVTPKGVTELSAEERLLHAIFGEKSREVRDTSLRVPHGGGGIIQDVKIFTRENGDELSPGVNKMVRVYIAQKRKIQVGDKMSGRHGNKGTVSVVIPEEDMPFLPDGTPVDIMLSPMGVPSRMNIGQVLELHLGMAARRLGIHVATPVFDGARDKDIWDAVKEAGMPSDGKYILYDGRTGEPFDKKIAVGVMHYLKLAHMVDDKIHARSIGPYSLVTQQPLGGKAQFGGQRFGEMEVWALEAYGAAYTLQEILTYKSDDVVGRVKTYEAIVKGEPIPKPGVPESFRVLVKELQSLGLDMKVLDASHKEIELRDLDDDDDVVNVDALSKLADKKKEQEDHAAKQPADQVETPSKSTNVNNSND

SEQ ID NO: 5641 - protein, 1220 aa, Lactobacillus buchneri
VVDVNKFESMQIGLASPDKIRSWSYGEVKKPETINYRTLKPEKDGLFDERIFGPTKDWECACGKYKRIRYKGIVCDRCGVEVTRSKVRRERMGHIELAAPVTHIWYFKGIPSRMGLVLDMSPRALEEIIYFASYVVTEPGNTPMEKKQLLSEREYREKKQEYGPRFSAQIGAEAIKTLLEDVDVEKEVTELKDELKNATGQKRTRAVRRLDILEAFVQSGNELSWMVMDAIPVIPPDLRPMVQLEGGRFATSDLNDLYRRVINRNNRLKRLLDLNAPGIIVQNEKRMLQEAVDALIDNGRRGRPVAGPGNRPLKSLSHMLKGKQGRFRQNLLGKRVDYSGRSVIDVGPHLKMNQMGLPVPMAMELFKPFIMKELVGRNLASNIKNAKRKIERQDDDVFSVLEDVIKEHPVLLNRAPTLHRLGIQAFEPVLVSGKSMRLHPLVCEAYNADFDGDQMAIHVPLSDEAQAESRLLMLAAGHILAPKDGKPVVTPSQDMVIGNYYLTMEEAGREGEGMIFNSPDEAQLAFKNGIVHWHTRVGIKASAYPKKTFTKDQLGKILVTSVGKIVFNEILPEDFPFINEPSETNLNGYVDDKFFLEPGEDIHEHLKNAKLILPFKKGFLSDIIAEVYKIYKVTETSFLLDRMKDLGYNESTKSGLTVGITDITQLPDKQEIIDGAHKKVDMVTKQFRRGLITDHERYERVIGIWNDAKDDIQKRLLENQDPQNPIFMMSDSGARGNISNFTQLAGMRGLMAAPNGEIMELPITSNFREGLTVLEMFISTHGARKGMTDTALKTANSGYLTRRLVDVAQDVIVREKDCGTDRGLTISAITEGNEMIEPLYDRIVGRYAHKTVKNPKTGDVIVPANTMITEDQATKIDDLGIKEVTIRSAFTCNTIHGVCEKCYGRNMATGDEVEVGEAVGTVAAQSIGEPGTQLTMRNFHTGGVAGNADITQGLPRVQEIFEARNPKGKAEISEVTGTVESIEENPAERTKEITIKGESDTRTYTVPITARMRVAEGDYIHRGSALNEGSVDPKELLKVRDVLSTENYLLHEVQKVYRMQGVEVADKHVEIMIRQMLRKVRIMDPGDTDVLPGTLMDINDFKISNGDTVVNGGIPATARPVLLGITKAALETNSFLSAASFQETTRVLTDAAIRGKNDPLVGLKENVIIGKLIPAGTGMPDYRGIKPEEIGSSSTDGVYSISQLEEKMKAEDANKSKTTK

SEQ ID NO: 5642 - protein, 230 aa, Lactobacillus buchneri
MMIIIQFLLGASLASFFNLVAVRRQRGESIVAPRSHCDRCGGQLKNFDLIPVFSYIILMGKCRYCKQKFSANLFTVELAAGSVAASLNLFEINCLYVGMLIILIALSSFDIVDQTIPTDGIIMLLLVCGLSNTHPVQEILIAILIYLLIQFLNHHFSWMGSGDIDIYFCLWLALDIPSLLWQTFIACVAALLYLIVAPWPKDSKIPFVPFITIGFYLTHQFQSILLPLIS

SEQ ID NO: 5643 - protein, 137 aa, Lactobacillus buchneri
MPTINQLVRKGRHSRTSKSKSPALNYAYNSLKKKQVTVPAPQKRGVATRVGTMTPKKPNSALRKYARVRLSNLIEVTAYIPGIGHNLQEHSVVLIRGGRVKDLPGVRYHVIRGALDTAGVQDRRQGRSKYGTKKPKE

SEQ ID NO: 5644 - protein, 156 aa, Lactobacillus buchneri
MPRKGNVQKREVLPDPIYNSKLVTRLINRLMLDGKRGTASQILYGAFDLIKKETNNEPVDVFEEAMKNVMPVLEVKARRVGGSNYQVPIEVRPDRRTTLGLRWIVNYARSRGEHTMTERLAREIMDAANNTGASVKKREDTHRMAEANRAFAHYRW

SEQ ID NO: 5645 - protein, 700 aa, Lactobacillus buchneri
MANKREFPLEKTRNIGIMAHIDAGKTTTTERILYYTGKIHKIGETHDGASQMDWMPQEQERGITITSAATTAQWKDHRINIIDTPGHVDFTVEVERSLRVLDGAIAVLDAQAGVEPQTETVWRQASDYDVPRIVFVNKMDKVGANFDFSVGSIEDRLNAKPLPIQMPIGAEDDFEGVIDLIEMKADIYDEDKLGSNWDTVDVPDEYKDEAKKRRDQLVETLADVDDDIMNKYLEGEEIPIPEIKAAIRKATLNLELFPVLAGSAFKNKGVQMLMDAVIDYLPSPLDVKPYNATDPATGDKIELKANDDASFAALAFKVATDPFVGRLTYIRVYSGTLESGSYILNATKDKRERVGRLLQMHSNHRQEIPEVFSGDIAAAIGLKNTTTGDSLTDVDHPLHLESMEFPDPVIQVAVEPKTKADQDKMNVALQKLSEEDPTFKATTNPETGETLIAGMGELHLDIIIDRMKREFHVEATVGAPQVSYREAFTKPTKAQGKFIRQSGGKGQYGDVWIEFTPNEEGKGFEFEDAIVGGVVPREYIPAVEQGLKESLANGVLAGYPLIDLKAKLYDGSYHEVDSSEAAFKVAASIALRNAAKTAAPVILEPIMKVDINVPEEYMGDVMGQVTARRGRVDGMESRSGAEVIHSFVPLAEMFGYATTLRSASQGRGTFTMTFDHYEPVPKSIQAEIIKKNGGNQPAED

SEQ ID NO: 5646 - protein, 102 aa, Lactobacillus buchneri
MAKQKIRIRLKAYEHRILDQSADKIVATAQRTGATISGPIPLPTDRTIYTVLASPHKFKDSREQFEILTHKRLIDILNPTPKTVDSLMKLDLPSGVDIEIKL

SEQ ID NO: 5647 - protein, 211 aa, Lactobacillus buchneri
MTRKGILGKKVGMTQVFTENGELVPVTVVEVTPNVIMQIKTVENDGYDSVQLGYADKRTVLTNKPEQGHAKKANTTPKRFIKEIKDVELGDYKVSDEVKADIFKPGDIVDVTGTTKGHGYQGNIHKDGQSRGPETHGSRYHRRPGSLGVIINRVVPGMKLPGRMGNKTVTIQNLEIVNADTDNNVLLIKGNVPGANKSYITIRSAVHGSNN

SEQ ID NO: 5648 - protein, 207 aa, Lactobacillus buchneri
MTDVALYKQDGSKNGTVALNDGIFGIEPNNNVVFDAIVMQRASLRQGTHSVKNRSAVRGGGKKPWRQKGTGRARQGSIRSPQWRGGGIVFGPTPRSYSYRLPKKVSRLALKSVLSEKVSDNKLVVVDTLQFDAPKTKEFAELLGKLDVSTKTLVVLEDDNEKAVLSARNLENVKVVSAQGINTLDVADHDKVVITKAALSQVEEVLA

SEQ ID NO: 5649 - protein, 95 aa, Lactobacillus buchneri
MESRDIILRPVITEETTSKMDDKTYTFDVDLRATKTQVKKAIEDIFDVKVVRVNIMNVRGKLKRQGRYAGYTKKRRKAIVTLTEDSKEIELFNEE

SEQ ID NO: 5650 - protein, 279 aa, Lactobacillus buchneri
LAIKTYKPTSNGRRNMTSLDYSAITKRKPEKSLLESKSKTAGRNNYGHMTVRHRGGGNKNQYRIIDFKRIKDDVTATVKAIEYDPNRTANIALIVYTDGIKSYIIAPKGLKVGDKVESGVDADIKPGNTLPLSNIPVGTIIHNIELKPGKGGQLVRSAGASAQLLGRDGKYSLVRLASGEVRLILSTNRATIGSVSNEEHELINVGKAGRTRYKGQRPHVRGSVMNPNDHPHGGGEGKAPVGLPSPLSPWGKKTVGKKTRSKKARSDKFIVRRRKGSKM

SEQ ID NO: 5651 - protein, 91 aa, Lactobacillus buchneri
MSRSLKKGPFADEYLLKKVDAQKDQDKKAVIKTWSRRSTIFPSFIGYTFAVYDGRKHVPVYVQEDMVGHKLGEFVPTRTFHGHGTDDKKTV

SEQ ID NO: 5652 - protein, 118 aa, Lactobacillus buchneri
MAEQVTSAKATAKTVRIAARKVRLVVDLIKGKSVAEAAAILDFTPRGASPVVSKVLKSAVANAENNFDLDSENLFVSEAFVNEGPTLKRFRPRAKGSASPINKRTSHITIVVSEKEEG

SEQ ID NO: 5653 - protein, 221 aa, Lactobacillus buchneri
VGNKINPNGLRVGIIRDWEAKWYAGKDYAAYLKEDLQIRKYIEKRLANASVSTVEIERAANRVNVSIHTAKPGMVIGKGGSEVENLRKELNDLTGKRVHINIIEIKKPDLDAKLVGENIARQLEGRVAFRRAMRQAMQRTMRSGAKGIKTQVAGRLNGADMARVESYSDGTVPLHTLRADIDYSWVEAFTTYGSIGVKTWIYRGEVLPEKPKDSNAAKGGK

SEQ ID NO: 5654 - protein, 144 aa, Lactobacillus buchneri
MLVPKRVKHRREHRGKLRGTAKGGKTVTFGEYGLQALDSHWITNRQIEACRVAMTRHMKRGGKVWIKIFPHKSYTEKGVGVRMGNGKGTPAGWVSPVKRGKVLFEIGGVDKATAHEALRLASNKLPVRTKIIEREEVGGESNEG

SEQ ID NO: 5655 - protein, 64 aa, Lactobacillus buchneri
MKAKDISKLTTAQMIDKEKDYKDELFNLRFQLATGQLENTARLKQVRKNIARIKTALRQQELNK

SEQ ID NO: 5656 - protein, 88 aa, Lactobacillus buchneri
MAEERNQRKVYQGRVVSDKSDKTITVEVSTYKKHATYGKRVRYSKKFTAHDENNEAKTGDLVQIMETRPLSKTKRFRLIKIVEKAVII

SEQ ID NO: 5657 - protein, 122 aa, Lactobacillus buchneri
VIQQESRLKVADNSGARELLTIKVLGGSTRRYAGIGDTIVATVKQATPGGVVKKGDVVKAVVVRTKAVTRRNDGSYIRFDENAAVLIRDDKSPQGTRIFGPVARELRDSNFMKIVSLAPEVL

SEQ ID NO: 5658 - protein, 102 aa, Lactobacillus buchneri
MFIKTGDKVRVISGKDKGKEGTVTKTIASKDRVIVEGINKVKKHTKASQTNPQGGIVDAEAPIHVSNVMLIDPSTNEPTRIGIKVEDGKKVRYSKKSQKAID

SEQ ID NO: 5659 - protein, 180 aa, Lactobacillus buchneri
MSSRLREKFNSEITPHMMDKFSYKSVMQAPKIDKIVLNMGVGDAVINAKNLDEAVSELALISGQKPLVTKAKKSIAGFRLREGMSIGAKVTLRGDRMYDFLDKLVNVSLPRVRDFHGVSTRAFDGRGNYTLGVREQLIFPEINYDNVNRVRGLDIVIVTTANTDEESHELLAQFGMPFAR

SEQ ID NO: 5660 - protein, 132 aa, Lactobacillus buchneri
MSMTDPIADFLTRIRNANMVYHETVEVPASKIKRDIAEILKREGFVRDVEYIEDDKQGIIRVFLKYGKDKQRVITGLKRISKPGLRSYVKADAVPKVLNGLGIAIISTSNGVITDKQARAQKIGGEVLAYVW

SEQ ID NO: 5661 - protein, 179 aa, Lactobacillus buchneri
MSRIGYKTIELPKGVEVKADGNTVTVKGAKGSLTREISSQIKMTIKDNEVNFEPIGDYNDKVRALHGTTRANVSNMVDGVTTGFKKTLKLVGVGYRAQLKGKNLTLNVGYSNPVEMTVPDDLTVEVPDNTTIHINGISKQAVGDFAASVRSVRSPEPYKGKGIRYENEHIIRKEGKTGK

SEQ ID NO: 5662 - protein, 118 aa, Lactobacillus buchneri
LISKPDKNKNRKRRHNRVRNKISGTAERPRLNVYRSNKNIYAQVIDDVEGVTLVSASTLDSAISSGNKTEQAASVGKLVAQRASEKNIKNVVFDRGGYLYHGRVQALADAARENGLEF

SEQ ID NO: 5663 - protein, 167 aa, Lactobacillus buchneri
MKKFIDPDKLELEDNVVSINRITKVVKGGRRLRFAALVVVGDKHGHVGFGTGKAQEVPEAIRKAVEAARKNLIEVPIVGTTIPHEVLGTFGGGRILLKPAEEGSGVAAGGAVRSVMELAGIDDVTSKRLGSNTPINVIRATFKGLVELKSAEEISALRGVSTQHLAE

SEQ ID NO: 5664 - protein, 61 aa, Lactobacillus buchneri
MAQLKITLKRSVTHRLPKQRKIVKALGLGRVNSTVVKPDNESIRGALFQIAHLIEVEQVKD

SEQ ID NO: 5665 - protein, 144 aa, Lactobacillus buchneri
MKLNELKADEGSRSLRTRKGRGRSAGKGKTAGRGQKGQKARSKTRVGFEGGQMPLYRRIPKRGFNNINRKEYAVVNVVKLESFDNGTEVTPELLQQSGLVKNAKSGIKILGEGELTKKLTVKANKFSKAAQSVIENAGGKIEVV

SEQ ID NO: 5666 - protein, 438 aa, Lactobacillus buchneri
MLSTLAKAFKVKDIRNKMLFTLFVLVIFRLGAYITVPGINAKALTSVASSGLVSILNTFSGGGLTNYSIFAMGVSPYITAQIIIQLLQMDIVPKYVEWGKQGEVGRRKLNQHTRYLTVILAFFQSVGITAGFNQLSSLNLVQNPSIKTFVIIGLILTGGTMLTTWMGDMITERGLGNGISMIIFAGIIARIPVGLQSLWTQYFVGVSGADLWQPILFAIALLIIVLVIVTFVTWVQQAERRVPIQYTRRVSGSPDSSYLPLKVNVAGVIPVIFASSFIATPQTILMAFTNNYSTATWFQVLNNLFNMQTPTGAAFYTILIIMFTFFYAFVQVNPEKLSENLQKQGSYIPGVWPGHETQSYVSDLLMKLSTVGALFLGVVALIPLIAQNLWNLDESIGLGGTSLLIVVGVAIETIRQIRGLMMKREYVGFIHDTRPTDD

SEQ ID NO: 5667 - protein, 218 aa, Lactobacillus buchneri
MSLNLILMGLPGAGKGTQAQFIVDKYHVPHISTGDMFRDAISNSTPLGVKAKSFTDKGDLVPDEVTNGIVKERLAQDDTKPGFLLDGYPRTLEQADALSQMTKDLDKPLTAVINIDVDPKLLTERLSGRFICKNCGATYHKLYHMPKVPGTCDVCGGHEFYQREDDKPEAVKNRLKVNVKMNTPLIAYYKDRNLLFNVDGSKDIDEVWQDVDKILSTL

SEQ ID NO: 5668 - protein, 72 aa, Lactobacillus buchneri
VAKDNVIEVEGKVVETLPNAMFRVELENGHEILAHVSGKIRMHYIRILPGDKVTVEMSPYDLTKGRITYRFK

SEQ ID NO: 5669 - protein, 120 aa, Lactobacillus buchneri
MARIAGIDLPRDKRIVIGLTYIFGIGNTTAQKVLAKAGVSEDVRVRDLTPDQEDKIREVVGDLKIEGDLRREVSMNIKRLQEIGSYRGMRHRRGLPVRGQHTKNNARTRKGSKVAAGRRK

SEQ ID NO: 5670 - protein, 129 aa, Lactobacillus buchneri
MVNKKTSRKRRAKKNIAAGVAHIHSTFNNTLVMITDTTGNAVSWSSAGALGFRGSRKSTPFAAQMAAEAAAKASMEHGMKSVEVAVKGPGSGREAAIRALQATGLEVTAIRDVTPVPHNGSRPPKRRRV

SEQ ID NO: 5671 - protein, 319 aa, Lactobacillus buchneri
MIRMIEFEKPNIHKIEETNNFGEVVVEPLERGYGTTLGNSLRRTLLSSLPGAAVTSIQIDDVLHEFSTIKGVVEDVTQIILNVKKISLKLDGPEDEEENLEIDVIGPADVTAGDIQADSDVTVLNPDLHIATVAEGATFHMRLTANKGRGYVSAVENKKRSSEMPIGVLPVDSIYTPIERVNYQVESTRVGQRDDFDKLTLDIWTDGSITPSEAVSLAAKILTEHLEMFVDLTDEAKNTEIMVEKEETHKEKMLEMTIEELDLSVRSYNCLKRAGINTVQELTEKTEADMMKVRNLGRKSLEEVKEKLAALGLSLRKED

SEQ ID NO: 5672 - protein, 127 aa, Lactobacillus buchneri
MGYRKLQRSSAHRRSLLRNLTTELIIHGQIITTEAKAKEVRSTADKMISLGKRGDLHARRQAASFVRDVVADVKEDGDDINVTTALQKVFGELATKYADRNGGYTRILKTMPRRGDGAPMVILELVD

SEQ ID NO: 5673 - protein, 277 aa, Lactobacillus buchneri
MKDIIQIKNISFNYPEQEKLFNNFSMNIQEGKWTAIIGQNGSGKSTLARLIDGLIVLKSGQIIVDGLTVNDTNIFEIRNKIGMVFQNPEDQFVGATVEDDVAFGLENRQVPREQMHQIVEQSLRQVGMWDFRDRIPANLSGGQKQRVAIAGIIALSPKIIILDEATSMLDPRGRQDILKLVNQIKRENNLTVISITHDIDEAAGADQVIVVNQGQVVEADQPDHIFGDIEKLTSIGLSAPFTSELLSALKKRGIDSHSQYLNDERLITWIKQLISKK

SEQ ID NO: 5674 - protein, 291 aa, Lactobacillus buchneri
MDQTINFKEVTHTYQPDTPFAQNALNQVSLTIASGSFTAIIGHTGSGKSTLVQHINALLKPTMGEIEVSGRTITPATTNKNLKQLRKHVGMVFQFPEKQLFEETVIKDVMFGPKNYGASDQEARADAKQAMALVGLDEDLQEKSPFDLSGGQMRRVAIAGVLAMKPEILILDEPTAGLDPRGHKEIMDLAEDLHEHQGMTIILVTHQMDDVVDYASDVIVMDQGKIVKHGRPQEIFADPQWVYQMHLDLPSSAEFASRLITAGVPLKSVPLTIDKLADAIVEVVQGGHGHE

SEQ ID NO: 5675 - protein, 265 aa, Lactobacillus buchneri
MSNFLFGRYLPGNSWVHQMSPQSKLMLSFYFVVVIFFANNIWTYAALSVLILMVVLMSGVSIGYFLKGIRPLIWLIIFTVLLQILFSSGGHVYWHFGPFSVSDTSLINGGFIFIRFLLIIMISTVLTLTTTPLAIADGVQTVLRPLKKVHFPVDTLALMLSIALRFVPTLMDEMETILNAQRSRGVDFGSGSLRHRIQAAVPLLVPLFTGAINHAENLSTAMEARGFTDSEHRSKYRIYRWQRKDTISWAVFLLVGVLVLFIRKS

SEQ ID NO: 5676 - protein, 267 aa, Lactobacillus buchneri
VFNIRYKVTLAYDGTLFSGFERQPKRRTIEGVLTQKVNIMAKNPDPPIVVYGSGRTDAGVHALGQVVHFDFPFDLPTKAIYRGLNSLLPLDMEIKKAEKVSNTFHARYDVSGKRYVYRLDLGEFKDPFKRNYTGNWRFPIDIERVQTAMNDFVGEHDFSSFVASGSTARSNVRTIYEANAILDKSANEIRLEFYGNGFLYNMVRIMVGVVVEIGSQMRPEHDILRLYEVKDRDQARRTMPASGLYLKKVYYEGEDPKHPTKLPKRQR

SEQ ID NO: 5677 - protein, 147 aa, Lactobacillus buchneri
VRTTYMAKPGEVERKWYVVDATDVSLGRLSSAVASILRGKNKPTFTPNVDTGDNVIVINASKVGLTGHKDTRKIYYHHSRFIGGLKQRTAGDLRAKNPEKLIETSVKGMLPHGTLGHKIGLKLHVYAGPEHDHQAQKPEVLDINNLI

SEQ ID NO: 5678 - protein, 130 aa, Lactobacillus buchneri
LAQVQYRGTGRRKDSVARVRLVPGTGKIIMNDKAIEDYIPFANLREVVVQPFNVTETLGNYDTLVNVNGGGFSGQAGATRHGIARALLAVDPDFRGPLKRAGLLTRDARMKERKKPGLKKARKASQFSKR

SEQ ID NO: 5679 - protein, 198 aa, Lactobacillus buchneri
MPVKKNTLRLNMLAMFIAIILLQTSIPLIGYIPIGPLEITIIPMTVVVATVLLGTVDGAIIGGVWGMTTFVRAFVWPTSPLAAIVFVNPIISVIPRIMIGVVAGMTYTYLKKHLKSQAASISVSAVLGSLTNTVLVLGLIYLFYKAKAPQLYQINIKELLPYLLGVVGTNGVPEAIFSGIVTPLIAVPVKKIFDRTSR

SEQ ID NO: 5680 - protein, 99 aa, Lactobacillus buchneri
MAKNTEVSEAQSKFHVGDEVSFKIEKQTFTGFVDKSYTNSFLITFESDDPEIIDKYHKKVVINNRHLKMIKAAPQPEVEDDDEDDNETKSSRTKKSSKK

SEQ ID NO: 5681 - protein, 210 aa, Lactobacillus buchneri
LAKYKKGRKRRAKKANAVLMLILVICGLVIIFGFHALYENGYHSSNIQSSNDEVAIEHRKFINKLAPQAQRLQGQYNILPSITLAQAILESNWGTSKLASKYYNLFGVKAQDNTTNSVYLNTQEFVNGRYVTIKARFQVYQDWNESLADHAKLLAYGTKWNPQQYKDVVAANNYLQAADGLQQDGYATDPAYTKKLIAIIRQYKLYQYDD

SEQ ID NO: 5682 - protein, 190 aa, Lactobacillus buchneri
MDLLKKRILEDGTVLPGNVLKVDNFLNHQVDAKLMDQIGAEFARLFKDEGVTKVVTVESSGIAPALTTAIHMGVPLIFARKHKSLTLTDNLYTASVYSYTKQVSNDISIDKRFLKPNDRILIIDDFLANGQAVQGLLEIAKLANVKVEGVGIVIEKSFQKGHTMIEKSGVRLESLARIASLDNQKVTFVD

SEQ ID NO: 5683 - protein, 386 aa, Lactobacillus buchneri
LANANVIYPGQTIGILGDSISTPTLLARAKQMGFNVGMYSSNENSKAMELADYKYIGPYTDKETLKMFAERCEAVIYDNQFIDSDVIRYISQYTAVAQRDGLLDIVQDRLIERTFFETLNINMVPYSTIVTLEDIYQAINSIGYPAILKPIQRGLNGGKELLIKNQADIVLASGFLDSGTYILESYVEHNTDYSVVVTRTESGSIVMFPPVEVMYEGDQLMTAYTPAKLDPSVKKEMTRITNEIANNLDYVGTFEVTLFLAKSGSIYVSRVAPKLSAAGFVFDYAANADEFEQHLRAIAGLPLTQIIPGIATVYQAIRQQEYQRVQTQWVIKDNWHFTFYGNEPTDDHQLVGHVLIPTKSISDTLVKLEATGIWHDIDYKTKYSNM

SEQ ID NO: 5684 - protein, 744 aa, Lactobacillus buchneri
VAEESLLAGLNKDQKDAVIHTEGPVLIMAGAGSGKTRVLTHRIAYIIEHNHIMPWRILAITFTNKAAREMRERVSKLLGEGGNDVWVSTFHALCVRILRRHIDLLGYNKAFTIADTSEQRTLVKRVLRDLNIDPKKFDPRAVLSAISNAKNDLLTPKAFKAQANSAFDQIVADVYDRYQAELKQNQSLDFDDLIMITIQLFDEHPDVLESYQDKFQYIHVDEYQDTNEAQYRLVNTLAKKNRNICVVGDADQSIYGWRGANMQNILDFKKDYPDAHVTLLEQNYRSTKTVLDAANSVIAHNDNRADKNLWTENPKGDQISYYRGQTENDEARYVVAKIQEEMAKPKRNYGSFAILYRTNAQSRVIEETLLKSNIPYTMVGGHKFYDRKEIRDALSYLTLLANPNDSMSFERVINEPKRGIGQASIERLRLFANDHQWSLLEAAKNVDLANEISTRAKNSIAEFEQTMRTISEKMAQLSITEITEEILDKSGYLSTLKASKSLEAQTRLENLEEFISVTQKYDEENEGETGQQNLVNFLSDLALVSDQDSLEEDNSQVTLMTLHAAKGLEFPVVFLMGMEEGLFPLSRAAADESELQEERRLAYVGITRAKEKLYITNAYSRMLYGRRQNNPESRFVNEISPELIHSDNQQQTESPLSTPFDRRTRRATATTYRRPGKVVESPKGSGADKLAWAVGDKVSHKAWGTGTVVKVTGTGEDMELDIAFKQEGIKRLLAAFAPIKKQEN

SEQ ID NO: 5685 - protein, 675 aa, Lactobacillus buchneri
VAFENMSEQQAAAKAGDLRKQLNQWADEYYTYDAPSVEDAVYDQTYQQLVALENQFPQIVTPDSPTQKVGDHTLPGFTKVNHEIRMLSLGDVFSKEELAEFVDRLSENDSVAFDYNCELKIDGLAINLRYENGVFVQGSTRGNGQIGEDITRNLKTIKSIPQKLTRPINIEVRGECYMPKESFAKLNEQRQLDGEEPFANPRNAAAGSLRQLDPRVTRSRKLSTFMYNVADIDDLQSDTQSGMLAELKELGFTINPDFKVAHNMADIDNYVDKYKDLRDGLPYGIDGIVIKVNSLPLQRSLGATVKVPRWAIAYKFPPEEVQTIVRDIEWTVGRTGVVTPTAVMDPVILAGSTVSRASLHNPDYLAEKDIRVGDTVKLHKAGDIIPEISQYLPDKRPANSQAYEIPTQCPSCGSTLVHLDQEVALRCINPQCPAQLKEGLTHFASRDAMNIDGLGPKIIAQLFEKHMVSDVAGLYDLSFDQLLTLDKFGEKSATKLLAAIDNSRSNSCERLLYGLGIRHVGIKAARLIAQRFKNIDKVMQASAQDIAEIATMGMIIADSVVTYFSMPESKQLIDQLKQVGVNMDYLGVTDEQLAESDSFFTGKKFVLTGKLQNITRPDATQWLEDHGAKVSSSVSKNTDIVVVGEDPGSKYDKAKSLGIQTWDEARFHQEMADEK

SEQ ID NO: 5686 - protein, 380 aa, Lactobacillus buchneri
VKKIILGISIILSGFMLAACGSVDNLSKDTSNSSGSKAKTQLTGQTNTDYYQGVIKNGRYQTSKSRGVSVSQESNQFNIKGFENGLLDISKKEFSTKKYIFQEGQYLSTSTVENWLGRQSKSNPTGLNPVKSKSTNPNTRNPIYLSQIDEQDFMTQSGKSLRLSGMTIGLGINSVDYYKKTAYGPTYETDISDAQVKKQGKAIANQVIKRLRQRRSLKNIPIIIALYKQASDDSLVGGNFFAYSMNDDGETKVAKWDKINQKNYVFPLQSDKKGPSQNDADSFDNFKSEIQGFFPNLSGVTAQAQYTDGSLSGMNISITTQFYSQTEIISFTQYIQNAAQRYLPANAPIDITVSSTEGIQSFLSRKQNEKKFSAHIFNSY

SEQ ID NO: 5687 - protein, 103 aa, Lactobacillus buchneri
MTEKISEDQVKHVAELAKLKIADDQLPYFTTQLDQIIGLFETLSEVDTDGVEPTSSVTDQINVMRDDIAEDWHQRQALLDNAPDTADGYIRVPTIIDESGDNE

SEQ ID NO: 5688 - protein, 487 aa, Lactobacillus buchneri
MNYFDQSLSSIHKQLVNKEISAKDLTQQTLDNIKSVDNDINAFITVDDEGALKKAADVDAKGIDADNLLSGMPIAIKDNMVTKGLTTTAASKILENFKPIYDATAVDKLNKLGTITVGKTNMDEFAMGGSTENSAFKITHNPWDTTKVPGGSSGGSAAAVAAGEVIAALGSDTGGSIRQPASFNGVVGMKPTYGRVSRWGLIAFGSSLDQIGPITRNVSDNATIMNAIAGHDEHDLTSSTKEVPDFTSTLNKGVKGMKIGIPTEFMAQGLDDDIKQTVLDTAETFKKLGATVEEVSLPHTKYGVAAYYIISSSEASSNLQRFDGIRYGRRAKDVKDLEDLYVKSRSEGFGDEVKRRIMLGTFSLSAGFYDAYFKKAAQVRTLMINDFTNVFKDYDLILAPTAPTPAYGIGEDVSDPMTMYMNDVLTLPVNLAGLPGMSIPAGFSKGLPVGVQLIGRPYDELTVYQAGSAFEQETNFAKQTPKMGGNN

SEQ ID NO: 5689 - protein, 473 aa, Lactobacillus buchneri
MNFETTIGLEVHVELKTNSKIFSPSPVEFGDEPNSNTNVIDWGYPGVLPTTNKGVVHDGIMAGLALHAQIERHPHFDRKNYFYPDNPKAYQITQSETPIAHDGWVEIDVDGKKKKIGIAEMHIEEDAGKNSHASEYSYVDLNRQGTPLIEIVSKPDISSPDEAYAYLEQLRQVIQFTGVSDVKMEQGSMRVDVNISVRPVGQQEYGTKTELKNLNSFTYVKKGLAFEEARHQRVLMSGGKIAQETRRFDESTGQTILMRTKEGSDDYRYFPEPDLPVLNISQDWIDEIQSELPEAPAKRRERYVNELGITDYDAMVITQTKEMSDFFDKMIAAGADAKLAANYLQGDVNAYMNDNQVELQDTKITPEHLATMIKLISDGTISSKMAKKVFKAITNGEEPKKFVEDKGMVQLSDPAKLQPIVDEVVAANPQSVEDFHNGKDRAIGFLVGQIMKQTHGKANPQVINKMLKDSMSK

SEQ ID NO: 5690 - protein, 332 aa, Lactobacillus buchneri
MRKRARVIYNPTSGRELLKQKLVDILNIFEQAGYETSAYATTPAKDSAKNEARRAAKDGFELVVAAGGDGTINEVVNGIAPLKKRPKMAIIPAGTTNDYARALHIPREDPVEAAKVVLKDQTLRMDIGKAGENYFINIAAGGLLTELTYDVPSDLKTFFGYLAYLVRGAELLPRIKPIEMDLKYDDEEFKGKASMFFLALTNSVGGFEQIVPDASLDDGKFTLIIVKTSNLVEILHLASKVLNGGRHVDDPRIIYKKVRKVTAKPVHDRMQINLDGEYGGDAPMTFVDLKQHIEFFANTDEIPDDAYSDETNEMRRVEKNFVTGVDKLPDKE

SEQ ID NO: 5691 - protein, 456 aa, Lactobacillus buchneri
MKKMVPVEKNQNYDVDITDLTYQGLGVAKIDDFPIFIENALPTENVTMKVIKVKKNFAFGRVVKINQKSKDRVELVDKAYTQTGIAPLQHLKYDAQLKFKQHQIQVDFDKMKLDVTVNPTIGMDDPTHYRNKAQIPVRSINGQLQTGFYRKHSHDLVPIEDFYIQDPKIDEAVVVVRDILRKFRVQPYDEQTNKGVVRNIMVRRGHYSHEMMIVLITRTEKLPSSSEIVAEIEQSLPEVKSIVQNVNPEKTNALMGKKNKVLAGKSTIEDTLLGLKFDISASSFYQVNPVQTEKLYDLATKKADLSADDVVIDAYCGIGTISLSMARVAKQVYGVEIVPEAVEDAKKNAKLNNLTNVHFVTGKAETQMAKWQEDGLKPDVISVDPPRKGLDASLIDSVVKMQPKRVVYVSCNPATLARDVKLFTEQGYQVNQPIQPVDQFPQTVHVESITVLERGH

SEQ ID NO: 5692 - protein, 399 aa, Lactobacillus buchneri
MTAKLQVQHLTKIFGRRIQKAEELLKQGKSKAEILQNAGATVGVSDANFEVNDGEIFVIMGLSGSGKSTMIRMINRLIEPTSGKVLIDGENLTDLNKKELLDVRRNKMSMVFQNFALFPNRTIIENTAYGLEVKGVDKDERLKKAHDALELVGLHGYDDQYPTQLSGGMQQRVGLARALATDSEILLMDEAFSALDPLNRKDMQDELLDLQENLHKTIVFISHDLNEALRIGDRIMIMKDGVIVQTGTPEEILTQPADEYVEKFIEDVDRTKVLTASNVMIRPTFVNIDKDGPRIAMRRMRENEISSVYVVNSKREFVGVADADHVMGLIKQKNPDLMSVVQTDVPTTHPDTPITEIMEKISQTPIPFAVLDDQKHLLGIIIRGAVLGAISGNEVTEDE

SEQ ID NO: 5693 - protein, 283 aa, Lactobacillus buchneri
MNNIPQLPVSSWIDKFVDWLSGFEGFFNGVTNFIGGIINGFQWVFDILPIWLFMLIVLGATYWLNRNTKHWTLLIFEAIGLLYIWNQGFWRDMTQTLTLVLTSSLIALVIGVPLGIWMAKSKVFAVINKPILDFMQTMPAFVYLIPAVAFFGIGMVPGVIASVIFAMPPTVRMTNLGIRQVPNDLIEAADSYGSTGWQKLFKVQLPLAKSTLMAGVNQSMMLSLSMVVIASMIGAMGLGNKVYFAVGRNDAGGGFAAGLAIVILAIILDRITQAINRTKVPKS

SEQ ID NO: 5694 - protein, 300 aa, Lactobacillus buchneri
MRKKNNRFLLTIALFFSMILLSACGSKPARYHANESLGKQINYTITGIEAGAGIMSSTQKAMKAYGLDKGKWQLQTSSTAAMTSTLGKAIKNHQPIVVTGWTPHWMFTKYNLKFLKDPKNVYGKAEDIHTIVRKGLKKDKPQAYEMLNRFNWRPKQMADVMLKVNNGEDPHKAANDWIKANQKQVDTWTKGIAHVHGQSIKLTYVAWDSEIASTNVVANVLRSLGYKVEIQAMEVQPLWASIATNAADGMVSAWLPTTQGLYYKDYKGKFDDLGVNLHGAKVGLAVPTYMKNVNTIGDLK

SEQ ID NO: 5695 - protein, 223 aa, Lactobacillus buchneri
MTMTKEITTAQLAKYLDHTNLKPEATEASIRQTCEEAIKYNTASVCINSHWIPLAAELLKDTTVNPITVVGFPLGATNTETKVYEAITAIDDGAEEIDMVLNVGELIGGNLDYVTADIQAVAEAVHAKHKMLKVIFETSLLNDEQIVNACHASEAAGADYVKTSTGFSTEGATLHNVALMRKTVGNKLGVKASGGIHSRQEALAMIEAGASRLGVSATVKILS

SEQ ID NO: 5696 - protein, 398 aa, Lactobacillus buchneri
MTVKKYKRIFGIVMDSVGTGEAPDAAKFGDVGSDTLGHVGEAYQGKLQIPNLQKLGISNLRQTAIEGVDKVTSPIGYYGKMQEISAGKDSMDGHWEMMGLPVEKPLNTFPNGFPEEILKKLADFSGRKIIGNRPESGTKIIAELGEQQMKTGDLIVYTSGDSVLQIAAHEDVIPLEELYKICEYARTLVNGPKYTVGRIIARPYVGQDKDHFTRTANRHDFTLEPTGTTDLDDLQKAGVHTVGIGKINDIFSGHGIDEGYHNESNMDGMDHVDHVMAEDFTGFCFTNLVDFDAMYGHRRNPIGFGQALMDFDKRLGTVLKNLKDDDLLLITADHGNDPGFKGTDHTRELVPLLAYSPSMQHAGSLGIRKTFADFGATVLDNFNVAGNGVGDSFLADLK

SEQ ID NO: 5697 - protein, 237 aa, Lactobacillus buchneri
MSTHIGAKPGEIADTVLMPGDPLRAKFIAETYLDNPVRYSEVRNMFGYTGTYKGHRISVQGSGMGIPSLAIYTTELIKEYGVKTIYRVGSCGGMSPDVKIRDVILGQSGTTDSSIIQNTFGPGMYYSPIADFGLLDSAYHTAQEMGINTKVGNIFAADRFYNDELDIHKLIDYGVLATEMETSGLYLLAAKHHIRALTILTVSDHLLTGEALSAKERETSFDEMARLSLETAIKNMS

SEQ ID NO: 5698 - protein, 315 aa, Lactobacillus buchneri
MDEIKDITKLKQSLRVAELYFQDNLSQIEIAARLGVSRPTVSRLLQYAKDNGLVKIQIVNPLVDSQVLSKQLSDKYGIEFHVVPNNYGGTVSIQDGVGRYTADFLSANVQAGDIIGIGWGETIHSVTKQLEEQDVAGVQVVQLKGSISHSQEKTWAYESVNELAKAYHTHPEYLPLPVIFDNQVTKEMVETDRHIKHILDLGRRANVALFTVGTVRSEALIFQLGYFNDQEKAEIQRLAVGDIFSRFVDENGQIVSKEINDRTIGIQLDDLKDKPHAILVASGNRKAAAVHAAINAHYTNCAILDQSLAQLLLDY

SEQ ID NO: 5699 - protein, 433 aa, Lactobacillus buchneri
MRMVDVIHTKRAGKQLTDEQIQFFVDGVVSGDIPDYQISALLMAIFFQGMTSEEQAKLTMTMMKSGDHLDLSQIPGVKVDKHSTGGVGDKTSIPLAAVVAALGIPVPMISGRGLGHTGGTLDKLEAIPGYQVEISEDDFIAQLKKDQLAIIGATGNIAPADKKIYALRDVTDTVDSIPLIASSIMSKKIASGADALVIDVKTGAGAFMKTLDDSRALAKALVEIGKGVGMQCMALITDMNQPLGDAVGNALEIQESIDLLKGNGPADLEKLIVVIGGYMAVMGGQAETTEEGQQKCATVIHNGQALERFRAMIADQGGDPAVIDDPEHVLPQAQFKIDLPAPSSGVVSKIVADEIGIASMLLGGGRQKADDQLDYAVGIMLHKKIGDQVKTGESLLTIYSNRDDVDDIKKRLYDNIEISESANKPTLVYETVE

SEQ ID NO: 5700 - protein, 148 aa, Lactobacillus buchneri
MSVLDASEIMDLIPNRYPILFMDKVDELNPGESIVVTKNVTINEEFFQGHFPGNPVMPGVLIIESLAQAASILILKTEKYKGKTAYLGAIDNAKFRKVVRPGDVLKLHVTMEKQRENMGKVKCEAKVDDKVACSAELTFIVPDPKKKI

SEQ ID NO: 5701 - protein, 155 aa, Lactobacillus buchneri
MNSQSDEIKKDTDFINESLINVYDSIMRIEESEIRKSRFKDITAKEVHLVHTIGLHDRKTTSEVAHILKLSKGTLTANLNNLERKGYVMRIANQEDHRIINLGLTSKGRLLYRAHDAFHKLLVKRFLRGFDDDDIRLIKQAMVNLEDFIDEVSAK

SEQ ID NO: 5702 - protein, 327 aa, Lactobacillus buchneri
MTFEDFKIIETASSVPQRVVDNDELSSMMDTSDAWITQRTGIKRRHVAVEETTSSLATAVATKLLAKSGLKPTEIDLIVVATMSPDYLTPSVSAMVQGNLGADQAIAFDIDAACSGFVYGLKVVRQMLKADRPMHAILIGAETLSKLLDWHDRSTSVLFGDGAAGVLMTNQSGDSGSFIAEDLKTLGKLGKHLTAGQVGVKSPFAAPKTSYSPFFKMNGHRVYGFAVKNVPESINRALEKANLTVDDIDCFVLHQANERIIEKIADTLGASMNQFPVNINEYGNTSAASEPILLAELVAKQRIKRGDVIALSGFGGGLTVGTMIIKY

SEQ ID NO: 5703 - protein, 79 aa, Lactobacillus buchneri
MTKEEVFNKVKDIIVDQLDVDADKVKEDTNFKNDLDLDSLDIFEVVDKIEDTYDIEIDTDEGMETVGELVDYVLKQQTK

SEQ ID NO: 5704 - protein, 305 aa, Lactobacillus buchneri
LKLGYLFSGQGKQFAGMGQDLYQQEPIYRQTIEEASQILGKDMSDSKIFDDPANTQVSIVILSTGIYRILAHDLGQPVGATGLSLGEYSGLIAADSLSFEDGLPLVGDRNHYMDQAGQHYPGKMAAVLKANANLVDEACRVGSKVGPVYPANYNTDTQIVIGGSAAGLNAATEYLHEHGIKRVVPLKMTVASHTPFMQEASDELSKRLQTVNFQDPDFPVFSNTIIKPFTRLNVKQTLVNQLVNPTHFNECLKELLNLDANVLIEIGPGDTLMKFAKPLICNADKFHVDSVETLNQVRSNKKLVK

SEQ ID NO: 5705 - protein, 243 aa, Lactobacillus buchneri
MTETKQVALVTGAAKGIGLAIAKRLADDGMTVVINAHHELSDEDSQQLAAAGYSFDVLVGDVASEADAEQMINSVVEKYGQIDVLVNNAGITKDKLLSRMKLADFQAVLETNLVGAFNMTKFAMKLMQKARKGSIVNISSISGLHGNLGQANYSASKAGLVGLTKTAAREGALRNIRANAVAPGMVKTDMTEKMSERRQSEFTDQIPLKRFAEPTEIADAVAFLVGNQYITGQVITVDGGLTI

SEQ ID NO: 5706 - protein, 409 aa, Lactobacillus buchneri
MSRVVVTGLGAVTPIGNDVDSFLENLFASKVGIAPITKFDSEPTGITVAGEVKDFDPLKRVDKKFAKRNDLFCTYALYSATEAMENAGLIDGGVDPEELGVIYGSGIGGLTTIEQQVIKMHDKSPKRVSPLFVPDSIINMAAGNISIAFNAKNTSQAIVTACSSGTNAIGNAFEYIKQGKAQVMIAGGTEASVNEIGIAGFAALTALSKETDPKKASIPFDKDRNGFVMGEGSATLILEDYDHAKARGAKILAEVVGYGTTSDAYHMTAPDPEGKGAKRAMQQAVKEAGIDETQVDYINAHGTSTHANDSAEAKAINEVFANNDHVKVSSTKGMTGHALGAAGAIEAVATIGAILHNQMPVNVGVVNQDEECDVELVDDSNKNAEVNYAISNSFGFGGHNAVIAFKGCD

SEQ ID NO: 5707 - protein, 157 aa, Lactobacillus buchneri
MDEKEIERLLDKFDRSSLKNFELAQDDFKLKFSKREGDDHAVVEDSAQAASASTNGLGHGQNSQPTTVEQPETPVAQNVAEIKAPLVGVVYFAPSPDKPAFKKQGDHVEKGDVVCVIEAMKMINEVKSDVTGTISNILVEDGSMVEYDQPIFQVTKG

SEQ ID NO: 5708 - protein, 138 aa, Lactobacillus buchneri
MKPDVQDVIPQRYPFQMIDKFIDVKPGESAAAVKLISINEWFFANKQANNLVVPRPIMIESMAQTGVAAILSMPEYQGKNAFFGGIKNAVFQDDFRPGDKLTFTVELKKLKHNIGLGHGTIHREGQQICEADLIFAVE

SEQ ID NO: 5709 - protein, 459 aa, Lactobacillus buchneri
MFKKVLVANRGEIAVQIIRALHDMGITAVAVYSSADKDALFVHLADEAICIGGPQPSESYLNMAQIISAANLTGCEAIHPGYGFLSENAEFAELCETCHIKFIGPSHELIALMGDKANAREAMKKAGVPVIPGSDGVVNTVAQAEQVADQIGFPVLLKSAAGGGGKGIREVDRPEELKSAFEQTQQEARISYDDEDIYVEKLIRQAKHVEMQVIADNFGHVVYLPERDCSLQRNHQKVIEESPCVLISAEERRHLGEIVANATLKLGYTNTGTFEFLMDDEHHFYFMEMNTRLQVEHTITEEVTGIELVKGQLAVAAGEELPFTQADAAVKGHALECRLNAEDPTNNFAPQPGQINHLFFPAGSLGVRIDSGVTNGSFISPFYDSMIAKVIVHLNDRDTVISKMHRILGELEIDGIRTNQSFLDYLIGTDKFHQGIYSTSYIQNEVLSDKEGFHATQSV

SEQ ID NO: 5710 - protein, 281 aa, Lactobacillus buchneri
MLRSRFNMPSHEELVKRMDAIPDHVLRECPICHATFFSLRAGSTKTCPNCGYGFRITAKRRAKITFDSFDEIDKSMTVPDQYTDEKYLAKVKKAKKVTGINESVLTGIGTLDKQQVGVGIMDPFFVMGSLGSATGEKITRLFEEATRKKLPVIMFTASGGARMQEGIHSLMQMAKVSGAVAEHSRAGLFYVVVLCDPTTGGVTASFAMDGDVILAEPHALVGFAGRRVIEQTIMQKPPKDFQSAETVMAHGFIDAIVPRKQMKATLSRLISLHTKENVYGR

SEQ ID NO: 5711 - protein, 256 aa, Lactobacillus buchneri
MADKTAYQRVKAARRPDKITTAELINHLTSDFFEQHGDRLEADDPAIIGGIGLLNDKPITVVGIQKGSDTDQNIARHFGSPTPQGYRKALRLMKQAEKFHRPILALVNTPGAWPDVESEYHGQGSAVAQNIIQGMQLRVPYITIIVGEGGSGGALALSCGDRVFMFEDSIYSVLSPEGYASIMWKDSSKVKEAAEELKLTPEALLADGIIDKIIHEYQPGEDLSALRDFLDQEFSQLAKLPIDDLVDRRNKRYRNF

SEQ ID NO: 5712 - protein, 260 aa, Lactobacillus buchneri
NADHFABIMSGFLDGKTIVIMGVANKRSIAWGCTQAILDQGAKVILTYQNDRIKKSLERFVPDDLDLIECDVADDANVKQAFETIGNQYGKIDGVIHAIAYADKDTLTSGLVNTTKDGYDLAQNISAYSLIAVARYAQPVLNNPASILTLTYFGSTRAIPNYNMMGVAKAALEANVRYLASDLGENGIRVNAISAGAVKTLAVTGIKHHGELLKESESRTVDQKSVTTSEIGNVAAFLMSDLSTGMTGDVVYVDKGVHLI

SEQ ID NO: 5713 - protein, 330 aa, Lactobacillus buchneri
MVNHQRQILDALLTAAGRYVSGNELAKKLQISRPAVYNNIQKLSHCGHVITTRKGLGYCYQKSQFFDDAVIDHYRTTTFPVAIHAFASISSTNDYAKQFGSSQDFTIPQVFVADTQTQGHGRLGRHFYSPAKGGIYLSILIPLQNRRTIHSGLITTGTAVCVVRTLQQFFPDEDFRVKWVNDILVHDKKCGGILTETISSLEDGLHENVVVGIGLNIDSTDFPDQIAHKAGAIVTNTAIDKNRIAASLIDNFFYMYQTYTSGNFLQEYAKLSETLGKRVQIVMGNRTITGLADRFTGDGALVVKQDSGEPITVSSGEVTKVYLPGNGYSG

SEQ ID NO: 5714 - protein, 180 aa, Lactobacillus buchneri
MKIRQLTQTALMIAAIIVLGMIPPIPLGIIPVPIVMQNLGIMLAGLFLGSKNGTIAVGVFLLLAFLGFPVLSGGQAGPAVFIGPTAGYLFGWLITPLMMGYRRSRPFMSHSWGQLIVIWISGVLIVNLMGALWLWWVTPISLIGALTSGLLFIPGDTLKAVVAYLVAVRMKVLSRAARQV

SEQ ID NO: 5715 - protein, 453 aa, Lactobacillus buchneri
MILKLLALLIGIIFLLVLIIKFKINTFVSLVLTAVVTAIMLQMPLGTIADSVSNGIGSQLGELSMVFGFGAMLGRLVSDSGGAYMIAETLIKRFGKKRLQIAVMLASFILGIALFFEVGMVLLVPIVFAIAVEAGVPILYLGIPMAAALSVTHGFLPPHPAPVAIAQVLGANDGKVLLFGFVIAIIAAYIAGPLFSKMARKFAPAAFERKGNLSSIGEVKQFTPEESPSFGLSVLTALFPVLLLAIATIYKMTVNGGVDPKNPSVIDSIIEFIGSPSIAMLISLFFAMYTMGWGRKRTTAQIMESLENAVKSIAMLLLVIGGGGAFKQVLIDGGVGKAVAQLFIGSPISPLILGWLVAVVLRIALGSATVASLTAAGIVAPLMAQAGVDPALMVLAIGAGSLAASHVNDAGFWMFREYFDLTIKQTLQTWTVLESIISVVGIIMVMGLNLIFH

SEQ ID NO: 5716 - protein, 520 aa, Lactobacillus buchneri
MDYTLGVDIGTTSVKTVLYDVKGKVHGYSNNGYPLYQDTPDMAEEDPEEIFSAMSDGITELVRKANMKPGELKGVAFSCAMHSLILLDENHKPLTRAITWGDNRAVNYADKLKASPEGMEIYKHTGTPIHPMTPLTKLIWLRNDHADLFKQARWFVGIKEYILYKLFGVLKEDYSIANATGMFNIYNMDWDEQALKLAGVTRDQLPDLVDTTYQLKGMREEYAKVLGIDINTPFIIGASDGPLANLGVNAIQPGVVAVTIGTSGAVRVVTDKPHTDPKARVFCYYLAKNMWVVGGPVNNGGVVFRWVRDQLCAPEKVTAEQMHIDPYDLLTEIAAKVPAGSDGLLFFPFLGGERAPIWDANARGSFFGLNRTHTRAHMIRAVLEGIVYNLYTVALALEEVVGQPTSIQASGGFARSALWRQMLTDIFEQDVAIPESFESTALGAATLGMYSLGLIDSLSDVSNFVGTTVVHHPDPKNFQAYRELIPIYIRLSRSLQPEYKNIAEYQRRHEHEDEDAEKSE

SEQ ID NO: 5717 - protein, 281 aa, Lactobacillus buchneri
MSSPVQLLKQSFDELSRTNKKIAKYVMENPQAASEANIEDLAEVTETSTASVSRLVKTLGYGNFREFTLALAYTQLRPQNLPIFKDIDANDSLGTIADKIFNSSQRAIQDTRAGIDEDEFARAVLRIIHCRRLGLFGLGGSSVAALDGYHKFLRTSIDCFYYPDFDVQLMEAVKLGEEDCAIVVSHSGKNRQTLKVAETLKKRKVPVIGITSYPDSPLALHSDITFISSSDESNYRSEGMYSLLAQLAIVDTLFMMATVRMGPATEDAIRNVQNIIESTRT

SEQ ID NO: 5718 - protein, 252 aa, Lactobacillus buchneri
MKRRDIQPIYAETYQRRKRTRRVVFGIFLLILIGFSTFLLLRWHENQQLKKYPIHGVTIDQSNGYIDFESLKSKGISFVYLKATQGAAFTDDSFQSNFERSQGSQLPIGVYHYFSFTSSPTAQFKNFVRQVKYNTGSLPICIQIQYYGTFDQSTIHWQAARKEVRQLSHLLRQYYKRPVVISATQQIIKSLQLKANAKTQFWLTDGKIGRPNADATFIQADDKAGFKLDSQLIFLPMSVFNGNRRQWREYIN

SEQ ID NO: 5719 - protein, 122 aa, Lactobacillus buchneri
LRKRSFFIFMVSFLISLFHTKRTPKHRPDPADPMFFVGTWQFKDHRERVHRLEIDPDLKLLIDGKDMSAKVSLLTRYELSYVDKFGYKLEIRGNEARPIKFYDESENYTYDLQSANEIEQSN

SEQ ID NO: 5720 - protein, 333 aa, Lactobacillus buchneri
LIKLGIIGTNWITQQFIDAIKLSRKFDLTSVYSRHDQTAKTFAAKNGAQETFTDLNAFFTKGQFETVYIASPNSLHFEQAQMAIQHGKNVIVEKPAFSTQKQMAKIQALLDENPQVLYFEAARNIHTENFHAIEKKLGQLKTVQGAEFTYSKYSSRYDLVLEGEEPNVFSLKYAGGALQDLGVYTVYDAVALFGMPEEAAYYPQLIRTGVDGKGTAILQYPEYNVTLNFSKITNSHMTSEIYGLKDLIEIDDAGEINAVIYIDDDRNKQVIGNTIDENPMLPEVEDFARVINDPKNPQNKHDYDYWRQLSVYVNKLIYNLRQDAHISFVGEKK

SEQ ID NO: 5721 - protein, 429 aa, Lactobacillus buchneri
LIEEFKQHAKELGYNQPTAIQQAVYQPLKDGQSVLGLAPTGSGKTVAFALPLLENIQPEDGLSLLVIEPSAELAMQTQKVLLEWGKLIGLSVQGIIGGANINRQVDKLKQHPNVIVGTTGRIVNLIDLGKLKLDSLKAIVIDEADNLLSEDTLASIRSLVDLADDSVTLGFFSATQNDLLAHVNRWFGQDIQTFDVSDIDDTRGEVKHTLLEVSNRKKAQMLLRFLHMKDFKALVFFDQLDTLQKVAGFLSHRHIKEAAQLTSEQRQTARQKALRDFRDGKIRLLLTTDVAARGMDIEKLPVVVNFDLPSDPKTYVHRVGRTGRMHQDGMVINMGDDHDLRDLKKLVKPYGYELSNIYFDGNQLSDTRPKQPVNLDDEPKTSKAASSQDVKRSSEAKKTGRKPMPAKPHGKKKHKHSKRKGMHHKRTEG

SEQ ID NO: 5722 - protein, 368 aa, Lactobacillus buchneri
MDIRKEAVQANAKLSTLEKVSYSFTDMAGNLLYVSMSSYILYFYTDVFDIPVSAAGMIILIACIVDAVSAIFWGSIVDHTHTKWGQSRPYFLWLAVPFALSTFLAFTAPNISGVPKLLYAGITYVLAAGVIYTGIQTTISAILPNLTLDPTERIGANSYRMVGSLIGSFVTSTFTLPLVAFFGNGNDKHGFMMTIAIFGVAAILLLITAFKNMRERVPVSQKSLPFKQSLKATVGNVPWYLLVISFATFWIAQADRNSFSTYYAKYNLGNTELAAVFNGLQVLGIISSIAIPFIVKITNKTATMLIGLGIGAVGQTMMALVGGNFILVIVSWLIGVLGSALAMSMPFAMLADTVDFGEWKTGVRAPVS

SEQ ID NO: 5723 - protein, 279 aa, Lactobacillus buchneri
MRRIKFRWLMLLGVFAVLGLVITGCGQKKSADKGPLTVATSGTLYPTSFHDQKTNKLTGFDVEVVRAVAKKLGRKVDFKEMNVDGQETAVKTGKADMAANDFAVSPQRAKEFAISTPYKHSFNSIIVRKKGDSGIHSWADIKGKKAAGEAGTGYQRLAKQLGAKTVNYNNVSNDVYLRDVESGKTDLIMNDYYLQKLALAAVPNNTLKIMPNMYFRTNEDGKGVGILMKKGNTKLQKQVNKALKELKKDGTLKKLSEKYYHADVTKQPHVHISKTFTIK

SEQ ID NO: 5724 - protein, 221 aa, Lactobacillus buchneri
LDIIKYLSIPDFFNAPLAFRSIPRILAGFPMSIGLTAISFILSLILGLFLTLAQLSHHKLLHYPARAFISFMRGVPMLVLLFIIYFGFRADALPAAVIAFTINCSAFVSEVYRSSFSAVDHGQWEAAYSLGLPYRKVISKIVFPQAFRIAIPALGNILLDLFKGTSLAAMITVSEMFMDAQIVAGANQDYMTIYITIAVVYWFFCWLMTIGQTQLERELAR

SEQ ID NO: 5725 - protein, 48 aa, Lactobacillus buchneri
MPKINRQTLRQQRQEFPEGYYTKADGFKLLAIAAVMILILIVVAKYLM

SEQ ID NO: 5726 - protein, 148 aa, Lactobacillus buchneri
MIDRLKKLYDKYEEVIAYLFWGVLTTLVNVAIFSGLHLFTNINYMVNNFIAWVISVLFAYITNKAYVFHSPSKSFVSDLKEMGSFFGGRVATLVIEWILLWIGISLMHQNQILVKIFENIVVIILNYFWSKWAVFKNSTNRNQPKQGR

SEQ ID NO: 5727 - protein, 315 aa, Lactobacillus buchneri
LKTISLIVPCYNEEPTVELFYNTTEKVFDKLNASHEEHYHPDYLFINDGSADKTLDVMRRLHSQHPDEVHYISFSRNFGKESAFAAGLANAHGDYVAVMDVDLQDPPELLLQMVDILEDPKQDYDVVGCVQTSRKQNPIRAFLSASFYKIINRMSKVQMKQNVRDYRLMSRKYVDAILKLPEYNRFSKGLFSWVGFKTKYLEYEGVPRAAGETSWSIFQLFEYSMEAIVDFSDVPLKLATFVGILTFFLSIIGLFFVVIRALFFGGSVNGWASMVSIILFLSGVQLFSLGILGTYVGKIYLETKHRPKFVIAEKR

SEQ ID NO: 5728 - protein, 370 aa, Lactobacillus buchneri
MKPIKVMTIFGTRPEAIKMAPIILLMQQHLDEFQPITVVSAQHREMLDQVLDVFHITPDYDLNIMKQGQSLSDITTRVITELDPIIEKAQPDIILVHGDTTTTFSASISAFYHQIKIGHVEAGLRTWNKLSPYPEEMNRQLTDVLADLYFAPTSLSRDNLLKENHPDKNIFVTGNTAIDALKQTVTENYQHSVFDELKENSKMILLTMHRRENQGEPMRRTFEAIKEVLANHPDVEVVYPVHLSPAVQKVAHEVFDGVKAVHLIEPLDVLDFHNMSARSYFIMTDSGGVQEEAPSLKKPVLVLRDTTERPEGIQAGTLRLVGTDPKVVKSEMERLLDDPKEYQKMAEAKNPYGDGHAAERILKAIRDQFN

SEQ ID NO: 5729 - protein, 299 aa, Lactobacillus buchneri
MKRLYEAVKNFIEIIIKRYSSGDVSDSAAVLAFYTLLSIFPIFFIVGSILNLFHIHITEVEVYLRPLFPDRIYSMLEPIINSTLQSGGASQLSVGLIVTIWSASRAIAAFQRSINKTYGVAADQTAISNRLISFVWMLVLVLALVVLMMVFAFGQMFFQWLTPILNVPGWILNLISTVKWPGTIAVSWLLLSLLFYFVPTAKVKFRYVWVGALIATLGLMLLAQAFTVYLKFFSQRIDAYKTIGTFIVLMFWLDFSGVIMLFGGVVNATIQEIRQGKIQEQEDAIENVWKRARKIRKHK

SEQ ID NO: 5730 - protein, 149 aa, Lactobacillus buchneri
MITAHVVYATITGNNEDIADIVTEALEDADVQVEETEISQTDPSVFENVDICVVCPYTYDEGALPEEGMDFYDDLSDLDLKGKIFGVAGSGDVFYEEFYNTSVDKFEEAFEKTGATKGAESVKINLEPDQKDIEKLDQFTAELVAKVNQ

SEQ ID NO: 5731 - protein, 265 aa, Lactobacillus buchneri
MAKTITKIEAQKRKGRFNVYVDGQYAFPISEEVFIKYRVFKGMELDDQLIETLKNADNISKLHSRALNYLAHNLRTEYEVRQKLAELTEDEDAIDQVIDILADQTLIDDQRYADSFVRTVVRERKNGPDWIRRHLKDKHVASDQAENSLNQYYPAQEVIEIGGEVAEKQLKRYRRDSAKMAINKTKELLMRRGFPYGDIEEIMNQVDTSDMATKDQAVIDQVAEKYWRQYRKLQPYERNQKVKQALFRKGFLMDDITIAMAKLTE

SEQ ID NO: 5732 - protein, 203 aa, Lactobacillus buchneri
MKNGLGTIDVFRLVRKWVPYMPRLQKLPGEGQFIAIQSYKHDGSLHRVWRDTMVLKTSENSLIGCNNHTLVTEDDGRHWVTREPALVYFHKHYWFNVVAMIRDDGIAYYCNLASPYVLDKEALKYIDYDLDVKVFPDGRRKLLDADEYLAFSKRWNYGPEIDHILKRNVRILVDWIENEKGPFSKEFIAIWYERYLELARQNK

SEQ ID NO: 5733 - protein, 369 aa, Lactobacillus buchneri
MFERLKNSPLMFWSLEILIVVAIIWISTKINFVFSPIAIFFSTVFIPILLAGILFYMLNPIVNLITKIKFGKHQITRTWATTLVFLLLLGLVALAATVFIPKILNQLITLANQIPDAASQGQKLVDKLFKDMNSQQMLKKIDFTTLTNKLSANVNKYAETIFNGVTNGLGGIISAAANAVIIAVTVPVVLFYMLKDGYRLAPTIKKFLPERHREQTMDLLGKMSHTISKYISGQMIECLFVGTFTAIGYVIIGTPYALLLGVIAGICNIIPYLGPYIGIAPALIVSFSHGGLWSVVYNIIVVLIVQQIDGNLVYPNVIGKSLEIHPLTIIIILLAAGNIAGLMGMILAVPLYAVVKVVVVHMYNIYQLE

SEQ ID NO: 5734 - protein, 136 aa, Lactobacillus buchneri
MKKVITYGTFDLLHKGHVRLLKRAKALGDHLTVCLSSDEFNAEKGKKAYTSYEDRKYILEAIKYVDEVIPETNWDQKIHDVQDRDIDVFVMGDDWKGKFDFLKDYCEVVYLPRTEGISTTKIKEDLGLTDTEDWKA

SEQ ID NO: 5735 - protein, 285 aa, Lactobacillus buchneri
MGRAIFLATTIHGIRKATFRRQLLSLINNQYQVVVLLAMTDFDEIWQAKREFSKIDLPKGTPSVRLISLADIYAEHDGVSLKAADFMDPDLSGLQTFKAHQGKLPVTRYIDADGNIVAETLFTEDNTRIHTLYFDKSSRISQINSYDDADRLFGIEKYVDDALTESLLLNAKGELVYRFTNYVKDQKVSYNVTPSSTIAAPQELSEIQDDKSNSKDEMLTAYEGQGKSTFTKALSYSDYHRYDDINAFYHQVLLNMNIEDARTYIDIDNIVDASKYLPGKRIFNY

SEQ ID NO: 5736 - protein, 674 aa, Lactobacillus buchneri
LRAILSGVHQKKGKQVLEFELLDVAVSLDTAYVLFVEKNSLASIMKPISKVLSHNIIRVNIDAQDFHFQSEDQTEFEWQIFLINNNLTNKNVIQVESEYLSDRHQLELTSYYQFNSDAQGMALFNIRTHQSDEEFMINSVNLTDENLEITGYNKINGTLIKNQRIILKNHTTEGTLEYPVTKKLFEGMFTVAIPLTDIPQNSIGELFIEYELNGKSIKQRLIISKSLAGQSTDIQLAGNREITLEKRYDNGILVKEFAGASLLQKVGAAGGKAGTIIDVIKMIQDKLNLVRMRFLFKSGHSPYDNTTIIFESFGGRQVSDSPYAIYKVFKTLYPGINMIWSIDRSQKKFCKENQIAYVIRRTNKWVRVLEKSQFWISNARFPTWVKKPNYVTYIQTWHGTPLKKLGLDIENVSMPGTTTVKYHKNFVREANRWDALVSPNDYSTQIFRSAFGFNNQILKIGYPRNDELINTQPEDIDAIKEQLGIPLDKKVVMYAPTYRDNQFAEKGKYTFELPFDLDDFRKSFGDDTVLILRMHYLISNALDISDYSDFVYDYSNYPNISDLYLVSDLLITDYSSVFFDYAYLKRPILFYPYDYHLYKEELRGFYLNYEKDLPGKIAENSKQLLAEINHALAHPDMSANEKFMNFYNRFCAINDGLSSLKVVNYVMHQIESGM

SEQ ID NO: 5737 - protein, 527 aa, Lactobacillus buchneri
MNTQQLEKEDSTRRTFAIISHPDAGKTTITEQLLLFGGVVRSAGTVKARKTGNFAKSDWMEIEQKRGISVTSSVMQFDYGGKRINILDTPGHEDFSEDTYRTLMAVDSAVMVIDSAKGIEPQTKKLFQICKMRGIPIFTFMNKLDRDGREPMDLVDELENVLGIEAYPMNWPIGMGKTLTGIFDRYNHHVELYNHEKNNQSSEIVDLDDNNDPVNNDQLAQDEQFEDAKDAIELLDMAGNQFDEGKIATGDMTPVFFGSALVNFGVKTFFDAYLKYAPAPSAHKTEEGDLIKPDDDTFSGFVFKIQANMNPNHRDRIAFVRVCSGEFEKGMDVNLYRTQKKLRLSNVTEFMANTRENVQTAVAGDIIGLYDTGNFQIGDTIYTGKKKVEFEKLPQFTPELFVRVSAKNVMKQKSFHKGIDQLVQEGAVQLYQSYTTNDYILGAVGQLQFEVFQFRMKNEYNSEVNMDPMGHKIARWIDPDQLDEKMSSSRNLLVKDRAGNPLFLFENEFALRWFKDKYPDVTLTAKL

SEQ ID NO: 5738 - protein, 475 aa, Lactobacillus buchneri
MVSKHLSACTTVLVGKKASIDGSTMIARNDDTFLPLTPQRFYVEPANDHQTGEWVSNQNGFKAPLPKQAYRYSLTPNVEVDKEGVYAESGFNEKNVAMSATESVYGNERALAFDPLVKDGLAEDSLQSMVLPYIDSARDGVQYLGKLIKQYGSPEGNGVLFSDNNEVWYMEIVTGHHWVAQRIPDDAYAIAANQVAIQQVKFDDPDNFMYSDGIQEFVEKYHLNTDKQGFNFRHIFGTDNEKDRHYNTPRVWFGQKYLNPEIEQSPTSSNLPFICHTDHKISVEDVEYILSSHYNETPYDPFSKGHEDTKTLFRPISMNRTQNSHVLQIRNDLKNNSNAIMWLCFGVPAFSPYVPFFANATDTDDTYANTPVHCDDVSAYWMYRKLSMLVESHYSEFIQDDVDFLTDMKEQLRRHVQSAIDESQALKGEELTSYLTEQNHEVVKMMRIATEHFNHQLIEKGLTLSKLTFNMDKNL

SEQ ID NO: 5739 - protein, 196 aa, Lactobacillus buchneri
MDIGNKIRAYREVRGLSQEELASKIYVSRQTISNWETGKQYPDIQNVLLLSVLFGVSVDELIKGDLEAMKAKLSDKKVNTAMSAYTWVMLIAAVLGTMSIGLVIYFEQSTLIILVPIICFAVMFISASQVERIKKRKNLRTYAEIVAFTDGQDVEEQRQKRDPAKNRLEKLMIVGGFAVVVCMIALVSVFIFVIFK

SEQ ID NO: 5740 - protein, 377 aa, Lactobacillus buchneri
MKFMDWVKQQLNIFVSPRSHRQSNRRGRRRDYHQRKRWQSAQVDPDNSDQTAEVDNSSNQDAVKDQADGLLNDPSPAPSQAEETIQIKSQVTFFYLDENDDPIKKPDILIGNDGERFSLQLPSFKQYYLVSIDNFSTYFADTDQEVTFRYALKQGLPVLAYYLDIDTGETLHHVTIHSGKLGESYDVSAADIPGYRVINDVGPTHGHFDDRTHGMIFYYRRIHWQTVQPVEYYVRLKKRHAVLDQPNGHALQTGLPANVITKIFARIETTDNQSWLNIGGFEWIKNADLEPSDPPTNHLVPPITKTSRNPVMLFGTVDFVAGRPIEVFDKPYGTSTGTVADGQRVSIKARIIDDQGLIWYELADQSVIFSEYVRIDS

SEQ ID NO: 5741 - protein, 753 aa, Lactobacillus buchneri
MLCQNCHKNPATIHLYTNVNGQKQTINLCQNCYQLLSNQQRNTGGAQNMAQDPFGFGGLDDIFRAMQGGNVDPTNGQQVPPTQPMGPNNGGPNRPRTGGAGGNSLLGQYGINLTQLAKDGKVDPVIGRDNEIQRVIEILNRRTKNNPVLIGEAGVGKTAVVEGLAQEIVSGNVPSKLQNKQIIRLDVVSLVQGTGIRGQFEQRMQQLIKEVQDNPDIILFIDEIHEIVGAGNAEGGMDAGNVLKPALARGEFQLIGATTLKEYRDIEKDSALARRLQPVTVDEPSPEESIKILKGIQKRYEDYHHVKYTDDAIEAAVKLSDRYIQDRFLPDKAIDLLDEAGSRKNLTINAVDPHTVDEKIQSAEKQKQAALKSEDYEKAAYYRDQVTKLENAKKNGSVDSAATPKVTAQDMEKIVEEKTEIPVGELQTKEQQQLRNLAPNLEKHVIGQNEAVEKVARAIRRNRVGFNGTGRPIGSFLFVGPTGVGKTEMAKQLAYELFGSKDSMIRFDMSEYMEPHSVAKLIGSPPGYVGYEEAGQLTEQVRRHPYSLILLDEVEKAHPDVLHMFLQILDDGRLTDSQGRTVSFKDTIIIMTSNAGQGNAEANVGFGAAASGKTHSIIDKLTDYFKPELLNRFDDIVEFHSLSKDNLMKIVSLMIDDVNGMLKQQGLKINVTDKAKAKLVDLGYNPAMGARPLRRVIQEQIEDKVADFYLDHENAATLTADVDSKGNIVIKSDSAAEVKASTKAKPDSKDSDK

SEQ ID NO: 5742 - protein, 69 aa, Lactobacillus buchneri
VAEENQDYNQLLEKLESGEIEKIEVKPESFMAFQTAYMNFDHRKRVVGSATEGGVITYVYERDDKQKSS

SEQ ID NO: 5743 - protein, 88 aa, Lactobacillus buchneri
MEKRQFNIIAETGIHARPATLLVQTASKFNSDITLEYQEKSVNLKSIMGVMSLGVGQSAAVTITADGDDEKEAIDAISETMKAEGLTE

SEQ ID NO: 5744 - protein, 574 aa, Lactobacillus buchneri
MKEFKGIAASDGIAIASAFRLTEPDLSFKKRSITDASDEIKRLYAAIDVSKDELLTIQQRTLEDLGSSEAEVFKAHGAILSDPELLNRIKSTIEKEKVNAEYALTKVTDGYIKIFNSMTDNEYIRQRSSDIRDVTKRVLSHLLRVPLVDPALIHHKVIIIAHDLTPSDTAQFVPSYVLGIVSDMGGRTSHSAIMSRSLEIPAVVGFKGRLADIKNGDTVIVDGSTGNVIVNPTEAQTDEYTQKQADYRQRKSKLADFKHQMTSSSDGKHPIIAANIGTLDDLDGAIENGAEGIGLFRTEFLYMDSNHLPTEDEQFNVYKTVLQKMDKKPVIIRTADIGGDKDLPYLDVPKEANPFLGYRAIRMSLDKPDIFRTQVRALLRASSFGNLSVMFPMITTINELKKAKNIFNQERIKLIREKVRVKPVKIGIMVEVPAAAILADQFANEVDFMSIGTNDLIQYIMAADRGNRMVSYLYQPYNPAVLRMIKHIIDACHDNNLPAYMCGEMAGDQTAIPILVGMGLNEFSMSASSILKSRALIKRLDSREMVTLANKAVTMASASEEVTAFVHQATNNVQ

SEQ ID NO: 5745 - protein, 394 aa, Lactobacillus buchneri
VNIGIFTDTYFPQVSGVATSIKTLKNELERQGNQVYIFTTTDPHVDKDTYEQNIFRFSSIPFISFTDRRIAVRGLFQAYEIAKELNLDIVHTQTEFSMGMIGKFVAKNLNIPCVHTYHTMYEDYLHYVANGKLLKPVHVKEGTLAFCYHLSGVIAPSDRVLDKLTDYGVKSEIRIIPTGIDVDMYAEEIKTDIRKEYHISPDTPLMLSISRLAYEKNILEVIDYLPKILTEVPNAILMIVGDGPAKDDLMSQVHALQLDDHVIFTGEVANDHVNAFYRACDVFVSTSKSESQGLTYIEAMAAGLPVVVSASDYTNGLLSSETLGQTFEHDDEFVGIVTHYLKHEVNTQTPKAKQILKKKLTAISAETFGKRVINFYHSVAVAQELQDNATTNID

SEQ ID NO: 5746 - protein, 340 aa, Lactobacillus buchneri
MLRINMFSTADKVKGQGVGSAYVELVRMLKDHFPNDFKITINSYAPADITHYHTINPSFYLSTFSRRRGRKIGYVHFLPETLEGSIKIPQPFKAIFYKYVIAFYKRMDHIVVVNPSFIPKLERYGINKQRITYIPNFVSKAEFYDVDDQQKQALRVKHGYDPKRFTILGSGQIQTRKGVLDFVELAKQNPTIQFIWTGGFSFGKITEGYADLEKIVKDPPSNLSFPGIIDRAKMVQYYNMADLFLLPSYNELFPMSVLEAFSTNTPVMLRDLDLYKSIISGYYLPAADEKQMNEQLHQLLLNPDKLAALQHETTIASERYSEDHLAKVWYDFYNQQSKEG

SEQ ID NO: 5747 - protein, 343 aa, Lactobacillus buchneri
MSRNNKITLFTMVIIGIAIIAYSLRDVKLSVLIHDLFTLNPWWILVAFLCICAYLLIEGVITKVLVSNRVEHFTFKDALRVPLVEQLFNGITPFSSGGQPGQLFVMLQTGIDGGRASSALLMKFVVYQGMIVINFFISLVIGFHFVATKLHFLALFVLFGFLIHLFVIVGLLLIMYWPSFTKKLSKLLFHPVKWFIKDEKFYSMRETMYSKIDNLFEESVRIGRQPKLLLKIVVLTFFQLLFYYLIPYFIMLSLGYTSINVIMVTSLHIMIVMIISLFPIPGGSGGAEFSFESLFHSFISSNSKLVLAMIIWRILTYYFGMAAGACALLVKPDKVDDPDNRIK

SEQ ID NO: 5748 - protein, 687 aa, Lactobacillus buchneri
MLTDKKYRFSNLLNTRIGFFLLVVILFCIKTYIAYQTKFTLGVKGGMQEFLLAVNPIPAALLTLGIALYFSGRLSYWLMMIIDTLESIWIFANILYYREFSDFLSLGVIKGSGNVQNNLGKSLVEILHFSDFFVFLDVIILIALLAFHVIRIDAAPFKKRYAFFITIVSFLLMGGEYGLASTDRSGLLTRTFDNNYIVKYLGLNEYAAFNACQTQKESATRSKAKASDMDSILKYLDHSRAKANPAYFGKAKGENVFIIHLESFQQFLIDYKVDGREVTPHLNAFFHNKNTIGFDNFFHQVAQGKTSDAEMMLENSLYGLPQGSAMVTYGAQNTYQAAPAILDQRGYTTAAFHGDVPSFWNRDSTYKSWGYDYFFSSQYYKTKPSYSVGYGLKDKIFFRDAANYIQQLPQPFYAKLITLTNHYPYLLDKQNTDFPATKTGDKTVDPYVQTAHYLDQAFAEFMNYLKRTGLMKNSMIVVYGDHYGISNNHRPAIAQLLHKKSINNYDLAQFQKVPFMIHAPGLKGGVNHTYGGEIDVLPTILHLLGDKNNNTIQFGTDLLSKQHDQRVAFRDGDFVTPKYTKVGSDVYLTKTGKLITPNAAQKRQLASIQNHVTTELSLSDRVIWGDLLRFYTPKGFKKVNRKDFTYQYTKALDNLKQAQKKEPTSIEARNNGKSTMNLYKTDAPELK

SEQ ID NO: 5749 - protein, 56 aa, Lactobacillus buchneri
MALKVNRQNDMDAMFGKFAEMDPEDKKRDKFLKHDKKDKDKKRKNEEKPEKKKRWF

SEQ ID NO: 5750 - protein, 489 aa, Lactobacillus buchneri
MKKSLKAIIQTLIMIAAVFTLTTVFSNPASAADTSLQRVKQRGELIMVTSPDYPPYEFQVNKNGKDKIVGMDIDVAKKVAKDLHVKLVIKSMNFDSLLVAIQTGKADMAIGGINPTAARRQSVDFSKIYYSGGQSFLINSSDVNKYKSAKNLRGATIGAQTGTLQYGLAKKKIPNSTVKGMDKSTDLVLALKTHKIDALGIEKPSAEAYVKNDPSLKMISSGYHLNKNEIGAAIAFKKGSGSLVAAVNKSIDQIKKQNLTEQYLADAGKYMKVNTVNTSMFHYWKYFAKGVEYTILISVVSTFFGVLIGVILALMRFSKQKWLRGLAISYTEFIRGTPLMVQVLFVYFGIGVVVNIPALISGMIAVSLNSGAYVAEIIRGGINSVAKGQTEAAASLGLSKGDLMRFVILPQAFKNIWPALGNEFISLIKESSIVSIIGVTDLIYQLNIVRADTYRGVMPIFVAMLLYFIMTFALTRVLNHFEGKMKHAG

SEQ ID NO: 5751 - protein, 249 aa, Lactobacillus buchneri
MQDKKILEVNHLNKKFGDNEILKDINGTVKSGEVICVIGPSGAGKSTFLRCLNLLEKPTSGEVKFEGTDLTHVDEKQLINLRERMGMVFQSFNLFPNMTVIENLKLAPIRVKHMKDDEAQKIAMHLLDRVGLAEKADAYPSSLSGGQQQRVAIARALAMNPEVMLFDEPTSALDPEMVGEVLEVMNELAKEGMTMVVVTHEMGFAKEVADEVWFMADGYILERNKPEELFDNPQNERAKDFIGKIIQNV

SEQ ID NO: 5752 - protein, 610 aa, Lactobacillus buchneri
LASEYIEHKLALLPDMPGCYLMKDINGKIIYVGKAKNLKNRVRSYFKSSHEGKTARLVSEIADFEYIVVSSDKEAFLLEITLIQKHRPYFNIKLKQGNGGYPYIKITNERDPQIKIVNTLLKDGGFYFGPYPNVYAAEETVNFLQKVYPLRRCNGFQNRPCLYYHMGQCLGACFKVVPEETYAKQIKRIKSFLNGNVSHAKQMLTTRMEKAAAKMEYERAAEIRDLIKYIEITVEKQKIISTDNTPRDIFNYYMDKGWLSIQVFFIRQSRLMKREKRLFPIIDDPEEEMVSFISQFYKQKNQILPKEILVPKSLPTDVISHVVEDVPVRTPQRGQKRDLLEMAGKNAQMVLEEKFRLLELDESKTTGAMKELTDAMGIAPGHKIEAFDHSHIQGADLVSAMVVFVDGQPNKNLYRKYKLKTVDHADEAASTKEVIRRRYTRLLKEHAEMPDLILMDGGVIQMSAVKDVLVNELGLNIPVGGMVKNTHHQTADLLFGDNDTPLQLDPKSQGFYLLQRIQDEVHRFAITYHHKVHTKNSLSSRLDSIAGVGPKTRNKLLRKFGSLRKISNAPIEELRQLGISETVAQTIKFSLSKIDEERKVTNYQDKKLTH

SEQ ID NO: 5753 - protein, 415 aa, Lactobacillus buchneri
MVAFRREKYVPNGGPAGGDGGRGGNVIFKVDSGMNTLMDFRYHRKFKAKNGGNGANKSMTGRSADDLVIPVPEGTTVTNTDTGEVIGDLVKPDQELVVAKAGRGGRGNIHFASPTNPAPEIAENGEPGQEVSLSLELKVLADVGLVGFPSAGKSTLLSVITSAKPKIAGYHFTTLVPNLGMVRLDDGRDFAVADLPGLVEGASNGVGLGFQFLRHVERTRVILHLVDMSGLEGRDPFEDYLAINKELEQYDERILKRPQIIVATKMDLPDSADNLQIFKQQLAEHSDADKTREIFPISSVTHTGLTELVRRTADLLDTTKLSDMEQPAETTKEYAYQPAETSDFHIEYDKEYESWVISGDKIEKLFKMTDTEHDQSMLRFARQMHGMGIDDALRKAGAKDGDTVTILDFSFTYVE

SEQ ID NO: 5754 - protein, 644 aa, Lactobacillus buchneri
MQQVQTKKQGKRLKNSRYISGFDGIRALAVVGVIIYHLLPYKLQGGYLGVPTFFVVSGYLITDLLLQEWEQNGRIDFWAFYARRLKRLYPALVFMLVGTGTYITLFQRSLLTNLRSIITTNMLYVYNWWEVGHGQSYFDRFNGESPFTHLWSLSIEGQYYLIWPLILTAMVLIIRKRRTIANILLVLAIGSGVLMGLLYTGPDTLNRVYYGTDTRMFSIVFGALLAVIWPSTHLKKNVTTRSRWTLNIIGLVSIAIIAYLYFELSGQNTFTYRGGMFIMAIASTTLIAACAHPGADVNRWLTNPVFRWMGTRSYGIYLYQFPVMIFYEIKVQNIAAHPLMNASIEIALIMIISELSYRYIEAPLRHYRYRNLGRSIYEFVQPNSEYGWKRLWLIPAVLLIGISAYGSAISPTKDAKNVLEENISKNEKTANANNKAALAKQKKASKLTANQKRMKKLLKKKLTVKQYKIAKHYGLNKRQYLTVYQQPLTAIGDSILADNSHDLQNVFQNAYVSAAVGRQIWQAGQVLTQMKNKNELAPNVLINLGTNSPMTSAQINSVIKSIGPKHQIFWVTTHVPTRNWETEVNHTIRVAAKRHKNMHIIDWHSYSLNRRDWFWNDNVHPNPKGNIYYTHLIATSISDFYSKK

SEQ ID NO: 5755 - protein, 248 aa, Lactobacillus buchneri
MKAKGYLIIMFAILSVGLAACGGNKSNQATEKKSLSADMSNEPSSSSTSSSSSQSWSDYQYKVPKSVQKNAHYVKNGDLSTKHQFTFDRFGTRQQLADVTTKPVDIKADKLTYKVNQVRVIKNTAKTPQAKEAAEQVLNLRSIPDTYYTFVLNYTVTNHHNFEIALNGVNYVKTNQGQMLTTANQLTDSSAGNKIGANRAVSFAMTGYLHNYATQPATKLTIQFGAIYTTTQKKVAPSPDSTLTINLK

SEQ ID NO: 5756 - protein, 95 aa, Lactobacillus buchneri
MNLDEFFRASSTLNPKLTLLISEGQHFLPVNQLLIDKNSLLLGKSSPSQGGFATITLDQFMTRTKRLSLKTDLRTLNDRQLIFGFRIVNKSIVFY

SEQ ID NO: 5757 - protein, 312 aa, Lactobacillus buchneri
MQIEFLGTGAGSPGKFRNVSSLALRLLDEINSVWLFDVGEGTQHQILRSTIRPRKIEKIFISHLHGDHIFGLPGLLSSRSFQGGNTPLDIYGPKGIKEYVNVSLKISESRLSYKINFHELPKDTDSKIFEGKKFTVYAAPLDHRITSFGYRVVEHDHPGELMVEKLTQLHIPSGPVYGKLKMGQTVKLADGRVIDGKEMIGRAQPGRIVTIIGDTRKTDNAVKLAEHADALVHESTFGKGENKLAKNYYHSTNMQAAQIAKQAGAKMLLLNHISARYTGKMAHELEKQAQTVFPNTKVVKDFDVIEIPFEKH

SEQ ID NO: 5758 - protein, 137 aa, Lactobacillus buchneri
LKKQISTIISIILIIIIAIFALMNFESVEVNFGFASFQVPLVLLILICLLIGALIIFLFSSTQNVKKNRQYKQLASESQKRQDDLNAEICELNNNLKELETRLKNSTGKQEIGSRDQQISDLQDEIAKLTEKLSSQK

SEQ ID NO: 5759 - protein, 776 aa, Lactobacillus buchneri
MIDSKYKWQLDQPADSSVVDKLAKDANIDPFMAKTLIQRGITSADAVEDFLNPSVSAFHDPFLMHDMHKGIERIQQAVENGEHITVYGDYDADGITSTTVMYETLSDLGADVDYYIPNRFTEGYGPNVEAFQKIIQKGTSLIVTVDNGVAGNQAIVAANELHCDVVVTDHHSLPEKLPDAYAIIHPRVKNENGDAYPFGDLCGAGVAFKVAQALMDEVPSDLIDITAIGTVADVVSLRDENRAIVKFGVQAISNSQRPGLLALIKEAGIDLGRFSEEDIGFGIAPRLNSLGRIKDATVGVELLSTFDEDRAGELAKFANQQNDLRKSLVDQFFTEAVQSVEDSGDISQRHTLVVVGHNWHQGVLGIVASRLVDKYQRPTIVMTDTDGSEEVKGSGRSVDNFDLFKAIDPIRDQTIGFGGHHSAVGLTIKKDKVPVLKDQLEKAAEEQQLDLSVKPKLAIAGVIPVSQVTAVLCDKIKTLAPFGQDNPKPIFQVQFDQLANVKAMGKTSDHLKFSLVQGNNRLTAIAFGRGSAAVELQNSQAAVQVVGEIGENTWNNRTTLQLMVDDLKQTLPPVIDERTHELHRKMFATVGTYVFFHEKVLKQLQGYVGGQSQVVMYDQVTEASANGNRLYIVDCPDVLDDLVQLLAKVQPQTTVLYLYKKQLISKIGMPDRNSYAKLFRFVKEHSNVNIAMQLKQISEHLHISARTIIFMVQVFLELDFITIQDRVINLNPNYTARDLKTAPSYHLRVEQLAAEKKLLVSNTHELVSFVKDCLGV

SEQ ID NO: 5760 - protein, 172 aa, Lactobacillus buchneri
MPIDFSKYIASYPDFPEPGILFRDISPLLENGEVYRAATDKIVDFAKERNVQMIVGPEARGFIVGCPVAYKLGVGFSPARKKNKLPGETIEESYGLEYGKSSLYLRTNAVKPGQRVLVTDDLLATGGTIDATIRLVEKLGGIVVGTAFLIELSDLKGREKVKDYDFFTLLKY

SEQ ID NO: 5761 - protein, 214 aa, Lactobacillus buchneri
LSTLIDFILHIDDHLINIVNTFGNSTYLILFGVIFIETGAVIFPFLPGDSLLFAAAALSANVNYGLSIGLFVIIFLAASIGGDSLNFFFGNKFGEIIPRNRILGKFIKEKDLTKAREFFNKYGAMAIFFGRFIPIIRTLIPFVAATSDFPYKRFIKYNLIACISWVAICCGAGYYFGNIPVVKENFSMVIIGIVAISLIPAVVGYAKTKFASSK

SEQ ID NO: 5762 - protein, 126 aa, Lactobacillus buchneri
MSFKIGMKVHGTVTGIQPYGVFLDIGEHMQGLIHISECQTGFVDDLYKIFRVGQTVSALIIDIDEYSGKISLSTRSTDVNLEILRRPKSFRPKRIHYWTDYRLNIGFKPLARAKGGWMRDAQNFFS

SEQ ID NO: 5763 - protein, 395 aa, Lactobacillus buchneri
MKTFKFQSFVLVLIAFVLGFSEFLIVGILDDLSHQFNVSVATVGYLVTAFAIVYAISTPFITILIGRFNLFWDLMVAMAVFTFGNILSFLAPNFLMLTVSRVVTAMVAGVSISLGLTFAGYVAPMAKRGWLLSWVFSGFSIASVVGVPLGTWISTQFGWRISFLTVIVISVLTMGLIFVSLPKDFKQKKSTISGQLALLGNHRIQIGMLLPMFNLAAIYVFYTYLRPIITNQLHFSVSMLTILLAVFGIANIIGNRASGRLSEGPGMKGMPFVYIGQFILMMLMPLVFNFSWPGALLLTLVIFTMPLINSPIQLFFLQIAEKDYPQSIVLASSLNSIFSNFGIALGSATGGVIVSNLSLDAVGPGGAVYAVVALGLVLWLNHLTSKGLSSRSTNL

SEQ ID NO: 5764 - protein, 234 aa, Lactobacillus buchneri
MNGFIGELFGTYVLIVLGTGACAGANLKQTYAKGSNWTFISVAWGMAVTMGVYVASSLGSLGHLNPAVTIPYAIFGLFPWNQVVPYLLGQFLGAFLGAATIMMIFYPHFKTTTVDNGNTVGIFATRPAIYSPVSNYLSEVVATFVFVFALLNLGDFTQGLKPLVVGLLIMVVGLGVGTTTGFALNPARDWGPRFAYSVIPVPNRGSGEWYYSWVPMFGPLTGGIIAAGLQVMVK

SEQ ID NO: 5765 - protein, 237 aa, Lactobacillus buchneri
MDRVGMKLEAKRIIGSHFPFFVLLFLPAVIIQLGYSVAYSANPLHEADTNQAFNQIIQGTAHFGSNELLNLWLISTLISIISGLLLSGMMFVCIDLIRNKVPFDQPVTRSFTILNHGQYFIGAIMIGIITTVLTLLWSVLLIVPGIIKGFAYSQALNIYRDSVDAGKPIGYLEAITRSRKMMVGHKMDYFVMELSFIGWYILNSFTYGILLLWLQPYYQLSFANFYVKIAQMNQTEQ

SEQ ID NO: 5766 - protein, 376 aa, Lactobacillus buchneri
MSDKLIDIDTLLAQAGNRDNHDQYHSVSTPIYLTSNFRHRDLEDAETFDPHKQYSYSRLSTPTRSVLQKTLADLEGGANAFAVSSGMAAIQLVFSLFKSGDEIITSDDLYGGSFRYFDYLADHYGVKFSKWNGKDYEKLSDLVTAKTKAVWLETPSNPTMKIIDIQKVADLIHAANQNALVCVDNTFLTPVYQQPLREGADIVVHSATKYLSGHNDMLAGCVIAKSEEIASELEFNFNTTGVTLDPFDSWLLLRSLKTLAVRMERHTSNAKYVAACLKKLPQVQKVLYPGVGGMISFYLQNMDQVDRLFKHLKIISFAESLGGVESLLTIPSLQTHSDMAKEDRLKLGITDELLRLSTGLENPKDLANDLTQALGD

SEQ ID NO: 5767 - protein, 389 aa, Lactobacillus buchneri
MKENFDFLMPSVNFFGKGVIKKIGDRAKMLNMKKPLIVTDKFLRGMDNGPVAQTLDSLDAAGVSYVIFDGVEPNPKIRNIQAAKQVYLDNDCDSIITVGGGSSHDCGKGTGIILTNGDDITKLAGIETLENPLPPLMAVNTTAGTASELTRHCVITNEKTKLKFVVVSWRNIPLVSFNDPMLELDVPAAMTAATGMDTFVQSIEPYVSTNRNEITDGQCIEAIKLCEESLREAVANGHNLEARTKMVEAEMLGGMAFNNADLGYVHAMAHQLGGQYDAPHGVCCAMLLPIVEEYNLVACPERFAELAKAMGENTDGLSTRDAAELAIKAMRQMADDVHIPRSIKAIGAKPEDFELMAENALKDGNAFSNPRKGTKEEIVQLFQKAYDMK

SEQ ID NO: 5768 - protein, 168 aa, Lactobacillus buchneri
MKKFDLADAALLLLIPLTMIGFSASIHTRDRDISTTKAAQVNKIGENIDTEYSGDSDLNKGNIRPLYFQPSRVFSVKYRTVSFKTVLDEDYREEKLYRYVPGAKKNNRTYRWSTIKARTGKRVYVDKKAKAYYRDDDGERESEDFYRIRVSANKHATRYWVNEDAIDD

SEQ ID NO: 5769 - protein, 327 aa, Lactobacillus buchneri
LKILVTGGAGFIGSNFIHYLLENHPTDQVINFDALTYAGNLASLADIQNDSRYHFVQGNISDPQAVAQVISTYQIDSVVNFAAESHVDRSILHPDAFVRSNFVGVSTLLDVVKQQRVNKFVQISTDEVYGSSRGHEQFNESAHLNPSSPYSATKAGADLLALSYYKTYGINVSITRSANNYGPFQFPEKLIPLMVTNGLRGKSLPVYGDGKNVRDWLHVFDNCRAIDAILRHGRPGGIYNIAAHNYEENIQIVAKIVKQLELPQSMIDYVSDRPANDQRYSIDDALIRNELGWQPTIDFDQGISQTVDWYVTHEKWWRPLLGAVHNR

SEQ ID NO: 5770 - protein, 290 aa, Lactobacillus buchneri
MKIGFIGTGVMGTGMIKNLLKAGYDVTVYNRTKEHAKDALDAGAAWLDTPAEVTKNSEVVITIVGFPKDVEQVYFGDDGILGVAHAGQTLIDMTTSSPRLAKQIAKAGEARDIGVLDAPVSGGDVGAANGTLTIMVGGSESTFEKSKPVLSAMGSTITRFGGAGQGQNAKMANQIMVAGTMTGMIESLEYAKHAGIDLSQMIRTINGGAAANWSMTNYGPRILQGDFQPGFAAKHFLKDLRIALDTADEMNINLPATKVARDLYEKMTDELHLGNLGTQGLLKVYEPDNN

SEQ ID NO: 5771 - protein, 68 aa, Lactobacillus buchneri
MGFSPKLIVADAALVISIALAFFIQKSSFPDDVKIGLVILAGICLLVSVIINLVSANQSRKERKNQQK

SEQ ID NO: 5772 - protein, 144 aa, Lactobacillus buchneri
MAELDSNDAFIDTNKLIFGIGQVQQITGVSGRQLRYWEEQGYIQSISQKKGAAREYSLHTLFFIFHVTRFLNNGFTLQAAVDRAKKFDRQLPVLRQFLRAQLQGVNIDDDQSVLDFGYVDSSHTQRIYGVVKDGETFFRIENVD

SEQ ID NO: 5773 - protein, 69 aa, Lactobacillus buchneri
MLKIKYENGGGTESIEYKSAADFLANQRLEVPDLEDYYKIVDVTLDGKPVELKDKTIIGLYKKFDNEDD

SEQ ID NO: 5774 - protein, 217 aa, Lactobacillus buchneri
MLKFKHIFVLVLTTLILVIGFSALGSQSASAQTIKFTSAMHTSKNLTYNGTIKYYVKADAKKYSPEITYATQKWNKALGKKVFQRTTSISRSRLVFTGTNKLNRNYAGVAEINSGVIALNTSWMNRYNQQKRRAVIIHELGHTFGTKDLYNYPNGALRSLFKQQTIMGGNYATSIKSFDAKLAKWTLRKTRSMSQTEFRHYRSNAGLYYQQMLNGQL

SEQ ID NO: 5775 - protein, 418 aa, Lactobacillus buchneri
MNILEDLKWRGAINQETDHEGLNELVNQKSVGIYVGIDPTGDSMHIGHLIPFMILKRFQLAGHHPVILIGSGTGSIGDPSGKKSERVLQSMDKIKRNEIALTAQMEKLFGEDGKFEIVNNYSWLSKLSLLDFLRDYGKLFNVNTMLNKEIVASRLEVGISFTEFTYQILQAIDFLHLYRHNDVQLQLGGADQWGNITSGIDLIHKIEGPDAKAFGLTIPLLLKSDGTKFGKSEGGNVWLDPKKTSPYEFYQFWINQDDNDVIKYLKYFTFLSQDEIADLEKKVQTQPEKREAQRKLAEEVTEFVHGKEAVKQAEHITAALFSGNVADLTTTEIEQGFKNMPSVEVSSEPLNIVQWLVDATKIEKSRRQAREDITNGAIRINGERIEDVDYEINPAKKFDGKFVIVRRGKKKYFLARVK

SEQ ID NO: 5776 - protein, 402 aa, Lactobacillus buchneri
MLKKQAQLGHKVNVVCIRENTVNLRDSVYGQICWAIDMLHMTDEFKYSVSPMRITHISSGSAFYFYGGDKPEKLKSNTIQNVIALWYEEAANFKSAEVFDQTNPTFIRQKSPWVNDVKVFYSYNPPRNPYDWINEWIALQEENPQCFIDTSTYLDDQLGITQEQQLALIETYKKNDPDYYKWLYLGKIIGLGTNVYNMELFHPLTKLFDDDPLVNLYFSIDAGHINSATTCLAIGVTAEGKVILLHTYYYSPEHQSHKKAPSDLVPEIKSFEDSMDYHQPIGKRTIDSAEGALRNEFVKEYNEVWHGVAKSDEATMIDYVSSLLAQGRVYYLDTPENQIFIKQHEQYQWDEKTVHSDNPKVVKENDHTCDAFKYFAIDNAKMLGLKIDPQRNAKVKLFKRGL

SEQ ID NO: 5777 - protein, 534 aa, Lactobacillus buchneri
MKIDEILQKEYPNIQDTFISGKDASKLGWTNNDTVNLSGSAYLDDNDVFHYSATQNIKNNPIDLFNMINVHRTRLMPIYIMKRQYYKGRHINILNREPTPHGDPDNRRIVNMPKKLVDSFNGYFIGTPIDIAYQDPSDEETAESNKVNDLITAMTKHQVLDDVFTEASKWSSVYGRAYLYLYTDEKAYPHITFLDPLNTFIVYDNTIQNKPLFGVTYSYYPDSKGNESLHGQLIEIDDTVPFSNSATSDASLVFDENPDPDTGVDDNLGHPFSQLPIAEIMDNEERIGVFDDTVSLVDDLDSAVSAKSNNSDSFAASILKVINSELDDDQLKEIKQSRVLNLYLDKAWAESDESKALPTPDAEFMEKPSGDQLQEHQIQHDTDFIYQVAQIPNLDNIDFSTSAAQALDFKIHSMKIKALNKETKMKKALTQIWACALQAQGINVDDVDNLEYTFNFTIPHNLLAEAQTANELQSTTSQETAIASLSNVPDAKKEMQKIAAEQDQMAQQAKARMSDPYADNNNSQNDTSQTESDD

SEQ ID NO: 5778 - protein, 343 aa, Lactobacillus buchneri
MKPISNAQEKKYIAKLLKSDEQVYGKSHDFYQVALQEIEDHLNFFIAEYGVDGLLKYVELLKRDSAADRRRLLHFQIKARINNDTQSQNRSKEYARNAPIDRYHTLNSLIGFSVAGATIATIKLLNQTLKSDFKRDVSRQFNNNRLAKKAGADIVKAARITKREVLRNSEQIISKTVDGSQWSDDLWLYNDNLVNNVQSLVAKSLRTGLKQADVNQLFPSIRTAKPQTITGLFNTNNAYIRRMIVTERARVLDRSTTQMFKSQGIAYFDWITQPGACDKCEGIADDGPYAVNDASSPSIPDDSHPNCRCTKIAHVSLVPLLGVAGAIAATDHSNKNQTSDDEQ

SEQ ID NO: 5779 - protein, 273 aa, Lactobacillus buchneri
MESDKLNMNLQYFADAGQVGSQSQPGAQGGDNGEGGQNADNNTATNSGNQNGQSSQDFIKSLVDKVANSANQSQSNQNTNKNSDQTDNDDTSSKDNTDDNNGDNSSNDKTFTQTEVDKLLKDREFRAHKKGIEEGKKAGKSNAEKYAQMTDEEKQQAQIKEILEENKQLKAERNRSDMRDEVLKQLKDTGYQFTNEDVDTLVSDDPDTTKHNVDNFKSMLDRVVKETKKNMFKNNQIPNSNTQQNNAAPSFGELVAKKTLGDPDRFKGKFFDK

SEQ ID NO: 5780 - protein, 130 aa, Lactobacillus buchneri
MADTQYFANSDPRVRQDLTVGLPGTIDSSTVTAGSNGKKVILQGTPVGAAVDWLSADQSAGVTKLSEFTGAEGQVFAGVVAADTDVTAGDADVTIWFENVYLRQKLLDSTVVAALQAVAGKTSGVKLINR

SEQ ID NO: 5781 - protein, 345 aa, Lactobacillus buchneri
VATAFDLLTSNYLQGYWNTNPQYTAPYLMEALFTPTKQQADNVKLINGQDLYPAPLDLTKEDSAALPVERGSLQTGTLPTYKFKNKLNLNEYDFKDLNNAIASNDENLILTITKKLYDDQANLLLRARFTREYYAVQALLNGKLLLGNQLADFGYESFQNMKVAKVWTDDSSNPYDDISSVKDTASQKVGTALTRVLMNSKTMYILMHNAALKNTIFSGTVSPQGNILTQPVVEQWFSAFLGLQVVVYDKGWNNNGTFEKFIPDGKIIFLPGTANEPIGQMNFVETPEESVSVSGTTVSIFDTGVSLSTSASSDPVTVKTIVDEKFVPTITVAKQVFILDVTTAA

SEQ ID NO: 5782 - protein, 67 aa, Lactobacillus buchneri
MFPDQIDTSKNFSENGNVYYIVQEGDELWAVATANNTSTRMLANLNRIYPQEDLKPGKKLIISKGAK

SEQ ID NO: 5783 - protein, 114 aa, Lactobacillus buchneri
MDYPFDQNDVIASVKSLSDVELSDDILNSLLPIAYGLLKPLNIPINDKFVWNQIMEMKMLSLIWINSDLGKGILVDNFKDLHTQYNGNAVNQWEELLNDFLIRYGYSGWRIKLG

SEQ ID NO: 5784 - protein, 173 aa, Lactobacillus buchneri
LDDLFSDDNRFPEIKEEFRKLNHYMVEVGVMKPVGNKSLAFMQMIATVNEFGAEIYPKNGPYLIVPMRDGTFYKLKHVKIPERSFLRDGVDLGMHKIVSCVEDGLAGIMGGDMTARELYEAVGLLIEQRIKDEIVLKTSPHNAALTIENKGKDDPLVDTGALHKSIGVKVIEI

SEQ ID NO: 5785 - protein, 157 aa, Lactobacillus buchneri
MKFSKKSLIKRYGIPIRIYQNTSYTDGGATLTGDFLRTDFRQQPYIDDSEPITPVSPNADANQIILTGDGKSVNYSHEWYSMHLHVPLGTVIAIKNGDKDTQWEYLQVVGQDPYYGMSDACIYYLRSNSQEVQSDNEANDQLAGNTGNNDSGDPFFN

SEQ ID NO: 5786 - protein, 86 aa, Lactobacillus buchneri
VIADKAYGSEAFRQYLEAEEGTYTIPPKSNAKEKWPVDYYVYRERHLIENFFNQLKNFWRIATRYDKLAHVYLERVYLAAILIRLK

SEQ ID NO: 5787 - protein, 139 aa, Lactobacillus buchneri
MKLAKKYLYSTILGLSLGVGMSTNVVKAAPSSNSAVVSPTSDPSQDEQANPDLSGKVEDVSYTVKDDQLTLYGGTIKKIHENFSLPWQQDGVRDRIKKLKIDGPLEFEQDGAYEFFEALGNLESISGLRSCLVSLILTQ

SEQ ID NO: 5788 - protein, 77 aa, Lactobacillus buchneri
MELTATDYEILKAIYTGRVSSGTPVNHFVDYCDNVIGGDPKPLVAAGYIVTDHNEINGLTEKGTKAYEAHAAQESNS

SEQ ID NO: 5789 - protein, 487 aa, Lactobacillus buchneri
MKMIYQQLLAFFLVIGCTILLLGFSFSRMSKTFVYDQTWHNLEKYSDSLIQQSLTISSKNKAKVTFDEEKLKNSEALLENQAVHFTVFSPQDQVIYPNNGVAPRITQKDWEHLRRNQIVRKVNNKNFKLSNGKTRPAMIEVLKPYYYKKKLVAAVTVGAFISDVNSNVKRINRDLLKALFVALLISMFISYFIARRLNRRISKLRSAANQVSNGNYKIRLKPGGKDEIGELIVDFNHMTQSLQQANNEIQRQEERRQEFLANAAHEMRTPLTTISGILEGIKYDVIPQESRAKSIDLMSSETQRLIRLVNENLDYEKIRSNSIQLDKRHFNAAKVLENVIDQLDSKAEESQDKLVLNAPKDLSIYADYDRFVQIVFNIVTNAIQFTDQGTITVTGERGYNETIIKVADTGIGMSEDQQKNIFERYYKADASRRTGKYGESGLGLAIVHQLVKSHGGKISVSSKLGEGTTFTVIIPDATAAEKEQENH

SEQ ID NO: 5790 - protein, 242 aa, Lactobacillus buchneri
MKLLMIEDNKSVSEMMQMFFQKEGWDVTFAYDGIEAMDKFNEDPDSWDMITLDLNLPKKDGMEVAKEIRAKSQTVPIIMLTARDSDSDQVLGFEMGADDYVTKPFSPITLVARIKALQRRAHTETEEKSEDEKAKNVFDVQTDHFKLNSSTREVYLDDKRISDLTPKEFELLKTLAQKPRQVFSREQLLETVWNYEYYGDERTVDAHVKKLRQKIEKVGTQVIQTVWGVGYKFDDSEVGKKK

SEQ ID NO: 5791 - protein, 232 aa, Lactobacillus buchneri
LEKTTIANEKTSRFFVRLRRIPGEHWYLANGNEKNVNPKNKIKVPDSIKAQDFLIDEISFFNKLVWYHFTCGDLEGWLPKRNIRKTFRRLDVEPIKQPTQSDIDNQCTAILMLLNSAGINVDVSDIRDKVEKWHAQSGTLMDLSDLIISLTHSIRDLNGVDFRKLDKQLLRRRPILVKVAGLDNLKSSLILLTGFNRKLYYYNDPWTGKLESISQNHLRKHWKRGNLEAISY

SEQ ID NO: 5792 - protein, 257 aa, Lactobacillus buchneri
MYKGIAFFDLDHTLFNEHTRVDDEVADAMRQLKANQVLPVISTGRNLFEIPNTMQKTGINTVVSANGSYVIFEGQPVYKAVLEKSVVKDFVAFAKSNHEATTVMNSQGAKINFINDIVRGNYNFINSRMPNLGVDDFIENQEVIMMLINTKGPDERYIDRFADTLTFFRNTPFSMDIVHKGSSKKKGIQELIANANLSGIPTYAFGDGNNDIPMLDFVDHPVVMENGLPQVKKYAEFITTKNTDHGIVNGLKYFDLL

SEQ ID NO: 5793 - protein, 389 aa, Lactobacillus buchneri
MKSLKVQSFILISIGFILGMSEFIIVGIINDLADSFDVGISNVGFLVTMFAIVYAIVTPILTILVGEHRLKRVMLLLLSVFTISNVMTALANSFFILSLSRVLNAVVAGITVSIAITFAAVIAPRDKRAWLISWVFSGYSVASVFGVPIGTWISDQVGWRWAFWLIVLISVMITVMFMLSLPGDLRQGKAKSLGEQFSLFKDPRILLGICLPILNLGGVYVVYTYLRPIVTSGLHFPTSFVTPFLFVFGLASLFSNQYSGRLANRNGLKSMVTVFVIQALTMLAISLLFGLPWAALAALIIMGLTMYLLNSPMQIFYLAVAEKDYPQSMVLASSLISIFNNVGIAVGSATGGVLFNHLGLKSLGYSGAVYTVVALAILIVLNRVRKSFD

SEQ ID NO: 5794 - protein, 160 aa, Lactobacillus buchneri
MQNQTPSRLQQKQSKQEQKKTKHTKLIVWLSVLVIVLVGFLYVGHQVHELTDAQRQTNTILDKPIKNTVVKVVEPKLPEEVRPQVVKIIQEEPLYRLQQAADNPTTFQQIADKYQVPETYVAPAKQYWFSQQNDALRSDIYHAKLMQIMSELRALDNSNQ

SEQ ID NO: 5795 - protein, 276 aa, Lactobacillus buchneri
LYFRNRPGVFFSLLGAMISFLLYVVFLKKSMISSWKTVPSSHQLLDFWLIGGTLSVTAITTTLTSLGQLVKDKERKVIKDFYLTDLSHFEITMSYMLSAALIGFIMQIVMFALMIGYFSITDNLTMPWESLPAVICVALFSSLLAVVINMLFIRFISRFDSLNAIGTIVGTASGFLVGTYIPIGILPNFAQLLIKLTPGAYVAAIYRQILMADKLKTAFHGQQSHFEKTMGIKLEWHHLLTGMQTTVLLTVVFLLGIAVLLIVDLIRSKENVRTVD

SEQ ID NO: 5796 - protein, 287 aa, Lactobacillus buchneri
MIIQTKGLTKTYQSKVVVDHIDLAIKEGSLTALLGPNGAGKTTTISMLTKILNPTSGMIKMKPDIKISMVFQQSILDNDLTVMENLSIRNKLYKEAKSNHIDALIQKIGLTEFINQKYGRLSGGQRRRVDIARALLNQPDIIFLDEPTTGLDIQTRSAIWKLLHSLQSQNNLTIILTTHYLEEADNADEVYIIDHGKIIASGSADEIKTQNSSSKLVIVSEQADQLMALIPSKIIHTQINHKTICLKANSDEALSLLLKFRIFIKTFTYQEGTMDDAFLSLTGRKMH

SEQ ID NO: 5797 - protein, 194 aa, Lactobacillus buchneri
MAKIGYARVSSKEQHLDRQLAALKDVDKLFTDKLSGANTNRPELQKMLAYIREGDIVMVTELDRLGRNNQDLTKIMNTIQNKGATLDVLNLPSMTGIADPNLRQLMTNLIIELYKYQAESERKRIIERQQQGISLAKQQGKYHGRKPQYTQDDPRLLHAFKLYQTGMSDVDVARNTGIKRTTFIRYRKKCNIKR

SEQ ID NO: 5798 - protein, 86 aa, Lactobacillus buchneri
MARIEARIDDETKQKAIAELKKHQITLSAFVKAQVATVASDGLPPYYSIPNIKQDEAIQEIADDLTGKKKLKSATSSDELERLLNE

SEQ ID NO: 5799 - protein, 126 aa, Lactobacillus buchneri
MNEVKFTSEFKKQYKKVSRGAQWGRVFKRPLPKEIDQENRAPWAYIKDCFINNEPIDAYFYPHKIETDKHAAKVLKNVESQTGLKNLSVWWLHFDGHNGNHLLEYVITPSTVYLSRIGTHNDLMKN

SEQ ID NO: 5800 - protein, 68 aa, Lactobacillus buchneri
MGLFEDYYDEHDLDKNSEYSHMSKKELVIEAEYLHNSLWNILKYVDNGGTDMDVVKAEVYDGIYESRI

SEQ ID NO: 5801 - protein, 56 aa, Lactobacillus buchneri
MMMRLDKFFVEEMQKNGFDVDFKRLKQIYLDSRNRHSDDIEKGKVRALNERLKYED

SEQ ID NO: 5802 - protein, 594 aa, Lactobacillus buchneri
LSNVVTKQYEVQNNSIGTVLNWIKSGEIGLPELQRPFVWKSSKVRDLVDSLYRGFPIGYLITWNNTTVKLKGGGSAVGKKIIIDGQQRITALRAALTGEPILNKQLESKRIKIAFNPWNEKFETTTAPIEKNKRWINDIANLFQMANTFSFINNFLLKNNDKTPTERDKAVNAIEKLHALTNNDIGNIVLSSELPIEDVTEIFNRINSKGTVLNSADFVMSKLSADEKHNGEKIRRAIDYFAKLLVNPTMLADIKNNDAGFTASNYFKQIAWAANERTDLYDPDFGDILHVILNFQFGRGKLTDLVGLISGRDFKTKTYTEEAMDKAYHELETGLLRFVNKSNFERYIMLLRSLGMISRKTLSLSGKGAINFGYSLYLLLKYQGQTTNFELETIVKKWIIMSALTYRYSGSSETQSQTDIRKFASTDPVKYLNSIVKQELPDSYWHNTLPNGALVSSSTQANVWRIFVMSQVRKHTIAWLEKDHEVADLLIEQGNIHHIFPRAYLKKNGLSQTMYNQIANYIWITQPRNLQISDRAPKDYLADQQIIKYGNAKSFSENAIPESLKHDDYTEYEDFLVKRRQLISQKLKEYFESL

SEQ ID NO: 5803 - protein, 157 aa, Lactobacillus buchneri
LGEIVEINSGRDYKKLGRGKIPVFGTGGYMLSVNGKLSDRDSVGIGRKGSIDKPQFLSAPFWTVDTLFFMTPKNKNDAKFIFDLSQLIQWKKYDESTGVPSLSKSTISNIPITVTKEDEQNKVSTLFELVDKIIAANQRKVEKLKELKKGYMQKMFC

SEQ ID NO: 5804 - protein, 247 aa, Lactobacillus buchneri
LKALGLSKSTYYHWKHYQISRHDKQDTILKSQIFEIWKNNYKAYGYPRITIAMRRLGVVIGPNRVYRLMQELGIRSLMGRRFKKPGTHVDYSQRPNLIKNHPIGTIWRADITYLELRPGTWVYLSTIFDQASKQIIAFNIGKEMASKLIIKTLLQVLSRASKPTFLHSDMGSQYTSIAYEGLLKRHLIRHSYSKQGYPYDNGPLEAFHSLLKREFIFQTRFTSFEDLVLRVENYINWYNTERIRING

SEQ ID NO: 5805 - protein, 87 aa, Lactobacillus buchneri
MKYYSDEFKNNIVKLYHNENRSKKSLANEYGVHPTTISHWIKRAKLVELPDGGVTSVEAFKQLQKENQQLKEENEILKAAAVLLGRH

SEQ ID NO: 5806 - protein, 56 aa, Lactobacillus buchneri
MNEEDKKKEEQQRLADKKFEDFIQGIYDTNKEPSNEDWLDNVASAMVPNEADKEKR

SEQ ID NO: 5807 - protein, 102 aa, Lactobacillus buchneri
MSKDLLKKSLNSDVTQVPKPSNIFSRDMKVKANTKKSKPKTTTIRCSVETADMVNALSAVLNFKSVDEMLEHTINSTLEGLTNEERAEYRTVKKIYTSRRSK

SEQ ID NO: 5808 - protein, 276 aa, Lactobacillus buchneri
MVKVITFGNFKGGTGKTTNSCMISYRLAKQGYKVLLADLDPQANATALYLKTKQVQNNEVVKFDNTLMNAISNDDISTIVTKIRDNLYLLPSFADFTSYPIFLEKKYPNTDDQYKRAKHFSNLLDKIKDDYDYIIIDTPPTVSVYTDSALMASDSVIIVLQTQERSYVGAEAFISYLQELVSNYDADFNIAGILPVLLKNNSQVDQSILEQAEAEFDKDNIFKNVVKNMERLKRYDIIGIVDPDLKTQKHDMHDMRVDALYKKITNEFVERVGKDE

SEQ ID NO: 5809 - protein, 73 aa, Lactobacillus buchneri
LQSPINTVLTILGMLGVITDVQTINVSQDTTGTLEHVTNEVDSASQADKAPTSANVSNVTSTSAEIKVDNKAE

SEQ ID NO: 5810 - protein, 365 aa, Lactobacillus buchneri
MNQTNFNFIESEKAYATRFFQFPQVLIYGSQYKTLSDSAKLGYMILHDRLDYSLKNNWVDEDNRVYFIFTNQELTDLMGWSKKKVIRVKNELENQGLLFQKTMHFNPKTGKNEPNRLYLADLEVTATDIYTKSRQQEPRTLGTRESVKTEPSRKFVKTLDTRESVKTEPSRKFVKDTPQTLDTRESVKKSHNLDYTNNLDTTRYNIDTQKLDFSTAHFSPAELEKQNHDLVNHANDFLTDEDSGLPVFLEPEAVQLLSFWCRTPQQMRRFIGIILNAKYRVEKDHQDIGVLIPLDDEELKPLMTKALRRYFNALRSNEKHIKNVENYLYGTMQNLFGIWWNKQAAREYAAKHPEEQNTDNGPSWN

SEQ ID NO: 5811 - protein, 65 aa, Lactobacillus buchneri
MTKSSKEVETIEQLLADPWAVDIQDVWEQAAHNPDPDKRKLFDALHTYLLDKRQEQIINEKHFVI

SEQ ID NO: 5812 - protein, 229 aa, Lactobacillus buchneri
MSELKRYIIVAGINGAGKSTLYRARPELFTHSKRLNADEILQKMGGDWYKDRDNFRAMREEIKQLHAALDTGQSIHVETTIAGQGKAQLNLIERAHQNGFEVTLLYVALKNERVAINRVHERVKKGGHGVPDEIIKKRYNQSNHNLAIVAFKADNVVIYDNSQKFVSVYRREHDQVIKNNLHNFPWINPKIIFEAAIQKQLNDFVKNNPDLKIKNPMNDSENKNDRPSY

SEQ ID NO: 5813 - protein, 92 aa, Lactobacillus buchneri
MPNQYEKLVEQQARLKQKIEREDFKLRQSKYYENRQARKARSRRLIQKGALLEKYFQADNLSVEQTEELLKIFANYVNAHKPNKFKGDQPNN

SEQ ID NO: 5814 - protein, 69 aa, Lactobacillus buchneri
MSQSNLEKQEAKLKQLNQKIKAEKNKIEQNLGKQIIRSVNLDYGTLTTPQIEMIAKKVAAFLNQAQNNQ

SEQ ID NO: 5815 - protein, 686 aa, Lactobacillus buchneri
MAIFHMSFSNISAGKGRSAIASAAYRSGEKLFDDQEGHHYFYARSVMPESFILTPENAPEWASDREQLWNEVEKKDRKSNSRYAKEFNVALPIELSVDEQKELLTKYVQENFVDEGMVADVAIHHDHPDNPHAHVMLTNRPFNPDGTWGQKTKTEYILDSHGNKTKTPAGNVRNRKIWLVDWDKKEKITEWRHNWAVSVNQVLEQKNIPDRISEKSFIKEGIDDTPMQHEGINSKRHERKEFNQQVKNYRKAKASYKNNQEKVINRGHLDSLSKHFSFNEKRVVKELSHELKTYISLENLDDKRRMLFNWENSTLIKHAVGEDITKQLLTINQQESSLKKADELLNKVVDRTTKKLYPELDFEQTTAAERRELIKETNSEQTIFKGSELNERLMNIRDDLLTRQLLTFTKRPYVGWKLLMQQEKEVKIELKYTLMIHDDSLESLEHVDQGLLEKYSPTEQQKITRAVKDLRAIMAVKQVIKTQYHEVLKRAFPKGDLDGLPLIKQEQAYTAVMYYDPVLKPCQAETIEQWQANPPQVFSPQEHQQGLAYLSGQLSLDQLENHHLQRVLKHDGTKQLFFGECKADPTIKNSQIEKIQMQLKEQQAKDDQYRKANIGHYQPLNYKPVSPDYYLKTAFSDAIMTVLYARDEDYQRQKQERGLKETEWEMTKKQRQHQTRNRHEDWGMHL

SEQ ID NO: 5816 - protein, 503 aa, Lactobacillus buchneri
MVYQRDQAIKNFKPEPYFELNAEILANQQKFVAKLDPYQRFKDETGLMTFMQAKHVQKGSQDGFIKDVQKQGKKRASPQLFSLSSLQSAMNKRYHASASQTLAAIQSLYEAKLLSYPRTDCAYITDEEFGYLVANLTKYLGLVSKQVALTNTTPNKRYVNGKKVEEHYAIIMTKVVPTKEKLASLPKLQQQVYDLVLRTTLAMFADPYEYEETTIITQVGDANFKATGKVPTKQGWQALFDDHKAEQQEAATLPLVHQGDQVQANLQTPQKETTPPVPFTEGTLITAMKTAGKTLDDEVAQAILKDVQGIGTSATRANVLEVLKKRGYLVTEKNKLHVSEAGITLCKAVELEPLLTSPEMTAKWEQALQQISTEERTPDNFLSQIKKFVEKLIADVPTQLTGNAAIKQQINHQQQAQKSAEVFLETPQATVLNKQKFYIVKPKQGEDFTLPKKWSSKTLGKTAIKALVTKGETSKLKGFKSKKGKSFDAKLKLDGHKLSFDFD

SEQ ID NO: 5817 - protein, 71 aa, Lactobacillus buchneri
MNNELAVLASELPVLQAKGTYKYLKEITGNGAYYQVAWQKLSDGYVALYGTTPIQIRSLPTLNDIFEDEEG

SEQ ID NO: 5818 - protein, 374 aa, Lactobacillus buchneri
MPNKADVKAWKAQLVAQAEQQILKLTDSDRFKQYLNTLAKFHQYSARNIDLIYAQNPQATQVAGFKQWQKAFNRTVNRGAKAIRIAAPIIKKLTPAEQKHLDTTDERAIVGYRYLPVFDVAQTSGEPVLSAKDFVKENLADHQNVTSLYNAFKDYLNQQTDLKVSEVPLAMLNGAKGYFQPSTNEIVIGGDESDNALKLKTLYHEYAHSQLHGLKSAFKDRPRAYQETQAEAVAYVAMQNIGVDTSNYSLGYVATWAKDKAVIHSALSEIQQVSNKVIELSDGLTKQLGLQEAPKEPEHDLKKLSAHDLNKSYQGLQQQIQQTTNTQQKSQFRHQLTDVHQEISKRTQKQLKAFAEQHPEIKQPDSEPDQSLKR

SEQ ID NO: 5819 - protein, 204 aa, Lactobacillus buchneri
MIKTIITGIVLYASTAIDLLVILMLLFSKYRSTKHKQQIYIGQFLGSYTLIAISLFFALVLHYVPAKWILGFLGLIPIGFGIKYILSDEDEAAEVDEKIEQRKDKNLIATVALITVASCGSDNIGLFVPYFVSLTIEQLITTFIVFTFCIFILVYLGDKFSRVKIVKKLLDKFGNWIMAIIYIGLGMMIILESDTISHLIKILF

SEQ ID NO: 5820 - protein, 118 aa, Lactobacillus buchneri
MIKVDCCPDKPELASRDLLSEENASEIVLLFKVLSNDTRLRILHCLTREPKISVGKIAARLNMKTAAISNQLQRLVDQKIVKTERDGNFINYEIIDECTAILLERAWCLAEDTGKITG

SEQ ID NO: 5821 - protein, 391 aa, Lactobacillus buchneri
MNELTTEIIAALAQKQDLDEVFRHHLEIAINQLLQTELAEFLGYERYSYAGINTGNNRNGSYERSFDTKYGQLNLTIPRDRNGRFENHTLPAYGRHSDNLETTVIQLYTKGITTAEIAELIEKMYGAHYSKATVSNMTKAVNEQVQAFQQRRLASQYAAIFLDATYLPLKRDTVQKEAVHIAIGIRPDGTKGVLNYQVAPTESTGIWTELLGTLIKQGVKDVLLFVADGLVGLDEGLNRHFPKAKRQRCLVHVGRNLMNKVRVKDRKAVISDFKQVHRAANREAAELKLNEFANNWHQTYPKLIKDLLKMPNLLTFMDFPPAIRQSLYSTNLIENFNKHLKRTTHHKEQFPTEDSLDRFLVSQFNVYNEKSLKRIHRGFKGLQDTLEASFI

SEQ ID NO: 5822 - protein, 122 aa, Lactobacillus buchneri
MTKPPLTTNRHAISDEKWQQIEKLFPAYTTGRPPKLSNRAALNAVLWQLKVGSPWRDLPTEFGSWKTVYSRFRKWTDSGLFEQIFKIICEDDDPDMENVSLDSTTIRVHQKGTGAQKNPAAQ

SEQ ID NO: 5823 - protein, 147 aa, Lactobacillus buchneri
MIKETPRNIEELKKKANNKNSWRERLSAVNVLKEYDCKQSKDILARLAINDPVFKVKETAFRAAQALGVTSHGNPIYLGKGKKGNLVKGINKKLEKVRNSLPDDYSFEDFKSEFQKKYPSAYDVYEGTKKDFDGWLKKSEANLPHRK

SEQ ID NO: 5824 - protein, 501 aa, Lactobacillus buchneri
VAKDKEMNDQMIVRRQKMDELRKEGIDPFGHRFVRTYLAEQLHHDFDDEDKDELMEKDKKVTIAGRMIAKRGKGKVGFADLKDRTGKIQIYVRKDIVGDDIYHIFKRSDIGDHLGISGQIIKTDMGELTVRAESVTFLSKALRPLPDKFHGLKDKEQRYRQRYLDLISNQDSFDRFVKRTKIVSAVRKYLDSNDYQEVETPVLHNSAGGANARPFITHHNALNIDLYLRIALELHLKRLIVGGLERVYEIGRVFRNEGMDTRHNPEFTMLESYVAYYDFHDVMDETEGIFKAAAAAVTDDNVVTYQGHTVDLNKPFKRQHMVDAIKEYTGIDFWQPMSDDDAKKLADEHHIHYEPWWKTGHIINAFFEELVQPKLEQPTFIYGHPVEISPLAKKNHDDPRFTDRFELYILTNEFANAFSELNDPIDQRQRFEAQVAERKAGNEEAEGIDEDYIEALEYGMPPTGGLGIGIDRLVMLLTDAPSIRDVILFPTMRPEDNTNND

SEQ ID NO: 5825 - protein, 335 aa, Lactobacillus buchneri
MKWNIGNVTIPNQVVVAPMAGVTNSAFRIICKEYGAGLVVCEMISDRGIMYKNKKTLDMMFVDPREHPMSIQIFGGTKETLVQAAKFVDQNTAADIIDINMGCPVNKVVKTDAGARWLLDPKKVYEMVSYVTDAVKKPVTVKMRTGWDEDHIYAVENALAAERAGASALAMHGRTRKQMYEGHADWGILKQVAQEIHIPFMGNGDVRTPQDAKKMLTEVGTDAVMMGRAVEGNPWILKQTQHYLETGELLAEPTPEEKVVTAKEHLHRLVELKGDYIGSHEFRGQAGYYLKGIPHSARTKVALTNASGESAMDDIFDEFLEKNEQRKARQHRIAQ

SEQ ID NO: 5826 - protein, 298 aa, Lactobacillus buchneri
MDDYLVKATTTDGMFRAYAVNAKQLVTTAQQDHDTWSASSAALGRTLVGTVMLAESVEKNGEAVTVKINGQGPVGQIVADSDSNGHVKGYIQNPHVHLPLNAHHKIDVGKAVGVNGLIEVSRAAEGEDPYTGSVPLASGEIGDDFTYYLAQSEQIPSAVGVSVFVNDDNTIGAAGGYLVQVLPDATDDAINQVIERIKQMPMISELLLDNQSPEDILELIFGKGQLHFLETVPVEFFCNCSKNRFGRDLEGLPVPQLETMLKEDKGIDVTCNFCESKYHFNEEELGKIIKVAKAEGHH

SEQ ID NO: 5827 - protein, 711 aa, Lactobacillus buchneri
MNSNRNGLFKNSLFYIVIFLLIMGVIYFFNGNTNQTTSQEIQSSQFVKNLKDDKVKSFSVQPSGGVYKVTGTYRQGQKVQVQSGLIGGNQTQSKNVTKFTTTVLENNSSIAEITKAAQSNNVKMNAKPEESSGFWVNLLVYVLPLLLFVWFFYMMMGRAGGQGGGNGKVMSFGKSKAKPADSKQNKVRFSDVAGEEEEKQELVEVVEFLKDPRKFTTLGATIPHGVLLEGPPGTGKTLLAKAVAGEAGVPFYSISGSDFVEMFVGVGASRVRDLFDQAKKAAPAIIFIDEIDAVGRRRGAGMGGGHDEREQTLNQLLVEMDGFSGNEGVIVIAATNRADVLDPALTRPGRFDRKILVGRPDINGREAILKVHSKNKPLANDVDLHEIAKQTPGFVGADLANLLNEAALLAARRNKTQIDASDLDEAEDRVIAGPAKRNRVISKEERETVAYHEAGHTVVGLVLNDARVVHKVTIVPRGRAGGYAIMLPREDQQLMSKKDAMEQIAGLMGGRAAEEIVFDSQSSGASNDFEQATNIARAMVTQYGMSKRLGPVQLENPAQDTYGPRYSQETGAAVDEEVRRLTNEAHDTAKKIIEEHRDKHKLIAEALLKYETLDEKQILSLWHTGKMPESSDTSEFPSERAATFEEAKRELERKEAERQAELEKGHTTGDQTQDTDQNNSDDQSTDGSEKPDDVSNNDQPKDNNHDNDDNN

SEQ ID NO: 5828 - protein, 180 aa, Lactobacillus buchneri
MNNDILKVLYSKEEIQAAVERLGKEIAQTYAGKTPVVVGVLKGAIFFMTDIARAVDSYMQIDFIDVSSYHGATESSGTVELLQDINTDIDGRDVLIVEDIVDTGRTLKFLLDTFADRGASSIKVCTLLDKPAGRAVDAESDFIGFKVPNEFVVGYGLDYDEKYRNLPYIGVLKPEIYTNN

SEQ ID NO: 5829 - protein, 460 aa, Lactobacillus buchneri
VDLQKQFNFIVKQKAWWQAGDAVVVAVSTGVDSMTLLYLLQHLPRAVRPKIIVAYVDHQLREQSVEETRYISNYCSEYGLLLKQAVWSKDDHPTTGIEAAARTFRYRFFKRVLKETGSTCLLTAHHGDDLVETVIMKLVRGGQLASLTGIRETRSFADAKMIRPLLSFSKQQLESFAQTTGLRWFEDETNQQPAVERNRIRHGVMPLLKAENPQLLPHVLSYTNQLADNLAAIKFLIQPLIHSAVGFSEKHRAEIDLDSLKDFPDSVVKCLLEEVFEHYLRIPNISVDQLDEVLGLIQQTARPQAKMDLEAGWQVRRVYQSLIICKEPQKIVGKPEKDRTFMVILDRWYSLSPSTKFGVFTAHKTVANNKLTTFYLQDTDLPLQVRSPKAGDRLSIGHGQHQKVSRVLINAKVPNDQRERTLLLVDARGTVLSVLGLKNAVVSRDSEDTRPYFLIEVRQK

SEQ ID NO: 5830 - protein, 168 aa, Lactobacillus buchneri
MAIEVGEKVNGKVSGITNFGAFIDLGDHRTGLVHISEVSDGFVKDIHDVLKVGDDVTVKVLKIEGNNKISLSIRKASDNHEHEDSKNENHSHRNFHENNHESHENHGNHQSHGYHSRGGSSAHNNHSNNHEESFDDMMSGFLKESEDRLSTLRKNTEGKRGGRGGRRS

SEQ ID NO: 5831 - protein, 136 aa, Lactobacillus buchneri
MTQQSGKVRKLDNDFTRRREIELNNSRVTAVLSNRRKKRALVISAIFLFFASIFLIQIVRAKVNYADVHVRIAREQKTLKQQKADQKQLKTQVAQLNDKNYVEQIIRDRYYYTKPGETVYSFPNKAPKDVNDYDVK

SEQ ID NO: 5832 - protein, 90 aa, Lactobacillus buchneri
MRIDKFLKVSRIIKRRSVAKEIADKGRIFINGRAAKSSTEVKPNDEVVIKFGNKTLTILVKELLDTTKKDDAERMYEITSEDYERDFRNE

SEQ ID NO: 5833 - protein, 532 aa, Lactobacillus buchneri
MKNRSRRQLVLKGTLLLTVASFVAKLLSAVYRIPFQNMVGNIGFYVYQQIYPIYGIGMTFALTGLPVFISKLVVDTKDPRDQVGLAIRIQNILIVVCLVAFCILQFAAGFIAGKMDDPRLAPVVQSVSWMFLFVPFLSTWRGYFQGKMEMRPTAYSQVIEQVVRVSSILLVGYWAFKSTVSPYRMGQLAMLSAPIAGLIALLFILIWMKSRSLPTNWRNRRPTIETRLLIKRILLEGGTLCLVSAVMLLLQLADSFSVVSGLRSFGYSLVAAQNIKGIYDRSQTLVQLGQVLSIASATAVLPGLVLANKHRQDVTFQHVAATNLRTNLAVSLAMSVGLAALMPQINRLLFASSELNLTISLYCISIVLTSVLMTYNVILQSKDNYLRTMIAILAGFLIKVLVNQLFVAHFGIIGASLATLLSLMVMVLLMNLLSRKELAKLISFKQLGKLAVVLVTMFIAVRTTVFGINLADLADNPRIAALLVVCAAIPIGVIIFFAGCRLLDVFTVREWLAIPFVGKFLKIKGVTTHENR

SEQ ID NO: 5834 - protein, 1178 aa, Lactobacillus buchneri
LKLDQLLTTIPQYQELVATLKPGTRQLVTGVGGSARTLLIDNLIHSTDKPTVVVVDSLFHADQLVNDLSNLIDDDQLFEFPVEEMGAAELATSSPEYKAQRVLALDKLASGDPAVIVTSVSGIRRLVPEKKQFQAAKLTLEMDGTYDLEQLKLQLHQMGYVFQKMVAAPGDFSIRGSILDIFPLNHQDPVRIDFFDTDVDSMRTFDVSNQRSIKNIKSITVLPATDLLMTDDQRKAVSKQLSKRLIAEQSKLDDKAAKKLQGNLEPQIMDLQNGLSDPRWLLFADMIYKKQSSLLDYLAADGVVIFDDYARITETARQLESDDDEWLNDKIKHYEVLKSTTYTNDFKKAFSANHHATLILSLFQKGMGRMRLDAIEDITVRPMQQFFSQIPMLRTEILRWQKMKQTVIIMVQDEKRLAKVASTLNDFEITATQTDKDHLLKQEVQLISSNLDNGFELPLASCVVITEKEMFGTVTKKRPRQTTFNNAERIKSYTDLKPGDYVVHVNHGIGRYEGMKTMEVDGKHQDYLTISYKDNAKLFIPVTQLNLIQKYVSSEDKHPRINKLGGSEWAKTKAKVASKIEDIADELIDLYAKRSAEKGYAYPQDDSLQAEFEAAFPYSETPDQLRSATEIKRDMETQHPMDRLLVGDVGYGKTEVALRAAFKAIEVGKQVAFLVPTTILAQQHYETMLDRFREYPITVRVLSRFQTAKQVKETLQGLKDGKVDVVVGTHRLLSKDVKFNDLGLLIIDEEQRFGVKHKERIKEMRSDVDVLTLTATPIPRTLNMSMMGVRDLSVIETPPSNRYPIQTYVIEQNAGTIREAIEREMSRGGQVFYLHNRVSDIEKTVEQISALVPSARVGYIHGQMSENQMEDILYDFINGEYDVLVTTTIIETGVDIPNVNTLFVENADRMGLSQLYQLRGRIGRSSRVAYAYFMYKPNKVLTEIGEKRLEAIRDFTELGSGFKIAMRDLSIRGAGNLLGKQQHGFVDSVGYDLYTQMLSDAVAKKRGKNFEYRTDATIELDLEAYLPSDYIQDNQQKIELYKRIRQIENEDQLHEVEDDLIDRFGDYGEPVANLLKISQLKMFSDYALVDKIHQNQPKITITFSPRAGTEFSSKELLEAIAQTKFRATINTENDRYQIQLTVQPNMTKWLDGLIALVKQLSKTRHHHGAAGKVKSDEK

SEQ ID NO: 5835 - protein, 186 aa, Lactobacillus buchneri
MKMIVGLGNIGPQYDGTRHNTGFMVVEQFAKSHDISIKTRKMNAKYGSGFVNNTKVMVVEPTTFMNDSGLAVRPLMDYFDVSIEDLIIVHDDMDLPVGKIRIKDKGSAGGHNGIKSIIASVGTQNFDRIRVGIDHPDHGNTVVNYVLGRFSKDQAPIFKQAADHAVNALDDWIDGMSIPDLENQYN

SEQ ID NO: 5836 - protein, 315 aa, Lactobacillus buchneri
LTLQRQKVALIGDGAVGSSYAYAMMQQGLAEEFVIVDVIKERTEGDALDLEDAQAFTSPKHVYSGDYADCKDADLAVITAGAPQKPGETRLDLVNKNLKIMKSIIDPLVGSGFNGVIVVAANPVDILTYAAQKFSGFPKNRVFGSGTSLDTSRLQVALGKKLQVSPQSISAYILGEHGDSEFAAYSAAQIGGRPFLDVAKEAGLSMDNLKEIEDQVRHKAYEIINRKGATFYGVATCLMRISRAILRDENAVLPVGAPMDGEYGLHDVYIGSPAVVNASGIQKVVEVPLNADEAAAMKASAETLQKTTADGMAEL

SEQ ID NO: 5837 - protein, 214 aa, Lactobacillus buchneri
MLLKTLVKPKERLVTVKEDATLEEALQTLEDSGYRCVPILDETGKIFRGNIYKMHIYRHKSRGGDMSLPVTTLLKNATKFINVNSAFFQVFFSIKDLPYIAVLDERNNFYGILTHTRLLDMLSQSWNVNIGSYVLTVVASGERGDLEEIAKIITKYTNIASVISLDAQEGELVHRIMFTLPAEVDQDRLNRIIAALERKEFRVPEVENLQEEKN

SEQ ID NO: 5838 - protein, 118 aa, Lactobacillus buchneri
VTDVIFKRGDIFYADLSPVIGSEQGGMRPVLIVQNDIGNHYSPTVIVAAITARISKPKMPTHVGILAGNGIERDSVILLEQIRTIDKQRLKDKVTHLDPPIMSKVDKAIKISLGLAKG

SEQ ID NO: 5839 - protein, 94 aa, Lactobacillus buchneri
MEKATNSKHFSVMINDQIADRLEQFSATVGISESAAVEIAINYFFDDPKVIDGLMRGYREMGSLNREISKDFSCCEEDADIHLTQYRQRLRNLQ

SEQ ID NO: 5840 - protein, 374 aa, Lactobacillus buchneri
MTVGNLRDAQVTVDLAAIYSNIHHAKQRLDDGDDLFQVVKADGYGHGAVQVAEIAEKAGATGFCVAILDEALQLRQAGIKLPVLVLGITDPECAQLAASENISLTVGSIDWLNQAAKLLDTSAFKGRLNIHLALDTGMGRIGFQTPDELKAAVGVLNAHSDRMCFEGIFTHFATADSPDDTYFKFQYQNFQDFMAVLDKRPKYVHVANSATSLWHKVCGGNMIRFGIAAYGLNPSGRDITQLPYQLKPGLSVTSEIDFSKLVKKGRSIGYGATYTTDSDQWIGTVPVGYADGIPRAMQGFSVLVDGHKCPIVGRVCMDQFMIRLPHDYPYGTTVTIIGQSGDAQITADDVADYLHTISYEVICGLSPRLRRKYV

SEQ ID NO: 5841 - protein, 119 aa, Lactobacillus buchneri
MIAGIGIDVTDIRRIVAAVERNQHFTERILTADEMKQLAELSDKRRYEYISGRFSAKEAYSKAFGSGLGSKVRFQDLCIVNNEEGKPFFSKQPFDGNAFVSISHTDDIVVTQVILENRG

SEQ ID NO: 5842 - protein, 539 aa, Lactobacillus buchneri
  misc_feature (6)..(6): Xaa can be any naturally occurring amino acid
DEADBXATPDEPENDENTRNAHELICASECSHALKFSELGLSDHLLTAINNSGFEEATPIQAETIPMVLKGEDVIGQAQTGTGKTAAFGLPILQKIDFDNPNVQALIISPTRELAIQTQEEIYRLGKDEKAKVQVVYGGADIRRQINALKGHPQIVVGTPGRILDHIRRHTLKLEHVKTLVLDEADEMLNMGFLDDIEDIIKQTPKERQTLLFSATMPAQIKRVGVQFMRDPHQVTIKAKELTTDLIDQYYVRVKEYEKFDTMTRFFDVQDPEVTIVFCRTKRRVDEVSKGLQARGYKAAGLHGDLTQARRTQIMQEFKAAKIDILVATDVAARGIDISGVTHVYNYDIPQDPDGYVHRVGRTGRAGKHGVSITFATPNEMDYLREIEKLTKVRMLPLKPPTIQEAFVGQLNSAESDIADLIKKTNTDKYEKMADKLLDEYEATDLVAALLNDVTRDNVKVKITPERPLPHHGHGHGGHRNDRRGGGHGGHYKGSKSHRNGDRNNGSRNRGHYEGSNDRKHSDRRSSSNKKRRFTIKNS

SEQ ID NO: 5843 - protein, 462 aa, Lactobacillus buchneri
MKMTIGEVAQAINANTENFDKAMLDESLTGVCFDSRKIQTGQLFVPLVAEHDGHDYIDNAIAGGASATLWASDHADRLPLTIPALVVDDPLTAFQQLSKYYLDKINPRVIAVTGSNGKTTTKDMIAAILSSTFNVTKTQDNFNNEIGLPYTILQMESNTEFLVAEMGMDRPGQLDFLSKLARPDVAVITMIGEAHIEFFGTRDKIADAKMEITHGLKADGFFVYDGDEPLLTERAQQVDESVIKSTFGRKDSNDVFATDSKDGQYQTQFHVNLWPEIDFTIPMIGDYNVNNALAAISVGRIFRIYPQMMADKLAKFDLTKNRTQWLSGSKGERILSDVYNSNPTAAKEVLTAFKNTTTKGRRIAVLGDMLELGTQSKAMHASLADALDPASIRVVYLIGADMDALYEKLKPVYAPENLHYYQADQLDELTSDLQAELRADDEVLLKASHGLHLENVVAKLVK

SEQ ID NO: 5844 - protein, 251 aa, Lactobacillus buchneri
LIFINTNPISNMILSSGITAADFINGLDELPQNIILLNNDDQAANGYNSHSKFNLINGTGEIRTYLLRNPDQKKKFIDFDVEDSVNNLSPFEIAELLYLAHMGTPMGRPFSSKLNNHYIYLSQDNGTIRSYYRRFSDFNHVLEIAIKRNLRETHNTLRVFLRPLAIKDIDRSILLDLITKANDGLFISFDSLRERSRTYHIPLRILKDPDQVSIILRTGKVDENTVYAGDLTYNLQTSKWHLEWQDQTVGV

SEQ ID NO: 5845 - protein, 155 aa, Lactobacillus buchneri
MTNVLFVCLGNICRSPMAEVMFRQMVKDAHLENQITVASAAISTEEHGNPPHPGAIAELAKHGLSVGNKTSTPITKEDFDQADYIIAMDNQNIFYLNQMAPIADRKKIFLCYNIIPDKQGKDIPDPWFDHKFGRTYRQLSETLPKWLDKMKSQVA

SEQ ID NO: 5846 - protein, 239 aa, Lactobacillus buchneri
MRKGLLKKILINVVFVLLVIVALGMIFNRPIKNELIKSYHPKITRQTVAKTERRQKAQTKRHKQNVSYDFKKVKSLDFQTAARARMNTNAIEVIGEILLPKSHIHLPIGLGVANNTLALAAGTMRPDQQMGKGNYPLAGHHMVNRHVLFGPLYFKTQVGDRIYLSNMTKVYQYKVYQRKFIAATRVDVVRQTKRPIVTLITCDATGAGRLMIRGKLQKSYRISHATPKLKRALLGPVNN

SEQ ID NO: 5847 - protein, 409 aa, Lactobacillus buchneri
LLTKQVGPNSWRRNLAVLWFGTFMAGIGFSEVMPFLSLYVDSLGHFTHNELSLYSGLAFAASYLVTAIASPLWGKLADRTGRKLMLVRASAGMAIVFILMGLVTNVWQLIGLRLLQGVFSGYISNANALIATQVPKRKSGQALGTLVTGNVSGALLGPLLGGTLASFFSYRVTFFITGALFVGVFLVTTLMVHEDFKPVAKSKMLNTRGVIGELANSKLVLGMFVTTMIIQAANNSIVPILALYVRQIMNNSPATTFYSGIVAAVPGIATLAAAPMLGRLGDRIGADRVLLVGFLLAIVVYVPMAFVTNVWQLIGLRFLIGVANASMLPAVQSILAKNTPPHVTGRVFSWNQSFQAMGNVAGPMIGSVVSTSFDYAGVFISTAVLVVINLTLVFNNTRGMRRARKQRIE

SEQ ID NO: 5848 - protein, 84 aa, Lactobacillus buchneri
MKKGIHPAYQQVVFQDSSTGFKFISGSTKTSDETIKMDDGKTYPLIRVEISSDSHPFYTGKQKFNQVDGAVDRFNKKYGLTDNK

SEQ ID NO: 5849 - protein, 427 aa, Lactobacillus buchneri
MSKLIINGGKRLSGEISIGGAKNSTVALIPAAILADTPVRFDSVPDILDVHNLMLILKSMNVSSEFKGDVLTIDPTNIVEAPLPSKAIKSLRASYYFMGALLGRFQRATVSFPGGDNIGPRPIDQHIKAFKALGAEVSEHDGTVTIKTGPDGLHGAQIFLDIVSVGATINTILASVKAPGTTVIGNAAKEPEIIDIATFLNNMGANIRGAGTDVIRIEGVPTLQARNTHTIIPDRIEAGTYLSLAAAVGDGILITNIIPEHLEAFVAKLEEMGCDLTVYEDSIYVGPSHDLKPIRIKVMPYPGFATDLQQPLTPLLFKAKGRSVIIDTIYPKRIKHITELNKLGGKVKSEDTDEGIIVVDNSPKLMGAKVQAGEIRAGASLVIAGLMADGTTEICHADNILRGYGNIVDKLRGVGADVKLEVEERVN

SEQ ID NO: 5850 - protein, 880 aa, Lactobacillus buchneri
MKRLFTTIGENIHRHHKLWITVILIMTIGFAFGLPKIQMKMGNDVFVSSSSKTYQDSQTYQKKFGGDSLYLLLDGNQSTLLSHKTMQQVAKFDSKVSQVDNVRNTTDIVSSLNDQLSHAGTGNSSAQFNFNSKKLQQDLMAELSSKQKQSIQSKMQHSLTSTQQNQVQTYLLKQLTPAQKKLMAAAGAQAQGSKQQQQAMLQKQLTTKQQAAVQSYTMSLLNHQQQSQLADTVIPMLPKVQDMSTKLLRDIFLSDNGHVPSAMKQLLPKDGKHLLIIINTNKKSSDMNTAVQINHDANQAIKQTNFSSSIKTRLGGQPAVLGQVRSKVITSMATMLAFAVVLMVIILLLIFPVRKRLLPLIFVLACLVWTFGLMGWLHIPLTLATMATLPIIIGLGTDFGVQFQNRYEEEVRKRQNSQEAISVAISSMGPAVGVSLIVMVFSFLTMYLSKAPLMQQFGLTLAIGVACSYVVEFGLMFSSLSLLDKHASTAKLAPKKLSQPSRLSLFLSHYAEWVTHHAGILLTIGVVLAGLGFSFEKSINIETDFTKMIPQNMTALKNTKYLQSKIGSTTYLTYLVEGNGRDIRDQDNLKTIDQVGQKVDHKYHDVTDVTSLSTAYQQTNGSLNTSQKQLTVGVDNLPTSLKQTLISSNHHDATIQFKIKNGLSSKEQLKLMNRINHDIKGTHHGLKISPAGAQVMMLLGINNMSANHDLIIIAGLSIIFIVLFLIYRDWRLALYPVIPILLVLGLSPLTLKLLGISYNPVTIALSSLVLGIGTEFTILILERYREELQRGISTRDAIVSATASVGQAITVSGFTVMGGFSAIMFSSFPVLKSFGLITVLDTGYSLICALTILPAVIYLLRKRKPAATQSSSEQATESKD

SEQ ID NO: 5851 - protein, 170 aa, Lactobacillus buchneri
MADTQSQQRTKRDILQAMMTLLRKKKFDDITIGEICDEAMIHRSTFYRYFQDKVDLANTIIYNLSEELLGTDFRETVVLTQVTHFISDNIDLIRHLIPESQSKFYDEFRNILENLFNERANNPAYQNDPVVTLIKQSSSQPLMISFLANTIMGFLEEQLLKANIDWPQLE

SEQ ID NO: 5852 - protein, 538 aa, Lactobacillus buchneri
MTKYIFVTGGVVSSLGKGIVAASLGRLLKNRGLNVTIQKFDPYINVDPGTMNPYQHGEVFVTNDGTETDLDLGHYERFIDNNLNKYSNVTTGKIYDEVLRKERHGDYLGATVQVIPHITGMIKEKIMRAAKVSDAEIVITEIGGTVGDIESLPFLEAIRQMKTEVGDENVFYVHTTLIPYLRAAGEMKTKPTQHSVKELRGLGIQPNLLVVRSEKPITDSMRKKISLFCDVKPQAVVESLDVPTLYTIPLNLQKQGMDQQILDHFGIDKPAADMTEWKQLEHHVQHLKRTIHITLVGKYVGLQDAYISVAEALKHAGYVVDADIDLEMLDSEKITPDNVADLLSDADGVIVPGGFGDRGIEGMITAIKYVREQDIPYLGVCLGMQMACVEFARDVLSYPDANSTEMNPRTKHNVIDLMADQEDVHDMGGTQRLGAYPCKLKPGTVAAKAYDNADVISERHRHRYEFNNAYRDAMEKNGMVISGTSPDNHLVEVVEIPKNRFFVGSQYHPEFISRPNRPEGLFKDFVAAANDLYLEKNK

SEQ ID NO: 5853 - protein, 205 aa, Lactobacillus buchneri
LELEVFKGQNKNELSMIEVAHAILAQRGDTMPFADLANAVQAYLGDSNKEIRDRLSQFYTDLNIDGSFISLGDNLWGLRTWYPYESIDEATVHTEEDEDRPKRKKRRKVNAFLADASDDDDVIDYDDDDPEDQDDDDFDDDTDDDDDSDDESEDLGKYNKDLQDIDDDSDDEDLPDGIEGQLNELNDDDDSLDDDDDDFNSKDDH

SEQ ID NO: 5854 - protein, 144 aa, Lactobacillus buchneri
MDNLTTGVPVQIHLETNILQEGQKSNFVFDVTGQLVRVGSSLYIRYEEETEDGGVPVTIKISDNGNVKLTRSGENRLQLLFSDGKRIAARYRTPYGLMDVQTVTSALDMEILDAPLRGNIGIDYLLYAGDALLGKYNIRLQFTI

SEQ ID NO: 5855 - protein, 275 aa, Lactobacillus buchneri
MSFTNVPITVINQIYSKSTKLDAFADTNALLEICDQTLKPFIHFWTTSEATLILGINDRHLPKLADGLKSLLANHYDYFLRNSGGLAVVSDPGILNISLFIPQPDTVYTIDQAYELIKGLISMSFPQLDIKSFEVTNSYCPGKYDLSVNGQKIAGIAQRRTTNALVLMLYLSVNGDQDARSQTVAEFYETADAYSQSRWTFPKVDKDTMTTVQDLGFPNITLEDVEHKFLASVNQQNIEVDVTSGPDFMLSPAFTQERAKQLRKIQLRNDQLPIV

SEQ ID NO: 5856 - protein, 444 aa, Lactobacillus buchneri
LDYAHQQLKREKVFRDPVHNYVYVKYQVILDLINTTEFQRLRRVHQLGTTSLIFHGAEHSRFSHSVGVYEIARRIIESFQKNFMSQQPGDGLWDDSEKLVALCAALLHDVGHGAYSHTFEHIFGTNHEQITQAIITSPTTEINQVLRRVSPDFPEKVASVINKTYPNKQVVEMISSQLDADRMDYLLRDAYNTGVKYGTFDLSRILEVMRPYKDGICFEMSGMHAVEDYIVSRFQMYQQVYFHPVSRAMEVVLNRLLQRAKVIFSGEVHHDPQTPYLLLPFFKGDFNLDDYLQLDDGVLNTYFIHWKRYPDDILSNLASRFIDRKPLKSVKFDKSTADLLPRLREIIEQSGFNPDYYTATDNSFDLPYDAYQADKKQIHLMQDDGTLVSLSSVSPLVRAISDRQTGDNRFFFPREILKPDENVDLFQPEYDEFNRHIRNDKLIK

SEQ ID NO: 5857 - protein, 269 aa, Lactobacillus buchneri
MDIKLIAIDIDGTLLNEKNELAQPTIDAITEARKNGVKIVLCTGRPLSGVQPYLDKLAIKGASEFAITFNGAMAQSLDGQVMVNHTISYDNFLETEMLSRKLNVNYQIETTDSIYTTNRDTNPYGIAESFLVRLPIKFRSPEEIPRDLVMSKAMFVDYPENITKANDLIPAKLRDEMYVVQTEPFFIEMMNKQASKGKTLGELADQLHLTKDNLMAIGDQGNDLTMVKAAGLGVAMGNAIDEVKDAAQFITKPNTEDGVAFAINKYINH

SEQ ID NO: 5858 - protein, 123 aa, Lactobacillus buchneri
MVDLVKKSPVWSSIIVVVIINFLLILFRMPEMVLGNLDFLVGLFLIVLGSVFIVGSGHLFTGWRFHIRKKSDLEAENDPKHPKAKDVGSIKNQPIKVNKYARYCLGVGGFLIVLGVILTSLPQ

SEQ ID NO: 5859 - protein, 326 aa, Lactobacillus buchneri
MAQQYFDSKLKIFALNSNRPLAEKIAETVGVPLGKTSVDRFSDGEIRINIDESIRGDNIFIIQSTSAPVNDNLMELLIMVDALRRASAGTINVVIPYYGYARQDRKARSREPITAKLVANMLQTDGVDRVVALDLHAAQIQGFFDIPVDHLMGAPLLADHFIKQGFGSDDVVVSPDHGGVSRARALAEFLKAPIAIIDKRRPRANVAEIMNIIGDVKGKRCLMIDDMIDTAGTITLGAQALMDAGASEVYACCTHPVLSGPAIQRIQDSAIKQLVVTDTIQLPKEKQIDKIEQVSVGPLIGDAIKRINENKPVSPLFNNRFRGEEN

SEQ ID NO: 5860 - protein, 458 aa, Lactobacillus buchneri
MATKNTIILAAGKGTRMKSKLYKVLHRLCGKTMVDHVLTAVEKADMDNVVTVVGFGADAVRENLGKRTQYVVQEKQLGTGHAVLQAEKLLGNLDGMTMVVSGDTPLLTTKTFEDLFTYHQNKKAKATILTSQAPDPTGYGRIVRNDLGIVEKIVEQKDATREEQAIDEINTGVYVFDNQALFEALHKLTNDNAQGEYYLTDVIEILKSEGETIAAYKMDDFDESMGVNDRIALARATKIMRTRINRQHMMDGISMIDPERTYIDADVKIGSDTIIEPGVQLKGHTVIGNDCYIGANSEIRDSVLHDHVTVTSSLIEESEMMDHSDIGPNSHLRPEAKIGKHVHLGNFVEIKKSSIDEGTKVGHLTYVGNAKLGKNINVGCGVIFANYDGAHKHETTVGDDSFIGSNSNLIAPLEVADHSFIAAGSTINKTVNQYDMAIARARQTNKAGYFKKLPYQKD

SEQ ID NO: 5861 - protein, 272 aa, Lactobacillus buchneri
LKVRRSDRLIDMTRYLLERPHTLVPLTFFADRYDSAKSSISEDLTILKRTFQNRGTGLLETIPGAAGGTRFLPYILKEEAQEVVNKLIAEMSSDTRYLPGGYVYMSDLLGSPATLREIGRIFATQYLNQNVDAVMTIATKGVPIAQSVADFLNVPFVIVRHDTEITEGSTVNVNYVSGSSTRIEKMSLSKRSLKPDSNVLIVDDYMRGGGTVGGMISMVEEFDANLIGVGVVAESTAPNGRTIGDYTSLMRVDAENNTVVSQPGNYIEKIFN

SEQ ID NO: 5862 - protein, 267 aa, Lactobacillus buchneri
MFSFEFMRNAYLAGTLIAIVSGIMGVFVVARNMPFMTHTLSEIGFAGAAFGIFIGWTPLNGMLAFTTVSSILVGELSGAVESRRESVISAISGLFIGLGILFLSLSNKNSSYATNILFGSVIGISHQEVVQMAALSVLVLVVLFFIFRNLKDDSFDAVGAKTNHIHSSLISIIFLVLLAFSVSVAAQIVGSLLIFVLLTLPAASSKYFAHTVIQMMLLAIGFAIFGVWFGLYLGYVTNWPVTFFIASIEAAIYGLALIYNSIANKSR

SEQ ID NO: 5863 - protein, 227 aa, Lactobacillus buchneri
LSETLISVEDLSLSFPNHQVLSDLTFAVHRGEFLGVIGENGVGKTTLVRVILNQLKPSAGRIKLKAGLKIGYVPQFRNVDVEYPLSIEDFISLNFTGIKLPWLSRKEKQKIQTVIKQVNLEHISKRPLGLASGGEKQKAYLAQALINDPDLLILDESTASLDPNTKRELLDVVKRLNQTLGLTIIFVSHDMQVIHEYPDHFLWLTKNGYTAGPISELHNDSKEGEYV

SEQ ID NO: 5864 - protein, 290 aa, Lactobacillus buchneri
VKRIVRAPAKLNLGLDAPFVHPDGSIEWRMVMTSIGLSDHIQIETKSSHSAIRIFSDSSFLPNDRRNLAYQAARLFFDKVGFKVGLEISIEKNIPVAAGLGGGSSDAAAVLRALNEMFETGLSFEELAQIGVQVDSDVPYCVYSRTALVSGRGEIVTPLTKLPKMWFVLAKPHVSVSTPKILKQLATTSVSHPPIDELLAGIENQDYDRIVANIGNSLEEITTAGHPQIKTLKSRLIEYGADGSQMSGSGPTVFGICRTESRARRVYNSISGFCNEAYISQPECDSHPVI

SEQ ID NO: 5865 - protein, 82 aa, Lactobacillus buchneri
MPVTLSVIKHKMDDHIGQHVLVTSQIGRRKTTKRRGILRETFPAVFVVELDPGNANFERVSYSYTDILTKNIEVDFDASQAV

SEQ ID NO: 5866 - protein, 296 aa, Lactobacillus buchneri
MTEYPQIASPTRTQAILNRYHLSAKKSLGQNFLVDLGVLDNIVAAAKITKADNVIEIGPGIGGLTEQLAKAANKVVAFEIDANLLPVLDETLAPYDNIEIINQDILKANLPKIIDDVFDTEKPLKVVANLPYYITTPIVMDLITGETQFDAIVVMMQKEVAERLNAEPSTKPYGSLSVIVQELNQVEISFVVPKTAFIPQPKVDSAIVKLTPRVKRAVEPFDQKAFISFVRGCFMHQRKTLWNNLQGIFGKTPEVKANIKEVLASVNIDAGVRPENLTVDQFVTLANAFHTLKNLI

SEQ ID NO: 5867 - protein, 188 aa, Lactobacillus buchneri
MKKIKEVIVVEGKDDTKRVQRAVDADTIETRGSAIPEETLDLIKKVAQTRGIIVFTDPDFSGEKIRKTISAEVPNAKHAFITKKQGVPNRSDGSLGVEHASVESIREALSQVYTEDESAGELISKAELMKYGLMGNPSAKKRRERLGEILRIGYVNGKQLQHRLRMFGIKHDEFLAAVEQINQEEAHD

SEQ ID NO: 5868 - protein, 258 aa, Lactobacillus buchneri
MKIFDSHTHLNDEHLYPEAAKYFKHAQNLGVVKLANVGSNQQLNDRSLELAAQYPDMYSIIGWHPEDSIHYHEQQEQLLIEQLQSQKVVAVGEIGLDYHQTTSPRDVQKRVFKRQIDIAKQLHLPISVHNRDAFEDTYAILKEMDVSDIRGVMHSFNGDPEWLKKFLDLGMLVSYSGVASFKKTHEVHDAVRQTPFDSMLVETDAPYLSPEPLRGKQNEPAYSLYTVEALARICDVNPDVIAAHTYENTLRLFGIEES

SEQ ID NO: 5869 - protein, 675 aa, Lactobacillus buchneri
MAESKPTFYITTPIYYPSGKLHIGNSYTTIACDAEARFKRAMGYDVFFLTGTDEHGLKIEQKAEQLGMSPKDYVDQMAASIKQLWKKLEISNTKFIRTTDDYHEKAVADIFQKLLDNGDIYLGEYTGWYSVSDEEYFTESQLAEVYRDKNGKVTGGKAPSGHEVQLVHEQSYFFKMSKYADWLLQYYKDNPDFIQPATRMNEMIKNFIEPGLEDLAVSRTTFTWGVPVKSDPKHVVYVWIDALTNYITALGYDGKDDSNFKKYWPANVQMVGKEIVRFHTIYWPIILHALGLPLPKTVYGHGWLLMKDGKMSKSKGNVIYPETLVDRYGLDALRYYLLRAMPYANDGLFTPEDFIDRLNFDLANDLGNLLNRTVSMINKYDGGILPAYQAGVNEADKELEETAATVIAHYKQLMNDLHFSDALAETWKLVSQTNKYIDQTEPWNLAKNPDDKDKLDAVMAHLAAGLRVIAELISPVMTHAPKEIFAQLGITEDIDLEDLKFEDVPAGVKAVAKGTPIFPRVEVDDEVDYIKQQMTKTDKAKGRAAMKEAAEADFNPEETNLNLTKKEVRFEAFEKIELKVAEIKDVNKVEGADKLLQFRLDAGDDGDRQILSGIAEWYPDYKQLIGKKVIIVSNLKPRKMRGQVSQGMLLSVEHKDGNVELVTVGSHLENGVTLE

SEQ ID NO: 5870 - protein, 282 aa, Lactobacillus buchneri
LITIGLTTFSEHPSLIDGAKRKVRLTEYSGYFPVVELDTPFYAIPKIEVVTNWQKQVPDNFQFILKANRVMTMHDQGSADPVDNEQRFVAFNEYKRAVAPLMDTGQLKAILFQFPPYFARKIATIQYLRRISQLMAGYPVAVEFRNSTWYGDEITDDVAGYLSELGMTLVAVDEPHTTNAGVPFEPLVTTENLALLRLHGRNVKGWTEQSADWRGKRTLYRYSEEELAAFRKVVLDLDKQAKEVCVIFNNNSGGDAADNALQLKKMLGIEFGGLSPVQMDLF

SEQ ID NO: 5871 - protein, 238 aa, Lactobacillus buchneri
MIDSKLQAEFDNAKRIVFLTGAGVSTASGIPDYRSKNGLYTNDKSDKPAEYYLSTDCLRDEPKVFWEYEKSNMYYPDAKPNVIHERQAEFTQKRNAVVVTQNIDSLYRKANTQHLVEFHGNLYKVYCQKCHKTVNYQDYLKSMYHENCGGILRPDIVLYGEGLDPVAISKSVEAVSQADLIVIVGTSMRVYPFAGLIDYRSQNAKVLAVNEEPLQFGFPFTMVKENAVDFFKDLTVNV

SEQ ID NO: 5872 - protein, 327 aa, Lactobacillus buchneri
MENMMDNNIDIELNKDVHGLIDAVNNFFPGTVTVTFIGKLQSGYVRHDQAQTVQDGKNIIVQIADLSAPDYTASHELLHLLMVLRGFPQVFYSLTTGDDTLDEQLKMMGTELYDIVSHFVVVSEQRKHNLINDDIEEMYLKGVYATIKPEPDPLDDQMMLRLTTLLDALVFYGEGIDKVADKFKQDFPVSFEAAQKLYQVITDKPTDSPFGLRRNVVKLFKAFDEQLKDWELPALHNTEFTTLTSVLSERQLGLKVKQLFEIYHSDLTEVTSNTKGYVGFNRVDDQNSFVLANPKGNQDDPEFFKGVYDKSAKQLFDDLKMPYIVRK

SEQ ID NO: 5873 - protein, 430 aa, Lactobacillus buchneri
LYQLFVPLTDDGDIMENKWDHFYKKSYEQRLSLIAEAANLSKAQLDLLGRSLNPRSGELIENNLTDYPLPEGIAVGLVVNGHEHLVPMVTEEPSVIAAASNGAKLLSAGAGIHCSVPDNLVSGQVIVKDADPHQVTKFVHDYQQQLIQIADQSHPSVLKYGGGAKGLDVRILSKQFLSVDLLVDTGEAMGANIINTMLEAVSNWLSEQLTVETTMAILTNFADKAIVEVSGKVAMAKLGTKSLSGPQVAQKIADASQIAQLDIRRATTHNKGIMNGVDAAVMAFGNDWRAVESAAHAFAARSGSYQGLSTWEIDEDQLVGRMSLPVPIGFVGGASKVLPLAGINKQIAQIDNSREEMQVVAALGLAQNLAALKALVTDGIQKGHMNLQLRSLALSNGTTMQELPVVVQKLQGMDHPSSQTVKEILKILRR

SEQ ID NO: 5874 - protein, 310 aa, Lactobacillus buchneri
MENLVILDIGSNSVRMAINQISDDGSYREIKRIKSDSRLSEGMGRGKILQPAAMERTIKSLLDFKQIYSQYEAKRVIGIATAAVRQAKNQAKFLKAVSERIGISLQVLSGNQEAYYDYLGVINRLGIRNCLILDIGGASCELIRVNEGKSSNLTSIPIGAVNITERYHLNDNITGANLFNAQFNIRKIYSRIDWLNRAAHQPLVLLGGANRTLARINRRRQNMVRIDAIHGYHLTAEQVNRTYLNLLKGNVNRRRKIQGLEHDRADIIVGGLLPLIVLMDKIDAKKVLFSESGVREGIITEYIQKEYGIE

SEQ ID NO: 5875 - protein, 338 aa, Lactobacillus buchneri
MTKKIILTGDRPTGKLHIGHYVGSLKNRVELQNSGDYETFIMIADMQALTDNARDPEKIRHSLIQVALDYLAVGIDPQKSTILVQSQIPALPELTQHYSNLVTVSRLNRNPTVKNEIKQKKFGQSVPVGFAMYPISQAADITAFKATTVPVGDDQEPMLEQTREIVRTFNSVYNDDILVEPEGYFPPKGMGRIPGLDGNAKMSKSLGNAIYLADDEDTIQKKVMSMYTDPNHIHVEDPGQVEGNTVFTYLDIFDPDKRKVQELKDQYSHGGLGDVKIKRYLNDVLQAELKPIRERRQRYAEDEQGVYQILKKGSEHANEVANQTLKEVRDAIGINYFD

SEQ ID NO: 5876 - protein, 315 aa, Lactobacillus buchneri
MKILDLFNLTTEQQAKLTALGDVQVIEPADLNSSNVKSVDAIYGWNQQARTVLSESPKLKFVQSNSAGVDYMPLNDFADKGITLANVSGIHAEPISEMVIAYVLAFARGIVTTQAARRDQKWLGDQVRMQNYTIKNRTAVIFGTGHIGRAIAEKLQAFGTKTVGVSRHGKPTAHFDQVVGDDQGVVQAAKADIVINIMPLTPATHHFFDQAFFDQMRNQPIFINVGRGPSVDTEALIAALDQHQLAGAGLDVFESEPLPSDSPLWGMDNVILTPHISGGFQEYGDEAFDILYQNLTSFIQTGKVAVNKVDLSAGY

SEQ ID NO: 5877 - protein, 769 aa, Lactobacillus buchneri
LENNEKQIEQSRVDKVVTKIDQKIISTDDELNRAHAETKKVQQTYSDNTSVNYFEVDDRIETSAELQQQRGLVSRLTENESILKNQLSTLKDLKKSPYFGRIDIQDDDEDQTEKLYIGIASFENEDGEFLVYDWRAPISSVYYNGTLGEVAYDTPMGRQQTNLKKKRQFQIVDGQIRNMFDTNETVGDEMLQSALGEQNDEYMQNIVATIQHEQNDIIRDTTSNLLVVQGVAGSGKTSAILQRIAFLLYHSRDTLEADQIILFSPNKLFSHYISEVLPSLGERNMRQVTFDEFIDNRLKGLNVQSLFERYETDGDLTEQQRLVRGFKESAKFMDELQEYCDKLQPAQIFFSDIIFNESTFFSKQEIQDIFDSFPKAAKVYDRFLHTKNELIKRLKRRIDDETKADWVNDEIDQMSNEKYHDLLAGKELGEFQNEDAERFFIARKIVSARLRVVYDAIFNDNFFDAYLQYADFLKKVDLPQNIETPQWLQSVDEFNHSIEFHAIKLDDCAPLLYMRDYMSNSGQNNTMKYLFVDEMQDYSVAQLKYLRYAFPKTKWTLLGDSEQALFKDVEQPKEILDKLNAAFHVRRSRLISLMRSYRSTLPITNFAKSILPNGDDIEAFTRPGDIPELVLTSDFNDGINQLQKVIADQRKQYATVAVLTKNMTEAQQVYERLHALGDVTLLQDADRTLPKGILVLPIYLAKGLEFDSVIAWDTSEKNYSDESLLGTLYTIITRAMHHLTLISLGDVTPLISDESLTDRKIKIEKKIRK

SEQ ID NO: 5878 - protein, 442 aa, Lactobacillus buchneri
MTKQYDVVILGGGVAGGSLAHSLRRQHKTVAVVEDNLFGGTCPNRGCDPKKILLSGLEITQVVNDMQGNGISGSVSVNWPDLMRHKRQYTNPISDATNNGLISDGVDTYHEHAQFNSDGLLTAGNQSLSGDQYVIATGQRPRILDIPGSQFFKTSTDFLNLDDLPNDVTFVGGGYIGFELAGIARAAGATVHLIHHNNRPLKQFDQQLVHEEIDRLTTLGVDFHLDTDVQEITQVGEQFVLSGDNFKLPTDMVFCTAGRIPNVDTIGIQNVGVKTDQHGVIVDDHLQTSNPQIFAMGDVVSTKRPKLTPVAGFEAGYLAGYFNGSTDPIQFKSIPTIVFGQPSLGQVGLPSSIATHDSRYMLITNDMTKWYSYHRLNEPLAKAKVVINRDTETVVGATVLSNHADYLINILTMMIDQHMKIGDFNREILAYPTLASDVQYLI

SEQ ID NO: 5879 - protein, 325 aa, Lactobacillus buchneri
MVHALWRQFPRINLKLIALEPYLLNAVNLPNQPIHHKISQLLKSGGKFLRPGFFYIYSEFGQEVDPAKIKAGAAAVELLHVATLIHDDVIDESPIRRGIETIHTEYGQKNAIYAGDYLFTCYFTQVLKSTQDPANMKRHVDAMQTILAGELDQMKYNFNQQMTEADYFHEITGKTAELFRLCFQQSALVSQASDQIFKLGGEIGLTIGQAYQILDDILDYSGDPHQTKKPVLEDLKSGVYTLPLIFALQTAQKQLKPLLDKREQLTHEDIAQIQAIVVQSGGLQQAIKSANQLTAKAEKLIAQLPEQRAKRDLQTLTQLLLTRKQ

SEQ ID NO: 5880 - protein, 580 aa, Lactobacillus buchneri
MKNFRKTFENDTWVMPYLRKYKGLLILVLFLGFMTFFSGGALMFNSGYLISEAARQPSSIIYIYVPVVLARAFGIARPVFRYVERLTSHNWVLRIVSDFRKKLYQTVEQKASAIQRSHQTGDILSILADDIDHIENLYLRTVFPMVIGWLLYIFVVIGVGSLNWVVGLLMLLLLGIITIVMPLASVATNGVREFKQHQIQHEFYTNLTDEVLGLGDWLISGRYNDFINLQKKPIKAIAALRKRDHYFQWWRSFLVQFVILLTTLVLLVWSANQFTASKSLANWVAAFALAIFPAVSPFVNMSQGASEWPVYKRSIERVNALDSGTVKPVKQTALAEPFKELSINDLTFKYADGDRDVVQHISMTIHPGEKVALLGPSGTGKSTFLKLVVGDLTPSDGQVLINQQNILSLQDVRSSLFGILDQQPYLFDTTVMNNVRLGNVNASDQQVKDAIAAVGLKELIESLPDQYDTQVQEAGKRFSGGERQRLSLARILLQDAPIIILDEPTVSLDPITEKKLLDKVFELLHDKTIIWVTHHLAGIAHVDQVRFMENGQFDMQGTPQELYKAQPRFRQLYDLDRGRV

SEQ ID NO: 5881 - protein, 576 aa, Lactobacillus buchneri
LIDKRLFDLPGMKKYAVILGILVFIQAIAIIAQARALSIAIVNLWNLQSINTIIWPTVVFTVAFLGRHLLTVAENHVLFPFVEKTSGDMREDLMAKIFRLGPAEIDKRGTGNIVTMALEGIDQVQTYLMLVVIKILDMSITPWLILLYVLFLRWEQAIFLFAIFPIIILFMIILGLAAQSKADRQYESYQRLSNHFVDTLRGLPTLKQLGLSKRYADNVYEVSESYRTETMSTLRIALTSTFALDFFTTLSIAVVAVFLGFDLMDGKVMLLPALTILVLAPEYFLPIRNFANDYHATLNGKNAMSAVLDVLHEPEMSQREVLPDLKWNNDSTLKLNQASLTYPGSKEPTLKDISIDIKGMQKIGIIGASGSGKSTLINLIGGFLSPDGQNQISINGQPLPHLNQANWQKNFLYIPQNPYLFHATLADNISFYVADATEAAISNAADKAGLTDWINTLPDGLNTMIGEGARTVSGGQAQRIALARAFLDPNRKVLLFDEPTAHLDIETEAGLKQDILPVFNDHLVFFATHRLHWIGEMDYVLVMDHGRLVEQGTPDQLAQRNGDYVKLRSEMEAADL

SEQ ID NO: 5882 - protein, 337 aa, Lactobacillus buchneri
MTSYQFIWFLLIGVLFSGFFFLEGFDFGIGMSVRFFAKNRAERDTVIQTIGPHWDGNEVWLITAGGAMFASFPMWYASLFSGYYLVLFLILVALIFRGVSFEFRANMQTDTWRNFWEWASSIGSFCAAFLFGMMFTSMIQGVPIDKNGDIFGSFTTYVNWFSIVGGVAVSLLCFIHGLNFLRLKTSGELRERAEKWSKVLYPVLLAGEVVFVILLYLTTDFFTRKPMSTWGILIALVIFTLAAWWGAQSSHDWTSFIASGLSLISVVVLIFNGLFPRVMIATNNANSILIKNASSSPYTLHLMTILTFTILPIVLIYFIWSYWVFYKRIKSPKQVAE

SEQ ID NO: 5883 - protein, 484 aa, Lactobacillus buchneri
MLNIGVTMLGLSRFQFAMTTVFHFFFVPFSIGLAFIVAIMETCYVVTKDETYKNMTKFWGKIFLYSFAVGVVTGIIQEFQFGMNWSDYSRFMGDIFGAPLAIEALAAFFLESTFIGLWMFTWDRFNKVVHCLFIWLTAFGSTLSALWILAANSFMQNPVGYAMNVAQHKVEMTSFSAVIMNRQLWNEFPHVIFGAFLTAAFVVAGCSAWRLLKKDHEHFYRKSMKVSLIIGLCACLGSVWSGDTQTRYLINNQPMKFAAMEGIYKDSTNKGDWALASGFKGHDKTWSIEIPYVLNILGHHSLNGTFKGQQTVNKELKAKYNKNDQTKNYYVPTRTLFWSFRIMAISAGLFGLVAIIGLWFNRKKSQSIMRQRWFLYLMGLMVWLPFIVNTCGWFVTEFGRYPWVVYGLLTIADAVSPTSTVASLMFTNIVYFLIFASLGAVMIILSHRVLKQGPDSVQTDGYSSEPQAADQKVDPYEMGAAHND

SEQ ID NO: 5884 - protein, 567 aa, Lactobacillus buchneri
NADHDEHYDRGENASELIKEPRTEINMTKNIVVIGAGFAGVYATKQLAKRFKSNSDVQITLIDRHSYFTYLTRLHEVATERVDPSSIQYDLQRIFHKQKNVQLVTDNVTSVDKDKKIVNGEHGTYPFDSLLISMGGEPNDFGTPGVKENGFTLWSMEDALRLRAHIREIIGRGAVERDPDKRRAMLTIVVCGSGFTGAETIGELIDYKKVLARDYKLDPDEIHILLVEAAPTIINMLDRTNAAHAENYIKDHDVEVRPSSMITSVNPDSVDIKDQDSIPTNTLIWTAGVKTNHVADSFGIDAGRGGRLITNQYLQAKGFEDKSIYVAGDDSNATEQGAERAVPQTAQEAENEAVVSSANIAADIEGNHNYTEFHDKNMGFTVSFGARYGIAQVFGGKRVRGWLATIMKHGTNLLYFMRIHSGYFMMQYILQEFFRVDNNRTVLPGITARQGNALWSVPLRMFLGIVLMVDAFSYNAIIPVGFGLTAIEGIIGCLLFFGLFTWIASLALIVIFFMGIASWPHAWIVFAAIALMNGSGRSIGLDYWFVPWLQKTWGRSRYGIPKSLYKK

SEQ ID NO: 5885 - protein, 258 aa, Lactobacillus buchneri
MDLNQVSYHYPQQPTLLNEISATIPVGHILSIIGPNGAGKSTLLKLMAGILQPSGGEVDLDGQPISSIPRKQLATKVAVVSQQNDIFDDMKVIDVVKTGRLAHHSLLATISDAEVAKYIQATHLTSLAQRPLSSLSGGQRQRVWLASALAQDPTYLLLDEPTTYLDIHYQAELMGILKQLNEQKHITIIMVIHDINQAFKISDVLWLVKRGEVVKVGKPEECYDRELLANIFETNIQIVDVPHYGKYIVEIPETQAES

SEQ ID NO: 5886 - protein, 321 aa, Lactobacillus buchneri
LTKSEKIWYSTILVMLVITILFAMMLGASFITPQQMMTAFQGGNPNQLDILINIRFPRILSTMLCGGMLAVAGAASQAAFRNVLADPSILGVTSASDFFILIGTMLLPAFPASKFIFSILGGLFALLLLTRGPALKSPYRLIIIGVAMMLTFTGFEQLFANGFGGQTTGSFNGITWSQTEVLLFLGVSGMFAAVVISPWANYLKLSTEQLQTKGVSASMMRLALLLVVVYLSSGVSSVVGTVPFMGIVVPNVVRYLVGRDYQTIIPLSMLMGAWLLLVVDTIGRIVVLPSELSAAVIMTVIGGPFLILMLQRKNFNGLKSS

SEQ ID NO: 5887 - protein, 301 aa, Lactobacillus buchneri
MKGSRKIALIVLSLVLVVGVLGGIFMSRIGAANHQKKARIVATTFAVVQIADKLDLPLVGVPTTQNKIPARYAHAARVGNPMNPSVEKIASLKPTVVYSVTTLQDQFGKAFKERHITPHFLNLTSVAKLKQTVTAMGKQYQRKAQAKHAVDQIDQAEQHVKLVAKRHATKPRVLVLMGLPGASYMIATNQSYVGDLVAISGGHNVFSSKTQEFVSPNDEAIKKAQPQVILRLAHALPNIVIPQFNSEFKSDPMWKTLPAVKNHRVYDLEEPNFDATANMRAAKALQIVSNWLYPQEGSQTN

SEQ ID NO: 5888 - protein, 270 aa, Lactobacillus buchneri
MELSNRSKWLLGLFVAIGLFIVSIIPASAQTIAYHPLRYGTNQTSMADGYFVKPANVVVKNHLYYVTMEIKTAKSLSSFPVKVNWVNGKAPLNVRRVKDRAGDSLLYYSFYANNLKKRINAKLAIDVPKVYKAHHLISFKFSTAGLPSLGRTHAAAATPKTATSTTKPKAATSPSTKAKQTNSRPKANAPKKTKKAAKTASSTKTKQPKAKQSSAKKASSQPSKASSNLTKPAKKTSDKPQAKKSGVPWIVGGVTVIAGLSAGLWIYFKH

SEQ ID NO: 5889 - protein, 396 aa, Lactobacillus buchneri
MKKRFVHFIQFVFVAIIFAFVGGAFSSNAKADSVNLSDASYTVPITLLKSGSSSQSIANHFFDQTAQVTVSKGTYTTVITTNGANYIASMTMGDQTALPIVTSGNNGTLTFNLTNPSSTMPVSFTLHNIPILGQMQESADFSFDWADAVKVPGSDAATTTTSDSSTTTEPAATSSSATTPAATSSSATTPTTTTTSTVTTKKKTTAKAKVPTTTRKYVVLKGDSNSRSIANQYYTRTAVIKKIAKHYNVQLKVAYKKNLKLGSKAVRPVTINGRKVKSSVVSYGQTTNYYTMTYSFNVSSFKTLKKVIKGSIHVVVPQAQINTTWPIRFKFSQKAPAKASKHVAVVPTATSAKLSTSSQTKLPQTGDASQNSLSMLGLALVSGLSFVWGSNHGIVK

SEQ ID NO: 5890 - protein, 257 aa, Lactobacillus buchneri
MAEKVALVTGGGQGIGEAIATRLHEDGFKVAVADLNIDNANKVAAKLSPDGSQAIGVKVDVADRDSVFSAVNETVDKLGGFDVIVNNAGLGPTTPLDTITPDQFRLVYGVNVGGVLWGAQAAHQAFKKLGHGGKIINATSQAGVVGNPNLALYSGTKFAVRGITQVLARDLAEEGITANAYAPGIVKTPMMLDIAHQVGKNAGKDDEWGMQQFAKDIALKRLSEPEDVAAAVSFLAGKDSNYITGQTIIVDGGMQFH

SEQ ID NO: 5891 - protein, 121 aa, Lactobacillus buchneri
MASTHHIETVINGHHVNKNHYFSPKSYQWRVRHHKTMGKKNLAIGQLAWVEVTGQVKPVLVIITGIHKLTEAADRQVARQLKTVKTITTNSVKDLDAITQNNFEQYLATHPQGDPFYQPQQ

SEQ ID NO: 5892 - protein, 98 aa, Lactobacillus buchneri
MPKGTVICDRLKLIKLPYYAHGLAKKTVSNTRENIFIAIATVAFLLIGLIFGYIYMASGMFVHEASILVVILNAMRLINFQTKFDKHQPTKTIQAATA

SEQ ID NO: 5893 - protein, 106 aa, Lactobacillus buchneri
MIKEIHDQDFAKETDTGIAVIDFRADWCPPCRMMDPILKSLSEDPAYKDQVNFVSLNIDHDQATASQFQVQGIPTFLIKKDGQVVSHMVGARPKPDFEAELKKALA

SEQ ID NO: 5894 - protein, 89 aa, Lactobacillus buchneri
MATTEEYVTSKQIKTRLKRSAGQLDGVLRMMDENRPCEDVLVQLSAVKSSIDKAMKLVIARNINNCVDAMTTADVQNLEHSLDLLLKTK

SEQ ID NO: 5895 - protein, 37 aa, Lactobacillus buchneri
MNFFHDIVSQKSVICDFDSYSDQLWLLSPGLMVAWKA

SEQ ID NO: 5896 - protein, 83 aa, Lactobacillus buchneri
LSSITYSERIKIETFCELGLSNLQMGVRLNRSPSTISYELSRCQPYQAELAQTDAEYKRSRCGRKTKLSDILTKNFRIMIRKI

SEQ ID NO: 5897 - protein, 99 aa, Lactobacillus buchneri
MQHFSHHYQSDISRQQFDLIRQDLEASRKRTHPKHIDPYDIFCAMLYVLKNGCTWRDLPADFPKWSTVYYYWMNWSKAPTPDKPALLTQVLKKLSLIDD

SEQ ID NO: 5898 - protein, 263 aa, Lactobacillus buchneri
MEIITFSAIKGGVGKTTLAFNYGEWLAKNGKHVLFIDLDHQSNLTQTYNIYDNQDTVGNIFLDRGKVKIHEISAYISIIAGDMHLDDIERTIENKTNKNMFLYMWLSDNYERLNLGKFEYIILDCHPDFSTATKNAVIISNAILSPITPSEHGYNAKFNLEERINELRKEAIDYSTRKSYVTTKLFFIANMIKHNTRSSRELLKALKGDPSVLATVPEKELFNRSTLDKKSLSKMAEDHKTYIDQHEFFDSMDKTFNEITEKL

SEQ ID NO: 5899 - protein, 79 aa, Lactobacillus buchneri
MAFDPENKNIKKALQKNETEQPTDTKDKLVIPVFKDEEERTKNYTFSLQPSARKRLDGLAKEHNFKSASKFLNELIKNM

SEQ ID NO: 5900 - protein, 67 aa, Lactobacillus buchneri
MPVVGELIQFQFGCFTVGGPMNLFKVTDHGLAVFYANFVHQIPPNMNQATLSFGFREMPIQAFIQTN

SEQ ID NO: 5901 - protein, 234 aa, Lactobacillus buchneri
MHLHKIFYALRHFIYTRFLTLPLLGTGFATSISKVINKVNGFRFHTLTEDAYEELYIISRGGDVRFVPDTYVVNENYSQIKQAGRGMLRWSRGTVQCMLYFLNYAFSHCVISPSFKSFHILCRISSLSKMMQLIIIWGFWVWNYIFGAAFNLRVSWLIYPMWFQHAMLILSIIMTLNMVVFENFYLLYPSYGLWKTCYLIANAYVFQIFYNCINLWALVTFWKNKWVVSTHGGK

SEQ ID NO: 5902 - protein, 102 aa, Lactobacillus buchneri; identical to SEQ ID NO: 5124

SEQ ID NO: 5903 - protein, 296 aa, Lactobacillus buchneri
LVQEKHNKLLSAIISIGLLSFLGIVVETALNITFPQLTTYFSIPISQVQWLTTGYMLVSTSLIPLGSFFLRRFRVVTLFRVSCLSFLVGTLIASFSNSFNLVLLGRLCQGIADGIALPLMFAVILDQVPKKKVGTFMGLGSLVIAFAPAVGPIYGGIIQDTFNWHFLFIILIPIIMVTWLLGELSIEQSSPVHYVPFDVRGGIFLAIFLTTTLMFIVNLTANSSSFKLYLFLLGTAFFSGLLFLLNEKHKSHKLLELILFKNKRFLQLLSAFFLLQFSSLSMSYLIPKKLSKIYDF

SEQ ID NO: 5904 - protein, 167 aa, Lactobacillus buchneri
MNEQIVITFGNEKILTELKAAHPDRDLMMYQALSQPGEFMLLDHSGKDSVFKAPVFYDILSHSGEDKWDGFISFSTLDLNFDQQKVFDARINKLRTNGLPDGMHSIYSLNYHKDISQRIILGTWDDYADFELWKNSSDEFIPKEYRDSPNFYSHEAYYTPAKTKKTQ

SEQ ID NO: 5905 - protein, 246 aa, Lactobacillus buchneri
LKLTVIGFLGGYPDHGDATSSYLLESGDFKLLIDCGSGALLSLEQVVDPLKLNAVILSHYHHDHTADVGVLQYYWQLHEKRYSEPVLPIYGHTLDETNFKGLTWPKSTKGIAYDPSQALTVGPFTITFFKTHHPVPAFAMRIQESSTGKVLVFTADTAYFPELTQFVHDADLLMTDTNFFAEKTGQKWHMTSTESGQLAHDGNVHRLLLTHLPADGDIEQLKAEAQTTAGEAMPILVAKTHLSVDI

SEQ ID NO: 5906 - protein, 132 aa, Lactobacillus buchneri
MTVNLLTTPSCTSCRKAKQWLIDHEVDFVERNIFAKPLSEVELKQILMLSEGGTDDVISTRSFLYDQYKSKMSSMTISQVISLLATHPELIRRPILVDAKRIEFGFNEDEIRCFMPRSTRKCELEKMVKKAL

SEQ ID NO: 5907 - protein, 226 aa, Lactobacillus buchneri
MEMERINENTIRVLIGNDDLDKRGITVLDLLGNHKQIESFFYSILEEVDKDHQFQNNDAVTFQVLPNQNGLELFISKDVDMSDNDMFDAGDSDSDHPEKRDRVSKYIAEHADNNKPQPVSDKKTNDEFGHQKRTVILEFDQLDDFVSLAKALRLENGTSDLYLYEGKYYLKLELFSNDPVDMVVSDEVAIANEYGKKTAVTEEVLNEYGQQLMENSALELSRYYFK

SEQ ID NO: 5908 - protein, 330 aa, Lactobacillus buchneri
MDKKQELISIVLPVYNEEQGIETTINTLENFAANQPQTFEFIFVDDGSTDKSVELISNQQAKHNNIRLVEFSRNFGHQLAITAGIRYTQGEAVVVMDADLQDPPAVIVDMIDKWHEGYDVVYGKRLSRNGESVFKKATAALFYRGLKRITNVNIPLDTGDFRLMDKQVVYQLRQMNEADPFVRGMVSWVGFKQTDVTYERQERIAGTSKYPLRKMIRLAMDGVTSFSSFPLQLANWLGTLSIIFSVGYLVTSLFTTMDTIHFAVFALFLMVGITLLTIGMLGAYLYRVFEASRKRPLYIVSKTVGFRTPQSQNSRQTYYRTTIKGRAYQQ

SEQ ID NO: 5909 - protein, 762 aa, Lactobacillus buchneri
MATNNLSIENTQNRYQRKFRFDWILGVILVLALFLYGWQIWKAGSANAFYTAAIKSMTESFHNFWYGSFDPAGYITVDKPPVALWFMAISAKIFGLHGWSIVLPSVLFGVGSVYLMYRLIQPYFGQNAARLSALALTLTPIVVADSRTNNMDATLVFFLMLALYFLEKAIGSRKIWSLLISFALIGIAFNVKMLQAFMILPAMYLFYWLAANETWKKKITKLTLATVSLLVFTLAYPISVDMTPASSRPYVGGSETNSLLELAFGYNGSERLLGQTTGTGGTFGAGMNSKTTNKKGGGMPGGQAPTGMKQTGKHQTPPGGKQMKGQPNGGKGGPGKMGNGGGGGGAFNIGTAGPFRLFQSALGPEVSWLLPFALFGLIGGLVFFRDRRKRWFSLSKQQKQLILWTSWLIPVYGFFSVASFFHPYYMIMLAPPIAALFGTGVTALVGLFKNSLRTCWKFYLLPIAIVATAALQSWYVYSYYPWLTWVILIAAIGFSIGMAILPRGRAFQALLVGGLISIMAAPTWWSLTPTIAAESAMIPTAGPSLLTSSSNGMPGGGGGMGNSSVNTKLLNYVEKHQGNAKYLFATSDSTTAAPYIIKTGKAVMAMGGFNGTDPAITLSQFKKLVKNGDLKYFYYSGRSGNTKIINWIKKHATKVKTSLYQSSSSNGSQAGMGGPGATTTTKSTKQAKAPNSNQAPTGAPSGKKKPTGKPGTKPSTKSNPKLKSTQKAGQSNSKSTQKQTTMQGPGGMGSSGVLYDLSSIYK

SEQ ID NO: 5910 - protein, 117 aa, Lactobacillus buchneri
VLTYVIYLLLLHPTNATIAMAIGYGITSLLGLALNNRWVFQTGASVKTVAWKYYATYIFTWLISVLFAHFASGWPILDSRLIPIVSLMITVPTNFLLSKFWVFNQHHLKEVRHYGNQ

SEQ ID NO: 5911 - protein, 230 aa, Lactobacillus buchneri
MKDLHILIIEDDEDLAKSLQLFLGEIAQTTVSHDGFEGQMLGQEGIYDLVVLDLMLPQVSGYDILKHWRTEDHLSMPVLILTAKDTLDDKVHGFELGADDYLTKPFHREELLMRVKALLKRSGHLGDDNTLSVGPFKVNLSNRIVEVNGKELALNGKEFDLLVYFIQNPDTIITKDQIFDRLWGFESETAISVVEVYMSNLRKKIKQSSSLQPIKTLRNVGYMFETEESD

SEQ ID NO: 5912 - protein, 436 aa, Lactobacillus buchneri
LKKGDPQQKQQLSLFLKELVGFALLFAVLGLVVFFLFHQSIYKNIDQGLVTQKQNVLSNRKAPQFRTGGNAQNPAPAKPNNGDTPFRTNILVFNKKGQIINAQMLGNRIYNLFINTELDKSQVNKVREVTLMSTDNTLHYFRTLLIKVPKSNSNPIYAGNYVLILENIDTDLMAVNSFKRSLLTTLVFFWIVAIAIAYFLSRSSMKPILDAWKRQRQFSANAAHELRTPLTVIQNQMEYMLTKPKTKVIDQVDPISTSLDEVRHLQTLTNRLLMLARSDSGTIEINKQEVDLKPWFSQILKPYDDIAASQHKSMVTVLKADGKGRLDKDLIRQLLIILLDNAIKYTPAGGTVTVMTALNRDRLTIEVRDTGTGIPDADKKRIFERFYRSDKSRNSKTGGNGLGLAIAKWIVQQHSGTISVKDNYPKGTVFDVLIKL

SEQ ID NO: 5913 - protein, 512 aa, Lactobacillus buchneri
MLKNLLKHIQEERVAEQLYHSLIGIEIEEHRIDDHGRLSRKPYPQNLGSRRYHPYLQSDFSESMSEIITDPNPNIGGVLDQLDTLQTVLYRSIDKSESFWPLSMPPAMDEDDVNYIKGHFGRPAYAKYRDYLTEKYGVARKIITGVHVNFSIPEPVINRLYVHYQDQFSTLVAFKNALYFQLAQNFVLHRWLLTYLFGASPIAEKGFLSAEDQKQLTHPVRSIRNSIYGYVNEPQDQVDATIYTSLDHYIDGINHAIDDHYLYSTAEFYGPVRLRGQDDIKDYRTKGISYLEFRVLDNTPFTPNGISRHAMYFLKFFLMYLLVTPVDHENIAADLKQSFTDNNQVALENPNQPTFKMAEGIQIFDQLIEMAKSLHAHSEQLQALDDFSEVVTHPELTASAMLLKHIKNGSLMDFGTTVAKRWRAQRLGATTLLPSIGKISFDAQRLIFYAIQLGIRYYVVKDEDGESLITLTYDNVTQVVYTDKVGKVEPLEYLHELFPGINKADKQDQSLI

SEQ ID NO: 5914 - protein, 379 aa, Lactobacillus buchneri
MLIAMIDNQLVNAAEFKGQKNLANRLVCPGCRQKVIFKRGKYRIPHFSHKSNRVCGSFSENESQAHLQGKLTFQRQLRAMATEAVLEYYLPTIEQRADVYLPSPKLILEYQCSPISFAELSRRTVNYQSLGIDVVWVLGDRHLNAAKRLDGVAKFARFSSQLGFYIIFYSAKNQQFRIDFQIREVAGKLTSHMRLFKTLAELKRFIDHPPSALQRYSVRATNTAILHQLNRIQRSIVLKNPTYLDMVTRCYQRRKVFVGCPLICHGKEGEGWPIFRRTALCWRVWIVLQLFTGSNREISNQELNQVFKQSVQLFGQQFAQVDDYVRFFQMAFTSFIFSLRAGGYLRHTVAGVQIIKQPVWFADYDEKRQYIMTAKPEVC

SEQ ID NO: 5915 - protein, 603 aa, Lactobacillus buchneri
MPKPQELPLRKDVPEELTWDLTTIYPTDQEFETDYDAVQTGAKQFAELAGTIEKSAASLLTATERLMTLSRKLEKVYVYAQLKNDQDTSEDKYQAMYSRAESLGAQFGAATAWFEPELLKISDDQIKQFYQDEPKLADYRRFFDQTFKRRNHILSNDVEAVLAGAGDIFSSGEKTFGILDNTDLSFPAVTDENGNQVKLSQGVYGILLESTKQSVRKEAFEKLYQVYRQFQHTLAATLTTNVKNHNFKANIRHYNNALEAALADNEVPTDVYNNLIKVVNEHLDLLHRYVALRKKILGLDELHMYDMYTSLVGKKSPKYTFEQSKQIALEALQVMGPDYVSHVKEEFNNRWIDVVENQFKRSGGYSSGTYDTNPYILLNWKDNLDNLYTLIHETGHSMHSYYSHHNQPYQYGDYSIFVAEIASTTNENILTDYLLNKFKDDDEMKKFILNYYLDGFKGTVFRQTQFAEFEQYIHEQDAKGQPLTANFMDDYYRNLNQKYYGDAVISDPQIGLEWSRIPHFYYNFYVYQYSTGFAAASTLADGIVNGGQANVDKYLNYLKSGSSDTPTNVMKKAGVDMTQPEYLEKAFQIFEQRLDEFERLYNK

SEQ ID NO: 5916 - protein, 206 aa, Lactobacillus buchneri
MVLEIYLFVDPLNRHCYDAEKTIERISQKLNKQISVRFVSMLNIKILHDFSKNEQLSHLDHNLPYDTILDFKAASFQGKKFGRRFLMDLQKELLINSVPYSDELVAKLAERNGLDVEMFMADRRSDLAEKMFRCDQRVVHEMEVRDPSTTVLFNSDVADSGIRIKDFDYNSLFGFCAKSLGSAAHFEQASKKPTTVPYPKSNLRFN

SEQ ID NO: 5917 - protein, 217 aa, Lactobacillus buchneri
LVENWDDFLVPYKQAVDELKVKLRGIRAQFLKIDGRSPIEFVTGRVKPVDSIKEKMVRRHISEDRLEEDMEDIAGLRIMCQFVEDIYQVVDLLRKRTDINILEERDYVHNKKPSGYRSYHIIFEYPVQMLDGEKVILAEIQVRTLAMNFWATVEHSLNYKYQGEFPDDLKGRLERSAEAAFHLDEEMSEIRDELQETNKHEPGKDVRKSSDEDSHLQ

SEQ ID NO: 5918 - protein, 270 aa, Lactobacillus buchneri
MKIAIYSNLGESSNIVATSLKKKIEESPDLSIDGLNPEIVISVGGDGTLLSAFHHYQDISDRIRLVGIHTGHLGFYTDWRDYEVAELVDSLEHDNGQSVTYPLLDIRVNYVSGGPADYGLALNESTLKQISGSMVADVYIKDTLFESFRGDGLCVSTPSGSTAYNKSVGGAIINPTLNAIQMAEISSINNRVFRTLGSPLIISPDEWVKIVPKSSNRTILTCDHQIISNEAVESVEYRISKRRIAFAQYRHTQFWRRVSNSFIGKVNLDD

SEQ ID NO: 5919 - protein, 296 aa, Lactobacillus buchneri
MTEFTWKYTGQAPIKVRTFIMSYGITRTLLKKIKYHGGKTLVNGEASLVNRMLQTGDTVKVVLPPEPENDHVSVSNVPIEIVHEDPNFLVVNKPYGVASVPAHNHVDSLVNRVKGYYQRQGYANQKIHIVTRLDKDTSGLVIFAKHHFAHSVLDKQLKDRTIQKTYLAIVADRISTPHFEIYLPIGRADDSFVKRQVVDSGKMSVTEAWTVRRLAKQTLLKVRLHTGRTHQIRVHMAAIGHPLIGDWLYNSDDHSMTRQALHCAELTFYDPFAGRLLHCEARLPEDMQSYINLHKL

SEQ ID NO: 5920 - protein, 282 aa, Lactobacillus buchneri
VKKIDFGQKFMKQNLQLFRCPVCQTPFDEVVGYSLSCPHHHTFDISKKGTLFFLTKQANNEYDKSMLQARHKILQAGLFDPIVDAIATYLGPEPETILDVGCGEGTPLARLLALRDGKDTAIGFDISKDGINLATQQPADAFFCVADLARLPFNDHTISTIIDLFSPSAYDEFNRVAKTGGRLIKIIPNSDYLHELRVALFGTGQKNSSYSNNKVFDLFMTHYSSASIDKLTYEFSIPKGMQQDLLTMTPLHWGKGRQDNALQLVNALKTITVDVSVMVADF

SEQ ID NO: 5921 - protein, 170 aa, Lactobacillus buchneri
MTNHIVLFEPLMPANTGNIARTCAGTDTVLDLIEPLGFSIDDKHLKRAGLDYWDKVQINYHQNLPEFLKSVKNPKNLFLVSKFANQDYTDPDYSDPSQDYYLLFGKETTGLPEPFMRQNPEKAIRIPQDDDNIRALNLSNTCAIVIYEVLRQQNFNNLERTHQYEHDKLK

SEQ ID NO: 5922 - protein, 785 aa, Lactobacillus buchneri
IIIEMKTKRTKRTKQTSSKPVKKRGRPRKTTKKTGGQSSFLQKYTVNVIGGVVAILALLGLFQAGIVGTLMINIAKLFVGSLYPVFLLVGIVVGVFLAGFSRFPKIPAKYTWGTALILLGVLLWLTLIEYIQAAQPVDFINFNWQKLVDDVVSSNSDSNIGGGILATIVFYLAHVLFGKIGTGIVASLIILIGGFILFDISFAKIFMGLRTCLTFIKTRAAAIRQQTDQKRSKKPAKQPSSATAANHPQTVEQPQNDDSEPNKLSASAITISGMPVTDEAKQSRKPVSKPTPPKESEKADDSADVNLVDVKEDDAYKLPTTDLLTQIPQDDQSSELQSIDHNAQVLQKTLDSFGVKAEIKHVSLGPSVTKYELHPDIGVKVSRIVNLADDIALALAAKDIRIEAPIPGKSLIGIEVPNRKIATVSFRDVVEHQPDNHGHVLQVPLGKDVNGNVITADLTKMPHLLIAGSTGSGKSVAINGIITSILLHAKPSQVKLMLIDPKKVELGVYNGIPHLLSPVVSEPKKAARALQKVVSEMENRYELFAKFGQRKISTYNDFVAKNNRENDTKIQPMPYIVVIVDELADLMMTVSNDVEAAIIRLAQMGRAAGIHMILATQRPSVDVITGLIKANVPSRIAFAVSSGIDSRTIIDTNGAEKLLGRGDMLFLPIDSNTPIRVQGAFIPDKDVSRVVKFITDQQSADYDESMMVSDEEIKEEDQEDSEDDLFNDALAFVVDQQKASTSLLQRHFRIGYNRAARLIDDLEKRGYIGPQDGSRPRQVYKEKQE

SEQ ID NO: 5923 - protein, 127 aa, Lactobacillus buchneri
MHISPWMTDTVTFITQFLILFAVAGFLVVLRKNQFFRSKVPIKPLDFWPPILLYFIHEISKKGLSGSFIPEVVIVWLGLTLIVLIWQIFANPNLTYRKFFITFWRFSDLFLFGCWIVVGIYVIFESI

SEQ ID NO: 5924 - protein, 141 aa, Lactobacillus buchneri
MFMGEYQHNIDAKGRIIIPAKFRQDLGDKLVVTRGMDGCLFGYPMSEWEKVEQKIDTLPVNKKDARYFTRFFFSAAVECEFDKQGRINIPATLRDYAKIEKKCVVVGVSNRFEIWSDDRWNDFSHDAEENFNEIAENMIDF

SEQ ID NO: 5925 - protein, 315 aa, Lactobacillus buchneri
MSEFKHVTVLLNEAVKGLNINPDGTYVDATLGGGGHTTKILEQLTNGHLYSFDQDEEAIAYNQQHLAEYIEAGKLTLIHDNFRHLKSALQNVDVSGIDGIVYDLGVSSPQFDEAGRGFSYRFDARLDMRMDQDNPIDAWKIVNEWPYEKLVRIFYRYGEEKFAKSIARRIETVRREHPIDTTNDLVEVIKEGIPAAARRHGGHPAKKVFQAVRIAVNDELSALEDSLEQALDLLNVNGRISVITFQSLEDRLVKTMFKEKTSLPELPPNLPIIPEGIKPKFKSITRKPIVPTEAELEENHRSHSAKLRIIERIKN

SEQ ID NO: 5926 - protein, 124 aa, Lactobacillus buchneri
MAQNNLARNLTEQPQPYVSSPDQAKVKRVSIAKALKLSSFEKLLIVCGSAVLTVLMLVVVSSKIALSNSQHELQHLDNQVVTVRTSNTNLKQQIGELQSSTRLDKIAHKSGMSLSNANIRNVTK

SEQ ID NO: 5927 - protein, 719 aa, Lactobacillus buchneri
MKEPSDRSADKLNARKSRKIVGISLFLAFFLLFAFLGSRLLVIAVGKNVKNVNLNDRAEKLYTQTQTLKAKRGSIYDANGNPIAEDTSTYSLYAVLDKQQKGLNGKPLYVVNKTKTARVLAKYLPITEKKALKILSPKDKQPFQVEFGSAGTNISLLTKKKIEAAKLPGIDFVQKQARLYPNGVFSSNLIGVAVSETNKKTGTANLVGQMGIEKAFNKTLAGQNGFKNAQYDVYGYKLPGKQQKEKPAKNGNNIYTTIDSRIQTLLESEMNSVQSQVHPAGMNAVLMDAKTGKIVAASQRPTFNAATLKGIGSAWTNTLSSDMYEPGSTMKVFTLSSAINSGHYNGTDTYESGRYSIDGKIVPDWNPAGWGYITYNKGFALSSNVAMAHLEQQMGPKTWKKYIKRFGFLKSTNSGLPGELTGRIQFNYPIEQADTSFGQGIEVTTLQMMQALSAVSNNGTMMKPYFISKITNPANNKTIKQYGKQVVGHPITAATAKAVRKHMQDVVYKSYGIGADYKIKGYRVAAKTGTAQVSNGMGGYASGDDSYLYSVAGMVPANNPRYVMFITMKQPKLTGTKTATQLLAEIFKPVITRALQNSNTKQATVKRQVPTVTYQTTTYAKRVMNEKGFNVVTIGSGDSILKQSPSAGTTQAEQKRVFLLTNKDWKMPRIIGWSKADVEKFCSLTGLKLESTGSGYADSQSINFEKSIDTGDVLKVNFE

SEQ ID NO: 5928 - protein, 322 aa, Lactobacillus buchneri
MATMGNWLTPLLSTFVITAIFMPSLIKYFRSRHEGQMIREEGPSWHEKKSGTPTMGGILFIVAIVLSDLAFGGAKGMLNPTLLILLFVLITYGLLGMWDDSIKLFRRQNEGLKAWQKMLGQIVAAVIFSVVYIHEGFPMAIKIPFGGDLRLGYWYILFIVFWLVGFSNAVNLTDGLDGLVAGLGTISFAAYGVIAAVQKQPEVAVFCFSVVGGLLAFFIFNHKPAKIFMGDMGSLALGGALAAVSVLVHHEFSLLIIGIIYVCETASVIIQVGSFKLTGKRVFKMTPIHHHFEMSGWSEWKIDIVFWLIALVASAISVMTIV

SEQ ID NO: 5929 - protein, 459 aa, Lactobacillus buchneri
MKKIDDYNHKKVLVLGAGKSGTHAAELLKELGATVVLSDSKPSSELPEVAELQDSGIQTVTGKQDPAILDDGFDIMVKNPGIPYDNAVVAAAVDHHLPIITEVELASQITDAEIIGVTGSNGKTTTVTMITEILNQERAKGHAYAAGNIGISATETAKKATTDDTIVMELSSFMLLGIKTLHPHVAVLTNIFSNHLDYHKTRENYVNAKMRITMNQTPEDFFVVNFDSDEWRGLSKRSAAKVVPFARTTEIDKGAYEKNGKLYYNDEFIMNAEDIKVPGKQNVENALAAIACAKVLGKSNLAITNVLETFTGVRHRLQFVLEANGRKFYNDSKATDIEATQMALEGFDKPVVLLAGGLDRGYTFDKLIPQFKEHVKAAVLFGETADLLEDSLKKAGIQNIQKVDNIDEAVPAAYSFSDEGDIVLLSPANASWDQFKTFEERGDRYIADVEKLTNKQEGH

SEQ ID NO: 5930 - protein, 363 aa, Lactobacillus buchneri
MRLIISGGGTGGHIYPALAIIEDLLKQEPDSEVLYVGSQRGLESSIVPEQGIKFVALEIQGFKRSLSLENFKTVALFLKSVHESKKIIRDFKPDVVIGTGGYVSGAVVYAAAKAHIPTMIHEQNSAVGLTNKFLSRYVDKIAIGFHEAASQFPKEKVVFAGNPRAQQVANMKSTFKWSDVGLQDGEPTVLIFGGSQGAPAINKAVIGAVSELNKRQYQVVFVTGQKRYQNVMNLLDKTRISSNIKILPYINNMPQVLPKVSLIVGRSGATSIAEITALGIPAVLIPSPYVTADHQTKNTMSLVNRGAALMIKQDDLNPKSLLKAVDQLMHDSTAREKMAENSKQLGVVDSADEILNLARTLIK

SEQ ID NO: 5931 - protein, 235 aa, Lactobacillus buchneri
MWPLVMLITIILLVMIFMISSYSRVKKVTVSGNEIVSDQQIKAFSPVKKGTSLFAVWGKTDKLAQSLKQRSRRMQSVKMKLVNFNQVKIKVEEYPTIGYLFVHGGYQPILKSGVIIKGKVLNPKAGFPVLKKFQNPKKLRRTIKQYRRISPPVRAVMNTISFSPTKSNPDRIFIQMSDGNKVYASISTFGDKMDYYPSISSKLKVKSVINLEVGAYSYPIPKKQTSTKTTSVQGY

SEQ ID NO: 5932 - protein, 434 aa, Lactobacillus buchneri
MDNSGLYVGLDIGTTSIKVIVAEKVKGQLNVIGVGNQPSNGLSRGVIVDIDQAADAIRSAVNQAQEKASIEIKDVIVSVPANMLRIEPCNGLITLDDQSREITEEDVRNVAASALGTSLPQEREIIDIQPEEFIVDGFDGIKDPRGMVGVRLEMRGKLITGSKGIMHNLQKAVNKAGLNIISTVLTPLAESHVVLNDGEQDFGTIIVDLGGGQTTASVIHDHQLKYATTDPEGGTFITKDISIVLNTSMENAEKIKRDYGYADSLQASADNEFPVEVVGQSEPTYIDERYLAEVIEARLSQIFDRIKDRLNQIQALDLPGGIVLTGGVAALPGIAELAADQFNTNVRVYIPDQMGLRHPSFTAALSLVSYFADLADVDMIVRSAVGATLTKAPKLSQPEQTPMPAAGKTKKTKKPTQKKKRGEGIKNFFSDFFD

SEQ ID NO: 5933 - protein, 428 aa, Lactobacillus buchneri
MEYSLDSTDNHGANIKVIGVGGGGSNAVNTMINSDVKGVEFIVANTDVQALATSKAETRIQLGPKLTRGLGAGSNPDVGAKAAEESEEAITEALEGADMIFVTAGMGGGTGNGAAPIVAKIAKDQGALTVGVVTRPFSFEGPRRAKYADEGVAQLKENVDTLIVISNNRLLEMVDKKTPMMDAFKEADNVLRQGVQGISDLITSPGYVNLDFADVKTTMQDQGSALMGVGTANGENRTAEATKKAISSPLLEVSIDGAEQVLLNITGGPDLSLFEAQDASDIVSQAATSDVNIIFGTSIDETLGDEVRVTVIATGIDKKKAEQDRMSTRRTRSARPQPTARPHSDRQAPETNQSQDSSNAKSDPLGNWDIRKQPAPTRPAAQDEFSDVEKKDFDPFQPDVNSDDTRPDTSDDSQDDIPPFFKHRRRGK

SEQ ID NO: 5934 - protein, 114 aa, Lactobacillus buchneri
MPKFNLANFFGMDTDQPENQIDKPADNVVLMNRQEPETSSIVVFEPVNYTDVDTIAQKLLEDSAVIIKLDKLDNNSAARMVDFLNGVLFAIHGSINRLGRNIFICSPKKFQVTE

SEQ ID NO: 5935 - protein, 107 aa, Lactobacillus buchneri
YGGTFAMILYPRTEINLVTFVMYAVWFIDKAINIYMLCIVVYALMSWFPNAYGTAIGRFLARIVEPFESLFNFATIGMISLAPIVALAVLTFVQMGVNYLGQLLIGY

SEQ ID NO: 5936 - protein, 263 aa, Lactobacillus buchneri
LVDSNVSQHYRQAELPFLESIDSLSGRVANEYRPILTDFLNPRQLYILETIVNRYEGVSFQTFGGYPSAELKRAVAFPDYFVPKADDYNITAFQIDYPSKFATLSHGQILGSIMGSGIDRDVIGDIVTDGLNWQFMCESEMADYVQSQVDRIGKIKIKLKQIQPEEIIVPVDEGEELTTTVASLRVDALVSEGFHISRHHAKELIEGGMIRINWEDANRPDLEISIQDIISVRGFGRLVVQDIAGMTKKGKIRIGLKVYNRNK

SEQ ID NO: 5937 - protein, 227 aa, Lactobacillus buchneri
MVLSPQDIHNKEFSTKLRGYNVDEVNDFLDQVIKDYQIVLQENKDLNSQLNEAKDKLSYFNDLKDSLNQSILVAQEAADKVKTNSKKEAEITSREAQKKADDILNAANEKADAVLEEASKRAKKLAIETDDLKKNTRVFRQRLQVMLESQLEVIKGSDWDRLVEEKPTTTYEDIEKVVGSLDNIANPGVQSETKQSNGAADVEETPATVDDSNQTVVIYPDGRTQNE

SEQ ID NO: 5938 - protein, 934 aa, Lactobacillus buchneri
MRVKDTLNLGKTKFKMRGNLPVKEVDRQKAWEDNDVYQQRQKLNEGKPTFVLHDGPPYANGDIHMGHALNKISKDIIVRYKSMTGYRAPYVPGWDTHGLPIEQKLTQAGYDRKKMSTNDFRKLCRDYALKQVDRQKEEFKRLGVSGDWDDPYLTLKPEFEAQEVRVFGAFAKRGLIYKGKKPVYWSWSSESALAEAEVEYHDITSPTAFYGEHVVDGKGVLDDDTYMVVWTTTPWTIPASEGITVDAGFDYSVVQPEGETRKFVIATELVDKVADLIGWTNVKTIKTVKGQDLEGILAEHPFDHSRKLLTMLGDFVDLEEGTGLVHTAPGYGEDDFNIGRQYGLDIFAPVDDKGYLTKESGEDFAGVFYDDANKIALDKLKDAKLLLHYMPLKHSYPFDWRTKKPIIFRATPQWFASVDKIKDEILKSLDDVQFFPDWGKVRLSNMIKNRGDWVISRQRVWGVPLPIFYGEDGEAIITEETVNHVADLFEKYGSDIWFEKDAKDLLPDGFTSEHSPNGKFTKENDIMDVWFDSGSSHQGVLEERKELTYPADMYLEGSDQYRGWFNSSLITSVAVSGKAPYKQVVSQGFTLDGNGHKMSKSLGNTIAPIDVIKKMGAEIVRLWVTSVDTSADVRVSTENFVKVSDSYKKIRNTMRFLLANTSDFDPKENTVAFDDLESQDQYMLVLFNKFLADTRSYMERYDFLDWNKKVVGFITNDLSAFYLDIAKDIVYIDKQDGHKRRSMQTVMYEIAVGLTKLMTPVLPHTTEEIWGFLHEPEEFVQLTDIPEPKKYDHDSEILANWTKFRSYRDDVLKVLEEARDAKKIGKSSEAALTIYATSEVADLMNSLQTDLATVLMVSQLTMKDFADAPDDSTKFDSDGLALSVKPAEGKTCERCRLVRQDVGADSDYPTFCQSCAQIVRDQFPETATEGFEEK

SEQ ID NO: 5939 - protein, 69 aa, Lactobacillus buchneri
LLKGKIKSYNPQNAFGFITQDSGEDDLFFFKNAFPEDQYGTIQVGKPVEYVVVAGQKGPQAAKAHVIED

SEQ ID NO: 5940 - protein, 180 aa, Lactobacillus buchneri
LDFEEKVIGTEKIYDGAIINVEKQTVKLPDGQTSFREIVHHSGAVGILALTHDNKIILEKQWRAPAKKTTIEIPAGKVDGRDANFHDTVIRELNEEIRYVPNTVKELYGFYSSVGFSDEYMKLYLAEGLKPVANQLPRDKGEFLEVFEKTLDEAVAMIADGEIQDAKTITAIQYWQLMQK

SEQ ID NO: 5941 - protein, 109 aa, Lactobacillus buchneri
LAIDDNHKNDGKPLTREQYRKLKLQQEADFEARDKRRVQVEREYARKHQQPVSEATPEPQETTRAHENHPEDDDFKTPRWHRINRKLNWTITILILLMVIVFLVLFFVN

SEQ ID NO: 5942 - protein, 229 aa, Lactobacillus buchneri
MTYGIICAMDEELAILKEALSGEETKHYGNADYYLGTIHGQTLVIVKSGIGKVQAGITTSTLINEFHVDAVINSGSAGGIGDGLAVGDIVVSTETAYHDVDVTTSGYKMGQLPGFPARFKASEELADKIVKAAQQSGVTAHKGLIVSGDQFIADSSKIAQIKHNFPDALCSEMEGAAVGQVAYQNKVPYAVIRAMSDVGDEEAEVSFDKFIITAGKKSGQMLIDLFKNE

SEQ ID NO: 5943 - protein, 122 aa, Lactobacillus buchneri
  misc_feature (113)..(117): Xaa can be any naturally occurring amino acid
MKEIYLDNAATTPVSDEVYTELMDKYKNIYGNASTLYGLGRESKAVMENARDVIAKSINADPDDIVFTSGGSESDNTAITQTAIARKSLGNHIITTAIEHEAVIRPCEALEKXXXXXHDWKQ

SEQ ID NO: 5944 - protein, 231 aa, Lactobacillus buchneri
MPIHEIGEILKDHQAWFHTDAVQAYGLLDIDVQRDHIDMLSTSAHKINGPKMIGFLYRRKGVNFPSLIKGGDQEEKRRAGTENVPAIAGFAKAVQTITPEEKAHRQAKYLKFKYYIADKLKQNGVEFEVNGRITEDNLNHVFNIWLKGISTYVMQTNLDLAGIAVSGGSACTAGSIEPSHVLVAMYGKDSPRISESIRISFGRYNTTEDLDKLVDAITKIVNRVKTKGVKM

SEQ ID NO: 5945 - protein, 114 aa, Lactobacillus buchneri
MAFAKTGKVNGDDTVYELRDNVKRFTLRDLGFIEGKTGVFSLEKSLDPTSPYNANYKFKMKVDKDLSGFRMAITTGNGLEKVNIFKNPDTQPSVEQYQFIINDLIDRDVLKRRV

SEQ ID NO: 5946 - protein, 341 aa, Lactobacillus buchneri
MAKQKLEDLDWTNLGFAYRDLPYSYNEEFKDGKWQNGGLTTDSTLTFNEAAEDLHYGQEVFEGMKAYRTKDGRIQLFRPDMNAKRFTNSAKRLVMEPYPEDKFVEAVKEVVKANADFVPPYGSGGSLYIRPFMVGTEPLVGVSPSSTYTFHIYATPVGAYIKGLHPMPYMVSKYDRAAYAGTGQAKTAGNYAGSLLAAKEAKDNGFAGELYLDPRQHKYVDEFGGANFYAIGKDGKFYTPKSHSILPSITKKSILQIAKDLGLDPSETNIDVNDLDEYTEAGAMGTAAVISPVGSLTNNGKKHVFYSETEPGPITQKLYDTLFGIQSGDVEDKYGWVVPVE

SEQ ID NO: 5947 - protein, 345 aa, Lactobacillus buchneri
MAKAKPATEIDWENLGFDYMDLPYRFLAHYQDGQWDEGQLTEDGTLHISEGSTGLHYGQADFEGLKAYRTKDGSINLFRPDQNAKRMTKSCARLLMPAFPEDKFVAAVKKVVAANADYVPPYGTGGTLYLRPLMIGVGGNIGVHPADEYIFTIFAMPVGAYYKGGLKPTNFTTSYYDRAAPHGTGQSKVGGNYGGSLLPGDQAHKAGYSDVIYLDPATHTKIEEAGSANFFGITADNEFVTPKSDSILPSITKYSLLYLAEHRLGLKAVEGDVFIDDLDRFEEAGAMGTAAVIAPIGGIEYKDNLHVFYSETEVAPITKKLYNELTGIQFGDVEAPEGWIQKVEV

SEQ ID NO: 5948 - protein, 278 aa, Lactobacillus buchneri
VIKREGHSHTEFCPHGSGDDVELMIQKAIKLGFQEYSITEHAPLPDGLADKYAGKTTGLTEASMAATDLDAYFQKANQMKAKYADQIKINIGFEVDFLPDFVDWTRDFLNEYGPQTTDNILSVHFMQGANDKFWCVDDTVGDFQAGLLNQCPDSQVLYEHYFQTVLASVNADLGPYTPNRIGHMTLIKKFQDYFGLDRHFSEDNLRLVDQILKAVSGQHRELDLNAAGLYKPYCNEQYPSYSVIQMAKSLNIPFVYGSDAHSIAEVGQGYNGVISLVE

SEQ ID NO: 5949 - protein, 381 aa, Lactobacillus buchneri
MKNKNLPSGTRDEFGTEAEVKETIQNKLFQGFRRRGFRKLTTPVLEYSDVFQPLNAENYRPYQLLDEQGEPLVLRPDLTLPVARVMSTTGIELPVKWYYGGDVFRVKKQLSGSYNQLTQAGIEIVGYKGLKADWECLEVALAGCRDMAIENVTIELSHAKFVDVLIDQLDLPEPTKAGLKQALFAKDLSKYNQLAQPLAETPFSSFINEWPWLFGNFDEVMKVVDTLPPIEELKGIVNHLKSTAAFIQQLFPKVNVTLDLSIPSPQSYYTGMAFRGFTDKSSGYLFSGGRYDDLLTNFQNVKTSAVGVAFDVDALVERTSFPDDTPTTLIFFEDDQWQEAEAALSKFANATLCLTDDFEDAKRLAASTNSQLIDLTKAGEK

SEQ ID NO: 5950 - protein, 217 aa, Lactobacillus buchneri
MERIKIALTKGRTEDQVVPLLEAAGINCEGIRNKQRRLIFDEDPRYEIILVKGPDVLTYLNSGSVQIGIVGSDILAEQENFQYAMLDLNVGKCRFVLASTKDFNPQAHRRKIIATKYPNITKRYFQGIGEDVEIIKIEGSVELAPLIGLADAIVDIVETGNTLRENNLQVFAKLQPVNTKVVVNRLALRQYQPQIKSLIASLAKADDQLIQSKLIKE

SEQ ID NO: 5951 - protein, 194 aa, Lactobacillus buchneri
MRTATISRNTNETQIELSLNLDDYSKIQIDTGIGFFNHMLDAFARHGRFGLVVKAKGDLDVDPHHTTEDVGIALGLALKQALGDKAGIERFGSALIPLDETLSRVVIDLSGRSYLVFKAEFANDHLGGYDTEVTEDFFQAFAFNAEMNLHAEVLYGRNTHHKIETLFKALGRSLRAAVTINPEIKGIPSTKGVI

SEQ ID NO: 5952 - protein, 208 aa, Lactobacillus buchneri
MITIIDYDTGNTRNVKNALDFLGVSNQLSADPSEILTADGLILPGVGAFKKAMDSLNERGLVPVIQQAADAEIPILGICLGMQILFDKSYEFGESTGLGLIAGEVVPIPENLGVKVPHMGWDQNQSQQTDALGDGFDGQFSYFVHSYYVQTAAENIVSTVDYGVQIPSIVRKDNVIGFQFHPEKSGEVGLNGLAKFKEMVENADYSRN

SEQ ID NO: 5953 - protein, 242 aa, Lactobacillus buchneri
MQIIPAIDLKNQQSVRLYQGDFQQTTVISKSPLQQALAIDSAGLKNLHLVDLDGAKSGRPVNRSLIEQICAQTDLKVEVGGGIRSLSQINTYLTSGVNRVILGSAALNNPKLVQQAIEQFGADQIVVGIDGKDGRVAVSGWLEQSSVEMGELMASMVAFGVNTFVVTDISRDGTMTGPNTAQLSSLQAKFPQVTVVASGGIRNVSDLEDLQTAGIKAAIVGKAMATSDLPLDVLAEVNTSVS

SEQ ID NO: 5954 - protein, 252 aa, Lactobacillus buchneri
VLAKRIIPCLDVDHGRVKKGVNFVNLQDVGDPTEIAAAYQQQGADELVFLDITATNEKRKAIVETIEKVASQVFMPLTVGGGIHSVDDMQNLLKAGADKTAVNSAAVSNPQLITAGAEKFGAQCVVLAIDAKWNPESGQYDVYVNGGRQRTNLNAIEWAKKGVALGAGELLVTSMDKDGTKSGYDINLYKQLTAAVNVPVIASGGCGQLGDFAEVFDQADVDGALAASVFHFGELTIADVKTDLRKDGVIVR

SEQ ID NO: 5955 - protein, 111 aa, Lactobacillus buchneri
MKPDFEKYSDGLVPTIVIDDNTKQVLMMAYVNEESFNLSMQTRQSWFWSRSRQELWHKGETSGNTQKIVSIDIDCDEDTLLMKVIPAGPACHTGHTSCFYRTILPEPTKEE

SEQ ID NO: 5956 - protein, 106 aa, Lactobacillus buchneri
MQDLDELYQLILERKNNPEKGSYTDYLFTKGLDKILKKVGEEATEVVVAAKNPSDPDFILEVADLAYHVEVLMAQRGITPDQIKQELASREGKKSITKDRKQIKEW

SEQ ID NO: 5957 - protein, 358 aa, Lactobacillus buchneri
MVKEAVKNLKPYVPELTLEQLKKQKGLDKLVRMSANENAYGTSADVAKALDKWHYRDANLYPDSNADELREIIASQFDINADKLIFGNGLDEIIELLSRVILEPGDEVLDPAPTFSEYALHAEIEGAKIKSVGLDDSGRIDLKAMARSISSKTKMIWICNPNNPTGTFLEADAIRAFVEDVPEAITVIVDEAYIDFTGGIHDSVIQLTKEFKNLVVLRTFSKAYGLANFRVGFAVCSDPLIGYLQAARLPYNLSTFAEIAATAAFKDQSFVDNTVKKVIAERKKWEHFLIKAGLPFYDSATNFIFFQVKGGDADALHEYLLENGYLLRNGLRKDWLRVTIGRPEDNQAVQKLIADYLA

SEQ ID NO: 5958 - protein, 374 aa, Lactobacillus buchneri
MQDNSQTRVVVGMSGGVDSSVVAYLLKQQGYDVIGVFMKNWDDTDENGVCTATEDYKDVAKVANKIGIPYYSVNFEKEYWDRVFTYFLDEYKKGRTPDPDVICNKEIKFKAFLDYALELGADYIATGHYAQLTRDADGHNHLLRASDGNKDQTYFLSQLSADQLDRVMFPIGNLVKPDVRKIAREAGLATADKKDSVGICFIGEKNFKNFLGHYLPATPGKMMTVDGKVKGQHDGLMYYTIGQRRGLGIGGDGVDNQPWFVVGKDLKQNILYVGKGYHNPLLYADYLEASDIHWVNNLDRGKDFHCTAKFRYRQKDTGVTVHISDDGQSVRVDFDAPVRAITPGQAVVFYDGDECLGSAIIDAAYKQAKELQYV

SEQ ID NO: 5959 - protein, 218 aa, Lactobacillus buchneri
LTKLYFVRHGKTEWNLESRYQGAGGDSPLLAQSYTEMDLLGKHFQKTDFAHVYSSPIKRARVTAARIDRKLKSHPDISLLSRLEEFHLGKMEGQKFADVEQAYPEEFEDFRNHPDLYDPKAIGGESYLDVINRMTPAITSIVKAYPGQNVMIVSHGAALNAEINALLGVGLPNLRKRGGLANTSTTILESTDEGQSYQLIDWNDTSYLNKKLDPTDLV

SEQ ID NO: 5960 - protein, 246 aa, Lactobacillus buchneri
MANNSDKIKKLQAKNQENQRKYTRKREAEEAKAKATIHKLVEKVDHEPNNYHNYYDLATFLVEAKDYEQAEELLMKALGLFDKASQAVKDTLKFGLGNVYYAAAEYDKAIKIFQEIEDKKLQAESYIMLAQSYMAKGDNKRAMVFALSAQSARHDDPDVNQMIGDNLLALGNFAQAGDFYDIVLKTEPENGKANFNRGLVAMVNGEDFENYFAKAKQADPVYFEKGQQKLKDIEKVIQINKDKPKK

SEQ ID NO: 5961 - protein, 827 aa, Lactobacillus buchneri
LDHSIDLFGSEQNNHEPQYVDGRLKAIFFSSNDSFYKVVLVEITETNVNWPEDEIVVTGNFGDLVEENSYHFTGKLVDHPRYGKQFQASNYTSVIATTREGVVKYLSGDQFPGIGKKTAERVVDVLGDDAIEKITADNRVLDDVPISAKLRSAIIENLDADDNLEKTIVGLNSYGFSSAIASAIYQKYHEDALKIISDNPYQLVEDIDGISFKKADAIALRLGIVPDSNERIRAGLMYAIDELCLQNGDTYTTTAPLIQTASSLLEGNAQQQIPGKKLAESLVELAKEGKVVGEEDRIYLTRLYNAEVQIADHLNRVIKNQDDEDQLKEDAIKKQLRVVEKQFDINYDDSQVAAIVQAIQSPAFILTGGPGTGKTTIINGIVNTFARLHEYSLDINSYKDKPFPIVLAAPTGRAAKHMTESTGLPASTIHRLLGLNGRESNDTTGTKDIEGALLIIDEMSMVDTYLFRSLVRAIPNHMQVVLVGDQDQLPSVGPGQVFHDLLVSKQIPAMQLNTIYRQEKGSSIIQLAHDIHRGQLSENFTQNQSDRSFIPCNEYQISSVIEQVTKRAKQKDFGLMDVQVLAPMYRGRAGIDRLNDVVQDVWQGDPTGKKSVTIREHTYRIGDKVLQLVNNPENNVFNGDIGIIVGMDAPKGQQVPNKITIDFDETEVTYEKNEWTQFTLAYCTSIHKAQGSEFKMVILPIVRQFSRMLQRNLLYTAVTRASDFLIMLGEKEAFEQCVRNVSVNRQTSLVKRLVDAIGIQPQSKGTDREPEAEDQKQLPTDTQPAQETDDAKADNLPDHLTTAVINQNLIDPMIGMGDVTPRDFLKS

SEQ ID NO: 5962 - protein, 319 aa, Lactobacillus buchneri
MAESKTHPNLKLFSLNSNRHLAEEISKAVGVPLGKSTVEKFSDDEIKISVDESIRGDEVYIIQSVSDPVNSNLMELLIMVDAVRRASAKSINVVIPYYGYSRADRKARSREPITAKLVASFLEMDGVDRVVALDLHADQIQGFFNIPVDHLKADTLLADYFVKTHKSSDVVVVSPDHTGVSRARKFAELLSAPIAIIDNRSPEDATTVPESVIGNVKGKRAIIVDDMIDTAFKLTIAAETLKKAGATDVFAIATHAVFSGDAQQRLQDSPIKKVIVTDSISISKADQFEKLEVVSVGQLFGEAINLIHNHKSVGKLFGR

SEQ ID NO: 5963 - protein, 329 aa, Lactobacillus buchneri
MYKANDDRYENAVVRRAGNSGLQLPALSFGLWHSFGDDANYGDSEKVILKAFDLGIFSFDNAYNYGPSAGAAERMFGEVYRANLKPYRDELVITTKAGFNMWPGPYGNFSSKKTLVNALDGSLKRMGLDYVDIYYSHRFDPNTSLEETAEALDEIVRSGKALYIGISNYNAAQTAEIIKYFKELHTPFVVNQASYNMLNRGIEEDGLLDTLSQNNKALVAYGPLAEGLLTDKYLDGMGDDVKIHWSNEFVIKHGKDELVKKLNELNDIAKNRNQNLAQMSLAWLLHDPTVVSVVTGASKINHLEDNLKALNNLDFTSDELAQIDKIVKE

SEQ ID NO: 5964 - protein, 335 aa, Lactobacillus buchneri
MTKKVTITDLAARAQVSVTTVSQILNGKAARFSSKTVEKVKQLQKEMGYVPDFNAQSLIRKSGRTIGVIIPNMNNPFFSRVLLGIETEAIKQDYVPLIFGSNNSQSQETHYLFESVRRAADGMIIASAVSDINYIDNILNQNGIPYILIDQAPVVKGDRVDANNQKGGALLADYLIKNGHTDVAVVCATKPTLNLQERLAGFVETYKNNGTPIPEDRIITTEMTKKGGYAATKAALATKPTAIFGINDEVAIGVYRGLEEAGLKIPSDISVVGYDDIDLGEYISPKLTTVHQPAFEMGTNAAQMIIKRIEDHNEPIQQVSLPVSLVERDSVRAIN

SEQ ID NO: 5965 - protein, 305 aa, Lactobacillus buchneri
MTNKVVVLGSLNVDTTLHIDQMPKPGETISAKSKTNSAGGKGANQAVAAARSGAQTSFIGQVGDDSNGIFMIDALKLDGINTDHVGINQVDGTGSAVILLDSQGQNSIMVYGGANQAMKTEVIADSQALIKSADILISEFETPQEVTYEAFKLAKQHGVTTILNPAPASKIIYGLLEVTDLIVPNETESATLTGIEVNDTDSMDQNAAKFSEMGIDNLIITVGDRGAYYHTPSDSGFVPAFKVKAKDTTAAGDTFIGAFSSQIDKDLSNIEAALVYAQKASSITVQRLGALPSIPTAEEIKAEYK

SEQ ID NO: 5966 - protein, 72 aa, Lactobacillus buchneri
MSNKLEILREYQKASSKLDQLKSEEADKIKSTPVNTSSTEVITPQFGNEMTHLNEECMQLNMILEAMDASED

SEQ ID NO: 5967 - protein, 319 aa, Lactobacillus buchneri
MYSTSYLLFQSLTAVALGDALGYPIQHDTRLNPFDDPIHEMVEHRTNQIPAGTWSDDTSLSIASLVSLTFGYNLYDLMTRYSQWVHFGDYTPFNYAYDVDETTKAAIQRFDTGTPPVLSGGTLDSDNDNTALKRLMPLAFYILTKNQQYTFNETVADMVHDYTATTNRTPKTFIGSGVLTNVIIRLIQNPNKYAMLRAVKESLDYYRSKDQFAAQVPFFEQLEESHFLRQSSTKLRPSSDVIATLNAVFWCLMNSEQYNVAVSKAVNLGSNADTIGSITSMLASLLFAPVTFPENWLSKLQGRNQIKSAVSVALLSDNF

SEQ ID NO: 5968 - protein, 316 aa, Lactobacillus buchneri
MKYFIIINLHAGGDNAKKVWPDIQKQLAAAHADYQTLYTAYPNHAVELAEQALSEIDTANQTDAVLIAAGGDGTLHETLLGCQHYYRVHQNDHPVPIAFLPVGSGNDFARGLKIPLHWEKALADILTQSAAKTINVGHYTDLDHHSEGFFTNNFGIGFDATVVHLANHSSLKSHQFFGQFSYMAAILNVIIHFKGFKTEILPGNMPKVTFDNTFLLTTTDIPYFGGGINIMPSASVFDDHLDLVVVEKPSLWQLILFVSMIFLKRHLRLKFIHHYHEKELFIKTNGNRLGQIDGEELGERTFNLKLDTVKYPFWIR

SEQ ID NO: 5969 - protein, 561 aa, Lactobacillus buchneri
MKKLNVKNNEAAIYGVGGLGEIGKNTYGIQFQDEIILIDAGIKFPEDDLLGVDYVIPDYQYLVENKDKIKALVITHGHEDHIGGVPYLMKVLNVPIYAGPLAMALIKNKLEEHGLLNSVELHEISDKSVLKFQKMKVSFFRTTHSIPDTVGIAVHTPVGVIVETGDYKFDLTPVTNQPPDLQEMARLGAEGVLCLMSDSTNAEKPIWTKSEKWVGTSIAHIFDNIEDRIIFATFASNISRIKTACDNAMAHGRKIAVFGRSMDAAIVNGRELGYLDIPDDAFVDAHELQSLPANKTLILCTGSQGEPMAALSRIANGTHRQISIQPGDTVIFSSNPIPGNTTSVNSVINKLEEAGANVIHGRVNNIHTSGHGGQEEQKLMLRLMKPKFFMPIHGEYRMLKIHTELAEQCGVPLDHSFIMQNGDVLALSKDNARMAGHFTAGDVYIDGSGIGDVGNVVLRDRQLLSEEGIVVVVATINLANQEIQSGPDILSRGFVYMRESGELLDEGRRRVFKTIRKSMRAKKATESSIRNAIIDDLQEFLYDKTERHPMILPMLIMNGKD

SEQ ID NO: 5970 - protein, 73 aa, Lactobacillus buchneri
MIWKVLYQPSKKESPRRETTHSLYVEADTEVEAHALVEDNTDYDIEFIEPLQGKHLEYEQSSPDYKVTEFNNK

SEQ ID NO: 5971 - protein, 164 aa, Lactobacillus buchneri
MNIDLIIQIIIGLVAAFAVYNLIHYIFVTRPGRKRLALAQRIANEAVKTSINQLVDQKAVLPFDESDFKSEDIAEVWGRGVMAFEYHLPKAKIESSIPDFRKALATTLEQYGDTHHMHAHTDQADRPAFMVTDVWQLDDRVHFDVAYLVNVTTIEYVDDLKRLH

SEQ ID NO: 5972 - protein, 300 aa, Lactobacillus buchneri
MKTIGQTVKMIRQIKGFTQSEVYSGVMSRSFAHRFENGENDISAAKLFKILDNLSISANEFRFIQNDYHEPTATSLKRRLLRAYNGHDLQTMGQIIAETQKSSRLSYKSVAAMGQILVVTYYSKTFTVTPAMENLWDTLFASQTWTLEEIRQAQILLPIAVSRHQEKLISEIVRRFENNCRQYLQAVDDPFHIADELMDLYLSLFQIELNLAQYQSAKEILNKIRQVNTLDLSWNGRFQQQLITAVWQLYFGSEKKGLALIAKLVAVENLYSPPVDHNLLAIIKVRKRLAKQYRKANAVD

SEQ ID NO: 5973 - protein, 420 aa, Lactobacillus buchneri
MQVIKDVSSNFTSTFCGDMFSFALGLMLLRATGMSLSFGLSMIIMPIVTLIGLVPIGNLVDTYPHKRLLIISLVVRITALFIYSIAIGHFDGSGKLIPTIGFLIINYASVNLSNSGYMASVHELVNEGHIQKLNSLSQSAASFASTFSPIVAAGLYVIVGFRLFIVFQLTAHVIALIILLTMNFHYLSYPRKSSQTPQESQWAKFKLGLNYLMAHGFLRYLICIALFLNFIFAVINVGLPFMIVEHLHLGNVTLGILNSADALGMLIGNLIISVSKELRHLAKILAVTMVIIGTGLAGVGALLMAAPEQLVVQLVGSLMLFAVGMSLAFMNTPFGIYMQKTVPTELMGRVSSTEMSLNMMSIPLGTVFYSFVFQQIPSGIVFIISGIALIAVTGLTMPTFMHVQMPKTGHATQKADRQRL

SEQ ID NO: 5974 - protein, 188 aa, Lactobacillus buchneri
VFLMKDIVRDGDPVLRKQAQKVKFPLSKEDKQLAHDLMEYLEVSQDPEQCEKLGLRAGVGLAAPQVGVSEMMASVLVPSEDEDEKDEPVFKDVIINPVIVSNSVQRGALTEGEGCLSVDKDIPGYVPRAARITLKYQDVDGKEHKVRLKNYPAIVCQHEIDHLHGTLFYDHINKDNPFAKTDDEIFVY

SEQ ID NO: 5975 - protein, 373 aa, Lactobacillus buchneri
MAAKSKHVVDFAKIKSTMSDPYKKPVQVIDESGKIVNQELFDQFSDDELVTLMEKMVWERALHEQTMNFSRQGRLGFYAPTYGEEASEMGIAHAMKKQDYLFPAYRDLPQLIQHGATVKEGYLWSKGHYQAYDYVRRGVRAFIPQIIIGAQYVQSAGAALGIKKNGEKDTVAYTFTGDGGTSQGDFYEGINFASSFQAPEVFFVQNNGWAISVPRKTQTAAETLAQKGVASGVPGVQVDGMDILATYLVAKEARDFVVAGNGPALVETLTYRFGAHSSAGDDPSRYRTKEQEKPWFDRDPLIRLRKVLTDKKLWDQDKEDKLVAQYKDEFKEAMKDAEAAPKQKVSDFLKNTFEVPTPDVAADIKKYEAKESK

SEQ ID NO: 5976 - protein, 325 aa, Lactobacillus buchneri
MAKMTYIKAITNGLDQVLQDDPKTLIFGEDVGKNGGVFRTTEGLQDKYGEDRVFDTPLAESGILGMSIGLALTGWRPIPEIQFMGFTMEAVDSVGGQMSRNRFRFSGDVTMPITIRTPFGGGTHTAELHGDSLENLFIGIPGLRVVTPANPYDAKGMVISAVENNDPVLFMENLKLYRSMKDEVPDGHYTVPLDKANVVREGSDITVVAYSAEVNEALKVADKLEKENISVEVIDLRSLSPIDDETIFASIDKTHKVVIAQEAQKMAGAGAKVASDIAENDIMSLDAPIGRVSAPDSIFPFAMAENDWLPNADDIEAKVREILNY

SEQ ID NO: 5977 - protein, 446 aa, Lactobacillus buchneri
MAYKFKLPEMGEGITEGEIATWDVKVGDTVKEDDPLVEIQNDKSVQEMPSPVAGTIKSIEKQEGETAEKGDVLVVIDDGSPDEPDDAAPAAAPAKEEAAPAPAKEEAPAPAAAPAPAAAPAAVTAAPAASNPNAIVKAMPSVRQYARDKGVDITAVPATGNHGQITKADIDNFNPAAAPAAPAAAATAAAPAGEAKAAAGQAIKPWKSDQPDLETREPMSPMRKIIAKSMRTSKDIAPHVTSFDDVEVSALMANRKKYKQAAADQDIHLTFLPYIVKALVAVMKKYPEFNASIDDTTQEIVYKHYFNVGIATNTDHGLYVPNIKNADSKGMFEIAKEITENTQAAYDNKLGPDTMKGGSITISNVGSIGGGWFTPVINQPEVAILGVGKIAKEPYVDPEDGEIKVGNMLKLSLSYDHRLIDGALAQNALNYMNQLLHDPAMLLMEG

SEQ ID NO: 5978 - protein, 474 aa, Lactobacillus buchneri
MADVEKKETVIIGAGPGGYVAAIRASELGQKVTLIEKSDTLGGVCLNVGCVPSKALIAAGHRLQEANDASTYGITTQPATIDFAKTQEWKQKKVVDRMTSGVKMLLNKHKVEIIHGEAVLDSDTQLRVMPTGPQQFMSADTGTTIQFDNLIIASGSHPIEIPGFKFDGRVIDSTGGLNLPEIPKEFVVIGGGYVGTELAGAYANLGAHVTIIEGLDSILNGFTKDMVSLVVKNLKKKGVDIHTSAKAISSSQDDNSVSVTYEEEGKQTTIKADYCMVTVGRRPNTDDLGLEYTKVKLDDHGIVQTDIQGRTDSEHIFAIGDIASGPALAHKAFFQGKVAAGAISGKNTANDYVGVPAVCFSDPEIAVVGMTQAQAKDKNIEVSTSKFPFAGNARAVSLDEADGFVRLIFTKDDKTIVGGEIVGPGASDLVAELSLAVNSHMNVEDIALTIHPHPTLSEPVQEAADVGLGFPTHI

SEQ ID NO: 5979 - protein, 95 aa, Lactobacillus buchneri
MAEGYEYPLIDGLDVDEIIDVVNFFEAIEQAYEEAEGIKRADFIKAYRKFQEVVPAKMEQKQLEKEFANRSGYDSYEVIKLSKDGQAANLKVREA

SEQ ID NO: 5980 - protein, 259 aa, Lactobacillus buchneri
MEINELKQIDKTVKGWLHESRDNVLRKIDTRLEVDTKTSRRDLVTNIDKQNEKFLVGKIREFDPNAQILGEEGFGDQVHSTEGRIWIVDPIDGTMNFVKQRNHFAIMIALYEDGKGLLGYVMDVIGKHLLSGGPDIGVFDNGHPLPQVKDTPLREGLIGLSGPMVLHNDYNMVDIAQQSLGMRIYGSAGIDIISVLRGELVGYISYLKPWDFGAGRILCETAGLKMTTIDGQRLDVLSSTPVLLATRNAHQDILTIVSQ

SEQ ID NO: 5981 - protein, 615 aa, Lactobacillus buchneri
LDTKLKTRDDIRNIAIIAHVDHGKTTLVNEMLKQSDTLDQHVQIEDRALDSNAIERERGITILSKNTAVRYGDKQINILDTPGHADFGGEVERIMRMVDGCLLVVDAFEGTMPQTRFVLKKALEQHLTPIVVINKVDREGARPQEVVDEVLDLFIELGADEEQLDFPVVYASAMNGTSSYDPDISKQEHTMKPIFDTIVKDIPAPIDNSDEPLQFQVAMLDYNDFVGRIGIGRIFRGTIKVGDSVTVMKLDGSKQNFRVTKLMGFFGLKKEDIQSAKAGDLIAVSGMEDINVGETVVDPKDPEPLPILRIDAPTLQMTFGTNTSPFAGQDGKFVTARQLGDRLKRELHTDVSLRVEDTDQPGSWIVSGRGELHLSILVETLRREGFELQASRPEVIYREIDGTMCEPFESVQIDTPDEYTGSIIDTLSQRKGTMQNMETTDNGQTRLTFLAPSRGLIGYSTEFLSLTRGYGILNHTFEKYMPVIKGWNPGRTKGTLVSMNAGKATTYAMMGIESRGTLLIDPGTEVYEGMIVGENNRENDITVNITKGKNLTNVRAAGSDDMARIKTPTHLSLEESLEFLNEDELCEVTPHFIRLRKKILNSNTREKEAKKKRHN

SEQ ID NO: 5982 - protein, 393 aa, Lactobacillus buchneri
MGKARLKNLDYVIFIPYIVMSIIGVVMVYSASANISLQNGGSPLSYLIKQLFFVVLSVIIVGVMTAMNIKYLRKPKFLKFLLYALIVVLIGLLLVGKTINGAAGWIHLGPINIQPAEFVKFFLIIWLADTIDKAQPEITLSFRDWWNHMKWPLFFSAVLIALILKQPDSGGAAINLAIAFILFNCSGFSWKRALAIIYGCMVAAVLAFEFILVPMAKSDSFSHSYQLQRIVAFTNPFGHAQGTGQQVVNSYYAISNGGLFGVGLGNSVQKTGYLPEPNTDFIMSILTEELGAITAVIVLALLTVIILRTVQIGVRSNDTYQSLVCYGVATYMSIQTFFNMGGVLGVLPITGVTFPFISYGGSSILTLSFCLGLVLNISSRQRMERKALIAARN

SEQ ID NO: 5983 - protein, 93 aa, Lactobacillus buchneri
MALTVQPTTGLIVYLHSIRHSRNLKSYGRLYYVSKRMRYGLIYVNKDDEEEITKKLASQSWVKQVVPSHLNELVQEVEGKTELDDDDSVDEDY

SEQ ID NO: 5984 - protein, 188 aa, Lactobacillus buchneri
MRIVSGKYGGIRLNPVKSDQTRPTTDKVKESLFSMTGPYYHGGRFLDLFAGSGAVGIEAVSRGMDSAVLVDRQYQAIKTIKDNIAKIHAEDQFTVIKGNAETVLKQLAANGDKFDQVFLDPPYKLQKIVNTLEELKSHDLLNEGATVICETDNHTELPLNLDGFHAVKQKNYGLTNLTIYDYQMGNVQ

SEQ ID NO: 5985 - protein, 159 aa, Lactobacillus buchneri
MTKALYAGSFDPITFGHIDVIKRASRIFDKVYVAISINTHKHALFTDEERAEFARQALNQLPNVDVVVSEELTVQLAHSLGATVLVRGVRGGSDLDSEMSIAGLNEKLADDIQTIFIPTAANYRDLSSSMIKEIAKFHGDVSKFVPGPVAQALNDKYQQ

SEQ ID NO: 5986 - protein, 345 aa, Lactobacillus buchneri
MKKWVKKYLIWFAILLFVAIGFLWPLPKYIEGPGDAANLSKIVNIQGHPDRQKGQFMLMSVSISQARPFTYLYAKLSPYYSIEPEEDVTGGQDMKEYSKVQQIYMDGSINSAIYTAYHQAHKAVKIKYSGIYVMSLMKNSNFKNKLKVGDVVVALDGHHFKSSLGFIKYVKQQKYGQKLTVTYKRHGKLHQATAPLGMIAKHRAGIGITLTDDVQVKPKIPIKVHPGQVGGPSGGLMFALQIYSQLTNKNLRHGQKVAGTGTVDGLGNVGEIGGIDKKVITAKKHGAKIFLAPYVKPTKTILKYEEGHKTNYQLAKATAKKYAPSMKVIPVKTFAQAVSILEKNQ

SEQ ID NO: 5987 - protein, 243 aa, Lactobacillus buchneri
MDRIREFIDEYLYQILIGLVAVIVIFMFVIGGLLIGKGGETASSEEPVAVQSSSASSDTGSAASSSPGDQPKQVAAGTNQQMYVDVKGAVKNPGVYQVSSNMRVVDAIELAGGYNRSADKKKINLAQKLTDQQVIYVPIRGEKGTPVTSTVAASPTPSETPADSGSDNSAPSADGTSGTSQQINLNTADKSKLQELTGIGDKKADQIIAYRQAHGQFKNIEELKEVPGFGDKTFANLKASICV

SEQ ID NO: 5988 - protein, 158 aa, Lactobacillus buchneri
MDKRIKWDQYFMMQAVLLASRSTCERLSVGAVIVRDKRIIAGGYNGSVAGDDHCIDVGCYLEDGHCVRTIHAEMNAILQCAKFGESTDNAEIYVTDFPCLQCTKMLLQAGITKINYLRNYHNNDYAQKLIRLKNIELNKIKLTQADMDRVPFGSYLSD

SEQ ID NO: 5989 - protein, 737 aa, Lactobacillus buchneri
MLLMSMAMYGNRLIAAALLSILIMRIYFLRDVKVVSTCILAGLIFAFGGLLTNRQVSAPVSQQNYLVKVYPDSAKVNGANLSFIARPEGAKQKMVLYARLKSSSQQRRLAAGINPMMLKVSGKSAPFLPATNLNQFDMEKYYHHQKIQSCFLVDHFVLLPPPAKLSIVDRIHIIRSKFNQYCSQLPKTLGIYATGLISGYRPVNFFDEMTGVKKLGLLHVFSISGMHVAYFLSIVDQLLAWLGLSRFKKSIISITFLGAYFVFSGGSPGLLRAVMMAIIGILNRLFKFGLSQLDIWSGSLIINLLILPEAMFLMGVQLSYGLSLGLIASEKFSYIKQTILLNFLTVPILLFHLYEWHFLSVAVNLIVLPLFGRVIFPLVIIGVIGGLVAETLVLPIDMFLRIFNDGLNAVSRLPGMLTFGKPALPIVLTMLAVTMLLAVVDRVRAPKLIGILAAVYLVTYCWIHFPLNGEVTMFDIGQGDSFLIREPFNRSVTLIDTGGKVQFNTQPWQKGAQTYQAKRLSINYLKSIGISKIDNLCVSHQDSDHCGDLPAFIEEMEIKRIIIPLGMDQNPSFMKRIANRSRSTKVISVNDETQVPGLPAQIFHPYLAGKGENHDSMVIGTQKGGLRWLFTGDLDRPGELDTLQRHPGLSADVLKVGHHGSKTSSDPQFIATVKPRIALISAGRNNRYGHPNDETLVTLKQHHVKIFNTQKHGMVRYIYRNNTGHFETVLAGHEGNL

SEQ ID NO: 5990 - protein, 341 aa, Lactobacillus buchneri
MNYSQLIQQLNQGNLAQVYLILGDQEYLSGRIKDAFVKIIPDNERSMNIGNYDMEDTTISAAVEDAISVPFFGERRLVMINRPYFLTGMRTKSKLDQNIDDFLEYLKHPEESTVMVIFAPYDKLDSRKKVTKALKKVATTIEIGSLRENEIKKLVTDKIAAAGFKIDHDALDRMVELTGGKLTAMMSDLPKLILYNNDTKVIDLASVNGLVSKSMEQNVFDLVNSVLAKNPKQSMDIYHQLILENDEPIRINAVLIQQFRLLLQVMILQKHGYSQGNLASTLKVHPYRVKLAMQTIRKFNYDQLREAYIGLVDTERQMKSTQRPPELLFELFVLKFMKSVS

SEQ ID NO: 5991 - protein, 84 aa, Lactobacillus buchneri
MPIIKSAIERVKTNEKAQRRNAAQLSAYRTAVKKFQKAQVAGSDDVKDLYINAISAIDRAKSKGLIKANKAARDKSRLTSKLAK

SEQ ID NO: 5992 - protein, 89 aa, Lactobacillus buchneri
MAITQTKKNEIINKFARHEGDTGSAEVQIAVLTADINELNDHMRTHRKDYHSQRGLMKKIGHRRNLLAYLRNKDVTRYRQLIKDLGLRR

SEQ ID NO: 5993 - protein, 571 aa, Lactobacillus buchneri
MKNEIKVMAIGGARENGKNMYAVDINGGIYILDCGLKYPENELLGIDVVIPDFSWLEENKDRIVGVFLTHGHADSIGAISYFLSKFDVPVFGSEMTIELAKINVSDSEEVKHFDDFHVVSDRSEIDFEDIKVTFFKTTHSIPGSLGIALHTSDGIIVYTGDFKFDQTAAPIYQTNYSALTQLGDEGVLALLDDSSNAENPNPSASEKKIAEYVYDTFNYQNSRIIVAGVASNILRMQQVFNAAARTGRRVYLTGHDLERIVKTAMGLNTLKLPEDDLLIGSLDELKKMAPDKVVIIQTGKMGEPIKAIQRMANKEQSDINIEPGDLVFITTTPSTAMETTVAKTRDMVYRADGEVKMISDEMNSSGDASQADLQLLMNLLHPKYIIPVQGEYRLLEANAQLAKEIGYTDDQIVIPAKGDVISISEDDIHLGKGVDLADTMIDGIGIGDIGNIVLRDRKVLSEDGIFVAVVTIDRKKKRIVSTPKLTSRGFVYVKANKDLMKDAAGIIEKTVTNNLEHKEFDWSNLKQDVREDLSDYLYKQTKRRPVILPVIMEVNQHHKRSKKKQKAAEKN

SEQ ID NO: 5994 - protein, 309 aa, Lactobacillus buchneri
MTEMTKNDRVILLSAQEDLRDGRYNQVVNKAEHLLGKYPQSVELNDLYANALYHLKRYADAGQVVADFAEDFIAQPRYQGHAMEILLANNLFMSAREVLAQVPTSKKGEWKQRIVTAENDYRQQHSTELAAKSRKFAYLGALSVTEQVHEVQAALHLPLNEYLSAAKTLLNDPYGWQVSKTQVLLQLMKAQVSENVDLIWLDGKTHTISLDELKPLEKIDAFVRVLQIVEQQFAAKDPIKLDLLERELFTQSNYIYPYFDDVITGPNFWAQAIIAQSFGEPLPAKTQQQQRMLSWINRIHDQEIKIGLI

SEQ ID NO: 5995 - protein, 395 aa, Lactobacillus buchneri
MAKEHYERTKPHVNIGTIGHIDHGKTTLTAAITKVLAAKGLAKAEDYADIDAAPEERERGITINTAHVEYETEKRHYAHIDAPGHADYIKNMITGAAQMDGAILVVAATDGPMPQTREHILLAHQVGVDYIVVFLNKTDLVDDDELVDLVEMEVRELLSEYDYPGDDIPVLRGSALKALEGDKEQEQVILDLMDVVDEYIPTPERDDSKPFLMPVEDVFTITGRGTVASGRIDRGTVKVGDEVEIVGLNDEPLKSTVTGLEMFRKTLDEGQAGDNVGVLLRGIDRDQVVRGQVLAAPGSIQTHKKFEGQVYILTKEEGGRHTPFFSNYRPQFYFHTTDVTGVIELEKGVEMVMPGDNVTFQVELTKPVAIEKGTKFTIREGGHTVGAGVVSDVND

SEQ ID NO: 5996 - protein, 444 aa, Lactobacillus buchneri
MSAKWEKKGTNDGELTFEIGTDSIKSGLDRAFKKNKNSIRVPGFRKGKVPRQIFTKMYGEEALYEDALNILLPDEYEKAVQDAKIEPVDQPKINVESMEKGKPWVIKANVTVKPEVKLGDYKGLSVPKQNTRVYQKDVDAELEKKRESQAELVLKEDKAAEKGDTVVIDFEGSIDGKPFEGGSAENHSLELGSNSFIPGFEDQLIGHKAGDEVEVKVTFPKDYQAKDLANKEAIFKTKIHEVKTKELPKLDNDFAKDVDEDVDSLDELKEKIKEDLKSQKKSEARDAIEDAAISEATDNAEVKDIPQAMIDEDIQRQMDQYLAGMQQQGINQDMYFQLTGTKPEDLKKQFADGAEKRVKTNLVLEAIVAKEKIEPSEDDVKAEVKNLAKQYGMKEDAVRSALTEDMLKHDIAIKQAIDMIVDSSKQDAKAKSTEKDSTEASSEK

SEQ ID NO: 5997 - protein, 415 aa, Lactobacillus buchneri
LFEDNESSGPITCSFCGKTQDQVKKIVAGPGVYICNECIDLCKEIIDEELAPEKSSDDLLKVLTPAQILDKLNEFVIGQENAKRTLSVAVYNHYKRVNEMISEPDDDLELQKSNICIIGPTGSGKTYLAQTMAKILNVPFAIADATTLTEAGYVGEDVENILLKLLQNADYDVERAEHGIIYIDEIDKIAKKSENVSITRDVSGEGVQQALLKILEGTIANVPPQGGRKHPQQEFIQIDTTNILFIVGGAFDGIEGIVKSRLGDKTIGFGTNSDEAAKVDAKNIMQSVIPEDLLKFGLIPEFIGRLPILTALDKLDEHDLVRILTEPKNALVKQYKKLIELDGAELEFAPGALEKMAQLAIARDTGARGLRSIIEGVMRDIMFDLPSRNDVSKVIITPETVTDHKEPELILKQAS

SEQ ID NO: 5998 - protein, 195 aa, Lactobacillus buchneri
MEVHNVDLTISAVAEKQYPNTQFPEIALVGRSNVGKSSLTNVLINRNKFARTSSQPGKTQTLNFYNIEDKLYFVDVPGYGYAKASKASREKWGRMIETYLTKREQLRGVITLVDGRHAPTADDVSMHNWLKYYNIPMLTVATKMDKISSGKWNKQESLIKKTLQLDADEPLILFSALTKTGKNEIWRWIEGRMKR

SEQ ID NO: 5999 - protein, 103 aa, Lactobacillus buchneri
MNFDDYQKAANRTLMGNEQVLTNCALGLTGESGEVADLIRKYTFQSKKLDHDELVKEMGDVLWYLSQISEWADIPFDEVATDNIKRLEKRYPEQSGGVNQVNI

SEQ ID NO: 6000 - protein, 431 aa, Lactobacillus buchneri
MSENNKVILAYSGGLDTSVAIAWLKDKGYDVVACCINVGEGKDLDFIKQKALNVGAVKAYVIDALDEFADNYAAVALKANAMYEGSYPLISALSRPLISKTLVQIAHQEHAVAVAHGCTGKGNDQVRFEVAIHGLDPQLEVLSPVRDWHWSREQEIEYAKDHNIPIPIDLDSPYSIDANIWGRANEAGILEDPWQSAPEDAFAITNPIENTPDTPTEVEITFEKGIPTELNGKKMKFADIIQELNETAGENGVGRIDHIENRLVGIKSREVYEAPAATVLLKAHKELEDLTFERDLAHFKPTIEKQLSELVYNALWFSPLMDSIQAFIDKSQEVVNGVIKLQLFKGNVMVLGRKSDSSLYDKDLATYTSSDSFDQEAAKGFIKLWGLPTQVYQQVALKNKNAQFVQAVTKSQLKDKVTVHEHNSAHTGAKK

SEQ ID NO: 6001 - protein, 460 aa, Lactobacillus buchneri
MSTKKLWGGRFQEQAAQWVDQFGASISFDQLMADEDIEGSLAHVKMLGHTKILPMADVDQIVAGLNGLREDLHAGKLRFTVENEDIHMNIEALLTERIGPVAGKLHTARSRNDQVATDFHLYLKNRLPQVIDEITTLQKTLVEMAEKNVETIMPGYTHLQHAQPISYGHYLMAYYQMLKRDKERFAFNMKHTDIMPLGAAALAGTTFPIDREYTAKELDFGEVYPNSLDAVSDRDFALEFLSNSSILMMHLSRFCEEISMWVSHEFKYLELSDAYTTGSSIMPQKKNPDMAELIRGKSGRVYGHLIGLLSTMKSLPLAYNKDLQEDKEGTFDTVKTLLPSLKVFNGMLKTAKPNVERMKQATENDFSNATELADYLAAKGIPFREAHGIVGKLVLKGIETHQNLQDMSLEELQAASPKIQEDVYHDLKSEVAVERRHSFGGTGFDQVRLQIKNAKKELGE

SEQ ID NO: 6002 - protein, 104 aa, Lactobacillus buchneri
MFKFFNTVASISVTELQEKMKGTIHLLDVRTPNEYRSGHISKAKNVPLNKVDGYKGSLTEEVYVICQSGMRSKKAAKILQKKGYSVVNIRGGMSQWTGQIRGGK

SEQ ID NO: 6003 - protein, 551 aa, Lactobacillus buchneri
MTKIIIVGGVAGGMSAATRLRRLMEDAEIVVLEKGPFVSFANCGLPYYVSGEIEARESLLVQTPEALRARFNLDVRPHHEVIAINPVDKTVTIKHSGQITTESYDKLILSPGAKPFIPPIIGLAEATNVYSLRNVPDLDKIMTNIDQENPKKAIVVGAGFIGLEMAENLKKRGLEVALIEKAPHVLPPLDEEMAAFVKNELVSKGVEVITSQSAAEFRNQGKLVILEDGTELQSDLTILSVGVQPENTLAKDAGIKLGLRGGILVDNNYQTNLSDIYAVGDAILVKQQITGEDALISLASPANRQGRQVADVIAGLNRKNKGSIGTAIVRVFGLSAASTGLSERVARLAGLDVAVVHISGKDHAGYYPGATEIVLKLMYNPKTGEIYGAQGIGEKGVDKRIDILATAIKGGLTVFDLPELEFSYAPPFGAAKDPVNMIGYVALNQIEGLSNTIQWHELTDELAKGKILLDVREESELANGRFKEAINIPLNDLRCRVSELDPTKEYIISCHSGLRSYVGERILKQAGFKVENLDGAFALYKAVRLEDVDYV

SEQ ID NO: 6004 - protein, 102 aa, Lactobacillus buchneri
MFSSIGVDEFYQKSKTESLTIVDVREADEFERGHIPSAKALPLSGLEQHIDQLNKDEKYYVICQSGRRSAMACDFLSSEGYKVVNVMGGMSAWKGELTYGDL

SEQ ID NO: 6005 - protein, 86 aa, Lactobacillus buchneri
MGTCDKSILNRLTRAEGQMRGIQKMIEEEKECIDVITQLSAVRSSVDRIMGIIVAENLKSCLDNPELDSDKQSQKVEQAINMIIKK

SEQ ID NO: 6006 - protein, 52 aa, Lactobacillus buchneri
MEELNGALPFNASLSEEERANLRFLKATQGTPVTEFKDAKEVADWLNDPDED

SEQ ID NO: 6007 - protein, 111 aa, Lactobacillus buchneri
MIQMRTNDLVSLYVSFVETNGGKSRSVLIRRVSEQTVEVFKITSQYEKKSAYIKQQYYPIQDWQSAGLKKPSWVDLGNIYRFPKAGLNFKEIGHLSKLDQNKISVKLRKQK

SEQ ID NO: 6008 - protein, 60 aa, Lactobacillus buchneri
LGLILFVIVGYFIYKYLEDKQNGTSIFREQNSALDILNERYAKGEIDEETYRIKKETLNE

SEQ ID NO: 6009 - protein, 87 aa, Lactobacillus buchneri
MHGYWYNGFDNMMNFGYENSWWFMIYDGLKLLVIIGAVIFIAKMLMNRSNNDHASNSNRAINILKERYARGEISEEEYRDQLNKLRE

SEQ ID NO: 6010 - protein, 128 aa, Lactobacillus buchneri
MHIVYEKKTNKKLGEAIDSLTEQLKENGFGVLWQLNFKDKLKEKGLDFEEDFVVMEVCNPKKAKEVMGKNIHIGYVLPCKMVVREKNNQTYIGMTRPEALIDLFDDFNLNEIAKEVEGTLRQSIESTV

SEQ ID NO: 6011 - protein, 107 aa, Lactobacillus buchneri
  misc_feature (100)..(103): Xaa can be any naturally occurring amino acid
LSSITYSERIKIETFCELGLSNIQMGVRLNRSPSTISYELSRCQPYQAELAQTDAEYKRSRCGRKTKLSDELKQKILNHLRLSWSPGMIAHEFKLATKSXXXXFLLE

SEQ ID NO: 6012 - protein, 90 aa, Lactobacillus buchneri
MMINQRNRIGDFELDTVVGPRGHSKAVLLTLIDRKSRFLWAYRLKDRTTATVNEALTKFLTTFNGPVHSFTVDRGTEFSGLVSLWIEVNI

SEQ ID NO: 6013 - protein, 69 aa, Lactobacillus buchneri
MPTRYDKEFKQNIINLYKQGKSAAQLAREYGIGYSTVHWATRPPYKLKLQHLQAKWPPDLMLSRVQISY

SEQ ID NO: 6014 - protein, 194 aa, Lactobacillus buchneri
MAKIGYARVSSKEQHLDRQLAALKGVNKLFTDKLSGANTNRPELQKMLAYIREGDIVLVTELDRLGRNNHDLTKIMNSIQNKGATLDVLNLPSMTGIADPNLRQLMTNLIIELYKYQAESERKRIIERQQQGISLAKQQGKYHGRKPQYAEDDPRLLHAFKLYQNGMSDVDVARNTGIKRTTFIRYRKKFSVYR

SEQ ID NO: 6015 - protein, 225 aa, Lactobacillus buchneri
LPLKRDTVQKEAVHIAIGIRPDGTKEVLNYQVAPTESTGIWTELLGTLIKQGVKDVLLFVADGLVGLDEGLNRHFPKAKRQRCLVHVGRNLMNKVRVKDRKAVISDFKQVHRAANREAAELKLNEFANNWHQTYPKLIKDLLKMPNLLTFMDFPPAIRQSLYSTNLIENFNKHLKRTTHHKEQFPTEDSLDRFLVSQFNVYNEKSLKRIQRGFKGLQDTLEASFI

SEQ ID NO: 6016 - protein, 282 aa, Lactobacillus buchneri
  misc_feature (243)..(246): Xaa can be any naturally occurring amino acid
MCRILGVSRAQYYRYRSPKPSKRRAEDEDLKQRILRIFAEFKQRYGVMKIHHELNLELQPLQRRCSPRRISRLMKELDIHSVTVNKWKAASASKTKVEQRPNLLKQDFSTTGLNQKWTADMTYIQTKRNGWCYLSTIMDLHSRRIIGYSFSKKMATDLVLKTLESAVKNRTITGDLIIHTDLGSQYTSDDYNQRLTELHIRHSHSRKGCPYDNAPMESFHASLKKECVYPVPVFENYETAAAXXXXQSGKSPDEIKAMEKRLASLSEENEILKKALGFLAQK

SEQ ID NO: 6017 - protein, 88 aa, Lactobacillus buchneri
MDIQKDQLIKAESKAMELDIENRRLQKLVGTLQGIVRSVDRFLQRKLGIGLPNEWLERAGLKEPSKKAPQRPQERFKERHDELDGPSL

SEQ ID NO: 6018 - protein, 86 aa, Lactobacillus buchneri
VIADKAYGSEAFRQYLEAEEGTYTIPPKSNAKEKWPVDYYVYPERHLIENFFNQLKNFWRIATRYDKLAHVYLERVYLAAILIRLK

SEQ ID NO: 6019 - protein, 81 aa, Lactobacillus buchneri
MTADDDRNLEVINDLEYALAGTRQISYGGLFKQIKQDLKLEDVDKGDLVHVGNEEYSKEQMEAAEEVVAKWDFKKQNYFMW

SEQ ID NO: 6020 - protein, 88 aa, Lactobacillus buchneri; identical to SEQ ID NO: 6017

SEQ ID NO: 6021 - protein, 112 aa, Lactobacillus buchneri; identical to SEQ ID NO: 2601

SEQ ID NO: 6022 - protein, 370 aa, Lactobacillus casei
MESIVYVGMDVHKATYSLCALDKATGALLAETQCASEPKLVEKFINGLAEELESDTKFVTGYEAGILGYSLYRSLKNLGIDCIILAPTTMYSSAKNKMVKNDSMDARMIAKNLAANTYCAVYVPDEADNEVKEFIRLRKMMKKDLIRVKQQIGMFLLRQGLKCSASKWTLAYMDWLKKVPLSPVLRSVLDEMTLQKSELEEKIARYDQTIETFANSERYTKPIHALTSMKGFKTTTAMTIHIEIADFKRFKTAKAFMSYVGLNPSEHSSGDHTIKGGISKQGNSIVRTTIIEATQGLVKGSIGYKSRALKARQAGQESAVISYADKAGAHLHRKFTRMLTQGKSYNVAIAAVARELAGFIWGMETGNINY

SEQ ID NO: 6023 - protein, 115 aa, Lactobacillus casei
MTTQFDRTINIFAKGFHVSDLLEKEKIENFVVFTINNLSSYDNLMHATVFLSAIAGFFEQSNLPLRIQVMQIPLSDNKSKVDFIAIRLLDSEYNRAVQKLEDAYNQNKRNTKRKK

SEQ ID NO: 6024 - protein, 175 aa, Lactobacillus casei
MELTYLIPHIFAMVVLTLTLRFKNSALKKERQHREISFENSNLDQELQAKVLKQEAVLNQRHFITEILINAQFAGVYIAAFCFSAGVLYAEESTGVYLFPSIGVFCLFANILFVVEEQAFRLYKKRQLKKYLAVDRGVKIIENHGARRYYVYLALLILEGFINLGLFYAMAVWLY

SEQ ID NO: 6025 - protein, 158 aa, Lactobacillus casei
MDIYMPYILAAFLWVATTIYSRIIKGRFRKNLEKRLKMSRSEIMRREAIDRKFIDNAIGKIFNRILAGVTISYIFIFSFSLGAITVLPASTKDAYLIVSIFLLLFAIYTSATSFFLQRVGKTNKNKLPEVSFVKRLAGVVIRDFGSFLIFLIFEMNSF

SEQ ID NO: 6026 - protein, 457 aa, Lactobacillus casei
MKYPNEDSGVADYTVIKGLVTSNGDTGRDSIALDTATQLTATDVQHFRDYGFSIVGRYLTGTVGADFKPKNLTSTEVKTILDGGLKFFPIYEDGGYVESYFTAAEGQKDGQTAISTALSLGLPADTVIYFAVDVDFQEGDIDGTVIPYINAVQNVLNRSIYKAGIYGTRNVCLHAEKTGINYSFVANMSYGWSGNLGFKMPDNWAFDQFVEYPIYGIDIDQDASSGRDQGVSAVTEATPATQKAYVANRLLSIFPDYHNLFGTINWTVSSPTQHITTPLADYYVTLEDKWSATVVDNKTGVLTIQDAKIINESTDILEQFESAMSSYNVGDLAGTFNKLAPMIGNGAIKAGLAIRDGMVGFKVAIESSVENTSTSSSVENQFTLTLETYIHKDQVPQNDYDPVYQPVTEPNPTFAVDLEKVATIVVVGLIVTSTLPESGAVTALGGLFNAVRVLLFT

SEQ ID NO: 6027 - protein, 497 aa, Lactobacillus casei
MTKKNSVFALSIFIIGVFMSALDNGIISSALSTINYSFHVNEVQGTWAITLYTLGMAIATPIIGKLADKFGRRKLFLIEILIFAIGSLLVALSPSFIFFLGARLVQSIGGGGIFIIASSHILATYPKPQQGALLGALGAVNGIASVVGPNLGSLILNITGQWHWLFLINLPIAVFILISGFIAIPETKAAAIKGLDLKGLVFLTLGIFSMMLAITNLSSDQLLASVLTPQVWGLFLLSLAFFFGFTRIEKGIRGNVDPFLPYKLIKSPGFLLTLFMGLLSGALIAVFVFIPSFVEQRYGISANNSGVWMSGIGLGSIVGAGVGGMLVGKLGAIKSIIVSGTLSTIGFAMVAFLSPTTLWFIIASTVAGIGFGMLMGAPFSVLMSEIASQKDNGVALGTLSVSRQIGLTIAPTIYATLIQTGFSKLALKGGTASIESFYRGLQGLAASTHKNQLLQNFYAIAQQAYQNMFFLSVAASAIILLGGLYLQARHRKLDEIA

SEQ ID NO: 6028 - protein, 89 aa, Lactobacillus casei
MSTKQHQSQTLGSFTVKRTGNLLSLPIPAEAGVTEGQEYLLFVTEDGTLRYEPQRMNPWHTETIRKINFAAMKKNIGIASEEPSRGKEI

SEQ ID NO: 6029 - protein, 255 aa, Lactobacillus casei
MIHVLVAGFRGAMGQKTVKMIQSHSDFALSAVFDPKITINNPQNYGLPAEVKVLNRYDQLNASVADVWVDFTNPGAVAANTEAAINAGIHPVIGTSGMAPADQDRLIKLAKAKHLGGLIAPNFGLSAVLLMKFAQEAAAYFPDAEIIEMHHQDKADAPSGTAIATAHKIAAGRTQKPLSTIDNDARGQRIDDVPVHAVRLPGYIAHEEVLFGGPGEALTIRQDSFDRQSFMQGVAVAIRKVQEADQLVVGLENFL

SEQ ID NO: 6030 - protein, 301 aa, Lactobacillus casei
MQKAELITAIVTPFNDRDEIDYAVMQRLVDHLIAEGTDGFVVGATTGEGPTLSHDEKITLYTRFVDMVHGRALVTANSGSNNTRETVDFTHEVGGIAGIDATLVVVPYYNKPDQNGMIAHYTAVAANAQKPIIIYNIPGRTGVEMLPETVATLAQNPMIQGIKQCGSLAALSDIIDRTKHDAFSVWTGEDAQALTIKTLGGMGVISVASHLYAHSIREMYAALDRGDITTVAALQRQLLPKMAALFHFPSPAPTKAALNALGFNVGSPRLPILPLTAKQQQELAHLLGVPELSAIEAEVLA

SEQ ID NO: 6031 - protein, 378 aa, Lactobacillus casei
LIAIRRQLHQIPELALQEKETHAFLLKTVQSFPQTHLTIRTLPKLPTALLVKVHGQNPQRTIGYRTDIDALPVTEQTGLPFSSQHPGIAHACGHDIHMTVALGILDYFAHHQPKDNLIFFFQPAEESKNGGKLAYDMGTFTGDWHIDEFYGLHDRPDLPAGTISTRLGTLFAGTTEINVDLIGKSGHAALPQNANDMIVTAASFINQIQTVVARNVSPTDSAVITFGLMRAGTIRNVIAGRAHLEGTLRGFTQKQIDFLQQRIRDIGRGIAASFNCNVNVDLNQGGYYPVENNPQLTKDFIQYMQSDPAVTFAPTGPVMTGEDFGYLLNKIPGTMFWLGVNDPDSQLHAADFSPDEAALAPGVTAVVHFLEHRMAENN

SEQ ID NO: 6032 - protein, 234 aa, Lactobacillus casei
MAQLDTQKIISTIANSQKTTPVKVYLKGELADLHFPKSVHAFVGEHTGTVIGDWAIIQPILKKAKLDDYYVEAAGRNTGVPLLDIKAENARIEPGAIIRDQVLIGNNAVIMMGAIINIGAEIGDGTMIDMGAVLGGRAIVGKHCHIGAGTVLAGVVEPPSAKPVTIGDHVMIGANAVVLEGVSVGEGAVIAAGAVVINDVPAHTVVAGVPAKVIKQVNDQTEAKTVLLDELRKL

SEQ ID NO: 6033 - protein, 449 aa, Lactobacillus casei
MNFATNQEGQLTIGGVAASQLAHTFQTPLYVYDVEAIRHQIRAFKQVFEAANVRYAVSYASKAFATIAMYDIAKAEDIHVDVVSGGELYTAKAADFPMAKVSFHGNNKSKAELQQALDAGVGTIIVDNFHELDLLDELLNAAVGQQDVLIRVAPGISAHTHAYDQTGQTDSKFGFDLESGQADEAAKQILADEHLNLLGIHAHIGSQIFEVAGFEAVTQKLLAVLDNWHRQFGFTPQVLNVGGGFGIAYTSQDDPLPPEAFVKAILSTLKTQSSQLDWQLPAVWIEPGRSIVGPAGYSLYTVGSRKDVPGLRPYVAVDGGMGDNIRPALYQAQYTAVVADHPTAKPTEHVHLVGKYCESGDILIDDAPLPATQPGDVVAVFDTGAYGYSMASNYNRNPRPAVVFVENGQAQLVVTRETYADLIQHDHHYAAPSSSAPATTANNATTATK

SEQ ID NO: 6034 - protein, 459 aa, Lactobacillus casei
VRVVKFGGSSLANGSQFAKVVAIMKANPARQVMVTSAPGKRHPGDVKVTDLLIQYAQAVLRHENATAVVTEIVARYHAIADDFGLDPQVMQQIRKELYQLPKKAFANRDYLLAGFKARGEKLNAFLMTAVLNHEGIEATYGEPKDLGIVVTDDPNDAEVSRETYTHLETFSRPLGVLVVPGFYGYTSKGAVATFSRGGSDITGAILANGFHADLYENFTDVDGVAAADPRVVANPQMIQEMTYREMRELSYGGFGVFHDEAILPAIAGQIPINLKNTNHPDAPGTMIVPEQHFVPKHAITGIVSSQHFGAIYLHRYLLNKEVGFTLKLLQVLERHGISYEHMPSGIDDLTIILDDRQLNEAKRKAVCDEIQAAVHPDVLKWIDDYAIIMVVGEGMAQRTGLIQTILQPLASAGVHVSMINEGASQISLMLGTSRESANRAVKAIYNAFFIPINQRLEVH

SEQ ID NO: 6035 - protein, 335 aa, Lactobacillus casei
MVTLQKVHGSENSFFLLDETQLTQPLTKTQLATLTQRLTDSQTGLLGGADGVLAITDAPGTAGEMTVVNTDGSFAKLCGNGLRTVARYLSEKTGQTSFRVHTDFADLAVAKQKPLATGVPAYSVEISPVSFVPQALPFANLGTDRIVDTVLPAIHPHLKFTAVAVPNPHLIAFVSKDELAGPDLERIGKQLNGENPYFPEGVNVTFAEILGQDTLFARTYERGVGFTNACGTGMSATTLAFILTHPNQAALDRVNTVYSPGGMVKTVVHRDHDHYWIELIGNATVTATITLPETALIDGDLQQAVIAPTSEQAAYERFVAALPHRALADTLTEGV

SEQ ID NO: 6036 - protein, 352 aa, Lactobacillus casei
MSGYHVAVVGATGAVGTRMLKMVAESKLPIASVLALASKHSEGKKVPFRDGTLTVHETTDDSFKGIDIALFSAGGSVSKRFAPAAVKAGAVVVDNTSAFRMEPDIPLVVPEVNPEALRHHQGIIANPNCSTIQMVTALEPIRKAFGLKQVVVSTYQAVSGAGQSAMNELFDETRAALDDQPLEPKILPTAGDKKHYPIAFNALPQIDVFEPDGYSHEEWKMIHETKKIMAGDMNSDAIKVTATCVRIPVPIAHSEEVYFEVEDSNATADAIRAKLAAAPGVVVQDDPSQQLYPQARNAVGSKEVFVGRIRADAENPRFFHMWDVSDNLLKGAAWNSMQIAETMDAMGLIQPK

SEQ ID NO: 6037 - protein, 87 aa, Lactobacillus casei
MVNVKLRGIAEGRLGKGSILSSGSTVSEIVKDVAFKDDDLKHNLFDERTNKPRLLCRVLINGKLATVDQPVNPNDEVMLASVMTCDG

SEQ ID NO: 6038 - protein, 246 aa, Lactobacillus casei
MEFNNSRYNRQLLMPQVGEHGQQLINNFSVVSVGAGGVKSPLLYYLAAAGIGKIKIIDFDRVELSNLNRQILYTTEDIGEYKAVAAAKKLRLLNSDIEIEYSVEKVTPDNIDDLLGGFDVILEGGDGPEQRLMVNQYAVDYKVPMVHVSAQYGYGYAFTRLTDDDPCLQCAFPDLPESRKGPVAVWGIGTGIAGIMGANEVLKIALKEGELARGYLMSCSNFQNDYYKLPIPKNPRCPACGKKTKA

SEQ ID NO: 6039 - protein, 120 aa, Lactobacillus casei
MISNLLNLFANADFITFIDIGFFKTLPDVTATPFNAVLYKKITSKKDREFVITVGINPQFIASNKKLNPAPRPYPMFVGNIILPIKTVASLLDKGEIIRLLVKEAADLSIIPNKDIYIKN

SEQ ID NO: 6040 - protein, 174 aa, Lactobacillus casei
VYVPLIVVMYFKNYSWLSPMAFIINTVVISLFQGKVNTWAAENRRYDRLWVISGAIIAASFLVTSVTTVMHIDTLIFMALLMLIVSQVLAELFSSAALAMYMVIYSRSESLTTDLSAINLGGQLQNILGPTMFGSAAVSSNGLISFLMFTLTAAVSAHAYMYRGLNKEELKDEL

SEQ ID NO: 6041 - protein, 223 aa, Lactobacillus casei
MNFDGEDKRWDEYYKREWNDKRKPLPIEKIIKKAVPKQNAGLYVGLGTGRNVFPLLKEGWNVYACDIAHTSIKNAKENYPQYATHFDYGSYTEAFPHIKAFDYTICSEVLVNGNFPNVVERFRLLKDRLTKEGFLIFELPAIGTDIWPNWKSLSMSKNGSLKLKYRADVPNKLYLSFQDICHLLENAGFKIVYGPKPVNSERSRYPGGLIRDWLGIAQNVSLT

SEQ ID NO: 6042 - protein, 225 aa, Lactobacillus casei
MIEVKGLTKKFAQRMIFENVNCQLVQGKSYAIIGKSGTGKTTFLNILGGLETTTAGTVMVDDQPVSTKNLPQLRRDKFGFIFQNFGLVDKETVAYNLKIGLANQRLPRQEQTIAMKEVLQQLGLANVGLKQRIFTLSGGEQQRLALARLLLKKPTIIFADEPTGSLDAANADEVTQHLLHDFGDQATIIVATHTAEVWRHCDYLIRVENCRITITENIAKGEKLA

SEQ ID NO: 6043 - protein, 116 aa, Lactobacillus casei
MKKAKILDSTLAALVMVAVAGILLIHNQWTDLINPFVPEQTSYAKVPQGKQRYRNVELYTATQTKPTLVLKEMTGYDPDGKYVAVRHKGQYVKRVTYVSKEAFIKKLRQSSKSGTK

SEQ ID NO: 6044 - protein, 43 aa, Lactobacillus casei
MISESVNEKKVKLAISVFTLEVIITAVFFFLLYRHFKSHPPFI

SEQ ID NO: 6045 - protein, 70 aa, Lactobacillus casei
MAVIGTILIVLLAVLALVIVLALIVAGIQTLLSLWPSTKMKRLPYHVRAGTMLASLFNVLYKVVTLGSVI

SEQ ID NO: 6046 - protein, 95 aa, Lactobacillus casei
MTPRTLKIEDLIAKYSVHPEAKAQFDQGKARLMTAYQFMKAREAAGLSQRDLAVAAGVPQRTIARVELGDSTSLDTLHKIAMALGKTLDVTLVDD

SEQ ID NO: 6047 - protein, 152 aa, Lactobacillus casei
  misc_feature (4)..(4): Xaa can be any naturally occurring amino acid
NDIXDMAINPRTEINMVEVHFETVPQRPDSVLVVQFFNGGIIWVHNSKRQWELTGGKLEAGETLAQAAVRESFEESGAVIKPSSIVPLGYYVLPTGHVTAVVRAEVDRLEAIPASSETDDRKLSLEPLPDADRSFHDDVYCQIFRHIGWPDE

SEQ ID NO: 6048 - protein, 271 aa, Lactobacillus casei
MALTPVMNKWSMITLSPLAASFYNALISLVLTLITIAMTKTKMVWIKQPVVWILGLTNCLGIFLQYLSLFFLDPVSVGLIGRFYIVFAILLSVLMLHEKFDRRELVPILLCIAGTALVSDFSGNVNNIIGLVCAFGYTFSFALTNTLAKKALTQVDEKILLLYDQGTAVVILGLILAGSGKLSFSPNMGMGAVAISAFCSGFLGLLLFYRGLKFISFRDANLIRALNPIFVLIYSLPFFTIQITPAFLLGGVLIVLSIVWMSLPVKKSQID

SEQ ID NO: 6049 - protein, 59 aa, Lactobacillus casei
MKIDDLLKKEMQNPEFASAYTLDKERSAAALALYHAREAAGLTQADLTCRCTTDNDCSN

SEQ ID NO: 6050 - protein, 542 aa, Lactobacillus casei
MNAVVWQTLKKHRAAFIILVIFTMLSTSLITGNTYLEGKLLDSLVYSRDPRLFVLFFGLMLGFGILRLGISFFTSHIQILTKQKTVLELNRKIIFRLFTKNTLGILKWSPTTLSARINDDVTEIVSFFSDTVVRLCSVIVSTLTITAYVLSANAEIFTIMVVFLPVYFLIYVVFHRKIYRVSLEIKGKQNDYYSARNDFIGRYVEIKGAENLPSEIARLDQVGHNLFKTFTKSFWIHYWMSTWQIVMQLAFQTLFFVIGGLAVLRGSITIGFFAIILQYFGQLLNSVDQIFGIAIGAEAYRASLARMEQILDMADDQTGMQDVARIHRIDVDAFNIKRFEKKSDVQELFYSRDLSCSFKTPGLYVISGDNGVGKSTFVRTMTGIYQPELKGNISINGIKMKQIDMRTLRKKEIGFSFQDVPSPHVTVREYLAGMTQNDPLSMVKRSPLFAKVYDSDVFNLRNIYDEKVDVLSSGELQLVRLLAAFGKENASMYILDEPTANIYPEIRAAVIGLLKELAKSKLVIAITHDDHLLHIGTPVVMQ

SEQ ID NO: 6051 - protein, 57 aa, Lactobacillus casei
MAKTQPFRLEATYTPISKRSCSRFETRSLAQKSACKDLGRNGLSPGHRAQGHLHSDF
